United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 21

SEQ ID NO: 904953 - RNA, 22 nt, Human
gagcuucaaauggacgaccuuu

SEQ ID NO: 904954 - RNA, 18 nt, Human
uccaaaaucauguauuuu

SEQ ID NO: 904955 - RNA, 22 nt, Human
ccugaguugucaguugcuguag

SEQ ID NO: 904956 - RNA, 22 nt, Human
ugcuuugcagugucuaacagaa

SEQ ID NO: 904957 - RNA, 22 nt, Human
caugacacccaggcauagcacc

SEQ ID NO: 904958 - RNA, 20 nt, Human
ugcccuguggaggggaaagg

SEQ ID NO: 904959 - RNA, 17 nt, Human
ucauuucaguaaaucca

SEQ ID NO: 904960 - RNA, 23 nt, Human
aggaaguuaaggcagacagacag

SEQ ID NO: 904961 - RNA, 22 nt, Human
ccauggcuaaguaucuguagaa

SEQ ID NO: 904962 - RNA, 22 nt, Human
augccuccucaaaucugccaca

SEQ ID NO: 904963 - RNA, 22 nt, Human
cccauuuguauagagccuuaua

SEQ ID NO: 904964 - RNA, 22 nt, Human
acuuuaauuaaugaacuguggc

SEQ ID NO: 904965 - RNA, 23 nt, Human
cuguuauuccaggcugaugggug

SEQ ID NO: 904966 - RNA, 22 nt, Human
cacaggagcuguggggcagugu

SEQ ID NO: 904967 - RNA, 17 nt, Human
ucccaggaacagggaau

SEQ ID NO: 904968 - RNA, 22 nt, Human
uacucaugacugaugaauaccu

SEQ ID NO: 904969 - RNA, 22 nt, Human
guguggcuaggauggcuuugcu

SEQ ID NO: 904970 - RNA, 22 nt, Human
guucuucagcauuagaagucau

SEQ ID NO: 904971 - RNA, 22 nt, Human
uggcuccuaggauggugccugg

SEQ ID NO: 904972 - RNA, 22 nt, Human
uacaugugguagggagggcagu

SEQ ID NO: 904973 - RNA, 22 nt, Human
ggguugaggcggaugucggcgg

SEQ ID NO: 904974 - RNA, 22 nt, Human
caccaggggcagagaccaaagu

SEQ ID NO: 904975 - RNA, 19 nt, Human
uguugccagguaucauguu

SEQ ID NO: 904976 - RNA, 22 nt, Human
cgacgggcucgguccgcuuccu

SEQ ID NO: 904977 - RNA, 22 nt, Human
aagggcuggaucucucugagca

SEQ ID NO: 904978 - RNA, 22 nt, Human
acaguaaaaagccuuagaauuu

SEQ ID NO: 904979 - RNA, 22 nt, Human
ugaaaugagcauuuauucuuua

SEQ ID NO: 904980 - RNA, 18 nt, Human
aaauggcacacagaccug

SEQ ID NO: 904981 - RNA, 21 nt, Human
acaaugcauggaacucauggc

SEQ ID NO: 904982 - RNA, 20 nt, Human
aaugaaugaacgaauggaug

SEQ ID NO: 904983 - RNA, 22 nt, Human
ggagcugcuccuucagccaagu

SEQ ID NO: 904984 - RNA, 22 nt, Human
gcaagaacugcaauuacuuuug

SEQ ID NO: 904985 - RNA, 22 nt, Human
agacaaaccuuguuuuaugaug

SEQ ID NO: 904986 - RNA, 22 nt, Human
augacuucaccucugugaagca

SEQ ID NO: 904987 - RNA, 22 nt, Human
acauuucucauucuccccuaac

SEQ ID NO: 904988 - RNA, 22 nt, Human
uauuucagggagaauaaauuug

SEQ ID NO: 904989 - RNA, 22 nt, Human
auguucccagcacugaguaaca

SEQ ID NO: 904990 - RNA, 22 nt, Human
gugaaggcuugacgucaucagg

SEQ ID NO: 904991 - RNA, 22 nt, Human
acccaggcuagagugcaguggu

SEQ ID NO: 904992 - RNA, 21 nt, Human
gacuuuaauuugagagcaaaa

SEQ ID NO: 904993 - RNA, 22 nt, Human
aguguuucacagcacuuuuucu

SEQ ID NO: 904994 - RNA, 22 nt, Human
agcugccuguguagaaccaucu

SEQ ID NO: 904995 - RNA, 22 nt, Human
auaggcuugagcuaagagagaa

SEQ ID NO: 904996 - RNA, 22 nt, Human
auugggaagauuuagauccacu

SEQ ID NO: 904997 - RNA, 22 nt, Human
cauugaaagagauaaagccuuu

SEQ ID NO: 904998 - RNA, 22 nt, Human
uguuuucaucacagaauguaac

SEQ ID NO: 904999 - RNA, 22 nt, Human
cauucauaaguuuuugugcugg

SEQ ID NO: 905000 - RNA, 22 nt, Human
gcucugggaacugacugccuuc

SEQ ID NO: 905001 - RNA, 22 nt, Human
aaguuucaaauauaaaauuaca

SEQ ID NO: 905002 - RNA, 22 nt, Human
cagcaugaugcucacacaaaac

SEQ ID NO: 905003 - RNA, 22 nt, Human
uaggccaggacagagcuuccag

SEQ ID NO: 905004 - RNA, 21 nt, Human
ugggacagugauggcuccucc

SEQ ID NO: 905005 - RNA, 22 nt, Human
aagcugcacuacuugagggacc

SEQ ID NO: 905006 - RNA, 22 nt, Human
acguugaaugguuaauuuguau

SEQ ID NO: 905007 - RNA, 22 nt, Human
ucacagaauagcacuguaagcg

SEQ ID NO: 905008 - RNA, 22 nt, Human
acgggccuucucuucaggcgag

SEQ ID NO: 905009 - RNA, 22 nt, Human
agaaaucaauaucuauauguug

SEQ ID NO: 905010 - RNA, 22 nt, Human
ggacagcguggcugguggaggg

SEQ ID NO: 905011 - RNA, 22 nt, Human
aaguguuucaauaauuuggacc

SEQ ID NO: 905012 - RNA, 22 nt, Human
cuggcuccaccccaggaggaug

SEQ ID NO: 905013 - RNA, 22 nt, Human
ggaggugggagacauaggcggc

SEQ ID NO: 905014 - RNA, 22 nt, Human
gaaguucaaaagacagauuuga

SEQ ID NO: 905015 - RNA, 22 nt, Human
gcaauaaacucucucaagccac

SEQ ID NO: 905016 - RNA, 22 nt, Human
aaaguacuuggauuacaggcau

SEQ ID NO: 905017 - RNA, 22 nt, Human
acaggggaccuaggacccucgg

SEQ ID NO: 905018 - RNA, 22 nt, Human
gggcacugugcuaggugcugag

SEQ ID NO: 905019 - RNA, 22 nt, Human
uuucaguuuaaguaacugcuau

SEQ ID NO: 905020 - RNA, 22 nt, Human
gagcagagaauccagcuaagug

SEQ ID NO: 905021 - RNA, 22 nt, Human
ccagagggcuugguuugggcca

SEQ ID NO: 905022 - RNA, 22 nt, Human
ucuuaacagugcuacagagcag

SEQ ID NO: 905023 - RNA, 22 nt, Human
uuuaauuaggaaaugggcaggg

SEQ ID NO: 905024 - RNA, 22 nt, Human
uaacaggcugaucauauauccu

SEQ ID NO: 905025 - RNA, 22 nt, Human
cauaugaaguucaacagagaug

SEQ ID NO: 905026 - RNA, 22 nt, Human
ucuacuauguuucuuaaauaga

SEQ ID NO: 905027 - RNA, 22 nt, Human
cucuuuguagccuuugcauauu

SEQ ID NO: 905028 - RNA, 22 nt, Human
agucuuaguaugguuuuagguu

SEQ ID NO: 905029 - RNA, 22 nt, Human
auuguuaauaacuauuacauug

SEQ ID NO: 905030 - RNA, 18 nt, Human
aacuaaagaucuuuaagc

SEQ ID NO: 905031 - RNA, 22 nt, Human
uguaaaagacauuucuaagcaa

SEQ ID NO: 905032 - RNA, 22 nt, Human
uucucuaaagaguuaggccaag

SEQ ID NO: 905033 - RNA, 22 nt, Human
acauugaauuucacuuuuguac

SEQ ID NO: 905034 - RNA, 21 nt, Human
caugcagauucuggagccaga

SEQ ID NO: 905035 - RNA, 22 nt, Human
uuuuaaguuaauauaauugagg

SEQ ID NO: 905036 - RNA, 22 nt, Human
caaggcagcuauugucuccaua

SEQ ID NO: 905037 - RNA, 22 nt, Human
ucugaggcccugcaggcagugu

SEQ ID NO: 905038 - RNA, 22 nt, Human
uuacagaagaguaacuuggcaa

SEQ ID NO: 905039 - RNA, 22 nt, Human
agcaggcaggaaggcagcacug

SEQ ID NO: 905040 - RNA, 22 nt, Human
gggcagcugccccucucugggc

SEQ ID NO: 905041 - RNA, 22 nt, Human
gagaggcucugaggacuggggu

SEQ ID NO: 905042 - RNA, 22 nt, Human
uugaagcaaauucugugcagua

SEQ ID NO: 905043 - RNA, 22 nt, Human
aagcacagcuggaacagcagga

SEQ ID NO: 905044 - RNA, 22 nt, Human
gggcugagccauuugaaccuug

SEQ ID NO: 905045 - RNA, 22 nt, Human
uggcuuuaaaaugguuugguau

SEQ ID NO: 905046 - RNA, 22 nt, Human
uagguuccauuuaaacaaagaa

SEQ ID NO: 905047 - RNA, 18 nt, Human
cuagagaagguuacuaug

SEQ ID NO: 905048 - RNA, 22 nt, Human
guuggcacuuagccccagucua

SEQ ID NO: 905049 - RNA, 22 nt, Human
cugaggcaggggcagcuggaga

SEQ ID NO: 905050 - RNA, 22 nt, Human
augucacagcucccauuccucc

SEQ ID NO: 905051 - RNA, 18 nt, Human
uggcuggcucugucaucu

SEQ ID NO: 905052 - RNA, 20 nt, Human
agcugccuucauuuucuaga

SEQ ID NO: 905053 - RNA, 22 nt, Human
uacuaaacaucuggcauuaaau

SEQ ID NO: 905054 - RNA, 22 nt, Human
agaacagcaacaucagacaaag

SEQ ID NO: 905055 - RNA, 22 nt, Human
gcugggcucuuaucaccuguac

SEQ ID NO: 905056 - RNA, 22 nt, Human
cagaggcucuuccucacugccc

SEQ ID NO: 905057 - RNA, 22 nt, Human
ggggugugaguagagcugggga

SEQ ID NO: 905058 - RNA, 22 nt, Human
uagaaucuuuaaaauucauagu

SEQ ID NO: 905059 - RNA, 20 nt, Human
aacacugaggccuacucuuc

SEQ ID NO: 905060 - RNA, 22 nt, Human
uugacagaauguuacauauaga

SEQ ID NO: 905061 - RNA, 22 nt, Human
ggcaggugaguucauuaucugc

SEQ ID NO: 905062 - RNA, 22 nt, Human
uuauuugugaaucauuuaucua

SEQ ID NO: 905063 - RNA, 22 nt, Human
uggcucagcaagacauugaccu

SEQ ID NO: 905064 - RNA, 22 nt, Human
uggaaggcaggaccugccuugg

SEQ ID NO: 905065 - RNA, 22 nt, Human
cagccuucgacaguuggaguag

SEQ ID NO: 905066 - RNA, 23 nt, Human
gccuggccaccccagggcugcuu

SEQ ID NO: 905067 - RNA, 20 nt, Human
uccaguggccugaaucugga

SEQ ID NO: 905068 - RNA, 22 nt, Human
ccauuuugucugacuucuugcu

SEQ ID NO: 905069 - RNA, 22 nt, Human
agauguggccggcuagggagag

SEQ ID NO: 905070 - RNA, 22 nt, Human
ugucccaguuuaucugggacug

SEQ ID NO: 905071 - RNA, 22 nt, Human
acauuccugaaugggcacauuu

SEQ ID NO: 905072 - RNA, 23 nt, Human
gggaagugaggagccccucagcc

SEQ ID NO: 905073 - RNA, 17 nt, Human
aggugcuggagcaucag

SEQ ID NO: 905074 - RNA, 22 nt, Human
gggcagguggccucuuguacua

SEQ ID NO: 905075 - RNA, 22 nt, Human
uaaaugcuccauacauacacca

SEQ ID NO: 905076 - RNA, 22 nt, Human
agcugcuccuuuccugcaggcg

SEQ ID NO: 905077 - RNA, 22 nt, Human
ccagcauuugcuucuggugggg

SEQ ID NO: 905078 - RNA, 22 nt, Human
uccugaggcccuguuagggucu

SEQ ID NO: 905079 - RNA, 22 nt, Human
aggacccugaggucuccuguga

SEQ ID NO: 905080 - RNA, 19 nt, Human
ggcagcucuugucuucugc

SEQ ID NO: 905081 - RNA, 22 nt, Human
uggcccugcugggucagagcug

SEQ ID NO: 905082 - RNA, 22 nt, Human
cauuucaguguuauucuaauuu

SEQ ID NO: 905083 - RNA, 22 nt, Human
agaggccugugugcuccagugg

SEQ ID NO: 905084 - RNA, 21 nt, Human
ccuccugcccgcaagcuaggg

SEQ ID NO: 905085 - RNA, 22 nt, Human
ugagguaggaauuuguauuggg

SEQ ID NO: 905086 - RNA, 22 nt, Human
gacagcugaacaggugggauaa

SEQ ID NO: 905087 - RNA, 22 nt, Human
agagguagaaaauaauggagag

SEQ ID NO: 905088 - RNA, 22 nt, Human
cccagcugaacuugcauuccaa

SEQ ID NO: 905089 - RNA, 22 nt, Human
gugucugaguuuggaaagucca

SEQ ID NO: 905090 - RNA, 22 nt, Human
cugguaggggugacuguuaucg

SEQ ID NO: 905091 - RNA, 22 nt, Human
gcaaacuggcaaaccugucugu

SEQ ID NO: 905092 - RNA, 22 nt, Human
ugaggccaggacccccagcagg

SEQ ID NO: 905093 - RNA, 22 nt, Human
gucuuuggauguaagauaaagu

SEQ ID NO: 905094 - RNA, 22 nt, Human
uaaguucauuagacuacagaua

SEQ ID NO: 905095 - RNA, 22 nt, Human
ucaggaguuuggccuacagagg

SEQ ID NO: 905096 - RNA, 22 nt, Human
accaugaguuauuugacaggcc

SEQ ID NO: 905097 - RNA, 22 nt, Human
cuccugugguacucccagggcc

SEQ ID NO: 905098 - RNA, 22 nt, Human
agggggugaaugucugucuaca

SEQ ID NO: 905099 - RNA, 22 nt, Human
aggagaggguggcauuaaguuu

SEQ ID NO: 905100 - RNA, 22 nt, Human
uagaggaaccaggcaggcugag

SEQ ID NO: 905101 - RNA, 22 nt, Human
agccagagacuuuaccugugca

SEQ ID NO: 905102 - RNA, 19 nt, Human
agcuaacucacuaacuaug

SEQ ID NO: 905103 - RNA, 22 nt, Human
acugagacugaaucugaaugau

SEQ ID NO: 905104 - RNA, 20 nt, Human
gagggcucguggauggauaa

SEQ ID NO: 905105 - RNA, 22 nt, Human
aaaauauuuuagggccaggaga

SEQ ID NO: 905106 - RNA, 22 nt, Human
aaaaaucuaugacugcuucucc

SEQ ID NO: 905107 - RNA, 22 nt, Human
auugagaaggagauuggcaucu

SEQ ID NO: 905108 - RNA, 23 nt, Human
aggccagcgcagacaccgagcac

SEQ ID NO: 905109 - RNA, 22 nt, Human
guuuagaauggcaaaauuaagu

SEQ ID NO: 905110 - RNA, 22 nt, Human
agcuggccagcaccuccagguc

SEQ ID NO: 905111 - RNA, 22 nt, Human
ugaguaaaaauucuacauuucc

SEQ ID NO: 905112 - RNA, 22 nt, Human
ucuuauaaaaggacucccauuu

SEQ ID NO: 905113 - RNA, 22 nt, Human
gccaguggucagugggagggug

SEQ ID NO: 905114 - RNA, 22 nt, Human
ucugcugcacaaauucaucucu

SEQ ID NO: 905115 - RNA, 17 nt, Human
agaaaagagaccagcag

SEQ ID NO: 905116 - RNA, 22 nt, Human
uucuuuaaaugaauucucugua

SEQ ID NO: 905117 - RNA, 22 nt, Human
aguugcacuuucuagauacugu

SEQ ID NO: 905118 - RNA, 22 nt, Human
ccuuuucccauguuucuggagc

SEQ ID NO: 905119 - RNA, 22 nt, Human
agaauccucuucaguaaauucu

SEQ ID NO: 905120 - RNA, 17 nt, Human
caggucccagggucucu

SEQ ID NO: 905121 - RNA, 22 nt, Human
aacaguuaaugaagaggaagcc

SEQ ID NO: 905122 - RNA, 22 nt, Human
gggugaagcuccugcaggggcc

SEQ ID NO: 905123 - RNA, 22 nt, Human
acugcacaccuccagggcacua

SEQ ID NO: 905124 - RNA, 22 nt, Human
ugugugaacucucugauguaca

SEQ ID NO: 905125 - RNA, 22 nt, Human
uccaggcuagaagucacaggcc

SEQ ID NO: 905126 - RNA, 22 nt, Human
cuacccaggcuggagugcagua

SEQ ID NO: 905127 - RNA, 22 nt, Human
cccagagagcacaggugguggg

SEQ ID NO: 905128 - RNA, 22 nt, Human
ugcccacaggaagacaccagcg

SEQ ID NO: 905129 - RNA, 22 nt, Human
cuuugacauccuuguuccucag

SEQ ID NO: 905130 - RNA, 22 nt, Human
ugagagcugcugagacuguccu

SEQ ID NO: 905131 - RNA, 22 nt, Human
gguucuaggucuggggauaaug

SEQ ID NO: 905132 - RNA, 22 nt, Human
cuggaugcuuccucucugcuag

SEQ ID NO: 905133 - RNA, 22 nt, Human
uggcuucucccuacaacaugcc

SEQ ID NO: 905134 - RNA, 22 nt, Human
agcaauuauggaguuguugacg

SEQ ID NO: 905135 - RNA, 22 nt, Human
augucuguuuucauaucagaua

SEQ ID NO: 905136 - RNA, 22 nt, Human
cuagaacaaauuaggaggcaua

SEQ ID NO: 905137 - RNA, 22 nt, Human
uuagcaguuuccauuuugguca

SEQ ID NO: 905138 - RNA, 22 nt, Human
aagauuucugcuccugagagaa

SEQ ID NO: 905139 - RNA, 22 nt, Human
ugagaagcccacacucuuuccu

SEQ ID NO: 905140 - RNA, 17 nt, Human
gcuccugcaggucagga

SEQ ID NO: 905141 - RNA, 22 nt, Human
ugccucccucucugccacugga

SEQ ID NO: 905142 - RNA, 22 nt, Human
cacaguguuccagagcaguggu

SEQ ID NO: 905143 - RNA, 22 nt, Human
ucaggccacggcucacugagac

SEQ ID NO: 905144 - RNA, 17 nt, Human
aggcauggucuggggug

SEQ ID NO: 905145 - RNA, 22 nt, Human
aggcuggagugcaauggcguga

SEQ ID NO: 905146 - RNA, 22 nt, Human
aagcuguucugaaucaguaagu

SEQ ID NO: 905147 - RNA, 22 nt, Human
cucuguguuccggguugcugcu

SEQ ID NO: 905148 - RNA, 22 nt, Human
auggcaagcaagcugaagagau

SEQ ID NO: 905149 - RNA, 22 nt, Human
uacauacacaaaugcugaaugg

SEQ ID NO: 905150 - RNA, 22 nt, Human
uucaugagcagaagggaggggu

SEQ ID NO: 905151 - RNA, 20 nt, Human
aauuauauaacuccaacauu

SEQ ID NO: 905152 - RNA, 22 nt, Human
aguaguggcuuccuggagugcu

SEQ ID NO: 905153 - RNA, 22 nt, Human
agcuggcuucacaggcagugug

SEQ ID NO: 905154 - RNA, 22 nt, Human
ugaagauuuccaccaaaucaca

SEQ ID NO: 905155 - RNA, 22 nt, Human
agaguuauggacuuaaugcagg

SEQ ID NO: 905156 - RNA, 22 nt, Human
acaaauuuauugaagggcauau

SEQ ID NO: 905157 - RNA, 22 nt, Human
uaagcaaauaaugcaucaaggg

SEQ ID NO: 905158 - RNA, 22 nt, Human
gccuuccuuacaccugcucagc

SEQ ID NO: 905159 - RNA, 18 nt, Human
cuuugcaguuacagggca

SEQ ID NO: 905160 - RNA, 22 nt, Human
uuugacaaauauuuauuggcac

SEQ ID NO: 905161 - RNA, 22 nt, Human
guuuauaugugugccacucuua

SEQ ID NO: 905162 - RNA, 22 nt, Human
gagacacaauuuccccauccua

SEQ ID NO: 905163 - RNA, 22 nt, Human
gaaaaggcugcccacuuauuga

SEQ ID NO: 905164 - RNA, 22 nt, Human
cucccgugauccuggaggagag

SEQ ID NO: 905165 - RNA, 20 nt, Human
aaguaauauuuguguaacug

SEQ ID NO: 905166 - RNA, 22 nt, Human
gugcugaauccacucuuaggaa

SEQ ID NO: 905167 - RNA, 22 nt, Human
agagucugaaugcucagaguug

SEQ ID NO: 905168 - RNA, 22 nt, Human
uucauucugggcucuaaggaac

SEQ ID NO: 905169 - RNA, 23 nt, Human
caggaagcagaugggguagaaga

SEQ ID NO: 905170 - RNA, 22 nt, Human
ugcccuguuccugccuccagcu

SEQ ID NO: 905171 - RNA, 22 nt, Human
ccacugaggccugggcccaggg

SEQ ID NO: 905172 - RNA, 22 nt, Human
uggaggaauaacagcaaccuua

SEQ ID NO: 905173 - RNA, 22 nt, Human
ugccucugggugaccaaggagc

SEQ ID NO: 905174 - RNA, 22 nt, Human
cuugagaagagauuuauauuug

SEQ ID NO: 905175 - RNA, 22 nt, Human
cuaaagaucuacagaggcuuuu

SEQ ID NO: 905176 - RNA, 19 nt, Human
uucccagagccaugaguga

SEQ ID NO: 905177 - RNA, 16 nt, Human
gcaggcagaucacaug

SEQ ID NO: 905178 - RNA, 22 nt, Human
gcaugggcuuucucagaguucu

SEQ ID NO: 905179 - RNA, 23 nt, Human
cagacccucaauccacuuguuuu

SEQ ID NO: 905180 - RNA, 23 nt, Human
agggcuccuuguugauuagcauu

SEQ ID NO: 905181 - RNA, 22 nt, Human
ucauccaguaccauggaaggca

SEQ ID NO: 905182 - RNA, 22 nt, Human
caaaaguaauugugguuuuugc

SEQ ID NO: 905183 - RNA, 22 nt, Human
acauuguaagcauauuagcuga

SEQ ID NO: 905184 - RNA, 22 nt, Human
acacuucaccccugcucccagu

SEQ ID NO: 905185 - RNA, 22 nt, Human
gagaagcaaucgugacaucucc

SEQ ID NO: 905186 - RNA, 22 nt, Human
agaggugaaagaauuuggcucu

SEQ ID NO: 905187 - RNA, 22 nt, Human
caagguuuacuuuaugauccag

SEQ ID NO: 905188 - RNA, 22 nt, Human
uugugaaaucguguuuggaagc

SEQ ID NO: 905189 - RNA, 22 nt, Human
auguaaguauucaaaauauuuc

SEQ ID NO: 905190 - RNA, 22 nt, Human
gcugccuggagcucagccugcc

SEQ ID NO: 905191 - RNA, 22 nt, Human
ccaaacugugucgucugcauag

SEQ ID NO: 905192 - RNA, 22 nt, Human
uucauuguacuuuaagagaugc

SEQ ID NO: 905193 - RNA, 22 nt, Human
auaaucuggucuuuguaugagu

SEQ ID NO: 905194 - RNA, 22 nt, Human
aauagcauguaaguuuaaaaga

SEQ ID NO: 905195 - RNA, 22 nt, Human
aacuuuacuugaaagaacaugu

SEQ ID NO: 905196 - RNA, 22 nt, Human
caagucugaccucugggugaag

SEQ ID NO: 905197 - RNA, 18 nt, Human
cucaggccuuucccugug

SEQ ID NO: 905198 - RNA, 22 nt, Human
gggcuucuagaauuucugauau

SEQ ID NO: 905199 - RNA, 22 nt, Human
ccuccagggcagacggggagca

SEQ ID NO: 905200 - RNA, 22 nt, Human
uagagggccagcuggacagcga

SEQ ID NO: 905201 - RNA, 22 nt, Human
gcugagugagguccagagcuug

SEQ ID NO: 905202 - RNA, 22 nt, Human
gcugggaaccaugggaaggcag

SEQ ID NO: 905203 - RNA, 22 nt, Human
guccuuggcugggcuugccucg

SEQ ID NO: 905204 - RNA, 22 nt, Human
gauauuuaacucucacaggucc

SEQ ID NO: 905205 - RNA, 20 nt, Human
caucagugccugacaggucc

SEQ ID NO: 905206 - RNA, 20 nt, Human
cucaguguggccugaguguu

SEQ ID NO: 905207 - RNA, 23 nt, Human
ugcugguguuuuugggaccaggg

SEQ ID NO: 905208 - RNA, 22 nt, Human
cauuguccucugaugccuuccc

SEQ ID NO: 905209 - RNA, 22 nt, Human
aaaaguguccagauuaugaaga

SEQ ID NO: 905210 - RNA, 19 nt, Human
agaggcugucaccuguagc

SEQ ID NO: 905211 - RNA, 22 nt, Human
aucuccgccaucgcgaacgccu

SEQ ID NO: 905212 - RNA, 22 nt, Human
gagagcuggguucaaguagcug

SEQ ID NO: 905213 - RNA, 22 nt, Human
ggagcugaggaauagcuuugau

SEQ ID NO: 905214 - RNA, 22 nt, Human
aagaggggugugugucaaccca

SEQ ID NO: 905215 - RNA, 22 nt, Human
ccagaggcauguucaaagcaau

SEQ ID NO: 905216 - RNA, 22 nt, Human
ucagagcauucgggugacaaau

SEQ ID NO: 905217 - RNA, 22 nt, Human
cucuucuugucucugguuagaa

SEQ ID NO: 905218 - RNA, 18 nt, Human
aggaaagacgaagagggc

SEQ ID NO: 905219 - RNA, 22 nt, Human
acaguguuuaaaauaauaugcu

SEQ ID NO: 905220 - RNA, 19 nt, Human
ugaggagcagcugguugau

SEQ ID NO: 905221 - RNA, 22 nt, Human
gaauuucaaagagguuaagagg

SEQ ID NO: 905222 - RNA, 21 nt, Human
uucagcuuaugugucacuugc

SEQ ID NO: 905223 - RNA, 21 nt, Human
gggugggguuccagccuuuuc

SEQ ID NO: 905224 - RNA, 22 nt, Human
ugcagagguuugugguguugcu

SEQ ID NO: 905225 - RNA, 22 nt, Human
aagcacuuagaagagugccugc

SEQ ID NO: 905226 - RNA, 22 nt, Human
cuuuuaagggauaauaagaugu

SEQ ID NO: 905227 - RNA, 22 nt, Human
ucaggcagaauuaucaaaagau

SEQ ID NO: 905228 - RNA, 22 nt, Human
uggcaccaccagacaccaggag

SEQ ID NO: 905229 - RNA, 22 nt, Human
caguuucagaaucaaaacauca

SEQ ID NO: 905230 - RNA, 23 nt, Human
uaagugauuagaauuugcuguca

SEQ ID NO: 905231 - RNA, 22 nt, Human
guguguggaaaguuuuccaugg

SEQ ID NO: 905232 - RNA, 22 nt, Human
ugccauuucucaggcuauuuca

SEQ ID NO: 905233 - RNA, 22 nt, Human
uucaacaaauauuuauugagcu

SEQ ID NO: 905234 - RNA, 22 nt, Human
uguaagucuggcuuauagcuuu

SEQ ID NO: 905235 - RNA, 22 nt, Human
cccugcugccuucacccaggac

SEQ ID NO: 905236 - RNA, 22 nt, Human
gccugagcagcuauacacacag

SEQ ID NO: 905237 - RNA, 22 nt, Human
auucaacuguaaacuuguucac

SEQ ID NO: 905238 - RNA, 22 nt, Human
uuucagugcccagagcuuugca

SEQ ID NO: 905239 - RNA, 22 nt, Human
aaaauaguuaacguucagagua

SEQ ID NO: 905240 - RNA, 22 nt, Human
auugcuucccacaaagauguau

SEQ ID NO: 905241 - RNA, 22 nt, Human
aggaagcuuagauuuccagauc

SEQ ID NO: 905242 - RNA, 22 nt, Human
aauuaaaggucauguuaaaggg

SEQ ID NO: 905243 - RNA, 22 nt, Human
uaaaaggcaauacuagaugagu

SEQ ID NO: 905244 - RNA, 22 nt, Human
gugagucugccuagcacaucac

SEQ ID NO: 905245 - RNA, 22 nt, Human
gcuuuagauagauuuagucuuu

SEQ ID NO: 905246 - RNA, 21 nt, Human
ugucagaaauaagcaugugau

SEQ ID NO: 905247 - RNA, 22 nt, Human
guugaaaguagaugcuauuugg

SEQ ID NO: 905248 - RNA, 22 nt, Human
uuagaaccaggaacucuaauau

SEQ ID NO: 905249 - RNA, 22 nt, Human
auguuauuucaaaauucccuug

SEQ ID NO: 905250 - RNA, 22 nt, Human
aauguaugggugagaaaguuga

SEQ ID NO: 905251 - RNA, 20 nt, Human
agucugacauuuuucucuca

SEQ ID NO: 905252 - RNA, 22 nt, Human
cuggagcuuauugggagcagaa

SEQ ID NO: 905253 - RNA, 22 nt, Human
guggaauggccaugggauccuu

SEQ ID NO: 905254 - RNA, 22 nt, Human
gaggaaggagggaaagcgcgcg

SEQ ID NO: 905255 - RNA, 22 nt, Human
gcccaaggucccauggcagcac

SEQ ID NO: 905256 - RNA, 22 nt, Human
auguguaucuaagguguucuau

SEQ ID NO: 905257 - RNA, 17 nt, Human
acccauuuugcacaggc

SEQ ID NO: 905258 - RNA, 22 nt, Human
ucauuuacuguaggcaaaaauu

SEQ ID NO: 905259 - RNA, 22 nt, Human
aggcuccaugguucucccucag

SEQ ID NO: 905260 - RNA, 22 nt, Human
ucucuucccggauaaaguaagu

SEQ ID NO: 905261 - RNA, 20 nt, Human
acaguuuauccaguuagcag

SEQ ID NO: 905262 - RNA, 22 nt, Human
ucuuuggaaaugcuuugagaau

SEQ ID NO: 905263 - RNA, 22 nt, Human
cuaugcagaauuuagugacuua

SEQ ID NO: 905264 - RNA, 22 nt, Human
ugaguggacaccugcuucuuua

SEQ ID NO: 905265 - RNA, 22 nt, Human
aacaugucuggguauucacaag

SEQ ID NO: 905266 - RNA, 22 nt, Human
uugucugucccagcuugugcau

SEQ ID NO: 905267 - RNA, 22 nt, Human
gagaggagaagccugcgcuuca

SEQ ID NO: 905268 - RNA, 22 nt, Human
ggaugggaacuugguagggcau

SEQ ID NO: 905269 - RNA, 21 nt, Human
gcagcuggucucagagcuugc

SEQ ID NO: 905270 - RNA, 22 nt, Human
guguccagccugcacagggugc

SEQ ID NO: 905271 - RNA, 22 nt, Human
gggagggaucugcuaggcaaug

SEQ ID NO: 905272 - RNA, 20 nt, Human
ugauuucucuucuauuccuu

SEQ ID NO: 905273 - RNA, 22 nt, Human
cuguggcuaggaagcuguggga

SEQ ID NO: 905274 - RNA, 22 nt, Human
uagaggccugaaagaaugauca

SEQ ID NO: 905275 - RNA, 22 nt, Human
gccuguccuggaugcucugcaa

SEQ ID NO: 905276 - RNA, 22 nt, Human
cauguuauuuauccauuaaaca

SEQ ID NO: 905277 - RNA, 22 nt, Human
caaucuauagagcuuuagacua

SEQ ID NO: 905278 - RNA, 22 nt, Human
aggagugaguguccucagcaga

SEQ ID NO: 905279 - RNA, 22 nt, Human
gcccaguaguucaagguugcag

SEQ ID NO: 905280 - RNA, 22 nt, Human
gcaggagugacauggaugugga

SEQ ID NO: 905281 - RNA, 22 nt, Human
agccaaaggcaccagagacacu

SEQ ID NO: 905282 - RNA, 17 nt, Human
agaguggcuaaggcuca

SEQ ID NO: 905283 - RNA, 22 nt, Human
agagggcagggcgguaaguccu

SEQ ID NO: 905284 - RNA, 22 nt, Human
aaaugucaaggugauagaugca

SEQ ID NO: 905285 - RNA, 19 nt, Human
gggagcaggaaagcugugg

SEQ ID NO: 905286 - RNA, 22 nt, Human
agcugcugagagucugccgggc

SEQ ID NO: 905287 - RNA, 22 nt, Human
ugagcaggggagagcgaaugug

SEQ ID NO: 905288 - RNA, 22 nt, Human
gaauagcuguaggcuagugucu

SEQ ID NO: 905289 - RNA, 22 nt, Human
aucaagaauugggagcuauuga

SEQ ID NO: 905290 - RNA, 22 nt, Human
gccagcugcaucuccugggcug

SEQ ID NO: 905291 - RNA, 22 nt, Human
guuccacagagucucacuauga

SEQ ID NO: 905292 - RNA, 21 nt, Human
aggugggagaccauguagguc

SEQ ID NO: 905293 - RNA, 22 nt, Human
cagggcuccaugcagggacucc

SEQ ID NO: 905294 - RNA, 22 nt, Human
cacauugggaugaagucuaaaa

SEQ ID NO: 905295 - RNA, 22 nt, Human
gacaguaagaccuuaccagccu

SEQ ID NO: 905296 - RNA, 22 nt, Human
agggcaugugggagaggagccu

SEQ ID NO: 905297 - RNA, 22 nt, Human
ucugggaaccagugcggcuggg

SEQ ID NO: 905298 - RNA, 19 nt, Human
caucuguaaggacagaaac

SEQ ID NO: 905299 - RNA, 22 nt, Human
cccaggagaauauuuuuggguc

SEQ ID NO: 905300 - RNA, 22 nt, Human
uggaauguaaagcgugugauaa

SEQ ID NO: 905301 - RNA, 20 nt, Human
uugcagcagugaggugaagg

SEQ ID NO: 905302 - RNA, 22 nt, Human
ugcugccacauuuaaagagggg

SEQ ID NO: 905303 - RNA, 22 nt, Human
uccaugccaggcagucgaugca

SEQ ID NO: 905304 - RNA, 22 nt, Human
auuauugccagcuauuacaaca

SEQ ID NO: 905305 - RNA, 22 nt, Human
auacuguaauaccuaaaugaac

SEQ ID NO: 905306 - RNA, 22 nt, Human
ucacuggggagcacugacaugu

SEQ ID NO: 905307 - RNA, 17 nt, Human
gaagaaggaaucuagaa

SEQ ID NO: 905308 - RNA, 22 nt, Human
gcccaaggucacacacaggaag

SEQ ID NO: 905309 - RNA, 22 nt, Human
agcacagaaagcacauuugaaa

SEQ ID NO: 905310 - RNA, 22 nt, Human
ugcuucagcacuuugagagccu

SEQ ID NO: 905311 - RNA, 22 nt, Human
agcagcugaaaggcaaacuucu

SEQ ID NO: 905312 - RNA, 22 nt, Human
aagcaugguggaugauacagug

SEQ ID NO: 905313 - RNA, 22 nt, Human
aaaugcagccuagcucaguuuu

SEQ ID NO: 905314 - RNA, 18 nt, Human
ggcuccugugaucacauu

SEQ ID NO: 905315 - RNA, 22 nt, Human
ucuaggcauuguuauuacaacu

SEQ ID NO: 905316 - RNA, 22 nt, Human
gguggccauaggaccagccugg

SEQ ID NO: 905317 - RNA, 22 nt, Human
gaaugcugguguucagaauuuu

SEQ ID NO: 905318 - RNA, 17 nt, Human
uguuuucauucauugcu

SEQ ID NO: 905319 - RNA, 23 nt, Human
uguuuguuucuaugagagauagc

SEQ ID NO: 905320 - RNA, 22 nt, Human
gggcuaggcuuggccagcacug

SEQ ID NO: 905321 - RNA, 22 nt, Human
aaugcuaaaauggcacuaaagu

SEQ ID NO: 905322 - RNA, 19 nt, Human
ucugcuggcagaauucccu

SEQ ID NO: 905323 - RNA, 22 nt, Human
uggcaacaugucgaagugcugu

SEQ ID NO: 905324 - RNA, 22 nt, Human
uuacaacaaaggcacgugcaug

SEQ ID NO: 905325 - RNA, 22 nt, Human
cagcaaggcauucuguggauua

SEQ ID NO: 905326 - RNA, 22 nt, Human
ucucagaguaauucuuuaaggu

SEQ ID NO: 905327 - RNA, 22 nt, Human
gggcaggggucaguggccccaa

SEQ ID NO: 905328 - RNA, 22 nt, Human
gugaagccacagagccacgccg

SEQ ID NO: 905329 - RNA, 22 nt, Human
uagacuauagcucacagugcuu

SEQ ID NO: 905330 - RNA, 22 nt, Human
ugauuuuuaaaauucuccuugc

SEQ ID NO: 905331 - RNA, 22 nt, Human
cucugugugguccucuguauug

SEQ ID NO: 905332 - RNA, 22 nt, Human
ggauggagguucucagaugcuc

SEQ ID NO: 905333 - RNA, 22 nt, Human
auacuacaucacagccaagaag

SEQ ID NO: 905334 - RNA, 22 nt, Human
gccaggagacuccauucauuug

SEQ ID NO: 905335 - RNA, 22 nt, Human
ugcagccucucugcuucaggaa

SEQ ID NO: 905336 - RNA, 22 nt, Human
gacacuuuaggauuuaaaaguc

SEQ ID NO: 905337 - RNA, 22 nt, Human
gagccaagggcgugcuggagag

SEQ ID NO: 905338 - RNA, 22 nt, Human
ugacagaaauaguucuuaauuu

SEQ ID NO: 905339 - RNA, 20 nt, Human
cagugcauugcuucugauuu

SEQ ID NO: 905340 - RNA, 22 nt, Human
acuuagcaaaucuuuuggauuc

SEQ ID NO: 905341 - RNA, 22 nt, Human
gaagcuaaugauuuauuuucug

SEQ ID NO: 905342 - RNA, 22 nt, Human
caggaagucuuugcccaggcca

SEQ ID NO: 905343 - RNA, 22 nt, Human
ccagcagccaccuucucgaaau

SEQ ID NO: 905344 - RNA, 22 nt, Human
uuuacaucucaccagauucaua

SEQ ID NO: 905345 - RNA, 22 nt, Human
agcucaggcucugcagggacua

SEQ ID NO: 905346 - RNA, 22 nt, Human
cagagcagaaaccugggugauu

SEQ ID NO: 905347 - RNA, 22 nt, Human
uacauacaagcauucaauuuua

SEQ ID NO: 905348 - RNA, 22 nt, Human
acaugagaggcuguggaguaca

SEQ ID NO: 905349 - RNA, 22 nt, Human
aacuuguuucuuccauucaaca

SEQ ID NO: 905350 - RNA, 22 nt, Human
uacuuugguaucaaacuaaaac

SEQ ID NO: 905351 - RNA, 20 nt, Human
ggccuuagggagggcuguaa

SEQ ID NO: 905352 - RNA, 22 nt, Human
guauacauuuauuacaggucuu

SEQ ID NO: 905353 - RNA, 22 nt, Human
acagggaaguucugcaacagga

SEQ ID NO: 905354 - RNA, 22 nt, Human
cagcccucugaagaggcgcuug

SEQ ID NO: 905355 - RNA, 22 nt, Human
cuuuaaggugaugagagaugcu

SEQ ID NO: 905356 - RNA, 23 nt, Human
uccagagcucaugcucucaacca

SEQ ID NO: 905357 - RNA, 22 nt, Human
gcagcaagaggugccaucuuga

SEQ ID NO: 905358 - RNA, 22 nt, Human
ucugcagaauucgaggaagaaa

SEQ ID NO: 905359 - RNA, 22 nt, Human
uaggggaacuggcacagggcag

SEQ ID NO: 905360 - RNA, 22 nt, Human
acagguacaagggauuaggaug

SEQ ID NO: 905361 - RNA, 22 nt, Human
uuagcaauguaugauuaaaaua

SEQ ID NO: 905362 - RNA, 22 nt, Human
uuucaggacaccuuuaaaaacg

SEQ ID NO: 905363 - RNA, 22 nt, Human
augaagacuaaugugaauggga

SEQ ID NO: 905364 - RNA, 22 nt, Human
aaagccaggcagccaagccagu

SEQ ID NO: 905365 - RNA, 22 nt, Human
ugcagcugguaucccauggauu

SEQ ID NO: 905366 - RNA, 22 nt, Human
aggagaggaaucauuauuacaa

SEQ ID NO: 905367 - RNA, 22 nt, Human
aauuuggagagaaacaaguagg

SEQ ID NO: 905368 - RNA, 21 nt, Human
agcagccauuucacagagacu

SEQ ID NO: 905369 - RNA, 21 nt, Human
acauuauaauucauauuccac

SEQ ID NO: 905370 - RNA, 22 nt, Human
aaauaauugaguuggucaauau

SEQ ID NO: 905371 - RNA, 22 nt, Human
gggauggggucgggacccugcu

SEQ ID NO: 905372 - RNA, 20 nt, Human
aucaccuguagguucuuugu

SEQ ID NO: 905373 - RNA, 22 nt, Human
gggcagcauuugaaaaacagau

SEQ ID NO: 905374 - RNA, 22 nt, Human
ggaaaucuggugguagauggga

SEQ ID NO: 905375 - RNA, 22 nt, Human
ugugggaggucuggaaggcucc

SEQ ID NO: 905376 - RNA, 22 nt, Human
gugcucuaggugauuccaaaau

SEQ ID NO: 905377 - RNA, 22 nt, Human
uaugaagauauaucugaucucu

SEQ ID NO: 905378 - RNA, 22 nt, Human
aaugacuguagucauauuaagg

SEQ ID NO: 905379 - RNA, 23 nt, Human
caucagugagggggaaucacuaa

SEQ ID NO: 905380 - RNA, 22 nt, Human
cagcacugugauaacugagcca

SEQ ID NO: 905381 - RNA, 22 nt, Human
guuugauucaagaacaaagagu

SEQ ID NO: 905382 - RNA, 22 nt, Human
ccuggaggggaccaggaccagg

SEQ ID NO: 905383 - RNA, 22 nt, Human
cucaacauuuaacagugaaaaa

SEQ ID NO: 905384 - RNA, 22 nt, Human
aacugcaaaauaaucaaguugu

SEQ ID NO: 905385 - RNA, 22 nt, Human
uguauagacuagcuuucacgau

SEQ ID NO: 905386 - RNA, 22 nt, Human
aaauuguauauuccauuuguau

SEQ ID NO: 905387 - RNA, 22 nt, Human
uguguacauauacacaaauaca

SEQ ID NO: 905388 - RNA, 22 nt, Human
auguguuuguaccuuuaaauau

SEQ ID NO: 905389 - RNA, 22 nt, Human
uccacagcuguccuguaacagg

SEQ ID NO: 905390 - RNA, 22 nt, Human
uucuaguccuagaaacuacaug

SEQ ID NO: 905391 - RNA, 22 nt, Human
ugucagaugcgauaaacuagug

SEQ ID NO: 905392 - RNA, 22 nt, Human
gcucugggugaaggguaccauu

SEQ ID NO: 905393 - RNA, 22 nt, Human
caccugcccagcaccugggauc

SEQ ID NO: 905394 - RNA, 22 nt, Human
gguaggggaagacaagugaaaa

SEQ ID NO: 905395 - RNA, 22 nt, Human
aggcugagcuggcccuugaaau

SEQ ID NO: 905396 - RNA, 22 nt, Human
uucuggaagaguaaaauaagcc

SEQ ID NO: 905397 - RNA, 22 nt, Human
ucccagcagucagagcuaugug

SEQ ID NO: 905398 - RNA, 22 nt, Human
cagugauguuucugcaucagag

SEQ ID NO: 905399 - RNA, 22 nt, Human
cagcagaggaaagcaaaucuaa

SEQ ID NO: 905400 - RNA, 22 nt, Human
uuccucaggcuucccuuugucc

SEQ ID NO: 905401 - RNA, 22 nt, Human
gcucuggaagcaucugagagga

SEQ ID NO: 905402 - RNA, 22 nt, Human
cuggagcugucuucacaggccu

SEQ ID NO: 905403 - RNA, 22 nt, Human
uagcaccuuagcauuucuagug

SEQ ID NO: 905404 - RNA, 20 nt, Human
uuuauucacagagaagaguu

SEQ ID NO: 905405 - RNA, 22 nt, Human
gcugccuuagagggagugguuc

SEQ ID NO: 905406 - RNA, 22 nt, Human
uuggagggucuuccacagccau

SEQ ID NO: 905407 - RNA, 22 nt, Human
aagacaugcaauuagcaaggaa

SEQ ID NO: 905408 - RNA, 22 nt, Human
ggugugcuaagagcacuuucaa

SEQ ID NO: 905409 - RNA, 22 nt, Human
uggcagccaucagagcaggggu

SEQ ID NO: 905410 - RNA, 22 nt, Human
guguccuuuuaugugacugguu

SEQ ID NO: 905411 - RNA, 22 nt, Human
acacaagaauaaugaugaaggu

SEQ ID NO: 905412 - RNA, 21 nt, Human
ccagcccagcugugucccagc

SEQ ID NO: 905413 - RNA, 21 nt, Human
caaugucugcucucugccuag

SEQ ID NO: 905414 - RNA, 22 nt, Human
ucccugugucuuccucuugccc

SEQ ID NO: 905415 - RNA, 22 nt, Human
acuuguuaguuuuaucugcaug

SEQ ID NO: 905416 - RNA, 22 nt, Human
aaauagacaggcuuaaauagga

SEQ ID NO: 905417 - RNA, 22 nt, Human
aagggagaggagggucuuguug

SEQ ID NO: 905418 - RNA, 22 nt, Human
caguacuuugcaucauuccacu

SEQ ID NO: 905419 - RNA, 22 nt, Human
caggccuucucccucccucaac

SEQ ID NO: 905420 - RNA, 22 nt, Human
cauauguauuucucauaauuag

SEQ ID NO: 905421 - RNA, 22 nt, Human
cuuagcaauaagagggaauaua

SEQ ID NO: 905422 - RNA, 22 nt, Human
aaguuuguggucauuuauuaua

SEQ ID NO: 905423 - RNA, 22 nt, Human
ggugaggggcgccucugcccag

SEQ ID NO: 905424 - RNA, 22 nt, Human
auacuuaguuuuaauccauuag

SEQ ID NO: 905425 - RNA, 22 nt, Human
uacuccagacauucuguccucg

SEQ ID NO: 905426 - RNA, 22 nt, Human
agggccagcugaugagaaugag

SEQ ID NO: 905427 - RNA, 22 nt, Human
auguccagcucaugauacuauc

SEQ ID NO: 905428 - RNA, 22 nt, Human
ggaaaucucagaucucccagau

SEQ ID NO: 905429 - RNA, 22 nt, Human
ucugggagagcacguggcugac

SEQ ID NO: 905430 - RNA, 22 nt, Human
cugaggaccccacaggaggccc

SEQ ID NO: 905431 - RNA, 23 nt, Human
ggguccagagacaggcaugggug

SEQ ID NO: 905432 - RNA, 22 nt, Human
agcuccuugaagggcucuggga

SEQ ID NO: 905433 - RNA, 22 nt, Human
uccuuugguucucuaagaugcu

SEQ ID NO: 905434 - RNA, 22 nt, Human
acaaauauuuacugaauccacu

SEQ ID NO: 905435 - RNA, 23 nt, Human
aggagacagggaagugccuggcu

SEQ ID NO: 905436 - RNA, 22 nt, Human
acaguggauauauuaaaugaga

SEQ ID NO: 905437 - RNA, 22 nt, Human
cauucaaaaugggcugaccugu

SEQ ID NO: 905438 - RNA, 22 nt, Human
guggcagagagcaagugucuga

SEQ ID NO: 905439 - RNA, 21 nt, Human
acugugccaggcacaaaaaca

SEQ ID NO: 905440 - RNA, 22 nt, Human
uaugaucucugggucuggagcu

SEQ ID NO: 905441 - RNA, 19 nt, Human
gguggcagaacgugggucc

SEQ ID NO: 905442 - RNA, 22 nt, Human
uagggcugugucuccaggacca

SEQ ID NO: 905443 - RNA, 22 nt, Human
uugcaucagguagacaacuaua

SEQ ID NO: 905444 - RNA, 23 nt, Human
ugacaaagucaucucuccuucuu

SEQ ID NO: 905445 - RNA, 22 nt, Human
aaagucaguuggccagaucacu

SEQ ID NO: 905446 - RNA, 22 nt, Human
acaggucaacgagagcaggcaa

SEQ ID NO: 905447 - RNA, 22 nt, Human
gccuggagcagacgugucccgg

SEQ ID NO: 905448 - RNA, 23 nt, Human
acugaaaggauccuagcagagac

SEQ ID NO: 905449 - RNA, 22 nt, Human
caagagggaaccuaagauguau

SEQ ID NO: 905450 - RNA, 22 nt, Human
aucaccaaggcuuuaggaauuu

SEQ ID NO: 905451 - RNA, 18 nt, Human
accacagugcuuaauaug

SEQ ID NO: 905452 - RNA, 22 nt, Human
cuucuuccugaaagcuggcucu

SEQ ID NO: 905453 - RNA, 22 nt, Human
gaaguucucuugggggccugag

SEQ ID NO: 905454 - RNA, 22 nt, Human
augauguaacauaaagaugucu

SEQ ID NO: 905455 - RNA, 22 nt, Human
ccaggcuugguguguggucagg

SEQ ID NO: 905456 - RNA, 22 nt, Human
ucugugcagauguagaccaguu

SEQ ID NO: 905457 - RNA, 22 nt, Human
agcucugggggaaagucugcuc

SEQ ID NO: 905458 - RNA, 22 nt, Human
gucuguccaucagcaaaggcuu

SEQ ID NO: 905459 - RNA, 22 nt, Human
ucucaauauuauaugucauaaa

SEQ ID NO: 905460 - RNA, 22 nt, Human
ugaaccuuuugcuaagaaguua

SEQ ID NO: 905461 - RNA, 22 nt, Human
ggagucacacagagaagauaag

SEQ ID NO: 905462 - RNA, 22 nt, Human
ucagaaagugaacuguugacau

SEQ ID NO: 905463 - RNA, 22 nt, Human
uccaggcugggcugaagggugc

SEQ ID NO: 905464 - RNA, 17 nt, Human
gugccuguuguccugga

SEQ ID NO: 905465 - RNA, 22 nt, Human
aggcugugcaauuaggguaaga

SEQ ID NO: 905466 - RNA, 23 nt, Human
ccuggcucaccccuuauguccag

SEQ ID NO: 905467 - RNA, 21 nt, Human
gucaaacuugcaccagugccc

SEQ ID NO: 905468 - RNA, 22 nt, Human
aggcuccacggucacuggcucu

SEQ ID NO: 905469 - RNA, 22 nt, Human
uagauaacagcacuggccucgc

SEQ ID NO: 905470 - RNA, 22 nt, Human
gcuguggcugaagaugcaggga

SEQ ID NO: 905471 - RNA, 22 nt, Human
cagccacuuccccucuaugggu

SEQ ID NO: 905472 - RNA, 22 nt, Human
guguaaaugccccauucauuga

SEQ ID NO: 905473 - RNA, 22 nt, Human
cuggcugggcagacagaaugcu

SEQ ID NO: 905474 - RNA, 22 nt, Human
gcuggcagccaagugaagaggg

SEQ ID NO: 905475 - RNA, 22 nt, Human
ggcucagcaaugaugagccccu

SEQ ID NO: 905476 - RNA, 22 nt, Human
ugggucccaggaaggaccagca

SEQ ID NO: 905477 - RNA, 22 nt, Human
uuucuagcaugacacaguccuc

SEQ ID NO: 905478 - RNA, 22 nt, Human
agcugagcuaguaguuccagug

SEQ ID NO: 905479 - RNA, 22 nt, Human
ccugcugggccugagcaaugag

SEQ ID NO: 905480 - RNA, 22 nt, Human
augaaacucuaacuuaacaagu

SEQ ID NO: 905481 - RNA, 22 nt, Human
ugcagcugaccagcaaguccug

SEQ ID NO: 905482 - RNA, 22 nt, Human
cucccagguuacaucugagccu

SEQ ID NO: 905483 - RNA, 22 nt, Human
agacccuugcaugaauuaauuc

SEQ ID NO: 905484 - RNA, 22 nt, Human
acuuuauuuccuauugcaucca

SEQ ID NO: 905485 - RNA, 22 nt, Human
uagacuggugaauuagggggaa

SEQ ID NO: 905486 - RNA, 22 nt, Human
uggaauguaaucaugugguggu

SEQ ID NO: 905487 - RNA, 19 nt, Human
cacauacagaaaagaguaa

SEQ ID NO: 905488 - RNA, 22 nt, Human
aaacaucaccauuuuaccuaau

SEQ ID NO: 905489 - RNA, 22 nt, Human
acccucaguaaucgugcaguuu

SEQ ID NO: 905490 - RNA, 22 nt, Human
ucaaaacucauuuuggaaguaa

SEQ ID NO: 905491 - RNA, 22 nt, Human
uuguuucuucaggcuuuuagga

SEQ ID NO: 905492 - RNA, 22 nt, Human
uucaguaagcacuucuagagcu

SEQ ID NO: 905493 - RNA, 22 nt, Human
cagcuucagcgugacaccagug

SEQ ID NO: 905494 - RNA, 22 nt, Human
gaagaaacugaaagggguuggu

SEQ ID NO: 905495 - RNA, 22 nt, Human
gccaagccuguagacacaagcu

SEQ ID NO: 905496 - RNA, 22 nt, Human
ggccccuguaaaauguacaugu

SEQ ID NO: 905497 - RNA, 22 nt, Human
uuugcaaauaaauaagugcucg

SEQ ID NO: 905498 - RNA, 22 nt, Human
cuguguuugacaggcggucucc

SEQ ID NO: 905499 - RNA, 23 nt, Human
uggccaggcauaaaggugggugg

SEQ ID NO: 905500 - RNA, 22 nt, Human
gaggccugcuuuggcacucugg

SEQ ID NO: 905501 - RNA, 22 nt, Human
gagaaggcuggucuuaagucga

SEQ ID NO: 905502 - RNA, 22 nt, Human
ugacccuuucauuauucucauu

SEQ ID NO: 905503 - RNA, 18 nt, Human
uaaguucuuaggcagcuu

SEQ ID NO: 905504 - RNA, 22 nt, Human
uaaugcuaacaucauaucacug

SEQ ID NO: 905505 - RNA, 22 nt, Human
gggucaggccucaaggugggcu

SEQ ID NO: 905506 - RNA, 20 nt, Human
agauuauuccuaagauuucu

SEQ ID NO: 905507 - RNA, 22 nt, Human
ccagugugaaccucaccacccu

SEQ ID NO: 905508 - RNA, 22 nt, Human
aagagagaccaugggggacagg

SEQ ID NO: 905509 - RNA, 22 nt, Human
gcggaggaaacugaggcaagag

SEQ ID NO: 905510 - RNA, 22 nt, Human
uaagaugguuguagauggacug

SEQ ID NO: 905511 - RNA, 22 nt, Human
agaggcggagguugcagugagc

SEQ ID NO: 905512 - RNA, 22 nt, Human
cuaggggcaugaaauagagaau

SEQ ID NO: 905513 - RNA, 18 nt, Human
gggcuaggcaaggaccac

SEQ ID NO: 905514 - RNA, 22 nt, Human
caguuaaaaugugcuauaagaa

SEQ ID NO: 905515 - RNA, 22 nt, Human
acuccagaugauaagggacagu

SEQ ID NO: 905516 - RNA, 22 nt, Human
auaugaauuuggggaggacaca

SEQ ID NO: 905517 - RNA, 22 nt, Human
uaauacauguauuccagagagu

SEQ ID NO: 905518 - RNA, 22 nt, Human
ccugagguuuuuggauaguugu

SEQ ID NO: 905519 - RNA, 22 nt, Human
ccuggagaggcgcugcagagga

SEQ ID NO: 905520 - RNA, 22 nt, Human
gaggaacagcagccacaugucc

SEQ ID NO: 905521 - RNA, 22 nt, Human
acauguguuaaaauucucacca

SEQ ID NO: 905522 - RNA, 22 nt, Human
uaaagcauguacugugugcuag

SEQ ID NO: 905523 - RNA, 22 nt, Human
cagcuguguaugagagcaugcu

SEQ ID NO: 905524 - RNA, 22 nt, Human
uccucuccaugucucacgccac

SEQ ID NO: 905525 - RNA, 22 nt, Human
gccugccugcugugugcaaguu

SEQ ID NO: 905526 - RNA, 22 nt, Human
uugaagaaccaucugugccacu

SEQ ID NO: 905527 - RNA, 22 nt, Human
ucuuuuauuaggcugaaauggg

SEQ ID NO: 905528 - RNA, 22 nt, Human
aaugauaugcaaauuaucauca

SEQ ID NO: 905529 - RNA, 22 nt, Human
augggaggaucacuugaggcca

SEQ ID NO: 905530 - RNA, 22 nt, Human
ucaccaggauuccuaucaguag

SEQ ID NO: 905531 - RNA, 16 nt, Human
caauacauggcauuuc

SEQ ID NO: 905532 - RNA, 22 nt, Human
agugguggagccaggaaaugug

SEQ ID NO: 905533 - RNA, 22 nt, Human
gugaugucuuguacauaugauu

SEQ ID NO: 905534 - RNA, 22 nt, Human
acuccaggaaacuuaggggaaa

SEQ ID NO: 905535 - RNA, 22 nt, Human
cagagcagccuccagggggagc

SEQ ID NO: 905536 - RNA, 22 nt, Human
gaguguggaucccagaagcaga

SEQ ID NO: 905537 - RNA, 20 nt, Human
gcuguugccaguacagaugg

SEQ ID NO: 905538 - RNA, 22 nt, Human
ugcaacaaggccucauuucuug

SEQ ID NO: 905539 - RNA, 22 nt, Human
gcauuuggaacuugguugagau

SEQ ID NO: 905540 - RNA, 22 nt, Human
uugggaaagaaugagaagguga

SEQ ID NO: 905541 - RNA, 22 nt, Human
agcuuauuaauuuuucugcaug

SEQ ID NO: 905542 - RNA, 22 nt, Human
caucaguggauauagauuagcg

SEQ ID NO: 905543 - RNA, 22 nt, Human
ucagaucuaauuggauuauuau

SEQ ID NO: 905544 - RNA, 22 nt, Human
cuuugugauaguguuaagacca

SEQ ID NO: 905545 - RNA, 18 nt, Human
cugaagacaaaaugucca

SEQ ID NO: 905546 - RNA, 22 nt, Human
gaggccagcuaguccaggaagu

SEQ ID NO: 905547 - RNA, 22 nt, Human
aagauucuacaguagguacauu

SEQ ID NO: 905548 - RNA, 22 nt, Human
gaggcugguuugccuuuuggca

SEQ ID NO: 905549 - RNA, 23 nt, Human
gaagugucugagcuguauuuuuc

SEQ ID NO: 905550 - RNA, 22 nt, Human
agcaauaaccacucuaauuuau

SEQ ID NO: 905551 - RNA, 22 nt, Human
aaacagugccuggcauggagga

SEQ ID NO: 905552 - RNA, 22 nt, Human
agaagccaugguaugcaacuac

SEQ ID NO: 905553 - RNA, 22 nt, Human
cuuguuaaauuauauaagcaga

SEQ ID NO: 905554 - RNA, 22 nt, Human
auaguacagauccauuaauuau

SEQ ID NO: 905555 - RNA, 22 nt, Human
ggaagcuggcauauguaauccu

SEQ ID NO: 905556 - RNA, 22 nt, Human
uuacucuuaauggcaacaacug

SEQ ID NO: 905557 - RNA, 22 nt, Human
ucugugcggucuguguuaugaa

SEQ ID NO: 905558 - RNA, 22 nt, Human
aaaguguugggauuauaggcgu

SEQ ID NO: 905559 - RNA, 22 nt, Human
caauuucagaccuuuccuugga

SEQ ID NO: 905560 - RNA, 22 nt, Human
uggcccuguguccugcugccag

SEQ ID NO: 905561 - RNA, 16 nt, Human
cuugucuguugcucau

SEQ ID NO: 905562 - RNA, 22 nt, Human
uuguaugaucaaaagaaaugua

SEQ ID NO: 905563 - RNA, 22 nt, Human
cugcagggguguccuguauugg

SEQ ID NO: 905564 - RNA, 22 nt, Human
cagaggacaugaaaacucgcuc

SEQ ID NO: 905565 - RNA, 22 nt, Human
aggcuccauuccaggagcuaga

SEQ ID NO: 905566 - RNA, 22 nt, Human
cacugucacguucugaaacugu

SEQ ID NO: 905567 - RNA, 22 nt, Human
cagcccugaaacaaccuccucu

SEQ ID NO: 905568 - RNA, 22 nt, Human
cuuguauuccccuaucucuaaa

SEQ ID NO: 905569 - RNA, 22 nt, Human
gcccagcacauugcugaggacc

SEQ ID NO: 905570 - RNA, 22 nt, Human
ccugcuggcugguagaguuccg

SEQ ID NO: 905571 - RNA, 22 nt, Human
agcccugcucaucuggaucccg

SEQ ID NO: 905572 - RNA, 22 nt, Human
ccugccugauuccaggauggcu

SEQ ID NO: 905573 - RNA, 22 nt, Human
ucuuugaugggagaucugagag

SEQ ID NO: 905574 - RNA, 22 nt, Human
uccaaacacccuccaugcugca

SEQ ID NO: 905575 - RNA, 22 nt, Human
caaauacugagcacgcaaucaa

SEQ ID NO: 905576 - RNA, 22 nt, Human
acaaugaauuuaauaccuuauu

SEQ ID NO: 905577 - RNA, 22 nt, Human
auuguacaaugccuggaacauu

SEQ ID NO: 905578 - RNA, 22 nt, Human
aaugagguuuuuuaaagccaga

SEQ ID NO: 905579 - RNA, 22 nt, Human
acagcuguggucuccuuagugu

SEQ ID NO: 905580 - RNA, 22 nt, Human
cugaggccagagugggccucuu

SEQ ID NO: 905581 - RNA, 20 nt, Human
aagaaacuugaaaguacaag

SEQ ID NO: 905582 - RNA, 22 nt, Human
aagauauaauaacuguugucau

SEQ ID NO: 905583 - RNA, 22 nt, Human
cccuccucucccuaagagucac

SEQ ID NO: 905584 - RNA, 22 nt, Human
aguggcugccaagauauaauuc

SEQ ID NO: 905585 - RNA, 22 nt, Human
acugaacuuggugaaugccaca

SEQ ID NO: 905586 - RNA, 22 nt, Human
auguguuuguccugcagaaaua

SEQ ID NO: 905587 - RNA, 22 nt, Human
gggggcuaccgucucuggagcu

SEQ ID NO: 905588 - RNA, 22 nt, Human
caggucuggcaucagcugugug

SEQ ID NO: 905589 - RNA, 22 nt, Human
uguuuuguccuuuucuauauac

SEQ ID NO: 905590 - RNA, 22 nt, Human
uuacaaagaguguucuuuucca

SEQ ID NO: 905591 - RNA, 22 nt, Human
uacuguuuuuuagacucauggu

SEQ ID NO: 905592 - RNA, 22 nt, Human
ucacaggcccaaaccacgcuua

SEQ ID NO: 905593 - RNA, 22 nt, Human
gcaggugguggcgcgcgcccug

SEQ ID NO: 905594 - RNA, 22 nt, Human
agcagcaggugaccucgaugcc

SEQ ID NO: 905595 - RNA, 22 nt, Human
ugggagcaggugugcuagggaa

SEQ ID NO: 905596 - RNA, 23 nt, Human
ugaaacauuuaggguagaauuuc

SEQ ID NO: 905597 - RNA, 22 nt, Human
aaaguuacuaucacaaugaaau

SEQ ID NO: 905598 - RNA, 22 nt, Human
cucugaagggagggccaagccc

SEQ ID NO: 905599 - RNA, 17 nt, Human
ucugcucugccaaucca

SEQ ID NO: 905600 - RNA, 22 nt, Human
ugcucuggaccaugacuaugug

SEQ ID NO: 905601 - RNA, 22 nt, Human
ucucagggagguuccccguucu

SEQ ID NO: 905602 - RNA, 22 nt, Human
gauaaacaugaaguucugugua

SEQ ID NO: 905603 - RNA, 22 nt, Human
uucuccagacaacagaggguga

SEQ ID NO: 905604 - RNA, 22 nt, Human
uucaaacaguguagaauauaug

SEQ ID NO: 905605 - RNA, 20 nt, Human
cacucuaaccauauuuccuc

SEQ ID NO: 905606 - RNA, 22 nt, Human
acauuucagaaucacacagcuu

SEQ ID NO: 905607 - RNA, 22 nt, Human
cuacaggaaggaucuugcucaa

SEQ ID NO: 905608 - RNA, 22 nt, Human
cuucugggagagcuuuugcuuc

SEQ ID NO: 905609 - RNA, 22 nt, Human
ccagcuguaggcaggggguuua

SEQ ID NO: 905610 - RNA, 22 nt, Human
uggcuggcaaggcuggagucag

SEQ ID NO: 905611 - RNA, 22 nt, Human
gggagcugagaaacaacauucu

SEQ ID NO: 905612 - RNA, 22 nt, Human
cgggcagugcccagcggggcag

SEQ ID NO: 905613 - RNA, 22 nt, Human
ucagaggcuuucaauguguuuu

SEQ ID NO: 905614 - RNA, 22 nt, Human
uuccuggccccaccccuggaga

SEQ ID NO: 905615 - RNA, 22 nt, Human
ucuagacaucuuggcugcaauu

SEQ ID NO: 905616 - RNA, 22 nt, Human
aggcccuggggucuguuaaauu

SEQ ID NO: 905617 - RNA, 22 nt, Human
ucugagccagacaagacagcca

SEQ ID NO: 905618 - RNA, 22 nt, Human
auuuuuucccaguuagccagga

SEQ ID NO: 905619 - RNA, 22 nt, Human
aagggaggccagagguuuugca

SEQ ID NO: 905620 - RNA, 22 nt, Human
ucauaaagugaaggaugauggg

SEQ ID NO: 905621 - RNA, 22 nt, Human
auuuccuagccucucuugcagu

SEQ ID NO: 905622 - RNA, 22 nt, Human
ucagaauucuagcucuucccuu

SEQ ID NO: 905623 - RNA, 22 nt, Human
ggccagccuggggcucccagac

SEQ ID NO: 905624 - RNA, 22 nt, Human
agaccuggaguggggccucagg

SEQ ID NO: 905625 - RNA, 22 nt, Human
auaaagcuucugagucuagauc

SEQ ID NO: 905626 - RNA, 22 nt, Human
aaauuucaagcaaaguagcuau

SEQ ID NO: 905627 - RNA, 22 nt, Human
acauuuaaguuaaaaccucagu

SEQ ID NO: 905628 - RNA, 18 nt, Human
aagaggcuguucuguggg

SEQ ID NO: 905629 - RNA, 22 nt, Human
auccaaaguagauuaagucaca

SEQ ID NO: 905630 - RNA, 22 nt, Human
acacacucaauugcauaagcac

SEQ ID NO: 905631 - RNA, 22 nt, Human
gcagaggcaaucagguaugugg

SEQ ID NO: 905632 - RNA, 22 nt, Human
gcaaagcauucuguggagucua

SEQ ID NO: 905633 - RNA, 22 nt, Human
cagagccugcugccuucugaag

SEQ ID NO: 905634 - RNA, 22 nt, Human
gacaaagcagacaagauaauuc

SEQ ID NO: 905635 - RNA, 22 nt, Human
ucucucuggagcuggggcauga

SEQ ID NO: 905636 - RNA, 22 nt, Human
uuucaagacucauugaguauug

SEQ ID NO: 905637 - RNA, 22 nt, Human
guacaggaaggagggaguuuca

SEQ ID NO: 905638 - RNA, 22 nt, Human
auucaguuccuugugauuguag

SEQ ID NO: 905639 - RNA, 22 nt, Human
ggaagacugcauggcauaguga

SEQ ID NO: 905640 - RNA, 22 nt, Human
acacauguucaagaauguucag

SEQ ID NO: 905641 - RNA, 22 nt, Human
acacugugcagauucccuguga

SEQ ID NO: 905642 - RNA, 22 nt, Human
aauugcuuaguugcaacuaugc

SEQ ID NO: 905643 - RNA, 21 nt, Human
ucuggggaagacaucuaggau

SEQ ID NO: 905644 - RNA, 22 nt, Human
cucccugcuuguuucccuucag

SEQ ID NO: 905645 - RNA, 22 nt, Human
agcuugggcaacacagcaagac

SEQ ID NO: 905646 - RNA, 22 nt, Human
aucuacagugcacaggacagcc

SEQ ID NO: 905647 - RNA, 22 nt, Human
agcugcuuguugaaauccaaac

SEQ ID NO: 905648 - RNA, 22 nt, Human
uggcacagagggacccagcagc

SEQ ID NO: 905649 - RNA, 22 nt, Human
uuggggaguuaaugccaaagau

SEQ ID NO: 905650 - RNA, 22 nt, Human
gcugcagagggaggggcucgca

SEQ ID NO: 905651 - RNA, 22 nt, Human
gcucugggaaguccuuuaccau

SEQ ID NO: 905652 - RNA, 22 nt, Human
gagagggcuggaaacuuccugg

SEQ ID NO: 905653 - RNA, 22 nt, Human
aauguguagcagaaccaggauu

SEQ ID NO: 905654 - RNA, 22 nt, Human
cagugcuggcuguuaggacagu

SEQ ID NO: 905655 - RNA, 22 nt, Human
gucccaggucccagcacaucug

SEQ ID NO: 905656 - RNA, 22 nt, Human
aaaugccucauuuucucucacu

SEQ ID NO: 905657 - RNA, 22 nt, Human
uuagaaguucaggucuguaauc

SEQ ID NO: 905658 - RNA, 22 nt, Human
uguacauuuucucagaguuuau

SEQ ID NO: 905659 - RNA, 22 nt, Human
uuacuuuaucuccuagauucca

SEQ ID NO: 905660 - RNA, 22 nt, Human
cugagccagagggagucggguc

SEQ ID NO: 905661 - RNA, 22 nt, Human
aucacaaucuucaaaucgauuc

SEQ ID NO: 905662 - RNA, 22 nt, Human
guuuuggcagccguguucacau

SEQ ID NO: 905663 - RNA, 22 nt, Human
cugagcgacaaguagcuuuuga

SEQ ID NO: 905664 - RNA, 22 nt, Human
aaucacagaguccagcagauga

SEQ ID NO: 905665 - RNA, 22 nt, Human
uggcagagucugggcuugggca

SEQ ID NO: 905666 - RNA, 22 nt, Human
ccuugaaaccacaucuuagaaa

SEQ ID NO: 905667 - RNA, 22 nt, Human
aauuuucugccuagcaaaaacu

SEQ ID NO: 905668 - RNA, 22 nt, Human
ucucuagagcaugugcugggca

SEQ ID NO: 905669 - RNA, 21 nt, Human
uguuuaauacauauuugugga

SEQ ID NO: 905670 - RNA, 17 nt, Human
cagguauuuaggcauug

SEQ ID NO: 905671 - RNA, 22 nt, Human
aggaggaacucagaaagaaggu

SEQ ID NO: 905672 - RNA, 22 nt, Human
gggcccuggggccugauuugca

SEQ ID NO: 905673 - RNA, 22 nt, Human
gcuggcagcauuagacccuggg

SEQ ID NO: 905674 - RNA, 22 nt, Human
aggcauucaacaaauguuugug

SEQ ID NO: 905675 - RNA, 22 nt, Human
aaaagauuguuagggagaaugu

SEQ ID NO: 905676 - RNA, 22 nt, Human
caacauuugugaugagcaaacu

SEQ ID NO: 905677 - RNA, 22 nt, Human
gggcugugcugaguaggaggug

SEQ ID NO: 905678 - RNA, 22 nt, Human
ggcuggagaagggugguugaca

SEQ ID NO: 905679 - RNA, 22 nt, Human
aauacgucugaaugcauucuca

SEQ ID NO: 905680 - RNA, 22 nt, Human
uguuacaguggcuuuuuaaaca

SEQ ID NO: 905681 - RNA, 22 nt, Human
aaaggaagaugccaggacucug

SEQ ID NO: 905682 - RNA, 22 nt, Human
gcagugaaucuggcaagaauuu

SEQ ID NO: 905683 - RNA, 22 nt, Human
auuucaguauuauacaacugcu

SEQ ID NO: 905684 - RNA, 22 nt, Human
ugaggcagauauuuauuggguu

SEQ ID NO: 905685 - RNA, 22 nt, Human
uuuuugaaggcugaugugauua

SEQ ID NO: 905686 - RNA, 22 nt, Human
guucaaagcuccugguacagua

SEQ ID NO: 905687 - RNA, 22 nt, Human
cugcugugagugguucuugccu

SEQ ID NO: 905688 - RNA, 22 nt, Human
acugaacagccuuucaaacuua

SEQ ID NO: 905689 - RNA, 22 nt, Human
aguaaacuguggguacagaugu

SEQ ID NO: 905690 - RNA, 18 nt, Human
uggcagcuagguaaagaa

SEQ ID NO: 905691 - RNA, 22 nt, Human
aaaguccuguuugaaggaccug

SEQ ID NO: 905692 - RNA, 22 nt, Human
uggaaggcugugauuacugugc

SEQ ID NO: 905693 - RNA, 22 nt, Human
ugacagaacagguugggagcaa

SEQ ID NO: 905694 - RNA, 22 nt, Human
gugugugugcauauaacauaua

SEQ ID NO: 905695 - RNA, 22 nt, Human
cucuuucucgccgcccgcaguc

SEQ ID NO: 905696 - RNA, 22 nt, Human
gugcaaugucugugauaugaaa

SEQ ID NO: 905697 - RNA, 19 nt, Human
gaggcaaggaguuuaagcc

SEQ ID NO: 905698 - RNA, 22 nt, Human
ggccuggcccucccggguucaa

SEQ ID NO: 905699 - RNA, 22 nt, Human
ggcuggcucuuaccgacagcgu

SEQ ID NO: 905700 - RNA, 22 nt, Human
uggcagcacauugacccgggcu

SEQ ID NO: 905701 - RNA, 21 nt, Human
uccugggagucugagauccug

SEQ ID NO: 905702 - RNA, 22 nt, Human
gucuccugagccuugacugcaa

SEQ ID NO: 905703 - RNA, 22 nt, Human
ggauuuccucuugacucuaaag

SEQ ID NO: 905704 - RNA, 22 nt, Human
ugucaccagcugcuccucagga

SEQ ID NO: 905705 - RNA, 22 nt, Human
ggggcugcucccaccccugagg

SEQ ID NO: 905706 - RNA, 18 nt, Human
cuuccucuucuggagaaa

SEQ ID NO: 905707 - RNA, 22 nt, Human
ggaguuccagaaucugcuuuuu

SEQ ID NO: 905708 - RNA, 22 nt, Human
ggcagagcuaguggcuucucuu

SEQ ID NO: 905709 - RNA, 23 nt, Human
agagccuuuucacacuucaaugu

SEQ ID NO: 905710 - RNA, 22 nt, Human
ucauacauaaauaagaguuuag

SEQ ID NO: 905711 - RNA, 19 nt, Human
acaugcaaggcaccugcag

SEQ ID NO: 905712 - RNA, 22 nt, Human
ggagagggggcucccugcuugg

SEQ ID NO: 905713 - RNA, 22 nt, Human
aaagaggcucaaggugggccag

SEQ ID NO: 905714 - RNA, 22 nt, Human
cagcugagaagugauagcugca

SEQ ID NO: 905715 - RNA, 22 nt, Human
agcugcagcuuccuaguccagc

SEQ ID NO: 905716 - RNA, 23 nt, Human
cuggcccuggcucugugaucaug

SEQ ID NO: 905717 - RNA, 22 nt, Human
aacauuuuuaagaccaagugcu

SEQ ID NO: 905718 - RNA, 22 nt, Human
acacacaugccuuuccuaagua

SEQ ID NO: 905719 - RNA, 22 nt, Human
augcauauugauuauagauuca

SEQ ID NO: 905720 - RNA, 22 nt, Human
caugccaggacucuggaggcuu

SEQ ID NO: 905721 - RNA, 22 nt, Human
aauucugaaagauuccuuauuc

SEQ ID NO: 905722 - RNA, 22 nt, Human
aauacugcccccacucugccca

SEQ ID NO: 905723 - RNA, 22 nt, Human
auauaguaagcagucuguaaau

SEQ ID NO: 905724 - RNA, 22 nt, Human
ucuguucauacagaguauagua

SEQ ID NO: 905725 - RNA, 22 nt, Human
augacauuuauacagugagcuu

SEQ ID NO: 905726 - RNA, 22 nt, Human
aaccaggaauugcagggcugca

SEQ ID NO: 905727 - RNA, 22 nt, Human
cugggcugucaguuuuguuuua

SEQ ID NO: 905728 - RNA, 22 nt, Human
auucuagccaaccaucugagau

SEQ ID NO: 905729 - RNA, 22 nt, Human
acagaagaaguucaaggugaag

SEQ ID NO: 905730 - RNA, 22 nt, Human
ucaugacaacuugcacaguuuu

SEQ ID NO: 905731 - RNA, 22 nt, Human
aaacaaauuucaagcugugaca

SEQ ID NO: 905732 - RNA, 22 nt, Human
aaauaaagguccacuuuagggc

SEQ ID NO: 905733 - RNA, 22 nt, Human
ugugcgugauggaccgggccug

SEQ ID NO: 905734 - RNA, 21 nt, Human
uggaaugaggcugagcagugc

SEQ ID NO: 905735 - RNA, 22 nt, Human
gcugguccacucccuggaggcu

SEQ ID NO: 905736 - RNA, 22 nt, Human
ugaggcacuccaggaugcuguu

SEQ ID NO: 905737 - RNA, 22 nt, Human
ugauggggaauuaauuaauggg

SEQ ID NO: 905738 - RNA, 22 nt, Human
gcccugcccugagccguagacc

SEQ ID NO: 905739 - RNA, 22 nt, Human
ugcaggggcuugucugggccug

SEQ ID NO: 905740 - RNA, 22 nt, Human
cacugaguucccugacauuuca

SEQ ID NO: 905741 - RNA, 19 nt, Human
ucagcuggcaggccuccuc

SEQ ID NO: 905742 - RNA, 22 nt, Human
uucauucuuugaaucugaggua

SEQ ID NO: 905743 - RNA, 22 nt, Human
gggauaggagauugggaguguu

SEQ ID NO: 905744 - RNA, 20 nt, Human
agaaggcuccuuuugccaag

SEQ ID NO: 905745 - RNA, 22 nt, Human
gugagugccaggugaaguaugu

SEQ ID NO: 905746 - RNA, 22 nt, Human
acagcagcuaaaggugucuccu

SEQ ID NO: 905747 - RNA, 22 nt, Human
gugacaauauuagcucaggggc

SEQ ID NO: 905748 - RNA, 22 nt, Human
cagcuguugacugguacaugaa

SEQ ID NO: 905749 - RNA, 17 nt, Human
uucugcaugugaagaug

SEQ ID NO: 905750 - RNA, 22 nt, Human
caaaguauauuucauagucuca

SEQ ID NO: 905751 - RNA, 22 nt, Human
cucugauuuccuuauucuguca

SEQ ID NO: 905752 - RNA, 22 nt, Human
uccagcuggggacaugggcuuc

SEQ ID NO: 905753 - RNA, 22 nt, Human
ucugugcaagaccaacuuucaa

SEQ ID NO: 905754 - RNA, 22 nt, Human
ggcgccagcacugcagcgccuc

SEQ ID NO: 905755 - RNA, 22 nt, Human
ugaggccagccacagccacccu

SEQ ID NO: 905756 - RNA, 22 nt, Human
uucucucugagagcaucuggaa

SEQ ID NO: 905757 - RNA, 22 nt, Human
gcagggacaccuuugugaagcu

SEQ ID NO: 905758 - RNA, 22 nt, Human
ugggcaggugcuauuuuccaug

SEQ ID NO: 905759 - RNA, 18 nt, Human
acacugcagcagucugcu

SEQ ID NO: 905760 - RNA, 22 nt, Human
caacaaguggguacuuuacagg

SEQ ID NO: 905761 - RNA, 22 nt, Human
ccugagcaucagcgccuccuua

SEQ ID NO: 905762 - RNA, 19 nt, Human
ggcuccuggggcucagccc

SEQ ID NO: 905763 - RNA, 22 nt, Human
ccaugugcuugcucuggcaccu

SEQ ID NO: 905764 - RNA, 22 nt, Human
ccaaggaggccccaggucagcu

SEQ ID NO: 905765 - RNA, 22 nt, Human
acuuaucaguugucucuaaugu

SEQ ID NO: 905766 - RNA, 19 nt, Human
aucuagauuauugagaagg

SEQ ID NO: 905767 - RNA, 22 nt, Human
aacuuaaacaagcucccaaguu

SEQ ID NO: 905768 - RNA, 19 nt, Human
ggacacccuaucaauaccu

SEQ ID NO: 905769 - RNA, 22 nt, Human
gagcuuggugaugccuccuggu

SEQ ID NO: 905770 - RNA, 22 nt, Human
ucaguguaaguuauguagaugu

SEQ ID NO: 905771 - RNA, 22 nt, Human
auacagguggaacuaaauaaau

SEQ ID NO: 905772 - RNA, 22 nt, Human
aguguucagugauugucaaccg

SEQ ID NO: 905773 - RNA, 22 nt, Human
uacauugaaaucaauggaugug

SEQ ID NO: 905774 - RNA, 22 nt, Human
auaaaaucagaguuggauugga

SEQ ID NO: 905775 - RNA, 22 nt, Human
auuuucauuuugcagggugaga

SEQ ID NO: 905776 - RNA, 22 nt, Human
ggggaaggaaaguuauuagcag

SEQ ID NO: 905777 - RNA, 22 nt, Human
ugcagugguugagagcccagac

SEQ ID NO: 905778 - RNA, 22 nt, Human
augugcucacccuauuuaugga

SEQ ID NO: 905779 - RNA, 22 nt, Human
cugaugaccuuggcaagucaca

SEQ ID NO: 905780 - RNA, 22 nt, Human
gaugucuuucugugugccuaga

SEQ ID NO: 905781 - RNA, 22 nt, Human
augagacuugagggccucaagu

SEQ ID NO: 905782 - RNA, 22 nt, Human
ucauuucacuucucuagggaga

SEQ ID NO: 905783 - RNA, 22 nt, Human
guggcagguuauaagcaucuca

SEQ ID NO: 905784 - RNA, 22 nt, Human
augcauggucugaagucaaccu

SEQ ID NO: 905785 - RNA, 22 nt, Human
uaagagcauuguaaaauaaucu

SEQ ID NO: 905786 - RNA, 22 nt, Human
uuggauacagaugaaaggaagg

SEQ ID NO: 905787 - RNA, 22 nt, Human
aggcuggagcaagggggcauau

SEQ ID NO: 905788 - RNA, 22 nt, Human
auugcuucaacuguucaauggg

SEQ ID NO: 905789 - RNA, 22 nt, Human
ugccuccauguuucagcaucua

SEQ ID NO: 905790 - RNA, 22 nt, Human
aggccagccucaggcagggacc

SEQ ID NO: 905791 - RNA, 22 nt, Human
acaguguucacuaagguuagcu

SEQ ID NO: 905792 - RNA, 22 nt, Human
uaagcauaagauacaugagaca

SEQ ID NO: 905793 - RNA, 22 nt, Human
aaggagcgcuuagggggcagaa

SEQ ID NO: 905794 - RNA, 22 nt, Human
ggcagucuuucccuugagcucu

SEQ ID NO: 905795 - RNA, 19 nt, Human
cuucuagaccuuauaccac

SEQ ID NO: 905796 - RNA, 22 nt, Human
uuugggaacucuaucauggaaa

SEQ ID NO: 905797 - RNA, 23 nt, Human
uugcacaguguauacacauauuu

SEQ ID NO: 905798 - RNA, 22 nt, Human
auucaaguaaacacugaaggaa

SEQ ID NO: 905799 - RNA, 19 nt, Human
acauggcaucccaggaggu

SEQ ID NO: 905800 - RNA, 22 nt, Human
uggccuccccuaacagccucuu

SEQ ID NO: 905801 - RNA, 22 nt, Human
guguuauuugagugggagcgug

SEQ ID NO: 905802 - RNA, 23 nt, Human
aagagcagggaauauuuauuugc

SEQ ID NO: 905803 - RNA, 22 nt, Human
acccugucuucccugggcauca

SEQ ID NO: 905804 - RNA, 22 nt, Human
cacagcuucaguuucugacuug

SEQ ID NO: 905805 - RNA, 22 nt, Human
uguuaacuaauggucuaacauu

SEQ ID NO: 905806 - RNA, 17 nt, Human
cccuuagagcaaaagau

SEQ ID NO: 905807 - RNA, 22 nt, Human
cuucauguucuuggugaaaggc

SEQ ID NO: 905808 - RNA, 23 nt, Human
uggucccugagagcuggggaggg

SEQ ID NO: 905809 - RNA, 22 nt, Human
cuuuucuucucacggcugucag

SEQ ID NO: 905810 - RNA, 22 nt, Human
aggugaguuacaggaggagguc

SEQ ID NO: 905811 - RNA, 22 nt, Human
ccacggccacccgcucaugggc

SEQ ID NO: 905812 - RNA, 22 nt, Human
ggcauagauuucuuuagguuua

SEQ ID NO: 905813 - RNA, 22 nt, Human
augguauucucagcaccuagca

SEQ ID NO: 905814 - RNA, 22 nt, Human
aaagaugaccguaugucagagc

SEQ ID NO: 905815 - RNA, 22 nt, Human
uaauacuuugaaugagagcuaa

SEQ ID NO: 905816 - RNA, 22 nt, Human
cauguaucccuaauuguguuaa

SEQ ID NO: 905817 - RNA, 22 nt, Human
gcugccaggggcagcugucuca

SEQ ID NO: 905818 - RNA, 22 nt, Human
aaucuggagagucaucucugac

SEQ ID NO: 905819 - RNA, 22 nt, Human
gugggcaggaggcccugcccug

SEQ ID NO: 905820 - RNA, 22 nt, Human
cuuuagaaggguaacggaauua

SEQ ID NO: 905821 - RNA, 22 nt, Human
uuugcaaacggcccugaguccc

SEQ ID NO: 905822 - RNA, 22 nt, Human
aacaucuguguuugaaucucaa

SEQ ID NO: 905823 - RNA, 22 nt, Human
agugacagcugggaaggugaaa

SEQ ID NO: 905824 - RNA, 22 nt, Human
cuuuuaaugagcauugcugucu

SEQ ID NO: 905825 - RNA, 20 nt, Human
uuugcgaggccaaggcgggc

SEQ ID NO: 905826 - RNA, 22 nt, Human
uuauuauugugaccugagaaug

SEQ ID NO: 905827 - RNA, 22 nt, Human
aaaugauguggagugaaauugu

SEQ ID NO: 905828 - RNA, 22 nt, Human
ugugggaaugcugaugggaucu

SEQ ID NO: 905829 - RNA, 22 nt, Human
aaacauagauaauagauagaug

SEQ ID NO: 905830 - RNA, 22 nt, Human
guggugcaggaagcaucuggcu

SEQ ID NO: 905831 - RNA, 22 nt, Human
agggagcagggcuccuuugggu

SEQ ID NO: 905832 - RNA, 22 nt, Human
ucagagauggaguuagcaguga

SEQ ID NO: 905833 - RNA, 22 nt, Human
uguucuggagauaagagguaga

SEQ ID NO: 905834 - RNA, 22 nt, Human
caucaagucaucaaagaauuca

SEQ ID NO: 905835 - RNA, 22 nt, Human
guacacauagguuacugauuaa

SEQ ID NO: 905836 - RNA, 22 nt, Human
cugcagcuccucucugugcccc

SEQ ID NO: 905837 - RNA, 22 nt, Human
caggcagaggaagucugggucu

SEQ ID NO: 905838 - RNA, 22 nt, Human
aaggacagaaacagauugcugg

SEQ ID NO: 905839 - RNA, 22 nt, Human
uggaaccuggccugagcuacca

SEQ ID NO: 905840 - RNA, 22 nt, Human
ucuuagaaguucauguuccagc

SEQ ID NO: 905841 - RNA, 22 nt, Human
gaggagcacaugaggcugaggg

SEQ ID NO: 905842 - RNA, 22 nt, Human
ugccaggcccucccacagauua

SEQ ID NO: 905843 - RNA, 22 nt, Human
uggccagccauaaaagaaccca

SEQ ID NO: 905844 - RNA, 22 nt, Human
auggacagguggauagguggau

SEQ ID NO: 905845 - RNA, 22 nt, Human
caggaagggggauccuuggaag

SEQ ID NO: 905846 - RNA, 22 nt, Human
aaaugcuguaacugauauucug

SEQ ID NO: 905847 - RNA, 22 nt, Human
uccuggggaggucgaggcugag

SEQ ID NO: 905848 - RNA, 22 nt, Human
aauauauagaaguacccguugu

SEQ ID NO: 905849 - RNA, 22 nt, Human
uugugaguagugccgcaauaaa

SEQ ID NO: 905850 - RNA, 22 nt, Human
gccugggaaagaguagggaaau

SEQ ID NO: 905851 - RNA, 22 nt, Human
cacuguaauggaauuuucuuua

SEQ ID NO: 905852 - RNA, 22 nt, Human
uuccacaauguaugaauaagau

SEQ ID NO: 905853 - RNA, 22 nt, Human
gagagggccgggggccagcucc

SEQ ID NO: 905854 - RNA, 22 nt, Human
agcacagagagcucuagguaaa

SEQ ID NO: 905855 - RNA, 22 nt, Human
acagaguacauucagagacuau

SEQ ID NO: 905856 - RNA, 22 nt, Human
ugggcugcggauaggccucgga

SEQ ID NO: 905857 - RNA, 22 nt, Human
augucacagcaggaguauucuu

SEQ ID NO: 905858 - RNA, 22 nt, Human
uguacacaaccuacagucugcu

SEQ ID NO: 905859 - RNA, 22 nt, Human
acagagucucaaaccuacaaag

SEQ ID NO: 905860 - RNA, 22 nt, Human
agcauuuaguuaguaaauguuu

SEQ ID NO: 905861 - RNA, 22 nt, Human
agcucugggguggagcccagga

SEQ ID NO: 905862 - RNA, 22 nt, Human
guggaagaggcaagauagcucu

SEQ ID NO: 905863 - RNA, 22 nt, Human
gagaggcaggcgcugcaauggu

SEQ ID NO: 905864 - RNA, 22 nt, Human
cccaggaccgcgcggcugagcg

SEQ ID NO: 905865 - RNA, 22 nt, Human
guggcugacaaccacuggagga

SEQ ID NO: 905866 - RNA, 22 nt, Human
ucacagagagguuaagcaguug

SEQ ID NO: 905867 - RNA, 22 nt, Human
ccuuuggcccugagagaugauu

SEQ ID NO: 905868 - RNA, 22 nt, Human
cuggcaggagcuguggccguag

SEQ ID NO: 905869 - RNA, 22 nt, Human
uaaguauuggccuauagcuaga

SEQ ID NO: 905870 - RNA, 22 nt, Human
cacagagagcuacgugcagcgu

SEQ ID NO: 905871 - RNA, 22 nt, Human
aauuauauugaaguugaauguc

SEQ ID NO: 905872 - RNA, 22 nt, Human
ggccucugcuuaugcugaugac

SEQ ID NO: 905873 - RNA, 22 nt, Human
cugagcaggacagugggagacc

SEQ ID NO: 905874 - RNA, 22 nt, Human
aaguacuaaggcuauuaugaug

SEQ ID NO: 905875 - RNA, 22 nt, Human
agcccuccaucugugcucaggc

SEQ ID NO: 905876 - RNA, 22 nt, Human
aaaguguaggcuucaaagaggg

SEQ ID NO: 905877 - RNA, 22 nt, Human
acagaggccccgugggagagcc

SEQ ID NO: 905878 - RNA, 22 nt, Human
cucacaggucaugugguggcuu

SEQ ID NO: 905879 - RNA, 22 nt, Human
ugauuagauugagucaaccuug

SEQ ID NO: 905880 - RNA, 18 nt, Human
ugaacacaguacaauucc

SEQ ID NO: 905881 - RNA, 22 nt, Human
ggaaaguggugguggaaagagg

SEQ ID NO: 905882 - RNA, 17 nt, Human
gcugagaaggggaagag

SEQ ID NO: 905883 - RNA, 22 nt, Human
auacuucuagaaauacuaugca

SEQ ID NO: 905884 - RNA, 22 nt, Human
gcaccugcuggaaucagucugu

SEQ ID NO: 905885 - RNA, 22 nt, Human
cccaguuguugccggcucugga

SEQ ID NO: 905886 - RNA, 22 nt, Human
uauuucagucacuucuucucug

SEQ ID NO: 905887 - RNA, 22 nt, Human
gccugggauuguguaagugaau

SEQ ID NO: 905888 - RNA, 22 nt, Human
gacuccagaaucuggacggucc

SEQ ID NO: 905889 - RNA, 22 nt, Human
uguuccugaaugccuggcuggc

SEQ ID NO: 905890 - RNA, 22 nt, Human
cagggugacaaguggcaaggag

SEQ ID NO: 905891 - RNA, 22 nt, Human
cccccaccguguuccugcucgg

SEQ ID NO: 905892 - RNA, 22 nt, Human
cauuccuauuaugucccuagug

SEQ ID NO: 905893 - RNA, 22 nt, Human
uuugcuaaugccucugaaauca

SEQ ID NO: 905894 - RNA, 22 nt, Human
uucccacacccauauugugauu

SEQ ID NO: 905895 - RNA, 22 nt, Human
gaguugaagaaauaguuuugau

SEQ ID NO: 905896 - RNA, 22 nt, Human
uacaucugauuuaccuacugaa

SEQ ID NO: 905897 - RNA, 22 nt, Human
caugugugaagacugcgggcca

SEQ ID NO: 905898 - RNA, 22 nt, Human
cauguuucugagaaaaguagga

SEQ ID NO: 905899 - RNA, 22 nt, Human
ggaggacaggggcugcagcaca

SEQ ID NO: 905900 - RNA, 22 nt, Human
ugagucacauccauuuuugugu

SEQ ID NO: 905901 - RNA, 22 nt, Human
ucuuuauggaaaaugaauggca

SEQ ID NO: 905902 - RNA, 22 nt, Human
ucugccugccagucugguccuc

SEQ ID NO: 905903 - RNA, 22 nt, Human
gauaccagacagggagggagaa

SEQ ID NO: 905904 - RNA, 22 nt, Human
augcuaaacuaugaucauuuuc

SEQ ID NO: 905905 - RNA, 22 nt, Human
agcaucuguuaagugccuucaa

SEQ ID NO: 905906 - RNA, 22 nt, Human
agucugugcuguuggugaggau

SEQ ID NO: 905907 - RNA, 22 nt, Human
uuacacacaauuagcauaguaa

SEQ ID NO: 905908 - RNA, 22 nt, Human
ugucuucuucauaaggagagug

SEQ ID NO: 905909 - RNA, 22 nt, Human
gucccagaaacauauugcuggu

SEQ ID NO: 905910 - RNA, 22 nt, Human
aaaugucuuugaguauuucugc

SEQ ID NO: 905911 - RNA, 22 nt, Human
gcgggcagggcacugguccccu

SEQ ID NO: 905912 - RNA, 22 nt, Human
ccaagagguugaggcugcagug

SEQ ID NO: 905913 - RNA, 22 nt, Human
acauggcacccagaucucaaaa

SEQ ID NO: 905914 - RNA, 22 nt, Human
gacagacauuuccugauccaau

SEQ ID NO: 905915 - RNA, 22 nt, Human
uucaucuggaauuuauguuaua

SEQ ID NO: 905916 - RNA, 22 nt, Human
uauguagacaggcugcuuuucc

SEQ ID NO: 905917 - RNA, 22 nt, Human
gcuggggagcaagaguagugag

SEQ ID NO: 905918 - RNA, 22 nt, Human
ucccaggaaggauucggcauuu

SEQ ID NO: 905919 - RNA, 22 nt, Human
gcauuacacauagacauucguu

SEQ ID NO: 905920 - RNA, 22 nt, Human
cuuucaugaacagacaaggaac

SEQ ID NO: 905921 - RNA, 22 nt, Human
auucugagacaauugccgucag

SEQ ID NO: 905922 - RNA, 22 nt, Human
aaguugaaucaguaacacaguu

SEQ ID NO: 905923 - RNA, 22 nt, Human
gcagcuguacuggcagcauugu

SEQ ID NO: 905924 - RNA, 22 nt, Human
aauguauuugauguauuagccu

SEQ ID NO: 905925 - RNA, 22 nt, Human
ucauuuuucucuuacacguaga

SEQ ID NO: 905926 - RNA, 22 nt, Human
cuccugggagucuuccuggaug

SEQ ID NO: 905927 - RNA, 22 nt, Human
ccagcugugccggggaccuggg

SEQ ID NO: 905928 - RNA, 21 nt, Human
uccaggggccagcacccaagc

SEQ ID NO: 905929 - RNA, 22 nt, Human
ccugagguggcugcagcacugc

SEQ ID NO: 905930 - RNA, 22 nt, Human
ugcagagugggagaggugcggg

SEQ ID NO: 905931 - RNA, 22 nt, Human
aggaggcaggaagucuauggga

SEQ ID NO: 905932 - RNA, 22 nt, Human
gcaggugggggucggugcaucu

SEQ ID NO: 905933 - RNA, 22 nt, Human
aagugcaggucucagcuacucu

SEQ ID NO: 905934 - RNA, 22 nt, Human
cuaacuuugucaucuucccuuu

SEQ ID NO: 905935 - RNA, 22 nt, Human
ugggccacuugaaaguggaugu

SEQ ID NO: 905936 - RNA, 22 nt, Human
agacagcauuucccggaaccgc

SEQ ID NO: 905937 - RNA, 22 nt, Human
cugccugaguggaggucgaggg

SEQ ID NO: 905938 - RNA, 22 nt, Human
acacagaguccuuacugaggua

SEQ ID NO: 905939 - RNA, 22 nt, Human
caaaauuagaaaugcagcuguu

SEQ ID NO: 905940 - RNA, 22 nt, Human
guuaaauaaccucauguccguu

SEQ ID NO: 905941 - RNA, 22 nt, Human
auuucccaggacuagaaauaua

SEQ ID NO: 905942 - RNA, 22 nt, Human
uggcagagucaucacaucugga

SEQ ID NO: 905943 - RNA, 22 nt, Human
accuggacaccugcugucaucu

SEQ ID NO: 905944 - RNA, 22 nt, Human
guggccagaaccaggagaauga

SEQ ID NO: 905945 - RNA, 23 nt, Human
gcaggaguuccuggacuccagga

SEQ ID NO: 905946 - RNA, 22 nt, Human
agcuaagacuuagugacuuagu

SEQ ID NO: 905947 - RNA, 22 nt, Human
aaggaugucagucauuuuggau

SEQ ID NO: 905948 - RNA, 22 nt, Human
cucuggccugcagauccaugcu

SEQ ID NO: 905949 - RNA, 22 nt, Human
ucagccaggcacaauggcagcu

SEQ ID NO: 905950 - RNA, 22 nt, Human
uggaaggcuuugcuguccuugc

SEQ ID NO: 905951 - RNA, 22 nt, Human
uagaaagacaaugggaagugcu

SEQ ID NO: 905952 - RNA, 22 nt, Human
ggagcugaugacgucaccaugg

SEQ ID NO: 905953 - RNA, 22 nt, Human
cagacagaccugcaagggcaca

SEQ ID NO: 905954 - RNA, 22 nt, Human
gcccaaagccagugugcucucc

SEQ ID NO: 905955 - RNA, 22 nt, Human
uggcaggugccaugggcucaga

SEQ ID NO: 905956 - RNA, 18 nt, Human
cucuagaaugggagauuu

SEQ ID NO: 905957 - RNA, 22 nt, Human
aguagacaugagcaaugauaau

SEQ ID NO: 905958 - RNA, 22 nt, Human
gaggauguaaaauagacaaaau

SEQ ID NO: 905959 - RNA, 22 nt, Human
aggcccuggcacugccugggag

SEQ ID NO: 905960 - RNA, 22 nt, Human
ccaauguuuauuuuccugcugc

SEQ ID NO: 905961 - RNA, 20 nt, Human
ugacaguuucauaugguuca

SEQ ID NO: 905962 - RNA, 22 nt, Human
aaagaucuaugggcauuuagcu

SEQ ID NO: 905963 - RNA, 22 nt, Human
aagagcagauuccuaguggagc

SEQ ID NO: 905964 - RNA, 22 nt, Human
aaguaucucaaaaacaguaauc

SEQ ID NO: 905965 - RNA, 22 nt, Human
ggcugccuccacugcuuguccc

SEQ ID NO: 905966 - RNA, 22 nt, Human
ccuuuccccgcgggaggugcca

SEQ ID NO: 905967 - RNA, 22 nt, Human
gucuagaaauguucucaggggu

SEQ ID NO: 905968 - RNA, 19 nt, Human
ccauuguaaagaaaaaugu

SEQ ID NO: 905969 - RNA, 22 nt, Human
caugcagaggugccacgaggcu

SEQ ID NO: 905970 - RNA, 22 nt, Human
gcauacaguccuuguauucuuc

SEQ ID NO: 905971 - RNA, 22 nt, Human
aguacagcaccaugagcacagg

SEQ ID NO: 905972 - RNA, 22 nt, Human
uaguauuuaaucacuuuugucu

SEQ ID NO: 905973 - RNA, 22 nt, Human
uccuuccugcaggccaaguccu

SEQ ID NO: 905974 - RNA, 22 nt, Human
ugagcagcuacuguguucaggg

SEQ ID NO: 905975 - RNA, 22 nt, Human
ucccagccacaguuuccaccug

SEQ ID NO: 905976 - RNA, 22 nt, Human
cugcucugugcacuuguucagg

SEQ ID NO: 905977 - RNA, 22 nt, Human
aaaacguuaugcauuguuuauc

SEQ ID NO: 905978 - RNA, 22 nt, Human
uuucacuguguuggucaggccg

SEQ ID NO: 905979 - RNA, 22 nt, Human
gguucucuuccuccugacugag

SEQ ID NO: 905980 - RNA, 22 nt, Human
aggcacaaaagcagggugacca

SEQ ID NO: 905981 - RNA, 22 nt, Human
uuucauagucaaguguguauga

SEQ ID NO: 905982 - RNA, 22 nt, Human
gcugggcucagaccuagugaac

SEQ ID NO: 905983 - RNA, 22 nt, Human
ucuucaauauguguuuaauauu

SEQ ID NO: 905984 - RNA, 22 nt, Human
acugccuggccuggccucacug

SEQ ID NO: 905985 - RNA, 22 nt, Human
gauuucuucauucauuagaugg

SEQ ID NO: 905986 - RNA, 22 nt, Human
uccacagaauggaauucuccgc

SEQ ID NO: 905987 - RNA, 22 nt, Human
ggcaggcauuagagauucccag

SEQ ID NO: 905988 - RNA, 22 nt, Human
gagcaaggaugggucuauagua

SEQ ID NO: 905989 - RNA, 22 nt, Human
ucucacugauuugagaccaagg

SEQ ID NO: 905990 - RNA, 22 nt, Human
guuucuuagacagacauuaucu

SEQ ID NO: 905991 - RNA, 23 nt, Human
ggccauggagacuuagaaugggc

SEQ ID NO: 905992 - RNA, 22 nt, Human
gaaggaagcugucuggaugugu

SEQ ID NO: 905993 - RNA, 22 nt, Human
aaugguuuugucucaucaaugu

SEQ ID NO: 905994 - RNA, 22 nt, Human
gggaacagggccugagcugggg

SEQ ID NO: 905995 - RNA, 22 nt, Human
augagcaauuaggaagaaaaca

SEQ ID NO: 905996 - RNA, 22 nt, Human
uauuagcagccaacuuagcugu

SEQ ID NO: 905997 - RNA, 21 nt, Human
agagggagaguggcccuucca

SEQ ID NO: 905998 - RNA, 22 nt, Human
agccaucacuugagaaucuauu

SEQ ID NO: 905999 - RNA, 22 nt, Human
caaggcuuaucagccaggagcc

SEQ ID NO: 906000 - RNA, 22 nt, Human
ugcccugcaugcagggagcugu

SEQ ID NO: 906001 - RNA, 22 nt, Human
aggagcaaaugaugagacagca

SEQ ID NO: 906002 - RNA, 22 nt, Human
ucacaguuacuccuucagauga

SEQ ID NO: 906003 - RNA, 22 nt, Human
gagcaaggaggguggggccuuu

SEQ ID NO: 906004 - RNA, 22 nt, Human
cugggcaguaugaauauucaaa

SEQ ID NO: 906005 - RNA, 22 nt, Human
aggaagugaaagggaaggaguu

SEQ ID NO: 906006 - RNA, 22 nt, Human
gacuuucucuccucccaggugu

SEQ ID NO: 906007 - RNA, 22 nt, Human
uuggcuucuuuagucaguuugg

SEQ ID NO: 906008 - RNA, 22 nt, Human
agauacauugcacgaugcagau

SEQ ID NO: 906009 - RNA, 22 nt, Human
agaagccacuggagguugagau

SEQ ID NO: 906010 - RNA, 22 nt, Human
uggcaauucccuuggucaacag

SEQ ID NO: 906011 - RNA, 22 nt, Human
aggccccaaagcagugcaagua

SEQ ID NO: 906012 - RNA, 22 nt, Human
acaggacagucuaguaacagua

SEQ ID NO: 906013 - RNA, 22 nt, Human
uucauuuauucagcagguauuu

SEQ ID NO: 906014 - RNA, 20 nt, Human
agggaagugcgccaucaggg

SEQ ID NO: 906015 - RNA, 22 nt, Human
uccagccuucucaaggcuggcu

SEQ ID NO: 906016 - RNA, 22 nt, Human
agcagggcuugccgcuuguccu

SEQ ID NO: 906017 - RNA, 22 nt, Human
cucucuggcccauccuguugcc

SEQ ID NO: 906018 - RNA, 22 nt, Human
gagggccauucugaggggguga

SEQ ID NO: 906019 - RNA, 22 nt, Human
auuaguuuggugcaaaaguaau

SEQ ID NO: 906020 - RNA, 22 nt, Human
gggcuccagccaggugucccca

SEQ ID NO: 906021 - RNA, 21 nt, Human
acagagaaagagcagccuccu

SEQ ID NO: 906022 - RNA, 22 nt, Human
gcacugaaugcuuuuacuguaa

SEQ ID NO: 906023 - RNA, 22 nt, Human
aaagaacaaauuagcuguuuua

SEQ ID NO: 906024 - RNA, 22 nt, Human
gagaaagauggaaucuuacagg

SEQ ID NO: 906025 - RNA, 22 nt, Human
agggaaauaaucuauucugagg

SEQ ID NO: 906026 - RNA, 22 nt, Human
ucaggcuuauagguagugguua

SEQ ID NO: 906027 - RNA, 22 nt, Human
aggugucugggcuuuggaguca

SEQ ID NO: 906028 - RNA, 22 nt, Human
gagggcucugucuggaagggaa

SEQ ID NO: 906029 - RNA, 22 nt, Human
aagugaucuaaagaauauugaa

SEQ ID NO: 906030 - RNA, 22 nt, Human
accccucagcucuucgugcccc

SEQ ID NO: 906031 - RNA, 22 nt, Human
uucuguaugcucuggguccaga

SEQ ID NO: 906032 - RNA, 22 nt, Human
ggauuuuagaguaccuaagugu

SEQ ID NO: 906033 - RNA, 22 nt, Human
ugaaucaauaguugcaaguauu

SEQ ID NO: 906034 - RNA, 22 nt, Human
auugauuugaacaaagauauua

SEQ ID NO: 906035 - RNA, 22 nt, Human
cugcaagcaaaucaacucuuug

SEQ ID NO: 906036 - RNA, 22 nt, Human
agggucaccaguucauaggcac

SEQ ID NO: 906037 - RNA, 22 nt, Human
ucucuucuuguguuuuccugcc

SEQ ID NO: 906038 - RNA, 22 nt, Human
gcggucggcagaggggcucugc

SEQ ID NO: 906039 - RNA, 22 nt, Human
ucucuggaagcgcagaucuguu

SEQ ID NO: 906040 - RNA, 22 nt, Human
gagcccuguagcaagucauguc

SEQ ID NO: 906041 - RNA, 22 nt, Human
cugggagauugcuagagaugca

SEQ ID NO: 906042 - RNA, 22 nt, Human
cuguuaaaauguggucuuaaaa

SEQ ID NO: 906043 - RNA, 22 nt, Human
cugggagaucuccugagggcag

SEQ ID NO: 906044 - RNA, 22 nt, Human
uucugcagugaaugacucaaua

SEQ ID NO: 906045 - RNA, 22 nt, Human
ucagggcauggcugcacuuggc

SEQ ID NO: 906046 - RNA, 20 nt, Human
gugccuggagaagaggcugu

SEQ ID NO: 906047 - RNA, 22 nt, Human
gagguuccagacagcuuaggga

SEQ ID NO: 906048 - RNA, 22 nt, Human
gucuauaagcaggggaaaacuu

SEQ ID NO: 906049 - RNA, 22 nt, Human
aacauuuguuucguuaugugaa

SEQ ID NO: 906050 - RNA, 22 nt, Human
aggccagcccugggcugagaga

SEQ ID NO: 906051 - RNA, 22 nt, Human
ggguaaugaacagguggcagag

SEQ ID NO: 906052 - RNA, 22 nt, Human
cugggagaggcugcuccgcucu

SEQ ID NO: 906053 - RNA, 22 nt, Human
aaaggcaguggguauguggauc

SEQ ID NO: 906054 - RNA, 22 nt, Human
gaaggccugugguagugagacg

SEQ ID NO: 906055 - RNA, 22 nt, Human
gugugagggacagagaaagggg

SEQ ID NO: 906056 - RNA, 22 nt, Human
ugcagcugauaauuacauguuc

SEQ ID NO: 906057 - RNA, 22 nt, Human
uugucaucauguuuuccaaagg

SEQ ID NO: 906058 - RNA, 22 nt, Human
ccagcugcugugaggaccacag

SEQ ID NO: 906059 - RNA, 22 nt, Human
uacaguuucccagcagaugcaa

SEQ ID NO: 906060 - RNA, 22 nt, Human
aaagucauuuagccuuaucucc

SEQ ID NO: 906061 - RNA, 22 nt, Human
cacuggauaaaaauuuggaagu

SEQ ID NO: 906062 - RNA, 22 nt, Human
auggacagauuaacacaguaga

SEQ ID NO: 906063 - RNA, 22 nt, Human
guagucuuggauuuuaaaaagu

SEQ ID NO: 906064 - RNA, 22 nt, Human
gcugggcaagugccuuggguuu

SEQ ID NO: 906065 - RNA, 22 nt, Human
ugaggcucagagaagugcuguu

SEQ ID NO: 906066 - RNA, 22 nt, Human
ugucuaaugaauuaauuaauua

SEQ ID NO: 906067 - RNA, 22 nt, Human
uucacaguggcugugccauuug

SEQ ID NO: 906068 - RNA, 22 nt, Human
ggaggccaucuggcuggaggcu

SEQ ID NO: 906069 - RNA, 22 nt, Human
auagauauuugaguuguuucca

SEQ ID NO: 906070 - RNA, 22 nt, Human
cacugccuccccaggcuccaca

SEQ ID NO: 906071 - RNA, 22 nt, Human
uacaguaacauguuguacaagc

SEQ ID NO: 906072 - RNA, 22 nt, Human
ggcagcuugcccuggucucaac

SEQ ID NO: 906073 - RNA, 22 nt, Human
cuucuuuaauguauacaaaaga

SEQ ID NO: 906074 - RNA, 22 nt, Human
guccagagccggaagagugaca

SEQ ID NO: 906075 - RNA, 22 nt, Human
aagcauuugugaaauucagaug

SEQ ID NO: 906076 - RNA, 22 nt, Human
acaugggaucaaugaggcaggc

SEQ ID NO: 906077 - RNA, 22 nt, Human
aaagcuuagcauuuucaaaaug

SEQ ID NO: 906078 - RNA, 22 nt, Human
cagcagcucccauccgcugagc

SEQ ID NO: 906079 - RNA, 22 nt, Human
aaaauuuccaccaucuuugugu

SEQ ID NO: 906080 - RNA, 22 nt, Human
uguaaugaaaaggaggaaauag

SEQ ID NO: 906081 - RNA, 22 nt, Human
uccauuauacuucugauucaaa

SEQ ID NO: 906082 - RNA, 22 nt, Human
gggcaguugauggaggucugga

SEQ ID NO: 906083 - RNA, 22 nt, Human
gccucacugcagccccaggaag

SEQ ID NO: 906084 - RNA, 22 nt, Human
uguugcaguaaaaauggagagg

SEQ ID NO: 906085 - RNA, 22 nt, Human
uccagugaucuagggagcugga

SEQ ID NO: 906086 - RNA, 22 nt, Human
agcagggagaccaucucuuccu

SEQ ID NO: 906087 - RNA, 22 nt, Human
uucugucugauggugccagaac

SEQ ID NO: 906088 - RNA, 22 nt, Human
acccagcccagaaucuggggcc

SEQ ID NO: 906089 - RNA, 22 nt, Human
cagcuagggaguggcagagcuu

SEQ ID NO: 906090 - RNA, 22 nt, Human
uaggaacaaguuuccuugcugu

SEQ ID NO: 906091 - RNA, 22 nt, Human
ucuagcagguggcggccagcga

SEQ ID NO: 906092 - RNA, 22 nt, Human
uguguguagaaagggcccuggu

SEQ ID NO: 906093 - RNA, 22 nt, Human
cauuauugaugcaacagcccuu

SEQ ID NO: 906094 - RNA, 15 nt, Human
gccccaggaaucaaa

SEQ ID NO: 906095 - RNA, 22 nt, Human
ucagagaguuuucacuagggug

SEQ ID NO: 906096 - RNA, 22 nt, Human
ggaugggagcagaggacgacca

SEQ ID NO: 906097 - RNA, 22 nt, Human
agccagagaacagcaggaaaug

SEQ ID NO: 906098 - RNA, 18 nt, Human
gggaggccccagcaggag

SEQ ID NO: 906099 - RNA, 21 nt, Human
uccaggcuggaaggggcguug

SEQ ID NO: 906100 - RNA, 22 nt, Human
agggaggcaggaaaguugucug

SEQ ID NO: 906101 - RNA, 22 nt, Human
cagggcaggaauuugacauugc

SEQ ID NO: 906102 - RNA, 22 nt, Human
acagugucugacacauuguagc

SEQ ID NO: 906103 - RNA, 22 nt, Human
ucagugcagcggcagcagcucu

SEQ ID NO: 906104 - RNA, 22 nt, Human
ugggacagugugccuugcuccu

SEQ ID NO: 906105 - RNA, 22 nt, Human
caggccaggguugagaagagaa

SEQ ID NO: 906106 - RNA, 21 nt, Human
gaaaagcaagggaguagaaca

SEQ ID NO: 906107 - RNA, 22 nt, Human
aaaugucauauuuaaguaggaa

SEQ ID NO: 906108 - RNA, 22 nt, Human
acaguuuggcaaaugucccaca

SEQ ID NO: 906109 - RNA, 22 nt, Human
aauaagauugacacaaguaccu

SEQ ID NO: 906110 - RNA, 22 nt, Human
uuagcaacacccauuugugugc

SEQ ID NO: 906111 - RNA, 20 nt, Human
ucacacauaagugaacgcac

SEQ ID NO: 906112 - RNA, 22 nt, Human
guccugugaccugcauccugag

SEQ ID NO: 906113 - RNA, 22 nt, Human
cagagcauaauugacaugaggu

SEQ ID NO: 906114 - RNA, 22 nt, Human
cggcuucaugagaaaugacaga

SEQ ID NO: 906115 - RNA, 22 nt, Human
aaagcagggaaaucuauuugca

SEQ ID NO: 906116 - RNA, 22 nt, Human
cuaggcugcagaugcauggaau

SEQ ID NO: 906117 - RNA, 22 nt, Human
ucuagaaaguuuguacugauuu

SEQ ID NO: 906118 - RNA, 22 nt, Human
augagguauuagcaguaacuga

SEQ ID NO: 906119 - RNA, 22 nt, Human
uugaagaacauaauagcuacuu

SEQ ID NO: 906120 - RNA, 22 nt, Human
uuucaggaaacauuuaauggca

SEQ ID NO: 906121 - RNA, 22 nt, Human
uggcagcugaauggcuggaugg

SEQ ID NO: 906122 - RNA, 22 nt, Human
cacaugugcaaauacugaggcu

SEQ ID NO: 906123 - RNA, 22 nt, Human
ucagauuuuccagccuuucucu

SEQ ID NO: 906124 - RNA, 20 nt, Human
gccagaggccggcaggggcu

SEQ ID NO: 906125 - RNA, 22 nt, Human
uuuguacauuucacuccauugu

SEQ ID NO: 906126 - RNA, 22 nt, Human
uguucacaacgugcagguuugu

SEQ ID NO: 906127 - RNA, 22 nt, Human
cccugagcuaccuauguaagca

SEQ ID NO: 906128 - RNA, 22 nt, Human
cugugcccggcccagggcccug

SEQ ID NO: 906129 - RNA, 22 nt, Human
gagaacucagacgcaggucaug

SEQ ID NO: 906130 - RNA, 22 nt, Human
acccugcuuggccccacuucua

SEQ ID NO: 906131 - RNA, 18 nt, Human
aguguucucguuuuauaa

SEQ ID NO: 906132 - RNA, 23 nt, Human
cucagggauagaaaggaagacag

SEQ ID NO: 906133 - RNA, 22 nt, Human
agacauaagcgagcaucacagg

SEQ ID NO: 906134 - RNA, 23 nt, Human
gucucccauagcgcucccaggcu

SEQ ID NO: 906135 - RNA, 22 nt, Human
uuugaucuaugcgugguuuccc

SEQ ID NO: 906136 - RNA, 21 nt, Human
guuuacaaggcuuugcuccug

SEQ ID NO: 906137 - RNA, 22 nt, Human
uacagucagagugccuuucuaa

SEQ ID NO: 906138 - RNA, 22 nt, Human
gacagggcauggugcagaguuc

SEQ ID NO: 906139 - RNA, 22 nt, Human
uuguuuuaagccagucugccua

SEQ ID NO: 906140 - RNA, 22 nt, Human
auucagacugucuaaaugguuu

SEQ ID NO: 906141 - RNA, 19 nt, Human
ccauuucauauguauugug

SEQ ID NO: 906142 - RNA, 18 nt, Human
gagcagaggcucaacugg

SEQ ID NO: 906143 - RNA, 22 nt, Human
ugcaagggguuuaugcagauga

SEQ ID NO: 906144 - RNA, 22 nt, Human
ugguuagaugaggcugguuuca

SEQ ID NO: 906145 - RNA, 22 nt, Human
cuucugauuagcaaguuuguau

SEQ ID NO: 906146 - RNA, 21 nt, Human
aacuggcagaccaacuauggc

SEQ ID NO: 906147 - RNA, 22 nt, Human
cagagagagucugucccugaag

SEQ ID NO: 906148 - RNA, 18 nt, Human
ucagagguacagaaaagu

SEQ ID NO: 906149 - RNA, 22 nt, Human
ucugccugcaguguggcagggc

SEQ ID NO: 906150 - RNA, 22 nt, Human
gcuccaggauaauaaaguuguu

SEQ ID NO: 906151 - RNA, 22 nt, Human
ccagcucugcuugcccagucag

SEQ ID NO: 906152 - RNA, 22 nt, Human
gacaagcaggcuccugaagaaa

SEQ ID NO: 906153 - RNA, 17 nt, Human
aaacugaaaaauucacu

SEQ ID NO: 906154 - RNA, 22 nt, Human
gccuagggugcucagggacgag

SEQ ID NO: 906155 - RNA, 22 nt, Human
aagcuugauuguagucuagaca

SEQ ID NO: 906156 - RNA, 22 nt, Human
uccaaggucagcgagagucacu

SEQ ID NO: 906157 - RNA, 19 nt, Human
acacauguaacaguuuuuc

SEQ ID NO: 906158 - RNA, 22 nt, Human
guuaacaaccaaacagaaguuc

SEQ ID NO: 906159 - RNA, 22 nt, Human
uacaucauggcuucaugcugca

SEQ ID NO: 906160 - RNA, 22 nt, Human
ucuggggauaagacccagguau

SEQ ID NO: 906161 - RNA, 22 nt, Human
aguggcagagguugacugcagu

SEQ ID NO: 906162 - RNA, 22 nt, Human
caucugucugcuguuagcugca

SEQ ID NO: 906163 - RNA, 22 nt, Human
cauuuguucugauuucaaaagg

SEQ ID NO: 906164 - RNA, 22 nt, Human
aaagcagcaacagcuguuagaa

SEQ ID NO: 906165 - RNA, 22 nt, Human
aauacugaauuaguugagacaa

SEQ ID NO: 906166 - RNA, 23 nt, Human
ucugggcauaucuagucacaucg

SEQ ID NO: 906167 - RNA, 22 nt, Human
acauuuuuuagagucccacauu

SEQ ID NO: 906168 - RNA, 22 nt, Human
cacauuuaaaaaauccacgauc

SEQ ID NO: 906169 - RNA, 22 nt, Human
agggccaccucucuggguuccc

SEQ ID NO: 906170 - RNA, 22 nt, Human
gcuuuaggaaugaauaaaaauc

SEQ ID NO: 906171 - RNA, 22 nt, Human
uuuccuaaggcucauuuuaaaa

SEQ ID NO: 906172 - RNA, 22 nt, Human
uauaggaaguguagugcuugga

SEQ ID NO: 906173 - RNA, 22 nt, Human
cuggagcuggcccaggcuggcc

SEQ ID NO: 906174 - RNA, 22 nt, Human
gcugcugccgcggccgcuggga

SEQ ID NO: 906175 - RNA, 22 nt, Human
cugcuccacaccuccauuuccu

SEQ ID NO: 906176 - RNA, 22 nt, Human
uuuagugcuuugcuauucaugg

SEQ ID NO: 906177 - RNA, 22 nt, Human
cuaaaauuaccuaccaguuuag

SEQ ID NO: 906178 - RNA, 22 nt, Human
ugauggcugugcugauguuagg

SEQ ID NO: 906179 - RNA, 22 nt, Human
gggcugagggguaucucauggg

SEQ ID NO: 906180 - RNA, 22 nt, Human
ggugucaguugcucaucagagu

SEQ ID NO: 906181 - RNA, 22 nt, Human
acagagacaggcagacagucuu

SEQ ID NO: 906182 - RNA, 19 nt, Human
ccagcagguucauuucagg

SEQ ID NO: 906183 - RNA, 22 nt, Human
gggcaaaauacuuauaaaggcu

SEQ ID NO: 906184 - RNA, 22 nt, Human
gggcagcaucaggaggggcuuu

SEQ ID NO: 906185 - RNA, 22 nt, Human
ggcccugcugaguggaguggag

SEQ ID NO: 906186 - RNA, 22 nt, Human
agccacagagcaggagaccuuu

SEQ ID NO: 906187 - RNA, 22 nt, Human
cucugcugcaggaaggcgugca

SEQ ID NO: 906188 - RNA, 22 nt, Human
uaguucucuauucaaggaucaa

SEQ ID NO: 906189 - RNA, 22 nt, Human
ucuggaugacagaauggucaua

SEQ ID NO: 906190 - RNA, 22 nt, Human
aaucugaauauuuauguguauu

SEQ ID NO: 906191 - RNA, 22 nt, Human
ggacugggauucuggaucugcu

SEQ ID NO: 906192 - RNA, 17 nt, Human
uggcuucaggcugagca

SEQ ID NO: 906193 - RNA, 22 nt, Human
cugcauaucaaauuacuccugg

SEQ ID NO: 906194 - RNA, 22 nt, Human
cccugcagagccagcccugacc

SEQ ID NO: 906195 - RNA, 22 nt, Human
aguauauuuugauuguaugugu

SEQ ID NO: 906196 - RNA, 22 nt, Human
auggcuggcacuggccuggguu

SEQ ID NO: 906197 - RNA, 22 nt, Human
uggaggagugugauugucugcc

SEQ ID NO: 906198 - RNA, 22 nt, Human
ugagauaauuaaaucaaaaccu

SEQ ID NO: 906199 - RNA, 22 nt, Human
gaaaauagcagauagaccaaug

SEQ ID NO: 906200 - RNA, 22 nt, Human
gauguaaaaacuccuuucgaaa

SEQ ID NO: 906201 - RNA, 19 nt, Human
ggccagcacagggcucugu

SEQ ID NO: 906202 - RNA, 22 nt, Human
uuguaauuugcaaauguauugu

SEQ ID NO: 906203 - RNA, 18 nt, Human
ugacauuuccagagugua

SEQ ID NO: 906204 - RNA, 22 nt, Human
gagcagugguugaacagaggca

SEQ ID NO: 906205 - RNA, 22 nt, Human
cagauuucagcucauauauuau

SEQ ID NO: 906206 - RNA, 22 nt, Human
acaaaauagaguucuccccugg

SEQ ID NO: 906207 - RNA, 22 nt, Human
gggggcaggucuggaacuuuga

SEQ ID NO: 906208 - RNA, 23 nt, Human
uccugagaugagacagugcugcc

SEQ ID NO: 906209 - RNA, 22 nt, Human
gaguccaagcuagagccacuca

SEQ ID NO: 906210 - RNA, 22 nt, Human
guuuucuuugaaugcuucuaga

SEQ ID NO: 906211 - RNA, 22 nt, Human
gaggaggucuccuccgcagggg

SEQ ID NO: 906212 - RNA, 22 nt, Human
aucuguagucacugcacagcuc

SEQ ID NO: 906213 - RNA, 19 nt, Human
ucuguaacacucuagccuu

SEQ ID NO: 906214 - RNA, 22 nt, Human
gcugaggauugaagaguugcca

SEQ ID NO: 906215 - RNA, 22 nt, Human
agagcuguagcuuccuagagcc

SEQ ID NO: 906216 - RNA, 22 nt, Human
uuccuaacgccaguauuuucau

SEQ ID NO: 906217 - RNA, 22 nt, Human
aggccucaggaagguaaagaag

SEQ ID NO: 906218 - RNA, 22 nt, Human
agagaccagaauccagcugccu

SEQ ID NO: 906219 - RNA, 22 nt, Human
aguuuauucucuggucuuagua

SEQ ID NO: 906220 - RNA, 22 nt, Human
aaaugcaugagaaaguauucug

SEQ ID NO: 906221 - RNA, 22 nt, Human
uuuucaguaaugucuacauaau

SEQ ID NO: 906222 - RNA, 22 nt, Human
agcuggaugaauuuggaacacu

SEQ ID NO: 906223 - RNA, 22 nt, Human
uccaggcuggccucgcgugaca

SEQ ID NO: 906224 - RNA, 22 nt, Human
aggcuucauguguccuggguga

SEQ ID NO: 906225 - RNA, 22 nt, Human
cacagagauggccagggcacau

SEQ ID NO: 906226 - RNA, 22 nt, Human
cauaaguugcagagggugcauu

SEQ ID NO: 906227 - RNA, 23 nt, Human
uggaaucuucgauauugauucag

SEQ ID NO: 906228 - RNA, 22 nt, Human
aagucugagagaaacucucuca

SEQ ID NO: 906229 - RNA, 22 nt, Human
uauuccaaaaucccaaacugcc

SEQ ID NO: 906230 - RNA, 22 nt, Human
agauuuccucuuuuguaaagug

SEQ ID NO: 906231 - RNA, 22 nt, Human
cagagagggagcaguagucucu

SEQ ID NO: 906232 - RNA, 22 nt, Human
cuggcagcaguuaugaaacaau

SEQ ID NO: 906233 - RNA, 22 nt, Human
ucugggagcagaugaugguaua

SEQ ID NO: 906234 - RNA, 22 nt, Human
aaggggaaaaaguguuaggagu

SEQ ID NO: 906235 - RNA, 22 nt, Human
uuggaauccugccucugcuacu

SEQ ID NO: 906236 - RNA, 22 nt, Human
gaaggcacccuccaucacucac

SEQ ID NO: 906237 - RNA, 22 nt, Human
ugccaggcugaacagggucuua

SEQ ID NO: 906238 - RNA, 22 nt, Human
aaucauucucaugccaguuucc

SEQ ID NO: 906239 - RNA, 22 nt, Human
gaggccaacuuuggagaacagg

SEQ ID NO: 906240 - RNA, 22 nt, Human
uuuggaaacugaugguacauuc

SEQ ID NO: 906241 - RNA, 22 nt, Human
caggccucuuccaugcagcagc

SEQ ID NO: 906242 - RNA, 23 nt, Human
aauguauguuaguaucuuagaga

SEQ ID NO: 906243 - RNA, 22 nt, Human
uaaaucucagccuuucugcuua

SEQ ID NO: 906244 - RNA, 17 nt, Human
agcagggagucaaggga

SEQ ID NO: 906245 - RNA, 22 nt, Human
caguaguggaagggagagaaaa

SEQ ID NO: 906246 - RNA, 22 nt, Human
uguuaauggcugaagacauccu

SEQ ID NO: 906247 - RNA, 22 nt, Human
uauuuauguggaccauaagccu

SEQ ID NO: 906248 - RNA, 22 nt, Human
ggcuguccuuggccaaggcacu

SEQ ID NO: 906249 - RNA, 22 nt, Human
ucuuggccacuaccaccuggag

SEQ ID NO: 906250 - RNA, 17 nt, Human
gcugagugcagggaguc

SEQ ID NO: 906251 - RNA, 22 nt, Human
agcaggcagcaugggacccucc

SEQ ID NO: 906252 - RNA, 22 nt, Human
agaggcuguuacacucccagau

SEQ ID NO: 906253 - RNA, 21 nt, Human
cagugggcugcugcgcuccag

SEQ ID NO: 906254 - RNA, 22 nt, Human
uccuggcaaagauguugguguu

SEQ ID NO: 906255 - RNA, 23 nt, Human
auguuauuauuagcagucuugcc

SEQ ID NO: 906256 - RNA, 22 nt, Human
uuagaaauacaagugagguuga

SEQ ID NO: 906257 - RNA, 22 nt, Human
ucucagcugacugcuuuccucg

SEQ ID NO: 906258 - RNA, 22 nt, Human
gguggcucagggcuccaagcau

SEQ ID NO: 906259 - RNA, 22 nt, Human
gcagcccuagcgacaaauugau

SEQ ID NO: 906260 - RNA, 22 nt, Human
uuugucauaacucugcugcaag

SEQ ID NO: 906261 - RNA, 22 nt, Human
guauuguauugggaugagcucu

SEQ ID NO: 906262 - RNA, 22 nt, Human
uagguaagauguuaacagcuga

SEQ ID NO: 906263 - RNA, 22 nt, Human
agcugcagggcuuggguuuccc

SEQ ID NO: 906264 - RNA, 22 nt, Human
agggagcucgaugccugagugu

SEQ ID NO: 906265 - RNA, 22 nt, Human
guaggcagucucucaggugauc

SEQ ID NO: 906266 - RNA, 22 nt, Human
auagaguuuuauuuuccaauaa

SEQ ID NO: 906267 - RNA, 22 nt, Human
uaggauggucacagagauggac

SEQ ID NO: 906268 - RNA, 22 nt, Human
gggacagaggcaaacuagcaga

SEQ ID NO: 906269 - RNA, 22 nt, Human
ugagaguucucucuucaggugg

SEQ ID NO: 906270 - RNA, 22 nt, Human
cagacagaaggcuccuugaggu

SEQ ID NO: 906271 - RNA, 22 nt, Human
uaucuguucaauggaagaugac

SEQ ID NO: 906272 - RNA, 22 nt, Human
gggcuggaggaccggccucgga

SEQ ID NO: 906273 - RNA, 20 nt, Human
uguguaugugcacaugcgaa

SEQ ID NO: 906274 - RNA, 22 nt, Human
ugugaaaagcaggcuacuuucu

SEQ ID NO: 906275 - RNA, 22 nt, Human
uuggaaaauguauuucuagaag

SEQ ID NO: 906276 - RNA, 22 nt, Human
cagcaguguggaagcugagggg

SEQ ID NO: 906277 - RNA, 22 nt, Human
guguauaacccaaauaugcugc

SEQ ID NO: 906278 - RNA, 22 nt, Human
gggcuggagucuucugaaagcc

SEQ ID NO: 906279 - RNA, 22 nt, Human
uccagccaccaccuugauugcc

SEQ ID NO: 906280 - RNA, 22 nt, Human
auauguggcauuauuucugagg

SEQ ID NO: 906281 - RNA, 22 nt, Human
gacagcugcuuaugaaccaacg

SEQ ID NO: 906282 - RNA, 23 nt, Human
uggagggcagaauaacagacuac

SEQ ID NO: 906283 - RNA, 22 nt, Human
ucaauauucuucuuuaguagga

SEQ ID NO: 906284 - RNA, 22 nt, Human
caggaacaugucuccaauuaga

SEQ ID NO: 906285 - RNA, 22 nt, Human
guuuccuuucuauugccuugau

SEQ ID NO: 906286 - RNA, 22 nt, Human
cuauggugauagaaaucagaau

SEQ ID NO: 906287 - RNA, 22 nt, Human
gaaguuuagguucuuauguuua

SEQ ID NO: 906288 - RNA, 22 nt, Human
ccagcauccaugcucccucggg

SEQ ID NO: 906289 - RNA, 22 nt, Human
aaaggaaaauaaguaguuccau

SEQ ID NO: 906290 - RNA, 22 nt, Human
ggcccagugcuguucacccagu

SEQ ID NO: 906291 - RNA, 22 nt, Human
aaaagccuggauacuaucauua

SEQ ID NO: 906292 - RNA, 22 nt, Human
auaucacaggaaaggaagauac

SEQ ID NO: 906293 - RNA, 22 nt, Human
gagagcagacucucaaagcugg

SEQ ID NO: 906294 - RNA, 22 nt, Human
gaaggcugcgaggggagugccg

SEQ ID NO: 906295 - RNA, 22 nt, Human
ucuaguacuaguuaggaagagu

SEQ ID NO: 906296 - RNA, 22 nt, Human
cuucagugcauguuuauaauca

SEQ ID NO: 906297 - RNA, 22 nt, Human
augaggccacaguuauagauuu

SEQ ID NO: 906298 - RNA, 22 nt, Human
aaaugcauuuuuaauuagaccc

SEQ ID NO: 906299 - RNA, 22 nt, Human
ugagauaacauggaagaguagc

SEQ ID NO: 906300 - RNA, 18 nt, Human
ucccaucauccucuccag

SEQ ID NO: 906301 - RNA, 22 nt, Human
ugaauaaacuaugaggaggaau

SEQ ID NO: 906302 - RNA, 22 nt, Human
aggucaggguauucacgucugu

SEQ ID NO: 906303 - RNA, 22 nt, Human
gcccugagcacacaguagcaaa

SEQ ID NO: 906304 - RNA, 22 nt, Human
ccuuggguuccaagucacugaa

SEQ ID NO: 906305 - RNA, 22 nt, Human
aacuucuaaucuguacaguuuu

SEQ ID NO: 906306 - RNA, 19 nt, Human
ccugaguugggugaagaga

SEQ ID NO: 906307 - RNA, 22 nt, Human
augcuacauagauacaaaaaug

SEQ ID NO: 906308 - RNA, 22 nt, Human
uuuuaucaaucauuaagacauu

SEQ ID NO: 906309 - RNA, 22 nt, Human
aaaggcuaugagauagaagaua

SEQ ID NO: 906310 - RNA, 22 nt, Human
ugccuggcccugacagcccugg

SEQ ID NO: 906311 - RNA, 22 nt, Human
ccauggcuuuugagucucaaga

SEQ ID NO: 906312 - RNA, 22 nt, Human
ugugucacuguuccuccagcua

SEQ ID NO: 906313 - RNA, 22 nt, Human
augaguucaauuguuucaguca

SEQ ID NO: 906314 - RNA, 22 nt, Human
cugccuggcuaaacucaagucg

SEQ ID NO: 906315 - RNA, 22 nt, Human
auauggaagagccugggaauuu

SEQ ID NO: 906316 - RNA, 22 nt, Human
cauagaaaguauuauggaauuu

SEQ ID NO: 906317 - RNA, 22 nt, Human
aaaggcuggauucagagaggug

SEQ ID NO: 906318 - RNA, 22 nt, Human
agaagccaaaggggccagauau

SEQ ID NO: 906319 - RNA, 22 nt, Human
ucccagauuccugcucuuauau

SEQ ID NO: 906320 - RNA, 22 nt, Human
ugacagugcggguacaucauag

SEQ ID NO: 906321 - RNA, 22 nt, Human
cccaggcagugcugaucccuca

SEQ ID NO: 906322 - RNA, 22 nt, Human
cucugcaugccacaugagugac

SEQ ID NO: 906323 - RNA, 22 nt, Human
uuguuuucuccacugcaucuua

SEQ ID NO: 906324 - RNA, 22 nt, Human
gggcacugcuggaggcucccug

SEQ ID NO: 906325 - RNA, 22 nt, Human
aaggccaggagacuuggaguca

SEQ ID NO: 906326 - RNA, 22 nt, Human
gagugggcaccgugggcacacu

SEQ ID NO: 906327 - RNA, 22 nt, Human
aggacagagccugugcagaccg

SEQ ID NO: 906328 - RNA, 22 nt, Human
gaaagagaggggcugagaugca

SEQ ID NO: 906329 - RNA, 20 nt, Human
uagaggugggauuuggguuu

SEQ ID NO: 906330 - RNA, 22 nt, Human
gucugcucaugcuaccgcgggc

SEQ ID NO: 906331 - RNA, 22 nt, Human
gcagccuguuguaccagccugu

SEQ ID NO: 906332 - RNA, 22 nt, Human
cugugcugucuugggagccuua

SEQ ID NO: 906333 - RNA, 22 nt, Human
uauguacaccaaggauugaaaa

SEQ ID NO: 906334 - RNA, 22 nt, Human
aagaaauacaugguuuuugagu

SEQ ID NO: 906335 - RNA, 22 nt, Human
gacagacaaauguuuuuaacuu

SEQ ID NO: 906336 - RNA, 22 nt, Human
auauggcauuacauuguuaaau

SEQ ID NO: 906337 - RNA, 22 nt, Human
ugcaagaauuguauacccucau

SEQ ID NO: 906338 - RNA, 22 nt, Human
cauuaugugcguacauguaucu

SEQ ID NO: 906339 - RNA, 22 nt, Human
ccagcuguuggaguuucacugc

SEQ ID NO: 906340 - RNA, 22 nt, Human
uaucagcaucuccucaaagaua

SEQ ID NO: 906341 - RNA, 22 nt, Human
cucacuuagcagguuaauauca

SEQ ID NO: 906342 - RNA, 22 nt, Human
gggcagagguucaacuucaaca

SEQ ID NO: 906343 - RNA, 22 nt, Human
caggcuggagugcaguugugca

SEQ ID NO: 906344 - RNA, 22 nt, Human
agaggaugauuuuaaggacacu

SEQ ID NO: 906345 - RNA, 22 nt, Human
ggggggugacaaguagagguug

SEQ ID NO: 906346 - RNA, 22 nt, Human
ugagguaggugucgagagaggu

SEQ ID NO: 906347 - RNA, 22 nt, Human
ugccugucuccucugcagggug

SEQ ID NO: 906348 - RNA, 22 nt, Human
cccaggagacauauagaaggac

SEQ ID NO: 906349 - RNA, 22 nt, Human
caaguucuuaacucugagcagc

SEQ ID NO: 906350 - RNA, 22 nt, Human
cauaguaagugcauaauaaaug

SEQ ID NO: 906351 - RNA, 22 nt, Human
uacauacacaaauauacuguuu

SEQ ID NO: 906352 - RNA, 22 nt, Human
agguggcagacuaacagaagga

SEQ ID NO: 906353 - RNA, 22 nt, Human
ugacuaaaauaggacauuaacu

SEQ ID NO: 906354 - RNA, 22 nt, Human
cuuugugucuguuaauaauuau

SEQ ID NO: 906355 - RNA, 22 nt, Human
ggccuuggauccaagcugcggc

SEQ ID NO: 906356 - RNA, 22 nt, Human
acuugcauuuaaauauugaaua

SEQ ID NO: 906357 - RNA, 22 nt, Human
agugagggacuccaugacuccu

SEQ ID NO: 906358 - RNA, 22 nt, Human
augugugcuacaggugugggaa

SEQ ID NO: 906359 - RNA, 22 nt, Human
cugggaggcacuauucaggagg

SEQ ID NO: 906360 - RNA, 22 nt, Human
acccaggagccgugagagguua

SEQ ID NO: 906361 - RNA, 22 nt, Human
agggccagaguggcaaaagccu

SEQ ID NO: 906362 - RNA, 22 nt, Human
gaagaucugcagccucaggcga

SEQ ID NO: 906363 - RNA, 18 nt, Human
aggcaugguggugcgcac

SEQ ID NO: 906364 - RNA, 22 nt, Human
cugggcucaaauccuaucucca

SEQ ID NO: 906365 - RNA, 22 nt, Human
ucugagcuucugccugcugcaa

SEQ ID NO: 906366 - RNA, 22 nt, Human
gggcugaggaacauauuuuguu

SEQ ID NO: 906367 - RNA, 22 nt, Human
cuuccaggacaccaggguagua

SEQ ID NO: 906368 - RNA, 22 nt, Human
cagcugagaaggucugaucagg

SEQ ID NO: 906369 - RNA, 22 nt, Human
cuuuucuguaucaaaaggauua

SEQ ID NO: 906370 - RNA, 22 nt, Human
guuucccaaauuguucacaggg

SEQ ID NO: 906371 - RNA, 22 nt, Human
uggcagcugcaggccuccugag

SEQ ID NO: 906372 - RNA, 22 nt, Human
guggaagcaguaaggcaaguuu

SEQ ID NO: 906373 - RNA, 22 nt, Human
cuuacacagucuggcacuucuu

SEQ ID NO: 906374 - RNA, 22 nt, Human
ccugggaggcagagguugcagu

SEQ ID NO: 906375 - RNA, 23 nt, Human
uggggcucuggcaggccugaggu

SEQ ID NO: 906376 - RNA, 22 nt, Human
agcccuuaguacauuucucaag

SEQ ID NO: 906377 - RNA, 22 nt, Human
aagagguggaacagcaauucgu

SEQ ID NO: 906378 - RNA, 22 nt, Human
caccauuuucuaaaaauaugac

SEQ ID NO: 906379 - RNA, 22 nt, Human
ugcuuuaaauaugaauuagcau

SEQ ID NO: 906380 - RNA, 23 nt, Human
ggagccagccuguggggagcggg

SEQ ID NO: 906381 - RNA, 22 nt, Human
acucugggcuguuaggagcugu

SEQ ID NO: 906382 - RNA, 22 nt, Human
cagccagggucaggcagcuucu

SEQ ID NO: 906383 - RNA, 22 nt, Human
aaguccagcagugcuuguugau

SEQ ID NO: 906384 - RNA, 22 nt, Human
gggggcaguaaccucaaagugu

SEQ ID NO: 906385 - RNA, 22 nt, Human
gcaaagugcuucagugggagcu

SEQ ID NO: 906386 - RNA, 22 nt, Human
uagaggugagauauuuuauuuu

SEQ ID NO: 906387 - RNA, 22 nt, Human
gugggcagguaggcaccagcua

SEQ ID NO: 906388 - RNA, 22 nt, Human
ucuuugcagucugggcuuguuu

SEQ ID NO: 906389 - RNA, 19 nt, Human
ggagccuggagcacgugcc

SEQ ID NO: 906390 - RNA, 22 nt, Human
ugcagcugugggagaaucucug

SEQ ID NO: 906391 - RNA, 23 nt, Human
auguccaguuuacuucaggauga

SEQ ID NO: 906392 - RNA, 22 nt, Human
accagggcggcuugaggaggca

SEQ ID NO: 906393 - RNA, 19 nt, Human
uuucccagucccaggagug

SEQ ID NO: 906394 - RNA, 22 nt, Human
ucuugcuagaaucauuuggaga

SEQ ID NO: 906395 - RNA, 22 nt, Human
cacaugaacaugcuggaaaagc

SEQ ID NO: 906396 - RNA, 22 nt, Human
cagagucuggacugcaggcucc

SEQ ID NO: 906397 - RNA, 22 nt, Human
uggugagauaacuuucggcaag

SEQ ID NO: 906398 - RNA, 22 nt, Human
aaaaugucugcuguugguuuau

SEQ ID NO: 906399 - RNA, 22 nt, Human
gcaaauuaaccaaucaugcucg

SEQ ID NO: 906400 - RNA, 22 nt, Human
ucuuuggaaugcuagcauucua

SEQ ID NO: 906401 - RNA, 19 nt, Human
uugcuucaugucuuuugcu

SEQ ID NO: 906402 - RNA, 22 nt, Human
cuggcuccucaggacugcggga

SEQ ID NO: 906403 - RNA, 17 nt, Human
cucugggucuccugcuu

SEQ ID NO: 906404 - RNA, 22 nt, Human
gcugagguggaggaaggagacc

SEQ ID NO: 906405 - RNA, 22 nt, Human
agcagcucauggaguaggcacu

SEQ ID NO: 906406 - RNA, 22 nt, Human
uuaaaggcugaucuuaauauua

SEQ ID NO: 906407 - RNA, 22 nt, Human
ugaggccacaguaucagaacag

SEQ ID NO: 906408 - RNA, 22 nt, Human
caguuuauagcucuagcagcuu

SEQ ID NO: 906409 - RNA, 22 nt, Human
aaaguagaacauuuucuuaucu

SEQ ID NO: 906410 - RNA, 22 nt, Human
ucucugagaauaucccauaaga

SEQ ID NO: 906411 - RNA, 22 nt, Human
cauacaaauguguccaggcucu

SEQ ID NO: 906412 - RNA, 22 nt, Human
aaggaagagucuagaacaggca

SEQ ID NO: 906413 - RNA, 15 nt, Human
aucucucuagcugcu

SEQ ID NO: 906414 - RNA, 22 nt, Human
ggaaaugguggaggaaggcuua

SEQ ID NO: 906415 - RNA, 22 nt, Human
augucuuuauuaauaucaugcc

SEQ ID NO: 906416 - RNA, 22 nt, Human
gcauacaaagguuuacaacuga

SEQ ID NO: 906417 - RNA, 22 nt, Human
cuggguguagcccaguaugagg

SEQ ID NO: 906418 - RNA, 22 nt, Human
cagcacaggaauaugguggaca

SEQ ID NO: 906419 - RNA, 22 nt, Human
uucuucugccucccaccugaua

SEQ ID NO: 906420 - RNA, 22 nt, Human
cuuggugcauuacucaaucugu

SEQ ID NO: 906421 - RNA, 22 nt, Human
uuuuaucugugacaucuggcag

SEQ ID NO: 906422 - RNA, 22 nt, Human
uauuucugaauccaaaagguca

SEQ ID NO: 906423 - RNA, 22 nt, Human
uggcucugagcugcaaagcugc

SEQ ID NO: 906424 - RNA, 22 nt, Human
aggcagaauguuggaaaggaag

SEQ ID NO: 906425 - RNA, 18 nt, Human
ugucugaguucuuccauu

SEQ ID NO: 906426 - RNA, 22 nt, Human
uuaagagacaggagaaugaugu

SEQ ID NO: 906427 - RNA, 22 nt, Human
auggcagccugagcagaggaau

SEQ ID NO: 906428 - RNA, 22 nt, Human
agugugcucaauucaagucuuu

SEQ ID NO: 906429 - RNA, 22 nt, Human
uauacacaccuccaaagcagga

SEQ ID NO: 906430 - RNA, 22 nt, Human
ugcugcagaaauucugugagga

SEQ ID NO: 906431 - RNA, 22 nt, Human
acauuucaguaaguguuaauuu

SEQ ID NO: 906432 - RNA, 22 nt, Human
guauuuuacuuacgcaugacuu

SEQ ID NO: 906433 - RNA, 22 nt, Human
uguccagggggcuuaccuggag

SEQ ID NO: 906434 - RNA, 22 nt, Human
cagcuggcaaguggagcagggu

SEQ ID NO: 906435 - RNA, 22 nt, Human
uauuagcauauaugauucaguu

SEQ ID NO: 906436 - RNA, 23 nt, Human
uuaagcacuguuaguagaaaagg

SEQ ID NO: 906437 - RNA, 22 nt, Human
ugagcugggaguggugaugagg

SEQ ID NO: 906438 - RNA, 22 nt, Human
aauguacaauaagacaaagagg

SEQ ID NO: 906439 - RNA, 22 nt, Human
uccuggccucgcuguccaccuu

SEQ ID NO: 906440 - RNA, 22 nt, Human
cugugccuaagaugcaugucuc

SEQ ID NO: 906441 - RNA, 22 nt, Human
ccaagcaggauauucuguguca

SEQ ID NO: 906442 - RNA, 18 nt, Human
ucuuccagcuucuggagg

SEQ ID NO: 906443 - RNA, 22 nt, Human
accaaaaccugcuacuaaagga

SEQ ID NO: 906444 - RNA, 22 nt, Human
ucagcuacagcaucucugcuuu

SEQ ID NO: 906445 - RNA, 22 nt, Human
gguggcugaaucaaaucaggcc

SEQ ID NO: 906446 - RNA, 22 nt, Human
ccagcaggagaugccugugucu

SEQ ID NO: 906447 - RNA, 22 nt, Human
gugaccagcccauagagaggcg

SEQ ID NO: 906448 - RNA, 22 nt, Human
ugugaucaggugaucaugugag

SEQ ID NO: 906449 - RNA, 22 nt, Human
auuucaguagaaaaucuugauu

SEQ ID NO: 906450 - RNA, 22 nt, Human
agccagagagccccagguucua

SEQ ID NO: 906451 - RNA, 22 nt, Human
agaggcaaguucagagcuagga

SEQ ID NO: 906452 - RNA, 20 nt, Human
ccacaguggagacuggagac

SEQ ID NO: 906453 - RNA, 19 nt, Human
gucccuucacuccugcugg

SEQ ID NO: 906454 - RNA, 22 nt, Human
cuguuucccuccagggggugga

SEQ ID NO: 906455 - RNA, 22 nt, Human
acucuguguuuugguggcagca

SEQ ID NO: 906456 - RNA, 22 nt, Human
aacagcugucugccuaucucug

SEQ ID NO: 906457 - RNA, 22 nt, Human
gggcuccaggagcccuaagaga

SEQ ID NO: 906458 - RNA, 22 nt, Human
gaaggggaaaguugagcaaaua

SEQ ID NO: 906459 - RNA, 22 nt, Human
caaaugcuacuaauaggcaagu

SEQ ID NO: 906460 - RNA, 22 nt, Human
acucuuuuaugcauuccuucag

SEQ ID NO: 906461 - RNA, 22 nt, Human
augauaagaacacaguaugggg

SEQ ID NO: 906462 - RNA, 22 nt, Human
ggacugggaaucagggagaugc

SEQ ID NO: 906463 - RNA, 22 nt, Human
aggccugagcagaggaguggac

SEQ ID NO: 906464 - RNA, 22 nt, Human
aagaguuucuuuauuaaccuuu

SEQ ID NO: 906465 - RNA, 22 nt, Human
aaucuuuaaggacucagucucu

SEQ ID NO: 906466 - RNA, 22 nt, Human
acaguguguucugggaccucca

SEQ ID NO: 906467 - RNA, 22 nt, Human
uaugugcauaugcauacacaca

SEQ ID NO: 906468 - RNA, 22 nt, Human
ucugucacucccugaugaugaa

SEQ ID NO: 906469 - RNA, 22 nt, Human
gaccacugaugacaugaggaga

SEQ ID NO: 906470 - RNA, 22 nt, Human
accagaaaggaauaauagaauu

SEQ ID NO: 906471 - RNA, 22 nt, Human
augucuuucgcaucaguagcua

SEQ ID NO: 906472 - RNA, 22 nt, Human
gcuucacaacuucuuaauucuu

SEQ ID NO: 906473 - RNA, 22 nt, Human
gcauuacaggaauuuguuacug

SEQ ID NO: 906474 - RNA, 22 nt, Human
ugaugucucucuauacucuaac

SEQ ID NO: 906475 - RNA, 22 nt, Human
agggcccuuacgcaggcccuuc

SEQ ID NO: 906476 - RNA, 22 nt, Human
ucuguuauggaaguuuccuuuu

SEQ ID NO: 906477 - RNA, 22 nt, Human
uggcugcucaagggaggaggcu

SEQ ID NO: 906478 - RNA, 22 nt, Human
ugauuuuauuggugaggaaauu

SEQ ID NO: 906479 - RNA, 22 nt, Human
ugaucuucaccuuguucuuugg

SEQ ID NO: 906480 - RNA, 22 nt, Human
uucuccugaguucccaggucua

SEQ ID NO: 906481 - RNA, 22 nt, Human
acaugacagugcuuagcaaacu

SEQ ID NO: 906482 - RNA, 21 nt, Human
ucucuguguacagucucaccc

SEQ ID NO: 906483 - RNA, 22 nt, Human
agcagccaauuggaggaugaag

SEQ ID NO: 906484 - RNA, 22 nt, Human
aggcgcugugcuuggggcugga

SEQ ID NO: 906485 - RNA, 22 nt, Human
cacugccugugagcugugugcc

SEQ ID NO: 906486 - RNA, 22 nt, Human
uuuggucucauucacucauggg

SEQ ID NO: 906487 - RNA, 22 nt, Human
gagcagcucugggugacccagu

SEQ ID NO: 906488 - RNA, 22 nt, Human
ugggcaggagagaagcuaaaga

SEQ ID NO: 906489 - RNA, 20 nt, Human
cucacagucaaugcagaggu

SEQ ID NO: 906490 - RNA, 19 nt, Human
ugagacagggauucaggug

SEQ ID NO: 906491 - RNA, 22 nt, Human
gaugacacuaagcauguugugg

SEQ ID NO: 906492 - RNA, 20 nt, Human
agauacagugguuucuuuag

SEQ ID NO: 906493 - RNA, 22 nt, Human
gcugguauuugcagccugucau

SEQ ID NO: 906494 - RNA, 22 nt, Human
uccagacugcuucuaggaugag

SEQ ID NO: 906495 - RNA, 22 nt, Human
ucugcuauuuucuaucugugug

SEQ ID NO: 906496 - RNA, 22 nt, Human
auguggcuaguccucugcggca

SEQ ID NO: 906497 - RNA, 21 nt, Human
ucugaugguagaugagaugug

SEQ ID NO: 906498 - RNA, 22 nt, Human
uacagguuacacuuuuaaaagu

SEQ ID NO: 906499 - RNA, 22 nt, Human
acauuucugcuagaauagguga

SEQ ID NO: 906500 - RNA, 22 nt, Human
ggccagagguguccucaguucu

SEQ ID NO: 906501 - RNA, 22 nt, Human
uucucucugugucauuauggac

SEQ ID NO: 906502 - RNA, 22 nt, Human
uuguggcagaccaugagucuaa

SEQ ID NO: 906503 - RNA, 22 nt, Human
agaaguuuucauuaccuauaca

SEQ ID NO: 906504 - RNA, 22 nt, Human
uauuuguauguguguacauaua

SEQ ID NO: 906505 - RNA, 22 nt, Human
uuggcacucauccugguuguuu

SEQ ID NO: 906506 - RNA, 22 nt, Human
cuggcagcugugugaagaacug

SEQ ID NO: 906507 - RNA, 22 nt, Human
acuggcagaauugaauaguugu

SEQ ID NO: 906508 - RNA, 22 nt, Human
cuguuuuauaaaguccaaaagu

SEQ ID NO: 906509 - RNA, 22 nt, Human
gccacagcagggcccucucagg

SEQ ID NO: 906510 - RNA, 22 nt, Human
caggagagauaugaguccccac

SEQ ID NO: 906511 - RNA, 22 nt, Human
uuuuagaaagaucccuggcagg

SEQ ID NO: 906512 - RNA, 22 nt, Human
acaggccuggugcugcugacag

SEQ ID NO: 906513 - RNA, 22 nt, Human
cuaaauaaucccucuggucuua

SEQ ID NO: 906514 - RNA, 22 nt, Human
gaagcuuggauaacuguauggg

SEQ ID NO: 906515 - RNA, 22 nt, Human
ugcaguguuccuguggguuuau

SEQ ID NO: 906516 - RNA, 18 nt, Human
ccugcagcccaggaggcc

SEQ ID NO: 906517 - RNA, 22 nt, Human
gagaaacaacacuugaugccuu

SEQ ID NO: 906518 - RNA, 22 nt, Human
cugcaucacucuuacuggcuuu

SEQ ID NO: 906519 - RNA, 23 nt, Human
ggcuucagugagagucccugcug

SEQ ID NO: 906520 - RNA, 22 nt, Human
gacacaaaguuugucagaaauu

SEQ ID NO: 906521 - RNA, 22 nt, Human
uaggacuuuggcgucagaacug

SEQ ID NO: 906522 - RNA, 22 nt, Human
cagcuauauuguuuucuacugu

SEQ ID NO: 906523 - RNA, 22 nt, Human
ucaagaaaaugacgccaaccuu

SEQ ID NO: 906524 - RNA, 22 nt, Human
aacuuacaaggaugauagcugc

SEQ ID NO: 906525 - RNA, 22 nt, Human
ucaggcuggggugcuaaggugu

SEQ ID NO: 906526 - RNA, 22 nt, Human
cuuuggaauaauuuccuggagu

SEQ ID NO: 906527 - RNA, 22 nt, Human
gagccagccuccgccucucucc

SEQ ID NO: 906528 - RNA, 20 nt, Human
ugcagggccuaaaaagggaa

SEQ ID NO: 906529 - RNA, 22 nt, Human
cagaaauaaaguggacagagua

SEQ ID NO: 906530 - RNA, 18 nt, Human
ccagaggcccgggcaggc

SEQ ID NO: 906531 - RNA, 22 nt, Human
gugcugggcccugagaccaggg

SEQ ID NO: 906532 - RNA, 22 nt, Human
uagaggcucuucauugcaguag

SEQ ID NO: 906533 - RNA, 22 nt, Human
agcuccuggucuuuguccagag

SEQ ID NO: 906534 - RNA, 22 nt, Human
cauguauagacacucauacagu

SEQ ID NO: 906535 - RNA, 22 nt, Human
gcagaggauagcauaugaaccu

SEQ ID NO: 906536 - RNA, 19 nt, Human
ccaggccuccugggagguc

SEQ ID NO: 906537 - RNA, 22 nt, Human
agaggccccaggugagcaugcc

SEQ ID NO: 906538 - RNA, 22 nt, Human
uccaggccccacugaagccccu

SEQ ID NO: 906539 - RNA, 22 nt, Human
aggucgaguuucggggcuacuu

SEQ ID NO: 906540 - RNA, 23 nt, Human
uauuuggaaagagggaagaagac

SEQ ID NO: 906541 - RNA, 22 nt, Human
agauauauuuaagguaauaagu

SEQ ID NO: 906542 - RNA, 23 nt, Human
agucugugcugaagaaguuacaa

SEQ ID NO: 906543 - RNA, 22 nt, Human
aguucuaaguaaauauuuuaua

SEQ ID NO: 906544 - RNA, 22 nt, Human
guggaagccuacucuugugguu

SEQ ID NO: 906545 - RNA, 22 nt, Human
cagcacagugaccagacccacu

SEQ ID NO: 906546 - RNA, 22 nt, Human
cucuccagcagauguagucugu

SEQ ID NO: 906547 - RNA, 22 nt, Human
uucuaucauacuugaauacauu

SEQ ID NO: 906548 - RNA, 22 nt, Human
augugcuuuaaagaagccagcu

SEQ ID NO: 906549 - RNA, 22 nt, Human
cagggccucuccuccaggaacu

SEQ ID NO: 906550 - RNA, 22 nt, Human
gugccugcagcaauccauggca

SEQ ID NO: 906551 - RNA, 22 nt, Human
cugagcugugcuaagugaaaug

SEQ ID NO: 906552 - RNA, 22 nt, Human
cugagcagcaccuucaagaaac

SEQ ID NO: 906553 - RNA, 23 nt, Human
ggacagggcccugcccuauggcc

SEQ ID NO: 906554 - RNA, 22 nt, Human
aaacugcacaagggugcauagc

SEQ ID NO: 906555 - RNA, 20 nt, Human
ucagaggcugccagcugggg

SEQ ID NO: 906556 - RNA, 22 nt, Human
caggcagcucaaccuugggagc

SEQ ID NO: 906557 - RNA, 22 nt, Human
ucuaugucucuggaaggagugu

SEQ ID NO: 906558 - RNA, 22 nt, Human
cucacaggcgguaauucaggga

SEQ ID NO: 906559 - RNA, 22 nt, Human
cucuccuggggagcacacacac

SEQ ID NO: 906560 - RNA, 22 nt, Human
cagauucuucauugccccauuc

SEQ ID NO: 906561 - RNA, 22 nt, Human
acugauuacacgaguucugacu

SEQ ID NO: 906562 - RNA, 22 nt, Human
agcuccagaaagguacacacag

SEQ ID NO: 906563 - RNA, 22 nt, Human
ucagccagcauuaccccugacu

SEQ ID NO: 906564 - RNA, 23 nt, Human
uucuccugaggaagcagggacug

SEQ ID NO: 906565 - RNA, 22 nt, Human
ugaggcacauccaggccagcuc

SEQ ID NO: 906566 - RNA, 22 nt, Human
uuggaagguucuggucaugguu

SEQ ID NO: 906567 - RNA, 22 nt, Human
caggcucccacaagcucccagc

SEQ ID NO: 906568 - RNA, 19 nt, Human
cugaaaaacauucucagga

SEQ ID NO: 906569 - RNA, 22 nt, Human
ucaggaaagaguaauguauaca

SEQ ID NO: 906570 - RNA, 22 nt, Human
acaucucaaauuccaggcucca

SEQ ID NO: 906571 - RNA, 17 nt, Human
uuccacaauaguuuguc

SEQ ID NO: 906572 - RNA, 22 nt, Human
uuugaaagggacaaagucacug

SEQ ID NO: 906573 - RNA, 21 nt, Human
auucagaguaauucaucuuua

SEQ ID NO: 906574 - RNA, 22 nt, Human
ggcuuagaaggcaaaugacuug

SEQ ID NO: 906575 - RNA, 22 nt, Human
ggagucugggaauuggagagaa

SEQ ID NO: 906576 - RNA, 22 nt, Human
auuaaaacuaaaaugccugauu

SEQ ID NO: 906577 - RNA, 19 nt, Human
ggccccagccaggguauca

SEQ ID NO: 906578 - RNA, 22 nt, Human
augucuggaggucaucugguua

SEQ ID NO: 906579 - RNA, 22 nt, Human
caguugaucacuauaggcuuca

SEQ ID NO: 906580 - RNA, 22 nt, Human
cccugagccgcugcuccaaccu

SEQ ID NO: 906581 - RNA, 22 nt, Human
ggucaggauccaagucugugcu

SEQ ID NO: 906582 - RNA, 22 nt, Human
uuugacaauucaugacauuuau

SEQ ID NO: 906583 - RNA, 17 nt, Human
ucagggaaugagguugu

SEQ ID NO: 906584 - RNA, 18 nt, Human
uaguuucuaauggccuuu

SEQ ID NO: 906585 - RNA, 22 nt, Human
cagaagaucucuuaguggaggg

SEQ ID NO: 906586 - RNA, 22 nt, Human
aaagcagggcgauguccuccuc

SEQ ID NO: 906587 - RNA, 22 nt, Human
cagccaggcccccgagucguug

SEQ ID NO: 906588 - RNA, 22 nt, Human
uugugaaacauucauggauuug

SEQ ID NO: 906589 - RNA, 22 nt, Human
ucugggcugcugugcagugacc

SEQ ID NO: 906590 - RNA, 22 nt, Human
agacugggguucuggcaaggag

SEQ ID NO: 906591 - RNA, 22 nt, Human
uauucuacaguguuaguguuag

SEQ ID NO: 906592 - RNA, 22 nt, Human
caucaaauggcaagugaaagcu

SEQ ID NO: 906593 - RNA, 22 nt, Human
uuccaguucccaugaggauuaa

SEQ ID NO: 906594 - RNA, 22 nt, Human
gaugucucugacuaaggcagug

SEQ ID NO: 906595 - RNA, 22 nt, Human
ugagaagagcaaggaacugguu

SEQ ID NO: 906596 - RNA, 22 nt, Human
ccagagagauugcuucuaaaga

SEQ ID NO: 906597 - RNA, 22 nt, Human
ugaaguuuauaacauagccucc

SEQ ID NO: 906598 - RNA, 22 nt, Human
cacauuaugcuacuaccaaaug

SEQ ID NO: 906599 - RNA, 22 nt, Human
ucaaggacuauugcaugacucc

SEQ ID NO: 906600 - RNA, 22 nt, Human
aauguucugggagagaagcugu

SEQ ID NO: 906601 - RNA, 22 nt, Human
gacagcuggacagacacugaug

SEQ ID NO: 906602 - RNA, 22 nt, Human
uuccagaguugggggagugguu

SEQ ID NO: 906603 - RNA, 22 nt, Human
ugggccaguuauuucaccucug

SEQ ID NO: 906604 - RNA, 22 nt, Human
aaggaaauacaacauguauuca

SEQ ID NO: 906605 - RNA, 22 nt, Human
cacagugcuuuaugagagaucu

SEQ ID NO: 906606 - RNA, 23 nt, Human
uuugugaaaguguugagaggaga

SEQ ID NO: 906607 - RNA, 22 nt, Human
acaggccugaugccuuggcugg

SEQ ID NO: 906608 - RNA, 22 nt, Human
ugcaggccucacaccuggcacc

SEQ ID NO: 906609 - RNA, 22 nt, Human
cuacacagagccuacuucugca

SEQ ID NO: 906610 - RNA, 22 nt, Human
uuucacaguuagcaugaggacu

SEQ ID NO: 906611 - RNA, 16 nt, Human
acuuuuccaccuuuuu

SEQ ID NO: 906612 - RNA, 22 nt, Human
gcugucucaugggugcuagucc

SEQ ID NO: 906613 - RNA, 22 nt, Human
ccagcagccagagaaggaccuc

SEQ ID NO: 906614 - RNA, 22 nt, Human
auucuuaaauuuaggucuguga

SEQ ID NO: 906615 - RNA, 22 nt, Human
uccaggcuuuggggcaggagcg

SEQ ID NO: 906616 - RNA, 22 nt, Human
gcucugagagugcaugauagca

SEQ ID NO: 906617 - RNA, 22 nt, Human
uuugcauuuguuuagaaccuga

SEQ ID NO: 906618 - RNA, 22 nt, Human
ccacaguguggcauaaacugua

SEQ ID NO: 906619 - RNA, 22 nt, Human
uuauguacaauguuaauguaaa

SEQ ID NO: 906620 - RNA, 22 nt, Human
augucacuuuugagacuagguu

SEQ ID NO: 906621 - RNA, 23 nt, Human
uucagaagaaaugaguacaggag

SEQ ID NO: 906622 - RNA, 22 nt, Human
agcccagcuccuccacagaaua

SEQ ID NO: 906623 - RNA, 22 nt, Human
ggcaauaaucuacucugccacu

SEQ ID NO: 906624 - RNA, 20 nt, Human
acugccagccuugucuacug

SEQ ID NO: 906625 - RNA, 22 nt, Human
acccaggcuggcagaggcuccu

SEQ ID NO: 906626 - RNA, 21 nt, Human
agagaagggauuccaggcccu

SEQ ID NO: 906627 - RNA, 22 nt, Human
cuggcacaaaagaaaacugcca

SEQ ID NO: 906628 - RNA, 21 nt, Human
agcagcaucagccucaccuga

SEQ ID NO: 906629 - RNA, 22 nt, Human
acaugaucugacuugcuuuuua

SEQ ID NO: 906630 - RNA, 20 nt, Human
ggcagggagggauacugagg

SEQ ID NO: 906631 - RNA, 22 nt, Human
cucugggacuagaaccccaggg

SEQ ID NO: 906632 - RNA, 22 nt, Human
uucaugaagggugaauauaguc

SEQ ID NO: 906633 - RNA, 22 nt, Human
ugagaguuuugacgcuuguaac

SEQ ID NO: 906634 - RNA, 22 nt, Human
uagaacuuccaauucagggcug

SEQ ID NO: 906635 - RNA, 22 nt, Human
uuccugugaagaucugggugcu

SEQ ID NO: 906636 - RNA, 22 nt, Human
gagaagacgugauggccaagaa

SEQ ID NO: 906637 - RNA, 22 nt, Human
cugacaaacuuaauuuucugaa

SEQ ID NO: 906638 - RNA, 22 nt, Human
uggcacugaaaaaggagagguu

SEQ ID NO: 906639 - RNA, 22 nt, Human
aagggggccacaccugguguga

SEQ ID NO: 906640 - RNA, 22 nt, Human
cuccucccaauugccaagugcu

SEQ ID NO: 906641 - RNA, 17 nt, Human
uccuguuuaucauugau

SEQ ID NO: 906642 - RNA, 22 nt, Human
ugcuucagagaagaauggaaag

SEQ ID NO: 906643 - RNA, 22 nt, Human
aauuucaguaugaaguuucaca

SEQ ID NO: 906644 - RNA, 22 nt, Human
gaaguucugaccauauggccaa

SEQ ID NO: 906645 - RNA, 22 nt, Human
aagcuucuuuacaggagagauu

SEQ ID NO: 906646 - RNA, 22 nt, Human
uagaccagguugaccagguagg

SEQ ID NO: 906647 - RNA, 22 nt, Human
cuggacagaucccuuguagcuu

SEQ ID NO: 906648 - RNA, 22 nt, Human
aacuaucacaaacagagugucu

SEQ ID NO: 906649 - RNA, 17 nt, Human
aucugcauuucuaauga

SEQ ID NO: 906650 - RNA, 22 nt, Human
uuggcugaagacuagauguuua

SEQ ID NO: 906651 - RNA, 22 nt, Human
ggagccagaggcugcugcugug

SEQ ID NO: 906652 - RNA, 22 nt, Human
acagaacuuggaacuuuucaca

SEQ ID NO: 906653 - RNA, 22 nt, Human
uucuuauguucacauaauucca

SEQ ID NO: 906654 - RNA, 22 nt, Human
ugcuucaggaagaaacgccagg

SEQ ID NO: 906655 - RNA, 22 nt, Human
aaugaugggaaggagaaaagca

SEQ ID NO: 906656 - RNA, 22 nt, Human
gacaggcuggcaaugcccugcu

SEQ ID NO: 906657 - RNA, 22 nt, Human
caggccagugugcuucccaggc

SEQ ID NO: 906658 - RNA, 22 nt, Human
cagguggggcagcugugggagc

SEQ ID NO: 906659 - RNA, 22 nt, Human
uguuuacagcacugcacacugc

SEQ ID NO: 906660 - RNA, 22 nt, Human
gaggccaagggagaagaucucu

SEQ ID NO: 906661 - RNA, 22 nt, Human
uauuguccaugugucuguuagc

SEQ ID NO: 906662 - RNA, 22 nt, Human
uuacaaagcgcuuuaccucuga

SEQ ID NO: 906663 - RNA, 22 nt, Human
aagaaagguguguuugcagaug

SEQ ID NO: 906664 - RNA, 22 nt, Human
ggcagguggccaagugucuaag

SEQ ID NO: 906665 - RNA, 17 nt, Human
auacauguaaagugcuu

SEQ ID NO: 906666 - RNA, 20 nt, Human
ucuguaggcaaguuagcagg

SEQ ID NO: 906667 - RNA, 22 nt, Human
gcagauggaucaccugaggucg

SEQ ID NO: 906668 - RNA, 22 nt, Human
aaagcuaccuuuguguucauag

SEQ ID NO: 906669 - RNA, 22 nt, Human
uuugcaaaugaagcucugagga

SEQ ID NO: 906670 - RNA, 22 nt, Human
cugcccugauaugauuuagaac

SEQ ID NO: 906671 - RNA, 22 nt, Human
uaaagugcgacccaguccccag

SEQ ID NO: 906672 - RNA, 22 nt, Human
ugccugugcccuucuuggcauu

SEQ ID NO: 906673 - RNA, 22 nt, Human
uucauugaaauuaagcccaacu

SEQ ID NO: 906674 - RNA, 22 nt, Human
acagaggcagugugagauacug

SEQ ID NO: 906675 - RNA, 22 nt, Human
gccagggaacccaagggccuca

SEQ ID NO: 906676 - RNA, 22 nt, Human
cagcugaaagaaggaaguguca

SEQ ID NO: 906677 - RNA, 22 nt, Human
ggugaggaauuggggacugacc

SEQ ID NO: 906678 - RNA, 22 nt, Human
ugccaggcucaggaugucccug

SEQ ID NO: 906679 - RNA, 22 nt, Human
cccagguccccaccugucugcu

SEQ ID NO: 906680 - RNA, 23 nt, Human
uaacaagaaccucaugugacuuu

SEQ ID NO: 906681 - RNA, 22 nt, Human
uuuaagugaaauguaauacagu

SEQ ID NO: 906682 - RNA, 22 nt, Human
ugagcuuuguggguaaagagag

SEQ ID NO: 906683 - RNA, 22 nt, Human
cucugggguuaagcuuccaugg

SEQ ID NO: 906684 - RNA, 22 nt, Human
aaaguucuguagugcacugacu

SEQ ID NO: 906685 - RNA, 22 nt, Human
ccagggugagugucauggguua

SEQ ID NO: 906686 - RNA, 22 nt, Human
ggugcugaaggacuauaacggu

SEQ ID NO: 906687 - RNA, 21 nt, Human
aacauugauucauuuggcuau

SEQ ID NO: 906688 - RNA, 22 nt, Human
ggcugagugcugcuguucacga

SEQ ID NO: 906689 - RNA, 22 nt, Human
agaggccaguggcugugcuguc

SEQ ID NO: 906690 - RNA, 22 nt, Human
guguaucucauguucuucucug

SEQ ID NO: 906691 - RNA, 22 nt, Human
uuuuucugucucuuacauugca

SEQ ID NO: 906692 - RNA, 22 nt, Human
agaguccagaaaacagugugcu

SEQ ID NO: 906693 - RNA, 22 nt, Human
auggcagaauccauaguaggug

SEQ ID NO: 906694 - RNA, 22 nt, Human
guucagugguguauccccagug

SEQ ID NO: 906695 - RNA, 22 nt, Human
uuccugguuggauucugauuaa

SEQ ID NO: 906696 - RNA, 22 nt, Human
acauguacuguuggugaagagg

SEQ ID NO: 906697 - RNA, 22 nt, Human
accuccugaugagaguaaagga

SEQ ID NO: 906698 - RNA, 21 nt, Human
uuucuggguggcugcauagug

SEQ ID NO: 906699 - RNA, 22 nt, Human
ucauaauuguauacauuuaugg

SEQ ID NO: 906700 - RNA, 22 nt, Human
uucuuggcaucaugaaaaauua

SEQ ID NO: 906701 - RNA, 22 nt, Human
aaucuggaauauuugcauugua

SEQ ID NO: 906702 - RNA, 22 nt, Human
gcugugcaaaucgauuuguugg

SEQ ID NO: 906703 - RNA, 20 nt, Human
uuauguguaccugugcuccc

SEQ ID NO: 906704 - RNA, 22 nt, Human
ugcuggcacgaaagggugucca

SEQ ID NO: 906705 - RNA, 22 nt, Human
gcccucagaggacagcugacuu

SEQ ID NO: 906706 - RNA, 22 nt, Human
ucugccaguauucacggcccgu

SEQ ID NO: 906707 - RNA, 22 nt, Human
aaguguuuacuuaaagucaugg

SEQ ID NO: 906708 - RNA, 22 nt, Human
caguauuuccucuucuuaacuu

SEQ ID NO: 906709 - RNA, 18 nt, Human
ugcccagaaaagcaggga

SEQ ID NO: 906710 - RNA, 22 nt, Human
uaaaaguauacuuucaaaggag

SEQ ID NO: 906711 - RNA, 22 nt, Human
ucacugcucugaaaguacaggg

SEQ ID NO: 906712 - RNA, 22 nt, Human
ccaggaggaaagaccagcccau

SEQ ID NO: 906713 - RNA, 22 nt, Human
cacaaugugguuugucaucuuu

SEQ ID NO: 906714 - RNA, 22 nt, Human
ccuggcucagaccccaguucug

SEQ ID NO: 906715 - RNA, 22 nt, Human
aaaugaggccagaucaugcaga

SEQ ID NO: 906716 - RNA, 22 nt, Human
guauauaucggcacuauuuuaa

SEQ ID NO: 906717 - RNA, 22 nt, Human
ucugggaagcugcgugccuguu

SEQ ID NO: 906718 - RNA, 22 nt, Human
gccaggcuguggggaacuugaa

SEQ ID NO: 906719 - RNA, 22 nt, Human
cugugcugagugaugugacuua

SEQ ID NO: 906720 - RNA, 22 nt, Human
guggauuacaagacaguugaga

SEQ ID NO: 906721 - RNA, 20 nt, Human
uccagggcaacuagagugug

SEQ ID NO: 906722 - RNA, 20 nt, Human
cagcaguggaugagaguuuu

SEQ ID NO: 906723 - RNA, 22 nt, Human
ccagcccuuugugguucacuga

SEQ ID NO: 906724 - RNA, 22 nt, Human
ggggaggccaguggaccguccc

SEQ ID NO: 906725 - RNA, 22 nt, Human
aaauguucuacuuugauaauua

SEQ ID NO: 906726 - RNA, 22 nt, Human
agaggcuaggaccauguaucau

SEQ ID NO: 906727 - RNA, 22 nt, Human
gaggcuccgugcugcugcccug

SEQ ID NO: 906728 - RNA, 22 nt, Human
ggcaggcucuuggccuuaugag

SEQ ID NO: 906729 - RNA, 22 nt, Human
cucuccagucauauucucaguc

SEQ ID NO: 906730 - RNA, 22 nt, Human
acacaaauuguaggauaauugc

SEQ ID NO: 906731 - RNA, 22 nt, Human
agaauccuguuuuacuucauca

SEQ ID NO: 906732 - RNA, 21 nt, Human
ucuuccugacauaugcaaggc

SEQ ID NO: 906733 - RNA, 19 nt, Human
gcugagguggaggaaggag

SEQ ID NO: 906734 - RNA, 19 nt, Human
ccauauaaccagcaagugu

SEQ ID NO: 906735 - RNA, 22 nt, Human
uuuaguguaagcauaaagaaca

SEQ ID NO: 906736 - RNA, 22 nt, Human
aggcugucaucuuugcaggcag

SEQ ID NO: 906737 - RNA, 22 nt, Human
ucucucagacuccccaugguuu

SEQ ID NO: 906738 - RNA, 20 nt, Human
ggcacaguuuuugcaccugc

SEQ ID NO: 906739 - RNA, 22 nt, Human
uaacaaugcaaaaugaauuuag

SEQ ID NO: 906740 - RNA, 22 nt, Human
acuaggaaguggcaaaacugga

SEQ ID NO: 906741 - RNA, 22 nt, Human
gcaugagggggguuaggaaguu

SEQ ID NO: 906742 - RNA, 22 nt, Human
cuggacagugcugcuugagaug

SEQ ID NO: 906743 - RNA, 22 nt, Human
ucuucaaacugaaaauuuagaa

SEQ ID NO: 906744 - RNA, 22 nt, Human
guucuuuaaguggagaaggaaa

SEQ ID NO: 906745 - RNA, 22 nt, Human
ucacgagggcccugggcagcug

SEQ ID NO: 906746 - RNA, 22 nt, Human
acaagaagucacaucuaggagu

SEQ ID NO: 906747 - RNA, 22 nt, Human
uaaaauguagcuucuaggcugg

SEQ ID NO: 906748 - RNA, 22 nt, Human
cugagccccaucugaggugccc

SEQ ID NO: 906749 - RNA, 19 nt, Human
ccauucauauagacagcag

SEQ ID NO: 906750 - RNA, 22 nt, Human
caaagagcuguucagugucgcu

SEQ ID NO: 906751 - RNA, 22 nt, Human
cacuggcauuagucacgaggca

SEQ ID NO: 906752 - RNA, 22 nt, Human
accacccaccucacagcauagu

SEQ ID NO: 906753 - RNA, 22 nt, Human
cagucuccaaaucagucugaau

SEQ ID NO: 906754 - RNA, 22 nt, Human
uaauggcauugauuacaugaaa

SEQ ID NO: 906755 - RNA, 22 nt, Human
caggacugauguuccuccagcc

SEQ ID NO: 906756 - RNA, 22 nt, Human
guugauuuagugagugagcagu

SEQ ID NO: 906757 - RNA, 22 nt, Human
ucagcagaggggaaggcaucug

SEQ ID NO: 906758 - RNA, 22 nt, Human
uagauucuuugcuagaucauug

SEQ ID NO: 906759 - RNA, 22 nt, Human
acuugucuuuaauccgaaugua

SEQ ID NO: 906760 - RNA, 19 nt, Human
agaggcagucuccaacagg

SEQ ID NO: 906761 - RNA, 22 nt, Human
caaaggaggugauaggcccucu

SEQ ID NO: 906762 - RNA, 22 nt, Human
ugcuggagcaucugagagcauc

SEQ ID NO: 906763 - RNA, 22 nt, Human
agccagauacuuggaaagaccc

SEQ ID NO: 906764 - RNA, 22 nt, Human
aacacauuggaagccaagaaug

SEQ ID NO: 906765 - RNA, 22 nt, Human
uuucuuaggcucuaaaaugacu

SEQ ID NO: 906766 - RNA, 22 nt, Human
uggcagggaguugcaggauuuc

SEQ ID NO: 906767 - RNA, 22 nt, Human
gauguccauuucaaaccucauu

SEQ ID NO: 906768 - RNA, 22 nt, Human
gggcuggcuaagacuuuucugu

SEQ ID NO: 906769 - RNA, 21 nt, Human
agaugcaguuaugagaugcag

SEQ ID NO: 906770 - RNA, 22 nt, Human
gcuguuccugcuuagaggucgg

SEQ ID NO: 906771 - RNA, 22 nt, Human
cagggcaguaccgcccucuggc

SEQ ID NO: 906772 - RNA, 19 nt, Human
gguuuaucuguuucuucuc

SEQ ID NO: 906773 - RNA, 22 nt, Human
augcuuuagugucaaguuuggg

SEQ ID NO: 906774 - RNA, 22 nt, Human
ucagaaaagaccacauuauucu

SEQ ID NO: 906775 - RNA, 22 nt, Human
uucauugaaauacagucuugac

SEQ ID NO: 906776 - RNA, 22 nt, Human
agggagacacaugaggaaguca

SEQ ID NO: 906777 - RNA, 22 nt, Human
aguuuauguaaaauuaguaaug

SEQ ID NO: 906778 - RNA, 22 nt, Human
uauucuugacugcuuacuaugu

SEQ ID NO: 906779 - RNA, 22 nt, Human
agauguggccuuugggagauua

SEQ ID NO: 906780 - RNA, 19 nt, Human
uuacaauggugauuagguu

SEQ ID NO: 906781 - RNA, 22 nt, Human
agcaaggaguagaacaagagug

SEQ ID NO: 906782 - RNA, 22 nt, Human
agcacacaucacuucugcucau

SEQ ID NO: 906783 - RNA, 22 nt, Human
guuacaaagcacuucaagugaa

SEQ ID NO: 906784 - RNA, 22 nt, Human
caaagugaguuauaaacaucuu

SEQ ID NO: 906785 - RNA, 22 nt, Human
gugagcagaacagguggcuucu

SEQ ID NO: 906786 - RNA, 22 nt, Human
cucuucuguaccucggccucca

SEQ ID NO: 906787 - RNA, 22 nt, Human
uuccagagcuuugcgcuuggaa

SEQ ID NO: 906788 - RNA, 22 nt, Human
ccagcuccaggacugggagcug

SEQ ID NO: 906789 - RNA, 23 nt, Human
ccuggggagcuguauccagagug

SEQ ID NO: 906790 - RNA, 22 nt, Human
gaugcaggauagcuucacccag

SEQ ID NO: 906791 - RNA, 22 nt, Human
aggaaugguuauggggauagua

SEQ ID NO: 906792 - RNA, 22 nt, Human
ucugcaggaggcuggcugcagg

SEQ ID NO: 906793 - RNA, 22 nt, Human
gugggaagucucucggaggaag

SEQ ID NO: 906794 - RNA, 22 nt, Human
agagaagggguaaagaguccug

SEQ ID NO: 906795 - RNA, 22 nt, Human
uauguguggagccagccuggag

SEQ ID NO: 906796 - RNA, 22 nt, Human
guucuauucuccaguuacauau

SEQ ID NO: 906797 - RNA, 22 nt, Human
gagguccagccaagcggcaagg

SEQ ID NO: 906798 - RNA, 22 nt, Human
aaugguaauuugcagaaagucc

SEQ ID NO: 906799 - RNA, 22 nt, Human
augggaggcagcagagcccagc

SEQ ID NO: 906800 - RNA, 22 nt, Human
gguuugacagcuuggggcuguc

SEQ ID NO: 906801 - RNA, 22 nt, Human
acuguucugccaacuuugguua

SEQ ID NO: 906802 - RNA, 22 nt, Human
cccuucccuucugggagaucca

SEQ ID NO: 906803 - RNA, 22 nt, Human
ugaaaccacugaugguaccaag

SEQ ID NO: 906804 - RNA, 22 nt, Human
acaggcacucucauuaaaauag

SEQ ID NO: 906805 - RNA, 22 nt, Human
aggugccaauuuucagugaaca

SEQ ID NO: 906806 - RNA, 21 nt, Human
aaaaguuugacaggaaaggga

SEQ ID NO: 906807 - RNA, 22 nt, Human
aggcuggcauacauuuguucuu

SEQ ID NO: 906808 - RNA, 22 nt, Human
uggcccaggaggccagagggca

SEQ ID NO: 906809 - RNA, 22 nt, Human
aauguacagcugcugcugaagg

SEQ ID NO: 906810 - RNA, 22 nt, Human
ggagcagccacgucucagggca

SEQ ID NO: 906811 - RNA, 22 nt, Human
uggcugcuagccagagcuucag

SEQ ID NO: 906812 - RNA, 22 nt, Human
gaacaggguuugagaggcuuag

SEQ ID NO: 906813 - RNA, 22 nt, Human
uaaguaguuuguagccccauag

SEQ ID NO: 906814 - RNA, 22 nt, Human
ccuggcagcuccuccccggcgg

SEQ ID NO: 906815 - RNA, 22 nt, Human
gggcugacaaccaucugacaag

SEQ ID NO: 906816 - RNA, 22 nt, Human
uguaccagaugucuaaagccau

SEQ ID NO: 906817 - RNA, 22 nt, Human
cacaguacgcacccgauacaug

SEQ ID NO: 906818 - RNA, 16 nt, Human
guggcagccccuucuc

SEQ ID NO: 906819 - RNA, 22 nt, Human
gagcugcccugagcuuugcaug

SEQ ID NO: 906820 - RNA, 22 nt, Human
uuuuuuggauaauaaacgaucu

SEQ ID NO: 906821 - RNA, 22 nt, Human
ugggaguugagacauuuugccc

SEQ ID NO: 906822 - RNA, 22 nt, Human
cuucauaauuaccuugucugcc

SEQ ID NO: 906823 - RNA, 22 nt, Human
ugaaguuguuaagguugccauu

SEQ ID NO: 906824 - RNA, 22 nt, Human
gcugcccuguuuagccaggguu

SEQ ID NO: 906825 - RNA, 22 nt, Human
ucuguccaagacaccauagugg

SEQ ID NO: 906826 - RNA, 22 nt, Human
auacugauugauauucccauga

SEQ ID NO: 906827 - RNA, 22 nt, Human
auuuagagaauaagacauaaau

SEQ ID NO: 906828 - RNA, 22 nt, Human
ugugcucuucuguuacuuguag

SEQ ID NO: 906829 - RNA, 22 nt, Human
uuucucauggacccuucaugau

SEQ ID NO: 906830 - RNA, 22 nt, Human
uuugcuauaaaagggucacacg

SEQ ID NO: 906831 - RNA, 22 nt, Human
ugcaugauagagaugguauuag

SEQ ID NO: 906832 - RNA, 22 nt, Human
gaagcagcuaggaucuucauuu

SEQ ID NO: 906833 - RNA, 22 nt, Human
ugucuacaaacguguacacauu

SEQ ID NO: 906834 - RNA, 22 nt, Human
uucuuacauuagucugugcuuu

SEQ ID NO: 906835 - RNA, 22 nt, Human
aucagugcugggagaugucaga

SEQ ID NO: 906836 - RNA, 22 nt, Human
agagagucuuucucuuccuguu

SEQ ID NO: 906837 - RNA, 17 nt, Human
uccuccccgcaguugca

SEQ ID NO: 906838 - RNA, 22 nt, Human
caggauggucagaugcauuguc

SEQ ID NO: 906839 - RNA, 22 nt, Human
guuauuaaaguauuugauguua

SEQ ID NO: 906840 - RNA, 22 nt, Human
uuaaacagacaguaaaugaaac

SEQ ID NO: 906841 - RNA, 22 nt, Human
auaaagucauuaugaagaucua

SEQ ID NO: 906842 - RNA, 23 nt, Human
aauuaucuauuucaaauuuagca

SEQ ID NO: 906843 - RNA, 22 nt, Human
ucaagcaaucucugugucccug

SEQ ID NO: 906844 - RNA, 22 nt, Human
auguauacgugcaagucacagg

SEQ ID NO: 906845 - RNA, 22 nt, Human
gagcugugauuggugucucacu

SEQ ID NO: 906846 - RNA, 22 nt, Human
ugcuggcuacauuauugcuguc

SEQ ID NO: 906847 - RNA, 22 nt, Human
aaaauguucaagcaugcugguu

SEQ ID NO: 906848 - RNA, 22 nt, Human
ugcuuuaaaauggacuguuuug

SEQ ID NO: 906849 - RNA, 22 nt, Human
uuucugcuaaucuuuuacugag

SEQ ID NO: 906850 - RNA, 22 nt, Human
uugguuuguucaccaucaagca

SEQ ID NO: 906851 - RNA, 22 nt, Human
augucccaagauacagcuagag

SEQ ID NO: 906852 - RNA, 20 nt, Human
aauucugucuuuucugcugc

SEQ ID NO: 906853 - RNA, 22 nt, Human
auacaguauaacuaauaaaccc

SEQ ID NO: 906854 - RNA, 22 nt, Human
auuauauaggacuugcccuucc

SEQ ID NO: 906855 - RNA, 22 nt, Human
uauuuucaucuuguccuuggau

SEQ ID NO: 906856 - RNA, 22 nt, Human
gacaggcuuccuaagugccaga

SEQ ID NO: 906857 - RNA, 22 nt, Human
gcuucuggugaggccucaggaa

SEQ ID NO: 906858 - RNA, 22 nt, Human
ugcggagggagcagucggcugu

SEQ ID NO: 906859 - RNA, 23 nt, Human
uucauaacucaaggugauauaau

SEQ ID NO: 906860 - RNA, 21 nt, Human
gccaaggggguagcuauuccu

SEQ ID NO: 906861 - RNA, 22 nt, Human
uucugcauaggcuauauuuguu

SEQ ID NO: 906862 - RNA, 22 nt, Human
acguggagagaauagggcacca

SEQ ID NO: 906863 - RNA, 22 nt, Human
guuacaaauguaaauucugggg

SEQ ID NO: 906864 - RNA, 22 nt, Human
ugcuuauugcuuucaagacugu

SEQ ID NO: 906865 - RNA, 22 nt, Human
caauuucacuaauaauauuuac

SEQ ID NO: 906866 - RNA, 20 nt, Human
gccuguucacaggcuucuug

SEQ ID NO: 906867 - RNA, 22 nt, Human
ucagggaguguuggcaggauca

SEQ ID NO: 906868 - RNA, 22 nt, Human
aaaguucuuugcaucuuugcuc

SEQ ID NO: 906869 - RNA, 22 nt, Human
aacacauugccagagaucagca

SEQ ID NO: 906870 - RNA, 22 nt, Human
uagaaacucaggauacucuucc

SEQ ID NO: 906871 - RNA, 22 nt, Human
ucuguaaagacuccaaaagcca

SEQ ID NO: 906872 - RNA, 22 nt, Human
uuuggaaauuacucauuguccu

SEQ ID NO: 906873 - RNA, 17 nt, Human
ugcagcugauggggaaa

SEQ ID NO: 906874 - RNA, 22 nt, Human
cugaaggggguuucacugagcu

SEQ ID NO: 906875 - RNA, 22 nt, Human
uggcgagguuucagagagcggc

SEQ ID NO: 906876 - RNA, 22 nt, Human
uagugucugacauuuaagagca

SEQ ID NO: 906877 - RNA, 22 nt, Human
aaguuuguucauucauucaucc

SEQ ID NO: 906878 - RNA, 22 nt, Human
aaccugaauuacuuuugcacca

SEQ ID NO: 906879 - RNA, 22 nt, Human
aaagaguucuaugaucuuucca

SEQ ID NO: 906880 - RNA, 22 nt, Human
agucucuugcacauuguauuaa

SEQ ID NO: 906881 - RNA, 22 nt, Human
uggcagggugccaguugcgagu

SEQ ID NO: 906882 - RNA, 19 nt, Human
uauggcaggccgaggcacu

SEQ ID NO: 906883 - RNA, 22 nt, Human
cuccuguggcuuucugauuuca

SEQ ID NO: 906884 - RNA, 22 nt, Human
ugaaauguacauaaaaacgcac

SEQ ID NO: 906885 - RNA, 22 nt, Human
augcagacaugggagaguugag

SEQ ID NO: 906886 - RNA, 22 nt, Human
gacugggguaaggugaggaggu

SEQ ID NO: 906887 - RNA, 22 nt, Human
agguggagugugcagggagagc

SEQ ID NO: 906888 - RNA, 22 nt, Human
ugagcacauuucacaugacagg

SEQ ID NO: 906889 - RNA, 22 nt, Human
gcuccugaaggcucugcagggu

SEQ ID NO: 906890 - RNA, 22 nt, Human
uaaacuaucuguguuugaaguu

SEQ ID NO: 906891 - RNA, 21 nt, Human
agaagggauugugguaaagau

SEQ ID NO: 906892 - RNA, 19 nt, Human
cuggcaaaugcuuuggcca

SEQ ID NO: 906893 - RNA, 22 nt, Human
ccagagcuccagggcuacagaa

SEQ ID NO: 906894 - RNA, 21 nt, Human
gggcauccuuucccacccugc

SEQ ID NO: 906895 - RNA, 22 nt, Human
cuaaagucauacaaggugggag

SEQ ID NO: 906896 - RNA, 22 nt, Human
uuguuuccauugcagacugugu

SEQ ID NO: 906897 - RNA, 22 nt, Human
uggcaguuuacagaguucugaa

SEQ ID NO: 906898 - RNA, 21 nt, Human
uacagaugaggagaccaaggc

SEQ ID NO: 906899 - RNA, 22 nt, Human
aauguucagggcagcccugcua

SEQ ID NO: 906900 - RNA, 22 nt, Human
ugguuagacucaccuuauaguu

SEQ ID NO: 906901 - RNA, 22 nt, Human
ugccaagcuagaacguucccag

SEQ ID NO: 906902 - RNA, 22 nt, Human
ugucugggauguaauuccugcc

SEQ ID NO: 906903 - RNA, 22 nt, Human
auagaucauuugcauuggucgu

SEQ ID NO: 906904 - RNA, 22 nt, Human
cuggccuaaaauugcuucugca

SEQ ID NO: 906905 - RNA, 22 nt, Human
uuucuuucucguaaacuuaguu

SEQ ID NO: 906906 - RNA, 22 nt, Human
aggccugcagcaggagcaaacc

SEQ ID NO: 906907 - RNA, 22 nt, Human
ucugauucauucaugugcacca

SEQ ID NO: 906908 - RNA, 22 nt, Human
aagccagauagaagaacucauu

SEQ ID NO: 906909 - RNA, 22 nt, Human
ggaagaaagguggacaacaggu

SEQ ID NO: 906910 - RNA, 18 nt, Human
ggguccugugggagacag

SEQ ID NO: 906911 - RNA, 22 nt, Human
agugggagaaugaauaagggcc

SEQ ID NO: 906912 - RNA, 22 nt, Human
uucuggcuguaugauauuuaau

SEQ ID NO: 906913 - RNA, 22 nt, Human
ucuuggcaggcagugggguaag

SEQ ID NO: 906914 - RNA, 22 nt, Human
caggcagcguccugcuuccugu

SEQ ID NO: 906915 - RNA, 22 nt, Human
caaagcagagccagagcuuguc

SEQ ID NO: 906916 - RNA, 22 nt, Human
cagggccagggcuauggugaag

SEQ ID NO: 906917 - RNA, 19 nt, Human
auguuuuaugcugauggga

SEQ ID NO: 906918 - RNA, 22 nt, Human
gaggggucuuuuguugucaggg

SEQ ID NO: 906919 - RNA, 22 nt, Human
cuucuggguguggagugaggac

SEQ ID NO: 906920 - RNA, 22 nt, Human
acagccaggaauucuggagaag

SEQ ID NO: 906921 - RNA, 22 nt, Human
cagcuucuucaguccuggagcu

SEQ ID NO: 906922 - RNA, 20 nt, Human
uccugcuuccaccagagcac

SEQ ID NO: 906923 - RNA, 22 nt, Human
aaagaucuccccuucaaagagu

SEQ ID NO: 906924 - RNA, 22 nt, Human
gcagucuuuucugugacuggcu

SEQ ID NO: 906925 - RNA, 22 nt, Human
acagcugcacacugaacuuggu

SEQ ID NO: 906926 - RNA, 22 nt, Human
guucuucaguaaaauuaaaugu

SEQ ID NO: 906927 - RNA, 22 nt, Human
ucauuuacacuucacaaaugga

SEQ ID NO: 906928 - RNA, 22 nt, Human
ggaaaauuuccuucaaaaugug

SEQ ID NO: 906929 - RNA, 23 nt, Human
ccucucuuuuuaggugguguuug

SEQ ID NO: 906930 - RNA, 17 nt, Human
uuuguucauugaagaga

SEQ ID NO: 906931 - RNA, 21 nt, Human
ggccacaguuagggcucagga

SEQ ID NO: 906932 - RNA, 22 nt, Human
uuuagugccugguuuccuucuu

SEQ ID NO: 906933 - RNA, 22 nt, Human
gcucccagcauugcugcugaau

SEQ ID NO: 906934 - RNA, 22 nt, Human
uuacugcacgugggacauauau

SEQ ID NO: 906935 - RNA, 19 nt, Human
ugggcagugccagggcuua

SEQ ID NO: 906936 - RNA, 22 nt, Human
agugaaauuuguuuagauaggu

SEQ ID NO: 906937 - RNA, 22 nt, Human
ucugguccccauuccagguggg

SEQ ID NO: 906938 - RNA, 22 nt, Human
ucuugcagacagcuuccagccu

SEQ ID NO: 906939 - RNA, 22 nt, Human
agggcugcugcuccgggcccag

SEQ ID NO: 906940 - RNA, 22 nt, Human
uguuuacaagccacuuguuaag

SEQ ID NO: 906941 - RNA, 22 nt, Human
uagaaacucacguuaucauugc

SEQ ID NO: 906942 - RNA, 22 nt, Human
aguuacaaguacaggcuuugga

SEQ ID NO: 906943 - RNA, 22 nt, Human
gcugggaagugcaagaucaagg

SEQ ID NO: 906944 - RNA, 22 nt, Human
cauccugcggggagcagagggc

SEQ ID NO: 906945 - RNA, 22 nt, Human
gcagggcaucccugagcgggug

SEQ ID NO: 906946 - RNA, 22 nt, Human
auuuacagacguggauuagugc

SEQ ID NO: 906947 - RNA, 22 nt, Human
agucugggcauuuaggauguug

SEQ ID NO: 906948 - RNA, 22 nt, Human
uuccacugauuuugguugaccu

SEQ ID NO: 906949 - RNA, 22 nt, Human
cugagggcagugaugaagguga

SEQ ID NO: 906950 - RNA, 22 nt, Human
caacugaucuauuuccuaacug

SEQ ID NO: 906951 - RNA, 22 nt, Human
gggcuccagccagcuccuugug

SEQ ID NO: 906952 - RNA, 22 nt, Human
augcaagagcaauaugguaugc

SEQ ID NO: 906953 - RNA, 22 nt, Human
ucaagaacuggaaauugauaug

SEQ ID NO: 906954 - RNA, 20 nt, Human
ucugagaagcaaacaauguu

SEQ ID NO: 906955 - RNA, 22 nt, Human
agugaacaaagguagugagcau

SEQ ID NO: 906956 - RNA, 22 nt, Human
acaguguuccuuuguugugacu

SEQ ID NO: 906957 - RNA, 19 nt, Human
gggcuggagggauagagcc

SEQ ID NO: 906958 - RNA, 20 nt, Human
gagucacagaagaagcugaa

SEQ ID NO: 906959 - RNA, 22 nt, Human
auguacaaaaugccacugaauu

SEQ ID NO: 906960 - RNA, 22 nt, Human
ucucucagcuuugagaccugcu

SEQ ID NO: 906961 - RNA, 22 nt, Human
cugcuguggaugcaggaccuca

SEQ ID NO: 906962 - RNA, 22 nt, Human
cagcugugauuccugcugucca

SEQ ID NO: 906963 - RNA, 22 nt, Human
gggccuggcaugcagccccguu

SEQ ID NO: 906964 - RNA, 20 nt, Human
caugacacuguuccucugcc

SEQ ID NO: 906965 - RNA, 22 nt, Human
aaagccacaguucuaugucugc

SEQ ID NO: 906966 - RNA, 22 nt, Human
agagggaaugugauugcaccau

SEQ ID NO: 906967 - RNA, 22 nt, Human
cuucagagaacuugaucgcugc

SEQ ID NO: 906968 - RNA, 22 nt, Human
uguucaguuaacacagacacca

SEQ ID NO: 906969 - RNA, 22 nt, Human
cccaggagagggaaccaaaugu

SEQ ID NO: 906970 - RNA, 22 nt, Human
uugcuaaucauauuucaucacu

SEQ ID NO: 906971 - RNA, 22 nt, Human
ucugaagagcuuuggaaguaug

SEQ ID NO: 906972 - RNA, 22 nt, Human
cuggcccagagagcagagcuua

SEQ ID NO: 906973 - RNA, 22 nt, Human
augcugugucaggaauuugaua

SEQ ID NO: 906974 - RNA, 23 nt, Human
uguacaguuguuugacucagcuc

SEQ ID NO: 906975 - RNA, 22 nt, Human
cagcugggagcuccauuagaua

SEQ ID NO: 906976 - RNA, 22 nt, Human
aaagcaugugaauagaauaugg

SEQ ID NO: 906977 - RNA, 22 nt, Human
ucauuagaaaugcagauucuca

SEQ ID NO: 906978 - RNA, 22 nt, Human
ccagaagucaaguaagaugaag

SEQ ID NO: 906979 - RNA, 22 nt, Human
cugggcagaauuuuaggauggc

SEQ ID NO: 906980 - RNA, 19 nt, Human
aaggaauggcuuuaaguag

SEQ ID NO: 906981 - RNA, 18 nt, Human
acaggcugugggaauggu

SEQ ID NO: 906982 - RNA, 22 nt, Human
cuagaauaucauaugaagagac

SEQ ID NO: 906983 - RNA, 22 nt, Human
augaaauguaugagucuggguu

SEQ ID NO: 906984 - RNA, 22 nt, Human
aaguuccuauauccaaauacag

SEQ ID NO: 906985 - RNA, 22 nt, Human
aggaaauugggacacagagaaa

SEQ ID NO: 906986 - RNA, 22 nt, Human
uauggccaaucggguggacgcc

SEQ ID NO: 906987 - RNA, 22 nt, Human
ugaggaaggaauugagguuuua

SEQ ID NO: 906988 - RNA, 22 nt, Human
gcaggugaaugauggacuagga

SEQ ID NO: 906989 - RNA, 22 nt, Human
acaauuacucaacuuugcugcu

SEQ ID NO: 906990 - RNA, 22 nt, Human
uccaugaggcagggaggcuggc

SEQ ID NO: 906991 - RNA, 22 nt, Human
uuaacacauauuuaucaauugc

SEQ ID NO: 906992 - RNA, 22 nt, Human
gcagugauuggaucagagaugg

SEQ ID NO: 906993 - RNA, 22 nt, Human
ggggaagaaccgggauucccau

SEQ ID NO: 906994 - RNA, 22 nt, Human
gucugggcaagggagauggcgc

SEQ ID NO: 906995 - RNA, 22 nt, Human
gcugccugucccaggaugagga

SEQ ID NO: 906996 - RNA, 22 nt, Human
cuggaggacagaggccaugucu

SEQ ID NO: 906997 - RNA, 22 nt, Human
uauugcaucauccugcaggggu

SEQ ID NO: 906998 - RNA, 22 nt, Human
ugcugcuuugauguguaaauca

SEQ ID NO: 906999 - RNA, 22 nt, Human
gguguuggaacauggugagauu

SEQ ID NO: 907000 - RNA, 22 nt, Human
cauguaaagcauccuucuaggg

SEQ ID NO: 907001 - RNA, 21 nt, Human
agugaaauugcaucagaggga

SEQ ID NO: 907002 - RNA, 22 nt, Human
aaacuucuugcugcauuuucug

SEQ ID NO: 907003 - RNA, 22 nt, Human
ggguccagcuacaucagggugg

SEQ ID NO: 907004 - RNA, 22 nt, Human
cuggucugagggcucuugaggc

SEQ ID NO: 907005 - RNA, 22 nt, Human
uuaaagagaaaguguuugucuu

SEQ ID NO: 907006 - RNA, 22 nt, Human
agaugagggguagaaaggacuu

SEQ ID NO: 907007 - RNA, 22 nt, Human
ggcuguggacacugagcucaga

SEQ ID NO: 907008 - RNA, 22 nt, Human
cucuagaacagugcugagccuu

SEQ ID NO: 907009 - RNA, 22 nt, Human
accuggaaugggguugagagcu

SEQ ID NO: 907010 - RNA, 22 nt, Human
uggcccaguagaaaagggaucg

SEQ ID NO: 907011 - RNA, 22 nt, Human
ccugagggucaaggagcccuag

SEQ ID NO: 907012 - RNA, 22 nt, Human
augugucuaauuccaggagcac

SEQ ID NO: 907013 - RNA, 22 nt, Human
ugcaagaggagacuguacucag

SEQ ID NO: 907014 - RNA, 19 nt, Human
cagaggcaccagguauaga

SEQ ID NO: 907015 - RNA, 22 nt, Human
uggcaccuggugcaggguggcc

SEQ ID NO: 907016 - RNA, 22 nt, Human
uccucagggaagaugagccuca

SEQ ID NO: 907017 - RNA, 21 nt, Human
uucauugaacuauuuguggag

SEQ ID NO: 907018 - RNA, 22 nt, Human
uaaauguagucaaaggagccuc

SEQ ID NO: 907019 - RNA, 22 nt, Human
uauguauaaaugcaugugugga

SEQ ID NO: 907020 - RNA, 18 nt, Human
ggcacuggugaugcagag

SEQ ID NO: 907021 - RNA, 22 nt, Human
auguguaaaaagugcuuaauau

SEQ ID NO: 907022 - RNA, 22 nt, Human
caggaggcccaaagggcgcaga

SEQ ID NO: 907023 - RNA, 22 nt, Human
auuuugcugugguacauuagga

SEQ ID NO: 907024 - RNA, 22 nt, Human
cugcacagagcagggcagacac

SEQ ID NO: 907025 - RNA, 22 nt, Human
ucaggcagcuccaggaauggua

SEQ ID NO: 907026 - RNA, 22 nt, Human
acauguaagacuagcuuaaagu

SEQ ID NO: 907027 - RNA, 22 nt, Human
cugcuguuugccgucauugccu

SEQ ID NO: 907028 - RNA, 22 nt, Human
ugcuuuuuccccuucuggcgag

SEQ ID NO: 907029 - RNA, 22 nt, Human
cuucagcugcaguuauguuuag

SEQ ID NO: 907030 - RNA, 22 nt, Human
aaaucagaaaauauggagagga

SEQ ID NO: 907031 - RNA, 22 nt, Human
acagacaugggccgcucuugag

SEQ ID NO: 907032 - RNA, 23 nt, Human
uuccuuaacuguuaagauugucu

SEQ ID NO: 907033 - RNA, 22 nt, Human
ucccaggaucugagggcagaga

SEQ ID NO: 907034 - RNA, 23 nt, Human
ggcuccaggccugacgggcgcgg

SEQ ID NO: 907035 - RNA, 22 nt, Human
ugguauuuccaggcuuauggua

SEQ ID NO: 907036 - RNA, 22 nt, Human
aaaaguuuaagacucauucuag

SEQ ID NO: 907037 - RNA, 22 nt, Human
aacaggggauuagauagcaggc

SEQ ID NO: 907038 - RNA, 22 nt, Human
cuuguguuguacauucuauggg

SEQ ID NO: 907039 - RNA, 22 nt, Human
aauagcaaacagacaugcacaa

SEQ ID NO: 907040 - RNA, 19 nt, Human
gcuguucugaccaucaccc

SEQ ID NO: 907041 - RNA, 22 nt, Human
cauuuggaccaaaauagccaac

SEQ ID NO: 907042 - RNA, 22 nt, Human
uuuaucagaaguuagagaaaga

SEQ ID NO: 907043 - RNA, 22 nt, Human
gccuggucucuuucaugucagu

SEQ ID NO: 907044 - RNA, 22 nt, Human
ugccaggcuuagagcaggggcu

SEQ ID NO: 907045 - RNA, 19 nt, Human
ugcacacagauaaguaucu

SEQ ID NO: 907046 - RNA, 22 nt, Human
aagguacaguuuuaagaauaag

SEQ ID NO: 907047 - RNA, 22 nt, Human
aguguuuuauuagaacacagcc

SEQ ID NO: 907048 - RNA, 22 nt, Human
aguccuuugcugaacugucaca

SEQ ID NO: 907049 - RNA, 22 nt, Human
ucacccagaaaagacagcagau

SEQ ID NO: 907050 - RNA, 22 nt, Human
cagagccagcuguccuuggcau

SEQ ID NO: 907051 - RNA, 22 nt, Human
ccagcucugcagggccuggggu

SEQ ID NO: 907052 - RNA, 22 nt, Human
gucuuuuuauuauagaguggag

SEQ ID NO: 907053 - RNA, 22 nt, Human
uuguacacacaggaacaaacgu

SEQ ID NO: 907054 - RNA, 22 nt, Human
uggucagaugcugaguggaucu

SEQ ID NO: 907055 - RNA, 22 nt, Human
cccacaggacgggcuaaagagu

SEQ ID NO: 907056 - RNA, 22 nt, Human
gucuccuccauggagaugguau

SEQ ID NO: 907057 - RNA, 22 nt, Human
uggugccaucauagcucacugc

SEQ ID NO: 907058 - RNA, 22 nt, Human
cuuucuuugcagugagccagag

SEQ ID NO: 907059 - RNA, 22 nt, Human
agagucagcuuaugacacaguc

SEQ ID NO: 907060 - RNA, 22 nt, Human
augggcugcuucuccagcaccu

SEQ ID NO: 907061 - RNA, 22 nt, Human
augcauauagaacauuugacau

SEQ ID NO: 907062 - RNA, 22 nt, Human
aagcccuuggcagaguucccca

SEQ ID NO: 907063 - RNA, 23 nt, Human
cagcugaagcagccugggcugga

SEQ ID NO: 907064 - RNA, 20 nt, Human
agaaggcauuccucauucuu

SEQ ID NO: 907065 - RNA, 21 nt, Human
gguauucugugucaccuuugg

SEQ ID NO: 907066 - RNA, 22 nt, Human
auuccuuguuucacugaaaagg

SEQ ID NO: 907067 - RNA, 22 nt, Human
uggaaggcuuggaauacuucca

SEQ ID NO: 907068 - RNA, 21 nt, Human
ggggucaagugaaugguguug

SEQ ID NO: 907069 - RNA, 22 nt, Human
ccagagcccagggucaugcagg

SEQ ID NO: 907070 - RNA, 22 nt, Human
aaaugcuaacaaggaaugcugc

SEQ ID NO: 907071 - RNA, 22 nt, Human
cugaggugagaggaggccaugu

SEQ ID NO: 907072 - RNA, 22 nt, Human
ucucugggagccaggaugacac

SEQ ID NO: 907073 - RNA, 22 nt, Human
uuggcccacucucagaaugugg

SEQ ID NO: 907074 - RNA, 22 nt, Human
ugcagcaagaaggcacugucug

SEQ ID NO: 907075 - RNA, 17 nt, Human
aaucucaguggcuuaag

SEQ ID NO: 907076 - RNA, 22 nt, Human
uccagagaacgaugaaagcugg

SEQ ID NO: 907077 - RNA, 22 nt, Human
cucugugcuuaugcuccauggg

SEQ ID NO: 907078 - RNA, 22 nt, Human
agggccuggcuucacuuucuca

SEQ ID NO: 907079 - RNA, 18 nt, Human
gagcugggagaaggaagg

SEQ ID NO: 907080 - RNA, 20 nt, Human
uucugcuugcaaauaucaag

SEQ ID NO: 907081 - RNA, 22 nt, Human
acagggaacaggaauauacaaa

SEQ ID NO: 907082 - RNA, 22 nt, Human
uaaaucuucuacaucaucauaa

SEQ ID NO: 907083 - RNA, 22 nt, Human
gcauggcuuacagaggcugcag

SEQ ID NO: 907084 - RNA, 22 nt, Human
uuguucacuaugaagagguugg

SEQ ID NO: 907085 - RNA, 22 nt, Human
ugcuuccuucccguucuucucc

SEQ ID NO: 907086 - RNA, 22 nt, Human
ugcccagccaauuuguuauguu

SEQ ID NO: 907087 - RNA, 22 nt, Human
ugucauuuaguccucugugugu

SEQ ID NO: 907088 - RNA, 22 nt, Human
augaauaaaacauuuuaaucag

SEQ ID NO: 907089 - RNA, 22 nt, Human
auauuaaugggauuuagucagg

SEQ ID NO: 907090 - RNA, 22 nt, Human
aaaguuguuuccuaaggucuaa

SEQ ID NO: 907091 - RNA, 20 nt, Human
caaauucuguugaauacacc

SEQ ID NO: 907092 - RNA, 22 nt, Human
uuuauccauucaccaguugaac

SEQ ID NO: 907093 - RNA, 22 nt, Human
acauuuguauauaugcagcaua

SEQ ID NO: 907094 - RNA, 22 nt, Human
aguccaaacaaacuucccgagg

SEQ ID NO: 907095 - RNA, 22 nt, Human
uggcuucaccucagcaugaagg

SEQ ID NO: 907096 - RNA, 22 nt, Human
ccauucauuuguugucagccuu

SEQ ID NO: 907097 - RNA, 22 nt, Human
aaggaacuuugcagaggugauu

SEQ ID NO: 907098 - RNA, 22 nt, Human
aagaacaugaaccucuucuaac

SEQ ID NO: 907099 - RNA, 21 nt, Human
acucaagugggcaugcgcaga

SEQ ID NO: 907100 - RNA, 22 nt, Human
aaacaaauagugcaugggaauu

SEQ ID NO: 907101 - RNA, 22 nt, Human
ggcauggacgucucugaggcca

SEQ ID NO: 907102 - RNA, 22 nt, Human
gcgugggguagguagacaugga

SEQ ID NO: 907103 - RNA, 22 nt, Human
ccaggaagaaacagucuuuaua

SEQ ID NO: 907104 - RNA, 22 nt, Human
ucaagaaacugugcuacagagu

SEQ ID NO: 907105 - RNA, 22 nt, Human
aguuuccucaucuguaaaauga

SEQ ID NO: 907106 - RNA, 22 nt, Human
gaacagcuauaaucaucugucc

SEQ ID NO: 907107 - RNA, 22 nt, Human
cugccuguuuccucuugcuccc

SEQ ID NO: 907108 - RNA, 22 nt, Human
ucacuaagugccgaguuuaguu

SEQ ID NO: 907109 - RNA, 22 nt, Human
ggccuggcugguucaguacccu

SEQ ID NO: 907110 - RNA, 22 nt, Human
ugggccuguuucccuucagggc

SEQ ID NO: 907111 - RNA, 22 nt, Human
cugcugaucgaaucagucaccc

SEQ ID NO: 907112 - RNA, 22 nt, Human
gauacacaugcaugugcaugua

SEQ ID NO: 907113 - RNA, 22 nt, Human
caggacuggaagucucaagaga

SEQ ID NO: 907114 - RNA, 22 nt, Human
guuuccuagaucaguguucuua

SEQ ID NO: 907115 - RNA, 22 nt, Human
aagucuuuugcugucauaggug

SEQ ID NO: 907116 - RNA, 22 nt, Human
ggagaaagaaauuuuugauugg

SEQ ID NO: 907117 - RNA, 22 nt, Human
aauucugaugaauaaaucaucc

SEQ ID NO: 907118 - RNA, 22 nt, Human
aaagugcugggauuacaagugu

SEQ ID NO: 907119 - RNA, 22 nt, Human
auuuaugacguguucggucaau

SEQ ID NO: 907120 - RNA, 22 nt, Human
augguguccccagccuuugaag

SEQ ID NO: 907121 - RNA, 22 nt, Human
uagaaaugauugagcuguaaua

SEQ ID NO: 907122 - RNA, 22 nt, Human
auugucaucgauguuagccagu

SEQ ID NO: 907123 - RNA, 22 nt, Human
ucugcauauuuaucaugagucu

SEQ ID NO: 907124 - RNA, 22 nt, Human
gcaggagccaggccgagcuggu

SEQ ID NO: 907125 - RNA, 22 nt, Human
caaggcugcaaaacuacauggg

SEQ ID NO: 907126 - RNA, 22 nt, Human
ugaacuuucacaagaauaugcu

SEQ ID NO: 907127 - RNA, 22 nt, Human
gcugugcugauucauucccugc

SEQ ID NO: 907128 - RNA, 22 nt, Human
aagcagagguagggugugcagu

SEQ ID NO: 907129 - RNA, 22 nt, Human
guccagagaggcaggaggcuac

SEQ ID NO: 907130 - RNA, 22 nt, Human
cagaaacagagaaauauuggcu

SEQ ID NO: 907131 - RNA, 22 nt, Human
ugcugaggcauuuggacagagu

SEQ ID NO: 907132 - RNA, 22 nt, Human
cuggcucccggggaucgagcac

SEQ ID NO: 907133 - RNA, 22 nt, Human
cugggccuccucugcccaagcu

SEQ ID NO: 907134 - RNA, 22 nt, Human
cuguuauuaaaaagcucaggcu

SEQ ID NO: 907135 - RNA, 22 nt, Human
uacugccaaauugcagcaaugu

SEQ ID NO: 907136 - RNA, 22 nt, Human
ugauuuuauugaaacuucacuu

SEQ ID NO: 907137 - RNA, 22 nt, Human
agaccacuuggauaagaaacag

SEQ ID NO: 907138 - RNA, 22 nt, Human
aggcuggcugacuucugaagca

SEQ ID NO: 907139 - RNA, 21 nt, Human
aggugccaaggagaagcaggc

SEQ ID NO: 907140 - RNA, 22 nt, Human
auuuuacuuugugaauauugac

SEQ ID NO: 907141 - RNA, 22 nt, Human
agcaaugauguuuucaaguagg

SEQ ID NO: 907142 - RNA, 21 nt, Human
ucaggaagagcuucucccacu

SEQ ID NO: 907143 - RNA, 22 nt, Human
ggcuggcgggugggugaaagac

SEQ ID NO: 907144 - RNA, 22 nt, Human
uccagaggcuccaaagggagau

SEQ ID NO: 907145 - RNA, 22 nt, Human
ucccccaacucuuagcacugua

SEQ ID NO: 907146 - RNA, 22 nt, Human
aaugucugcucuacucaggagg

SEQ ID NO: 907147 - RNA, 22 nt, Human
uaaagugcaugcggggccagau

SEQ ID NO: 907148 - RNA, 22 nt, Human
auucaagaggaacaaugaagau

SEQ ID NO: 907149 - RNA, 22 nt, Human
aaugguaauggagagaacuacu

SEQ ID NO: 907150 - RNA, 22 nt, Human
ucaggaagauuaguuuccuacc

SEQ ID NO: 907151 - RNA, 23 nt, Human
uuccagagucuucgacgguaggc

SEQ ID NO: 907152 - RNA, 22 nt, Human
ugucuccugagagcuggacaga

SEQ ID NO: 907153 - RNA, 22 nt, Human
ucucuaaagaagccucccuaaa

SEQ ID NO: 907154 - RNA, 22 nt, Human
agcuccugugugaagccucccu

SEQ ID NO: 907155 - RNA, 22 nt, Human
aguuggcauuccugcauccuau

SEQ ID NO: 907156 - RNA, 22 nt, Human
gcauucauauggaaggaaacua

SEQ ID NO: 907157 - RNA, 22 nt, Human
agggccuccagggcagcagugg

SEQ ID NO: 907158 - RNA, 23 nt, Human
uuucacagcuuuuauucugcauc

SEQ ID NO: 907159 - RNA, 22 nt, Human
gggugggacucuuuggccugag

SEQ ID NO: 907160 - RNA, 22 nt, Human
uaguauaauuguucuggaauca

SEQ ID NO: 907161 - RNA, 21 nt, Human
uugcauuuuaaguuuacugcu

SEQ ID NO: 907162 - RNA, 22 nt, Human
guccugggccugcugaggcuga

SEQ ID NO: 907163 - RNA, 18 nt, Human
agccaaggaggaggagga

SEQ ID NO: 907164 - RNA, 22 nt, Human
gcggggggcaggcaguacguug

SEQ ID NO: 907165 - RNA, 22 nt, Human
ucuccugaugaugguacuggca

SEQ ID NO: 907166 - RNA, 22 nt, Human
uggaccugaagaauaggaagua

SEQ ID NO: 907167 - RNA, 23 nt, Human
uccuaacugauucugcagucucu

SEQ ID NO: 907168 - RNA, 22 nt, Human
cagcugccuaugaccuagccuc

SEQ ID NO: 907169 - RNA, 22 nt, Human
gucuuauuagguuaacccugcu

SEQ ID NO: 907170 - RNA, 23 nt, Human
uguccuuuuugaggccuccuccu

SEQ ID NO: 907171 - RNA, 19 nt, Human
gcugggugggguccacagc

SEQ ID NO: 907172 - RNA, 22 nt, Human
uccagagauaacuauuuaggag

SEQ ID NO: 907173 - RNA, 22 nt, Human
acaagaaagguaggauucaggu

SEQ ID NO: 907174 - RNA, 22 nt, Human
ggcugcagaggcgaucugaggu

SEQ ID NO: 907175 - RNA, 22 nt, Human
uccugaacauuaugcaagcuuc

SEQ ID NO: 907176 - RNA, 22 nt, Human
gugccuggggguaauguaggau

SEQ ID NO: 907177 - RNA, 22 nt, Human
uuccugggacuggagcagccca

SEQ ID NO: 907178 - RNA, 22 nt, Human
cugccuggucucaggcaugggg

SEQ ID NO: 907179 - RNA, 22 nt, Human
auggacaggaacucccuuggca

SEQ ID NO: 907180 - RNA, 22 nt, Human
augguuuuguccucuuugguuc

SEQ ID NO: 907181 - RNA, 22 nt, Human
cugggaagaagugggcuacauu

SEQ ID NO: 907182 - RNA, 22 nt, Human
aacagcagggggaccugcuggu

SEQ ID NO: 907183 - RNA, 22 nt, Human
ggcagguuggaugcuguaguga

SEQ ID NO: 907184 - RNA, 22 nt, Human
cugagcauuugugcagcuucuc

SEQ ID NO: 907185 - RNA, 22 nt, Human
uccaagaaguuucguuaaaugu

SEQ ID NO: 907186 - RNA, 23 nt, Human
ugcuguggauggcagguccuugc

SEQ ID NO: 907187 - RNA, 22 nt, Human
ccugggcauaaaucacuccaag

SEQ ID NO: 907188 - RNA, 22 nt, Human
ugucuacuccugugcuagcucc

SEQ ID NO: 907189 - RNA, 22 nt, Human
gcucugguagauccucaggcuc

SEQ ID NO: 907190 - RNA, 22 nt, Human
agagauucugugucaaaacgaa

SEQ ID NO: 907191 - RNA, 22 nt, Human
aggcccuguuguagcauuuugg

SEQ ID NO: 907192 - RNA, 22 nt, Human
cuaggccagagagaccucauga

SEQ ID NO: 907193 - RNA, 21 nt, Human
aggcccuggaggucagagaaa

SEQ ID NO: 907194 - RNA, 22 nt, Human
ccugucugcagauaucucaggu

SEQ ID NO: 907195 - RNA, 22 nt, Human
cuggcagcaggucacacgcaga

SEQ ID NO: 907196 - RNA, 22 nt, Human
gccaggcauuauuccgaucccu

SEQ ID NO: 907197 - RNA, 22 nt, Human
uuuuccuguccaggcaauuauu

SEQ ID NO: 907198 - RNA, 22 nt, Human
ucugccaugcuaacuucaguau

SEQ ID NO: 907199 - RNA, 22 nt, Human
uauuugucaccuauggcugucc

SEQ ID NO: 907200 - RNA, 22 nt, Human
agggagacaaaagcagcugcca

SEQ ID NO: 907201 - RNA, 22 nt, Human
uccugaaaaauuacauguucag

SEQ ID NO: 907202 - RNA, 22 nt, Human
auucugggccccaucccagacc

SEQ ID NO: 907203 - RNA, 22 nt, Human
uacagaaaaacuggcauugaag

SEQ ID NO: 907204 - RNA, 22 nt, Human
aauguaugagcgugaaagcacu

SEQ ID NO: 907205 - RNA, 22 nt, Human
gccuggugguauccuggcaaga

SEQ ID NO: 907206 - RNA, 22 nt, Human
acagacauggaccaagcacugu

SEQ ID NO: 907207 - RNA, 22 nt, Human
aggaagggcuguuucuccaaga

SEQ ID NO: 907208 - RNA, 22 nt, Human
uuucucauuuagaguggcaggg

SEQ ID NO: 907209 - RNA, 22 nt, Human
gaauuuaaauuuaaaucuacca

SEQ ID NO: 907210 - RNA, 22 nt, Human
ugcuggaaagagaguuucaaug

SEQ ID NO: 907211 - RNA, 20 nt, Human
gaugucuuggucacaguggc

SEQ ID NO: 907212 - RNA, 22 nt, Human
cuagccagacucaagggccacc

SEQ ID NO: 907213 - RNA, 22 nt, Human
uuacaacucugaacuacagagg

SEQ ID NO: 907214 - RNA, 22 nt, Human
cugagccccucugaccucagag

SEQ ID NO: 907215 - RNA, 19 nt, Human
cugaggcccauguaccaug

SEQ ID NO: 907216 - RNA, 22 nt, Human
cuguccagcuuggcuccugggg

SEQ ID NO: 907217 - RNA, 22 nt, Human
agcaacuuuauuccacugggca

SEQ ID NO: 907218 - RNA, 22 nt, Human
ugcuacacucaaucagugcuau

SEQ ID NO: 907219 - RNA, 22 nt, Human
aucugcaggauguuaggaugau

SEQ ID NO: 907220 - RNA, 22 nt, Human
gugcagugaaaaaagaaugucc

SEQ ID NO: 907221 - RNA, 22 nt, Human
accuacagaucuuugaaugugu

SEQ ID NO: 907222 - RNA, 22 nt, Human
gggcucuguggaugugagagcu

SEQ ID NO: 907223 - RNA, 22 nt, Human
ggccagcuggaguuccgggugg

SEQ ID NO: 907224 - RNA, 22 nt, Human
uuugggaacaaugaggaucuga

SEQ ID NO: 907225 - RNA, 22 nt, Human
cagucugggacugagcuccacc

SEQ ID NO: 907226 - RNA, 22 nt, Human
gucuuauuuaaccuaaauuucu

SEQ ID NO: 907227 - RNA, 22 nt, Human
uuuuacaagcugagucguuaaa

SEQ ID NO: 907228 - RNA, 22 nt, Human
cugaggccagcugcagagcucu

SEQ ID NO: 907229 - RNA, 22 nt, Human
uacagauauagagauuuauaga

SEQ ID NO: 907230 - RNA, 23 nt, Human
uuguuucuuuguauugucucuau

SEQ ID NO: 907231 - RNA, 21 nt, Human
uggcccuggccacggcugcca

SEQ ID NO: 907232 - RNA, 22 nt, Human
caugaauuuauauuauuaguga

SEQ ID NO: 907233 - RNA, 22 nt, Human
caugcuuauauggaaaggaaga

SEQ ID NO: 907234 - RNA, 22 nt, Human
cauuuguuaauuacuauuaucu

SEQ ID NO: 907235 - RNA, 22 nt, Human
ccacagugguucucaaccaggg

SEQ ID NO: 907236 - RNA, 22 nt, Human
acauuucuuugcuagacagcag

SEQ ID NO: 907237 - RNA, 22 nt, Human
gcuggugagcaaaggagaagga

SEQ ID NO: 907238 - RNA, 22 nt, Human
augccacauaaccaguucacuu

SEQ ID NO: 907239 - RNA, 22 nt, Human
aacuucugcuuuuacaggcagu

SEQ ID NO: 907240 - RNA, 22 nt, Human
gacaggguccaaaggcagggga

SEQ ID NO: 907241 - RNA, 22 nt, Human
uugcugcuuucauuuauacagu

SEQ ID NO: 907242 - RNA, 22 nt, Human
cugugucugaauaacucugugu

SEQ ID NO: 907243 - RNA, 22 nt, Human
acuguacuuuagaaaguguagu

SEQ ID NO: 907244 - RNA, 22 nt, Human
uucaagauccagcacaacagug

SEQ ID NO: 907245 - RNA, 22 nt, Human
uuccaaagcacuugauguaaag

SEQ ID NO: 907246 - RNA, 22 nt, Human
cuggcuggguuccaggauucca

SEQ ID NO: 907247 - RNA, 22 nt, Human
cccuggagggacagcugcucua

SEQ ID NO: 907248 - RNA, 22 nt, Human
ccaggcaauucugaaagcauuu

SEQ ID NO: 907249 - RNA, 22 nt, Human
guagaauuuuaauaauggagau

SEQ ID NO: 907250 - RNA, 22 nt, Human
gugaaggacugaaugaaaaugu

SEQ ID NO: 907251 - RNA, 22 nt, Human
ggagagagaccuccaugcccag

SEQ ID NO: 907252 - RNA, 22 nt, Human
uauagaaguaagcauugugaug

SEQ ID NO: 907253 - RNA, 18 nt, Human
gugcaugcaugcucugcc

SEQ ID NO: 907254 - RNA, 22 nt, Human
ggucugugugcuuugggaagug

SEQ ID NO: 907255 - RNA, 22 nt, Human
ugcuagaauuagguuaaacaaa

SEQ ID NO: 907256 - RNA, 22 nt, Human
gagaaagauguaggcugggagg

SEQ ID NO: 907257 - RNA, 22 nt, Human
cuggagauguccgggugcuguu

SEQ ID NO: 907258 - RNA, 22 nt, Human
gcccaggacucagggugucgcg

SEQ ID NO: 907259 - RNA, 22 nt, Human
gaaaaggccuggggcaaagugu

SEQ ID NO: 907260 - RNA, 22 nt, Human
caaugucugggagaccugugau

SEQ ID NO: 907261 - RNA, 22 nt, Human
ucaguuuauuucuuguuccaca

SEQ ID NO: 907262 - RNA, 22 nt, Human
aucucauaacucauuugaagac

SEQ ID NO: 907263 - RNA, 22 nt, Human
ucagaggauugccucagcgagc

SEQ ID NO: 907264 - RNA, 22 nt, Human
cagaugugcaugaugggaaggg

SEQ ID NO: 907265 - RNA, 22 nt, Human
ugagaaaaguacauggagaagc

SEQ ID NO: 907266 - RNA, 22 nt, Human
ugagaaccaugaaaagcuguca

SEQ ID NO: 907267 - RNA, 22 nt, Human
ccagagugacgugaagugugaa

SEQ ID NO: 907268 - RNA, 22 nt, Human
uuggaaguaaugaagagguggg

SEQ ID NO: 907269 - RNA, 22 nt, Human
guggccuggauagacuccaucu

SEQ ID NO: 907270 - RNA, 22 nt, Human
ugcaguguggccaugucagcua

SEQ ID NO: 907271 - RNA, 22 nt, Human
ccuuccuugagaagcaauuccu

SEQ ID NO: 907272 - RNA, 22 nt, Human
guucacagcugggacaagacug

SEQ ID NO: 907273 - RNA, 22 nt, Human
ccugugucaccggaacggagga

SEQ ID NO: 907274 - RNA, 22 nt, Human
uaccuagacaugaacacagaug

SEQ ID NO: 907275 - RNA, 22 nt, Human
cugccucuccccagaguggccc

SEQ ID NO: 907276 - RNA, 22 nt, Human
ucuccaggugcuaagugugccu

SEQ ID NO: 907277 - RNA, 20 nt, Human
cuuugcaggagaacagagaa

SEQ ID NO: 907278 - RNA, 22 nt, Human
ggagcugcauuuagggagccuu

SEQ ID NO: 907279 - RNA, 22 nt, Human
agccucugggggagcugggagc

SEQ ID NO: 907280 - RNA, 23 nt, Human
uggauaaagcugugcugcauagg

SEQ ID NO: 907281 - RNA, 22 nt, Human
uggcuuucucccccagcuucuc

SEQ ID NO: 907282 - RNA, 22 nt, Human
cuacaagaggaauggaggucug

SEQ ID NO: 907283 - RNA, 22 nt, Human
ugauuuccacgugcacccaggu

SEQ ID NO: 907284 - RNA, 23 nt, Human
aaugggugcaacuauccaugaca

SEQ ID NO: 907285 - RNA, 22 nt, Human
aucagcugcuacauuggccucu

SEQ ID NO: 907286 - RNA, 22 nt, Human
cgcagcugaccuuuuacaaaac

SEQ ID NO: 907287 - RNA, 22 nt, Human
uauacaaguaaugcugaaugau

SEQ ID NO: 907288 - RNA, 22 nt, Human
aaggguugaagauaaauaaggu

SEQ ID NO: 907289 - RNA, 22 nt, Human
aagaugcuuauugcuccugcag

SEQ ID NO: 907290 - RNA, 22 nt, Human
gcugcucuugaggggcucacug

SEQ ID NO: 907291 - RNA, 22 nt, Human
acacagaugcauuacacaucua

SEQ ID NO: 907292 - RNA, 22 nt, Human
ugccaguguggaacuaggaaga

SEQ ID NO: 907293 - RNA, 22 nt, Human
cuggaaaguucaagauaaagcu

SEQ ID NO: 907294 - RNA, 22 nt, Human
aagucuguuugagugucacacu

SEQ ID NO: 907295 - RNA, 22 nt, Human
gcacccagcccagggcgugaug

SEQ ID NO: 907296 - RNA, 22 nt, Human
aggcuagucaagucaagcagug

SEQ ID NO: 907297 - RNA, 22 nt, Human
aggagguggcugaacuugaggg

SEQ ID NO: 907298 - RNA, 22 nt, Human
gcaguaggagaagaggaugcuu

SEQ ID NO: 907299 - RNA, 22 nt, Human
cacauuuaagugcuuguucaga

SEQ ID NO: 907300 - RNA, 22 nt, Human
augaaacaaggguauuuucucu

SEQ ID NO: 907301 - RNA, 22 nt, Human
gaacaguacaguugaguaguug

SEQ ID NO: 907302 - RNA, 22 nt, Human
gacagggacgaggcuucaggca

SEQ ID NO: 907303 - RNA, 22 nt, Human
gccugccagccacaguggcagc

SEQ ID NO: 907304 - RNA, 22 nt, Human
ucuauuagauuauucucaagga

SEQ ID NO: 907305 - RNA, 22 nt, Human
ugaucugguccuacugugggca

SEQ ID NO: 907306 - RNA, 22 nt, Human
gcuccuggagagauugagaaag

SEQ ID NO: 907307 - RNA, 22 nt, Human
aggcagugaugagucaugaaua

SEQ ID NO: 907308 - RNA, 22 nt, Human
cuucaacaguuuuagaacacug

SEQ ID NO: 907309 - RNA, 22 nt, Human
uguccuuuguguaucuauagua

SEQ ID NO: 907310 - RNA, 22 nt, Human
acugaagcugggcgaugccucc

SEQ ID NO: 907311 - RNA, 22 nt, Human
agcuucuugaccaagccuguaa

SEQ ID NO: 907312 - RNA, 22 nt, Human
ucaggagggcuaagacuguagc

SEQ ID NO: 907313 - RNA, 22 nt, Human
agcacaggaacauggagauggg

SEQ ID NO: 907314 - RNA, 23 nt, Human
gggagaugggaaaugaaggcucu

SEQ ID NO: 907315 - RNA, 22 nt, Human
agaaaugaagcaggaguuauua

SEQ ID NO: 907316 - RNA, 22 nt, Human
ucugcuggccuuagcaggucua

SEQ ID NO: 907317 - RNA, 22 nt, Human
gggcgcagccaauccuggcccu

SEQ ID NO: 907318 - RNA, 22 nt, Human
aagugucuuuauauuugagaaa

SEQ ID NO: 907319 - RNA, 22 nt, Human
gugcugcucaagggacaggaca

SEQ ID NO: 907320 - RNA, 18 nt, Human
uuccaguagcuguaucac

SEQ ID NO: 907321 - RNA, 22 nt, Human
gcagcugggucugugugggcug

SEQ ID NO: 907322 - RNA, 22 nt, Human
cagcauccguucucaggacuga

SEQ ID NO: 907323 - RNA, 22 nt, Human
cuugccucccucagcucacagc

SEQ ID NO: 907324 - RNA, 22 nt, Human
ucagcccugggacccagggaug

SEQ ID NO: 907325 - RNA, 22 nt, Human
acagugaaaagaauauuagaau

SEQ ID NO: 907326 - RNA, 22 nt, Human
acaaauuugaauccugacuucu

SEQ ID NO: 907327 - RNA, 22 nt, Human
ucucuguguugcaggaaaaucu

SEQ ID NO: 907328 - RNA, 22 nt, Human
aagcagaggguauggccagguu

SEQ ID NO: 907329 - RNA, 22 nt, Human
uuacagaacugcccuaguuggc

SEQ ID NO: 907330 - RNA, 22 nt, Human
cacauuuagguuccuauagcca

SEQ ID NO: 907331 - RNA, 22 nt, Human
ucugaaauggggcugaagcacu

SEQ ID NO: 907332 - RNA, 20 nt, Human
ucacuucuuccuuuugucua

SEQ ID NO: 907333 - RNA, 22 nt, Human
uauacagauggaaagauacaca

SEQ ID NO: 907334 - RNA, 22 nt, Human
auuuggaaacaugcugaccaug

SEQ ID NO: 907335 - RNA, 22 nt, Human
cuacacaguucugccuaauggc

SEQ ID NO: 907336 - RNA, 22 nt, Human
acagccuggccugaguuaaggc

SEQ ID NO: 907337 - RNA, 22 nt, Human
ggugcagccuccccagugacag

SEQ ID NO: 907338 - RNA, 22 nt, Human
ucaguguccggagccugagugc

SEQ ID NO: 907339 - RNA, 22 nt, Human
uugauguacagaauuguucaca

SEQ ID NO: 907340 - RNA, 22 nt, Human
gcugcugucuggucugagggcu

SEQ ID NO: 907341 - RNA, 22 nt, Human
cccugagaugccucacccuagu

SEQ ID NO: 907342 - RNA, 22 nt, Human
auccaggguguggagagagcuc

SEQ ID NO: 907343 - RNA, 20 nt, Human
gccucagccaacccaugggg

SEQ ID NO: 907344 - RNA, 22 nt, Human
gaggcacaccagggagucuugu

SEQ ID NO: 907345 - RNA, 22 nt, Human
cuguggcuuugcagggcuuguu

SEQ ID NO: 907346 - RNA, 22 nt, Human
caggaaaugcguaguugaacuu

SEQ ID NO: 907347 - RNA, 22 nt, Human
cugcccugagucaugccagaug

SEQ ID NO: 907348 - RNA, 22 nt, Human
acagaggguuucuaaggauuug

SEQ ID NO: 907349 - RNA, 20 nt, Human
ugcugcugccuccgccucug

SEQ ID NO: 907350 - RNA, 22 nt, Human
caggggcaggugugagaucauc

SEQ ID NO: 907351 - RNA, 22 nt, Human
aucucaggaggacccugaugcu

SEQ ID NO: 907352 - RNA, 22 nt, Human
uuaggaagcacacaguaaauau

SEQ ID NO: 907353 - RNA, 22 nt, Human
agccugcuggaccaagcucaug

SEQ ID NO: 907354 - RNA, 22 nt, Human
agggcucuguccccagaggccc

SEQ ID NO: 907355 - RNA, 22 nt, Human
gauucuugggccuucugaaguu

SEQ ID NO: 907356 - RNA, 22 nt, Human
gugcaucaggaucugaccagau

SEQ ID NO: 907357 - RNA, 22 nt, Human
aagucagcacuccaggaagcca

SEQ ID NO: 907358 - RNA, 22 nt, Human
ugagcaggacucacugcagccu

SEQ ID NO: 907359 - RNA, 22 nt, Human
cccugagcauucaugugagcuu

SEQ ID NO: 907360 - RNA, 22 nt, Human
cugccaggugccagggcgcggc

SEQ ID NO: 907361 - RNA, 22 nt, Human
cccuggaggcggagcuugcagu

SEQ ID NO: 907362 - RNA, 22 nt, Human
aaauccaugguaaucuguuaca

SEQ ID NO: 907363 - RNA, 22 nt, Human
ugagccagucucucagaacccu

SEQ ID NO: 907364 - RNA, 22 nt, Human
aagguacaaaguauuauuuaaa

SEQ ID NO: 907365 - RNA, 19 nt, Human
aguggcugggcagaagcaa

SEQ ID NO: 907366 - RNA, 22 nt, Human
guuaaaugcacuauugaaagcu

SEQ ID NO: 907367 - RNA, 22 nt, Human
ucugaggccugaagcagcagag

SEQ ID NO: 907368 - RNA, 22 nt, Human
uacacauguccaaggugucacc

SEQ ID NO: 907369 - RNA, 22 nt, Human
uucuauguguugacaagccuga

SEQ ID NO: 907370 - RNA, 22 nt, Human
acuuucauuuguaauaaacuuc

SEQ ID NO: 907371 - RNA, 22 nt, Human
ggcucgagcagcuguguaggau

SEQ ID NO: 907372 - RNA, 19 nt, Human
aucagugcaugagugcugu

SEQ ID NO: 907373 - RNA, 21 nt, Human
cuuuuacauucagucaugaug

SEQ ID NO: 907374 - RNA, 22 nt, Human
aaauuaucaugggggagaaaca

SEQ ID NO: 907375 - RNA, 22 nt, Human
uucagugugugauaccugcugu

SEQ ID NO: 907376 - RNA, 21 nt, Human
ugggaugggucugggaccagc

SEQ ID NO: 907377 - RNA, 22 nt, Human
cucuagcaggugccuuguaaca

SEQ ID NO: 907378 - RNA, 22 nt, Human
ucugugcaggauuugaggaacc

SEQ ID NO: 907379 - RNA, 22 nt, Human
uucuucagauccuacaagucug

SEQ ID NO: 907380 - RNA, 22 nt, Human
ugaggucugcucaagucccugg

SEQ ID NO: 907381 - RNA, 22 nt, Human
gggcccaggccuccuuccuucc

SEQ ID NO: 907382 - RNA, 22 nt, Human
auaucauucugauguauaucuu

SEQ ID NO: 907383 - RNA, 22 nt, Human
aauggcuucugaagcacacuuu

SEQ ID NO: 907384 - RNA, 22 nt, Human
auuaaggagguaaacuaugguu

SEQ ID NO: 907385 - RNA, 21 nt, Human
agaaaaaccagcauguuuuca

SEQ ID NO: 907386 - RNA, 22 nt, Human
gaauacauuugccgugguucuc

SEQ ID NO: 907387 - RNA, 22 nt, Human
gagucccaugaugauagccaca

SEQ ID NO: 907388 - RNA, 22 nt, Human
cacuguaauagcauuauaagug

SEQ ID NO: 907389 - RNA, 22 nt, Human
cagcaguguacaaggugucaga

SEQ ID NO: 907390 - RNA, 20 nt, Human
cagugaggaggugcuggggg

SEQ ID NO: 907391 - RNA, 22 nt, Human
aguggccaauaugucaugcucu

SEQ ID NO: 907392 - RNA, 22 nt, Human
gauguaaacugggacuuccuag

SEQ ID NO: 907393 - RNA, 22 nt, Human
aggagcugucagagugccagag

SEQ ID NO: 907394 - RNA, 22 nt, Human
acauuugguugagcuguuguca

SEQ ID NO: 907395 - RNA, 22 nt, Human
ggcagcagaacuggcccuguau

SEQ ID NO: 907396 - RNA, 22 nt, Human
gcccuguuuugaaacuugcaua

SEQ ID NO: 907397 - RNA, 22 nt, Human
cuuugaagaucacauguugcuc

SEQ ID NO: 907398 - RNA, 22 nt, Human
uuucacauguggaaugccaggu

SEQ ID NO: 907399 - RNA, 22 nt, Human
aacagguugaggucaaaugcaa

SEQ ID NO: 907400 - RNA, 22 nt, Human
ggcagccagagggcagcuggau

SEQ ID NO: 907401 - RNA, 22 nt, Human
uuguugucauuguagaggauuu

SEQ ID NO: 907402 - RNA, 22 nt, Human
gggggacuaacuggauccugga

SEQ ID NO: 907403 - RNA, 22 nt, Human
acagaauuaucaggaaauguua

SEQ ID NO: 907404 - RNA, 18 nt, Human
aaggacacagucccugcu

SEQ ID NO: 907405 - RNA, 22 nt, Human
uaaaugauuuauguaugugaaa

SEQ ID NO: 907406 - RNA, 22 nt, Human
ucugucucaaguucuugcacuc

SEQ ID NO: 907407 - RNA, 22 nt, Human
ggaugcuggggaccaaucucug

SEQ ID NO: 907408 - RNA, 22 nt, Human
gggcagcaugaggacccucauc

SEQ ID NO: 907409 - RNA, 22 nt, Human
uuauagaucuaaaugugaaggg

SEQ ID NO: 907410 - RNA, 22 nt, Human
acacauuucucuuuuuguaagu

SEQ ID NO: 907411 - RNA, 22 nt, Human
gauuucaaggaguuuucacagu

SEQ ID NO: 907412 - RNA, 21 nt, Human
accuuuggguguuuauaauag

SEQ ID NO: 907413 - RNA, 22 nt, Human
ucucuggagcugcagauccagg

SEQ ID NO: 907414 - RNA, 22 nt, Human
gcauccucugagagcucuagau

SEQ ID NO: 907415 - RNA, 22 nt, Human
agaaugugugcaagcaagugug

SEQ ID NO: 907416 - RNA, 22 nt, Human
agcccagcggagcgggcccggg

SEQ ID NO: 907417 - RNA, 22 nt, Human
aacuggaaccuuuuauucaguc

SEQ ID NO: 907418 - RNA, 22 nt, Human
cccaggaacuccagagcuccuc

SEQ ID NO: 907419 - RNA, 22 nt, Human
uauuugcucaacccugccucca

SEQ ID NO: 907420 - RNA, 22 nt, Human
cuguauguagaauagcugacaa

SEQ ID NO: 907421 - RNA, 22 nt, Human
gguggccauucuaccgccuucu

SEQ ID NO: 907422 - RNA, 22 nt, Human
gaauuucagaucagagaccauu

SEQ ID NO: 907423 - RNA, 22 nt, Human
auacaauccagccauugccaca

SEQ ID NO: 907424 - RNA, 22 nt, Human
ccugaccuccaaguggcucugg

SEQ ID NO: 907425 - RNA, 18 nt, Human
uguagagccagguuugcc

SEQ ID NO: 907426 - RNA, 16 nt, Human
gaggcuggcagauguc

SEQ ID NO: 907427 - RNA, 22 nt, Human
acacauuucucccagucuccau

SEQ ID NO: 907428 - RNA, 22 nt, Human
aaggauuuguccaaagucacac

SEQ ID NO: 907429 - RNA, 22 nt, Human
ucuuccagaaguguuuucagaa

SEQ ID NO: 907430 - RNA, 22 nt, Human
ugugugucuuugccuccucuca

SEQ ID NO: 907431 - RNA, 20 nt, Human
agcagcuguguuuucauccu

SEQ ID NO: 907432 - RNA, 22 nt, Human
cacagugaguauuuaguaccua

SEQ ID NO: 907433 - RNA, 22 nt, Human
aaaaguguucaggaagaauaau

SEQ ID NO: 907434 - RNA, 22 nt, Human
uagaaacauguucuguucuguu

SEQ ID NO: 907435 - RNA, 22 nt, Human
uucuccucacugcagccuuuca

SEQ ID NO: 907436 - RNA, 22 nt, Human
ugaggguggcacaggcacaaag

SEQ ID NO: 907437 - RNA, 22 nt, Human
ugccugggaucugugcccuuug

SEQ ID NO: 907438 - RNA, 22 nt, Human
gcaauaaauaacauggaagaca

SEQ ID NO: 907439 - RNA, 22 nt, Human
aacaauuagacugacgguauua

SEQ ID NO: 907440 - RNA, 22 nt, Human
gaaacacugguaaagacugccg

SEQ ID NO: 907441 - RNA, 22 nt, Human
acaguguggaaagucaacuuga

SEQ ID NO: 907442 - RNA, 22 nt, Human
cuguaaaaugaaccuagucauc

SEQ ID NO: 907443 - RNA, 22 nt, Human
uacuaaauaguuuaauuccuca

SEQ ID NO: 907444 - RNA, 22 nt, Human
uagcugugugaugggaaaccuu

SEQ ID NO: 907445 - RNA, 22 nt, Human
agauacaaaagauaagauuuag

SEQ ID NO: 907446 - RNA, 22 nt, Human
ggcagugcaaggcagccuggau

SEQ ID NO: 907447 - RNA, 22 nt, Human
uaucaaaggcuaugugauuuuu

SEQ ID NO: 907448 - RNA, 22 nt, Human
cuuauucagaaggagaaaugga

SEQ ID NO: 907449 - RNA, 22 nt, Human
accuuuuacggugugacuagca

SEQ ID NO: 907450 - RNA, 22 nt, Human
caaggaaaacagaugaucaaca

SEQ ID NO: 907451 - RNA, 22 nt, Human
uccagacugcccugcacaugug

SEQ ID NO: 907452 - RNA, 22 nt, Human
caccauguauucaguuuggcac

SEQ ID NO: 907453 - RNA, 22 nt, Human
caguggccuuuccugcugcuca

SEQ ID NO: 907454 - RNA, 22 nt, Human
uuucuuuccagagugauuggca

SEQ ID NO: 907455 - RNA, 22 nt, Human
uuuauucaucaucuguucauau

SEQ ID NO: 907456 - RNA, 22 nt, Human
cucaggcugcccugacagcccc

SEQ ID NO: 907457 - RNA, 22 nt, Human
auacaucaccuauauauucaca

SEQ ID NO: 907458 - RNA, 19 nt, Human
gagguggguccccgcagcc

SEQ ID NO: 907459 - RNA, 20 nt, Human
uuuccuuucauuuuaguacc

SEQ ID NO: 907460 - RNA, 22 nt, Human
guaccaugggaucuagggccca

SEQ ID NO: 907461 - RNA, 22 nt, Human
cagagggugugaaggggaugaa

SEQ ID NO: 907462 - RNA, 22 nt, Human
aaagucaagguuuagacuagag

SEQ ID NO: 907463 - RNA, 22 nt, Human
uaacuucucugcuaucauagga

SEQ ID NO: 907464 - RNA, 22 nt, Human
guuaauuugcagcuuucgagcu

SEQ ID NO: 907465 - RNA, 22 nt, Human
ucacauuucuuuauguagucuu

SEQ ID NO: 907466 - RNA, 22 nt, Human
uagcugucagcugcaggcaggc

SEQ ID NO: 907467 - RNA, 22 nt, Human
ucccagaagagaugccacuuga

SEQ ID NO: 907468 - RNA, 22 nt, Human
uguuuuuacugugauccagaaa

SEQ ID NO: 907469 - RNA, 22 nt, Human
uccugcaggccagaggggugag

SEQ ID NO: 907470 - RNA, 22 nt, Human
cuggagaagagguaguauguag

SEQ ID NO: 907471 - RNA, 20 nt, Human
guauuacaggcuuagaacca

SEQ ID NO: 907472 - RNA, 17 nt, Human
agaugcuggccacaugu

SEQ ID NO: 907473 - RNA, 22 nt, Human
gagcucagaggcgucuuugucc

SEQ ID NO: 907474 - RNA, 22 nt, Human
gacagacaggugugguaggcac

SEQ ID NO: 907475 - RNA, 22 nt, Human
ugaaguuucuugaaucuuggag

SEQ ID NO: 907476 - RNA, 22 nt, Human
aaauuuaaggaggugcucacuu

SEQ ID NO: 907477 - RNA, 22 nt, Human
cuaaaugugacucaccaucuca

SEQ ID NO: 907478 - RNA, 22 nt, Human
cuggaaucuuuggagaaugugg

SEQ ID NO: 907479 - RNA, 22 nt, Human
auuacaaucgagagaaacaaau

SEQ ID NO: 907480 - RNA, 22 nt, Human
gcaggcaguuauuuaguagaau

SEQ ID NO: 907481 - RNA, 19 nt, Human
agcugugcagacacuucgc

SEQ ID NO: 907482 - RNA, 22 nt, Human
agaggacaaaaugagaagugcu

SEQ ID NO: 907483 - RNA, 22 nt, Human
uauccaaacauauagucucucu

SEQ ID NO: 907484 - RNA, 22 nt, Human
aaacagucgucuuaauaguauu

SEQ ID NO: 907485 - RNA, 22 nt, Human
ccaccugcugguuuugcucucc

SEQ ID NO: 907486 - RNA, 22 nt, Human
ccugggagccgacugacugugc

SEQ ID NO: 907487 - RNA, 22 nt, Human
aaauauuauugcuuaaggggag

SEQ ID NO: 907488 - RNA, 22 nt, Human
gaagccacagagauuguggggg

SEQ ID NO: 907489 - RNA, 22 nt, Human
uaaaugaguaauauagcuguuu

SEQ ID NO: 907490 - RNA, 22 nt, Human
gacugagaaucauagaaggcaa

SEQ ID NO: 907491 - RNA, 22 nt, Human
aauuuccagaucagaugacuca

SEQ ID NO: 907492 - RNA, 22 nt, Human
agccaggauuggcugagccuua

SEQ ID NO: 907493 - RNA, 22 nt, Human
agcuggccucacugcagaaugc

SEQ ID NO: 907494 - RNA, 22 nt, Human
aaaaggaggacaugguuacaga

SEQ ID NO: 907495 - RNA, 22 nt, Human
agcugccaucagccuuuggaug

SEQ ID NO: 907496 - RNA, 22 nt, Human
uccagagacuugcaugugcuug

SEQ ID NO: 907497 - RNA, 22 nt, Human
acacugaauauacaaugaauau

SEQ ID NO: 907498 - RNA, 22 nt, Human
agggccugucagcgguguccug

SEQ ID NO: 907499 - RNA, 22 nt, Human
uccuucagggggccgccugcac

SEQ ID NO: 907500 - RNA, 22 nt, Human
auguuuguugaucauuuaugaa

SEQ ID NO: 907501 - RNA, 22 nt, Human
cugccaggacugacgucuucag

SEQ ID NO: 907502 - RNA, 22 nt, Human
aaaagccaugcauaccuaagag

SEQ ID NO: 907503 - RNA, 22 nt, Human
ccuguguuuagauaugaugcug

SEQ ID NO: 907504 - RNA, 22 nt, Human
gccuaggguuggccugagaauc

SEQ ID NO: 907505 - RNA, 22 nt, Human
gagaggcuccgccacugcucag

SEQ ID NO: 907506 - RNA, 22 nt, Human
uuuucaagggcagggaaaucau

SEQ ID NO: 907507 - RNA, 22 nt, Human
auuauuauaaagugcaugaccu

SEQ ID NO: 907508 - RNA, 23 nt, Human
agugccauugacccuaugucuau

SEQ ID NO: 907509 - RNA, 22 nt, Human
ccacagaguuacaaaacaguca

SEQ ID NO: 907510 - RNA, 22 nt, Human
agugcugucuccuucccccggg

SEQ ID NO: 907511 - RNA, 22 nt, Human
agaggaaauggauaaaggguga

SEQ ID NO: 907512 - RNA, 22 nt, Human
ucuuugugccaugcagugaggc

SEQ ID NO: 907513 - RNA, 22 nt, Human
agcaagcugucaagagagcuga

SEQ ID NO: 907514 - RNA, 22 nt, Human
agggaggaaggaacuccuucua

SEQ ID NO: 907515 - RNA, 22 nt, Human
acagcugcuuucucuuacuaug

SEQ ID NO: 907516 - RNA, 22 nt, Human
agcaggaguuugaugcuuuuau

SEQ ID NO: 907517 - RNA, 22 nt, Human
gaaaaugugccuuuggguauug

SEQ ID NO: 907518 - RNA, 22 nt, Human
uuauagaugccuugaguaaaug

SEQ ID NO: 907519 - RNA, 22 nt, Human
accugcaggggugcucucuggg

SEQ ID NO: 907520 - RNA, 22 nt, Human
ucccagaggcuccagucucuau

SEQ ID NO: 907521 - RNA, 22 nt, Human
cugacacacugagcauuugaua

SEQ ID NO: 907522 - RNA, 22 nt, Human
ucuguacaguaccagauaguaa

SEQ ID NO: 907523 - RNA, 22 nt, Human
uaauaauuaguuauugaucgug

SEQ ID NO: 907524 - RNA, 19 nt, Human
gagguuucugaagugggcu

SEQ ID NO: 907525 - RNA, 22 nt, Human
uagaacuucuuacagcuaaguu

SEQ ID NO: 907526 - RNA, 22 nt, Human
ugcacacauguuuacaagcauc

SEQ ID NO: 907527 - RNA, 22 nt, Human
aaagucaucuguccuaggcucu

SEQ ID NO: 907528 - RNA, 23 nt, Human
ucuucaugcccaggccuuggugc

SEQ ID NO: 907529 - RNA, 22 nt, Human
uguuuuaucaagauggcauguc

SEQ ID NO: 907530 - RNA, 22 nt, Human
acauuucuggaguuucucaaca

SEQ ID NO: 907531 - RNA, 22 nt, Human
caggaagccacaggacagguag

SEQ ID NO: 907532 - RNA, 22 nt, Human
cagcuucuaccaucaggaaauu

SEQ ID NO: 907533 - RNA, 22 nt, Human
auuguuaauguugcacuaaggu

SEQ ID NO: 907534 - RNA, 22 nt, Human
ugucauguuuuccuacaaggua

SEQ ID NO: 907535 - RNA, 22 nt, Human
uguuccuugaauauaucagacg

SEQ ID NO: 907536 - RNA, 18 nt, Human
augugagagaaucuucuu

SEQ ID NO: 907537 - RNA, 22 nt, Human
aagccacugagauuucacugca

SEQ ID NO: 907538 - RNA, 22 nt, Human
caguaauagguaacauugcccu

SEQ ID NO: 907539 - RNA, 21 nt, Human
uauuugcugccaucuuugagg

SEQ ID NO: 907540 - RNA, 22 nt, Human
aguuucacagucugucauuguu

SEQ ID NO: 907541 - RNA, 22 nt, Human
auuuguuuaucgucgauuguag

SEQ ID NO: 907542 - RNA, 22 nt, Human
aggagguguugauagaagguuu

SEQ ID NO: 907543 - RNA, 22 nt, Human
guauuagaagaaauuauaggua

SEQ ID NO: 907544 - RNA, 22 nt, Human
aagagcaguguuuuacucagcu

SEQ ID NO: 907545 - RNA, 22 nt, Human
caagucaacucaaauuguuauc

SEQ ID NO: 907546 - RNA, 22 nt, Human
uagcaaaguuuuguggugauua

SEQ ID NO: 907547 - RNA, 22 nt, Human
uagucagggaugcaauuaugug

SEQ ID NO: 907548 - RNA, 22 nt, Human
augguaacaguugaguagaaac

SEQ ID NO: 907549 - RNA, 22 nt, Human
cugggcuuugaagccaggcugc

SEQ ID NO: 907550 - RNA, 23 nt, Human
gugauucucucugugugggcagg

SEQ ID NO: 907551 - RNA, 22 nt, Human
uguuggagcccgagucagggag

SEQ ID NO: 907552 - RNA, 22 nt, Human
cagcuccaucuugcuuauacca

SEQ ID NO: 907553 - RNA, 22 nt, Human
ccagucuccuaagagccccuga

SEQ ID NO: 907554 - RNA, 22 nt, Human
acaugaacacugcuugccacau

SEQ ID NO: 907555 - RNA, 22 nt, Human
gggcuggaggagauccagaggc

SEQ ID NO: 907556 - RNA, 22 nt, Human
guuuccauauuuuuagugccaa

SEQ ID NO: 907557 - RNA, 22 nt, Human
uagagcuugauuggauucaggg

SEQ ID NO: 907558 - RNA, 22 nt, Human
cauccaagaaaauuuucucucu

SEQ ID NO: 907559 - RNA, 22 nt, Human
ggugacgaauccauagcaucga

SEQ ID NO: 907560 - RNA, 22 nt, Human
ucaaguuaccuggucauuacua

SEQ ID NO: 907561 - RNA, 22 nt, Human
uggggugugagaaguagaggga

SEQ ID NO: 907562 - RNA, 22 nt, Human
acuugucuaugguuacauccua

SEQ ID NO: 907563 - RNA, 22 nt, Human
auuacaaguagacuaacuuuca

SEQ ID NO: 907564 - RNA, 22 nt, Human
acaaaugauuaucacagaggag

SEQ ID NO: 907565 - RNA, 22 nt, Human
cuguggcugcagaccuuaaaca

SEQ ID NO: 907566 - RNA, 22 nt, Human
uucugcaugaaaagaacugaac

SEQ ID NO: 907567 - RNA, 22 nt, Human
acauuucugucuuagggacugu

SEQ ID NO: 907568 - RNA, 22 nt, Human
uuccugguaaauuauguccagg

SEQ ID NO: 907569 - RNA, 22 nt, Human
gcuggcugggucccugagaggc

SEQ ID NO: 907570 - RNA, 22 nt, Human
auacaucucuuugaagugcuuu

SEQ ID NO: 907571 - RNA, 22 nt, Human
gugauucugccuggaagguccu

SEQ ID NO: 907572 - RNA, 22 nt, Human
ggcacacauggugguuggugaa

SEQ ID NO: 907573 - RNA, 22 nt, Human
cugcaguuuguaaacauuuuaa

SEQ ID NO: 907574 - RNA, 22 nt, Human
gagcacagugcaguuucugcua

SEQ ID NO: 907575 - RNA, 20 nt, Human
uggaggccaggauacuuugu

SEQ ID NO: 907576 - RNA, 22 nt, Human
ucaguguagcagacuuguagcc

SEQ ID NO: 907577 - RNA, 21 nt, Human
augccaagucuuaaugagggc

SEQ ID NO: 907578 - RNA, 22 nt, Human
agagacuguguccaucgugccu

SEQ ID NO: 907579 - RNA, 22 nt, Human
gaggucugccuucaggagaguu

SEQ ID NO: 907580 - RNA, 21 nt, Human
ccuucuccauuacaguaagcu

SEQ ID NO: 907581 - RNA, 22 nt, Human
gcagcugccaguccccuuccag

SEQ ID NO: 907582 - RNA, 22 nt, Human
caagugacugugcuggcaacau

SEQ ID NO: 907583 - RNA, 22 nt, Human
uccgggagcugaacgucuugcg

SEQ ID NO: 907584 - RNA, 22 nt, Human
uccaaauauaggaugugauaua

SEQ ID NO: 907585 - RNA, 22 nt, Human
uauuacagaaucaggcauaacu

SEQ ID NO: 907586 - RNA, 22 nt, Human
uacugagcugguccacugaggu

SEQ ID NO: 907587 - RNA, 22 nt, Human
acauucuuccagcuggcuguug

SEQ ID NO: 907588 - RNA, 22 nt, Human
aacaggcaauuuaggacucuuu

SEQ ID NO: 907589 - RNA, 22 nt, Human
uacuuagacucuaucuagagau

SEQ ID NO: 907590 - RNA, 22 nt, Human
uuugugaauagguuggcuucca

SEQ ID NO: 907591 - RNA, 22 nt, Human
uuguauucuuuaugacuucccu

SEQ ID NO: 907592 - RNA, 19 nt, Human
ccuggcucugagcccagcc

SEQ ID NO: 907593 - RNA, 22 nt, Human
ggcaggcacauuugggggccgu

SEQ ID NO: 907594 - RNA, 22 nt, Human
gccuguguuuuuaacucuagga

SEQ ID NO: 907595 - RNA, 22 nt, Human
uggcagugaaagacaauugggc

SEQ ID NO: 907596 - RNA, 19 nt, Human
uuuaugucauugaggucau

SEQ ID NO: 907597 - RNA, 22 nt, Human
gagggaggcaucaugaauccag

SEQ ID NO: 907598 - RNA, 22 nt, Human
uaagaaguguugccuaaugcaa

SEQ ID NO: 907599 - RNA, 22 nt, Human
uuucuacaugucaguaacugau

SEQ ID NO: 907600 - RNA, 22 nt, Human
uaaaaggcacuuggaugcugag

SEQ ID NO: 907601 - RNA, 20 nt, Human
cagggccuaugauugagcuu

SEQ ID NO: 907602 - RNA, 22 nt, Human
uuccugagcuuuuaaccuaguc

SEQ ID NO: 907603 - RNA, 22 nt, Human
aucugucuuccaccacacaucc

SEQ ID NO: 907604 - RNA, 22 nt, Human
cugcugugcaacauugcaccua

SEQ ID NO: 907605 - RNA, 22 nt, Human
gagugcguguuuggggaugugg

SEQ ID NO: 907606 - RNA, 22 nt, Human
augucugucuuuguacuccaca

SEQ ID NO: 907607 - RNA, 22 nt, Human
ugucucaucucuuaaccccacu

SEQ ID NO: 907608 - RNA, 22 nt, Human
ugucauguaaccuuucugagcc

SEQ ID NO: 907609 - RNA, 22 nt, Human
ccagggcauguccaagacuuag

SEQ ID NO: 907610 - RNA, 22 nt, Human
ccacaggcugcugcaggucccg

SEQ ID NO: 907611 - RNA, 18 nt, Human
gugcugugggcaguggcc

SEQ ID NO: 907612 - RNA, 22 nt, Human
gagauuuagcugcuuaacuccu

SEQ ID NO: 907613 - RNA, 22 nt, Human
gagcuguggucaacaggaaauu

SEQ ID NO: 907614 - RNA, 21 nt, Human
agagucugcauuucugacaag

SEQ ID NO: 907615 - RNA, 22 nt, Human
aguguccccuccaagggccugg

SEQ ID NO: 907616 - RNA, 21 nt, Human
aguuuagaccaagccuuucca

SEQ ID NO: 907617 - RNA, 23 nt, Human
auaucacacccaguacagucucc

SEQ ID NO: 907618 - RNA, 22 nt, Human
ccugaggacacacgcugcagga

SEQ ID NO: 907619 - RNA, 22 nt, Human
aggucacguccugugaugucau

SEQ ID NO: 907620 - RNA, 22 nt, Human
gaggggcuugaggcccugaugg

SEQ ID NO: 907621 - RNA, 22 nt, Human
gcacagaggaugaggcagcucu

SEQ ID NO: 907622 - RNA, 22 nt, Human
caagaaauucuguucagauagc

SEQ ID NO: 907623 - RNA, 22 nt, Human
agcccagcaguaagauuagaga

SEQ ID NO: 907624 - RNA, 22 nt, Human
agcugggucuugggccaggaga

SEQ ID NO: 907625 - RNA, 22 nt, Human
uuacacaaaaauaagauauggc

SEQ ID NO: 907626 - RNA, 22 nt, Human
uaagguuugaagaagacugagc

SEQ ID NO: 907627 - RNA, 22 nt, Human
augcacauaggccaaaucauuu

SEQ ID NO: 907628 - RNA, 22 nt, Human
aauacaguaauuuugaugaguu

SEQ ID NO: 907629 - RNA, 22 nt, Human
gccuggucucugggguugggua

SEQ ID NO: 907630 - RNA, 22 nt, Human
auguuucucacuguuucucuau

SEQ ID NO: 907631 - RNA, 22 nt, Human
augcacauguaucuauauacaa

SEQ ID NO: 907632 - RNA, 22 nt, Human
acuucucugcuaccugcaaaga

SEQ ID NO: 907633 - RNA, 22 nt, Human
ggcccagaauacuuuguaaaau

SEQ ID NO: 907634 - RNA, 22 nt, Human
cauguggcuuuggcaugugccc

SEQ ID NO: 907635 - RNA, 22 nt, Human
uucacagguucuuuuuaaggcu

SEQ ID NO: 907636 - RNA, 22 nt, Human
ggugaggaaagauggugacagu

SEQ ID NO: 907637 - RNA, 22 nt, Human
agccugggggcgcagaaaccgg

SEQ ID NO: 907638 - RNA, 22 nt, Human
uuacacaguugguaggggcaga

SEQ ID NO: 907639 - RNA, 22 nt, Human
ugcaggagacauaauagggacu

SEQ ID NO: 907640 - RNA, 22 nt, Human
uguaauauauauaacugugugc

SEQ ID NO: 907641 - RNA, 22 nt, Human
gagaaagaugaagaguggcguu

SEQ ID NO: 907642 - RNA, 22 nt, Human
uccuagggauucaacacugaac

SEQ ID NO: 907643 - RNA, 22 nt, Human
agaggcucuuugagcugggaga

SEQ ID NO: 907644 - RNA, 22 nt, Human
agaauaaauguuggacuuagga

SEQ ID NO: 907645 - RNA, 22 nt, Human
uguucacacacggaggccacag

SEQ ID NO: 907646 - RNA, 22 nt, Human
gucuccuguccugcaggaugga

SEQ ID NO: 907647 - RNA, 22 nt, Human
acacauaugucauugaaaaauc

SEQ ID NO: 907648 - RNA, 22 nt, Human
gggaacagcauaucugaagggu

SEQ ID NO: 907649 - RNA, 22 nt, Human
augcuguguggucaaguuaauu

SEQ ID NO: 907650 - RNA, 22 nt, Human
auggcagcggagcuggaaauga

SEQ ID NO: 907651 - RNA, 18 nt, Human
guaagcaaagacuuuaua

SEQ ID NO: 907652 - RNA, 17 nt, Human
agaguuuuaagaaauuu

SEQ ID NO: 907653 - RNA, 17 nt, Human
cucuccuuccucugagg

SEQ ID NO: 907654 - RNA, 22 nt, Human
gucacaaaggugagggacauga

SEQ ID NO: 907655 - RNA, 22 nt, Human
uuauauuaguuagacuugcugu

SEQ ID NO: 907656 - RNA, 22 nt, Human
ggaccaggcugagcaccugccu

SEQ ID NO: 907657 - RNA, 21 nt, Human
acaaaagaagcugccuuuuaa

SEQ ID NO: 907658 - RNA, 22 nt, Human
ugggaacuggggcauuguuucu

SEQ ID NO: 907659 - RNA, 22 nt, Human
ggcugccccagugcucauggcu

SEQ ID NO: 907660 - RNA, 22 nt, Human
cugagcuuggcuuaucuccagc

SEQ ID NO: 907661 - RNA, 22 nt, Human
acugaauagaaaugcucauagg

SEQ ID NO: 907662 - RNA, 22 nt, Human
uguccacaucacucacuuguca

SEQ ID NO: 907663 - RNA, 22 nt, Human
gggcuucaaaauuggcacucuu

SEQ ID NO: 907664 - RNA, 20 nt, Human
caugcugccuccauugaugc

SEQ ID NO: 907665 - RNA, 22 nt, Human
acacuauaagacagauacagca

SEQ ID NO: 907666 - RNA, 22 nt, Human
gcugcugucagcaggccuuguu

SEQ ID NO: 907667 - RNA, 22 nt, Human
ucauugaauacauauuugggau

SEQ ID NO: 907668 - RNA, 22 nt, Human
ggacagcagccucuuacaugaa

SEQ ID NO: 907669 - RNA, 22 nt, Human
accauuuuggguauuuucagag

SEQ ID NO: 907670 - RNA, 22 nt, Human
ugaugacagcaaaaaaugcuag

SEQ ID NO: 907671 - RNA, 22 nt, Human
gagggugggccagauaugaggg

SEQ ID NO: 907672 - RNA, 22 nt, Human
agcuggugcugaagcucuugag

SEQ ID NO: 907673 - RNA, 22 nt, Human
gacagcaaugacggggcagcug

SEQ ID NO: 907674 - RNA, 22 nt, Human
aaggagaaaugguagaugugca

SEQ ID NO: 907675 - RNA, 21 nt, Human
ugcaguuuugcuugaucucug

SEQ ID NO: 907676 - RNA, 22 nt, Human
acugagggugcacaggcaggca

SEQ ID NO: 907677 - RNA, 17 nt, Human
aucugcugacauucugu

SEQ ID NO: 907678 - RNA, 22 nt, Human
uuauuuuuaaaaguucacacag

SEQ ID NO: 907679 - RNA, 22 nt, Human
caucuucagguguuuuccauca

SEQ ID NO: 907680 - RNA, 22 nt, Human
caaauacuggguaaguuaauuu

SEQ ID NO: 907681 - RNA, 22 nt, Human
gccacaggucggcuagaggguc

SEQ ID NO: 907682 - RNA, 22 nt, Human
guuuguucauggcugaugcuug

SEQ ID NO: 907683 - RNA, 22 nt, Human
caaugucugaccguuuugccca

SEQ ID NO: 907684 - RNA, 23 nt, Human
aggcagagccaaggucaaaaccc

SEQ ID NO: 907685 - RNA, 22 nt, Human
acauucuguuuccccaaagaga

SEQ ID NO: 907686 - RNA, 22 nt, Human
agggauguugucaaggaugugg

SEQ ID NO: 907687 - RNA, 22 nt, Human
cagcaagaaucagacaaccuca

SEQ ID NO: 907688 - RNA, 22 nt, Human
uuucauugaugggugauagaaa

SEQ ID NO: 907689 - RNA, 22 nt, Human
cuagagaaaccccaugagcuuu

SEQ ID NO: 907690 - RNA, 22 nt, Human
cauuuaguccuugacuucucuc

SEQ ID NO: 907691 - RNA, 22 nt, Human
gcucuugaccuuggagaacucg

SEQ ID NO: 907692 - RNA, 22 nt, Human
gcaggggcuacucugagcuucc

SEQ ID NO: 907693 - RNA, 22 nt, Human
gggcagguauuuaucuucuauu

SEQ ID NO: 907694 - RNA, 22 nt, Human
acagggcagugucuugaaaaau

SEQ ID NO: 907695 - RNA, 22 nt, Human
ugggcugcccaagguggccaug

SEQ ID NO: 907696 - RNA, 22 nt, Human
uagaaaugaauguuuaaaaguc

SEQ ID NO: 907697 - RNA, 22 nt, Human
cccucagggaccacugacuuca

SEQ ID NO: 907698 - RNA, 22 nt, Human
auucucucauuuaucuguccua

SEQ ID NO: 907699 - RNA, 22 nt, Human
gccuguuuacuuugccgcagga

SEQ ID NO: 907700 - RNA, 22 nt, Human
ggggccagauaucacuaagguu

SEQ ID NO: 907701 - RNA, 22 nt, Human
ucucuacaaaaauuagcaugca

SEQ ID NO: 907702 - RNA, 22 nt, Human
uaacugaacagccuaauucuuu

SEQ ID NO: 907703 - RNA, 22 nt, Human
uucuucagauggugagaccucc

SEQ ID NO: 907704 - RNA, 23 nt, Human
ucuggcugcuccuuucaaugcuc

SEQ ID NO: 907705 - RNA, 21 nt, Human
uuggaauuugggagcuaugug

SEQ ID NO: 907706 - RNA, 22 nt, Human
gaccauuucuaggaaucagacu

SEQ ID NO: 907707 - RNA, 22 nt, Human
agccuauuccaggaugagcuca

SEQ ID NO: 907708 - RNA, 22 nt, Human
auaaggaaaugaaacucuaaua

SEQ ID NO: 907709 - RNA, 22 nt, Human
aaugcuuucuuauaaccacugc

SEQ ID NO: 907710 - RNA, 22 nt, Human
gaguggagcaaaagagguagau

SEQ ID NO: 907711 - RNA, 22 nt, Human
uagucagcaugaaauaagcagc

SEQ ID NO: 907712 - RNA, 22 nt, Human
uuugacucaagccuuucuuuag

SEQ ID NO: 907713 - RNA, 22 nt, Human
aggcaguggaaggagaaagcaa

SEQ ID NO: 907714 - RNA, 22 nt, Human
aucaugcagcuaauccaauuca

SEQ ID NO: 907715 - RNA, 22 nt, Human
guaaguuauauuaaaauuucag

SEQ ID NO: 907716 - RNA, 22 nt, Human
aguggcaaugggaguggagaca

SEQ ID NO: 907717 - RNA, 22 nt, Human
aacaaaccuggguggagaaagg

SEQ ID NO: 907718 - RNA, 23 nt, Human
cuucggaauaugauaagggaccu

SEQ ID NO: 907719 - RNA, 22 nt, Human
gaugcagggggaacgacgcccu

SEQ ID NO: 907720 - RNA, 21 nt, Human
uguaaucuaaagaagcucuuu

SEQ ID NO: 907721 - RNA, 22 nt, Human
ugcuucuguuuguuucugucau

SEQ ID NO: 907722 - RNA, 19 nt, Human
ucuaugggcuuuuuguagu

SEQ ID NO: 907723 - RNA, 22 nt, Human
gggcggggcuuccguccuccac

SEQ ID NO: 907724 - RNA, 22 nt, Human
gccucccuggcccacagcagcg

SEQ ID NO: 907725 - RNA, 21 nt, Human
aaauuuucuuggcuguagugu

SEQ ID NO: 907726 - RNA, 22 nt, Human
gagcugaguaucccacugaagu

SEQ ID NO: 907727 - RNA, 22 nt, Human
uagggacugugugagggacuug

SEQ ID NO: 907728 - RNA, 22 nt, Human
aagugcauuagauagaaugaug

SEQ ID NO: 907729 - RNA, 22 nt, Human
uagaggcuuucagcgguagguc

SEQ ID NO: 907730 - RNA, 22 nt, Human
acauaauaaaaauaacagcuca

SEQ ID NO: 907731 - RNA, 22 nt, Human
aaaugcagauugucauucagga

SEQ ID NO: 907732 - RNA, 22 nt, Human
gagagaaaugugcaguuugggc

SEQ ID NO: 907733 - RNA, 22 nt, Human
aaauguacaacauccauauaua

SEQ ID NO: 907734 - RNA, 22 nt, Human
cucuucaggaauaugucaguca

SEQ ID NO: 907735 - RNA, 22 nt, Human
ccuuucucuaucgacccaucgc

SEQ ID NO: 907736 - RNA, 22 nt, Human
uccacccccagacagcugguga

SEQ ID NO: 907737 - RNA, 21 nt, Human
ugaauaaagcugcugucgaua

SEQ ID NO: 907738 - RNA, 22 nt, Human
ggcgcucaguguugccccagag

SEQ ID NO: 907739 - RNA, 22 nt, Human
agcagagugugaaggcagggcu

SEQ ID NO: 907740 - RNA, 22 nt, Human
gccagcuuccauggccacguca

SEQ ID NO: 907741 - RNA, 22 nt, Human
uacaguagaaucuuauagccca

SEQ ID NO: 907742 - RNA, 22 nt, Human
cagggcaggaugcugugauuau

SEQ ID NO: 907743 - RNA, 22 nt, Human
cacauguuucaggccauauuug

SEQ ID NO: 907744 - RNA, 21 nt, Human
agcugcuuucagcuccuagag

SEQ ID NO: 907745 - RNA, 22 nt, Human
aggagcugcagauucugccuug

SEQ ID NO: 907746 - RNA, 22 nt, Human
gucagugugguugcuggcuugg

SEQ ID NO: 907747 - RNA, 22 nt, Human
aaaggcuuugagaaguccugca

SEQ ID NO: 907748 - RNA, 23 nt, Human
ugacacccucauugugugucgca

SEQ ID NO: 907749 - RNA, 22 nt, Human
aggguccaguaacagaugccag

SEQ ID NO: 907750 - RNA, 22 nt, Human
acaacugucuucuucaugcucc

SEQ ID NO: 907751 - RNA, 22 nt, Human
caggaagccuuccuugucugcu

SEQ ID NO: 907752 - RNA, 22 nt, Human
auucuuuuaaauggcaguagua

SEQ ID NO: 907753 - RNA, 18 nt, Human
ugucaucuguuuaaaacc

SEQ ID NO: 907754 - RNA, 22 nt, Human
acaugcaugucuaugggcaggu

SEQ ID NO: 907755 - RNA, 22 nt, Human
ccuccuggguucaagcgauucu

SEQ ID NO: 907756 - RNA, 22 nt, Human
gcacaggcacagagggccacug

SEQ ID NO: 907757 - RNA, 22 nt, Human
uucugcaguguuaacaauguca

SEQ ID NO: 907758 - RNA, 20 nt, Human
gaaauguacacauuaccaca

SEQ ID NO: 907759 - RNA, 22 nt, Human
uggcagcagggaggccaguguu

SEQ ID NO: 907760 - RNA, 22 nt, Human
ccagcucccugaagccuggucu

SEQ ID NO: 907761 - RNA, 22 nt, Human
uccaggcccgagaugggcugga

SEQ ID NO: 907762 - RNA, 22 nt, Human
cugggcuugaguuccugcucgu

SEQ ID NO: 907763 - RNA, 22 nt, Human
cuccaggccccuggccuucugc

SEQ ID NO: 907764 - RNA, 22 nt, Human
ccaggugcucuugccagggcug

SEQ ID NO: 907765 - RNA, 22 nt, Human
ggaacugaaugucucgguauaa

SEQ ID NO: 907766 - RNA, 21 nt, Human
ccccucauacacucuccuugc

SEQ ID NO: 907767 - RNA, 22 nt, Human
acauucuaugguugaugaguug

SEQ ID NO: 907768 - RNA, 22 nt, Human
uacagauuuugugaagaagugu

SEQ ID NO: 907769 - RNA, 17 nt, Human
cuuugcagcagacaugu

SEQ ID NO: 907770 - RNA, 22 nt, Human
gaagcccagcaaacugugauca

SEQ ID NO: 907771 - RNA, 22 nt, Human
acuuuacacaucuuuucucauu

SEQ ID NO: 907772 - RNA, 22 nt, Human
ucagcuggcaucggcucaccca

SEQ ID NO: 907773 - RNA, 22 nt, Human
ggcagcuccuccuagucugccc

SEQ ID NO: 907774 - RNA, 22 nt, Human
cuaggcagggugcugugccaug

SEQ ID NO: 907775 - RNA, 22 nt, Human
ggucccaggagaauaggugcaa

SEQ ID NO: 907776 - RNA, 22 nt, Human
caggaaagccgagugccauagg

SEQ ID NO: 907777 - RNA, 22 nt, Human
aucuuuuacuacaaaucaggug

SEQ ID NO: 907778 - RNA, 22 nt, Human
acacuuuacucuuacaccauug

SEQ ID NO: 907779 - RNA, 22 nt, Human
cugaagucagauggcacaaggu

SEQ ID NO: 907780 - RNA, 22 nt, Human
cugggugaguauaggaaaggga

SEQ ID NO: 907781 - RNA, 22 nt, Human
aagaacauggacugugggguua

SEQ ID NO: 907782 - RNA, 22 nt, Human
uguuucuuauccaaguggucug

SEQ ID NO: 907783 - RNA, 22 nt, Human
uaucauguugaauuucugagaa

SEQ ID NO: 907784 - RNA, 18 nt, Human
cuuugcuauaaauuguau

SEQ ID NO: 907785 - RNA, 20 nt, Human
aggaugcagggagucugcag

SEQ ID NO: 907786 - RNA, 22 nt, Human
ucccacccauccugcaucucuu

SEQ ID NO: 907787 - RNA, 19 nt, Human
gagcacagcggcauuuggu

SEQ ID NO: 907788 - RNA, 22 nt, Human
ugcugggcugcacccccagagu

SEQ ID NO: 907789 - RNA, 22 nt, Human
auguacaguggaaacuaacaaa

SEQ ID NO: 907790 - RNA, 22 nt, Human
cugugugcagggcacaauggaa

SEQ ID NO: 907791 - RNA, 22 nt, Human
uaguauauuuuguugcaauuca

SEQ ID NO: 907792 - RNA, 22 nt, Human
ggaggugcuggcggccagcucu

SEQ ID NO: 907793 - RNA, 22 nt, Human
augcacaacaguggcugccuug

SEQ ID NO: 907794 - RNA, 22 nt, Human
caaauucacaugauugcuucug

SEQ ID NO: 907795 - RNA, 22 nt, Human
augagguaagcacugggcccaa

SEQ ID NO: 907796 - RNA, 22 nt, Human
gucacuguuuccuauuauauuu

SEQ ID NO: 907797 - RNA, 22 nt, Human
aucuuuacaguguaagugcaga

SEQ ID NO: 907798 - RNA, 22 nt, Human
ucauauuuaguucacgcucaau

SEQ ID NO: 907799 - RNA, 22 nt, Human
ucagugugaauucaggagccua

SEQ ID NO: 907800 - RNA, 22 nt, Human
caggcauaaguaauguuuuaug

SEQ ID NO: 907801 - RNA, 22 nt, Human
agcagugaaacagcugcauaug

SEQ ID NO: 907802 - RNA, 22 nt, Human
acauuucuccuugcaggaguca

SEQ ID NO: 907803 - RNA, 22 nt, Human
accacaguaugaaaucugaaau

SEQ ID NO: 907804 - RNA, 22 nt, Human
augcaggggccgccuggccagg

SEQ ID NO: 907805 - RNA, 22 nt, Human
ugacaaauguuaauucagugga

SEQ ID NO: 907806 - RNA, 22 nt, Human
gcugucccgaaccccugguaau

SEQ ID NO: 907807 - RNA, 22 nt, Human
cagcuauagauggacugaagag

SEQ ID NO: 907808 - RNA, 22 nt, Human
uguuuauaauaugcagugagca

SEQ ID NO: 907809 - RNA, 22 nt, Human
uguguccuuuggaggaucagcg

SEQ ID NO: 907810 - RNA, 22 nt, Human
auucaaguccagcuucucuaca

SEQ ID NO: 907811 - RNA, 19 nt, Human
ugcuauuuagaacgccugg

SEQ ID NO: 907812 - RNA, 22 nt, Human
caaauguauucucacuucaggg

SEQ ID NO: 907813 - RNA, 22 nt, Human
gggcuggucuggcuuagucagg

SEQ ID NO: 907814 - RNA, 22 nt, Human
aaguacaucaaauguuuggcua

SEQ ID NO: 907815 - RNA, 22 nt, Human
uggcugaauucaucaagaaaau

SEQ ID NO: 907816 - RNA, 22 nt, Human
cuuuccuggcuggcaguugugg

SEQ ID NO: 907817 - RNA, 22 nt, Human
acaaugucaccucucauguuuu

SEQ ID NO: 907818 - RNA, 22 nt, Human
agggcaguucagccacaggcuc

SEQ ID NO: 907819 - RNA, 22 nt, Human
caaagaauagcauggcauuugu

SEQ ID NO: 907820 - RNA, 22 nt, Human
gauuuccuaauguggaucucug

SEQ ID NO: 907821 - RNA, 22 nt, Human
ucuuccucucuaauugaucaga

SEQ ID NO: 907822 - RNA, 22 nt, Human
uugagaaaauaguucgaauguu

SEQ ID NO: 907823 - RNA, 22 nt, Human
cuggaaagugcuuuucugagag

SEQ ID NO: 907824 - RNA, 22 nt, Human
ugccaggcauauggccucuuug

SEQ ID NO: 907825 - RNA, 22 nt, Human
ggcaggcauggggucugccauu

SEQ ID NO: 907826 - RNA, 22 nt, Human
guucauaauuugaaggaauagg

SEQ ID NO: 907827 - RNA, 22 nt, Human
augguacagauaauacaugcug

SEQ ID NO: 907828 - RNA, 22 nt, Human
acacugugucuagcauuuuaca

SEQ ID NO: 907829 - RNA, 22 nt, Human
gcgcagaguagcagagugcuga

SEQ ID NO: 907830 - RNA, 22 nt, Human
cucuguagaaacagggcagaag

SEQ ID NO: 907831 - RNA, 20 nt, Human
gggugggagagucugagggu

SEQ ID NO: 907832 - RNA, 22 nt, Human
uucuaguucugaaagccugaca

SEQ ID NO: 907833 - RNA, 22 nt, Human
uccccugcagcgccugcuucua

SEQ ID NO: 907834 - RNA, 20 nt, Human
agacugaagccaugugacua

SEQ ID NO: 907835 - RNA, 22 nt, Human
ucacauauuuaagaaaguuaaa

SEQ ID NO: 907836 - RNA, 22 nt, Human
ucaguguguuauucuacuuuca

SEQ ID NO: 907837 - RNA, 22 nt, Human
uccuggcugccgucguccugcg

SEQ ID NO: 907838 - RNA, 22 nt, Human
cccagccugucuuucccaauga

SEQ ID NO: 907839 - RNA, 22 nt, Human
ccaggaagccugugucucugga

SEQ ID NO: 907840 - RNA, 22 nt, Human
uuucuagaaacauuaucucuau

SEQ ID NO: 907841 - RNA, 22 nt, Human
cuggcacuuggcacccaugaaa

SEQ ID NO: 907842 - RNA, 22 nt, Human
ucucaaauguaaagcaugauuu

SEQ ID NO: 907843 - RNA, 22 nt, Human
ggcugggagccccacagaguca

SEQ ID NO: 907844 - RNA, 22 nt, Human
aauugcaauuuucuuaaggucu

SEQ ID NO: 907845 - RNA, 23 nt, Human
ugccuauucagcagagugauagc

SEQ ID NO: 907846 - RNA, 22 nt, Human
aggcuacagauacagaggcuac

SEQ ID NO: 907847 - RNA, 18 nt, Human
guccugagcucugcugua

SEQ ID NO: 907848 - RNA, 22 nt, Human
agugaaauacugucguuuuuag

SEQ ID NO: 907849 - RNA, 22 nt, Human
ugguggcaucagugaaguacac

SEQ ID NO: 907850 - RNA, 22 nt, Human
cauguguggagggcaugcaugg

SEQ ID NO: 907851 - RNA, 22 nt, Human
ccugucagcugauggcuaugua

SEQ ID NO: 907852 - RNA, 22 nt, Human
uucugagccuuucuaagaaaca

SEQ ID NO: 907853 - RNA, 22 nt, Human
gagugguuagaaguaguguggc

SEQ ID NO: 907854 - RNA, 21 nt, Human
ucucuuugggaacauuaauca

SEQ ID NO: 907855 - RNA, 19 nt, Human
ccaccccuuugcugggccc

SEQ ID NO: 907856 - RNA, 22 nt, Human
ugaacccugaccucuggaagga

SEQ ID NO: 907857 - RNA, 22 nt, Human
auauagaguaauuauuuggugu

SEQ ID NO: 907858 - RNA, 22 nt, Human
caucauuguuagggacucuaac

SEQ ID NO: 907859 - RNA, 22 nt, Human
cuggaaugggaaucaggaaaga

SEQ ID NO: 907860 - RNA, 22 nt, Human
gaagggugugugugagggacac

SEQ ID NO: 907861 - RNA, 22 nt, Human
ugaccauggcacauguuugccu

SEQ ID NO: 907862 - RNA, 22 nt, Human
cuguggcucucagaggcugcug

SEQ ID NO: 907863 - RNA, 22 nt, Human
ucaauacacaugccgcuguucu

SEQ ID NO: 907864 - RNA, 22 nt, Human
uggugucuuggaaguaggugcu

SEQ ID NO: 907865 - RNA, 22 nt, Human
guccuuggagucaggcaaggcu

SEQ ID NO: 907866 - RNA, 22 nt, Human
uggccaggcauucagauaagac

SEQ ID NO: 907867 - RNA, 22 nt, Human
uagcaggguaaauguagaugga

SEQ ID NO: 907868 - RNA, 22 nt, Human
cacuguguaagaagaugggcuu

SEQ ID NO: 907869 - RNA, 22 nt, Human
uccugggauuaagguggugauu

SEQ ID NO: 907870 - RNA, 22 nt, Human
cacagaggagugcacacucucu

SEQ ID NO: 907871 - RNA, 22 nt, Human
uuuaauuagcaagccagagagc

SEQ ID NO: 907872 - RNA, 23 nt, Human
cugcagucgccggccugggugcc

SEQ ID NO: 907873 - RNA, 22 nt, Human
gugcucuguguauuaggauguc

SEQ ID NO: 907874 - RNA, 22 nt, Human
caguauguuugggagacaugac

SEQ ID NO: 907875 - RNA, 22 nt, Human
cagggcucacucggcuggcguc

SEQ ID NO: 907876 - RNA, 22 nt, Human
agucuucagcagccuucucagg

SEQ ID NO: 907877 - RNA, 22 nt, Human
cuguacaaguccuucaucaggg

SEQ ID NO: 907878 - RNA, 23 nt, Human
uccaauucaauugggucaggaag

SEQ ID NO: 907879 - RNA, 22 nt, Human
uggguucccugacagcgaugcu

SEQ ID NO: 907880 - RNA, 22 nt, Human
agagacaggauaucugcucaug

SEQ ID NO: 907881 - RNA, 22 nt, Human
uucuuuaccacuacucuuccaa

SEQ ID NO: 907882 - RNA, 22 nt, Human
cugggagugaaaggagggcugc

SEQ ID NO: 907883 - RNA, 21 nt, Human
ugucagagcuuguaggacauu

SEQ ID NO: 907884 - RNA, 22 nt, Human
uuuggucuuuuauuuaaagcag

SEQ ID NO: 907885 - RNA, 22 nt, Human
gaccugggguggaaggaaggca

SEQ ID NO: 907886 - RNA, 22 nt, Human
cccugggcaagcccuauuuucc

SEQ ID NO: 907887 - RNA, 22 nt, Human
ucuacaaguuuaauuccacuua

SEQ ID NO: 907888 - RNA, 22 nt, Human
guccuuaguuacuuuucauguc

SEQ ID NO: 907889 - RNA, 22 nt, Human
agguuuauuauguagcauuauu

SEQ ID NO: 907890 - RNA, 22 nt, Human
gacagcaaagcagagccaaggc

SEQ ID NO: 907891 - RNA, 22 nt, Human
ccagcacucugucccagcuucc

SEQ ID NO: 907892 - RNA, 22 nt, Human
gggagcuggaguuguguugccu

SEQ ID NO: 907893 - RNA, 22 nt, Human
uuagaaagcuuuccauagucaa

SEQ ID NO: 907894 - RNA, 22 nt, Human
uucagaauguacugauagaaca

SEQ ID NO: 907895 - RNA, 22 nt, Human
ucugggccggagccgacggcag

SEQ ID NO: 907896 - RNA, 22 nt, Human
gaggcuggggucugccuuucug

SEQ ID NO: 907897 - RNA, 22 nt, Human
cuuacagugaucaacacaaaga

SEQ ID NO: 907898 - RNA, 22 nt, Human
agggagcuuucagguagcuuaa

SEQ ID NO: 907899 - RNA, 22 nt, Human
gggugggaugccgcugucucca

SEQ ID NO: 907900 - RNA, 22 nt, Human
ugugaaauuacuuaaaggaaau

SEQ ID NO: 907901 - RNA, 22 nt, Human
gacauuuagcuguuuugcauuu

SEQ ID NO: 907902 - RNA, 22 nt, Human
ucaaggaaggucuguugcucca

SEQ ID NO: 907903 - RNA, 22 nt, Human
uucuucuucuggcugcaccugg

SEQ ID NO: 907904 - RNA, 22 nt, Human
ucuugcagaaauaaguuuaaau

SEQ ID NO: 907905 - RNA, 22 nt, Human
aauuaagaaaauguuuuaugau

SEQ ID NO: 907906 - RNA, 22 nt, Human
ucugugaaaucacccagguuua

SEQ ID NO: 907907 - RNA, 22 nt, Human
agagcucugcagcuggccucag

SEQ ID NO: 907908 - RNA, 20 nt, Human
cagagccaggguuuuguuuu

SEQ ID NO: 907909 - RNA, 22 nt, Human
uguugccuaacugcccucugaa

SEQ ID NO: 907910 - RNA, 22 nt, Human
ggagaggugaauggcugcucua

SEQ ID NO: 907911 - RNA, 22 nt, Human
ccaggcagccaagugugugugu

SEQ ID NO: 907912 - RNA, 22 nt, Human
ucuauuaugguacuuaucauga

SEQ ID NO: 907913 - RNA, 22 nt, Human
gcccaagaucaguggggcagau

SEQ ID NO: 907914 - RNA, 22 nt, Human
ucuaaagagaguggguacaugu

SEQ ID NO: 907915 - RNA, 22 nt, Human
ggaccugaacauaaaacgaggc

SEQ ID NO: 907916 - RNA, 22 nt, Human
ggcugccucuggaagcuggaga

SEQ ID NO: 907917 - RNA, 22 nt, Human
uguauacaaauuggaaucagau

SEQ ID NO: 907918 - RNA, 22 nt, Human
ccugcagguuucccccggacgg

SEQ ID NO: 907919 - RNA, 22 nt, Human
uauuucuguaugcauaaaagga

SEQ ID NO: 907920 - RNA, 20 nt, Human
cauuucauugugucuucacu

SEQ ID NO: 907921 - RNA, 22 nt, Human
ucuuaugucaagaaugaauauu

SEQ ID NO: 907922 - RNA, 22 nt, Human
uuuaccauccucuuuuagaauu

SEQ ID NO: 907923 - RNA, 22 nt, Human
gagccuggccuccugccucagc

SEQ ID NO: 907924 - RNA, 22 nt, Human
agccaggcgggucuuugcuccu

SEQ ID NO: 907925 - RNA, 22 nt, Human
gcagcagaaguagaaguacagg

SEQ ID NO: 907926 - RNA, 22 nt, Human
uaacuuucacaucacacugacu

SEQ ID NO: 907927 - RNA, 22 nt, Human
aggcauggcuuuaggcaggcgu

SEQ ID NO: 907928 - RNA, 22 nt, Human
cagauauauuuuccuuauuagg

SEQ ID NO: 907929 - RNA, 22 nt, Human
ccuggaaaugucgcguguagaa

SEQ ID NO: 907930 - RNA, 22 nt, Human
ccugggcuggaguacagcagug

SEQ ID NO: 907931 - RNA, 23 nt, Human
agaaaaguucauaccuuuuuaac

SEQ ID NO: 907932 - RNA, 22 nt, Human
ucaaccuugugagaacugaguc

SEQ ID NO: 907933 - RNA, 23 nt, Human
ggcagcuuauacuuucauagaca

SEQ ID NO: 907934 - RNA, 22 nt, Human
agccaaggagugcagguggcuu

SEQ ID NO: 907935 - RNA, 22 nt, Human
gcaguccucucauuggccuccu

SEQ ID NO: 907936 - RNA, 22 nt, Human
ccuccuggcccugggccuggaa

SEQ ID NO: 907937 - RNA, 22 nt, Human
uaaguuuaagucauguuugaug

SEQ ID NO: 907938 - RNA, 22 nt, Human
aucaaaguucguaacugauaac

SEQ ID NO: 907939 - RNA, 22 nt, Human
uaauuuacucagauguucaauc

SEQ ID NO: 907940 - RNA, 22 nt, Human
uuugucuucccccuuuaaucag

SEQ ID NO: 907941 - RNA, 22 nt, Human
ucucugccacagcuucugccuu

SEQ ID NO: 907942 - RNA, 22 nt, Human
gagugcaggccugagcaccauc

SEQ ID NO: 907943 - RNA, 20 nt, Human
ugggacugacccaucugagc

SEQ ID NO: 907944 - RNA, 22 nt, Human
cuacauuuacacaguuaggcuu

SEQ ID NO: 907945 - RNA, 22 nt, Human
auauacacucaccaugguauuu

SEQ ID NO: 907946 - RNA, 22 nt, Human
auugucuuggcauucaaauuag

SEQ ID NO: 907947 - RNA, 22 nt, Human
gaggcucagagggagcaugguc

SEQ ID NO: 907948 - RNA, 22 nt, Human
ucagcacugucuauuagugaga

SEQ ID NO: 907949 - RNA, 23 nt, Human
agguagguuauugcugcuaccug

SEQ ID NO: 907950 - RNA, 22 nt, Human
uagaaguuaugauaauaauagu

SEQ ID NO: 907951 - RNA, 22 nt, Human
aggggagguggcagaaaugugc

SEQ ID NO: 907952 - RNA, 22 nt, Human
aagccgggccugagaaaugaca

SEQ ID NO: 907953 - RNA, 22 nt, Human
guuuagaaaauagugaagcaag

SEQ ID NO: 907954 - RNA, 22 nt, Human
uaggcacaagaccaugcaaagg

SEQ ID NO: 907955 - RNA, 22 nt, Human
uuagaacaaagccaccagguga

SEQ ID NO: 907956 - RNA, 22 nt, Human
uuuauuaaaacuguuggcucug

SEQ ID NO: 907957 - RNA, 22 nt, Human
agacaugaaaauuccaaacauc

SEQ ID NO: 907958 - RNA, 22 nt, Human
ucagacaguuugcagugugccu

SEQ ID NO: 907959 - RNA, 22 nt, Human
ggccaagcucucauuccagcac

SEQ ID NO: 907960 - RNA, 18 nt, Human
gccagagggcccaagguc

SEQ ID NO: 907961 - RNA, 22 nt, Human
gagguggcaauuuaaugcaguc

SEQ ID NO: 907962 - RNA, 18 nt, Human
gugaagcuuuauugaaug

SEQ ID NO: 907963 - RNA, 22 nt, Human
aagucagaaauaucugccauca

SEQ ID NO: 907964 - RNA, 19 nt, Human
uugagaaaugggaaaagca

SEQ ID NO: 907965 - RNA, 21 nt, Human
cagcuucuucugugaccuggu

SEQ ID NO: 907966 - RNA, 22 nt, Human
aaaguugagugcugaucugauu

SEQ ID NO: 907967 - RNA, 22 nt, Human
augggcugugagguccggcagg

SEQ ID NO: 907968 - RNA, 22 nt, Human
cuggagccccagacagggagag

SEQ ID NO: 907969 - RNA, 22 nt, Human
agcuccugcacccagccuugag

SEQ ID NO: 907970 - RNA, 22 nt, Human
gagguccauacagcuauucuac

SEQ ID NO: 907971 - RNA, 22 nt, Human
aggucugaguagagaaaaggca

SEQ ID NO: 907972 - RNA, 22 nt, Human
aucucuaaagucuguucagcuc

SEQ ID NO: 907973 - RNA, 22 nt, Human
agaauacaguaugcaaaaagau

SEQ ID NO: 907974 - RNA, 22 nt, Human
ggcagcucaccucugguccagg

SEQ ID NO: 907975 - RNA, 22 nt, Human
augccuguaaucccagugcuuu

SEQ ID NO: 907976 - RNA, 22 nt, Human
gcuuccaaugcuucuaucacau

SEQ ID NO: 907977 - RNA, 22 nt, Human
gagaaaaucuugggucaagaau

SEQ ID NO: 907978 - RNA, 22 nt, Human
ugcaaagaaggggaggaggauu

SEQ ID NO: 907979 - RNA, 22 nt, Human
uucaagaagcccaaagacuagc

SEQ ID NO: 907980 - RNA, 22 nt, Human
guuuugcucauuugguccaagg

SEQ ID NO: 907981 - RNA, 19 nt, Human
uuuuggaaaugugaacagc

SEQ ID NO: 907982 - RNA, 22 nt, Human
agaauaaaugcuaccuaucaca

SEQ ID NO: 907983 - RNA, 22 nt, Human
ugagcagagucgcuccagagug

SEQ ID NO: 907984 - RNA, 22 nt, Human
gauagucaccucccuuaacuuu

SEQ ID NO: 907985 - RNA, 22 nt, Human
cucuauauucugaaacaguuag

SEQ ID NO: 907986 - RNA, 22 nt, Human
gccagcugguaggcaccuagcc

SEQ ID NO: 907987 - RNA, 22 nt, Human
uuaggaaaaucaugagagauga

SEQ ID NO: 907988 - RNA, 22 nt, Human
auaugauuccacuauuguaugg

SEQ ID NO: 907989 - RNA, 22 nt, Human
cagccccauggugugcuccagc

SEQ ID NO: 907990 - RNA, 23 nt, Human
cuuccaguacugcacacucaagg

SEQ ID NO: 907991 - RNA, 22 nt, Human
ugggugucaaugucacacgauu

SEQ ID NO: 907992 - RNA, 22 nt, Human
cagagcugucauuugccaguga

SEQ ID NO: 907993 - RNA, 22 nt, Human
uuuauaugguugacuaugaguu

SEQ ID NO: 907994 - RNA, 22 nt, Human
auacagagcaguaauagaggag

SEQ ID NO: 907995 - RNA, 23 nt, Human
ggauaaaucucagcuucuuccau

SEQ ID NO: 907996 - RNA, 22 nt, Human
augacacaagcagaggcucuaa

SEQ ID NO: 907997 - RNA, 22 nt, Human
uccccagcauugagggucucuc

SEQ ID NO: 907998 - RNA, 22 nt, Human
uagauucagauauuuaggacaa

SEQ ID NO: 907999 - RNA, 21 nt, Human
uuacaaagcuacagauguugc

SEQ ID NO: 908000 - RNA, 22 nt, Human
cagaaaauagaguuucucugag

SEQ ID NO: 908001 - RNA, 22 nt, Human
aaacuaggaaguucaucuuauu

SEQ ID NO: 908002 - RNA, 22 nt, Human
ucuggccucuugggaugcuccc

SEQ ID NO: 908003 - RNA, 22 nt, Human
guauaguuccaagcauauuuug

SEQ ID NO: 908004 - RNA, 22 nt, Human
uguguucuccaacuguagauuu

SEQ ID NO: 908005 - RNA, 22 nt, Human
gugcauauauaugggagggagc

SEQ ID NO: 908006 - RNA, 22 nt, Human
uagcuuugacaguugcaggcag

SEQ ID NO: 908007 - RNA, 22 nt, Human
gagagggcaagguagaugcuac

SEQ ID NO: 908008 - RNA, 22 nt, Human
aguugcucaauguggcugugga

SEQ ID NO: 908009 - RNA, 22 nt, Human
gugggcugaggggacaccaagg

SEQ ID NO: 908010 - RNA, 22 nt, Human
ccaggaggugaaacuucaccag

SEQ ID NO: 908011 - RNA, 22 nt, Human
uucauguuuccucuugugcugc

SEQ ID NO: 908012 - RNA, 21 nt, Human
cacugcagccuugaccugggc

SEQ ID NO: 908013 - RNA, 22 nt, Human
cauguauaagcgcuaggagugc

SEQ ID NO: 908014 - RNA, 22 nt, Human
uaguuucugaggauugaaagau

SEQ ID NO: 908015 - RNA, 22 nt, Human
ucuagacaaugcacuguaagga

SEQ ID NO: 908016 - RNA, 22 nt, Human
agggccugugcugaguagacga

SEQ ID NO: 908017 - RNA, 22 nt, Human
gaagagcugcaguuuccugggc

SEQ ID NO: 908018 - RNA, 22 nt, Human
agauuuguugugagcaggaaua

SEQ ID NO: 908019 - RNA, 22 nt, Human
auggagcuaaauuguaaucaua

SEQ ID NO: 908020 - RNA, 20 nt, Human
gggguuggcuggcacaggga

SEQ ID NO: 908021 - RNA, 22 nt, Human
uggcccaaagcagcccagcagg

SEQ ID NO: 908022 - RNA, 22 nt, Human
auccucaguguuucugacaucu

SEQ ID NO: 908023 - RNA, 22 nt, Human
uugggaaacaguauagcuaaca

SEQ ID NO: 908024 - RNA, 22 nt, Human
gcuuggaaguaggauugggaga

SEQ ID NO: 908025 - RNA, 22 nt, Human
agugucugcaaaaugaaagagc

SEQ ID NO: 908026 - RNA, 18 nt, Human
uggcuccugccuccugca

SEQ ID NO: 908027 - RNA, 22 nt, Human
aagacuuucuguaaagcuacag

SEQ ID NO: 908028 - RNA, 22 nt, Human
aaacugcaauuacuuuugcagc

SEQ ID NO: 908029 - RNA, 22 nt, Human
auuuguacaaauuuauguuagu

SEQ ID NO: 908030 - RNA, 22 nt, Human
cauuuaauagaugcuguuucag

SEQ ID NO: 908031 - RNA, 22 nt, Human
gcugauuuugagaagcacaguc

SEQ ID NO: 908032 - RNA, 22 nt, Human
cacacagaaccgcucgccacuu

SEQ ID NO: 908033 - RNA, 22 nt, Human
acagaagacagaguguucaucu

SEQ ID NO: 908034 - RNA, 22 nt, Human
aguggcagacacaaugugggca

SEQ ID NO: 908035 - RNA, 22 nt, Human
ccugucucccuggcauggcuca

SEQ ID NO: 908036 - RNA, 22 nt, Human
gucaguguuauaaguuuagcca

SEQ ID NO: 908037 - RNA, 22 nt, Human
cuggcuguguccacagaguaag

SEQ ID NO: 908038 - RNA, 22 nt, Human
caaacuauuuacaauggaauca

SEQ ID NO: 908039 - RNA, 19 nt, Human
aggcuaaagagucuugcgu

SEQ ID NO: 908040 - RNA, 22 nt, Human
guagaauuaccucucuaugucc

SEQ ID NO: 908041 - RNA, 22 nt, Human
gagcuucucaacaguuaucucu

SEQ ID NO: 908042 - RNA, 22 nt, Human
auauccuugagacguggcuacu

SEQ ID NO: 908043 - RNA, 22 nt, Human
aggcauggcauggggcagaugu

SEQ ID NO: 908044 - RNA, 22 nt, Human
cagcaguggccaucuguguggu

SEQ ID NO: 908045 - RNA, 22 nt, Human
caauaaagaagauuuuugcaau

SEQ ID NO: 908046 - RNA, 22 nt, Human
gagcaagauuaaaaggcugggu

SEQ ID NO: 908047 - RNA, 22 nt, Human
auuucaguguugguuagcaagc

SEQ ID NO: 908048 - RNA, 20 nt, Human
uucuagaaugcccagggaca

SEQ ID NO: 908049 - RNA, 22 nt, Human
uucuuuagcaacuuggauuuag

SEQ ID NO: 908050 - RNA, 22 nt, Human
aacaauguguucagcacugugg

SEQ ID NO: 908051 - RNA, 20 nt, Human
auugacagaaaguguucacc

SEQ ID NO: 908052 - RNA, 22 nt, Human
uacauaugaacuuuauaacuug

SEQ ID NO: 908053 - RNA, 22 nt, Human
aaucuuacuuaugauuuuucgg

SEQ ID NO: 908054 - RNA, 22 nt, Human
augucaccuucgguggcacggu

SEQ ID NO: 908055 - RNA, 22 nt, Human
ugucuuucugacccaagguagu

SEQ ID NO: 908056 - RNA, 21 nt, Human
ggaguuuuucuggaagggacu

SEQ ID NO: 908057 - RNA, 22 nt, Human
uuacagaagugaaggccuuuaa

SEQ ID NO: 908058 - RNA, 20 nt, Human
uaugaguauuacuuucagga

SEQ ID NO: 908059 - RNA, 22 nt, Human
uggcacaggaucucagcggcca

SEQ ID NO: 908060 - RNA, 22 nt, Human
cugucuguguggacacggcugc

SEQ ID NO: 908061 - RNA, 22 nt, Human
uggcuggcuuucuuguauuuac

SEQ ID NO: 908062 - RNA, 22 nt, Human
cugggaagaauccaagggcccu

SEQ ID NO: 908063 - RNA, 22 nt, Human
cauuuccuuccugcugcuccuc

SEQ ID NO: 908064 - RNA, 22 nt, Human
uagugaaacaguuaucaaucug

SEQ ID NO: 908065 - RNA, 22 nt, Human
ucucugccaccaugagaugggc

SEQ ID NO: 908066 - RNA, 22 nt, Human
uacugugaauacaaaauaaauu

SEQ ID NO: 908067 - RNA, 22 nt, Human
ugguugugagcgauggauggag

SEQ ID NO: 908068 - RNA, 22 nt, Human
aaacuaucaaguguugggggag

SEQ ID NO: 908069 - RNA, 22 nt, Human
ugcagaagauggucugagcacc

SEQ ID NO: 908070 - RNA, 22 nt, Human
agucucagccacacagaccuau

SEQ ID NO: 908071 - RNA, 19 nt, Human
ccuuuggauuuguuuaguc

SEQ ID NO: 908072 - RNA, 22 nt, Human
gccaggcuggucuugaacuccu

SEQ ID NO: 908073 - RNA, 22 nt, Human
ucuagaucugcacuguuggaca

SEQ ID NO: 908074 - RNA, 22 nt, Human
ucacaaugcaaguguucagugg

SEQ ID NO: 908075 - RNA, 22 nt, Human
ggcucagguuuccuucccagcu

SEQ ID NO: 908076 - RNA, 22 nt, Human
cuuuuucuucuaggugugccug

SEQ ID NO: 908077 - RNA, 22 nt, Human
uccaucauguucacagcuauau

SEQ ID NO: 908078 - RNA, 22 nt, Human
gccaggucuggguagcagagga

SEQ ID NO: 908079 - RNA, 22 nt, Human
gagaguggauggagcugcgaag

SEQ ID NO: 908080 - RNA, 21 nt, Human
ggcugggucaugcagcuggcc

SEQ ID NO: 908081 - RNA, 22 nt, Human
aaagcagucucagacuuaagca

SEQ ID NO: 908082 - RNA, 22 nt, Human
uagcaccugcaggaugugcaca

SEQ ID NO: 908083 - RNA, 22 nt, Human
agaagccaccagcugaggaaga

SEQ ID NO: 908084 - RNA, 22 nt, Human
auuuuguuauagaacucuguga

SEQ ID NO: 908085 - RNA, 22 nt, Human
uggauuucagcaagggugggug

SEQ ID NO: 908086 - RNA, 21 nt, Human
ucuuccaagggcugcugagac

SEQ ID NO: 908087 - RNA, 22 nt, Human
gguuuauuaaugugaacuguau

SEQ ID NO: 908088 - RNA, 22 nt, Human
agguuuacugagggugcugguu

SEQ ID NO: 908089 - RNA, 22 nt, Human
aauaucaacaguguccuucuaa

SEQ ID NO: 908090 - RNA, 23 nt, Human
agcugaggcagaggggcauucuc

SEQ ID NO: 908091 - RNA, 22 nt, Human
agaaagguggaugcucuggaau

SEQ ID NO: 908092 - RNA, 22 nt, Human
ucaaaugcaggucuggucuugg

SEQ ID NO: 908093 - RNA, 22 nt, Human
gugugcagggcugccugugccg

SEQ ID NO: 908094 - RNA, 22 nt, Human
uucaucauugccagucuuuaaa

SEQ ID NO: 908095 - RNA, 22 nt, Human
ucugaaaucuguaagcacuagc

SEQ ID NO: 908096 - RNA, 22 nt, Human
uuucccaucuuagcagauuaaa

SEQ ID NO: 908097 - RNA, 22 nt, Human
aauguacaaaccuucuuuguag

SEQ ID NO: 908098 - RNA, 19 nt, Human
uccuggggaggggcauggc

SEQ ID NO: 908099 - RNA, 22 nt, Human
uugcuuuauucacaucuauauu

SEQ ID NO: 908100 - RNA, 22 nt, Human
uaaagacaugcaaagucuaauu

SEQ ID NO: 908101 - RNA, 19 nt, Human
acucaggcuuccucugagg

SEQ ID NO: 908102 - RNA, 22 nt, Human
gcucugccuccccuaguguuac

SEQ ID NO: 908103 - RNA, 22 nt, Human
auuucucucauuguuagcuagg

SEQ ID NO: 908104 - RNA, 22 nt, Human
aagauuuuuuuccacagacuca

SEQ ID NO: 908105 - RNA, 22 nt, Human
gccuccggagucacagugucuu

SEQ ID NO: 908106 - RNA, 22 nt, Human
gguucacauauugagaguauuc

SEQ ID NO: 908107 - RNA, 22 nt, Human
uuuaagacagugcaagcugaau

SEQ ID NO: 908108 - RNA, 22 nt, Human
acacauuagugcucugucucau

SEQ ID NO: 908109 - RNA, 22 nt, Human
gcugucacaaauauuucucagc

SEQ ID NO: 908110 - RNA, 22 nt, Human
cccaggucuccugcuucccagg

SEQ ID NO: 908111 - RNA, 22 nt, Human
guuacaaaggacugggggccac

SEQ ID NO: 908112 - RNA, 22 nt, Human
ugaggaaguugaucucaucagu

SEQ ID NO: 908113 - RNA, 22 nt, Human
ggagguggccugaaaauguggc

SEQ ID NO: 908114 - RNA, 22 nt, Human
ucuguuuaaugggaaugauacu

SEQ ID NO: 908115 - RNA, 22 nt, Human
cagggcuuucccuuguagaaau

SEQ ID NO: 908116 - RNA, 20 nt, Human
uuugagaccagucugcccaa

SEQ ID NO: 908117 - RNA, 22 nt, Human
uccaggccugacuauaaaugua

SEQ ID NO: 908118 - RNA, 22 nt, Human
uacuuuggauccuuacaauagc

SEQ ID NO: 908119 - RNA, 22 nt, Human
cauauauuauggacugcagaau

SEQ ID NO: 908120 - RNA, 22 nt, Human
gcagggcucauucuaguacaau

SEQ ID NO: 908121 - RNA, 22 nt, Human
uucacacagcaacuguaugaau

SEQ ID NO: 908122 - RNA, 22 nt, Human
acaaaugcaaguuuuaugucaa

SEQ ID NO: 908123 - RNA, 22 nt, Human
uacccaguucaguguuuaaaaa

SEQ ID NO: 908124 - RNA, 22 nt, Human
cuccuggcuuucccagaccagg

SEQ ID NO: 908125 - RNA, 22 nt, Human
ucugcaagagcuucaagguaga

SEQ ID NO: 908126 - RNA, 22 nt, Human
caugcacaacauacucaagagg

SEQ ID NO: 908127 - RNA, 22 nt, Human
ccagagguuacuuugccuugga

SEQ ID NO: 908128 - RNA, 22 nt, Human
ucugauuagcuccauuugcuaa

SEQ ID NO: 908129 - RNA, 22 nt, Human
uguagaaacuacacaugcaaca

SEQ ID NO: 908130 - RNA, 22 nt, Human
agcaugcaugaagauucagcaa

SEQ ID NO: 908131 - RNA, 22 nt, Human
gccugggagagggauagugcag

SEQ ID NO: 908132 - RNA, 20 nt, Human
caguccugcaggcgggagaa

SEQ ID NO: 908133 - RNA, 22 nt, Human
gaacaugauggcuguuauuuug

SEQ ID NO: 908134 - RNA, 22 nt, Human
gugcccagcuccaccucacaga

SEQ ID NO: 908135 - RNA, 22 nt, Human
agucuucuugaucuuuucagug

SEQ ID NO: 908136 - RNA, 21 nt, Human
ugcagaggcacaaacaagccc

SEQ ID NO: 908137 - RNA, 17 nt, Human
gccuuccuuccuccaca

SEQ ID NO: 908138 - RNA, 21 nt, Human
caggaaagaaaacguacauau

SEQ ID NO: 908139 - RNA, 22 nt, Human
acauucaaccaauguuugcuau

SEQ ID NO: 908140 - RNA, 22 nt, Human
cagaggcucagauggcccuggc

SEQ ID NO: 908141 - RNA, 22 nt, Human
uucuacaucacuuaacaugcua

SEQ ID NO: 908142 - RNA, 22 nt, Human
ucaggcagguggcuggcuaugg

SEQ ID NO: 908143 - RNA, 22 nt, Human
aauuuguauaaaaugguguuuu

SEQ ID NO: 908144 - RNA, 22 nt, Human
gaggcagcggcucacagagaaa

SEQ ID NO: 908145 - RNA, 22 nt, Human
ucucuggggccuuucuacauca

SEQ ID NO: 908146 - RNA, 22 nt, Human
gcacacugugaauuugcauaug

SEQ ID NO: 908147 - RNA, 22 nt, Human
ggggugagugcucagccccgga

SEQ ID NO: 908148 - RNA, 22 nt, Human
aguggggcggacaggaccagga

SEQ ID NO: 908149 - RNA, 22 nt, Human
uagcaaaugucugaaggaauag

SEQ ID NO: 908150 - RNA, 22 nt, Human
gccucccuguagaggccagccu

SEQ ID NO: 908151 - RNA, 22 nt, Human
aggaauguaaaucuagauuuua

SEQ ID NO: 908152 - RNA, 22 nt, Human
ggagcuguaacgagccauugcu

SEQ ID NO: 908153 - RNA, 22 nt, Human
uagggcuuagaaaagaauuuac

SEQ ID NO: 908154 - RNA, 23 nt, Human
agcagggccagaauacuugcugu

SEQ ID NO: 908155 - RNA, 22 nt, Human
aauccauaauguugugggguuu

SEQ ID NO: 908156 - RNA, 22 nt, Human
gggcuguaggagcuggaauggg

SEQ ID NO: 908157 - RNA, 22 nt, Human
cauuucucacuccagcaacuuu

SEQ ID NO: 908158 - RNA, 22 nt, Human
ggcagcugaccuagcaccaucc

SEQ ID NO: 908159 - RNA, 22 nt, Human
gugauucuggcaggcagaaggg

SEQ ID NO: 908160 - RNA, 22 nt, Human
cuugcaggauuuugcugcugua

SEQ ID NO: 908161 - RNA, 23 nt, Human
auccacauuacaguaucauacaa

SEQ ID NO: 908162 - RNA, 22 nt, Human
gcagccagccccucugaccucu

SEQ ID NO: 908163 - RNA, 22 nt, Human
agacauaagugcuaugacauug

SEQ ID NO: 908164 - RNA, 22 nt, Human
acaguucuccagugccuuugag

SEQ ID NO: 908165 - RNA, 22 nt, Human
gguucuaggauuaggaggccca

SEQ ID NO: 908166 - RNA, 23 nt, Human
ggcucugaggauggagcuggugg

SEQ ID NO: 908167 - RNA, 22 nt, Human
gggagaugaaucagaagugauc

SEQ ID NO: 908168 - RNA, 22 nt, Human
uguuauuuaucugagcauuuau

SEQ ID NO: 908169 - RNA, 21 nt, Human
agcuuguguguaucacagugu

SEQ ID NO: 908170 - RNA, 22 nt, Human
auucuggccuuggcucugucac

SEQ ID NO: 908171 - RNA, 22 nt, Human
uuaaaugugauuucauuuaugu

SEQ ID NO: 908172 - RNA, 22 nt, Human
agcuguggaagacugucagggu

SEQ ID NO: 908173 - RNA, 19 nt, Human
ucuuuggcuaaauugggug

SEQ ID NO: 908174 - RNA, 22 nt, Human
cagcugaauucuucagacucca

SEQ ID NO: 908175 - RNA, 22 nt, Human
ucucagaaaugacaggagguac

SEQ ID NO: 908176 - RNA, 22 nt, Human
caggagagcccggguccgggcu

SEQ ID NO: 908177 - RNA, 22 nt, Human
cuugucaguguacuuucuuuug

SEQ ID NO: 908178 - RNA, 22 nt, Human
acacacuguaaggacuaucacu

SEQ ID NO: 908179 - RNA, 22 nt, Human
aagagauuccucacucagaaug

SEQ ID NO: 908180 - RNA, 22 nt, Human
ugccuuaggguaccuggugcuu

SEQ ID NO: 908181 - RNA, 22 nt, Human
cagggagaucuuggcuccuggu

SEQ ID NO: 908182 - RNA, 22 nt, Human
uuucagagaugcagaauucagg

SEQ ID NO: 908183 - RNA, 22 nt, Human
aaauguaccuugauaguuuggu

SEQ ID NO: 908184 - RNA, 22 nt, Human
gccuuggcugccaagcugcuga

SEQ ID NO: 908185 - RNA, 22 nt, Human
aguguuaaggcugguugcuaua

SEQ ID NO: 908186 - RNA, 22 nt, Human
uuguauuaguaagucagcugcu

SEQ ID NO: 908187 - RNA, 22 nt, Human
cauuucaauuauuugcucuucu

SEQ ID NO: 908188 - RNA, 18 nt, Human
uccagggcuuccuccucu

SEQ ID NO: 908189 - RNA, 22 nt, Human
ugcugagacaguggauaggggc

SEQ ID NO: 908190 - RNA, 22 nt, Human
aggcugaguuucucauucucgc

SEQ ID NO: 908191 - RNA, 22 nt, Human
cuugggccaccuggagggacug

SEQ ID NO: 908192 - RNA, 22 nt, Human
agcagcuggcagcuucuucucu

SEQ ID NO: 908193 - RNA, 22 nt, Human
ugcagggagcucuggggugcag

SEQ ID NO: 908194 - RNA, 22 nt, Human
auagcaaagccuggcacaauga

SEQ ID NO: 908195 - RNA, 19 nt, Human
uccugggcugggccagguc

SEQ ID NO: 908196 - RNA, 22 nt, Human
ucucagaauaaauuccuaacuu

SEQ ID NO: 908197 - RNA, 22 nt, Human
ucuuucuugcaaggaugcagga

SEQ ID NO: 908198 - RNA, 22 nt, Human
uaauccaaaacugaaucugugg

SEQ ID NO: 908199 - RNA, 22 nt, Human
cugggccuggcguuccaggcug

SEQ ID NO: 908200 - RNA, 22 nt, Human
gaaaguaugccaucuaccucuu

SEQ ID NO: 908201 - RNA, 22 nt, Human
ucugggucucagagugaccaug

SEQ ID NO: 908202 - RNA, 19 nt, Human
uuccaccaucacucuguuu

SEQ ID NO: 908203 - RNA, 22 nt, Human
acuggggagugguuuugggaag

SEQ ID NO: 908204 - RNA, 22 nt, Human
gcccaugguccaggaagacaga

SEQ ID NO: 908205 - RNA, 19 nt, Human
ugguggaggugcaccugac

SEQ ID NO: 908206 - RNA, 22 nt, Human
cagaaaugugauguacacacac

SEQ ID NO: 908207 - RNA, 22 nt, Human
aaacagcucaagaaguuacucu

SEQ ID NO: 908208 - RNA, 22 nt, Human
ucaggaguaaguuauaaguauu

SEQ ID NO: 908209 - RNA, 22 nt, Human
gcauuagauuugccuuugaagc

SEQ ID NO: 908210 - RNA, 22 nt, Human
caugggggucuggacaacaggc

SEQ ID NO: 908211 - RNA, 22 nt, Human
cagaaccugagagcacaauccu

SEQ ID NO: 908212 - RNA, 22 nt, Human
gaaguacaguuuuaucuagcca

SEQ ID NO: 908213 - RNA, 23 nt, Human
ucucuuucaagagcuuaaugugc

SEQ ID NO: 908214 - RNA, 22 nt, Human
caggaaugaguucuggugcucu

SEQ ID NO: 908215 - RNA, 23 nt, Human
ugcagggcaaguuagagacccca

SEQ ID NO: 908216 - RNA, 21 nt, Human
ucacagacuggucagugaggc

SEQ ID NO: 908217 - RNA, 22 nt, Human
agaaaggucacuuagccucagc

SEQ ID NO: 908218 - RNA, 22 nt, Human
ccagcugugccuaggagcaggg

SEQ ID NO: 908219 - RNA, 22 nt, Human
ccagggguuggagguugcagug

SEQ ID NO: 908220 - RNA, 22 nt, Human
ggugggccaggaaggccgccag

SEQ ID NO: 908221 - RNA, 22 nt, Human
ugcaaaguugcaucaaaaccca

SEQ ID NO: 908222 - RNA, 22 nt, Human
ucugcuuucuugcgcagaugug

SEQ ID NO: 908223 - RNA, 22 nt, Human
cagaggccaccuguggccacug

SEQ ID NO: 908224 - RNA, 16 nt, Human
uggcugagagaggguu

SEQ ID NO: 908225 - RNA, 22 nt, Human
augagguaagguauucagggaa

SEQ ID NO: 908226 - RNA, 22 nt, Human
gcacugaaauuauaugcauuug

SEQ ID NO: 908227 - RNA, 22 nt, Human
ucacaguuauagucuguagaau

SEQ ID NO: 908228 - RNA, 23 nt, Human
agguucucuuaucaucucugccc

SEQ ID NO: 908229 - RNA, 22 nt, Human
ccacugucugcaggccucagca

SEQ ID NO: 908230 - RNA, 22 nt, Human
uaaaguuuguagcaauugauau

SEQ ID NO: 908231 - RNA, 22 nt, Human
aggcucagaggugagcaucugc

SEQ ID NO: 908232 - RNA, 22 nt, Human
cuucaucuuucugagccucagu

SEQ ID NO: 908233 - RNA, 22 nt, Human
caauguuuuguugaaugaauag

SEQ ID NO: 908234 - RNA, 22 nt, Human
aaugguuucaaacacacuaagu

SEQ ID NO: 908235 - RNA, 22 nt, Human
gacuggggcucuagccaggccu

SEQ ID NO: 908236 - RNA, 22 nt, Human
ucuggauguugcggaguacaga

SEQ ID NO: 908237 - RNA, 22 nt, Human
gcccaggaaagauagggccuca

SEQ ID NO: 908238 - RNA, 22 nt, Human
uggcagggaauacagauguuua

SEQ ID NO: 908239 - RNA, 18 nt, Human
cuucauuuguagaguucc

SEQ ID NO: 908240 - RNA, 22 nt, Human
agucacugggcugcuuccuaua

SEQ ID NO: 908241 - RNA, 18 nt, Human
ccuucagcucugccagua

SEQ ID NO: 908242 - RNA, 22 nt, Human
augggcugacaagacaugcaua

SEQ ID NO: 908243 - RNA, 22 nt, Human
ucugcaggcauuuuugguuguc

SEQ ID NO: 908244 - RNA, 22 nt, Human
ccaggcaggcuagaauguaaau

SEQ ID NO: 908245 - RNA, 22 nt, Human
uuuacaaggaucaagggaucuc

SEQ ID NO: 908246 - RNA, 21 nt, Human
acauacauaccuuaccaccuu

SEQ ID NO: 908247 - RNA, 22 nt, Human
aaugucauugagcuccaauccu

SEQ ID NO: 908248 - RNA, 22 nt, Human
cccagcuguaacgggucugcac

SEQ ID NO: 908249 - RNA, 22 nt, Human
aaucgguugaacccaggaagug

SEQ ID NO: 908250 - RNA, 22 nt, Human
aggcugccagaagccuucagga

SEQ ID NO: 908251 - RNA, 22 nt, Human
aacagcuuuuuuggucagcauu

SEQ ID NO: 908252 - RNA, 22 nt, Human
gccuucaggaaaucaguccuug

SEQ ID NO: 908253 - RNA, 22 nt, Human
gaauggcugaaugucuuaaauu

SEQ ID NO: 908254 - RNA, 22 nt, Human
aggcggagcucaguguguccaa

SEQ ID NO: 908255 - RNA, 22 nt, Human
cugucauuuaagacauucugga

SEQ ID NO: 908256 - RNA, 22 nt, Human
aaugcuuugacuauaucuauaa

SEQ ID NO: 908257 - RNA, 21 nt, Human
cucuagaaaucgaauaaccuu

SEQ ID NO: 908258 - RNA, 22 nt, Human
uuuauguaaguggaaugaugcc

SEQ ID NO: 908259 - RNA, 22 nt, Human
ugcucuggggagcuccucugcg

SEQ ID NO: 908260 - RNA, 22 nt, Human
cugagcugggcaacucuuagau

SEQ ID NO: 908261 - RNA, 22 nt, Human
ugcugcuguuuccuacaucuca

SEQ ID NO: 908262 - RNA, 22 nt, Human
aaaugcacucugcuucugugac

SEQ ID NO: 908263 - RNA, 22 nt, Human
gcugaaguguggagugacaguu

SEQ ID NO: 908264 - RNA, 22 nt, Human
uuagaaacccagacucuuaggu

SEQ ID NO: 908265 - RNA, 22 nt, Human
auguguguaaacaaguauaauu

SEQ ID NO: 908266 - RNA, 19 nt, Human
ucgcagaccugaguucuaa

SEQ ID NO: 908267 - RNA, 22 nt, Human
ucucuucacaugcuugcuccaa

SEQ ID NO: 908268 - RNA, 22 nt, Human
cccuuuccauggcucuccuagg

SEQ ID NO: 908269 - RNA, 20 nt, Human
ccuggcugcauucaggacgg

SEQ ID NO: 908270 - RNA, 22 nt, Human
ugaccugucacauuuugaugaa

SEQ ID NO: 908271 - RNA, 22 nt, Human
gaagcuucgaaagagugauuuc

SEQ ID NO: 908272 - RNA, 23 nt, Human
ugcugccaagcacgaguugaguu

SEQ ID NO: 908273 - RNA, 22 nt, Human
caguacuugggggguucuaagu

SEQ ID NO: 908274 - RNA, 22 nt, Human
agagcugugcuuugcaccacgu

SEQ ID NO: 908275 - RNA, 22 nt, Human
uggcaaggaaauuaguucuccu

SEQ ID NO: 908276 - RNA, 22 nt, Human
guuccaggcaguggcaacagcu

SEQ ID NO: 908277 - RNA, 22 nt, Human
acuguucuccagcauggcugua

SEQ ID NO: 908278 - RNA, 22 nt, Human
gcuggggcugggcugaggaaga

SEQ ID NO: 908279 - RNA, 22 nt, Human
uuaaauucauuccaacuuuuga

SEQ ID NO: 908280 - RNA, 22 nt, Human
guacuacaguuucucauuaaau

SEQ ID NO: 908281 - RNA, 22 nt, Human
aggucagaagugccagggaauu

SEQ ID NO: 908282 - RNA, 22 nt, Human
aaagggaaguugcacauguucc

SEQ ID NO: 908283 - RNA, 22 nt, Human
caaguuaucagaaggcacuuuu

SEQ ID NO: 908284 - RNA, 22 nt, Human
aaaugcagauucaugagcccca

SEQ ID NO: 908285 - RNA, 19 nt, Human
ugucccuggucaccagacu

SEQ ID NO: 908286 - RNA, 22 nt, Human
cuggcaccuccagcucauggcc

SEQ ID NO: 908287 - RNA, 22 nt, Human
ucaguaacuucaugaccaagca

SEQ ID NO: 908288 - RNA, 22 nt, Human
uucauaaacaacugaugguaau

SEQ ID NO: 908289 - RNA, 22 nt, Human
gucucuuguuaucauuucugag

SEQ ID NO: 908290 - RNA, 22 nt, Human
cccuggcugcuaccagguagcu

SEQ ID NO: 908291 - RNA, 22 nt, Human
aucaggaacguucauggacugu

SEQ ID NO: 908292 - RNA, 22 nt, Human
cagagggacaguguaaugcaua

SEQ ID NO: 908293 - RNA, 22 nt, Human
ggaggccaccauggagucacuu

SEQ ID NO: 908294 - RNA, 22 nt, Human
agaggaggccaggcccacaccu

SEQ ID NO: 908295 - RNA, 22 nt, Human
ggccagcuacccaucugcguca

SEQ ID NO: 908296 - RNA, 20 nt, Human
gcaucaagguacgcucucca

SEQ ID NO: 908297 - RNA, 22 nt, Human
ucuuuauguuugaaaguacaau

SEQ ID NO: 908298 - RNA, 19 nt, Human
agcugcugauugguggagg

SEQ ID NO: 908299 - RNA, 22 nt, Human
acaguuaaucaaauggcauaug

SEQ ID NO: 908300 - RNA, 22 nt, Human
uuucagagcucagcagcuagag

SEQ ID NO: 908301 - RNA, 22 nt, Human
guuuaauuuuagguugucaagc

SEQ ID NO: 908302 - RNA, 22 nt, Human
uuauuccaauuucuccuacaaa

SEQ ID NO: 908303 - RNA, 19 nt, Human
gugucaggaugugcagggg

SEQ ID NO: 908304 - RNA, 22 nt, Human
uauuaguagcuugaaauuggug

SEQ ID NO: 908305 - RNA, 22 nt, Human
cagcagaacaggcagggaagcu

SEQ ID NO: 908306 - RNA, 19 nt, Human
uggucagcauuaggauuug

SEQ ID NO: 908307 - RNA, 22 nt, Human
ggcugccugaggcugaggcccg

SEQ ID NO: 908308 - RNA, 22 nt, Human
ucagguccuuacugugcucccu

SEQ ID NO: 908309 - RNA, 22 nt, Human
ucaguguguaauucuuuguuuc

SEQ ID NO: 908310 - RNA, 22 nt, Human
aaggacugucuaaggccuccaa

SEQ ID NO: 908311 - RNA, 23 nt, Human
agugcucagggcauuaggcuaga

SEQ ID NO: 908312 - RNA, 19 nt, Human
aggauggagcaggcgguga

SEQ ID NO: 908313 - RNA, 19 nt, Human
cucuggccucuggaugcug

SEQ ID NO: 908314 - RNA, 22 nt, Human
cuguuauuuaugcugcuccauu

SEQ ID NO: 908315 - RNA, 22 nt, Human
aaaaggcagugcaagagagggu

SEQ ID NO: 908316 - RNA, 22 nt, Human
agggcagaggcggacacggaag

SEQ ID NO: 908317 - RNA, 22 nt, Human
uuccucagagagacagaaacua

SEQ ID NO: 908318 - RNA, 22 nt, Human
uaggaagcauuuaaagagaugg

SEQ ID NO: 908319 - RNA, 22 nt, Human
gcagcagcagcaauuuucuguc

SEQ ID NO: 908320 - RNA, 22 nt, Human
acagggaagcucaggggcucug

SEQ ID NO: 908321 - RNA, 23 nt, Human
uggagcugggcagcugggaaagu

SEQ ID NO: 908322 - RNA, 22 nt, Human
gaaggccuaggaaggaagccuu

SEQ ID NO: 908323 - RNA, 22 nt, Human
ccaggccucccuuuuccagcca

SEQ ID NO: 908324 - RNA, 22 nt, Human
uauuaauuuaaucuccauggua

SEQ ID NO: 908325 - RNA, 22 nt, Human
ccugcauguggucagcacuccu

SEQ ID NO: 908326 - RNA, 22 nt, Human
gggauggggagcuggaaagggg

SEQ ID NO: 908327 - RNA, 22 nt, Human
cagcaggacauggaggaguaaa

SEQ ID NO: 908328 - RNA, 22 nt, Human
agcagcaugaugacagagucuc

SEQ ID NO: 908329 - RNA, 22 nt, Human
gucuagaaauagguuucagaaa

SEQ ID NO: 908330 - RNA, 22 nt, Human
augaggcagguggaggcugcca

SEQ ID NO: 908331 - RNA, 22 nt, Human
cauaaagucaugaucugaguau

SEQ ID NO: 908332 - RNA, 22 nt, Human
aaacuuuaagacaguccucaag

SEQ ID NO: 908333 - RNA, 22 nt, Human
gacacagaugaucaggugugga

SEQ ID NO: 908334 - RNA, 22 nt, Human
ugguuugagagugugagcuuuu

SEQ ID NO: 908335 - RNA, 22 nt, Human
ggaaaagacagaauucuagaau

SEQ ID NO: 908336 - RNA, 22 nt, Human
uguuugcuguuuucuccaauga

SEQ ID NO: 908337 - RNA, 22 nt, Human
aguacaguggucauaauauaaa

SEQ ID NO: 908338 - RNA, 22 nt, Human
gcugaagauaagugaagaggcu

SEQ ID NO: 908339 - RNA, 22 nt, Human
gacacugaagucacuaagcagg

SEQ ID NO: 908340 - RNA, 22 nt, Human
aaagacaguggauucaaaaucc

SEQ ID NO: 908341 - RNA, 21 nt, Human
cacuauuuauauaugccagcu

SEQ ID NO: 908342 - RNA, 22 nt, Human
aaagauacuuaauaguugucug

SEQ ID NO: 908343 - RNA, 22 nt, Human
caugggcuuuggaggcuggagg

SEQ ID NO: 908344 - RNA, 22 nt, Human
auaaauagugugucauaaaguc

SEQ ID NO: 908345 - RNA, 22 nt, Human
uagcaagaccaauauguagaua

SEQ ID NO: 908346 - RNA, 22 nt, Human
agcuggaggauaacucacuucu

SEQ ID NO: 908347 - RNA, 19 nt, Human
acaaaugauguugcacuga

SEQ ID NO: 908348 - RNA, 22 nt, Human
ugacacaauugagugguacuau

SEQ ID NO: 908349 - RNA, 23 nt, Human
acagagacugccaagauauucuc

SEQ ID NO: 908350 - RNA, 22 nt, Human
agaaucagugcuggcuauuagc

SEQ ID NO: 908351 - RNA, 21 nt, Human
gugugaguagcaugugucuca

SEQ ID NO: 908352 - RNA, 22 nt, Human
ucagcugcgacaggggccugag

SEQ ID NO: 908353 - RNA, 22 nt, Human
cugaggcacugucagcugaggc

SEQ ID NO: 908354 - RNA, 22 nt, Human
aucccauaggguuaucauaggg

SEQ ID NO: 908355 - RNA, 22 nt, Human
uucaugaaaaggucuauuucuu

SEQ ID NO: 908356 - RNA, 22 nt, Human
aggcagagcuggguuuugaaau

SEQ ID NO: 908357 - RNA, 22 nt, Human
cuccugggggacagcggcaggg

SEQ ID NO: 908358 - RNA, 22 nt, Human
agucagugaaaacuagaauguu

SEQ ID NO: 908359 - RNA, 23 nt, Human
aggcauggcauggaugguggcuc

SEQ ID NO: 908360 - RNA, 23 nt, Human
ucugggaauuggcuguccacagg

SEQ ID NO: 908361 - RNA, 22 nt, Human
uccugcagccauuagaggucaa

SEQ ID NO: 908362 - RNA, 22 nt, Human
cacccagccuucacacaggagu

SEQ ID NO: 908363 - RNA, 22 nt, Human
auauggaaauagcaauaugguu

SEQ ID NO: 908364 - RNA, 22 nt, Human
aaacugaaacaucaucauguug

SEQ ID NO: 908365 - RNA, 22 nt, Human
cccaggccuggucugggccagu

SEQ ID NO: 908366 - RNA, 22 nt, Human
ugagcccaggaguuggaggcug

SEQ ID NO: 908367 - RNA, 22 nt, Human
acuacacagggaugugacuacc

SEQ ID NO: 908368 - RNA, 22 nt, Human
agcaaauggguuuauauuugac

SEQ ID NO: 908369 - RNA, 22 nt, Human
cucagaggucaagagcagagcu

SEQ ID NO: 908370 - RNA, 22 nt, Human
uaagguuucuucagauacuagu

SEQ ID NO: 908371 - RNA, 22 nt, Human
agccaggacagggcagcucgcu

SEQ ID NO: 908372 - RNA, 22 nt, Human
uaggucucucuucuugauggga

SEQ ID NO: 908373 - RNA, 20 nt, Human
agaaccuaaguuaaaacaca

SEQ ID NO: 908374 - RNA, 22 nt, Human
ucugccagcucugugggucucg

SEQ ID NO: 908375 - RNA, 22 nt, Human
uuaaaggaauugaguuucuugu

SEQ ID NO: 908376 - RNA, 22 nt, Human
ugugugucuggaagcucaggga

SEQ ID NO: 908377 - RNA, 22 nt, Human
caguacaguaaagcaagcugaa

SEQ ID NO: 908378 - RNA, 22 nt, Human
caacaagcgcucagagcaaagc

SEQ ID NO: 908379 - RNA, 22 nt, Human
gugugccaccacugacaggauu

SEQ ID NO: 908380 - RNA, 22 nt, Human
aaugcauugauugcuggaaaua

SEQ ID NO: 908381 - RNA, 22 nt, Human
acugcacacauguuuaagugga

SEQ ID NO: 908382 - RNA, 22 nt, Human
caggcuggagugcaauggugcu

SEQ ID NO: 908383 - RNA, 22 nt, Human
cuucuucaauagcaagcgcaua

SEQ ID NO: 908384 - RNA, 22 nt, Human
gaaauacaauuuugucccagcu

SEQ ID NO: 908385 - RNA, 21 nt, Human
uuucaguguaugacagugaaa

SEQ ID NO: 908386 - RNA, 22 nt, Human
uagaaacaaagaccugggugcu

SEQ ID NO: 908387 - RNA, 22 nt, Human
uagaaaucagguuuuuagaaag

SEQ ID NO: 908388 - RNA, 22 nt, Human
cccaggcugaguuagagguguc

SEQ ID NO: 908389 - RNA, 22 nt, Human
aguguuucccaguaggaugaaa

SEQ ID NO: 908390 - RNA, 22 nt, Human
aguucacagaauggccagaacu

SEQ ID NO: 908391 - RNA, 22 nt, Human
caugugugguuaccuacuugac

SEQ ID NO: 908392 - RNA, 21 nt, Human
ggcccugguuacgccuccucu

SEQ ID NO: 908393 - RNA, 21 nt, Human
cauuuacaugacagauugguu

SEQ ID NO: 908394 - RNA, 22 nt, Human
uuucuaagaugugguuucaagg

SEQ ID NO: 908395 - RNA, 19 nt, Human
agccagggugagaaggagc

SEQ ID NO: 908396 - RNA, 22 nt, Human
gaguaacauaccaaaauucaca

SEQ ID NO: 908397 - RNA, 22 nt, Human
aacauguaaauaucauuguacu

SEQ ID NO: 908398 - RNA, 22 nt, Human
agggagcuauuucaggguuauu

SEQ ID NO: 908399 - RNA, 22 nt, Human
ggcuggacuugguccuguuuug

SEQ ID NO: 908400 - RNA, 22 nt, Human
uucccagucccaagaaaagcca

SEQ ID NO: 908401 - RNA, 22 nt, Human
cagguuaguaaggucuacauaa

SEQ ID NO: 908402 - RNA, 22 nt, Human
ugaggcugacaaaagaugaggu

SEQ ID NO: 908403 - RNA, 22 nt, Human
ugcugggggcuuucuggauacc

SEQ ID NO: 908404 - RNA, 22 nt, Human
agcccccaggagucuccacgcc

SEQ ID NO: 908405 - RNA, 22 nt, Human
aagggccaucccagaacagaaa

SEQ ID NO: 908406 - RNA, 22 nt, Human
acagucuggaggcugcuucauu

SEQ ID NO: 908407 - RNA, 22 nt, Human
guauuuccuauagugagggccu

SEQ ID NO: 908408 - RNA, 20 nt, Human
caaaucacagguaauugcaa

SEQ ID NO: 908409 - RNA, 22 nt, Human
ucugggccagaucuagggaucu

SEQ ID NO: 908410 - RNA, 22 nt, Human
ugauauguaacuacuccuuaua

SEQ ID NO: 908411 - RNA, 22 nt, Human
gggagcuucuggaaggcaggaa

SEQ ID NO: 908412 - RNA, 21 nt, Human
uggcauggagguagcagugug

SEQ ID NO: 908413 - RNA, 22 nt, Human
uucuucagugccccucuaguag

SEQ ID NO: 908414 - RNA, 22 nt, Human
caaggccuaaucauacugcuaa

SEQ ID NO: 908415 - RNA, 22 nt, Human
auuucuguaguccacauucuuu

SEQ ID NO: 908416 - RNA, 22 nt, Human
agccaaauacaaacuggggugg

SEQ ID NO: 908417 - RNA, 22 nt, Human
uucagcuugcugacugcggcag

SEQ ID NO: 908418 - RNA, 22 nt, Human
uggcucagagcagggacucugg

SEQ ID NO: 908419 - RNA, 18 nt, Human
ggaaaaggagugucuagc

SEQ ID NO: 908420 - RNA, 22 nt, Human
aacccacucuaccuggcuccau

SEQ ID NO: 908421 - RNA, 22 nt, Human
gucacacucuucccuccacaug

SEQ ID NO: 908422 - RNA, 22 nt, Human
auagcaaauucuuuaggugcuu

SEQ ID NO: 908423 - RNA, 22 nt, Human
auuucuagacuuagaacucuua

SEQ ID NO: 908424 - RNA, 22 nt, Human
ccaggccuggacggguggccug

SEQ ID NO: 908425 - RNA, 21 nt, Human
ggcacugagccagauggacuc

SEQ ID NO: 908426 - RNA, 22 nt, Human
auucuaggcuugaaacaugaag

SEQ ID NO: 908427 - RNA, 21 nt, Human
ugaucacaugaaaaccaugca

SEQ ID NO: 908428 - RNA, 22 nt, Human
guggcauuuuagaacagcugac

SEQ ID NO: 908429 - RNA, 22 nt, Human
uggggccagggaggaccagaca

SEQ ID NO: 908430 - RNA, 22 nt, Human
aggaaggacugcagcauuuggu

SEQ ID NO: 908431 - RNA, 22 nt, Human
gcagcaugugccuuaaaucauu

SEQ ID NO: 908432 - RNA, 22 nt, Human
aguauacauagagauggcuguu

SEQ ID NO: 908433 - RNA, 22 nt, Human
ugcaaguaugacagccccaugg

SEQ ID NO: 908434 - RNA, 22 nt, Human
gaccuugguugagcuuccuaau

SEQ ID NO: 908435 - RNA, 22 nt, Human
acuccagacacagacacuauga

SEQ ID NO: 908436 - RNA, 22 nt, Human
gcagccacuaguuuuccuguuu

SEQ ID NO: 908437 - RNA, 22 nt, Human
uggucagagaaguagggacaau

SEQ ID NO: 908438 - RNA, 22 nt, Human
ucauuacacaguucaguggaaa

SEQ ID NO: 908439 - RNA, 22 nt, Human
uguuuucaugguuaugugucua

SEQ ID NO: 908440 - RNA, 22 nt, Human
uccucucugcacuggcccugcc

SEQ ID NO: 908441 - RNA, 22 nt, Human
cacauuuaaagguugaagcuga

SEQ ID NO: 908442 - RNA, 22 nt, Human
agaugcauguuuaugucuuucc

SEQ ID NO: 908443 - RNA, 22 nt, Human
ugcuccagcaccaagagcucca

SEQ ID NO: 908444 - RNA, 22 nt, Human
aggcagguuuacucuuauuugg

SEQ ID NO: 908445 - RNA, 20 nt, Human
ccuccaggcacacccaugug

SEQ ID NO: 908446 - RNA, 22 nt, Human
gcccugugugaucacaugaaca

SEQ ID NO: 908447 - RNA, 22 nt, Human
ugacuauguggccuugaccaag

SEQ ID NO: 908448 - RNA, 22 nt, Human
gggcacuguggggcccaugcug

SEQ ID NO: 908449 - RNA, 23 nt, Human
uuguaaaacagugugacgguucc

SEQ ID NO: 908450 - RNA, 23 nt, Human
uuugcaaauuuuccugacuacuc

SEQ ID NO: 908451 - RNA, 22 nt, Human
aaugucaagggaagcaggaaau

SEQ ID NO: 908452 - RNA, 22 nt, Human
gcaagcuggcuguuagaggaug

SEQ ID NO: 908453 - RNA, 22 nt, Human
uuauuauagauuaugcaagauu

SEQ ID NO: 908454 - RNA, 20 nt, Human
ggcugcaggacucauuggcu

SEQ ID NO: 908455 - RNA, 22 nt, Human
caucaaagggccuguggugcag

SEQ ID NO: 908456 - RNA, 22 nt, Human
gcuggagcugaguucccugggc

SEQ ID NO: 908457 - RNA, 22 nt, Human
acacauuaucucauuaaauacu

SEQ ID NO: 908458 - RNA, 22 nt, Human
accugaaaauuauuauuuccgc

SEQ ID NO: 908459 - RNA, 22 nt, Human
augaaaugugaaugcuuuucau

SEQ ID NO: 908460 - RNA, 22 nt, Human
uuggagucagaugacuguagga

SEQ ID NO: 908461 - RNA, 22 nt, Human
ggagcuggagaguacagaguuu

SEQ ID NO: 908462 - RNA, 22 nt, Human
ugcagugagaagcaguuaugau

SEQ ID NO: 908463 - RNA, 22 nt, Human
ugaaggcuugguggcagccucu

SEQ ID NO: 908464 - RNA, 22 nt, Human
cuguuuccaccuucauggcuaa

SEQ ID NO: 908465 - RNA, 22 nt, Human
uucuuucuuagcaaucuauggu

SEQ ID NO: 908466 - RNA, 22 nt, Human
acuaucaacaucauugcucuag

SEQ ID NO: 908467 - RNA, 22 nt, Human
acagaaaaaugagggagcugga

SEQ ID NO: 908468 - RNA, 22 nt, Human
gccaggucaccucacucaucca

SEQ ID NO: 908469 - RNA, 22 nt, Human
uguuuucuuccuaauugcucau

SEQ ID NO: 908470 - RNA, 21 nt, Human
ucaggaguggagagaauuggu

SEQ ID NO: 908471 - RNA, 22 nt, Human
gcagggcuguuuagugaauagg

SEQ ID NO: 908472 - RNA, 23 nt, Human
ucacaggggccagcgcucugugg

SEQ ID NO: 908473 - RNA, 22 nt, Human
acuuggcaaacaacguggauau

SEQ ID NO: 908474 - RNA, 22 nt, Human
uauuuuaaagugaagggucuug

SEQ ID NO: 908475 - RNA, 22 nt, Human
gaacacugagagagaugggcag

SEQ ID NO: 908476 - RNA, 22 nt, Human
aagcagauuggggauuuccaug

SEQ ID NO: 908477 - RNA, 22 nt, Human
cgugugcgugcauaugcacaag

SEQ ID NO: 908478 - RNA, 22 nt, Human
acagaaugggauuugaauauuu

SEQ ID NO: 908479 - RNA, 22 nt, Human
gagaacuucaggauuauucaag

SEQ ID NO: 908480 - RNA, 22 nt, Human
gaaguuuauuucaaucuauuca

SEQ ID NO: 908481 - RNA, 22 nt, Human
auguccaugcuuugcuccagaa

SEQ ID NO: 908482 - RNA, 22 nt, Human
ugucauguuucauguuuguagg

SEQ ID NO: 908483 - RNA, 22 nt, Human
uacugaaauagcacucugaugc

SEQ ID NO: 908484 - RNA, 22 nt, Human
gcccaggauggagaauaguggu

SEQ ID NO: 908485 - RNA, 22 nt, Human
uucuggacuugccuugcugaug

SEQ ID NO: 908486 - RNA, 22 nt, Human
cccagaaggcuugccaggaagc

SEQ ID NO: 908487 - RNA, 19 nt, Human
uuuuguguagcugcugguu

SEQ ID NO: 908488 - RNA, 22 nt, Human
ucaggggcuugaggugcauguc

SEQ ID NO: 908489 - RNA, 22 nt, Human
agagugaaaagcuagagcagua

SEQ ID NO: 908490 - RNA, 22 nt, Human
aagucugaucauuucuucuaua

SEQ ID NO: 908491 - RNA, 22 nt, Human
uaacaaugauuagugacuacag

SEQ ID NO: 908492 - RNA, 22 nt, Human
caugugugacaaacugccugca

SEQ ID NO: 908493 - RNA, 22 nt, Human
ccuguacuagggucucauugcc

SEQ ID NO: 908494 - RNA, 19 nt, Human
acuccagggaugacagaag

SEQ ID NO: 908495 - RNA, 19 nt, Human
ucauuuguuaguagaaguu

SEQ ID NO: 908496 - RNA, 22 nt, Human
ggcaggguuucuccauucugcc

SEQ ID NO: 908497 - RNA, 22 nt, Human
ggcucuucuguuucacaggcca

SEQ ID NO: 908498 - RNA, 22 nt, Human
ugucucagggcagcagcagggg

SEQ ID NO: 908499 - RNA, 22 nt, Human
aaagugcaccugcuucuucuug

SEQ ID NO: 908500 - RNA, 22 nt, Human
uacuaguucucauaugaaauaa

SEQ ID NO: 908501 - RNA, 22 nt, Human
uuucaguggagugacaugaucu

SEQ ID NO: 908502 - RNA, 22 nt, Human
aacuaguaaaagcaacaguaua

SEQ ID NO: 908503 - RNA, 22 nt, Human
augucagauuccuaaauaucuu

SEQ ID NO: 908504 - RNA, 22 nt, Human
ugagaaagacagacauuccuaa

SEQ ID NO: 908505 - RNA, 22 nt, Human
ugcccccugguggccagagccg

SEQ ID NO: 908506 - RNA, 22 nt, Human
accaucuuuuccucugccuccu

SEQ ID NO: 908507 - RNA, 22 nt, Human
aauuucucgguuuugauauugu

SEQ ID NO: 908508 - RNA, 18 nt, Human
agggcugaugaguuuggg

SEQ ID NO: 908509 - RNA, 22 nt, Human
uaugcugcaauaucauuuugcu

SEQ ID NO: 908510 - RNA, 18 nt, Human
ugcuuuaugcuuauauaa

SEQ ID NO: 908511 - RNA, 22 nt, Human
cuaaaugugcuaauagcaugaa

SEQ ID NO: 908512 - RNA, 22 nt, Human
ucacagaauaaauugagaagac

SEQ ID NO: 908513 - RNA, 22 nt, Human
ugaggcucuccaagcagaugag

SEQ ID NO: 908514 - RNA, 22 nt, Human
cuauuuauuguggguauccagg

SEQ ID NO: 908515 - RNA, 22 nt, Human
aggcucagauucacauuugguu

SEQ ID NO: 908516 - RNA, 22 nt, Human
gacacagacaguuagagguaau

SEQ ID NO: 908517 - RNA, 22 nt, Human
acaaaugucuccucuuuuguua

SEQ ID NO: 908518 - RNA, 22 nt, Human
cuguggaguggggaguacuggu

SEQ ID NO: 908519 - RNA, 22 nt, Human
ucugcugugauucuacuagugu

SEQ ID NO: 908520 - RNA, 22 nt, Human
agaaagggagagccagcacacg

SEQ ID NO: 908521 - RNA, 22 nt, Human
gagcugagaucauguacacuag

SEQ ID NO: 908522 - RNA, 22 nt, Human
ccugcagacacuuguccagcaa

SEQ ID NO: 908523 - RNA, 22 nt, Human
aaaguccuuuuugccaugcaag

SEQ ID NO: 908524 - RNA, 22 nt, Human
uugaauuauaagugugucuacu

SEQ ID NO: 908525 - RNA, 22 nt, Human
uccugggauucugcauuucuaa

SEQ ID NO: 908526 - RNA, 22 nt, Human
cacaguacccagcacuacugag

SEQ ID NO: 908527 - RNA, 21 nt, Human
auaucuucuucaaaccacuca

SEQ ID NO: 908528 - RNA, 22 nt, Human
uagaauccaccuacacaagaga

SEQ ID NO: 908529 - RNA, 22 nt, Human
uuguuuauggauuguagaaacu

SEQ ID NO: 908530 - RNA, 19 nt, Human
auggaagcugggaucaaug

SEQ ID NO: 908531 - RNA, 22 nt, Human
ccucaggcaggaaacugucccg

SEQ ID NO: 908532 - RNA, 22 nt, Human
gcagggaaacaggugcuaagga

SEQ ID NO: 908533 - RNA, 22 nt, Human
aaaugcuguagaucagugaguu

SEQ ID NO: 908534 - RNA, 22 nt, Human
auuccuuggaacagaugcgaag

SEQ ID NO: 908535 - RNA, 18 nt, Human
agaggggagguaagucug

SEQ ID NO: 908536 - RNA, 22 nt, Human
ugguggcagcugggacagaggu

SEQ ID NO: 908537 - RNA, 22 nt, Human
uaaguacaaauguauacauaag

SEQ ID NO: 908538 - RNA, 17 nt, Human
ggugagaccucccacuc

SEQ ID NO: 908539 - RNA, 22 nt, Human
gccugagauucugcauuucuaa

SEQ ID NO: 908540 - RNA, 22 nt, Human
uagaaaagauaacauucugugc

SEQ ID NO: 908541 - RNA, 22 nt, Human
cuucagauccuaauuugucuuu

SEQ ID NO: 908542 - RNA, 22 nt, Human
uaggaccccugugguagauggg

SEQ ID NO: 908543 - RNA, 22 nt, Human
gagcagccugaggagcgugggc

SEQ ID NO: 908544 - RNA, 22 nt, Human
gggcuugguggagagaaugcug

SEQ ID NO: 908545 - RNA, 22 nt, Human
aaaugccucugcuguacacaau

SEQ ID NO: 908546 - RNA, 22 nt, Human
auuucauacuaaggcucaaaaa

SEQ ID NO: 908547 - RNA, 22 nt, Human
gugagagggcugggcucaugau

SEQ ID NO: 908548 - RNA, 22 nt, Human
aaagcuucuauucacuuacuug

SEQ ID NO: 908549 - RNA, 22 nt, Human
ugaguccaccuuaguauauggg

SEQ ID NO: 908550 - RNA, 22 nt, Human
cuuguuaucugaaccaaaauua

SEQ ID NO: 908551 - RNA, 22 nt, Human
cagccugcagggcugccuguug

SEQ ID NO: 908552 - RNA, 22 nt, Human
aaauugcauugagcugcuuauu

SEQ ID NO: 908553 - RNA, 20 nt, Human
aguggcaggcgaucauuacu

SEQ ID NO: 908554 - RNA, 22 nt, Human
gugugcagggaugagugcaggu

SEQ ID NO: 908555 - RNA, 22 nt, Human
guggaaggugaaggagcagcga

SEQ ID NO: 908556 - RNA, 22 nt, Human
ggaggugguuugauuucuauau

SEQ ID NO: 908557 - RNA, 23 nt, Human
gccugggucuagagauaagagcc

SEQ ID NO: 908558 - RNA, 22 nt, Human
agggagcugacuggcugccauu

SEQ ID NO: 908559 - RNA, 22 nt, Human
agggaugugacauuacagaagc

SEQ ID NO: 908560 - RNA, 22 nt, Human
uggcccgccggaagaagauguc

SEQ ID NO: 908561 - RNA, 21 nt, Human
uucaaaaugguguguuugucu

SEQ ID NO: 908562 - RNA, 22 nt, Human
agaaccaugaguuugaguaucu

SEQ ID NO: 908563 - RNA, 22 nt, Human
aggaagcucauuuugacauauc

SEQ ID NO: 908564 - RNA, 22 nt, Human
guauaugagcucuauguaaugg

SEQ ID NO: 908565 - RNA, 22 nt, Human
ggcagggaaacagcugauccca

SEQ ID NO: 908566 - RNA, 22 nt, Human
guauuuuauggccuggggccua

SEQ ID NO: 908567 - RNA, 22 nt, Human
ugaacgcagguccacauggcuc

SEQ ID NO: 908568 - RNA, 20 nt, Human
aguuauaguaucuagccaug

SEQ ID NO: 908569 - RNA, 22 nt, Human
cagacugacuuucuguggcuau

SEQ ID NO: 908570 - RNA, 22 nt, Human
caggcuggagugcaauggcaca

SEQ ID NO: 908571 - RNA, 22 nt, Human
cagcucugagacugaggcuaug

SEQ ID NO: 908572 - RNA, 22 nt, Human
cugcugugcuuguggccacccg

SEQ ID NO: 908573 - RNA, 23 nt, Human
gggaaaggauaugauccuagggg

SEQ ID NO: 908574 - RNA, 22 nt, Human
acaccagggccuagccagggcg

SEQ ID NO: 908575 - RNA, 22 nt, Human
acuugcagcagcagcuauuggc

SEQ ID NO: 908576 - RNA, 22 nt, Human
ccuggcaggcaagaggaaggga

SEQ ID NO: 908577 - RNA, 22 nt, Human
acauuuacagugcuagacaauc

SEQ ID NO: 908578 - RNA, 22 nt, Human
auuuugaagggaauugaaguuc

SEQ ID NO: 908579 - RNA, 22 nt, Human
aaggucuaugaggccagaacau

SEQ ID NO: 908580 - RNA, 22 nt, Human
aggggccucagccuccugguca

SEQ ID NO: 908581 - RNA, 22 nt, Human
uaggcgacagcuugauggugcg

SEQ ID NO: 908582 - RNA, 22 nt, Human
auuaggcauauaugcuuuuaau

SEQ ID NO: 908583 - RNA, 20 nt, Human
acauuuuggcauacucucaa

SEQ ID NO: 908584 - RNA, 22 nt, Human
ggagagagagcucauuagcugc

SEQ ID NO: 908585 - RNA, 22 nt, Human
aagacgggagucaggugagcuc

SEQ ID NO: 908586 - RNA, 22 nt, Human
aacauucagcuggguggagcag

SEQ ID NO: 908587 - RNA, 22 nt, Human
uguacaguacauguguagugau

SEQ ID NO: 908588 - RNA, 22 nt, Human
ucuuucuucuuucauaguguga

SEQ ID NO: 908589 - RNA, 22 nt, Human
auggaucacagugccgugggug

SEQ ID NO: 908590 - RNA, 22 nt, Human
gcugcagccuucuugccauuaa

SEQ ID NO: 908591 - RNA, 22 nt, Human
gcugaaauuagacugcagaagu

SEQ ID NO: 908592 - RNA, 22 nt, Human
cugcccugcuuguuuccagugg

SEQ ID NO: 908593 - RNA, 22 nt, Human
ugagagcaacacgcaguaguau

SEQ ID NO: 908594 - RNA, 22 nt, Human
uauaaauuauuaggcugcuaaa

SEQ ID NO: 908595 - RNA, 22 nt, Human
ugucuuuugccaaagaucaguu

SEQ ID NO: 908596 - RNA, 22 nt, Human
agcuggcagggguucacacugc

SEQ ID NO: 908597 - RNA, 23 nt, Human
ucagaggaucaucaaacguuuuc

SEQ ID NO: 908598 - RNA, 22 nt, Human
cacaugcaugccaggcucacag

SEQ ID NO: 908599 - RNA, 22 nt, Human
caagggaguugcugcaugcagg

SEQ ID NO: 908600 - RNA, 22 nt, Human
cuggaaggcucugcugccuguc

SEQ ID NO: 908601 - RNA, 22 nt, Human
caguccagccaguagggugugg

SEQ ID NO: 908602 - RNA, 22 nt, Human
uuuuuuauaucaacugaagucu

SEQ ID NO: 908603 - RNA, 21 nt, Human
agcugcaagagcaacaucuuu

SEQ ID NO: 908604 - RNA, 22 nt, Human
acuauacugucucuuauagaua

SEQ ID NO: 908605 - RNA, 22 nt, Human
gacaagacaugugaugacauca

SEQ ID NO: 908606 - RNA, 22 nt, Human
augucauuaaaauugugcugca

SEQ ID NO: 908607 - RNA, 22 nt, Human
acacaguaugacauuggcagag

SEQ ID NO: 908608 - RNA, 22 nt, Human
agggguuggacauaagacagaa

SEQ ID NO: 908609 - RNA, 22 nt, Human
gugggcuguuguucccuguucu

SEQ ID NO: 908610 - RNA, 22 nt, Human
ggccccaggaccuccacggucc

SEQ ID NO: 908611 - RNA, 21 nt, Human
uaaaagaugacaagacagcuc

SEQ ID NO: 908612 - RNA, 22 nt, Human
ugcaggaauagcuacagagcug

SEQ ID NO: 908613 - RNA, 22 nt, Human
cagggcccauggcucagguagg

SEQ ID NO: 908614 - RNA, 22 nt, Human
caucccugcccucaugccuaua

SEQ ID NO: 908615 - RNA, 18 nt, Human
ugaggaaggggaaguauu

SEQ ID NO: 908616 - RNA, 22 nt, Human
uccaggagcauccaggugaagc

SEQ ID NO: 908617 - RNA, 22 nt, Human
uaguauuugcagauuuguguca

SEQ ID NO: 908618 - RNA, 22 nt, Human
ugcuacaggcgauccucaacua

SEQ ID NO: 908619 - RNA, 22 nt, Human
aaugaucacugcaguugaugag

SEQ ID NO: 908620 - RNA, 22 nt, Human
caggucuguuuucaaggucagu

SEQ ID NO: 908621 - RNA, 22 nt, Human
acagaaagaccuuguaacacuu

SEQ ID NO: 908622 - RNA, 22 nt, Human
cuuuuaaugggagcaguauuug

SEQ ID NO: 908623 - RNA, 22 nt, Human
ggugugugaggagucacuuagu

SEQ ID NO: 908624 - RNA, 22 nt, Human
aaaagaguguuucaacuuuggc

SEQ ID NO: 908625 - RNA, 22 nt, Human
caggaugugaggaggccauuug

SEQ ID NO: 908626 - RNA, 22 nt, Human
ccaagggcuauuuacagaacag

SEQ ID NO: 908627 - RNA, 22 nt, Human
auucuacaccucucucauuuag

SEQ ID NO: 908628 - RNA, 22 nt, Human
cuuugucauuuugucucucagu

SEQ ID NO: 908629 - RNA, 22 nt, Human
ugcucugggcuaucugagaaag

SEQ ID NO: 908630 - RNA, 22 nt, Human
uuggcagagggaccagccuaca

SEQ ID NO: 908631 - RNA, 22 nt, Human
uuugggaauagcagggacugag

SEQ ID NO: 908632 - RNA, 22 nt, Human
agggaaugcuccguauaaaucu

SEQ ID NO: 908633 - RNA, 21 nt, Human
aaaugaaugugguagugcaag

SEQ ID NO: 908634 - RNA, 22 nt, Human
aaguguuuccgggagacuuggu

SEQ ID NO: 908635 - RNA, 22 nt, Human
agccaggcuacuccuugcugac

SEQ ID NO: 908636 - RNA, 22 nt, Human
caacaguauugugggccaggua

SEQ ID NO: 908637 - RNA, 22 nt, Human
uuauuauugugguugcauuauc

SEQ ID NO: 908638 - RNA, 22 nt, Human
agcuggcugccuucuccuuagg

SEQ ID NO: 908639 - RNA, 22 nt, Human
aauucaguuggcaaacaugcug

SEQ ID NO: 908640 - RNA, 22 nt, Human
gaaaauaggcugcaucuccuuc

SEQ ID NO: 908641 - RNA, 22 nt, Human
gccuuuugaucuauaacugugu

SEQ ID NO: 908642 - RNA, 22 nt, Human
gcugcaagugcauguugcaacu

SEQ ID NO: 908643 - RNA, 22 nt, Human
auccuuagguggugcaucaggg

SEQ ID NO: 908644 - RNA, 19 nt, Human
uggaggccaggacacaggu

SEQ ID NO: 908645 - RNA, 22 nt, Human
uggcuucuugacuucuuggcug

SEQ ID NO: 908646 - RNA, 22 nt, Human
uuacaaagaaaauuaggcauuu

SEQ ID NO: 908647 - RNA, 22 nt, Human
uaaccuuuguucaauguaagau

SEQ ID NO: 908648 - RNA, 22 nt, Human
cagugcugcaucuccaugccag

SEQ ID NO: 908649 - RNA, 22 nt, Human
uggagcaggcaucuuucucucu

SEQ ID NO: 908650 - RNA, 22 nt, Human
ucagagaaaauggaaacuuuua

SEQ ID NO: 908651 - RNA, 22 nt, Human
cacuguuauuacuacuauacau

SEQ ID NO: 908652 - RNA, 22 nt, Human
acauuuacccuggaacauugga

SEQ ID NO: 908653 - RNA, 18 nt, Human
uucuuuucaugugaucuc

SEQ ID NO: 908654 - RNA, 22 nt, Human
auuuguucagcauugaauuugg

SEQ ID NO: 908655 - RNA, 22 nt, Human
uggugagagcugaccgugcgag

SEQ ID NO: 908656 - RNA, 22 nt, Human
uacauauuugucuuuguacugu

SEQ ID NO: 908657 - RNA, 22 nt, Human
uccaggccccugccugggccug

SEQ ID NO: 908658 - RNA, 22 nt, Human
ucaaagacuauauauuuuauuu

SEQ ID NO: 908659 - RNA, 22 nt, Human
cagcaaggacugggcaugugaa

SEQ ID NO: 908660 - RNA, 22 nt, Human
uggaaucuuuaggaagcacaua

SEQ ID NO: 908661 - RNA, 22 nt, Human
auugagcaccuacuuugugcca

SEQ ID NO: 908662 - RNA, 22 nt, Human
agagacagaucugagggaccuc

SEQ ID NO: 908663 - RNA, 22 nt, Human
guguggggucuucucuuggccu

SEQ ID NO: 908664 - RNA, 22 nt, Human
gacaaagagaaguaacaguacc

SEQ ID NO: 908665 - RNA, 22 nt, Human
aacugcaacuuguuugauucuu

SEQ ID NO: 908666 - RNA, 22 nt, Human
uaguuucuucaccuguaaaaug

SEQ ID NO: 908667 - RNA, 20 nt, Human
ccuagggcaagugggugggc

SEQ ID NO: 908668 - RNA, 22 nt, Human
cuucauuucaggcugaagaaua

SEQ ID NO: 908669 - RNA, 22 nt, Human
uugaucuuuauaauaguuuuga

SEQ ID NO: 908670 - RNA, 22 nt, Human
aguguuccuugcuuucccagag

SEQ ID NO: 908671 - RNA, 22 nt, Human
acaaaugauuuuccaagccagu

SEQ ID NO: 908672 - RNA, 22 nt, Human
uuucacagauccuacagcuugu

SEQ ID NO: 908673 - RNA, 22 nt, Human
gaauacauccagagcagggcug

SEQ ID NO: 908674 - RNA, 22 nt, Human
ugggcugcacccucagccucug

SEQ ID NO: 908675 - RNA, 22 nt, Human
agagcacaggcucuggagucua

SEQ ID NO: 908676 - RNA, 22 nt, Human
uggcacagggcuuggucgcuca

SEQ ID NO: 908677 - RNA, 22 nt, Human
gagguauugacuaugggauggc

SEQ ID NO: 908678 - RNA, 22 nt, Human
cauucauuagaauagauaugua

SEQ ID NO: 908679 - RNA, 18 nt, Human
augcuccuaucucugagc

SEQ ID NO: 908680 - RNA, 22 nt, Human
gccuggcuccuaagagcacaac

SEQ ID NO: 908681 - RNA, 22 nt, Human
uccagugcuggaccagagcacc

SEQ ID NO: 908682 - RNA, 20 nt, Human
uuucagagugucuuuccauu

SEQ ID NO: 908683 - RNA, 22 nt, Human
gaggagagaugguagauugggu

SEQ ID NO: 908684 - RNA, 22 nt, Human
uuucugauaauuuugugaaauc

SEQ ID NO: 908685 - RNA, 22 nt, Human
accaccaggggauuuucagaac

SEQ ID NO: 908686 - RNA, 23 nt, Human
aaauaggaguaucuggaucauga

SEQ ID NO: 908687 - RNA, 18 nt, Human
ucugcaggaccucagggc

SEQ ID NO: 908688 - RNA, 22 nt, Human
uucaugugaauauauuugucuu

SEQ ID NO: 908689 - RNA, 22 nt, Human
aggcugagccugggcguggugg

SEQ ID NO: 908690 - RNA, 22 nt, Human
agguauuuccuuuaaagaaacu

SEQ ID NO: 908691 - RNA, 22 nt, Human
uuucauguggcgaugucucugg

SEQ ID NO: 908692 - RNA, 22 nt, Human
gcucagcuugggagcgcccggu

SEQ ID NO: 908693 - RNA, 22 nt, Human
ugucuccuacugccuguggauc

SEQ ID NO: 908694 - RNA, 22 nt, Human
aaacaggcuugcaacauguuuu

SEQ ID NO: 908695 - RNA, 22 nt, Human
aucuucaacuugaucauuugaa

SEQ ID NO: 908696 - RNA, 22 nt, Human
gagggugggcuccuaucugggu

SEQ ID NO: 908697 - RNA, 22 nt, Human
uggcuucauggcugugcaaucu

SEQ ID NO: 908698 - RNA, 22 nt, Human
ugugguggcuauucuggucuca

SEQ ID NO: 908699 - RNA, 22 nt, Human
aaaugguccauccuaaagaagu

SEQ ID NO: 908700 - RNA, 22 nt, Human
aguacaaguauuagaguuauuc

SEQ ID NO: 908701 - RNA, 19 nt, Human
gcgaggaagucacuguggc

SEQ ID NO: 908702 - RNA, 22 nt, Human
ggcauuuaguuuucauauucug

SEQ ID NO: 908703 - RNA, 22 nt, Human
agggcagcccuucugggagggc

SEQ ID NO: 908704 - RNA, 22 nt, Human
cagggcuggguuaaaagcaggg

SEQ ID NO: 908705 - RNA, 19 nt, Human
ugaggggaggagaggccug

SEQ ID NO: 908706 - RNA, 22 nt, Human
gcuucugcuguugaagccacca

SEQ ID NO: 908707 - RNA, 22 nt, Human
ccagggaagauuagaagccacu

SEQ ID NO: 908708 - RNA, 22 nt, Human
aauuucucacucucuugaucac

SEQ ID NO: 908709 - RNA, 22 nt, Human
ugcagcugccuccuucccuugu

SEQ ID NO: 908710 - RNA, 22 nt, Human
ggcccuguccccuucaguuuug

SEQ ID NO: 908711 - RNA, 22 nt, Human
cagugccaagccacagaucacu

SEQ ID NO: 908712 - RNA, 22 nt, Human
agaaaguuaucacaaaauugag

SEQ ID NO: 908713 - RNA, 22 nt, Human
acauucaaaauauuucugaugu

SEQ ID NO: 908714 - RNA, 20 nt, Human
uucauucacguagcuguuga

SEQ ID NO: 908715 - RNA, 22 nt, Human
ugacagcauaacacuggucuug

SEQ ID NO: 908716 - RNA, 22 nt, Human
acuggaaaguauucuuucacug

SEQ ID NO: 908717 - RNA, 22 nt, Human
cuucaaaucccccugaguuuga

SEQ ID NO: 908718 - RNA, 20 nt, Human
gccugccucagcuagcugag

SEQ ID NO: 908719 - RNA, 22 nt, Human
ccugugaccacucugguucugc

SEQ ID NO: 908720 - RNA, 22 nt, Human
uaauaguuucauaaugugcuuc

SEQ ID NO: 908721 - RNA, 22 nt, Human
guggggugcagcaguacugugu

SEQ ID NO: 908722 - RNA, 22 nt, Human
guauugcauuuugaaugcaugg

SEQ ID NO: 908723 - RNA, 22 nt, Human
agcugccccaugagaggcaggu

SEQ ID NO: 908724 - RNA, 22 nt, Human
uagaggaaauuuccaaggugag

SEQ ID NO: 908725 - RNA, 22 nt, Human
caaggaaggagagaugaugggu

SEQ ID NO: 908726 - RNA, 22 nt, Human
aggaggaaggcuucauuagguu

SEQ ID NO: 908727 - RNA, 22 nt, Human
uguauguguauguacauaugca

SEQ ID NO: 908728 - RNA, 22 nt, Human
uuuggaauccucaguaugauca

SEQ ID NO: 908729 - RNA, 22 nt, Human
acugugugaaacaucaaugugu

SEQ ID NO: 908730 - RNA, 22 nt, Human
ggcacugagcgggcucugagcg

SEQ ID NO: 908731 - RNA, 22 nt, Human
ggaaggcucuguuccuugacuu

SEQ ID NO: 908732 - RNA, 22 nt, Human
cacagcuggaaugggguaccug

SEQ ID NO: 908733 - RNA, 22 nt, Human
acaggaggagcagcugugugcc

SEQ ID NO: 908734 - RNA, 22 nt, Human
ccuuccccaggugcucacuguc

SEQ ID NO: 908735 - RNA, 18 nt, Human
cugggacucaaugcuacu

SEQ ID NO: 908736 - RNA, 19 nt, Human
aggaaaggaucaaaauagc

SEQ ID NO: 908737 - RNA, 22 nt, Human
aaguaggaauccgaaugaguag

SEQ ID NO: 908738 - RNA, 22 nt, Human
ccaaaggcggaacugagucucu

SEQ ID NO: 908739 - RNA, 22 nt, Human
cugggagcaagaggcugcaaau

SEQ ID NO: 908740 - RNA, 22 nt, Human
ugucauauguaauauguucauu

SEQ ID NO: 908741 - RNA, 22 nt, Human
auuuucaugacuaccuuaaaua

SEQ ID NO: 908742 - RNA, 22 nt, Human
gggcaugagagggcagcuggca

SEQ ID NO: 908743 - RNA, 22 nt, Human
uguauuugaugagaggaggguc

SEQ ID NO: 908744 - RNA, 22 nt, Human
ucugugacucauaucuguagau

SEQ ID NO: 908745 - RNA, 22 nt, Human
aacaagaagggaaggcaugauu

SEQ ID NO: 908746 - RNA, 22 nt, Human
cuuacaaaggagaggagauagg

SEQ ID NO: 908747 - RNA, 17 nt, Human
uuuagaauacaauguuu

SEQ ID NO: 908748 - RNA, 22 nt, Human
cuauuacaaucugcuacuauga

SEQ ID NO: 908749 - RNA, 22 nt, Human
guuccauaucacagcagacgaa

SEQ ID NO: 908750 - RNA, 22 nt, Human
ucuacuuucacucauacuuauu

SEQ ID NO: 908751 - RNA, 22 nt, Human
guucuucagaggggaaagaacc

SEQ ID NO: 908752 - RNA, 22 nt, Human
ggcucacgcaauuaucccggcc

SEQ ID NO: 908753 - RNA, 22 nt, Human
gggcauggugagggauaugaag

SEQ ID NO: 908754 - RNA, 22 nt, Human
aaucuagagaacuguggggcag

SEQ ID NO: 908755 - RNA, 22 nt, Human
uauuuggaaaagggaagggaca

SEQ ID NO: 908756 - RNA, 22 nt, Human
gaugggguuuugccaggcuggu

SEQ ID NO: 908757 - RNA, 22 nt, Human
acuuuaugacacccuuuaguga

SEQ ID NO: 908758 - RNA, 22 nt, Human
agcugcagaaaggacaacuaau

SEQ ID NO: 908759 - RNA, 22 nt, Human
gaaagcaaguugacugcagaau

SEQ ID NO: 908760 - RNA, 22 nt, Human
uugcauuuugguuguaaauaug

SEQ ID NO: 908761 - RNA, 22 nt, Human
gagggcacgaaacaaccacuuc

SEQ ID NO: 908762 - RNA, 22 nt, Human
uuaaaugucuguagaugugcug

SEQ ID NO: 908763 - RNA, 22 nt, Human
aaguaacacauguuacuucugc

SEQ ID NO: 908764 - RNA, 22 nt, Human
cugaccugcggggaggagggcc

SEQ ID NO: 908765 - RNA, 22 nt, Human
aucauccuauugugccccaggu

SEQ ID NO: 908766 - RNA, 22 nt, Human
cugucccacaagcagugugcac

SEQ ID NO: 908767 - RNA, 22 nt, Human
uuauuaagugccuacaauaaag

SEQ ID NO: 908768 - RNA, 22 nt, Human
auacauguugagaaaauaucug

SEQ ID NO: 908769 - RNA, 22 nt, Human
acauuuuacaguugucuggcua

SEQ ID NO: 908770 - RNA, 22 nt, Human
ccacauuuacuggaugcucagg

SEQ ID NO: 908771 - RNA, 22 nt, Human
uggcaggcauugaugcgaguuc

SEQ ID NO: 908772 - RNA, 22 nt, Human
guaaauaacugguaauuggggu

SEQ ID NO: 908773 - RNA, 22 nt, Human
uacacugugacaaucaugacag

SEQ ID NO: 908774 - RNA, 22 nt, Human
ccugaggacaucagcaucaccu

SEQ ID NO: 908775 - RNA, 22 nt, Human
uucaaugcuuauauggacuaau

SEQ ID NO: 908776 - RNA, 22 nt, Human
ccacagcuagggcaaucugauu

SEQ ID NO: 908777 - RNA, 22 nt, Human
uuacaaagauuauauucaguua

SEQ ID NO: 908778 - RNA, 19 nt, Human
gaguccugugcuccuuguu

SEQ ID NO: 908779 - RNA, 22 nt, Human
uggugcugugauacgaggcacu

SEQ ID NO: 908780 - RNA, 22 nt, Human
gcucagagcccgaggcuugcau

SEQ ID NO: 908781 - RNA, 22 nt, Human
uuacaagauugauuugcuuggc

SEQ ID NO: 908782 - RNA, 22 nt, Human
gccaggccugcaagugcuggug

SEQ ID NO: 908783 - RNA, 22 nt, Human
uacuuaaauaauugcugcuauu

SEQ ID NO: 908784 - RNA, 22 nt, Human
aucuaaagugucauaaguagcu

SEQ ID NO: 908785 - RNA, 22 nt, Human
cuccugggaauuuaguugugag

SEQ ID NO: 908786 - RNA, 22 nt, Human
gcagcugcuggaaguuccugcc

SEQ ID NO: 908787 - RNA, 22 nt, Human
aaaugcagaaucucagacccca

SEQ ID NO: 908788 - RNA, 22 nt, Human
uacaacagacaggaauaagauu

SEQ ID NO: 908789 - RNA, 22 nt, Human
agggaggagaauggacuccuuc

SEQ ID NO: 908790 - RNA, 22 nt, Human
uuguuuuaaccuaguguuuaug

SEQ ID NO: 908791 - RNA, 22 nt, Human
uuggaauagggaggcuggcaua

SEQ ID NO: 908792 - RNA, 22 nt, Human
cugcuggggaggcgccucgacg

SEQ ID NO: 908793 - RNA, 22 nt, Human
ucuuacaagaaggaaaagggag

SEQ ID NO: 908794 - RNA, 23 nt, Human
cacaccaggagccgucugggcca

SEQ ID NO: 908795 - RNA, 22 nt, Human
ggcggggccucgcgaacggccu

SEQ ID NO: 908796 - RNA, 22 nt, Human
uugggaaggcguggaagcagaa

SEQ ID NO: 908797 - RNA, 22 nt, Human
agaggcuccaccuucucugucc

SEQ ID NO: 908798 - RNA, 22 nt, Human
cagcuaccaugguuuguuccag

SEQ ID NO: 908799 - RNA, 22 nt, Human
auuucuugauuccaccagugaa

SEQ ID NO: 908800 - RNA, 22 nt, Human
ucuacacuguagaauuauaagg

SEQ ID NO: 908801 - RNA, 22 nt, Human
ucagggaauaaguagaugagug

SEQ ID NO: 908802 - RNA, 22 nt, Human
uucacaguggcugacaggcugg

SEQ ID NO: 908803 - RNA, 22 nt, Human
cuauuuuucuguacccuaauuu

SEQ ID NO: 908804 - RNA, 22 nt, Human
gugugcauauguguggcucucc

SEQ ID NO: 908805 - RNA, 22 nt, Human
agauacauugaguuuccuccug

SEQ ID NO: 908806 - RNA, 22 nt, Human
caucaaaugccauauaugguug

SEQ ID NO: 908807 - RNA, 22 nt, Human
guuuccaugcaguagagcuuag

SEQ ID NO: 908808 - RNA, 22 nt, Human
ugcuuugugacagauuaguuuu

SEQ ID NO: 908809 - RNA, 22 nt, Human
ccacagugauucacuuuugaag

SEQ ID NO: 908810 - RNA, 17 nt, Human
uucucuuccuggauagu

SEQ ID NO: 908811 - RNA, 22 nt, Human
uaacacugauuuguucucaggg

SEQ ID NO: 908812 - RNA, 22 nt, Human
augauauuugcaaugugcuugc

SEQ ID NO: 908813 - RNA, 22 nt, Human
uuucuagacauuucuauguaca

SEQ ID NO: 908814 - RNA, 22 nt, Human
agaaguauucugcauguacuga

SEQ ID NO: 908815 - RNA, 22 nt, Human
gaauagcuuagauuccuuagug

SEQ ID NO: 908816 - RNA, 22 nt, Human
gaaaucuugcucauugugacaa

SEQ ID NO: 908817 - RNA, 22 nt, Human
auuuuccucugguuuccccaga

SEQ ID NO: 908818 - RNA, 22 nt, Human
ugagccuguggggugacaacca

SEQ ID NO: 908819 - RNA, 22 nt, Human
gcaggagccacuucagggaugc

SEQ ID NO: 908820 - RNA, 22 nt, Human
ccauuauccacgggcuuccuga

SEQ ID NO: 908821 - RNA, 22 nt, Human
gcuccuguuuucuuccagaaau

SEQ ID NO: 908822 - RNA, 22 nt, Human
ccuggcuuagagguugccuuuc

SEQ ID NO: 908823 - RNA, 22 nt, Human
acccugagaaagucacaugcau

SEQ ID NO: 908824 - RNA, 22 nt, Human
uacauucugguggagaaaguaa

SEQ ID NO: 908825 - RNA, 22 nt, Human
uggccagcccucuucccacacu

SEQ ID NO: 908826 - RNA, 22 nt, Human
ucuaacagaaauucugacaaaa

SEQ ID NO: 908827 - RNA, 22 nt, Human
agacagacaaaauuccugccug

SEQ ID NO: 908828 - RNA, 22 nt, Human
gaaagguuguaacaagacucuu

SEQ ID NO: 908829 - RNA, 22 nt, Human
gaaguucuuuauagcaguguga

SEQ ID NO: 908830 - RNA, 22 nt, Human
cacacaguggaguauuacucag

SEQ ID NO: 908831 - RNA, 22 nt, Human
agaggccuaauugcuacccuuu

SEQ ID NO: 908832 - RNA, 22 nt, Human
cauuaugugggaaaauguucuu

SEQ ID NO: 908833 - RNA, 20 nt, Human
gggcagcaagacauuugaca

SEQ ID NO: 908834 - RNA, 21 nt, Human
cagugagguccccagccuagg

SEQ ID NO: 908835 - RNA, 18 nt, Human
aaaugcuaggcuacauga

SEQ ID NO: 908836 - RNA, 22 nt, Human
ccaggaggugcuggaagaaagc

SEQ ID NO: 908837 - RNA, 22 nt, Human
caugugugggacccuuagguug

SEQ ID NO: 908838 - RNA, 22 nt, Human
ucccagggugcgccugcccucg

SEQ ID NO: 908839 - RNA, 22 nt, Human
gccacagcuccagucaggugac

SEQ ID NO: 908840 - RNA, 22 nt, Human
augguucauauuaugcaucuga

SEQ ID NO: 908841 - RNA, 22 nt, Human
uuggcacacaguaagcccuaag

SEQ ID NO: 908842 - RNA, 22 nt, Human
aaggccuuaaagcucucuccag

SEQ ID NO: 908843 - RNA, 22 nt, Human
agcugcagaucaauaggcucac

SEQ ID NO: 908844 - RNA, 22 nt, Human
acccaggcuggagugcaguggu

SEQ ID NO: 908845 - RNA, 21 nt, Human
ucuggcaggaagacggauggg

SEQ ID NO: 908846 - RNA, 22 nt, Human
gaguguccgugcagccccagac

SEQ ID NO: 908847 - RNA, 22 nt, Human
gccgugucaucugcggguggca

SEQ ID NO: 908848 - RNA, 22 nt, Human
uuuuccagagcugucucuugca

SEQ ID NO: 908849 - RNA, 22 nt, Human
agucucuuuugcgaagaguguu

SEQ ID NO: 908850 - RNA, 22 nt, Human
ccagagaaccaucugcuugagg

SEQ ID NO: 908851 - RNA, 22 nt, Human
cuguccugauggugccacuggu

SEQ ID NO: 908852 - RNA, 22 nt, Human
uuguguuucuggccaagaugga

SEQ ID NO: 908853 - RNA, 23 nt, Human
aaagugcaguugaggaaucauag

SEQ ID NO: 908854 - RNA, 22 nt, Human
ccacuucaucccagcucagaua

SEQ ID NO: 908855 - RNA, 22 nt, Human
guacauuuugagguuaaaacaa

SEQ ID NO: 908856 - RNA, 22 nt, Human
ugauaauguucgagaaugaaga

SEQ ID NO: 908857 - RNA, 22 nt, Human
gaacagaugggcucagauccug

SEQ ID NO: 908858 - RNA, 22 nt, Human
aaguacauuauaugagcagaau

SEQ ID NO: 908859 - RNA, 18 nt, Human
ugcugggguagaauccac

SEQ ID NO: 908860 - RNA, 23 nt, Human
caucaaguacuuuugacaagugu

SEQ ID NO: 908861 - RNA, 22 nt, Human
aaaguguuaugcaaaacucugu

SEQ ID NO: 908862 - RNA, 22 nt, Human
aguuuuguaauucucaaaaaua

SEQ ID NO: 908863 - RNA, 22 nt, Human
uccauguggcaauaggagacag

SEQ ID NO: 908864 - RNA, 22 nt, Human
ucauugaguaauacuguagugu

SEQ ID NO: 908865 - RNA, 20 nt, Human
ggagcuagagcugaaagacu

SEQ ID NO: 908866 - RNA, 22 nt, Human
ucagauaugaauucauaucucu

SEQ ID NO: 908867 - RNA, 22 nt, Human
gcagggaagacccggagcagcg

SEQ ID NO: 908868 - RNA, 18 nt, Human
guccacagcccucacagc

SEQ ID NO: 908869 - RNA, 22 nt, Human
uuacauaccucauagacucagg

SEQ ID NO: 908870 - RNA, 22 nt, Human
aaccacagagcccccucagaug

SEQ ID NO: 908871 - RNA, 22 nt, Human
ucacaagauaaacauagcucca

SEQ ID NO: 908872 - RNA, 22 nt, Human
ucagcauuguggcagagaaugg

SEQ ID NO: 908873 - RNA, 22 nt, Human
ggcuucacauagcaaugugagc

SEQ ID NO: 908874 - RNA, 21 nt, Human
gcauucuucaugugauucaga

SEQ ID NO: 908875 - RNA, 22 nt, Human
uugacaaugcacugugcuaagu

SEQ ID NO: 908876 - RNA, 22 nt, Human
uauaggaacagcuagcacagaa

SEQ ID NO: 908877 - RNA, 22 nt, Human
ugucuguggcaauuguggguaa

SEQ ID NO: 908878 - RNA, 22 nt, Human
aggucacauggauaaugaucag

SEQ ID NO: 908879 - RNA, 20 nt, Human
agacuuaggcaauuuaggcu

SEQ ID NO: 908880 - RNA, 22 nt, Human
cuuuggucagagggauggaguu

SEQ ID NO: 908881 - RNA, 22 nt, Human
aggaagcuuagugaaaggacca

SEQ ID NO: 908882 - RNA, 22 nt, Human
acagcugggugucccacuucug

SEQ ID NO: 908883 - RNA, 20 nt, Human
cccuggacuccugagcaaac

SEQ ID NO: 908884 - RNA, 16 nt, Human
ccuuggcaucagcugu

SEQ ID NO: 908885 - RNA, 22 nt, Human
ucauggcauuguuaaggguuuu

SEQ ID NO: 908886 - RNA, 22 nt, Human
agcuggaagauccugguuuugu

SEQ ID NO: 908887 - RNA, 22 nt, Human
uuaaaggcaugguuagacaugg

SEQ ID NO: 908888 - RNA, 22 nt, Human
gcuuucuugguucugcaggggc

SEQ ID NO: 908889 - RNA, 22 nt, Human
guccucagaagccugcuuagcu

SEQ ID NO: 908890 - RNA, 22 nt, Human
cugaagcuuaguuuacgcucca

SEQ ID NO: 908891 - RNA, 22 nt, Human
ucugaaggucugagaaccagga

SEQ ID NO: 908892 - RNA, 22 nt, Human
ugagagccaggaucugcucuau

SEQ ID NO: 908893 - RNA, 22 nt, Human
auggauaaauacuuggugguau

SEQ ID NO: 908894 - RNA, 22 nt, Human
gcuuggcagggccugcuggagc

SEQ ID NO: 908895 - RNA, 23 nt, Human
agggugagcaagcuauggagacc

SEQ ID NO: 908896 - RNA, 22 nt, Human
ccagugccugugggcauggugc

SEQ ID NO: 908897 - RNA, 22 nt, Human
uggggugagauucagauauuca

SEQ ID NO: 908898 - RNA, 22 nt, Human
agcaccuggagggcugggaccu

SEQ ID NO: 908899 - RNA, 22 nt, Human
uuauuaaaaugcggauuuggcu

SEQ ID NO: 908900 - RNA, 22 nt, Human
ccugggaaggggaagagaauuc

SEQ ID NO: 908901 - RNA, 22 nt, Human
acacaguaugcaucuagaaauu

SEQ ID NO: 908902 - RNA, 22 nt, Human
cuuuacacaaugauuuucuuua

SEQ ID NO: 908903 - RNA, 22 nt, Human
gugccugggguugagcuaugaa

SEQ ID NO: 908904 - RNA, 22 nt, Human
aagagacaagaauuccaacgcu

SEQ ID NO: 908905 - RNA, 22 nt, Human
uguaaacagccccauggagagc

SEQ ID NO: 908906 - RNA, 22 nt, Human
gccagggcugugcagguuuguu

SEQ ID NO: 908907 - RNA, 19 nt, Human
cugcagggaugugcagagu

SEQ ID NO: 908908 - RNA, 22 nt, Human
agucagugaaggcauugcucaa

SEQ ID NO: 908909 - RNA, 22 nt, Human
gcugggcuccacccucaacugu

SEQ ID NO: 908910 - RNA, 22 nt, Human
uccagcucuaacaugcugggcc

SEQ ID NO: 908911 - RNA, 22 nt, Human
gcagaggugcucaguggcagaa

SEQ ID NO: 908912 - RNA, 19 nt, Human
uccaggccauucccagagc

SEQ ID NO: 908913 - RNA, 22 nt, Human
aucacauauuuaagaaacaugu

SEQ ID NO: 908914 - RNA, 22 nt, Human
auuugcuuuuacuauguuaaaa

SEQ ID NO: 908915 - RNA, 22 nt, Human
ugagacagcagucagggaaaua

SEQ ID NO: 908916 - RNA, 16 nt, Human
acaguaaagcuggaca

SEQ ID NO: 908917 - RNA, 22 nt, Human
uguggcugcucaggugcagacc

SEQ ID NO: 908918 - RNA, 22 nt, Human
augacacugagaauaacaggua

SEQ ID NO: 908919 - RNA, 22 nt, Human
agcuccugugugcccaccugcu

SEQ ID NO: 908920 - RNA, 22 nt, Human
gggcugcaucagcaggacccgg

SEQ ID NO: 908921 - RNA, 19 nt, Human
aaggcagcaguagcaucca

SEQ ID NO: 908922 - RNA, 22 nt, Human
uucugcuccaccacuuccagca

SEQ ID NO: 908923 - RNA, 22 nt, Human
aagguccaugacucggcauagu

SEQ ID NO: 908924 - RNA, 22 nt, Human
cacaaaguuggacaacgcaccc

SEQ ID NO: 908925 - RNA, 22 nt, Human
ggaaacaugccugcuggacagu

SEQ ID NO: 908926 - RNA, 22 nt, Human
gcauuucaugccguggaagucc

SEQ ID NO: 908927 - RNA, 22 nt, Human
gaauuuaaggaccaagcauuuu

SEQ ID NO: 908928 - RNA, 22 nt, Human
aggaauugguucaagguuuauc

SEQ ID NO: 908929 - RNA, 22 nt, Human
uucuagaaccaugacuucaggg

SEQ ID NO: 908930 - RNA, 22 nt, Human
cuuagaauuuuaauccagaaag

SEQ ID NO: 908931 - RNA, 22 nt, Human
ugcuacaauucacaucuggaua

SEQ ID NO: 908932 - RNA, 22 nt, Human
cagaaacuauguaagaaaguga

SEQ ID NO: 908933 - RNA, 22 nt, Human
augcagggucuccgugugacga

SEQ ID NO: 908934 - RNA, 22 nt, Human
aggacagggauucaaacuccca

SEQ ID NO: 908935 - RNA, 22 nt, Human
ucagugucucauaugagguuuc

SEQ ID NO: 908936 - RNA, 22 nt, Human
uccuuuucccugaagguauuua

SEQ ID NO: 908937 - RNA, 22 nt, Human
gcccagcccagaaagguucgga

SEQ ID NO: 908938 - RNA, 22 nt, Human
gaggacagcuuagggcuuccug

SEQ ID NO: 908939 - RNA, 22 nt, Human
cuguuucucccaacgcccuagu

SEQ ID NO: 908940 - RNA, 22 nt, Human
agcugcuccuuggcugugguuc

SEQ ID NO: 908941 - RNA, 22 nt, Human
cagagcugggaucccaugggcg

SEQ ID NO: 908942 - RNA, 22 nt, Human
cugugggcucccagcuucucuc

SEQ ID NO: 908943 - RNA, 22 nt, Human
aaggaugauugguaaugacacu

SEQ ID NO: 908944 - RNA, 22 nt, Human
guauuauugucaugaaauaaua

SEQ ID NO: 908945 - RNA, 22 nt, Human
cuggagcagguuuaggaguccc

SEQ ID NO: 908946 - RNA, 22 nt, Human
cuggcuccucaguauuccacuu

SEQ ID NO: 908947 - RNA, 20 nt, Human
gccugagcuccgccuccugu

SEQ ID NO: 908948 - RNA, 22 nt, Human
uauguacaagcacacaugugac

SEQ ID NO: 908949 - RNA, 22 nt, Human
ucauuuacauagaaacaauaua

SEQ ID NO: 908950 - RNA, 20 nt, Human
aggcuucaaccauacaccuu

SEQ ID NO: 908951 - RNA, 22 nt, Human
gugccaggugcuaagcugugcu

SEQ ID NO: 908952 - RNA, 22 nt, Human
cccuuucauuggcagagcucuc

SEQ ID NO: 908953 - RNA, 22 nt, Human
aaacaacaugguggguguguag

SEQ ID NO: 908954 - RNA, 22 nt, Human
uuagaacaccauucuauauuac

SEQ ID NO: 908955 - RNA, 22 nt, Human
gagcucugcuuggguucuuagg

SEQ ID NO: 908956 - RNA, 22 nt, Human
gcccacagguccuaccucuuuc

SEQ ID NO: 908957 - RNA, 22 nt, Human
ugaggcucaaggucugguggag

SEQ ID NO: 908958 - RNA, 18 nt, Human
caauagaaacaguaggaa

SEQ ID NO: 908959 - RNA, 22 nt, Human
gcagacaauuuauuagcagauu

SEQ ID NO: 908960 - RNA, 22 nt, Human
ugcauauaucuuauuuuucugu

SEQ ID NO: 908961 - RNA, 22 nt, Human
uccauacauauccaaagagaag

SEQ ID NO: 908962 - RNA, 23 nt, Human
gcauugaacaaaagaggggagua

SEQ ID NO: 908963 - RNA, 22 nt, Human
ugcuucuuuacuauaggcaauu

SEQ ID NO: 908964 - RNA, 22 nt, Human
caucucuucauuagcauuauug

SEQ ID NO: 908965 - RNA, 22 nt, Human
uucccagaccuguaggaucaga

SEQ ID NO: 908966 - RNA, 21 nt, Human
acauuuucuguuuuaggaagu

SEQ ID NO: 908967 - RNA, 22 nt, Human
cccagagggaagggaaugaggu

SEQ ID NO: 908968 - RNA, 22 nt, Human
aaaucagaguagaauugagcca

SEQ ID NO: 908969 - RNA, 22 nt, Human
uuucuugucuuuaguaucuggc

SEQ ID NO: 908970 - RNA, 22 nt, Human
uugcuuuguuacugcaguuucc

SEQ ID NO: 908971 - RNA, 22 nt, Human
agcuggccuuagugagcaccug

SEQ ID NO: 908972 - RNA, 22 nt, Human
ucucuuccaguaagagucuuua

SEQ ID NO: 908973 - RNA, 22 nt, Human
agccagaggucaugagcacagg

SEQ ID NO: 908974 - RNA, 23 nt, Human
uggcagugcccagggagaugauc

SEQ ID NO: 908975 - RNA, 20 nt, Human
ucugccuuaugaccuucgcc

SEQ ID NO: 908976 - RNA, 21 nt, Human
uggcagaguugaguaguuaug

SEQ ID NO: 908977 - RNA, 20 nt, Human
gugcuggaguuaggaaaggu

SEQ ID NO: 908978 - RNA, 20 nt, Human
auguagaugaaagcaaaggc

SEQ ID NO: 908979 - RNA, 22 nt, Human
acacaugaaauaauauuaugca

SEQ ID NO: 908980 - RNA, 22 nt, Human
cagcaagaaaauucacaugcuc

SEQ ID NO: 908981 - RNA, 22 nt, Human
cugcaggggcaguccacuuccu

SEQ ID NO: 908982 - RNA, 22 nt, Human
uggaauguugcucugccuugcg

SEQ ID NO: 908983 - RNA, 22 nt, Human
agcuggggcugcagagaacagg

SEQ ID NO: 908984 - RNA, 22 nt, Human
uagucacaggaaguuucaaugu

SEQ ID NO: 908985 - RNA, 22 nt, Human
agagucagacuaagccauggug

SEQ ID NO: 908986 - RNA, 22 nt, Human
aaucuagaauuuuagggguaua

SEQ ID NO: 908987 - RNA, 22 nt, Human
guucaaauggcugcaguuacca

SEQ ID NO: 908988 - RNA, 22 nt, Human
cuucaguguugguucauuacga

SEQ ID NO: 908989 - RNA, 22 nt, Human
uagagcaguggguaccauggca

SEQ ID NO: 908990 - RNA, 23 nt, Human
uguuacaagcaccacagguggcu

SEQ ID NO: 908991 - RNA, 22 nt, Human
uuggcagcauacaguuggauug

SEQ ID NO: 908992 - RNA, 22 nt, Human
ucacaguuuuaagugugaucca

SEQ ID NO: 908993 - RNA, 22 nt, Human
aaagacuaaccaguugucaaaa

SEQ ID NO: 908994 - RNA, 22 nt, Human
cuggccgcaguguggaguugug

SEQ ID NO: 908995 - RNA, 22 nt, Human
ggcaagagggcagauggagugc

SEQ ID NO: 908996 - RNA, 22 nt, Human
cacaguaacuggcguguaguaa

SEQ ID NO: 908997 - RNA, 22 nt, Human
agucagaauucgaucccagguc

SEQ ID NO: 908998 - RNA, 22 nt, Human
acuucaugaacuaagggaucgg

SEQ ID NO: 908999 - RNA, 22 nt, Human
gucucugcucuagagucuguga

SEQ ID NO: 909000 - RNA, 22 nt, Human
uuaggaacuucugucucagugu

SEQ ID NO: 909001 - RNA, 22 nt, Human
caucagugucucucugguacuu

SEQ ID NO: 909002 - RNA, 22 nt, Human
ugaggggccagaccccaccuag

SEQ ID NO: 909003 - RNA, 22 nt, Human
aaggaagaugcuggccugggga

SEQ ID NO: 909004 - RNA, 19 nt, Human
ucagcucuggggucagugg

SEQ ID NO: 909005 - RNA, 22 nt, Human
cuuuaaauaauacaagguccag

SEQ ID NO: 909006 - RNA, 22 nt, Human
aggcuaggguaacagauguggc

SEQ ID NO: 909007 - RNA, 22 nt, Human
gcccugagacugaagaacuguc

SEQ ID NO: 909008 - RNA, 22 nt, Human
ccuggcagcuccguggccuucc

SEQ ID NO: 909009 - RNA, 22 nt, Human
ccagagccggcucccucagcuu

SEQ ID NO: 909010 - RNA, 22 nt, Human
cuggcacucauaggccaguuca

SEQ ID NO: 909011 - RNA, 22 nt, Human
ucuuugggagauguuauuuaua

SEQ ID NO: 909012 - RNA, 22 nt, Human
aaccuuugaggggagcucuuuc

SEQ ID NO: 909013 - RNA, 22 nt, Human
ggcugugauugguggaugugaa

SEQ ID NO: 909014 - RNA, 22 nt, Human
ugcccucugccuccucugcaga

SEQ ID NO: 909015 - RNA, 22 nt, Human
aagugaguggccuggagaggug

SEQ ID NO: 909016 - RNA, 18 nt, Human
aucuuguuuuuggauuaa

SEQ ID NO: 909017 - RNA, 22 nt, Human
uucccucuccuacucaggaaag

SEQ ID NO: 909018 - RNA, 22 nt, Human
uuuauuauucucuggagaaugu

SEQ ID NO: 909019 - RNA, 22 nt, Human
auagaacacagaugggcguggc

SEQ ID NO: 909020 - RNA, 22 nt, Human
ucaaugaaagagcaugcauuuu

SEQ ID NO: 909021 - RNA, 22 nt, Human
cugggggcaagcagacagcugu

SEQ ID NO: 909022 - RNA, 22 nt, Human
caguaacaggcucugugguaua

SEQ ID NO: 909023 - RNA, 22 nt, Human
auaugaaaagaagucaccauug

SEQ ID NO: 909024 - RNA, 22 nt, Human
aggcuggucuauacggagacga

SEQ ID NO: 909025 - RNA, 22 nt, Human
cacaggagguuaggaagugguc

SEQ ID NO: 909026 - RNA, 22 nt, Human
aagcaaggcaaccuauguccag

SEQ ID NO: 909027 - RNA, 22 nt, Human
uaaagacaaacccacuaggguu

SEQ ID NO: 909028 - RNA, 22 nt, Human
uccaggcacuauauauacuuuu

SEQ ID NO: 909029 - RNA, 20 nt, Human
guauauaaccauagugacua

SEQ ID NO: 909030 - RNA, 22 nt, Human
agcuucuuaaguuccugcagca

SEQ ID NO: 909031 - RNA, 22 nt, Human
ccucugagccugugugcggcac

SEQ ID NO: 909032 - RNA, 20 nt, Human
uagcugcacagcccuaggag

SEQ ID NO: 909033 - RNA, 22 nt, Human
uuuggaaugcccauggacuggu

SEQ ID NO: 909034 - RNA, 22 nt, Human
uaucacacuagccuauagugga

SEQ ID NO: 909035 - RNA, 20 nt, Human
gggugugugcagggccuggu

SEQ ID NO: 909036 - RNA, 20 nt, Human
uuucacuggcuugauaaggu

SEQ ID NO: 909037 - RNA, 22 nt, Human
ucuuagaauugaagucagaggg

SEQ ID NO: 909038 - RNA, 21 nt, Human
ugcuggaggacaggguuucau

SEQ ID NO: 909039 - RNA, 22 nt, Human
cuguacaggugaggagggggcu

SEQ ID NO: 909040 - RNA, 22 nt, Human
agcucccaggcagucaugagga

SEQ ID NO: 909041 - RNA, 22 nt, Human
gcugagggauagcugcucacug

SEQ ID NO: 909042 - RNA, 22 nt, Human
acuugucuaccaugaauauuua

SEQ ID NO: 909043 - RNA, 22 nt, Human
uaucuagaaacagaguuuuacu

SEQ ID NO: 909044 - RNA, 22 nt, Human
agagccuggucugagauaggac

SEQ ID NO: 909045 - RNA, 22 nt, Human
agcuaggacagguagagauggg

SEQ ID NO: 909046 - RNA, 22 nt, Human
ucaagaaaaugccugcuggugu

SEQ ID NO: 909047 - RNA, 22 nt, Human
gaggcugcccaacuggagugga

SEQ ID NO: 909048 - RNA, 22 nt, Human
gagcuguggaaggcagggacca

SEQ ID NO: 909049 - RNA, 22 nt, Human
uccauccauggauggaaaugug

SEQ ID NO: 909050 - RNA, 22 nt, Human
auacuacacauugacuauauuu

SEQ ID NO: 909051 - RNA, 22 nt, Human
acucagcuuccuacagcuagaa

SEQ ID NO: 909052 - RNA, 22 nt, Human
gagcagcucgagaaggaagcag

SEQ ID NO: 909053 - RNA, 22 nt, Human
uucaaagauaauuaccaaacau

SEQ ID NO: 909054 - RNA, 22 nt, Human
uucugugugcuuacugguguuc

SEQ ID NO: 909055 - RNA, 22 nt, Human
ggccugugguuucuaguagguu

SEQ ID NO: 909056 - RNA, 22 nt, Human
auuucuguugcuuauaaauuac

SEQ ID NO: 909057 - RNA, 22 nt, Human
ggguaauuggggccuugcagug

SEQ ID NO: 909058 - RNA, 22 nt, Human
uauuucuugagacucgucuucc

SEQ ID NO: 909059 - RNA, 21 nt, Human
gaguaacauuuccucuccaca

SEQ ID NO: 909060 - RNA, 22 nt, Human
cugcuguguggugaaacucagu

SEQ ID NO: 909061 - RNA, 22 nt, Human
gagaaccuacuguauacuauau

SEQ ID NO: 909062 - RNA, 22 nt, Human
uuguuacuguucuacauacagu

SEQ ID NO: 909063 - RNA, 22 nt, Human
uuguuucuccagucuaggaaaa

SEQ ID NO: 909064 - RNA, 22 nt, Human
ugcucuggguccugggccuccu

SEQ ID NO: 909065 - RNA, 22 nt, Human
guaguaaagcagguuuugcugu

SEQ ID NO: 909066 - RNA, 22 nt, Human
auaguucuggauguacuuauag

SEQ ID NO: 909067 - RNA, 22 nt, Human
aggcaggugagucaaaacagac

SEQ ID NO: 909068 - RNA, 23 nt, Human
uacagcaaggacaacauaggugg

SEQ ID NO: 909069 - RNA, 22 nt, Human
cagacucuugagcugauuguau

SEQ ID NO: 909070 - RNA, 22 nt, Human
auucuucacaccuguuccuguu

SEQ ID NO: 909071 - RNA, 22 nt, Human
ugcaaauugcgauuuuuauuag

SEQ ID NO: 909072 - RNA, 22 nt, Human
gaggggggcgcccugcagugca

SEQ ID NO: 909073 - RNA, 22 nt, Human
uuccuucuccagaacuucuagg

SEQ ID NO: 909074 - RNA, 22 nt, Human
cuggccauguugccucugagac

SEQ ID NO: 909075 - RNA, 22 nt, Human
uagagggcaggaguguccuacu

SEQ ID NO: 909076 - RNA, 22 nt, Human
aauauuucuguagcuauguucu

SEQ ID NO: 909077 - RNA, 22 nt, Human
augcucuacuuacggcuuucag

SEQ ID NO: 909078 - RNA, 22 nt, Human
caguuucucucaauaagcaucg

SEQ ID NO: 909079 - RNA, 22 nt, Human
augugugcauauucugccaccu

SEQ ID NO: 909080 - RNA, 22 nt, Human
ggucagcaauuuggacugggcu

SEQ ID NO: 909081 - RNA, 22 nt, Human
accuuuucaucugaaacuuuua

SEQ ID NO: 909082 - RNA, 22 nt, Human
cagcaacauauaugaaacugug

SEQ ID NO: 909083 - RNA, 22 nt, Human
guuuggauagugagagauacuu

SEQ ID NO: 909084 - RNA, 22 nt, Human
ucccucagggugcaguugcuuu

SEQ ID NO: 909085 - RNA, 22 nt, Human
aggaagcccaagucucaucuuc

SEQ ID NO: 909086 - RNA, 18 nt, Human
cuucagugacagucuggc

SEQ ID NO: 909087 - RNA, 22 nt, Human
aaggacugacaaaugucuuccu

SEQ ID NO: 909088 - RNA, 22 nt, Human
auacuuaugauaaauaauugcu

SEQ ID NO: 909089 - RNA, 22 nt, Human
aucauuugugcauaguaacaga

SEQ ID NO: 909090 - RNA, 22 nt, Human
gugcauauguaccugugaucau

SEQ ID NO: 909091 - RNA, 22 nt, Human
uuaaguguagugcuaagggcag

SEQ ID NO: 909092 - RNA, 21 nt, Human
gcucucagcugccugcugguu

SEQ ID NO: 909093 - RNA, 22 nt, Human
acagcagagugugagauagcca

SEQ ID NO: 909094 - RNA, 22 nt, Human
agguccuggugaccauggaguu

SEQ ID NO: 909095 - RNA, 22 nt, Human
cuuuuacacucaucugggaggg

SEQ ID NO: 909096 - RNA, 22 nt, Human
cucauagauuuagauagaucga

SEQ ID NO: 909097 - RNA, 22 nt, Human
uuugagaaugguaaguggaucg

SEQ ID NO: 909098 - RNA, 22 nt, Human
gacuuugguuugagcaagucag

SEQ ID NO: 909099 - RNA, 22 nt, Human
ggcaccaggcugggcauaggcc

SEQ ID NO: 909100 - RNA, 22 nt, Human
uuguugcauaaaguaggaaaua

SEQ ID NO: 909101 - RNA, 22 nt, Human
uaaacagccuccccuuucacuc

SEQ ID NO: 909102 - RNA, 23 nt, Human
auacaaaccuugcaggacauguu

SEQ ID NO: 909103 - RNA, 22 nt, Human
acccagggcucaagcguaggca

SEQ ID NO: 909104 - RNA, 22 nt, Human
agcagggccaacaguaaacacc

SEQ ID NO: 909105 - RNA, 23 nt, Human
acagaggcuuaaaugaguggcag

SEQ ID NO: 909106 - RNA, 22 nt, Human
guacaguggaggucuguguuca

SEQ ID NO: 909107 - RNA, 22 nt, Human
ugcucuggggcuccccaccaga

SEQ ID NO: 909108 - RNA, 22 nt, Human
aucauucagccuaagcaaguac

SEQ ID NO: 909109 - RNA, 22 nt, Human
aagugucuuaacuccuuuuggg

SEQ ID NO: 909110 - RNA, 22 nt, Human
cugugcauggccaucagugccc

SEQ ID NO: 909111 - RNA, 22 nt, Human
aaucuucagcacuccagagacu

SEQ ID NO: 909112 - RNA, 22 nt, Human
gcugccuggauuugcaauccuc

SEQ ID NO: 909113 - RNA, 22 nt, Human
agagcugggugaagugccauca

SEQ ID NO: 909114 - RNA, 22 nt, Human
gccccagcccuguggaccaugg

SEQ ID NO: 909115 - RNA, 22 nt, Human
ugucucugugacuccuuccgcc

SEQ ID NO: 909116 - RNA, 22 nt, Human
uaauccacaauagagauuaucu

SEQ ID NO: 909117 - RNA, 22 nt, Human
gcagggcagcucacugugguuc

SEQ ID NO: 909118 - RNA, 22 nt, Human
aaaugucugucucaugaggaaa

SEQ ID NO: 909119 - RNA, 22 nt, Human
gaaggaaaacagaucugccuga

SEQ ID NO: 909120 - RNA, 22 nt, Human
caagcaggaggagaaguuucug

SEQ ID NO: 909121 - RNA, 22 nt, Human
cugggagagaagcgaagcuggg

SEQ ID NO: 909122 - RNA, 22 nt, Human
gugcaugugucuuuauaguaga

SEQ ID NO: 909123 - RNA, 17 nt, Human
uguuucacuuggggaaa

SEQ ID NO: 909124 - RNA, 22 nt, Human
uagcagcauccuguggugaugg

SEQ ID NO: 909125 - RNA, 22 nt, Human
ggggaagaauggcagaaaacau

SEQ ID NO: 909126 - RNA, 22 nt, Human
uuaauacaagcauaugcacaca

SEQ ID NO: 909127 - RNA, 22 nt, Human
uggaagagaaaauccacccuua

SEQ ID NO: 909128 - RNA, 19 nt, Human
uccagcagugcuugaaauc

SEQ ID NO: 909129 - RNA, 22 nt, Human
gccagcucagaugcaggaagga

SEQ ID NO: 909130 - RNA, 22 nt, Human
aaguaaaauucaaucuucacug

SEQ ID NO: 909131 - RNA, 22 nt, Human
ugucaccuugcagggcuggggc

SEQ ID NO: 909132 - RNA, 20 nt, Human
uuuuccucguguuuguucua

SEQ ID NO: 909133 - RNA, 22 nt, Human
guuaacuuuuuacagaaaugaa

SEQ ID NO: 909134 - RNA, 23 nt, Human
uguaacuucuuaaauucuucacu

SEQ ID NO: 909135 - RNA, 22 nt, Human
cuggagcucuguguguuccuga

SEQ ID NO: 909136 - RNA, 18 nt, Human
augcagcaaucagaaaua

SEQ ID NO: 909137 - RNA, 22 nt, Human
uggagggcuaagcugagggaua

SEQ ID NO: 909138 - RNA, 22 nt, Human
uuucaguucauguauuccgagu

SEQ ID NO: 909139 - RNA, 22 nt, Human
acaggcauccaggacuaggccu

SEQ ID NO: 909140 - RNA, 22 nt, Human
acuugaaacccugagaugauaa

SEQ ID NO: 909141 - RNA, 22 nt, Human
ugccaggcuaaguggaggacuu

SEQ ID NO: 909142 - RNA, 22 nt, Human
cugucuggucaacaacugagug

SEQ ID NO: 909143 - RNA, 22 nt, Human
caugucaagcuuaucucugugg

SEQ ID NO: 909144 - RNA, 22 nt, Human
ugugaacuuuggaugguucuga

SEQ ID NO: 909145 - RNA, 22 nt, Human
ccaggcugcuguugguguccgc

SEQ ID NO: 909146 - RNA, 22 nt, Human
uaagauuauacuuaaagagaaa

SEQ ID NO: 909147 - RNA, 22 nt, Human
auacacacugcuauccuuuuuu

SEQ ID NO: 909148 - RNA, 22 nt, Human
guggaauuuuuaccuaugaaug

SEQ ID NO: 909149 - RNA, 22 nt, Human
cugggaaguggugagggccuga

SEQ ID NO: 909150 - RNA, 23 nt, Human
agcuccuguaagguggucgucac

SEQ ID NO: 909151 - RNA, 23 nt, Human
agcucuggcguuggggagguagu

SEQ ID NO: 909152 - RNA, 22 nt, Human
ugugaaauugaaugcccauugc

SEQ ID NO: 909153 - RNA, 22 nt, Human
uucuauaagacucauauuucuu

SEQ ID NO: 909154 - RNA, 22 nt, Human
ggacugaacacuuaaaugucca

SEQ ID NO: 909155 - RNA, 16 nt, Human
ccuggcccggcuuccu

SEQ ID NO: 909156 - RNA, 22 nt, Human
gggucaggaagaauucugccaa

SEQ ID NO: 909157 - RNA, 22 nt, Human
cugcccugcuugaugacagcga

SEQ ID NO: 909158 - RNA, 22 nt, Human
gcaggugauucacccugggccu

SEQ ID NO: 909159 - RNA, 22 nt, Human
ucuucacauuuuaagaaguucu

SEQ ID NO: 909160 - RNA, 22 nt, Human
gaaucccuugcaaguuguugua

SEQ ID NO: 909161 - RNA, 22 nt, Human
uuugaugaaccuauauaauuug

SEQ ID NO: 909162 - RNA, 22 nt, Human
acucagagaauaucuagaagga

SEQ ID NO: 909163 - RNA, 22 nt, Human
cagcaggaagguuuccccugca

SEQ ID NO: 909164 - RNA, 22 nt, Human
auggacaaauguaaggcauaau

SEQ ID NO: 909165 - RNA, 22 nt, Human
guuucucaguuuggucugcaga

SEQ ID NO: 909166 - RNA, 22 nt, Human
aaauagcuacaugaucucuagg

SEQ ID NO: 909167 - RNA, 22 nt, Human
ucauucuugaucacuaguuagu

SEQ ID NO: 909168 - RNA, 22 nt, Human
uuucaguuuuauaacuuuggcc

SEQ ID NO: 909169 - RNA, 23 nt, Human
ugggauggauucaccagugugcu

SEQ ID NO: 909170 - RNA, 22 nt, Human
agcacagagauuauuuacaaga

SEQ ID NO: 909171 - RNA, 22 nt, Human
ccugaggcccuggcugugcuga

SEQ ID NO: 909172 - RNA, 22 nt, Human
uguccugugucuaggggucuuc

SEQ ID NO: 909173 - RNA, 22 nt, Human
cucagagcucagcuuuguuagu

SEQ ID NO: 909174 - RNA, 22 nt, Human
auggccauagccuuauagcagg

SEQ ID NO: 909175 - RNA, 17 nt, Human
uguagcuucuccuucuc

SEQ ID NO: 909176 - RNA, 22 nt, Human
agcuuguuguuacugaugcauu

SEQ ID NO: 909177 - RNA, 22 nt, Human
caggaguucaagguugcaguga

SEQ ID NO: 909178 - RNA, 22 nt, Human
agaggggacagccaccugcccg

SEQ ID NO: 909179 - RNA, 22 nt, Human
cugccaggcacgugcagcauca

SEQ ID NO: 909180 - RNA, 22 nt, Human
cuguguguuuauaucauuuccu

SEQ ID NO: 909181 - RNA, 22 nt, Human
uaagcccaggaaugcacuucag

SEQ ID NO: 909182 - RNA, 22 nt, Human
cucaggagacaguguccacaug

SEQ ID NO: 909183 - RNA, 22 nt, Human
ucugugcucaaguucugccucu

SEQ ID NO: 909184 - RNA, 22 nt, Human
gaaccuuuuuccaaguaaacaa

SEQ ID NO: 909185 - RNA, 22 nt, Human
aucauuguaaauaaugcugcca

SEQ ID NO: 909186 - RNA, 22 nt, Human
agcugaagcaacaacaggaugg

SEQ ID NO: 909187 - RNA, 21 nt, Human
gagacagacuuucguccccug

SEQ ID NO: 909188 - RNA, 22 nt, Human
caggguagggcaagggaaccug

SEQ ID NO: 909189 - RNA, 22 nt, Human
cagguagcugcuggccauguac

SEQ ID NO: 909190 - RNA, 22 nt, Human
cucuuccauuucuacuucacag

SEQ ID NO: 909191 - RNA, 20 nt, Human
ugcacagggugggaagcaac

SEQ ID NO: 909192 - RNA, 22 nt, Human
ugaagacagaccaaggagaaug

SEQ ID NO: 909193 - RNA, 22 nt, Human
uuuucaugaggaaauacugccc

SEQ ID NO: 909194 - RNA, 22 nt, Human
caagcagggauacugcagggag

SEQ ID NO: 909195 - RNA, 22 nt, Human
aauuuacaguugcugaugguac

SEQ ID NO: 909196 - RNA, 22 nt, Human
agcaggagcccuuaucaccagg

SEQ ID NO: 909197 - RNA, 22 nt, Human
caucacagaaauaaacauaccu

SEQ ID NO: 909198 - RNA, 19 nt, Human
ucugagggagcacgaaggc

SEQ ID NO: 909199 - RNA, 22 nt, Human
cuugccugggacugaggcauuu

SEQ ID NO: 909200 - RNA, 22 nt, Human
auacauaauuacuuccgauguu

SEQ ID NO: 909201 - RNA, 22 nt, Human
uuaggaaucaccugcagaucuu

SEQ ID NO: 909202 - RNA, 22 nt, Human
agguggaguuaagugugaacug

SEQ ID NO: 909203 - RNA, 22 nt, Human
gagcugggauuugaaccuggga

SEQ ID NO: 909204 - RNA, 22 nt, Human
aaauguguuccuuugcuacaga

SEQ ID NO: 909205 - RNA, 22 nt, Human
auuucaaggcuacagaaaccuu

SEQ ID NO: 909206 - RNA, 22 nt, Human
caggguccggcugccuggcugu

SEQ ID NO: 909207 - RNA, 22 nt, Human
agcauuaauaagaaauggcucc

SEQ ID NO: 909208 - RNA, 22 nt, Human
cccagaggugacaucccauucu

SEQ ID NO: 909209 - RNA, 22 nt, Human
cuuuggaaggcagagcucugug

SEQ ID NO: 909210 - RNA, 22 nt, Human
gcaccugcuggguguagaggcu

SEQ ID NO: 909211 - RNA, 22 nt, Human
uucuucuuucccccugugguac

SEQ ID NO: 909212 - RNA, 22 nt, Human
uguuucaaagaaagaaaauaua

SEQ ID NO: 909213 - RNA, 22 nt, Human
cacagagauuagaauuagacua

SEQ ID NO: 909214 - RNA, 22 nt, Human
agggggguggaucaccugaggu

SEQ ID NO: 909215 - RNA, 22 nt, Human
auuucaugaauuccagaagcuu

SEQ ID NO: 909216 - RNA, 22 nt, Human
uagcaaauacaugauguaauuu

SEQ ID NO: 909217 - RNA, 20 nt, Human
aggaacuggaagggaggaaa

SEQ ID NO: 909218 - RNA, 22 nt, Human
uuucacaggccuuuuguagccc

SEQ ID NO: 909219 - RNA, 22 nt, Human
gcugcagagccuggagcccugg

SEQ ID NO: 909220 - RNA, 22 nt, Human
auuugcaugaccuuugcaagug

SEQ ID NO: 909221 - RNA, 22 nt, Human
ggcuccaggaaccuccucuccu

SEQ ID NO: 909222 - RNA, 20 nt, Human
ugccaggcacggagugcaug

SEQ ID NO: 909223 - RNA, 22 nt, Human
cucagaaguucagccuagagua

SEQ ID NO: 909224 - RNA, 22 nt, Human
ucuagagcuuuuuccucuugua

SEQ ID NO: 909225 - RNA, 22 nt, Human
uguaccaggugauggagucaua

SEQ ID NO: 909226 - RNA, 22 nt, Human
uuccuggucugugccauucaga

SEQ ID NO: 909227 - RNA, 22 nt, Human
auuaaaauuccaagguaugcca

SEQ ID NO: 909228 - RNA, 22 nt, Human
uaacauucuuaacuuagaaaca

SEQ ID NO: 909229 - RNA, 22 nt, Human
ugcugcacagauugccuuuuac

SEQ ID NO: 909230 - RNA, 22 nt, Human
uggcuuuauccaucaucgccaa

SEQ ID NO: 909231 - RNA, 22 nt, Human
uuuagcagcugguguuaccaua

SEQ ID NO: 909232 - RNA, 17 nt, Human
gcucuggcacaggauug

SEQ ID NO: 909233 - RNA, 22 nt, Human
cuggcuggccggaggcaucccu

SEQ ID NO: 909234 - RNA, 22 nt, Human
agcuccugcucuuugucccuaa

SEQ ID NO: 909235 - RNA, 22 nt, Human
cuggguaaaggcugcuuuucua

SEQ ID NO: 909236 - RNA, 22 nt, Human
uccuggggcucugagcgagaca

SEQ ID NO: 909237 - RNA, 22 nt, Human
cuugcugucuugcauuuagagc

SEQ ID NO: 909238 - RNA, 22 nt, Human
uuaacaaagcucuguuccuuuu

SEQ ID NO: 909239 - RNA, 22 nt, Human
uuccacauuccuuacauucaua

SEQ ID NO: 909240 - RNA, 22 nt, Human
ugagccaguggaagauggcagu

SEQ ID NO: 909241 - RNA, 23 nt, Human
uggaauguuucuuguacugaaug

SEQ ID NO: 909242 - RNA, 22 nt, Human
aaacugcacuuuauuuugucaa

SEQ ID NO: 909243 - RNA, 22 nt, Human
ugugaggauguuaaggggauga

SEQ ID NO: 909244 - RNA, 22 nt, Human
aaguucuuugccagacacgugu

SEQ ID NO: 909245 - RNA, 22 nt, Human
agcugcugguuuaagggauggg

SEQ ID NO: 909246 - RNA, 22 nt, Human
cuuucucuuacccaaggaucug

SEQ ID NO: 909247 - RNA, 22 nt, Human
ggagcacagccuugccaguacc

SEQ ID NO: 909248 - RNA, 22 nt, Human
cacaagauggucacauaagugc

SEQ ID NO: 909249 - RNA, 22 nt, Human
ggcagcacugcagcuuguuggg

SEQ ID NO: 909250 - RNA, 22 nt, Human
cuacccuuaaguuucugugggg

SEQ ID NO: 909251 - RNA, 22 nt, Human
uugacuuuucuuggucacauga

SEQ ID NO: 909252 - RNA, 22 nt, Human
gaggaaggauuuaguuugaggg

SEQ ID NO: 909253 - RNA, 22 nt, Human
auucuucacaaauauauagaag

SEQ ID NO: 909254 - RNA, 22 nt, Human
aguuacacaacuuaucacaucu

SEQ ID NO: 909255 - RNA, 22 nt, Human
guaaaauucuagcaucugaaag

SEQ ID NO: 909256 - RNA, 22 nt, Human
gcucuggcuacuguggcuaccg

SEQ ID NO: 909257 - RNA, 22 nt, Human
gcaaaacucgcaauuacuuuug

SEQ ID NO: 909258 - RNA, 22 nt, Human
ccucuucugagugagacucccu

SEQ ID NO: 909259 - RNA, 22 nt, Human
ccagaaaagcaucugguucuuu

SEQ ID NO: 909260 - RNA, 22 nt, Human
uucagaaaggauaauuggaagg

SEQ ID NO: 909261 - RNA, 22 nt, Human
accuagaauuuaaaacauugcu

SEQ ID NO: 909262 - RNA, 22 nt, Human
uguguggauucaucucaaagag

SEQ ID NO: 909263 - RNA, 22 nt, Human
cugcagagaugaagaagguggc

SEQ ID NO: 909264 - RNA, 22 nt, Human
cccaguuucaacuuuccagugg

SEQ ID NO: 909265 - RNA, 22 nt, Human
aucaacagagcaaagccugaac

SEQ ID NO: 909266 - RNA, 22 nt, Human
gccagucugcucccacaaguuc

SEQ ID NO: 909267 - RNA, 22 nt, Human
uugauuuuuccagcuucuagag

SEQ ID NO: 909268 - RNA, 23 nt, Human
ugcuggcuuuuaucuggucccua

SEQ ID NO: 909269 - RNA, 22 nt, Human
auggaaugcucccuggggacau

SEQ ID NO: 909270 - RNA, 22 nt, Human
ucuguucuuguccccacuucag

SEQ ID NO: 909271 - RNA, 22 nt, Human
agagcuuuucuguaauaacauc

SEQ ID NO: 909272 - RNA, 22 nt, Human
gcuuccuggaacaacuguugcu

SEQ ID NO: 909273 - RNA, 21 nt, Human
gccuucacucccagaguuugu

SEQ ID NO: 909274 - RNA, 18 nt, Human
agcuccaucugucagcau

SEQ ID NO: 909275 - RNA, 22 nt, Human
cagaaguaagauuacugugagu

SEQ ID NO: 909276 - RNA, 22 nt, Human
aggcuaauauuuaugaaaccaa

SEQ ID NO: 909277 - RNA, 22 nt, Human
cagcccugaguuagcccacgga

SEQ ID NO: 909278 - RNA, 22 nt, Human
aguuuccuuggauucaauuugg

SEQ ID NO: 909279 - RNA, 22 nt, Human
aaaagccaagguccucuucaga

SEQ ID NO: 909280 - RNA, 22 nt, Human
ucaucugaggcaccagagcaua

SEQ ID NO: 909281 - RNA, 22 nt, Human
ugcugucaguuggcaggaugag

SEQ ID NO: 909282 - RNA, 22 nt, Human
auucuaauggcagagacuccug

SEQ ID NO: 909283 - RNA, 22 nt, Human
cugugccagagggugaccaagg

SEQ ID NO: 909284 - RNA, 22 nt, Human
ucaaaugcaccucucauuuguu

SEQ ID NO: 909285 - RNA, 22 nt, Human
ggaaucuuugaaggauuuuaag

SEQ ID NO: 909286 - RNA, 22 nt, Human
uauuauccaaagagcugggagc

SEQ ID NO: 909287 - RNA, 20 nt, Human
auuucaguguuugcaauuuc

SEQ ID NO: 909288 - RNA, 22 nt, Human
cuugaaauccagauuucagagg

SEQ ID NO: 909289 - RNA, 21 nt, Human
ucuauaauaugcaggucauca

SEQ ID NO: 909290 - RNA, 22 nt, Human
uauccauuaggucuauggucaa

SEQ ID NO: 909291 - RNA, 21 nt, Human
cugcuguggcccccgacaugc

SEQ ID NO: 909292 - RNA, 22 nt, Human
acagcugugaaaauccacagga

SEQ ID NO: 909293 - RNA, 22 nt, Human
gcuuugcuggcuugaaaugcug

SEQ ID NO: 909294 - RNA, 22 nt, Human
gggcuagggccugcuaugguuu

SEQ ID NO: 909295 - RNA, 21 nt, Human
cacagaauauacauuuuaguu

SEQ ID NO: 909296 - RNA, 22 nt, Human
augcauauugucauuuaguccu

SEQ ID NO: 909297 - RNA, 22 nt, Human
aauuccacagaugucuaucugu

SEQ ID NO: 909298 - RNA, 22 nt, Human
agggucuaucucucugccuuug

SEQ ID NO: 909299 - RNA, 22 nt, Human
agaggggagagcuaagcaauuc

SEQ ID NO: 909300 - RNA, 19 nt, Human
ucuguggccuucccugaug

SEQ ID NO: 909301 - RNA, 22 nt, Human
ugccaaggagcuggaucagggc

SEQ ID NO: 909302 - RNA, 22 nt, Human
ugccagcuguucccacccaaaa

SEQ ID NO: 909303 - RNA, 22 nt, Human
ggaauguuuuccagaccuagau

SEQ ID NO: 909304 - RNA, 22 nt, Human
uccaggcaaagugcugggcugc

SEQ ID NO: 909305 - RNA, 23 nt, Human
agcuaaggaagcugaggcacagu

SEQ ID NO: 909306 - RNA, 22 nt, Human
uccuggucagugccaaacuggu

SEQ ID NO: 909307 - RNA, 22 nt, Human
ucuguuuuagauaagaaaggcu

SEQ ID NO: 909308 - RNA, 22 nt, Human
ggugugcuugggcuucgcaggg

SEQ ID NO: 909309 - RNA, 22 nt, Human
aaaaguaauugugguuuuugcc

SEQ ID NO: 909310 - RNA, 22 nt, Human
agacuacagaauggcauuguuu

SEQ ID NO: 909311 - RNA, 22 nt, Human
agcuguggaguaggggguugga

SEQ ID NO: 909312 - RNA, 22 nt, Human
cuggcugggguaccaguugaac

SEQ ID NO: 909313 - RNA, 21 nt, Human
auaauguacaaaaacugucuu

SEQ ID NO: 909314 - RNA, 22 nt, Human
uuuucaccauagacacuggucc

SEQ ID NO: 909315 - RNA, 19 nt, Human
ggauucugcaguuuucaca

SEQ ID NO: 909316 - RNA, 22 nt, Human
cuggaagguuccucccagcucc

SEQ ID NO: 909317 - RNA, 19 nt, Human
gggcagaauggcaucucag

SEQ ID NO: 909318 - RNA, 20 nt, Human
ccccacacuauugagcacuu

SEQ ID NO: 909319 - RNA, 22 nt, Human
uggagcaggucggcaccauuug

SEQ ID NO: 909320 - RNA, 22 nt, Human
ucuuugcaaaauacaacaaugg

SEQ ID NO: 909321 - RNA, 22 nt, Human
agcaccuguggcucaugcucgu

SEQ ID NO: 909322 - RNA, 22 nt, Human
gccagccugugggggcucugug

SEQ ID NO: 909323 - RNA, 22 nt, Human
ccugccaugguagacuuccagg

SEQ ID NO: 909324 - RNA, 22 nt, Human
caggcauggagaggcagagacu

SEQ ID NO: 909325 - RNA, 22 nt, Human
gggagggguugcauguuugagu

SEQ ID NO: 909326 - RNA, 22 nt, Human
agcugcagcacuccaguagccg

SEQ ID NO: 909327 - RNA, 22 nt, Human
gcuauucauggagcauguacug

SEQ ID NO: 909328 - RNA, 18 nt, Human
ucucugaauauuuuaugu

SEQ ID NO: 909329 - RNA, 22 nt, Human
aagauacacggucaacucucaa

SEQ ID NO: 909330 - RNA, 22 nt, Human
gcccugagcacugcugcugggg

SEQ ID NO: 909331 - RNA, 22 nt, Human
cacaggaccaauucacauucca

SEQ ID NO: 909332 - RNA, 16 nt, Human
cuuuuucuccccucuu

SEQ ID NO: 909333 - RNA, 22 nt, Human
gcaaagcaagcugucagccuca

SEQ ID NO: 909334 - RNA, 22 nt, Human
agcagcagcauugagcgcuugu

SEQ ID NO: 909335 - RNA, 22 nt, Human
gucaggaugcuauuguuauuaa

SEQ ID NO: 909336 - RNA, 22 nt, Human
ucagaggcuuccuuccucggag

SEQ ID NO: 909337 - RNA, 22 nt, Human
guuucauacagauuauucaugg

SEQ ID NO: 909338 - RNA, 22 nt, Human
ucucucuucaugcuuuuagaau

SEQ ID NO: 909339 - RNA, 22 nt, Human
agccacauuuuucugcuccuga

SEQ ID NO: 909340 - RNA, 22 nt, Human
ucaccccuggcccagucuugga

SEQ ID NO: 909341 - RNA, 22 nt, Human
aggcuaagaggccuucagauac

SEQ ID NO: 909342 - RNA, 18 nt, Human
auguggcuagugcaacug

SEQ ID NO: 909343 - RNA, 22 nt, Human
aucuacaaaaacugucucagga

SEQ ID NO: 909344 - RNA, 22 nt, Human
gagaggggcgcgcagcucgcga

SEQ ID NO: 909345 - RNA, 22 nt, Human
ggagccuguuaguugagugcuc

SEQ ID NO: 909346 - RNA, 22 nt, Human
uuugguuuuuaccugcugagag

SEQ ID NO: 909347 - RNA, 22 nt, Human
guccuucaagaguccccuacug

SEQ ID NO: 909348 - RNA, 22 nt, Human
ugccuggguccaggccaagccu

SEQ ID NO: 909349 - RNA, 23 nt, Human
cugugugugccgaggguggccac

SEQ ID NO: 909350 - RNA, 17 nt, Human
uuucaaagcagucagga

SEQ ID NO: 909351 - RNA, 22 nt, Human
aagagccauauaugcagcuaga

SEQ ID NO: 909352 - RNA, 22 nt, Human
ucucagaguuccucuggagucc

SEQ ID NO: 909353 - RNA, 22 nt, Human
cuguguccugcgucaagccaau

SEQ ID NO: 909354 - RNA, 22 nt, Human
uuacaauaccacaucaccucau

SEQ ID NO: 909355 - RNA, 22 nt, Human
ggggcuuuugcacgugggaggc

SEQ ID NO: 909356 - RNA, 22 nt, Human
cagguaggauggaagggcucaa

SEQ ID NO: 909357 - RNA, 18 nt, Human
cauguaugcaaauaagca

SEQ ID NO: 909358 - RNA, 22 nt, Human
gcaaauggagugaagagcugga

SEQ ID NO: 909359 - RNA, 22 nt, Human
aguggcaauugacaacaaagga

SEQ ID NO: 909360 - RNA, 22 nt, Human
ccagagucuaugaguccucauu

SEQ ID NO: 909361 - RNA, 22 nt, Human
auaagacacgcaaauagguacg

SEQ ID NO: 909362 - RNA, 22 nt, Human
ccuggcuucagcauugcccucu

SEQ ID NO: 909363 - RNA, 22 nt, Human
aguauuucugcucaugaaagag

SEQ ID NO: 909364 - RNA, 22 nt, Human
gcuggcaggagaccauacccua

SEQ ID NO: 909365 - RNA, 22 nt, Human
agcugcugugugcucaggcagg

SEQ ID NO: 909366 - RNA, 22 nt, Human
ucuuccaaaauuagucucaguu

SEQ ID NO: 909367 - RNA, 22 nt, Human
agcuagcaggaagcaguuuagu

SEQ ID NO: 909368 - RNA, 22 nt, Human
ucagccucagguguucagauuu

SEQ ID NO: 909369 - RNA, 22 nt, Human
ugauuuccucuacuagcaauua

SEQ ID NO: 909370 - RNA, 22 nt, Human
cugacagauuagaugugcauau

SEQ ID NO: 909371 - RNA, 19 nt, Human
aaccuuagcuucucaggcc

SEQ ID NO: 909372 - RNA, 22 nt, Human
aauacagaggaaacauuuaaua

SEQ ID NO: 909373 - RNA, 22 nt, Human
uacaaaggacagcagaaaaaua

SEQ ID NO: 909374 - RNA, 18 nt, Human
cucugggagaggcauaca

SEQ ID NO: 909375 - RNA, 22 nt, Human
uauuuauucuuuguacugccuu

SEQ ID NO: 909376 - RNA, 19 nt, Human
gcuggggccugaccagaca

SEQ ID NO: 909377 - RNA, 22 nt, Human
acuuuaguaaacuuauguuacu

SEQ ID NO: 909378 - RNA, 22 nt, Human
ucucuagcuuccuuaggaacac

SEQ ID NO: 909379 - RNA, 22 nt, Human
agauucaugggaaagcuuuagg

SEQ ID NO: 909380 - RNA, 22 nt, Human
ucugggcucugucagcaccucu

SEQ ID NO: 909381 - RNA, 22 nt, Human
aaacacugugucaaacuggggc

SEQ ID NO: 909382 - RNA, 22 nt, Human
caugcaaagcguuuugaccagc

SEQ ID NO: 909383 - RNA, 22 nt, Human
aaguugauuaaucuuucgagaa

SEQ ID NO: 909384 - RNA, 22 nt, Human
gguguggggagguucugcuucu

SEQ ID NO: 909385 - RNA, 23 nt, Human
aacuaccacaacucuugagaugc

SEQ ID NO: 909386 - RNA, 22 nt, Human
auguuuaaaggguugagaaaua

SEQ ID NO: 909387 - RNA, 22 nt, Human
cucaggagcuuccucagcccau

SEQ ID NO: 909388 - RNA, 22 nt, Human
cuuucagagguuacucaggaaa

SEQ ID NO: 909389 - RNA, 22 nt, Human
gguauggagucugaguuucuag

SEQ ID NO: 909390 - RNA, 22 nt, Human
ucuguccauuuggaguuggaag

SEQ ID NO: 909391 - RNA, 22 nt, Human
cuguuugucucucuccugaccc

SEQ ID NO: 909392 - RNA, 22 nt, Human
uuuuuguagucauuagaagagg

SEQ ID NO: 909393 - RNA, 22 nt, Human
uaguuuuuaaguguacaauuuc

SEQ ID NO: 909394 - RNA, 22 nt, Human
ucacagugcacagcaggcgugg

SEQ ID NO: 909395 - RNA, 17 nt, Human
agugaaauuuacauugc

SEQ ID NO: 909396 - RNA, 22 nt, Human
agcaucugcauauugggagacc

SEQ ID NO: 909397 - RNA, 22 nt, Human
ggagaaggguauguguggcgga

SEQ ID NO: 909398 - RNA, 22 nt, Human
guguggccaauuaugggcauuc

SEQ ID NO: 909399 - RNA, 23 nt, Human
gcugauaaugcauucuguuuaau

SEQ ID NO: 909400 - RNA, 22 nt, Human
ucuggucccugugucaccucuc

SEQ ID NO: 909401 - RNA, 22 nt, Human
ugcaauuuuaauacauuagagg

SEQ ID NO: 909402 - RNA, 22 nt, Human
acuuguucauugaguacauaug

SEQ ID NO: 909403 - RNA, 22 nt, Human
auggacagagcugagcuccacc

SEQ ID NO: 909404 - RNA, 22 nt, Human
gacaccagcaaggcugugagga

SEQ ID NO: 909405 - RNA, 22 nt, Human
ugaggccugcuuggaauugaau

SEQ ID NO: 909406 - RNA, 22 nt, Human
auuccagagaaaggccuggcug

SEQ ID NO: 909407 - RNA, 22 nt, Human
gcuagcuuuauaaugcugggcg

SEQ ID NO: 909408 - RNA, 22 nt, Human
ucacaugccuuuuacucugcac

SEQ ID NO: 909409 - RNA, 22 nt, Human
cugucacagcccgcgucuccuc

SEQ ID NO: 909410 - RNA, 22 nt, Human
aggcggcuucugaggaggcugc

SEQ ID NO: 909411 - RNA, 22 nt, Human
ggcaggagggcggacaaugacc

SEQ ID NO: 909412 - RNA, 22 nt, Human
gcucucuguuauuaagaucuuu

SEQ ID NO: 909413 - RNA, 22 nt, Human
aacaaagaugggugggaaagag

SEQ ID NO: 909414 - RNA, 22 nt, Human
uacacauuucucuuagagacac

SEQ ID NO: 909415 - RNA, 22 nt, Human
ucugugugcccuaaagccugcu

SEQ ID NO: 909416 - RNA, 22 nt, Human
ucacaggacccugaggguggcg

SEQ ID NO: 909417 - RNA, 22 nt, Human
uugugcaagaagccagcaccaa

SEQ ID NO: 909418 - RNA, 21 nt, Human
acugaacuuguguucuagagg

SEQ ID NO: 909419 - RNA, 22 nt, Human
ucuggcagaaggcagaaauuca

SEQ ID NO: 909420 - RNA, 22 nt, Human
auucugggcaagccuucuuaua

SEQ ID NO: 909421 - RNA, 22 nt, Human
agugaagaggaaguggggcaca

SEQ ID NO: 909422 - RNA, 22 nt, Human
gcucaaagcauaagacaucuaa

SEQ ID NO: 909423 - RNA, 22 nt, Human
uuggcuuuuaugcagcuuaggu

SEQ ID NO: 909424 - RNA, 22 nt, Human
uucuaguuaauguagcaucuug

SEQ ID NO: 909425 - RNA, 23 nt, Human
gggaccugguaggaggugauugg

SEQ ID NO: 909426 - RNA, 22 nt, Human
aaagggaggggcgauaagccgg

SEQ ID NO: 909427 - RNA, 22 nt, Human
guuuggcaauauuuguggaaca

SEQ ID NO: 909428 - RNA, 22 nt, Human
uuguuaaagaugcagauuccau

SEQ ID NO: 909429 - RNA, 23 nt, Human
uccaaauaccugucaccuugucu

SEQ ID NO: 909430 - RNA, 22 nt, Human
uggccagauucaugcauguauc

SEQ ID NO: 909431 - RNA, 22 nt, Human
uuccuguggccuuacaucugug

SEQ ID NO: 909432 - RNA, 22 nt, Human
gguggcagagacauaggacaua

SEQ ID NO: 909433 - RNA, 22 nt, Human
uugcaucagaaaauaugggaag

SEQ ID NO: 909434 - RNA, 22 nt, Human
uagaaauguugguauuaacauu

SEQ ID NO: 909435 - RNA, 22 nt, Human
acucugugugaguagagccugu

SEQ ID NO: 909436 - RNA, 22 nt, Human
aaacaugauauugaggcugggc

SEQ ID NO: 909437 - RNA, 22 nt, Human
ggcuggccucaggguccucgcu

SEQ ID NO: 909438 - RNA, 22 nt, Human
uucucugcauuguaaagagcca

SEQ ID NO: 909439 - RNA, 22 nt, Human
ggcuggcaggcacaguaugcaa

SEQ ID NO: 909440 - RNA, 22 nt, Human
aggccacaggaguacugucggu

SEQ ID NO: 909441 - RNA, 22 nt, Human
agauaaauuccuaagauuucag

SEQ ID NO: 909442 - RNA, 19 nt, Human
agugaacacaaagagaagg

SEQ ID NO: 909443 - RNA, 22 nt, Human
aaagaucacgucccaggacucg

SEQ ID NO: 909444 - RNA, 20 nt, Human
cccugugauuggcaaguguc

SEQ ID NO: 909445 - RNA, 22 nt, Human
uagaaacagagcagguggccca

SEQ ID NO: 909446 - RNA, 17 nt, Human
agcagcuggcacaggag

SEQ ID NO: 909447 - RNA, 22 nt, Human
uaaaugacauucuuaagucuug

SEQ ID NO: 909448 - RNA, 22 nt, Human
uggauuugcuaccuucugauau

SEQ ID NO: 909449 - RNA, 22 nt, Human
cagcccagugcauuuguguacu

SEQ ID NO: 909450 - RNA, 22 nt, Human
ugacaucauuaguaacauagcu

SEQ ID NO: 909451 - RNA, 22 nt, Human
gccagcugccaaguugugagau

SEQ ID NO: 909452 - RNA, 22 nt, Human
aaacaugaugucauauaugcca

SEQ ID NO: 909453 - RNA, 22 nt, Human
gucuauguguaauagcaugugu

SEQ ID NO: 909454 - RNA, 22 nt, Human
uauuugcaacauaaaacucuga

SEQ ID NO: 909455 - RNA, 22 nt, Human
cagcaucucauuugacuucugc

SEQ ID NO: 909456 - RNA, 14 nt, Human
caggaagacucagc

SEQ ID NO: 909457 - RNA, 22 nt, Human
ugucauuuugucucacugcuau

SEQ ID NO: 909458 - RNA, 17 nt, Human
ucaaaguauucugaugc

SEQ ID NO: 909459 - RNA, 22 nt, Human
ccucacagaggggcagccaucu

SEQ ID NO: 909460 - RNA, 22 nt, Human
aggucacacuuggaucauagaa

SEQ ID NO: 909461 - RNA, 22 nt, Human
ggcagggucuggacugaaagcu

SEQ ID NO: 909462 - RNA, 22 nt, Human
gcuguagguuuuuccaggaguu

SEQ ID NO: 909463 - RNA, 22 nt, Human
uuggcccagcaugcgggucugu

SEQ ID NO: 909464 - RNA, 22 nt, Human
cuggaaugagcagggcuuaugg

SEQ ID NO: 909465 - RNA, 22 nt, Human
agggccagggaaacgaucagca

SEQ ID NO: 909466 - RNA, 22 nt, Human
agggccaguggguugaaaggca

SEQ ID NO: 909467 - RNA, 22 nt, Human
uagcauuuggcaccaguuauuu

SEQ ID NO: 909468 - RNA, 17 nt, Human
uuaguguaucuguuuug

SEQ ID NO: 909469 - RNA, 22 nt, Human
gacagguugaaguaucaaaggu

SEQ ID NO: 909470 - RNA, 22 nt, Human
guugagaguuaagcgggcuaau

SEQ ID NO: 909471 - RNA, 20 nt, Human
cagaugcuggaucuuggucc

SEQ ID NO: 909472 - RNA, 19 nt, Human
uuugaaagaguuuuauugg

SEQ ID NO: 909473 - RNA, 22 nt, Human
uuucaaaccacugagguucuga

SEQ ID NO: 909474 - RNA, 21 nt, Human
auauuuuuguuuggacuguca

SEQ ID NO: 909475 - RNA, 22 nt, Human
gcuucuauccuaccaugucuug

SEQ ID NO: 909476 - RNA, 21 nt, Human
gcugcaucaaucuacccaggg

SEQ ID NO: 909477 - RNA, 19 nt, Human
ucaggaaguugaugaggug

SEQ ID NO: 909478 - RNA, 22 nt, Human
cagcugccugucuggaggcaau

SEQ ID NO: 909479 - RNA, 22 nt, Human
ggucuccaaagcuuaggacuac

SEQ ID NO: 909480 - RNA, 22 nt, Human
agcacauuaguaucuaagaaca

SEQ ID NO: 909481 - RNA, 22 nt, Human
uucugugugcugucuuggcuuu

SEQ ID NO: 909482 - RNA, 22 nt, Human
uguguuggcuugccuguuaggc

SEQ ID NO: 909483 - RNA, 22 nt, Human
gugcaucagaguguccuagaca

SEQ ID NO: 909484 - RNA, 22 nt, Human
ccugggauuugcgccagaccuu

SEQ ID NO: 909485 - RNA, 22 nt, Human
cugugccuucuacuucacucua

SEQ ID NO: 909486 - RNA, 22 nt, Human
uuguauuaauugaaaugaaugc

SEQ ID NO: 909487 - RNA, 22 nt, Human
ggcucccugccuguccucaguc

SEQ ID NO: 909488 - RNA, 21 nt, Human
cagagguggccugaccucuga

SEQ ID NO: 909489 - RNA, 22 nt, Human
ucauuauaaacauaugcuaaag

SEQ ID NO: 909490 - RNA, 22 nt, Human
uucuuuuaauguucugaaguuu

SEQ ID NO: 909491 - RNA, 22 nt, Human
ggcucugcccagguggacagca

SEQ ID NO: 909492 - RNA, 22 nt, Human
gcucuugucagagaggccagcu

SEQ ID NO: 909493 - RNA, 22 nt, Human
gcucagagauggggaaugaaaa

SEQ ID NO: 909494 - RNA, 22 nt, Human
uggugaggccaaagccaugaca

SEQ ID NO: 909495 - RNA, 22 nt, Human
gcaagcaagcagguagagcuga

SEQ ID NO: 909496 - RNA, 22 nt, Human
gucaagcagaagauaauuuaaa

SEQ ID NO: 909497 - RNA, 22 nt, Human
acauugauacugagauacaaag

SEQ ID NO: 909498 - RNA, 22 nt, Human
aggcucugggaagcagugaguu

SEQ ID NO: 909499 - RNA, 23 nt, Human
acacuucacccauugugauagga

SEQ ID NO: 909500 - RNA, 22 nt, Human
agauugaauauagagauucuug

SEQ ID NO: 909501 - RNA, 22 nt, Human
uguucacaaggugaugcuuuga

SEQ ID NO: 909502 - RNA, 22 nt, Human
aggcucuguuugcugugguacc

SEQ ID NO: 909503 - RNA, 22 nt, Human
acucucucacacacgccuauau

SEQ ID NO: 909504 - RNA, 22 nt, Human
uuuauauuguaaaaaugguucu

SEQ ID NO: 909505 - RNA, 22 nt, Human
ucaaauaccagcaauuucaugu

SEQ ID NO: 909506 - RNA, 22 nt, Human
acaggcaguugagguuugugug

SEQ ID NO: 909507 - RNA, 22 nt, Human
aaagagacaccaaagacucuag

SEQ ID NO: 909508 - RNA, 22 nt, Human
ccugugugguagccagcggugc

SEQ ID NO: 909509 - RNA, 22 nt, Human
ugaacucuccaggcaaaugauc

SEQ ID NO: 909510 - RNA, 22 nt, Human
auucauguuuucuugcuucaag

SEQ ID NO: 909511 - RNA, 22 nt, Human
aggcagaugguaacugugauau

SEQ ID NO: 909512 - RNA, 22 nt, Human
cugggccugugggcacacggac

SEQ ID NO: 909513 - RNA, 20 nt, Human
ucugugcauugccugcuggu

SEQ ID NO: 909514 - RNA, 22 nt, Human
aggcucaucugagcagaaaccu

SEQ ID NO: 909515 - RNA, 18 nt, Human
uaagucauuugaaaugcc

SEQ ID NO: 909516 - RNA, 17 nt, Human
aggcugcugggccaggg

SEQ ID NO: 909517 - RNA, 22 nt, Human
acagcagcuggguucccaccau

SEQ ID NO: 909518 - RNA, 22 nt, Human
ugagccuggagcccagauguuu

SEQ ID NO: 909519 - RNA, 20 nt, Human
ugagccaggcuaggaagggc

SEQ ID NO: 909520 - RNA, 22 nt, Human
agaagaguaguaacagaaauua

SEQ ID NO: 909521 - RNA, 22 nt, Human
ccaggcucaggugcgagagaca

SEQ ID NO: 909522 - RNA, 22 nt, Human
uccuaacuaauuuguagcaaaa

SEQ ID NO: 909523 - RNA, 22 nt, Human
aaugucaaaugagaggggagaa

SEQ ID NO: 909524 - RNA, 20 nt, Human
uucgcugggaguggccaggc

SEQ ID NO: 909525 - RNA, 22 nt, Human
aggccacaagaaaaugcuucau

SEQ ID NO: 909526 - RNA, 22 nt, Human
cugugcccuguggcuggcaccu

SEQ ID NO: 909527 - RNA, 22 nt, Human
acagugaauccaaauuccuacc

SEQ ID NO: 909528 - RNA, 22 nt, Human
gggugggguguaucggauccua

SEQ ID NO: 909529 - RNA, 22 nt, Human
gaaauacaguugggaggaggua

SEQ ID NO: 909530 - RNA, 22 nt, Human
auguuauuuauugaaacacuuu

SEQ ID NO: 909531 - RNA, 22 nt, Human
acagggcagagggcaguuggua

SEQ ID NO: 909532 - RNA, 22 nt, Human
uaugacaagguggaguaugagu

SEQ ID NO: 909533 - RNA, 22 nt, Human
ccugcugucugcuguguuaagc

SEQ ID NO: 909534 - RNA, 19 nt, Human
cugucugguucauguguuc

SEQ ID NO: 909535 - RNA, 22 nt, Human
cggcuucaaagggagcgagauc

SEQ ID NO: 909536 - RNA, 22 nt, Human
acauuaaacuugcuuggcugua

SEQ ID NO: 909537 - RNA, 20 nt, Human
uuccuggcucuaggaccuug

SEQ ID NO: 909538 - RNA, 22 nt, Human
acacauuuauuacaugcaugug

SEQ ID NO: 909539 - RNA, 22 nt, Human
ccagcaggguugguuucuucug

SEQ ID NO: 909540 - RNA, 22 nt, Human
cagugcccaagaugugccaugc

SEQ ID NO: 909541 - RNA, 22 nt, Human
cuuuguauucauccguaauaau

SEQ ID NO: 909542 - RNA, 22 nt, Human
uaaguccaccucauucuucagc

SEQ ID NO: 909543 - RNA, 22 nt, Human
gugggcagacagugcuuugcag

SEQ ID NO: 909544 - RNA, 22 nt, Human
uaauuucacaguucaacgcaca

SEQ ID NO: 909545 - RNA, 21 nt, Human
cagugcugccuaauagggagu

SEQ ID NO: 909546 - RNA, 22 nt, Human
gggaggugauuaggaccaugua

SEQ ID NO: 909547 - RNA, 22 nt, Human
aagauggaguaguguaaugguu

SEQ ID NO: 909548 - RNA, 19 nt, Human
agcagagcaaaguggcuga

SEQ ID NO: 909549 - RNA, 22 nt, Human
caugaaauauuaguaacuguuu

SEQ ID NO: 909550 - RNA, 22 nt, Human
uuuguacacugucuacuaugaa

SEQ ID NO: 909551 - RNA, 22 nt, Human
auucagugcuguaauacgcuaa

SEQ ID NO: 909552 - RNA, 22 nt, Human
uuauuuggauuuagcuuaucaa

SEQ ID NO: 909553 - RNA, 22 nt, Human
ggcagggcaggaaagucaggaa

SEQ ID NO: 909554 - RNA, 22 nt, Human
caagcccaggauuccccaguua

SEQ ID NO: 909555 - RNA, 22 nt, Human
aagaauacguaucaacaauggu

SEQ ID NO: 909556 - RNA, 22 nt, Human
uuuaccaagcuuuaauuacaua

SEQ ID NO: 909557 - RNA, 22 nt, Human
guucacaguguuuucuuugcau

SEQ ID NO: 909558 - RNA, 22 nt, Human
uuugauuuacuauaagcagcac

SEQ ID NO: 909559 - RNA, 23 nt, Human
acugucugauauguuuuccauca

SEQ ID NO: 909560 - RNA, 22 nt, Human
agcagcaaaguauugggcaaga

SEQ ID NO: 909561 - RNA, 22 nt, Human
agcagcugcagggagggucugc

SEQ ID NO: 909562 - RNA, 22 nt, Human
cauggaaugugaguuguuuagu

SEQ ID NO: 909563 - RNA, 22 nt, Human
cuucagggugacgcaggcugca

SEQ ID NO: 909564 - RNA, 22 nt, Human
aucuacaggauuuuacagaguu

SEQ ID NO: 909565 - RNA, 22 nt, Human
aggcagucagcccugcuagggu

SEQ ID NO: 909566 - RNA, 19 nt, Human
auuguacauugaguuuggc

SEQ ID NO: 909567 - RNA, 22 nt, Human
gagggaagaggccugacauuuu

SEQ ID NO: 909568 - RNA, 22 nt, Human
uucaacuuuggagauuuaauaa

SEQ ID NO: 909569 - RNA, 22 nt, Human
aguuuggacaaaagacuccuua

SEQ ID NO: 909570 - RNA, 22 nt, Human
gcuuugcacagugcuguguuaa

SEQ ID NO: 909571 - RNA, 23 nt, Human
augcaggguuacagggcugacuu

SEQ ID NO: 909572 - RNA, 22 nt, Human
aucuggaagccagauacucagu

SEQ ID NO: 909573 - RNA, 22 nt, Human
aauuguacauaaaccauuuggc

SEQ ID NO: 909574 - RNA, 22 nt, Human
uacaaugauuagcuaacuugcc

SEQ ID NO: 909575 - RNA, 22 nt, Human
uuuguacacaggauguuauaau

SEQ ID NO: 909576 - RNA, 22 nt, Human
ucgcuugaacccaggaagugga

SEQ ID NO: 909577 - RNA, 22 nt, Human
ugcugcuuccugguagauagga

SEQ ID NO: 909578 - RNA, 22 nt, Human
gaggaagggcugccugccgggc

SEQ ID NO: 909579 - RNA, 22 nt, Human
uccaggcagggcagccaucaag

SEQ ID NO: 909580 - RNA, 23 nt, Human
ccugggcauuggcugcagcuucu

SEQ ID NO: 909581 - RNA, 22 nt, Human
cugagccaaccacagcaggagc

SEQ ID NO: 909582 - RNA, 22 nt, Human
uggaaugugaacauacaaggua

SEQ ID NO: 909583 - RNA, 22 nt, Human
uugagacuccugguguagaaua

SEQ ID NO: 909584 - RNA, 22 nt, Human
ggcugccuagacuuggaauuuc

SEQ ID NO: 909585 - RNA, 22 nt, Human
aaagucuuguuacguuccauug

SEQ ID NO: 909586 - RNA, 22 nt, Human
ucagaaguuucaaucccagcug

SEQ ID NO: 909587 - RNA, 22 nt, Human
aaucagcuaaauaaacuaguca

SEQ ID NO: 909588 - RNA, 22 nt, Human
uagggacuaguuucaaggcuaa

SEQ ID NO: 909589 - RNA, 22 nt, Human
gugugagagaagcugccaugga

SEQ ID NO: 909590 - RNA, 22 nt, Human
auuguguuugaaugaggcucca

SEQ ID NO: 909591 - RNA, 22 nt, Human
agcagcuccccucaugcuccac

SEQ ID NO: 909592 - RNA, 22 nt, Human
uuguuuugcuaaagggucauca

SEQ ID NO: 909593 - RNA, 19 nt, Human
ggucaggaauuugacaaua

SEQ ID NO: 909594 - RNA, 22 nt, Human
ugccugugugaccacgggcaag

SEQ ID NO: 909595 - RNA, 22 nt, Human
gaaggugucagcaagucaaagc

SEQ ID NO: 909596 - RNA, 22 nt, Human
auucugaguggaaacuaucaau

SEQ ID NO: 909597 - RNA, 22 nt, Human
ugguaaaugcuccaagcaguac

SEQ ID NO: 909598 - RNA, 22 nt, Human
uguggugguaaugagccagaug

SEQ ID NO: 909599 - RNA, 23 nt, Human
aaacuucaguagugucaucagcc

SEQ ID NO: 909600 - RNA, 22 nt, Human
ugcagggcagcuagggagcuuu

SEQ ID NO: 909601 - RNA, 22 nt, Human
ugcagaagaauguaggcauaag

SEQ ID NO: 909602 - RNA, 22 nt, Human
uaccugaaccaagcccagcucu

SEQ ID NO: 909603 - RNA, 22 nt, Human
cagagcagagugauuguucugg

SEQ ID NO: 909604 - RNA, 22 nt, Human
cagggccucauccucagagauu

SEQ ID NO: 909605 - RNA, 19 nt, Human
guacaagaaugacugagca

SEQ ID NO: 909606 - RNA, 22 nt, Human
agagagcucuggcugggugacc

SEQ ID NO: 909607 - RNA, 22 nt, Human
acaaaugucuacauugagaaua

SEQ ID NO: 909608 - RNA, 19 nt, Human
aggucuaaucauaagacaa

SEQ ID NO: 909609 - RNA, 22 nt, Human
ggugagcacugcccugggucuc

SEQ ID NO: 909610 - RNA, 22 nt, Human
ucugagccccuagaacugagcg

SEQ ID NO: 909611 - RNA, 22 nt, Human
ucucaccauggugcuugcuuau

SEQ ID NO: 909612 - RNA, 22 nt, Human
aaagaaauagauggcauuuaaa

SEQ ID NO: 909613 - RNA, 22 nt, Human
uuguaaacuggauagaccuauu

SEQ ID NO: 909614 - RNA, 22 nt, Human
gcugugcccagccauucuagau

SEQ ID NO: 909615 - RNA, 22 nt, Human
ccaggcaauguucuaagugauu

SEQ ID NO: 909616 - RNA, 22 nt, Human
aacuauguuaauaaguuucauu

SEQ ID NO: 909617 - RNA, 19 nt, Human
auacagagcuuccuaauuu

SEQ ID NO: 909618 - RNA, 22 nt, Human
ccauggccgccgcugcucagga

SEQ ID NO: 909619 - RNA, 22 nt, Human
agagcugaggauccagcugagc

SEQ ID NO: 909620 - RNA, 22 nt, Human
accagugaguauuuguaacaga

SEQ ID NO: 909621 - RNA, 22 nt, Human
ugucuucaucuccaugcacaga

SEQ ID NO: 909622 - RNA, 22 nt, Human
acagcuucuccucgaugucaug

SEQ ID NO: 909623 - RNA, 22 nt, Human
cugccaggccucaucccagcca

SEQ ID NO: 909624 - RNA, 19 nt, Human
uuccugugcugcugugucc

SEQ ID NO: 909625 - RNA, 22 nt, Human
ucucagggcuuuucuuuugaau

SEQ ID NO: 909626 - RNA, 19 nt, Human
aggagccuugagcagugag

SEQ ID NO: 909627 - RNA, 22 nt, Human
ugcacaucuuucagcaucauac

SEQ ID NO: 909628 - RNA, 20 nt, Human
ucagagcugcaggagagaaa

SEQ ID NO: 909629 - RNA, 22 nt, Human
gagcugagggucuaggaggguu

SEQ ID NO: 909630 - RNA, 22 nt, Human
agcagcagugacagccgaaagc

SEQ ID NO: 909631 - RNA, 22 nt, Human
aagcugaaauuccuccugaaau

SEQ ID NO: 909632 - RNA, 22 nt, Human
uauuucugucagccagauaugg

SEQ ID NO: 909633 - RNA, 22 nt, Human
cuguagcuccagccugucuaca

SEQ ID NO: 909634 - RNA, 21 nt, Human
caucacauuacucaaaguccu

SEQ ID NO: 909635 - RNA, 22 nt, Human
aacuugguaaauugugucagau

SEQ ID NO: 909636 - RNA, 22 nt, Human
uauuggaugaagaaaggaagga

SEQ ID NO: 909637 - RNA, 19 nt, Human
auccuggguccuccagcug

SEQ ID NO: 909638 - RNA, 22 nt, Human
gcugaagucugagaauuugcaa

SEQ ID NO: 909639 - RNA, 22 nt, Human
uuuccuugggucucuuaguggc

SEQ ID NO: 909640 - RNA, 22 nt, Human
cacuggugacuucugagcugga

SEQ ID NO: 909641 - RNA, 22 nt, Human
agugacuuggcaugaugagaag

SEQ ID NO: 909642 - RNA, 22 nt, Human
caggaaauggcugaauaaauuc

SEQ ID NO: 909643 - RNA, 22 nt, Human
uuccccuuauaagucuggcuuc

SEQ ID NO: 909644 - RNA, 22 nt, Human
uauuucugggaguucagaaauu

SEQ ID NO: 909645 - RNA, 22 nt, Human
gcuggcuguguuucaucucuga

SEQ ID NO: 909646 - RNA, 20 nt, Human
uuucagauuuacagaaaugu

SEQ ID NO: 909647 - RNA, 20 nt, Human
ucuggccccuuccuguccug

SEQ ID NO: 909648 - RNA, 22 nt, Human
ugagaacugaggauuugaauuc

SEQ ID NO: 909649 - RNA, 22 nt, Human
uuguuuuaguagguacacugag

SEQ ID NO: 909650 - RNA, 22 nt, Human
agggugaaucucacaacucuua

SEQ ID NO: 909651 - RNA, 22 nt, Human
cuuuagaauuucauguuugguc

SEQ ID NO: 909652 - RNA, 22 nt, Human
ccagggccaguaagauuggcau

SEQ ID NO: 909653 - RNA, 22 nt, Human
ugaauacuauuucauaaugugg

SEQ ID NO: 909654 - RNA, 22 nt, Human
ccaaggccccuguggucuagcc

SEQ ID NO: 909655 - RNA, 23 nt, Human
agacucugagagugugcuuugca

SEQ ID NO: 909656 - RNA, 22 nt, Human
ggcgagggagcagugcgguggg

SEQ ID NO: 909657 - RNA, 22 nt, Human
ccacagugaguucuguacucug

SEQ ID NO: 909658 - RNA, 22 nt, Human
aggccuggguguucaccagaag

SEQ ID NO: 909659 - RNA, 22 nt, Human
cuguguccucccgcugcaccca

SEQ ID NO: 909660 - RNA, 22 nt, Human
caugucaagaaagagauuugaa

SEQ ID NO: 909661 - RNA, 22 nt, Human
ugcuuuauggagcccaucucau

SEQ ID NO: 909662 - RNA, 22 nt, Human
uccuagaauaaguaacaggaca

SEQ ID NO: 909663 - RNA, 22 nt, Human
auguggcugccaccugccugaa

SEQ ID NO: 909664 - RNA, 22 nt, Human
uucacaaugccagcaaccacuu

SEQ ID NO: 909665 - RNA, 22 nt, Human
ucuauacaugugcacacacauc

SEQ ID NO: 909666 - RNA, 22 nt, Human
aguggcuguacuauuuuuucau

SEQ ID NO: 909667 - RNA, 22 nt, Human
gcuccuggcaggcagugugugu

SEQ ID NO: 909668 - RNA, 22 nt, Human
gaagcacauggcuauagcuauu

SEQ ID NO: 909669 - RNA, 22 nt, Human
gcuggcugcgucaucacagggc

SEQ ID NO: 909670 - RNA, 22 nt, Human
ggccagcugccaccagcccuau

SEQ ID NO: 909671 - RNA, 22 nt, Human
aaggaagaggcagguuuugcug

SEQ ID NO: 909672 - RNA, 22 nt, Human
aguacauuuaguuuaugaacau

SEQ ID NO: 909673 - RNA, 17 nt, Human
uccuucagggccucaca

SEQ ID NO: 909674 - RNA, 22 nt, Human
ucacugcuauauuggauacuga

SEQ ID NO: 909675 - RNA, 22 nt, Human
ugaacaaaugaaucaguguagc

SEQ ID NO: 909676 - RNA, 22 nt, Human
ugugacagaucucuauacauga

SEQ ID NO: 909677 - RNA, 23 nt, Human
uacuacagggucuugcuaugaau

SEQ ID NO: 909678 - RNA, 22 nt, Human
gaaaguauuuaaguccauauuu

SEQ ID NO: 909679 - RNA, 22 nt, Human
uucucuccuacccaguauccau

SEQ ID NO: 909680 - RNA, 22 nt, Human
gccaggcagccacccucugcga

SEQ ID NO: 909681 - RNA, 22 nt, Human
aaacauucacauuugcuaguaa

SEQ ID NO: 909682 - RNA, 22 nt, Human
aaugaaauguagcuuauccaua

SEQ ID NO: 909683 - RNA, 19 nt, Human
cuuuagacacaccuggaca

SEQ ID NO: 909684 - RNA, 22 nt, Human
uuucuucuaugugugauauuuu

SEQ ID NO: 909685 - RNA, 22 nt, Human
aauguuuucauuauccuaacug

SEQ ID NO: 909686 - RNA, 22 nt, Human
gaggggcuggguagggcaaccc

SEQ ID NO: 909687 - RNA, 22 nt, Human
cugccguccaucuacgucucag

SEQ ID NO: 909688 - RNA, 22 nt, Human
aaaagagaaaguggcaggcuuu

SEQ ID NO: 909689 - RNA, 22 nt, Human
gacaauaagaacagauacugug

SEQ ID NO: 909690 - RNA, 22 nt, Human
uccauuuucucuuccggaggug

SEQ ID NO: 909691 - RNA, 23 nt, Human
ugaacaaaggcaggagaaggcgg

SEQ ID NO: 909692 - RNA, 22 nt, Human
caggcacaggggaaugucuuuu

SEQ ID NO: 909693 - RNA, 22 nt, Human
aaucaagagcugacuauauuuu

SEQ ID NO: 909694 - RNA, 22 nt, Human
uccuggcccggccgggccugcu

SEQ ID NO: 909695 - RNA, 22 nt, Human
uccagggcgugugugaaggaaa

SEQ ID NO: 909696 - RNA, 22 nt, Human
uccugggcuugcuccuccagcu

SEQ ID NO: 909697 - RNA, 22 nt, Human
ccauuuaacacagaguuuucca

SEQ ID NO: 909698 - RNA, 22 nt, Human
aagagguuauuguucccagcuu

SEQ ID NO: 909699 - RNA, 20 nt, Human
gaaucuuacuacauucucuc

SEQ ID NO: 909700 - RNA, 22 nt, Human
agugcagcaugcuggggaggcu

SEQ ID NO: 909701 - RNA, 22 nt, Human
ugacaggugauugugaacuaag

SEQ ID NO: 909702 - RNA, 23 nt, Human
aggaaagcauucauuuuuaccau

SEQ ID NO: 909703 - RNA, 22 nt, Human
ccccacucucggccagauaggc

SEQ ID NO: 909704 - RNA, 23 nt, Human
ugcuggcuuccagcugcucccuc

SEQ ID NO: 909705 - RNA, 22 nt, Human
ccagcucuaaacggcucugugg

SEQ ID NO: 909706 - RNA, 22 nt, Human
ucgcucaggcuugaguguagug

SEQ ID NO: 909707 - RNA, 22 nt, Human
ugcacacacucguguauaugag

SEQ ID NO: 909708 - RNA, 19 nt, Human
ccuggcugcugugggaugc

SEQ ID NO: 909709 - RNA, 22 nt, Human
ucuggaaugaaugagguucugu

SEQ ID NO: 909710 - RNA, 22 nt, Human
ugccaggccaaugaaggcaggg

SEQ ID NO: 909711 - RNA, 22 nt, Human
gcauuagacccaagguauuuug

SEQ ID NO: 909712 - RNA, 22 nt, Human
caugccagguuugaguaucuug

SEQ ID NO: 909713 - RNA, 22 nt, Human
auuguucuggauauuuacauug

SEQ ID NO: 909714 - RNA, 22 nt, Human
cccagggcccuggacagcuaca

SEQ ID NO: 909715 - RNA, 22 nt, Human
uggaagaaggcagagaggcauu

SEQ ID NO: 909716 - RNA, 19 nt, Human
ggcaggcuggauagagagg

SEQ ID NO: 909717 - RNA, 22 nt, Human
guacacauacuauucaaagaga

SEQ ID NO: 909718 - RNA, 22 nt, Human
acauguauugacauuauauucu

SEQ ID NO: 909719 - RNA, 21 nt, Human
agaugaggauacugaggccua

SEQ ID NO: 909720 - RNA, 22 nt, Human
agaaaugucaggaaagaagucc

SEQ ID NO: 909721 - RNA, 22 nt, Human
ggcucuggugaggguaggagau

SEQ ID NO: 909722 - RNA, 22 nt, Human
uguuuguccccaucccucagca

SEQ ID NO: 909723 - RNA, 22 nt, Human
acacuuaaucuuacugaggauc

SEQ ID NO: 909724 - RNA, 22 nt, Human
caauuucuuguuaauucucagg

SEQ ID NO: 909725 - RNA, 22 nt, Human
uggcagcagacaucugaggucu

SEQ ID NO: 909726 - RNA, 22 nt, Human
ucuccagggcccccgagcguug

SEQ ID NO: 909727 - RNA, 22 nt, Human
uggagcugaacuuugaggccag

SEQ ID NO: 909728 - RNA, 22 nt, Human
gagagucuaggaaccucauaua

SEQ ID NO: 909729 - RNA, 22 nt, Human
ggacccugcguguauccacacu

SEQ ID NO: 909730 - RNA, 19 nt, Human
agucuguggauuugugggu

SEQ ID NO: 909731 - RNA, 17 nt, Human
agagagagcaugccacc

SEQ ID NO: 909732 - RNA, 22 nt, Human
ugucaguguuuuaugugcccuu

SEQ ID NO: 909733 - RNA, 20 nt, Human
ucucuggguucucacucagc

SEQ ID NO: 909734 - RNA, 22 nt, Human
cagaggcuuauaccugauuagg

SEQ ID NO: 909735 - RNA, 22 nt, Human
uguuauugauaucuaaugcucu

SEQ ID NO: 909736 - RNA, 17 nt, Human
gcuggcugacccaugcc

SEQ ID NO: 909737 - RNA, 22 nt, Human
ucaggagguugaccacggggca

SEQ ID NO: 909738 - RNA, 22 nt, Human
uugcaaagagucauguaaguca

SEQ ID NO: 909739 - RNA, 22 nt, Human
aggauggcuugcaggaggcugu

SEQ ID NO: 909740 - RNA, 22 nt, Human
ggcucugaggcagaucgauggg

SEQ ID NO: 909741 - RNA, 22 nt, Human
ucagaggagccaaaguucugag

SEQ ID NO: 909742 - RNA, 22 nt, Human
auguuuauguugggcuauauuu

SEQ ID NO: 909743 - RNA, 22 nt, Human
caaggccuccugggcccagaga

SEQ ID NO: 909744 - RNA, 21 nt, Human
cucuggaggcaagggagagug

SEQ ID NO: 909745 - RNA, 22 nt, Human
acucugaguuccuacuugcucc

SEQ ID NO: 909746 - RNA, 22 nt, Human
ucugauaucgcacuaaacucug

SEQ ID NO: 909747 - RNA, 22 nt, Human
ccaggggaaacagggagcacuc

SEQ ID NO: 909748 - RNA, 22 nt, Human
uggagcuggaagaauguagacg

SEQ ID NO: 909749 - RNA, 22 nt, Human
aagcagugaugcauacagcugu

SEQ ID NO: 909750 - RNA, 22 nt, Human
ggccaggaagggaagaucagca

SEQ ID NO: 909751 - RNA, 22 nt, Human
gaagucuuuucuuccacccaaa

SEQ ID NO: 909752 - RNA, 22 nt, Human
uuucaaacauaucuucauuacu

SEQ ID NO: 909753 - RNA, 22 nt, Human
auugaaaaaugacuauugcuua

SEQ ID NO: 909754 - RNA, 22 nt, Human
gcuccaggugucccagguaaaa

SEQ ID NO: 909755 - RNA, 17 nt, Human
uggcuucagauguacau

SEQ ID NO: 909756 - RNA, 22 nt, Human
aggucaagguucacaggggauc

SEQ ID NO: 909757 - RNA, 22 nt, Human
gagcucuguacacagagggugu

SEQ ID NO: 909758 - RNA, 22 nt, Human
gcuggaguuagaacuagccugg

SEQ ID NO: 909759 - RNA, 22 nt, Human
aacagaaaucauuuagggcucu

SEQ ID NO: 909760 - RNA, 22 nt, Human
ccucugcucugguccaugugcu

SEQ ID NO: 909761 - RNA, 22 nt, Human
caagcugcuuauucucugcucu

SEQ ID NO: 909762 - RNA, 22 nt, Human
ggcugagaaggagugggugagg

SEQ ID NO: 909763 - RNA, 22 nt, Human
uaaagcaagacacacccauagc

SEQ ID NO: 909764 - RNA, 22 nt, Human
ugagcagaacacgggauccaug

SEQ ID NO: 909765 - RNA, 22 nt, Human
aaucauaauuguauacauucau

SEQ ID NO: 909766 - RNA, 22 nt, Human
uuguaacaggcacucugugcca

SEQ ID NO: 909767 - RNA, 22 nt, Human
uuagaacuuaaacuucagaaag

SEQ ID NO: 909768 - RNA, 22 nt, Human
cacaucucagggcuacaggcag

SEQ ID NO: 909769 - RNA, 22 nt, Human
ucagaacagaagaaggaacacg

SEQ ID NO: 909770 - RNA, 22 nt, Human
uaggaaugagaaagaauuagau

SEQ ID NO: 909771 - RNA, 22 nt, Human
acauuaaauuucauagugauua

SEQ ID NO: 909772 - RNA, 22 nt, Human
ggagggggaaacuuuggcugcc

SEQ ID NO: 909773 - RNA, 22 nt, Human
gaagauacaaaugugggcuuuc

SEQ ID NO: 909774 - RNA, 22 nt, Human
gcucuugucaaaaauuaguuga

SEQ ID NO: 909775 - RNA, 22 nt, Human
augcaacagagaaaauauugag

SEQ ID NO: 909776 - RNA, 22 nt, Human
uugcugagagcgugucaacaag

SEQ ID NO: 909777 - RNA, 22 nt, Human
agaggccuaaccaagauguccu

SEQ ID NO: 909778 - RNA, 22 nt, Human
accuagaauccaucugcuuauu

SEQ ID NO: 909779 - RNA, 22 nt, Human
cuggcuggagcuguuguaggcu

SEQ ID NO: 909780 - RNA, 22 nt, Human
ucugccuguucaagucuucuag

SEQ ID NO: 909781 - RNA, 22 nt, Human
aaauuacagccuuggguagcuu

SEQ ID NO: 909782 - RNA, 22 nt, Human
uacauaugaguucguucuaugc

SEQ ID NO: 909783 - RNA, 22 nt, Human
ggcaggaagcauuaaaacgauu

SEQ ID NO: 909784 - RNA, 22 nt, Human
ucagaauauauucauguuguca

SEQ ID NO: 909785 - RNA, 22 nt, Human
aguaaaauuguauuggaaaaca

SEQ ID NO: 909786 - RNA, 22 nt, Human
uuugacaugcaaagcacuuuag

SEQ ID NO: 909787 - RNA, 22 nt, Human
cagcagcugcaaauggaaacag

SEQ ID NO: 909788 - RNA, 22 nt, Human
uggagcagcaucacuuugagcu

SEQ ID NO: 909789 - RNA, 22 nt, Human
auuuagagugaaacauuaugca

SEQ ID NO: 909790 - RNA, 22 nt, Human
uuccaagaguaaauucaaauug

SEQ ID NO: 909791 - RNA, 22 nt, Human
aaaacaguuuuugcuaacugcu

SEQ ID NO: 909792 - RNA, 22 nt, Human
aaagagcuucauuuccauuuau

SEQ ID NO: 909793 - RNA, 22 nt, Human
gccaucuucaacaucagaaguu

SEQ ID NO: 909794 - RNA, 22 nt, Human
guacauaagaaauuacuacaga

SEQ ID NO: 909795 - RNA, 18 nt, Human
uccugguauugcaagcac

SEQ ID NO: 909796 - RNA, 22 nt, Human
ggaaaaaugacacauaucucaa

SEQ ID NO: 909797 - RNA, 22 nt, Human
ugaguccaggugcuuaccugga

SEQ ID NO: 909798 - RNA, 22 nt, Human
uggagcaugagagucuuuagcu

SEQ ID NO: 909799 - RNA, 22 nt, Human
gugugcguuccuaguaaacgug

SEQ ID NO: 909800 - RNA, 22 nt, Human
uuuucaguuuuccagguagccg

SEQ ID NO: 909801 - RNA, 22 nt, Human
gcuggcucgggaagcaggggau

SEQ ID NO: 909802 - RNA, 22 nt, Human
auguuuauuuugcagaguaggg

SEQ ID NO: 909803 - RNA, 22 nt, Human
agacagugugaguucagggugg

SEQ ID NO: 909804 - RNA, 22 nt, Human
agaguuuuauggcuuuaauucu

SEQ ID NO: 909805 - RNA, 22 nt, Human
auacuauauuaccuucucaacu

SEQ ID NO: 909806 - RNA, 22 nt, Human
cacaugcauuggcaaaagugua

SEQ ID NO: 909807 - RNA, 22 nt, Human
aaucacaugugcucaauuuuaa

SEQ ID NO: 909808 - RNA, 22 nt, Human
uguggggguacacguacacaug

SEQ ID NO: 909809 - RNA, 22 nt, Human
ggucugugcucuggagccucug

SEQ ID NO: 909810 - RNA, 22 nt, Human
cugggcucuguguuucaguuuc

SEQ ID NO: 909811 - RNA, 22 nt, Human
uggcccagcugcagauggugga

SEQ ID NO: 909812 - RNA, 19 nt, Human
ugacagagagcaggguggu

SEQ ID NO: 909813 - RNA, 22 nt, Human
caacagugauucugcaugagga

SEQ ID NO: 909814 - RNA, 22 nt, Human
gucacaauuauaggaacucaga

SEQ ID NO: 909815 - RNA, 22 nt, Human
guguccuuauuucugucucuca

SEQ ID NO: 909816 - RNA, 22 nt, Human
uuguguggauaauauuacuuga

SEQ ID NO: 909817 - RNA, 22 nt, Human
uccagggccaagucauggaacc

SEQ ID NO: 909818 - RNA, 22 nt, Human
ccccagagaaagucagcagcau

SEQ ID NO: 909819 - RNA, 23 nt, Human
cucuggguccgauguccugacag

SEQ ID NO: 909820 - RNA, 22 nt, Human
ucugacagucucuucuuuagcu

SEQ ID NO: 909821 - RNA, 22 nt, Human
ucucccaguccucugugcuuac

SEQ ID NO: 909822 - RNA, 22 nt, Human
ugacccuuagugaacauuagaa

SEQ ID NO: 909823 - RNA, 22 nt, Human
gaaagugccagaauaggaggcc

SEQ ID NO: 909824 - RNA, 22 nt, Human
caucaaaguugauauccaauua

SEQ ID NO: 909825 - RNA, 19 nt, Human
gccaggcuccauagccggc

SEQ ID NO: 909826 - RNA, 22 nt, Human
aucuucaaagaauuucuugucc

SEQ ID NO: 909827 - RNA, 22 nt, Human
agcugagcugcagaugacugua

SEQ ID NO: 909828 - RNA, 21 nt, Human
agcuggcuauaguuagugaug

SEQ ID NO: 909829 - RNA, 22 nt, Human
aacacagcuaauuucugucaau

SEQ ID NO: 909830 - RNA, 22 nt, Human
cagagccagcccacuguucccg

SEQ ID NO: 909831 - RNA, 22 nt, Human
acuguaaagaaguaaguauggg

SEQ ID NO: 909832 - RNA, 22 nt, Human
gaggagcugucaccgugacuca

SEQ ID NO: 909833 - RNA, 22 nt, Human
uuucagaggaaaucucauugag

SEQ ID NO: 909834 - RNA, 22 nt, Human
uauguguggcagcugggagugu

SEQ ID NO: 909835 - RNA, 22 nt, Human
cagaggugcauacaggucauua

SEQ ID NO: 909836 - RNA, 22 nt, Human
agagugaaguuuuugaaaguga

SEQ ID NO: 909837 - RNA, 21 nt, Human
agcggcagacccugcauuuga

SEQ ID NO: 909838 - RNA, 22 nt, Human
auguggcuaguggcuaugaucu

SEQ ID NO: 909839 - RNA, 22 nt, Human
gacccuuucugagugagcaguu

SEQ ID NO: 909840 - RNA, 22 nt, Human
uuguuucuccuggugccugaua

SEQ ID NO: 909841 - RNA, 22 nt, Human
ggaaaagacagguuaacuguga

SEQ ID NO: 909842 - RNA, 22 nt, Human
uggcagcucuguucaacaugag

SEQ ID NO: 909843 - RNA, 19 nt, Human
ucaguuuuagucaucaguu

SEQ ID NO: 909844 - RNA, 22 nt, Human
guuuccauggaagcaaaggugg

SEQ ID NO: 909845 - RNA, 22 nt, Human
uuuauucaagaugagguucaug

SEQ ID NO: 909846 - RNA, 22 nt, Human
ucacacuaggauguuguuucua

SEQ ID NO: 909847 - RNA, 22 nt, Human
ugaagccacuuuccagaaucac

SEQ ID NO: 909848 - RNA, 19 nt, Human
ccaggccucuggggccugu

SEQ ID NO: 909849 - RNA, 22 nt, Human
accccagcucugagccacacca

SEQ ID NO: 909850 - RNA, 21 nt, Human
uuugacagcucagagggcauu

SEQ ID NO: 909851 - RNA, 22 nt, Human
aaaugcauuucacuaauguuuc

SEQ ID NO: 909852 - RNA, 22 nt, Human
gaggagggagaauuaggcuuaa

SEQ ID NO: 909853 - RNA, 22 nt, Human
gagcuggcaagucuguccuugg

SEQ ID NO: 909854 - RNA, 22 nt, Human
aaguauucuacaaagaaauuga

SEQ ID NO: 909855 - RNA, 22 nt, Human
uaguacaguacugggcucuagu

SEQ ID NO: 909856 - RNA, 22 nt, Human
ucuucacauggagaagcaacuc

SEQ ID NO: 909857 - RNA, 22 nt, Human
acaaagucacaauaauuaaccu

SEQ ID NO: 909858 - RNA, 22 nt, Human
uuugcacuagcauuuguccaug

SEQ ID NO: 909859 - RNA, 22 nt, Human
ucugggcuuuguaaugggaggu

SEQ ID NO: 909860 - RNA, 22 nt, Human
gcuuuacugagaugacacaggg

SEQ ID NO: 909861 - RNA, 23 nt, Human
ucugaggaugaaggauagcaagu

SEQ ID NO: 909862 - RNA, 22 nt, Human
gagagcaggaggcagcgggacg

SEQ ID NO: 909863 - RNA, 20 nt, Human
ucccucaguccuggcuuugu

SEQ ID NO: 909864 - RNA, 22 nt, Human
uggugcaagucucugaggaggg

SEQ ID NO: 909865 - RNA, 22 nt, Human
gcagaugguggggcaggaaaau

SEQ ID NO: 909866 - RNA, 22 nt, Human
aaugccaaugggcagaacuaga

SEQ ID NO: 909867 - RNA, 22 nt, Human
gaauucuuugaucuuaaucuug

SEQ ID NO: 909868 - RNA, 22 nt, Human
acuaugauguauuuugcaucua

SEQ ID NO: 909869 - RNA, 22 nt, Human
ccagggcaaaugagaucauagc

SEQ ID NO: 909870 - RNA, 22 nt, Human
acuuucaugcucugagcacugg

SEQ ID NO: 909871 - RNA, 22 nt, Human
cauacuuuugcccugacauucu

SEQ ID NO: 909872 - RNA, 22 nt, Human
gcacuucacaugccuuuuccug

SEQ ID NO: 909873 - RNA, 22 nt, Human
ggcucugggccuccaaggucug

SEQ ID NO: 909874 - RNA, 22 nt, Human
cuggucccagcagagcucugag

SEQ ID NO: 909875 - RNA, 22 nt, Human
uuggaauugugaacuaagugau

SEQ ID NO: 909876 - RNA, 22 nt, Human
ugcuggaaagugaggugaauga

SEQ ID NO: 909877 - RNA, 22 nt, Human
acccagagcagagcuuggcuuc

SEQ ID NO: 909878 - RNA, 22 nt, Human
ccauggccugaaggagugcauc

SEQ ID NO: 909879 - RNA, 22 nt, Human
ucucugagccccugccucuuuc

SEQ ID NO: 909880 - RNA, 22 nt, Human
cuauuuauguccaaguguuuua

SEQ ID NO: 909881 - RNA, 22 nt, Human
gcagggcuccccaggcccgagg

SEQ ID NO: 909882 - RNA, 22 nt, Human
uuccucagggcggaugggcagg

SEQ ID NO: 909883 - RNA, 22 nt, Human
caaugucuaguuucccaaaucc

SEQ ID NO: 909884 - RNA, 22 nt, Human
uacagaaaaacaucuggagccg

SEQ ID NO: 909885 - RNA, 22 nt, Human
gcucccuguucucagccaugau

SEQ ID NO: 909886 - RNA, 22 nt, Human
gcugggucccaagccuggggag

SEQ ID NO: 909887 - RNA, 22 nt, Human
acaaguggguccuacauaaagc

SEQ ID NO: 909888 - RNA, 23 nt, Human
uaacuuacaucauucugcacaag

SEQ ID NO: 909889 - RNA, 22 nt, Human
cuacagaaguuucccuugcuua

SEQ ID NO: 909890 - RNA, 22 nt, Human
uagauuuaagacccugaauuug

SEQ ID NO: 909891 - RNA, 22 nt, Human
ugccaggcccugcgggguccca

SEQ ID NO: 909892 - RNA, 22 nt, Human
aacaaugugaagugcuguucag

SEQ ID NO: 909893 - RNA, 22 nt, Human
aagaauguuaguuucugauaca

SEQ ID NO: 909894 - RNA, 22 nt, Human
aucugaaauagucuuaucugag

SEQ ID NO: 909895 - RNA, 22 nt, Human
agcaaugacuggcuauaugauu

SEQ ID NO: 909896 - RNA, 22 nt, Human
gcagggcuguucaggagggugg

SEQ ID NO: 909897 - RNA, 21 nt, Human
uacauugacuacaaauaaagc

SEQ ID NO: 909898 - RNA, 22 nt, Human
auguaagagucuaagauuguag

SEQ ID NO: 909899 - RNA, 22 nt, Human
gcauggcauuaacaagauggaa

SEQ ID NO: 909900 - RNA, 22 nt, Human
uaaaucacaucgaaaucugggu

SEQ ID NO: 909901 - RNA, 22 nt, Human
agguggcaaggggcgccucucu

SEQ ID NO: 909902 - RNA, 22 nt, Human
uuuauuuggcaucucugccaag

SEQ ID NO: 909903 - RNA, 22 nt, Human
guaggaagcucugaggcuaguu

SEQ ID NO: 909904 - RNA, 20 nt, Human
acacaaagcaauggaguaca

SEQ ID NO: 909905 - RNA, 22 nt, Human
aaauugucagaauucagaaagu

SEQ ID NO: 909906 - RNA, 22 nt, Human
cagcaagacuucagggcuuggu

SEQ ID NO: 909907 - RNA, 22 nt, Human
gucuccagagguuacauccugu

SEQ ID NO: 909908 - RNA, 22 nt, Human
ugcuggagcaacauuauugugc

SEQ ID NO: 909909 - RNA, 22 nt, Human
gccccagaaaguucaaggcaca

SEQ ID NO: 909910 - RNA, 22 nt, Human
acacuacagggagaagacucac

SEQ ID NO: 909911 - RNA, 22 nt, Human
aggcuggagagugcaguggcgu

SEQ ID NO: 909912 - RNA, 23 nt, Human
gcucacaggguguaacuccuagu

SEQ ID NO: 909913 - RNA, 22 nt, Human
cucagggacaaggggagacccc

SEQ ID NO: 909914 - RNA, 16 nt, Human
cuguggcucccagguu

SEQ ID NO: 909915 - RNA, 22 nt, Human
gcucucugucguuaugcuucau

SEQ ID NO: 909916 - RNA, 22 nt, Human
acacagguaaugguuuuggaag

SEQ ID NO: 909917 - RNA, 22 nt, Human
aggccacaguacuuugcagacc

SEQ ID NO: 909918 - RNA, 22 nt, Human
ucauugaauuugguucaauaug

SEQ ID NO: 909919 - RNA, 22 nt, Human
aggacuccauguguccuggaga

SEQ ID NO: 909920 - RNA, 22 nt, Human
uuuaaucauaagaaggaaaaua

SEQ ID NO: 909921 - RNA, 22 nt, Human
uuacuuuugcaccaaacuaaua

SEQ ID NO: 909922 - RNA, 22 nt, Human
ugauagaaucagauaaaaggau

SEQ ID NO: 909923 - RNA, 22 nt, Human
uuaguguuuaaagguuucagag

SEQ ID NO: 909924 - RNA, 22 nt, Human
cagugcugagagccuggccagg

SEQ ID NO: 909925 - RNA, 22 nt, Human
aggccacacaacucuuagagau

SEQ ID NO: 909926 - RNA, 22 nt, Human
cagcuggccccacaguagaggc

SEQ ID NO: 909927 - RNA, 22 nt, Human
cugucaucacaguugagcagcc

SEQ ID NO: 909928 - RNA, 22 nt, Human
ggcacaggagcuagucaaagcc

SEQ ID NO: 909929 - RNA, 22 nt, Human
caaggcugugcaggguccauau

SEQ ID NO: 909930 - RNA, 22 nt, Human
caggaaaaucugcccacacaag

SEQ ID NO: 909931 - RNA, 22 nt, Human
ugcagcuccugugcugagugug

SEQ ID NO: 909932 - RNA, 22 nt, Human
ugaaaucaugagauagugucac

SEQ ID NO: 909933 - RNA, 22 nt, Human
auauauuacaaaagaggaagga

SEQ ID NO: 909934 - RNA, 22 nt, Human
cuucuuaaucccuuauauauuu

SEQ ID NO: 909935 - RNA, 22 nt, Human
ccaggcaaggucuccuagagag

SEQ ID NO: 909936 - RNA, 19 nt, Human
ggggugcuagggagggauc

SEQ ID NO: 909937 - RNA, 22 nt, Human
ccacagagagugucagccuuug

SEQ ID NO: 909938 - RNA, 22 nt, Human
gcugccucuccugaguugacag

SEQ ID NO: 909939 - RNA, 22 nt, Human
ugcugagguuguggagugcauu

SEQ ID NO: 909940 - RNA, 22 nt, Human
gagaaugaugauuuccaauuuc

SEQ ID NO: 909941 - RNA, 22 nt, Human
gggcuccacagcagugagugga

SEQ ID NO: 909942 - RNA, 21 nt, Human
ccacauggugaaacccuaucu

SEQ ID NO: 909943 - RNA, 22 nt, Human
caguccagcucaucaguggcac

SEQ ID NO: 909944 - RNA, 22 nt, Human
ucuuagaaguuuauggcacgga

SEQ ID NO: 909945 - RNA, 22 nt, Human
aguauacauauauuagccuucg

SEQ ID NO: 909946 - RNA, 22 nt, Human
ggggcuaacuuucugaggguag

SEQ ID NO: 909947 - RNA, 22 nt, Human
ucuauucaggcagagugcagca

SEQ ID NO: 909948 - RNA, 22 nt, Human
aaguuuaucuuugcuggguacu

SEQ ID NO: 909949 - RNA, 22 nt, Human
ccagguggcuucugcccgaugu

SEQ ID NO: 909950 - RNA, 22 nt, Human
gcuggagugcuggagugcagug

SEQ ID NO: 909951 - RNA, 22 nt, Human
aggcuucagcagcccucucuug

SEQ ID NO: 909952 - RNA, 22 nt, Human
agggcagauggaacuuccccga

SEQ ID NO: 909953 - RNA, 22 nt, Human
uggcuucaagucuagguucuac

SEQ ID NO: 909954 - RNA, 22 nt, Human
cagggcaugaggugugcuucuc

SEQ ID NO: 909955 - RNA, 20 nt, Human
acccugaggcuccccagccu

SEQ ID NO: 909956 - RNA, 21 nt, Human
ggcagccugacccccagagag

SEQ ID NO: 909957 - RNA, 22 nt, Human
uaaaguuuauuugaacaucucu

SEQ ID NO: 909958 - RNA, 22 nt, Human
caaggcauuguguaagcacuug

SEQ ID NO: 909959 - RNA, 22 nt, Human
ucccacagugaaguucaugaua

SEQ ID NO: 909960 - RNA, 22 nt, Human
gacaggcaguuuuccagaucag

SEQ ID NO: 909961 - RNA, 22 nt, Human
uuggaagccuaguuaagaugaa

SEQ ID NO: 909962 - RNA, 22 nt, Human
acaaaguguuuucugaaggccu

SEQ ID NO: 909963 - RNA, 22 nt, Human
uacaguuagccugucuacuccc

SEQ ID NO: 909964 - RNA, 22 nt, Human
aaaguccagagggcacacugaa

SEQ ID NO: 909965 - RNA, 22 nt, Human
uaggcaggugugcacugcccac

SEQ ID NO: 909966 - RNA, 20 nt, Human
gcagugauuugucuauguuu

SEQ ID NO: 909967 - RNA, 22 nt, Human
agguccuggacugcucuuguua

SEQ ID NO: 909968 - RNA, 22 nt, Human
caucuuuaguuauugaauauag

SEQ ID NO: 909969 - RNA, 22 nt, Human
ucagaauucuacaauagaucag

SEQ ID NO: 909970 - RNA, 22 nt, Human
ugcagggauuagaggccgggga

SEQ ID NO: 909971 - RNA, 22 nt, Human
ggucaucugccuccaaagcacu

SEQ ID NO: 909972 - RNA, 22 nt, Human
uguguggugaagcagagaugcu

SEQ ID NO: 909973 - RNA, 22 nt, Human
cccuccucaacucuggcuucca

SEQ ID NO: 909974 - RNA, 22 nt, Human
caggcagcaggagcccugcucg

SEQ ID NO: 909975 - RNA, 22 nt, Human
aguccaugcugucuacagaauc

SEQ ID NO: 909976 - RNA, 22 nt, Human
caaggcuggcucacaauaauga

SEQ ID NO: 909977 - RNA, 22 nt, Human
ugccauuucucacauauguaug

SEQ ID NO: 909978 - RNA, 23 nt, Human
aagaaucucagaauuagaaauac

SEQ ID NO: 909979 - RNA, 17 nt, Human
uaucuguaugauggaua

SEQ ID NO: 909980 - RNA, 22 nt, Human
caggcgggacgugggaggauca

SEQ ID NO: 909981 - RNA, 21 nt, Human
gucagcagauccagcacuugu

SEQ ID NO: 909982 - RNA, 22 nt, Human
aaaccuuuucagcugaauggag

SEQ ID NO: 909983 - RNA, 22 nt, Human
cagggccagccauccugcuggg

SEQ ID NO: 909984 - RNA, 22 nt, Human
cccaggcugauguucagcgggu

SEQ ID NO: 909985 - RNA, 20 nt, Human
uaagcauaguugucaggguc

SEQ ID NO: 909986 - RNA, 22 nt, Human
cugcauccauguugcugcaaag

SEQ ID NO: 909987 - RNA, 22 nt, Human
uuacaguacagaaaauaacaga

SEQ ID NO: 909988 - RNA, 18 nt, Human
guguaaacagccauugag

SEQ ID NO: 909989 - RNA, 22 nt, Human
cuuuuguuaggagaaaacauca

SEQ ID NO: 909990 - RNA, 22 nt, Human
cagagcugcgcuuuuuccuggu

SEQ ID NO: 909991 - RNA, 22 nt, Human
gauuuccaggacgggagguggg

SEQ ID NO: 909992 - RNA, 22 nt, Human
gcucagcucuauggacacaaag

SEQ ID NO: 909993 - RNA, 22 nt, Human
ugcagugauuuguacaauuaga

SEQ ID NO: 909994 - RNA, 22 nt, Human
cccuuagagauucugucagagu

SEQ ID NO: 909995 - RNA, 23 nt, Human
gccugugccuaugcccagcucug

SEQ ID NO: 909996 - RNA, 22 nt, Human
cucucccuggccagcugugcag

SEQ ID NO: 909997 - RNA, 22 nt, Human
cugagcugggagccuggcacca

SEQ ID NO: 909998 - RNA, 20 nt, Human
gcucugugcuggcggaggcu

SEQ ID NO: 909999 - RNA, 22 nt, Human
gauggugucccaggcucaggcu

SEQ ID NO: 910000 - RNA, 16 nt, Human
ggugucagauguccag

SEQ ID NO: 910001 - RNA, 22 nt, Human
aauacaagauuuauaguuguuu

SEQ ID NO: 910002 - RNA, 22 nt, Human
uccucaggagagcuccuaugcc

SEQ ID NO: 910003 - RNA, 19 nt, Human
aguguauuuuuuucuguag

SEQ ID NO: 910004 - RNA, 20 nt, Human
ccagaggcugacagacuuug

SEQ ID NO: 910005 - RNA, 22 nt, Human
caggcaagcaaggggucuugaa

SEQ ID NO: 910006 - RNA, 22 nt, Human
uaggcugggccugccuuccagg

SEQ ID NO: 910007 - RNA, 22 nt, Human
agcugcccugguaagauugaug

SEQ ID NO: 910008 - RNA, 22 nt, Human
caauagcaggucuacagagaga

SEQ ID NO: 910009 - RNA, 22 nt, Human
cauuuuguaagucucucuuguu

SEQ ID NO: 910010 - RNA, 22 nt, Human
gggggaagaggcaugaaguccu

SEQ ID NO: 910011 - RNA, 22 nt, Human
gguuggacacuagguaggagcg

SEQ ID NO: 910012 - RNA, 20 nt, Human
cagaacagucugagaggcca

SEQ ID NO: 910013 - RNA, 22 nt, Human
uauuugcuuugcuuuauagaga

SEQ ID NO: 910014 - RNA, 22 nt, Human
acagcaagaccccuagcauggu

SEQ ID NO: 910015 - RNA, 22 nt, Human
ccauccugucuguggccucagg

SEQ ID NO: 910016 - RNA, 22 nt, Human
aaacuugagccaagggcuuggg

SEQ ID NO: 910017 - RNA, 22 nt, Human
ugacauguccugagaagauggc

SEQ ID NO: 910018 - RNA, 22 nt, Human
agcaggagcauuuccaugauuc

SEQ ID NO: 910019 - RNA, 22 nt, Human
gcagagucugggcagccuccau

SEQ ID NO: 910020 - RNA, 22 nt, Human
uuugcaaaaugaggugaagagu

SEQ ID NO: 910021 - RNA, 22 nt, Human
aaggcuggggugcagacggccu

SEQ ID NO: 910022 - RNA, 17 nt, Human
ucucuuucccuuucugc

SEQ ID NO: 910023 - RNA, 21 nt, Human
cuguccaguaauuccuggcac

SEQ ID NO: 910024 - RNA, 22 nt, Human
cugguggaagccugggcucaga

SEQ ID NO: 910025 - RNA, 22 nt, Human
cauuucaaggaccacccuggga

SEQ ID NO: 910026 - RNA, 22 nt, Human
agcuccuggcuuuccucucacc

SEQ ID NO: 910027 - RNA, 22 nt, Human
gaauguaaaauugccuacaaga

SEQ ID NO: 910028 - RNA, 17 nt, Human
aauguggaaguacaugc

SEQ ID NO: 910029 - RNA, 22 nt, Human
gcucccagggaccgcagggcag

SEQ ID NO: 910030 - RNA, 22 nt, Human
caggccuuucuuggggcuuaga

SEQ ID NO: 910031 - RNA, 22 nt, Human
ucuccaaaucaaucaauaugaa

SEQ ID NO: 910032 - RNA, 22 nt, Human
uucaggagaauuccaagaagua

SEQ ID NO: 910033 - RNA, 22 nt, Human
cagacucucuuccaugcaucac

SEQ ID NO: 910034 - RNA, 22 nt, Human
uucuuucugucaugguguacug

SEQ ID NO: 910035 - RNA, 22 nt, Human
ggugcaggagcggggugcucgg

SEQ ID NO: 910036 - RNA, 22 nt, Human
cuggguauaggaaacaguuaag

SEQ ID NO: 910037 - RNA, 22 nt, Human
guggcuggaguaugaggaaagg

SEQ ID NO: 910038 - RNA, 22 nt, Human
cccagguggguuggccucuguc

SEQ ID NO: 910039 - RNA, 22 nt, Human
ucaaguguaguggugucagguc

SEQ ID NO: 910040 - RNA, 22 nt, Human
ugaaggugauuaugaauguaua

SEQ ID NO: 910041 - RNA, 22 nt, Human
cugagacacggagaggcugugu

SEQ ID NO: 910042 - RNA, 22 nt, Human
cagcagcugggaaggaggcuga

SEQ ID NO: 910043 - RNA, 22 nt, Human
agccaagcugaucuccugcuga

SEQ ID NO: 910044 - RNA, 19 nt, Human
uccccagcaccucugaguc

SEQ ID NO: 910045 - RNA, 22 nt, Human
auauggaaguuaccugacuuca

SEQ ID NO: 910046 - RNA, 22 nt, Human
cugucuguuuuguauacaggcc

SEQ ID NO: 910047 - RNA, 22 nt, Human
guugcagacacuccacagucga

SEQ ID NO: 910048 - RNA, 22 nt, Human
uccucuggauauaagccucacc

SEQ ID NO: 910049 - RNA, 22 nt, Human
cuggcugguccucggggacagc

SEQ ID NO: 910050 - RNA, 20 nt, Human
uaagugagaacaugugguau

SEQ ID NO: 910051 - RNA, 22 nt, Human
ugcaggugcguuuucaagccuc

SEQ ID NO: 910052 - RNA, 22 nt, Human
acugccuugucucuugccuguu

SEQ ID NO: 910053 - RNA, 22 nt, Human
ugugcgcgugcacgcauacuug

SEQ ID NO: 910054 - RNA, 22 nt, Human
caggugcuguccugcacauguc

SEQ ID NO: 910055 - RNA, 22 nt, Human
uauuucaggcuauauuucuugu

SEQ ID NO: 910056 - RNA, 22 nt, Human
aaguacaugcuguaaugauugg

SEQ ID NO: 910057 - RNA, 22 nt, Human
caguguugcuaaguucugaacu

SEQ ID NO: 910058 - RNA, 22 nt, Human
ucuuuagcuaacuggaugccaa

SEQ ID NO: 910059 - RNA, 22 nt, Human
ugugucagagguagagauggca

SEQ ID NO: 910060 - RNA, 22 nt, Human
aggaaggcugaucacugcuugu

SEQ ID NO: 910061 - RNA, 22 nt, Human
cagagcccauccuauacucucc

SEQ ID NO: 910062 - RNA, 22 nt, Human
uaguuuuauaauguuaacaucu

SEQ ID NO: 910063 - RNA, 22 nt, Human
accagugcuuccugcuggagcu

SEQ ID NO: 910064 - RNA, 22 nt, Human
auuuucaaaacaucugcugugu

SEQ ID NO: 910065 - RNA, 22 nt, Human
uguguacacacagauauauaca

SEQ ID NO: 910066 - RNA, 22 nt, Human
guaauuaggaauaaaaugggaa

SEQ ID NO: 910067 - RNA, 22 nt, Human
ugcugccaggucuugcugucca

SEQ ID NO: 910068 - RNA, 16 nt, Human
ccuuucucugccuucc

SEQ ID NO: 910069 - RNA, 22 nt, Human
caucagugcggcaucugucauc

SEQ ID NO: 910070 - RNA, 22 nt, Human
gacuuuccagguccugggcuau

SEQ ID NO: 910071 - RNA, 22 nt, Human
agcucaggccggagcuacaggc

SEQ ID NO: 910072 - RNA, 22 nt, Human
aaaggcaugccuccauuucuau

SEQ ID NO: 910073 - RNA, 19 nt, Human
uccaggggcuccaccuccu

SEQ ID NO: 910074 - RNA, 22 nt, Human
aaugcaaggccuguaucugauu

SEQ ID NO: 910075 - RNA, 22 nt, Human
auguauguaguguacauauaca

SEQ ID NO: 910076 - RNA, 22 nt, Human
ucuccagaguaaccuuggagca

SEQ ID NO: 910077 - RNA, 22 nt, Human
cuucuucucuacauccuuugau

SEQ ID NO: 910078 - RNA, 22 nt, Human
uucuccuuuuccaguucccagu

SEQ ID NO: 910079 - RNA, 22 nt, Human
acaguugguuaacacaaauauu

SEQ ID NO: 910080 - RNA, 18 nt, Human
uccagucuuauuaccauu

SEQ ID NO: 910081 - RNA, 22 nt, Human
accaggagccauagagucaggc

SEQ ID NO: 910082 - RNA, 22 nt, Human
uuaucauugucgcagucuaauu

SEQ ID NO: 910083 - RNA, 22 nt, Human
guggaguggccuggcccugaga

SEQ ID NO: 910084 - RNA, 22 nt, Human
cuguccuguagcuccaucaguc

SEQ ID NO: 910085 - RNA, 22 nt, Human
uguguuguuuuaagcugcugca

SEQ ID NO: 910086 - RNA, 22 nt, Human
cccuccaccaagcagggcgcca

SEQ ID NO: 910087 - RNA, 22 nt, Human
ucuuaugaaaagcacuuagaac

SEQ ID NO: 910088 - RNA, 22 nt, Human
agaucuggaacugagguuuauu

SEQ ID NO: 910089 - RNA, 22 nt, Human
cauuugaaaccuggaaucuacc

SEQ ID NO: 910090 - RNA, 22 nt, Human
acaugaaguggucagaucaaac

SEQ ID NO: 910091 - RNA, 22 nt, Human
gugaggggccaagaguagggca

SEQ ID NO: 910092 - RNA, 22 nt, Human
ucacaguuuuagcuguuaaaua

SEQ ID NO: 910093 - RNA, 22 nt, Human
caggaaugggugacagucagcu

SEQ ID NO: 910094 - RNA, 22 nt, Human
acugcagccuuugggcucauaa

SEQ ID NO: 910095 - RNA, 22 nt, Human
ccaucagcaugggagcaugggc

SEQ ID NO: 910096 - RNA, 19 nt, Human
caguggccuggaggucucu

SEQ ID NO: 910097 - RNA, 22 nt, Human
aggcuuccuggaggaagaggua

SEQ ID NO: 910098 - RNA, 22 nt, Human
uaccucaaguuccaggaaagcg

SEQ ID NO: 910099 - RNA, 22 nt, Human
uugugucuaugguuugagcauc

SEQ ID NO: 910100 - RNA, 22 nt, Human
uuuucuuuaaucugguggggug

SEQ ID NO: 910101 - RNA, 22 nt, Human
acugccuuuuccauuacuuaau

SEQ ID NO: 910102 - RNA, 22 nt, Human
cugagcccaggcgggagcugag

SEQ ID NO: 910103 - RNA, 22 nt, Human
uacauugaaagucauuuaaucc

SEQ ID NO: 910104 - RNA, 22 nt, Human
aaagcauagaauuagaguuagg

SEQ ID NO: 910105 - RNA, 22 nt, Human
caggagcccagaguccucagcu

SEQ ID NO: 910106 - RNA, 22 nt, Human
agagaagggggaaagaucucac

SEQ ID NO: 910107 - RNA, 22 nt, Human
cuaggcagacugagcucuaggg

SEQ ID NO: 910108 - RNA, 22 nt, Human
gaaaguucaaauuauagaaggu

SEQ ID NO: 910109 - RNA, 22 nt, Human
gucuagaauugcuuggcagaug

SEQ ID NO: 910110 - RNA, 22 nt, Human
uugugcuccuaugagaaucuaa

SEQ ID NO: 910111 - RNA, 22 nt, Human
gcccuggaaucucuccauggga

SEQ ID NO: 910112 - RNA, 18 nt, Human
cuaacagggaaaauagaa

SEQ ID NO: 910113 - RNA, 19 nt, Human
aggguuucuugacuuugcu

SEQ ID NO: 910114 - RNA, 22 nt, Human
aggacccacgcacaggaacccc

SEQ ID NO: 910115 - RNA, 22 nt, Human
aggcacugugcugaugucuuau

SEQ ID NO: 910116 - RNA, 22 nt, Human
agacauuuuagacauaaaagau

SEQ ID NO: 910117 - RNA, 22 nt, Human
ggcugcauguucagaugacacu

SEQ ID NO: 910118 - RNA, 22 nt, Human
acauaggcagagcuuuaaagcu

SEQ ID NO: 910119 - RNA, 22 nt, Human
ucauuuuggccaugauacagac

SEQ ID NO: 910120 - RNA, 22 nt, Human
ucacagugacuuacagagauug

SEQ ID NO: 910121 - RNA, 22 nt, Human
ugggcugcugucugcacaugcu

SEQ ID NO: 910122 - RNA, 22 nt, Human
cuuuccaaugcauuuccaaugu

SEQ ID NO: 910123 - RNA, 22 nt, Human
cugaaguuauuguacaaauuug

SEQ ID NO: 910124 - RNA, 22 nt, Human
ucacaagaguaaguucaugccu

SEQ ID NO: 910125 - RNA, 22 nt, Human
cucaggauuuaaaggggcacuc

SEQ ID NO: 910126 - RNA, 22 nt, Human
gccagcuggagugagagugggc

SEQ ID NO: 910127 - RNA, 22 nt, Human
aggaggccuacgcacaugucua

SEQ ID NO: 910128 - RNA, 22 nt, Human
auuaaagugaaguucucagaug

SEQ ID NO: 910129 - RNA, 22 nt, Human
caggaguugguaauauugugga

SEQ ID NO: 910130 - RNA, 17 nt, Human
ggugaguguccaggugg

SEQ ID NO: 910131 - RNA, 22 nt, Human
ugccagggugucaggagagcua

SEQ ID NO: 910132 - RNA, 22 nt, Human
auguacaggauggugcucaucu

SEQ ID NO: 910133 - RNA, 22 nt, Human
cucugcagaggcccaaggcuga

SEQ ID NO: 910134 - RNA, 22 nt, Human
gagacucuugcuuuaauagccc

SEQ ID NO: 910135 - RNA, 22 nt, Human
gcagagucugggcuaccucuug

SEQ ID NO: 910136 - RNA, 20 nt, Human
ccugucugcaauggagguca

SEQ ID NO: 910137 - RNA, 22 nt, Human
uuucucuccccaaguggaauug

SEQ ID NO: 910138 - RNA, 22 nt, Human
auuaaagacagcagauggaugg

SEQ ID NO: 910139 - RNA, 22 nt, Human
gucagaugauacacuguuguca

SEQ ID NO: 910140 - RNA, 20 nt, Human
ccagggcuggcuccugggau

SEQ ID NO: 910141 - RNA, 22 nt, Human
uagcacaaguaucugcuuuucc

SEQ ID NO: 910142 - RNA, 22 nt, Human
ugugccagaaaauaugcugagg

SEQ ID NO: 910143 - RNA, 22 nt, Human
uuaggaagagcuuucaaucacu

SEQ ID NO: 910144 - RNA, 19 nt, Human
uguggccaugguucagcug

SEQ ID NO: 910145 - RNA, 22 nt, Human
aguagaauagauggauacuauu

SEQ ID NO: 910146 - RNA, 22 nt, Human
gauuucuuggcccacucucaga

SEQ ID NO: 910147 - RNA, 22 nt, Human
gcucccagguucuugggccuug

SEQ ID NO: 910148 - RNA, 22 nt, Human
agcagcaauuuucacugucaau

SEQ ID NO: 910149 - RNA, 22 nt, Human
ucccuggccuggaaggauauca

SEQ ID NO: 910150 - RNA, 19 nt, Human
ggcuggagaaaggaaucag

SEQ ID NO: 910151 - RNA, 22 nt, Human
gagccaggcaccuucuguguug

SEQ ID NO: 910152 - RNA, 22 nt, Human
ggagcuguugauuguuugagga

SEQ ID NO: 910153 - RNA, 22 nt, Human
auguggcuguggacaccuuuca

SEQ ID NO: 910154 - RNA, 22 nt, Human
gaagcaauguguuuucaacauu

SEQ ID NO: 910155 - RNA, 22 nt, Human
uucucuugagcuggucauguuu

SEQ ID NO: 910156 - RNA, 22 nt, Human
agccacagcgaaccucucuucc

SEQ ID NO: 910157 - RNA, 22 nt, Human
ccagcgcuucccaucagggagg

SEQ ID NO: 910158 - RNA, 22 nt, Human
aguuacacagugucacuucuac

SEQ ID NO: 910159 - RNA, 22 nt, Human
cugccauccacggcccacucau

SEQ ID NO: 910160 - RNA, 19 nt, Human
ucuagacaccaaaguuguc

SEQ ID NO: 910161 - RNA, 22 nt, Human
gaaggcuggggcaucagugaaa

SEQ ID NO: 910162 - RNA, 22 nt, Human
augcaggguucugggcuagaga

SEQ ID NO: 910163 - RNA, 22 nt, Human
ucugccuucuuuuagucaucuu

SEQ ID NO: 910164 - RNA, 22 nt, Human
cuggaagaguaauauaaauuag

SEQ ID NO: 910165 - RNA, 23 nt, Human
aggcagguuugggcucuucuugu

SEQ ID NO: 910166 - RNA, 22 nt, Human
aacuacauuuuacagaagauga

SEQ ID NO: 910167 - RNA, 22 nt, Human
ucuuacaagucacccgcuuucu

SEQ ID NO: 910168 - RNA, 22 nt, Human
aagcaaaagguuacacuucugg

SEQ ID NO: 910169 - RNA, 22 nt, Human
ugcagggauuauguagggguug

SEQ ID NO: 910170 - RNA, 22 nt, Human
gucucuagauugggagagagaa

SEQ ID NO: 910171 - RNA, 22 nt, Human
aagauauuuuagaacauucacu

SEQ ID NO: 910172 - RNA, 22 nt, Human
caggcugccuggaagaggacug

SEQ ID NO: 910173 - RNA, 22 nt, Human
gaggcccagcagcgcaggucuu

SEQ ID NO: 910174 - RNA, 22 nt, Human
ccugagggcucagcccccagcc

SEQ ID NO: 910175 - RNA, 21 nt, Human
uuacuaaacaaaacaugcagg

SEQ ID NO: 910176 - RNA, 22 nt, Human
ggccccaggccuuuggucuggc

SEQ ID NO: 910177 - RNA, 22 nt, Human
gaagaagcaggaguguguagca

SEQ ID NO: 910178 - RNA, 22 nt, Human
cuguaguugggcauuauaauag

SEQ ID NO: 910179 - RNA, 22 nt, Human
cugguagcagugaagcuguuga

SEQ ID NO: 910180 - RNA, 22 nt, Human
cugaggcuaguauaaagagcau

SEQ ID NO: 910181 - RNA, 22 nt, Human
caauucaaaugcauaguucaca

SEQ ID NO: 910182 - RNA, 18 nt, Human
gcacagagcccaggcucu

SEQ ID NO: 910183 - RNA, 22 nt, Human
uuuaugcagccucaguaucaga

SEQ ID NO: 910184 - RNA, 22 nt, Human
aauggcuuagcucagcgcucag

SEQ ID NO: 910185 - RNA, 20 nt, Human
agacaggagcccccauucag

SEQ ID NO: 910186 - RNA, 23 nt, Human
aucauucuccaaucuggagcagg

SEQ ID NO: 910187 - RNA, 22 nt, Human
agucugacuuggccaggagcug

SEQ ID NO: 910188 - RNA, 22 nt, Human
cuggcuuucauucauucaggcc

SEQ ID NO: 910189 - RNA, 22 nt, Human
uacagagagauaaguguaaaag

SEQ ID NO: 910190 - RNA, 22 nt, Human
uagacauuauguauuaaguucu

SEQ ID NO: 910191 - RNA, 22 nt, Human
gguuuguugggguccaggccca

SEQ ID NO: 910192 - RNA, 22 nt, Human
acccagcuggaugcauggaggc

SEQ ID NO: 910193 - RNA, 22 nt, Human
aggccugaggaccagauaaaug

SEQ ID NO: 910194 - RNA, 22 nt, Human
ggguccaguuucaucugagguu

SEQ ID NO: 910195 - RNA, 22 nt, Human
ugcaggcauaaccgauguugau

SEQ ID NO: 910196 - RNA, 22 nt, Human
acagaaauugcuaauagcucau

SEQ ID NO: 910197 - RNA, 22 nt, Human
acugaggcuuaaagagauuagg

SEQ ID NO: 910198 - RNA, 22 nt, Human
agacagcaggggagucugguuu

SEQ ID NO: 910199 - RNA, 22 nt, Human
agcagccacacgccuccuucuc

SEQ ID NO: 910200 - RNA, 22 nt, Human
aggcucucacuauccuccuagc

SEQ ID NO: 910201 - RNA, 22 nt, Human
ccuccuucuggggccuucugcu

SEQ ID NO: 910202 - RNA, 23 nt, Human
caugcaaacacuauugcauuugg

SEQ ID NO: 910203 - RNA, 23 nt, Human
gcaggacaacagagugggaaggc

SEQ ID NO: 910204 - RNA, 22 nt, Human
ucguauccugcuucaugcccag

SEQ ID NO: 910205 - RNA, 21 nt, Human
ucuuuucucugcaggauuccu

SEQ ID NO: 910206 - RNA, 23 nt, Human
gagaacagccacagagagcugug

SEQ ID NO: 910207 - RNA, 22 nt, Human
ucuguugcuuucuuccugugug

SEQ ID NO: 910208 - RNA, 22 nt, Human
caggaggaggugagguagaacu

SEQ ID NO: 910209 - RNA, 22 nt, Human
auguaucacagcaauguaguca

SEQ ID NO: 910210 - RNA, 20 nt, Human
guccagaguaaugugcugac

SEQ ID NO: 910211 - RNA, 22 nt, Human
cuauuuuguccuuagugcaggg

SEQ ID NO: 910212 - RNA, 22 nt, Human
aggcagugccuggaccccagcu

SEQ ID NO: 910213 - RNA, 20 nt, Human
auguaaaagacagggaguag

SEQ ID NO: 910214 - RNA, 22 nt, Human
aauguucauuagcauuguugac

SEQ ID NO: 910215 - RNA, 22 nt, Human
uuccccaguaacauacauguga

SEQ ID NO: 910216 - RNA, 22 nt, Human
acagggcccugugggccccacu

SEQ ID NO: 910217 - RNA, 22 nt, Human
ggggaagauggcccuccaugug

SEQ ID NO: 910218 - RNA, 22 nt, Human
auuccagguuguagaaaaguuu

SEQ ID NO: 910219 - RNA, 22 nt, Human
ggcaagaguugaagcuccagga

SEQ ID NO: 910220 - RNA, 22 nt, Human
gucucugaagucaguuuuucua

SEQ ID NO: 910221 - RNA, 22 nt, Human
aggagccaagauggggcaagua

SEQ ID NO: 910222 - RNA, 22 nt, Human
ggcuucugcucagccugcacgc

SEQ ID NO: 910223 - RNA, 22 nt, Human
agucuucauuuaguugauccag

SEQ ID NO: 910224 - RNA, 22 nt, Human
cucuggcuaucuguuucuaugu

SEQ ID NO: 910225 - RNA, 19 nt, Human
aggcuucuacccuguccag

SEQ ID NO: 910226 - RNA, 22 nt, Human
aaagccaguucuuuuauauugg

SEQ ID NO: 910227 - RNA, 22 nt, Human
ugaggccagaguuuuuaauucc

SEQ ID NO: 910228 - RNA, 22 nt, Human
acaggaggagcuguuucaggga

SEQ ID NO: 910229 - RNA, 22 nt, Human
uacagugacuggacuuugucau

SEQ ID NO: 910230 - RNA, 22 nt, Human
cucucaaaugucauuccucuau

SEQ ID NO: 910231 - RNA, 22 nt, Human
ugcuggaaauaggcauuguagc

SEQ ID NO: 910232 - RNA, 22 nt, Human
aucguuaaucuugugugucaac

SEQ ID NO: 910233 - RNA, 22 nt, Human
uguguauacaacuuauaggagc

SEQ ID NO: 910234 - RNA, 22 nt, Human
agcagcaguguucuggaauucu

SEQ ID NO: 910235 - RNA, 22 nt, Human
aauagaaaggaggggcucuugu

SEQ ID NO: 910236 - RNA, 22 nt, Human
ccaggaggcucuugucccuggu

SEQ ID NO: 910237 - RNA, 22 nt, Human
agucccagcuucccccaugcag

SEQ ID NO: 910238 - RNA, 16 nt, Human
uggcagagguucagcc

SEQ ID NO: 910239 - RNA, 22 nt, Human
agggccugggccagcacccuuu

SEQ ID NO: 910240 - RNA, 23 nt, Human
uuguccuucugaaauauaucugg

SEQ ID NO: 910241 - RNA, 23 nt, Human
aaguuguuuuuggccagggaaag

SEQ ID NO: 910242 - RNA, 22 nt, Human
uuguaaacaucuguugcuuaga

SEQ ID NO: 910243 - RNA, 22 nt, Human
uguuacaaggaagaauguaggu

SEQ ID NO: 910244 - RNA, 22 nt, Human
gagguggcugcuugcugggaaa

SEQ ID NO: 910245 - RNA, 22 nt, Human
cagagcuguccaaacccugaca

SEQ ID NO: 910246 - RNA, 20 nt, Human
uagaaucuguucugauucau

SEQ ID NO: 910247 - RNA, 21 nt, Human
cagaaugcauucuuugaagga

SEQ ID NO: 910248 - RNA, 22 nt, Human
caguuucccugcuugaaaacgu

SEQ ID NO: 910249 - RNA, 22 nt, Human
gugauucuuccugcuggcauac

SEQ ID NO: 910250 - RNA, 18 nt, Human
gugccaggaggcgcagcc

SEQ ID NO: 910251 - RNA, 22 nt, Human
acaaacagaguugaaaaauagg

SEQ ID NO: 910252 - RNA, 22 nt, Human
ccagggcagcagaauuggggca

SEQ ID NO: 910253 - RNA, 21 nt, Human
ggaagcaguggcggcaacucc

SEQ ID NO: 910254 - RNA, 22 nt, Human
uguuucuucucacacaaacuca

SEQ ID NO: 910255 - RNA, 22 nt, Human
gagguccugucugagaauggag

SEQ ID NO: 910256 - RNA, 22 nt, Human
uuugaagagccacagugaaauu

SEQ ID NO: 910257 - RNA, 20 nt, Human
agcauuuuaugguaggaaac

SEQ ID NO: 910258 - RNA, 22 nt, Human
cauguguagugaaauaagcagu

SEQ ID NO: 910259 - RNA, 22 nt, Human
uacaggcacugaaaugcuuauu

SEQ ID NO: 910260 - RNA, 22 nt, Human
ccuccccacgggcagccggcgc

SEQ ID NO: 910261 - RNA, 22 nt, Human
cgaggccaugcaugcugaggac

SEQ ID NO: 910262 - RNA, 22 nt, Human
acacuuuuguuugaagucucca

SEQ ID NO: 910263 - RNA, 22 nt, Human
uucuaacucuguuauguguuuc

SEQ ID NO: 910264 - RNA, 22 nt, Human
uucuuuggaauaagucaagcug

SEQ ID NO: 910265 - RNA, 22 nt, Human
cuucaacauacacagagagagg

SEQ ID NO: 910266 - RNA, 22 nt, Human
ggcacagggugauguugcaguu

SEQ ID NO: 910267 - RNA, 22 nt, Human
aaugcuuugagggaagaugaaa

SEQ ID NO: 910268 - RNA, 22 nt, Human
acacauauaugucgaaguccuc

SEQ ID NO: 910269 - RNA, 22 nt, Human
gcugccugccuaguuccacagu

SEQ ID NO: 910270 - RNA, 22 nt, Human
auucuuuucccaacugcuuuaa

SEQ ID NO: 910271 - RNA, 22 nt, Human
cagaaauucccauuucagauuc

SEQ ID NO: 910272 - RNA, 22 nt, Human
gcaggaggaucacuugagccca

SEQ ID NO: 910273 - RNA, 22 nt, Human
guucuggguucaaaccccggcc

SEQ ID NO: 910274 - RNA, 16 nt, Human
auuucaugggcaguga

SEQ ID NO: 910275 - RNA, 22 nt, Human
cuuggaggaaaggcagggagac

SEQ ID NO: 910276 - RNA, 22 nt, Human
cacaagaugguuuccagaugcu

SEQ ID NO: 910277 - RNA, 22 nt, Human
gagcugcuggcuccucagguua

SEQ ID NO: 910278 - RNA, 22 nt, Human
uauuacaaauuauaaugggaga

SEQ ID NO: 910279 - RNA, 22 nt, Human
ugcagcugggacauuuuugaua

SEQ ID NO: 910280 - RNA, 22 nt, Human
agacauuuauguuucucuagga

SEQ ID NO: 910281 - RNA, 22 nt, Human
gggagcugccaccaccccuggg

SEQ ID NO: 910282 - RNA, 21 nt, Human
ugcuacauugcugguuauguu

SEQ ID NO: 910283 - RNA, 22 nt, Human
acugucaugaucgaagauguca

SEQ ID NO: 910284 - RNA, 22 nt, Human
uguacuguauucaucuuuaacu

SEQ ID NO: 910285 - RNA, 23 nt, Human
ugcagaggcaugaucacugcuca

SEQ ID NO: 910286 - RNA, 22 nt, Human
cagaauuauaguugcuuuuuaa

SEQ ID NO: 910287 - RNA, 22 nt, Human
guucauauuacuuugagugcag

SEQ ID NO: 910288 - RNA, 22 nt, Human
acuuagaauuaguguagaauga

SEQ ID NO: 910289 - RNA, 22 nt, Human
cuguucucuggcgguggcuguu

SEQ ID NO: 910290 - RNA, 22 nt, Human
aaccacagacccagacuagaga

SEQ ID NO: 910291 - RNA, 22 nt, Human
uccaggcuccccugcgugcucc

SEQ ID NO: 910292 - RNA, 22 nt, Human
acauuaacaccgugaguuuggu

SEQ ID NO: 910293 - RNA, 22 nt, Human
aauaugcagcaugaugaaguaa

SEQ ID NO: 910294 - RNA, 22 nt, Human
auguacauagcaucaucuagga

SEQ ID NO: 910295 - RNA, 22 nt, Human
uugaggccccauggaugagaac

SEQ ID NO: 910296 - RNA, 22 nt, Human
acucucccugcuauccacuucc

SEQ ID NO: 910297 - RNA, 22 nt, Human
agucugaaggauggaagguacc

SEQ ID NO: 910298 - RNA, 22 nt, Human
augcuccuuggcuucaaagcca

SEQ ID NO: 910299 - RNA, 20 nt, Human
ucucccaggcucagggaaga

SEQ ID NO: 910300 - RNA, 22 nt, Human
acagacuggagugagagaaaua

SEQ ID NO: 910301 - RNA, 22 nt, Human
ugcugcugaugcauagucugcu

SEQ ID NO: 910302 - RNA, 22 nt, Human
ugagguauccagugaagcagcc

SEQ ID NO: 910303 - RNA, 22 nt, Human
caggcucccgcuccacugggca

SEQ ID NO: 910304 - RNA, 22 nt, Human
uggcugagguuaugcugguugu

SEQ ID NO: 910305 - RNA, 22 nt, Human
ccuguucuguagugaguuugag

SEQ ID NO: 910306 - RNA, 22 nt, Human
uuccuaacaaacuucagugaau

SEQ ID NO: 910307 - RNA, 22 nt, Human
cugugggacucugaggaaaagc

SEQ ID NO: 910308 - RNA, 22 nt, Human
uugugaauagugccgcaauaaa

SEQ ID NO: 910309 - RNA, 22 nt, Human
auuacccagucugugguauucu

SEQ ID NO: 910310 - RNA, 22 nt, Human
augagguaacagcuuaucaaca

SEQ ID NO: 910311 - RNA, 23 nt, Human
auuagacacuuuggguugucuuc

SEQ ID NO: 910312 - RNA, 22 nt, Human
ugcugcagugggauuagccuga

SEQ ID NO: 910313 - RNA, 21 nt, Human
agcuguuugaagcuauauugg

SEQ ID NO: 910314 - RNA, 22 nt, Human
aggcuguggcaucacaucagga

SEQ ID NO: 910315 - RNA, 22 nt, Human
aagugaugcuacgacuuugaca

SEQ ID NO: 910316 - RNA, 22 nt, Human
uuguugcagagaugaaugacau

SEQ ID NO: 910317 - RNA, 19 nt, Human
uagauacugaugaacucca

SEQ ID NO: 910318 - RNA, 22 nt, Human
ccucccugcgcuccugcggcgg

SEQ ID NO: 910319 - RNA, 22 nt, Human
uuguugaauggauaaauaaauu

SEQ ID NO: 910320 - RNA, 22 nt, Human
cucagaguucuccugggaggug

SEQ ID NO: 910321 - RNA, 22 nt, Human
auuuccagcagcauauuugucu

SEQ ID NO: 910322 - RNA, 22 nt, Human
uagugaaagucaaagacagcua

SEQ ID NO: 910323 - RNA, 22 nt, Human
aucuuuuaugagcguucugaca

SEQ ID NO: 910324 - RNA, 21 nt, Human
aaguaaaucagagaaauaacc

SEQ ID NO: 910325 - RNA, 22 nt, Human
agacucuaacucaugccauugc

SEQ ID NO: 910326 - RNA, 22 nt, Human
aagggcugaaugaaggguugaa

SEQ ID NO: 910327 - RNA, 22 nt, Human
aaagggaacucuaauuaucuuc

SEQ ID NO: 910328 - RNA, 22 nt, Human
cuggcuguuuucaauguugaug

SEQ ID NO: 910329 - RNA, 22 nt, Human
caggagguacauagauucagau

SEQ ID NO: 910330 - RNA, 21 nt, Human
uguauacacacauauauguac

SEQ ID NO: 910331 - RNA, 22 nt, Human
auggcagauccacaguuugaag

SEQ ID NO: 910332 - RNA, 22 nt, Human
ugugccagucauccagaugugu

SEQ ID NO: 910333 - RNA, 22 nt, Human
agcuuacucuucaagaacaagc

SEQ ID NO: 910334 - RNA, 21 nt, Human
agugucugagcgcugcuucug

SEQ ID NO: 910335 - RNA, 22 nt, Human
caguccagagcccaccagagga

SEQ ID NO: 910336 - RNA, 22 nt, Human
uugaaucuggguacuuguaaua

SEQ ID NO: 910337 - RNA, 22 nt, Human
aucccauuuuauaccauaagag

SEQ ID NO: 910338 - RNA, 22 nt, Human
uugccuccuuuuaaggaaauca

SEQ ID NO: 910339 - RNA, 22 nt, Human
ggaguaggccccgggagagagu

SEQ ID NO: 910340 - RNA, 22 nt, Human
uugacuguuaagacuuggcucu

SEQ ID NO: 910341 - RNA, 22 nt, Human
agccuggaauuaaggaaaugca

SEQ ID NO: 910342 - RNA, 22 nt, Human
gagaggcugugugccauuguug

SEQ ID NO: 910343 - RNA, 22 nt, Human
gaguggagaucgugccacugca

SEQ ID NO: 910344 - RNA, 22 nt, Human
agcuaacauggaggaaaaaguu

SEQ ID NO: 910345 - RNA, 22 nt, Human
gggagggaggugaugcuuggcu

SEQ ID NO: 910346 - RNA, 22 nt, Human
auugugcaaauauuaucuguag

SEQ ID NO: 910347 - RNA, 22 nt, Human
ugucaacacaccuaucucaauu

SEQ ID NO: 910348 - RNA, 18 nt, Human
agugucuggauauuuggg

SEQ ID NO: 910349 - RNA, 22 nt, Human
uuccaucacaucacugaagaca

SEQ ID NO: 910350 - RNA, 22 nt, Human
aaggcugugguucuauacagaa

SEQ ID NO: 910351 - RNA, 22 nt, Human
ggagcugggacccugucaucug

SEQ ID NO: 910352 - RNA, 22 nt, Human
cugccugcaugcugccauagcu

SEQ ID NO: 910353 - RNA, 22 nt, Human
aagucacagaacccauuguaac

SEQ ID NO: 910354 - RNA, 22 nt, Human
uacugaaaaagaauccagaccu

SEQ ID NO: 910355 - RNA, 22 nt, Human
gccaccuguuucgcuugcccag

SEQ ID NO: 910356 - RNA, 22 nt, Human
agaacagccaacuguguaggag

SEQ ID NO: 910357 - RNA, 22 nt, Human
aaaguuuaguguccucuaccac

SEQ ID NO: 910358 - RNA, 22 nt, Human
cugcaggguuuuaacaauggac

SEQ ID NO: 910359 - RNA, 22 nt, Human
uuuaaccaguuuacaaagaauu

SEQ ID NO: 910360 - RNA, 22 nt, Human
gggcaggcugagcaugucaccu

SEQ ID NO: 910361 - RNA, 22 nt, Human
ccuggagcccaaggcagugaga

SEQ ID NO: 910362 - RNA, 22 nt, Human
guguacaaaaugucuccaugga

SEQ ID NO: 910363 - RNA, 22 nt, Human
cuuuaguuaguagauaauggca

SEQ ID NO: 910364 - RNA, 22 nt, Human
aggccaguuuuuggagggaaac

SEQ ID NO: 910365 - RNA, 22 nt, Human
agucuuuauacagaaauauaug

SEQ ID NO: 910366 - RNA, 22 nt, Human
ugcccagguuugagugcccaag

SEQ ID NO: 910367 - RNA, 22 nt, Human
ucacccagacuugugaaugugu

SEQ ID NO: 910368 - RNA, 22 nt, Human
uuccugggagcuagccacaucu

SEQ ID NO: 910369 - RNA, 22 nt, Human
ucucuguagagacagcacugug

SEQ ID NO: 910370 - RNA, 22 nt, Human
ucugcccaaggcugucacuaga

SEQ ID NO: 910371 - RNA, 22 nt, Human
cugagguagaggaaauguagcu

SEQ ID NO: 910372 - RNA, 22 nt, Human
ccaggagggaggaguuccugag

SEQ ID NO: 910373 - RNA, 22 nt, Human
cacgcacgcuggguggaggcgc

SEQ ID NO: 910374 - RNA, 22 nt, Human
aagaguuugucagaucugcacg

SEQ ID NO: 910375 - RNA, 22 nt, Human
ucuuagcaaauuuucuuugccu

SEQ ID NO: 910376 - RNA, 22 nt, Human
agucccagacuccaguuuucug

SEQ ID NO: 910377 - RNA, 22 nt, Human
ccuuaaaagaacuaucucuucu

SEQ ID NO: 910378 - RNA, 22 nt, Human
caaggagauaaaauguugagcu

SEQ ID NO: 910379 - RNA, 22 nt, Human
uauccuguuuugcacaauuaua

SEQ ID NO: 910380 - RNA, 22 nt, Human
cucccagccuucgccagucuga

SEQ ID NO: 910381 - RNA, 22 nt, Human
ggcucugggcauagaaggaagc

SEQ ID NO: 910382 - RNA, 22 nt, Human
gccuggagccucagcaaggagg

SEQ ID NO: 910383 - RNA, 22 nt, Human
uugcuaauaaaguuuuuaugug

SEQ ID NO: 910384 - RNA, 22 nt, Human
uauuucaucuggaacaagguaa

SEQ ID NO: 910385 - RNA, 20 nt, Human
cagggcucugggccuggccu

SEQ ID NO: 910386 - RNA, 22 nt, Human
uuuauugcuguguuagggacag

SEQ ID NO: 910387 - RNA, 22 nt, Human
auauacacauguguauacauuu

SEQ ID NO: 910388 - RNA, 22 nt, Human
ucccagcagcauagcucagaau

SEQ ID NO: 910389 - RNA, 22 nt, Human
gaggagaggcuggacgcgguga

SEQ ID NO: 910390 - RNA, 22 nt, Human
uuacacagaaauuuuauugccu

SEQ ID NO: 910391 - RNA, 22 nt, Human
uucauugaagcacaagugaucu

SEQ ID NO: 910392 - RNA, 22 nt, Human
aaguuucuuuauuagcuugucc

SEQ ID NO: 910393 - RNA, 22 nt, Human
gcugcuguguucucuugaccca

SEQ ID NO: 910394 - RNA, 22 nt, Human
gugcuuggaccaggucaucuuc

SEQ ID NO: 910395 - RNA, 22 nt, Human
aagcugcccaagacugaagcau

SEQ ID NO: 910396 - RNA, 17 nt, Human
aaacuucauucucagga

SEQ ID NO: 910397 - RNA, 22 nt, Human
caggccuugaguuuugggcuuu

SEQ ID NO: 910398 - RNA, 22 nt, Human
gccaggucacagggauaaaugg

SEQ ID NO: 910399 - RNA, 17 nt, Human
ugcuucaucccgauccu

SEQ ID NO: 910400 - RNA, 22 nt, Human
caacuuuucugugaauuuaagu

SEQ ID NO: 910401 - RNA, 22 nt, Human
cugcagugccugccacugagcc

SEQ ID NO: 910402 - RNA, 22 nt, Human
gaaauagacacuuucuaugaau

SEQ ID NO: 910403 - RNA, 22 nt, Human
uggcagugugggaggaagguac

SEQ ID NO: 910404 - RNA, 22 nt, Human
acacaaugaggaggggcuuuuc

SEQ ID NO: 910405 - RNA, 22 nt, Human
gucauuccuauccauuugauac

SEQ ID NO: 910406 - RNA, 22 nt, Human
ggcagagguagcuggaaccagg

SEQ ID NO: 910407 - RNA, 21 nt, Human
gaucuagacuugggcccagua

SEQ ID NO: 910408 - RNA, 22 nt, Human
gggcugagaaguugaucccaag

SEQ ID NO: 910409 - RNA, 22 nt, Human
gagcagugaagacagaaguaca

SEQ ID NO: 910410 - RNA, 22 nt, Human
cucagaguccccacaucugggu

SEQ ID NO: 910411 - RNA, 22 nt, Human
guguccuugcaguuugaagaaa

SEQ ID NO: 910412 - RNA, 22 nt, Human
aaaaauagaaggauugacugag

SEQ ID NO: 910413 - RNA, 17 nt, Human
agucugucuuuccuugu

SEQ ID NO: 910414 - RNA, 22 nt, Human
caguaaacaguuacuaagaaga

SEQ ID NO: 910415 - RNA, 22 nt, Human
uaagaacaagcuggggguucca

SEQ ID NO: 910416 - RNA, 22 nt, Human
gaggugugaggaaugaaugggg

SEQ ID NO: 910417 - RNA, 22 nt, Human
uggaagaccagacuucccgaac

SEQ ID NO: 910418 - RNA, 22 nt, Human
uggcaaaaguuuuagguuauuu

SEQ ID NO: 910419 - RNA, 22 nt, Human
aaagguuuccgagcuuuaauuu

SEQ ID NO: 910420 - RNA, 21 nt, Human
aaauuagcuucaaguucugca

SEQ ID NO: 910421 - RNA, 22 nt, Human
uuucuucuugauuuaaacaggg

SEQ ID NO: 910422 - RNA, 22 nt, Human
gcaguguugugauccaggucuu

SEQ ID NO: 910423 - RNA, 20 nt, Human
agagguucagucuggagaag

SEQ ID NO: 910424 - RNA, 22 nt, Human
uggaguaagagccaccagccaa

SEQ ID NO: 910425 - RNA, 22 nt, Human
aguggugucgugggaguggaag

SEQ ID NO: 910426 - RNA, 22 nt, Human
aggagucagauuguuugaaugu

SEQ ID NO: 910427 - RNA, 22 nt, Human
cuaaauuaucaugagaauuaug

SEQ ID NO: 910428 - RNA, 22 nt, Human
cucuuuccucgaugggcuccug

SEQ ID NO: 910429 - RNA, 22 nt, Human
gggaagacuuagucgguucaau

SEQ ID NO: 910430 - RNA, 22 nt, Human
uauguguacucguuaaauauuu

SEQ ID NO: 910431 - RNA, 22 nt, Human
auugcugacaccaaguaguagc

SEQ ID NO: 910432 - RNA, 22 nt, Human
ucuuuggauggaaaauguauuc

SEQ ID NO: 910433 - RNA, 22 nt, Human
acaaucauuccguucacaacag

SEQ ID NO: 910434 - RNA, 22 nt, Human
uuauguguguacaugcauaugu

SEQ ID NO: 910435 - RNA, 22 nt, Human
aguggcagagcugggauuuggg

SEQ ID NO: 910436 - RNA, 19 nt, Human
auuugaaagcugugcuugc

SEQ ID NO: 910437 - RNA, 22 nt, Human
gcuuccucccugcugcucacua

SEQ ID NO: 910438 - RNA, 22 nt, Human
cuggcuuguuuuaagaauacaa

SEQ ID NO: 910439 - RNA, 22 nt, Human
caucaguguucacuauuccuuc

SEQ ID NO: 910440 - RNA, 22 nt, Human
caugaagauccuguauguuuuu

SEQ ID NO: 910441 - RNA, 22 nt, Human
acagucaaucagaacagcaugu

SEQ ID NO: 910442 - RNA, 22 nt, Human
cuguagaggaacaagagcucuu

SEQ ID NO: 910443 - RNA, 22 nt, Human
guacauuuauuuuugcagcaua

SEQ ID NO: 910444 - RNA, 22 nt, Human
acugccugcucauaacauugcu

SEQ ID NO: 910445 - RNA, 22 nt, Human
auaccauggcaguuuauucacg

SEQ ID NO: 910446 - RNA, 22 nt, Human
ucuguuaaccuggucuuggcuu

SEQ ID NO: 910447 - RNA, 22 nt, Human
caauauauaggaacaacuuagg

SEQ ID NO: 910448 - RNA, 22 nt, Human
ugggcugccagcucuccagaug

SEQ ID NO: 910449 - RNA, 22 nt, Human
ugaaauggaugagagcagaggu

SEQ ID NO: 910450 - RNA, 22 nt, Human
cacauuuacuuuuaucccuugg

SEQ ID NO: 910451 - RNA, 22 nt, Human
auauauuuugaauagccucugu

SEQ ID NO: 910452 - RNA, 23 nt, Human
auuuaaugcugaguugaauguua

SEQ ID NO: 910453 - RNA, 22 nt, Human
uacaggacauugugcauuuguc

SEQ ID NO: 910454 - RNA, 19 nt, Human
accuucagaguggcacaaa

SEQ ID NO: 910455 - RNA, 22 nt, Human
uucuuaaagaggcaaaacacag

SEQ ID NO: 910456 - RNA, 20 nt, Human
uaaaugcaugaauguaaggc

SEQ ID NO: 910457 - RNA, 22 nt, Human
gagcugcagaguaaccuuugca

SEQ ID NO: 910458 - RNA, 22 nt, Human
ucagaagggaaacacaagugac

SEQ ID NO: 910459 - RNA, 22 nt, Human
acccaggggcgaagcuggccac

SEQ ID NO: 910460 - RNA, 22 nt, Human
uaacauugucaguucaacugcu

SEQ ID NO: 910461 - RNA, 22 nt, Human
uucuggaaguggaauuuuugua

SEQ ID NO: 910462 - RNA, 22 nt, Human
acaaaggcagccaaucaucugc

SEQ ID NO: 910463 - RNA, 21 nt, Human
gcacccagccgguucucccag

SEQ ID NO: 910464 - RNA, 22 nt, Human
gaaaauguuuguccggagcuga

SEQ ID NO: 910465 - RNA, 22 nt, Human
agcugcccuucucuugcccuug

SEQ ID NO: 910466 - RNA, 22 nt, Human
aaccauuagucaaucagcaaga

SEQ ID NO: 910467 - RNA, 22 nt, Human
ugauucucuuagaugauguguu

SEQ ID NO: 910468 - RNA, 22 nt, Human
uuaauuuucucaucugugaaau

SEQ ID NO: 910469 - RNA, 22 nt, Human
agugacagccaaauccauccau

SEQ ID NO: 910470 - RNA, 22 nt, Human
gcacugggugggagaucugaau

SEQ ID NO: 910471 - RNA, 22 nt, Human
gauucacucauauuuuacguuu

SEQ ID NO: 910472 - RNA, 22 nt, Human
gccuggagaauuaaaaggaagg

SEQ ID NO: 910473 - RNA, 22 nt, Human
uuccaguucagaugcaacaggg

SEQ ID NO: 910474 - RNA, 19 nt, Human
uuagaaacuguugacacug

SEQ ID NO: 910475 - RNA, 22 nt, Human
uuucuguauuuaggacaggugg

SEQ ID NO: 910476 - RNA, 22 nt, Human
aaacugaagagcuuuuugacac

SEQ ID NO: 910477 - RNA, 22 nt, Human
cccuagggcuaagcaggacugc

SEQ ID NO: 910478 - RNA, 22 nt, Human
uaggccuggaucucugggagca

SEQ ID NO: 910479 - RNA, 22 nt, Human
cuucagaacuauaaaaaguacu

SEQ ID NO: 910480 - RNA, 22 nt, Human
aagcucuuuucauaagagcaaa

SEQ ID NO: 910481 - RNA, 22 nt, Human
gacaucauguucugcuaauagu

SEQ ID NO: 910482 - RNA, 20 nt, Human
uccugagaggcucuuggaga

SEQ ID NO: 910483 - RNA, 22 nt, Human
cugucuggaugugagucaccua

SEQ ID NO: 910484 - RNA, 23 nt, Human
ugcaugugaauucauacuuguuu

SEQ ID NO: 910485 - RNA, 22 nt, Human
cugcuggguuugccuuucacca

SEQ ID NO: 910486 - RNA, 21 nt, Human
cagcccagcuucuuccccagu

SEQ ID NO: 910487 - RNA, 22 nt, Human
uguggcugccacccugaagccg

SEQ ID NO: 910488 - RNA, 22 nt, Human
uggcaaggccacaggugcaguu

SEQ ID NO: 910489 - RNA, 22 nt, Human
augugaaagagguguucagugg

SEQ ID NO: 910490 - RNA, 22 nt, Human
uauuuacuguauuugaaguuga

SEQ ID NO: 910491 - RNA, 22 nt, Human
gucagaggggacaagacacaga

SEQ ID NO: 910492 - RNA, 21 nt, Human
ugcaucuucaagguuggcagg

SEQ ID NO: 910493 - RNA, 22 nt, Human
ggggaagagcauugcacggugu

SEQ ID NO: 910494 - RNA, 22 nt, Human
guuagaaacgcaggcucuccgg

SEQ ID NO: 910495 - RNA, 22 nt, Human
gaaugaguuaauauuugcuugg

SEQ ID NO: 910496 - RNA, 22 nt, Human
uaagacaaauacuauuucaaga

SEQ ID NO: 910497 - RNA, 22 nt, Human
aaugaaacuguauauagacugu

SEQ ID NO: 910498 - RNA, 22 nt, Human
gaagagcugucagaaaagcuaa

SEQ ID NO: 910499 - RNA, 22 nt, Human
ugcccuguucacuucaugguuc

SEQ ID NO: 910500 - RNA, 22 nt, Human
uuuagaaguucacacauuuaaa

SEQ ID NO: 910501 - RNA, 21 nt, Human
ucaggaggcucagacuccugc

SEQ ID NO: 910502 - RNA, 22 nt, Human
gugcccugaguggguaggagag

SEQ ID NO: 910503 - RNA, 22 nt, Human
uaacaaugggaaggacugauga

SEQ ID NO: 910504 - RNA, 22 nt, Human
cuggagugcaaugaacaagguc

SEQ ID NO: 910505 - RNA, 22 nt, Human
gaggaaaagagacagguuauug

SEQ ID NO: 910506 - RNA, 17 nt, Human
agcaaaaguaucaaagc

SEQ ID NO: 910507 - RNA, 22 nt, Human
ccagcuucucucugaugcagcu

SEQ ID NO: 910508 - RNA, 22 nt, Human
caagccaggaaggauccagcac

SEQ ID NO: 910509 - RNA, 22 nt, Human
uagaaaagccccagcuggaggg

SEQ ID NO: 910510 - RNA, 22 nt, Human
cugccuggguucaaguccuguu

SEQ ID NO: 910511 - RNA, 22 nt, Human
aguuccagaacuggaaaaggac

SEQ ID NO: 910512 - RNA, 22 nt, Human
cacuuugaagagcuuuuugaca

SEQ ID NO: 910513 - RNA, 22 nt, Human
uccucagcauuagcacagacau

SEQ ID NO: 910514 - RNA, 22 nt, Human
ccuggcuccagcugccuguccu

SEQ ID NO: 910515 - RNA, 22 nt, Human
ugaagaaaauaugauuacccca

SEQ ID NO: 910516 - RNA, 22 nt, Human
caaaguaucaacucccacacug

SEQ ID NO: 910517 - RNA, 22 nt, Human
aguuuauuguauaugguaguuu

SEQ ID NO: 910518 - RNA, 22 nt, Human
cuggaguguaaagagcauagaa

SEQ ID NO: 910519 - RNA, 22 nt, Human
caaggccaguucaccaagggca

SEQ ID NO: 910520 - RNA, 22 nt, Human
caugugugaguauaucuuaucc

SEQ ID NO: 910521 - RNA, 18 nt, Human
ggagcugggccccacucc

SEQ ID NO: 910522 - RNA, 22 nt, Human
aaccaggagauuaaagaaaggu

SEQ ID NO: 910523 - RNA, 21 nt, Human
uuuucccacugaaagcuccca

SEQ ID NO: 910524 - RNA, 22 nt, Human
ucuguuaucucaagucacaaga

SEQ ID NO: 910525 - RNA, 22 nt, Human
cgcagcugcacggggcugagcc

SEQ ID NO: 910526 - RNA, 22 nt, Human
uguauaaacuuaagcaggaacc

SEQ ID NO: 910527 - RNA, 22 nt, Human
acccugagggaugagaguugca

SEQ ID NO: 910528 - RNA, 22 nt, Human
cugccuggcauagucuggucga

SEQ ID NO: 910529 - RNA, 22 nt, Human
ucuuuuuauauugacaaaaggu

SEQ ID NO: 910530 - RNA, 20 nt, Human
augugucugccucuguguuc

SEQ ID NO: 910531 - RNA, 22 nt, Human
aauucugaugauacugcauugu

SEQ ID NO: 910532 - RNA, 22 nt, Human
cccaggagguagagguugcagu

SEQ ID NO: 910533 - RNA, 22 nt, Human
agccucugaugaucacaggggg

SEQ ID NO: 910534 - RNA, 22 nt, Human
auguuuauuguuuuaagcugcu

SEQ ID NO: 910535 - RNA, 22 nt, Human
acuguugaagugccagcuugau

SEQ ID NO: 910536 - RNA, 22 nt, Human
acaugaaaugcagccuguaacc

SEQ ID NO: 910537 - RNA, 22 nt, Human
gcucugccuucucacuggguuc

SEQ ID NO: 910538 - RNA, 22 nt, Human
gggcaagcucuucagaagcucu

SEQ ID NO: 910539 - RNA, 22 nt, Human
cuccagccucaucuccuggcug

SEQ ID NO: 910540 - RNA, 22 nt, Human
uuccuggcugucaugcccuagu

SEQ ID NO: 910541 - RNA, 22 nt, Human
ucccuggagguguuugcucagg

SEQ ID NO: 910542 - RNA, 22 nt, Human
gugggcagccccuucaaggcca

SEQ ID NO: 910543 - RNA, 22 nt, Human
uacaugaagaaaauuaagcagu

SEQ ID NO: 910544 - RNA, 22 nt, Human
gcucugcuugcaucaugacugc

SEQ ID NO: 910545 - RNA, 22 nt, Human
gcucuuuucacaguccaaaaug

SEQ ID NO: 910546 - RNA, 22 nt, Human
ucuuuaaggugauuucugcuac

SEQ ID NO: 910547 - RNA, 22 nt, Human
ggaauuuagauguuucucaacu

SEQ ID NO: 910548 - RNA, 22 nt, Human
aauguauguguauaucaaauca

SEQ ID NO: 910549 - RNA, 22 nt, Human
cacaaggcccugggucaccaca

SEQ ID NO: 910550 - RNA, 22 nt, Human
augaagacaaacuggguagaaa

SEQ ID NO: 910551 - RNA, 22 nt, Human
gacuaggggcagcgugggagcu

SEQ ID NO: 910552 - RNA, 22 nt, Human
auggacagggcacaggcgcaga

SEQ ID NO: 910553 - RNA, 22 nt, Human
ucuuguuucuguauauaaugac

SEQ ID NO: 910554 - RNA, 23 nt, Human
ccucucucccuguuuggcaaaua

SEQ ID NO: 910555 - RNA, 22 nt, Human
uuucacaacacaaucucguuaa

SEQ ID NO: 910556 - RNA, 22 nt, Human
cugugccuuaguauucucauuu

SEQ ID NO: 910557 - RNA, 22 nt, Human
cagcugagcugccagacuacug

SEQ ID NO: 910558 - RNA, 22 nt, Human
augugucauuauccagaauaac

SEQ ID NO: 910559 - RNA, 22 nt, Human
gcuacagguauauagaugaaac

SEQ ID NO: 910560 - RNA, 22 nt, Human
caugauuuugucuuguguuaau

SEQ ID NO: 910561 - RNA, 22 nt, Human
uuuccagugggccccuugaaau

SEQ ID NO: 910562 - RNA, 22 nt, Human
guuucauauaccaagcacuuga

SEQ ID NO: 910563 - RNA, 22 nt, Human
aucugcuugaguuugaagucag

SEQ ID NO: 910564 - RNA, 22 nt, Human
agcaguguucuaaucuggcuag

SEQ ID NO: 910565 - RNA, 22 nt, Human
auugagaaauauaaucuggaaa

SEQ ID NO: 910566 - RNA, 22 nt, Human
uucugaauucaugagauuuggg

SEQ ID NO: 910567 - RNA, 22 nt, Human
gaacagaagaggcuggugccac

SEQ ID NO: 910568 - RNA, 22 nt, Human
uacuuacacugaagcaaagaua

SEQ ID NO: 910569 - RNA, 23 nt, Human
cuacaaaguaugagaagaccccu

SEQ ID NO: 910570 - RNA, 22 nt, Human
ugugcuuugguuuuacaggaug

SEQ ID NO: 910571 - RNA, 22 nt, Human
uuuaggaaauacuguccuauga

SEQ ID NO: 910572 - RNA, 22 nt, Human
ccaggggggcguagaugcuggg

SEQ ID NO: 910573 - RNA, 22 nt, Human
ugguuccucaagcgcuggcggc

SEQ ID NO: 910574 - RNA, 22 nt, Human
uacaccagauuauuuauaacau

SEQ ID NO: 910575 - RNA, 22 nt, Human
uauguauauauguuggguagaa

SEQ ID NO: 910576 - RNA, 22 nt, Human
uuugccugggaauucuagugua

SEQ ID NO: 910577 - RNA, 22 nt, Human
cccugcucuuagugccugugug

SEQ ID NO: 910578 - RNA, 22 nt, Human
ugagcagcaggaucuucuggua

SEQ ID NO: 910579 - RNA, 22 nt, Human
gcaaagauauuagaauagagua

SEQ ID NO: 910580 - RNA, 22 nt, Human
agacagugacuuagugaccaga

SEQ ID NO: 910581 - RNA, 22 nt, Human
uugacaaaaaccucauuucacc

SEQ ID NO: 910582 - RNA, 22 nt, Human
ugcgaauugaugucaacucagg

SEQ ID NO: 910583 - RNA, 22 nt, Human
uuuugccugagauccgagucug

SEQ ID NO: 910584 - RNA, 22 nt, Human
gacacuuuuuuaaagcucauua

SEQ ID NO: 910585 - RNA, 22 nt, Human
acccucaacaaauucacucuau

SEQ ID NO: 910586 - RNA, 18 nt, Human
uguuuauuuuucucuuac

SEQ ID NO: 910587 - RNA, 22 nt, Human
auucuuugaacaguuuuccugu

SEQ ID NO: 910588 - RNA, 19 nt, Human
gagauauagaaguagaugu

SEQ ID NO: 910589 - RNA, 22 nt, Human
ggcagggaguggagacucccua

SEQ ID NO: 910590 - RNA, 20 nt, Human
accagagauagcaauagugc

SEQ ID NO: 910591 - RNA, 22 nt, Human
uguucauucgcuauugucuaug

SEQ ID NO: 910592 - RNA, 22 nt, Human
ggugugggaacuacagguuuuu

SEQ ID NO: 910593 - RNA, 22 nt, Human
acacauagaaaauaaauaguua

SEQ ID NO: 910594 - RNA, 22 nt, Human
aaauaguuguuuggaucaauaa

SEQ ID NO: 910595 - RNA, 22 nt, Human
cucuauguuaugcagaauuaag

SEQ ID NO: 910596 - RNA, 22 nt, Human
uaaagauguucucauuucauag

SEQ ID NO: 910597 - RNA, 23 nt, Human
ccuggcuguggauuugggccugc

SEQ ID NO: 910598 - RNA, 22 nt, Human
acugcagagcuuuucaguugag

SEQ ID NO: 910599 - RNA, 22 nt, Human
caugcacaaagguaagaugcgu

SEQ ID NO: 910600 - RNA, 19 nt, Human
aagcuuucccauuaacccc

SEQ ID NO: 910601 - RNA, 22 nt, Human
aacuguuuuuuacuagaggacu

SEQ ID NO: 910602 - RNA, 22 nt, Human
uaaguuuccagauuguaagucc

SEQ ID NO: 910603 - RNA, 22 nt, Human
auuauuguugcggcuguuaccg

SEQ ID NO: 910604 - RNA, 22 nt, Human
aaaguucacuauguagcagcgu

SEQ ID NO: 910605 - RNA, 22 nt, Human
agaagagaacugccaaacacuu

SEQ ID NO: 910606 - RNA, 22 nt, Human
uaggcagagguaugguaaggac

SEQ ID NO: 910607 - RNA, 22 nt, Human
aacauuuaggaaggaccuccuc

SEQ ID NO: 910608 - RNA, 22 nt, Human
cacugaaaggcaaugcugacag

SEQ ID NO: 910609 - RNA, 19 nt, Human
agacauaaagaguuugcaa

SEQ ID NO: 910610 - RNA, 22 nt, Human
ucuucccauuaguaaugaagug

SEQ ID NO: 910611 - RNA, 22 nt, Human
uaguguaugucuaacauacacu

SEQ ID NO: 910612 - RNA, 22 nt, Human
gcugcugggauccugggucuca

SEQ ID NO: 910613 - RNA, 22 nt, Human
gagaagggauaugccacucucg

SEQ ID NO: 910614 - RNA, 22 nt, Human
acaauuuauccauuguauaguu

SEQ ID NO: 910615 - RNA, 22 nt, Human
uaacauuacggacaucugucag

SEQ ID NO: 910616 - RNA, 22 nt, Human
ccugagaggcccucucacuguc

SEQ ID NO: 910617 - RNA, 22 nt, Human
uccagcucugcuucacagucuc

SEQ ID NO: 910618 - RNA, 22 nt, Human
cucugacagccacauagaggcu

SEQ ID NO: 910619 - RNA, 19 nt, Human
uugaauaugcaaacugaag

SEQ ID NO: 910620 - RNA, 22 nt, Human
aacagacaacuccuguggcuca

SEQ ID NO: 910621 - RNA, 19 nt, Human
acaaagugcgugcucuuuu

SEQ ID NO: 910622 - RNA, 22 nt, Human
cugagcagucugacucaagcua

SEQ ID NO: 910623 - RNA, 22 nt, Human
gauguacacucagaaaagucau

SEQ ID NO: 910624 - RNA, 20 nt, Human
guacacauauauguaugugu

SEQ ID NO: 910625 - RNA, 22 nt, Human
agcaaauacauuuuuagcauaa

SEQ ID NO: 910626 - RNA, 22 nt, Human
uacacagauuuaaaagcaggga

SEQ ID NO: 910627 - RNA, 22 nt, Human
agcauuuaaggguggauacagg

SEQ ID NO: 910628 - RNA, 22 nt, Human
gacugggccaaggucagcagcu

SEQ ID NO: 910629 - RNA, 22 nt, Human
gggcucagaggaguggccuggg

SEQ ID NO: 910630 - RNA, 22 nt, Human
uuucauguuuucuuaaauggca

SEQ ID NO: 910631 - RNA, 19 nt, Human
ucucagaauuaagagugcu

SEQ ID NO: 910632 - RNA, 22 nt, Human
accuaagagaucuucuggucca

SEQ ID NO: 910633 - RNA, 22 nt, Human
gggaggaaagagaaguggucca

SEQ ID NO: 910634 - RNA, 22 nt, Human
ucagccagagguggaugaguca

SEQ ID NO: 910635 - RNA, 22 nt, Human
ucacauuucugauuauaccaaa

SEQ ID NO: 910636 - RNA, 22 nt, Human
ccagugugcauuaucauguguc

SEQ ID NO: 910637 - RNA, 22 nt, Human
guuauuuaacuuuguagcaugg

SEQ ID NO: 910638 - RNA, 23 nt, Human
ccagugauugccuggaaggaggu

SEQ ID NO: 910639 - RNA, 22 nt, Human
cccccaggcucugacacaggag

SEQ ID NO: 910640 - RNA, 22 nt, Human
acauuugacuguagauacuugc

SEQ ID NO: 910641 - RNA, 22 nt, Human
aagggaaaauaguugaugacca

SEQ ID NO: 910642 - RNA, 22 nt, Human
cuguccagucagaacgucauua

SEQ ID NO: 910643 - RNA, 22 nt, Human
gggcuggaagacaggaaaugcu

SEQ ID NO: 910644 - RNA, 22 nt, Human
ggcuccuggaggcaccacuggu

SEQ ID NO: 910645 - RNA, 22 nt, Human
gauguaaagcuucagagccggc

SEQ ID NO: 910646 - RNA, 22 nt, Human
uaaauguacugaggcaacagga

SEQ ID NO: 910647 - RNA, 22 nt, Human
ugcaguggaagagguggagauc

SEQ ID NO: 910648 - RNA, 22 nt, Human
uccugucuuaaugaucucgugc

SEQ ID NO: 910649 - RNA, 22 nt, Human
gggcugagcuguucugaguuua

SEQ ID NO: 910650 - RNA, 22 nt, Human
uguuuuuaaauaaugauagaaa

SEQ ID NO: 910651 - RNA, 22 nt, Human
uucacauugugcagauuauggu

SEQ ID NO: 910652 - RNA, 22 nt, Human
uacccaggagaaacagcagggc

SEQ ID NO: 910653 - RNA, 23 nt, Human
aaacuacauuuauaguuuuucuc

SEQ ID NO: 910654 - RNA, 23 nt, Human
ccuccugggcacaggccugaugg

SEQ ID NO: 910655 - RNA, 22 nt, Human
auagaauagcauagaaaauuga

SEQ ID NO: 910656 - RNA, 22 nt, Human
uggcauuauguagcagggagca

SEQ ID NO: 910657 - RNA, 19 nt, Human
cacuaagaugagauauagc

SEQ ID NO: 910658 - RNA, 22 nt, Human
ggaagccacccagcuuugauag

SEQ ID NO: 910659 - RNA, 22 nt, Human
ugggcagggaucucuuuugcaa

SEQ ID NO: 910660 - RNA, 21 nt, Human
agaauccauucagaccuucuc

SEQ ID NO: 910661 - RNA, 22 nt, Human
uuugacaugaaguagcuuauaa

SEQ ID NO: 910662 - RNA, 22 nt, Human
ucuagauuuggggcaugaaguu

SEQ ID NO: 910663 - RNA, 22 nt, Human
cacacaugugggauccgcaggg

SEQ ID NO: 910664 - RNA, 21 nt, Human
gcagagccggggcgagaaggc

SEQ ID NO: 910665 - RNA, 22 nt, Human
agauggggcagaauggagccau

SEQ ID NO: 910666 - RNA, 22 nt, Human
cugcuguguuagcagguuuagu

SEQ ID NO: 910667 - RNA, 20 nt, Human
aguaggggaaugcaagagca

SEQ ID NO: 910668 - RNA, 22 nt, Human
gccugcucugaguguggggggu

SEQ ID NO: 910669 - RNA, 22 nt, Human
aaguugguaggagacagaaggu

SEQ ID NO: 910670 - RNA, 22 nt, Human
uuuguuuacucauucauugaug

SEQ ID NO: 910671 - RNA, 22 nt, Human
aagcaggguuuuuccaccgcag

SEQ ID NO: 910672 - RNA, 22 nt, Human
acuucuguauguccugcauuca

SEQ ID NO: 910673 - RNA, 22 nt, Human
acccuggaggucuacagugcag

SEQ ID NO: 910674 - RNA, 22 nt, Human
ccaaugcauugaauuagguuuu

SEQ ID NO: 910675 - RNA, 22 nt, Human
guauuugucuuguuggucucca

SEQ ID NO: 910676 - RNA, 22 nt, Human
caaagcuguaccccaaccuaug

SEQ ID NO: 910677 - RNA, 22 nt, Human
aauuuacaggugcacucgccau

SEQ ID NO: 910678 - RNA, 22 nt, Human
uccagggcuacaaggcaccaga

SEQ ID NO: 910679 - RNA, 22 nt, Human
acuugguuggucucacccuguu

SEQ ID NO: 910680 - RNA, 22 nt, Human
ugaccuuucaacccuucuuggc

SEQ ID NO: 910681 - RNA, 22 nt, Human
uagucuggacuucuuaguguca

SEQ ID NO: 910682 - RNA, 22 nt, Human
aguucucuucucaucacccagg

SEQ ID NO: 910683 - RNA, 22 nt, Human
agggccacaguggggccugaga

SEQ ID NO: 910684 - RNA, 22 nt, Human
gccuggagagcacugugcgcuu

SEQ ID NO: 910685 - RNA, 22 nt, Human
gcugcagugagccaagaucgug

SEQ ID NO: 910686 - RNA, 22 nt, Human
aggacagcccccaacagcaaca

SEQ ID NO: 910687 - RNA, 19 nt, Human
cugggucuuauucugugaa

SEQ ID NO: 910688 - RNA, 22 nt, Human
gccagcugcucgcguaggguag

SEQ ID NO: 910689 - RNA, 22 nt, Human
gaacacaacucagaaugcuggu

SEQ ID NO: 910690 - RNA, 22 nt, Human
caacagagagaccagaaacagg

SEQ ID NO: 910691 - RNA, 22 nt, Human
cgcugccaggauccccugccgg

SEQ ID NO: 910692 - RNA, 22 nt, Human
uaauaauuggcaauguugagca

SEQ ID NO: 910693 - RNA, 18 nt, Human
ggccugcagugaagcaag

SEQ ID NO: 910694 - RNA, 22 nt, Human
uccaaggaggcuuugacgucca

SEQ ID NO: 910695 - RNA, 22 nt, Human
acugagacaacuguguuucuaa

SEQ ID NO: 910696 - RNA, 22 nt, Human
cccuggaggucagaggccuggg

SEQ ID NO: 910697 - RNA, 22 nt, Human
uugcccugucaguagaagugca

SEQ ID NO: 910698 - RNA, 22 nt, Human
ucugggucuaugaucucacuuc

SEQ ID NO: 910699 - RNA, 22 nt, Human
guaaaguacauacaugaacuca

SEQ ID NO: 910700 - RNA, 22 nt, Human
acaauagauacugggcacauau

SEQ ID NO: 910701 - RNA, 22 nt, Human
ccagccuggggaggcagcuucu

SEQ ID NO: 910702 - RNA, 22 nt, Human
uauauaagauggguaggcuugu

SEQ ID NO: 910703 - RNA, 22 nt, Human
gggcuagaaauucugcagugga

SEQ ID NO: 910704 - RNA, 23 nt, Human
cugaaauaccagaaaaucagugu

SEQ ID NO: 910705 - RNA, 22 nt, Human
uuucuaagaaaguaaugguuau

SEQ ID NO: 910706 - RNA, 22 nt, Human
aaauuauuaguuaaguugggca

SEQ ID NO: 910707 - RNA, 22 nt, Human
augaacaaguauuugcaugagc

SEQ ID NO: 910708 - RNA, 22 nt, Human
ucuuagaaauuccccaguggcu

SEQ ID NO: 910709 - RNA, 22 nt, Human
aaagaucagaggauagcugagu

SEQ ID NO: 910710 - RNA, 22 nt, Human
ugccuguguggggucugccgcc

SEQ ID NO: 910711 - RNA, 22 nt, Human
uucuaauugcaaguuuuaguau

SEQ ID NO: 910712 - RNA, 22 nt, Human
caggauggccccggggcugugc

SEQ ID NO: 910713 - RNA, 22 nt, Human
cuggaucugucuuuuggauccc

SEQ ID NO: 910714 - RNA, 22 nt, Human
uugaaagcuccauauuguagag

SEQ ID NO: 910715 - RNA, 22 nt, Human
agggaugauuucagugucugcc

SEQ ID NO: 910716 - RNA, 22 nt, Human
cucccaggcacagggaggagcc

SEQ ID NO: 910717 - RNA, 22 nt, Human
augauauauguguugagcuugc

SEQ ID NO: 910718 - RNA, 22 nt, Human
ccugugcucccuauguaucugg

SEQ ID NO: 910719 - RNA, 22 nt, Human
ucuuugcaucccuuccauaguu

SEQ ID NO: 910720 - RNA, 16 nt, Human
ggugggaggugaggug

SEQ ID NO: 910721 - RNA, 22 nt, Human
ggagaugcuuuccaguggggau

SEQ ID NO: 910722 - RNA, 22 nt, Human
aagauucucccugagauauuua

SEQ ID NO: 910723 - RNA, 22 nt, Human
uugaagcaugguacuuguucaa

SEQ ID NO: 910724 - RNA, 19 nt, Human
caagauuuguucacacaug

SEQ ID NO: 910725 - RNA, 22 nt, Human
caagaaucaacauuauuuagug

SEQ ID NO: 910726 - RNA, 22 nt, Human
aucaagcacuucuacaugacau

SEQ ID NO: 910727 - RNA, 22 nt, Human
uagaaucugaauguagagcuga

SEQ ID NO: 910728 - RNA, 21 nt, Human
ccuuuaugcaaggacuggcau

SEQ ID NO: 910729 - RNA, 22 nt, Human
ucacugcaaggaggcuucucaa

SEQ ID NO: 910730 - RNA, 22 nt, Human
aguuuccaaaaggagacaggga

SEQ ID NO: 910731 - RNA, 22 nt, Human
uauacagaaagaauucaagucu

SEQ ID NO: 910732 - RNA, 22 nt, Human
agaggccgggugccugcucaga

SEQ ID NO: 910733 - RNA, 22 nt, Human
ugagacaacagcuugugcugcu

SEQ ID NO: 910734 - RNA, 22 nt, Human
uuucaacaggaugauaauaggc

SEQ ID NO: 910735 - RNA, 22 nt, Human
aggcacuguggaagacaugguu

SEQ ID NO: 910736 - RNA, 22 nt, Human
ucuggaaauuucaguuuuagag

SEQ ID NO: 910737 - RNA, 18 nt, Human
uucaccagugugaugggu

SEQ ID NO: 910738 - RNA, 21 nt, Human
agcucuggagcagcaaucaag

SEQ ID NO: 910739 - RNA, 22 nt, Human
acagagguguuccagaccuagg

SEQ ID NO: 910740 - RNA, 22 nt, Human
ucuucaaauacagucauauuga

SEQ ID NO: 910741 - RNA, 22 nt, Human
agucagggccuggccugcugaa

SEQ ID NO: 910742 - RNA, 22 nt, Human
acaaaugagaauguagacagag

SEQ ID NO: 910743 - RNA, 22 nt, Human
cugucacucuggcaacccagua

SEQ ID NO: 910744 - RNA, 22 nt, Human
cucaggaugcaauuccaucaag

SEQ ID NO: 910745 - RNA, 22 nt, Human
ugugaaaucacaggcuauuuag

SEQ ID NO: 910746 - RNA, 22 nt, Human
gguugacagauauacauuguag

SEQ ID NO: 910747 - RNA, 22 nt, Human
cccaggccccagggcuugucag

SEQ ID NO: 910748 - RNA, 22 nt, Human
cuguccccgcgaguccagagcu

SEQ ID NO: 910749 - RNA, 22 nt, Human
ucaucugaacaugcagccugug

SEQ ID NO: 910750 - RNA, 19 nt, Human
uccugcccaccagccaggg

SEQ ID NO: 910751 - RNA, 22 nt, Human
uuggccuuguacaucauauuaa

SEQ ID NO: 910752 - RNA, 22 nt, Human
uuggucagaugugucuccuccu

SEQ ID NO: 910753 - RNA, 20 nt, Human
ucaagacagacauggaguuu

SEQ ID NO: 910754 - RNA, 18 nt, Human
ucucauaaaggggugugu

SEQ ID NO: 910755 - RNA, 22 nt, Human
aggaggcacucacucucagggu

SEQ ID NO: 910756 - RNA, 22 nt, Human
ucaguccaggggcugugauguc

SEQ ID NO: 910757 - RNA, 22 nt, Human
gaacagugccagcacacaauaa

SEQ ID NO: 910758 - RNA, 22 nt, Human
ucucccacgguacaggauaaac

SEQ ID NO: 910759 - RNA, 22 nt, Human
uggcaccugaacuuagaggugu

SEQ ID NO: 910760 - RNA, 22 nt, Human
uggagcugggguuugaaucugg

SEQ ID NO: 910761 - RNA, 21 nt, Human
uuucaauuugccuugagucau

SEQ ID NO: 910762 - RNA, 22 nt, Human
ugaaaacuugacaagugaggua

SEQ ID NO: 910763 - RNA, 22 nt, Human
uggcugggggugcuauagcugc

SEQ ID NO: 910764 - RNA, 22 nt, Human
auggcauuccaagucuucuuuu

SEQ ID NO: 910765 - RNA, 22 nt, Human
aagcuuuucucaguguccuugg

SEQ ID NO: 910766 - RNA, 22 nt, Human
uggcuucaguuccuguguuguu

SEQ ID NO: 910767 - RNA, 22 nt, Human
aaguuuuugauucuaagagaga

SEQ ID NO: 910768 - RNA, 22 nt, Human
gagucacaaaagaugcccaggg

SEQ ID NO: 910769 - RNA, 22 nt, Human
cugauucucugacucuuggcuu

SEQ ID NO: 910770 - RNA, 22 nt, Human
aaacagcaggaacaucuugcca

SEQ ID NO: 910771 - RNA, 22 nt, Human
ucagccuggcaggauggccugg

SEQ ID NO: 910772 - RNA, 22 nt, Human
gaaacguuguggaaaauccucu

SEQ ID NO: 910773 - RNA, 22 nt, Human
gugagucaauguauugcagcaa

SEQ ID NO: 910774 - RNA, 22 nt, Human
aaaaguuugugcaaacacucag

SEQ ID NO: 910775 - RNA, 22 nt, Human
agcacauuuuauuuaagaaaau

SEQ ID NO: 910776 - RNA, 22 nt, Human
uucaugaaacuuaacuguuggg

SEQ ID NO: 910777 - RNA, 22 nt, Human
uuagacauguuugcuaaaauga

SEQ ID NO: 910778 - RNA, 22 nt, Human
cuuauaaaguccaucugaacaa

SEQ ID NO: 910779 - RNA, 22 nt, Human
ucugaaaauguugacuuuguuu

SEQ ID NO: 910780 - RNA, 22 nt, Human
aaguauacuuaggcauaauggu

SEQ ID NO: 910781 - RNA, 22 nt, Human
uacaggauaucacuucauuucu

SEQ ID NO: 910782 - RNA, 22 nt, Human
aagcagcuuaaauuagagccug

SEQ ID NO: 910783 - RNA, 22 nt, Human
agguggccccaggccucugcca

SEQ ID NO: 910784 - RNA, 22 nt, Human
auuggaaaauaugguuucugga

SEQ ID NO: 910785 - RNA, 22 nt, Human
caagacaauggguaaguguaac

SEQ ID NO: 910786 - RNA, 22 nt, Human
ccagagagggcgccaccuggag

SEQ ID NO: 910787 - RNA, 22 nt, Human
caaauguugcuguaauguuugu

SEQ ID NO: 910788 - RNA, 22 nt, Human
ucucccauucagcuugcaguca

SEQ ID NO: 910789 - RNA, 22 nt, Human
ugagguagugcuugucauguuu

SEQ ID NO: 910790 - RNA, 18 nt, Human
aggggcagcuugugugga

SEQ ID NO: 910791 - RNA, 22 nt, Human
uuugaaauaugaggcauuauga

SEQ ID NO: 910792 - RNA, 23 nt, Human
uuagagaugauuaaaaaaucuug

SEQ ID NO: 910793 - RNA, 22 nt, Human
guucuagccuggggcuccuugg

SEQ ID NO: 910794 - RNA, 22 nt, Human
uuugagaaaaagugaugaugau

SEQ ID NO: 910795 - RNA, 22 nt, Human
ucuuuaugccuaccugggaaga

SEQ ID NO: 910796 - RNA, 20 nt, Human
ccacauuuuacuguuugcca

SEQ ID NO: 910797 - RNA, 22 nt, Human
uagcugcacaggaaguaagauu

SEQ ID NO: 910798 - RNA, 22 nt, Human
cugucccuucccaagcccagcc

SEQ ID NO: 910799 - RNA, 22 nt, Human
ggcaguggcuccucucuacucc

SEQ ID NO: 910800 - RNA, 22 nt, Human
uccugaccauuccuugucucca

SEQ ID NO: 910801 - RNA, 22 nt, Human
ucaguguagggcagaccccugg

SEQ ID NO: 910802 - RNA, 22 nt, Human
auggcagccugaacacuuccug

SEQ ID NO: 910803 - RNA, 22 nt, Human
aaaggaggaauggagagaugcu

SEQ ID NO: 910804 - RNA, 22 nt, Human
uagcauuaucugucuuaucauu

SEQ ID NO: 910805 - RNA, 22 nt, Human
augaaagugaagguuuacuaag

SEQ ID NO: 910806 - RNA, 22 nt, Human
gugauaagacaguaggcacaag

SEQ ID NO: 910807 - RNA, 22 nt, Human
auucuacacaaagcaagaagac

SEQ ID NO: 910808 - RNA, 22 nt, Human
auaaagcaucuagucugucacu

SEQ ID NO: 910809 - RNA, 22 nt, Human
gcuguguaggauccuguuguau

SEQ ID NO: 910810 - RNA, 22 nt, Human
aaacucuaaucaaauauagcau

SEQ ID NO: 910811 - RNA, 22 nt, Human
ucuaaauuacuuugggcaguau

SEQ ID NO: 910812 - RNA, 22 nt, Human
caggccacacggcggcucccug

SEQ ID NO: 910813 - RNA, 22 nt, Human
acuuuagaaguaaggaugaguu

SEQ ID NO: 910814 - RNA, 22 nt, Human
gcuggcccagggucaccuagga

SEQ ID NO: 910815 - RNA, 22 nt, Human
aaagauaugucuccaaagagau

SEQ ID NO: 910816 - RNA, 22 nt, Human
ugggagugcaccugggacacga

SEQ ID NO: 910817 - RNA, 22 nt, Human
gcuuuagagaagaaagguugcu

SEQ ID NO: 910818 - RNA, 22 nt, Human
uggcuuccagagcugcuccacc

SEQ ID NO: 910819 - RNA, 22 nt, Human
ugcagcugaggccagcuaugcc

SEQ ID NO: 910820 - RNA, 22 nt, Human
acucugagaaucccuggacuuu

SEQ ID NO: 910821 - RNA, 22 nt, Human
cacuaguggccccaugugguug

SEQ ID NO: 910822 - RNA, 22 nt, Human
gguaccaccaauucagcugcca

SEQ ID NO: 910823 - RNA, 22 nt, Human
agcuggcaucgagcauuugaac

SEQ ID NO: 910824 - RNA, 20 nt, Human
ugccuuuuauaccuuuaaac

SEQ ID NO: 910825 - RNA, 22 nt, Human
ggcagugccacuaagcucugcu

SEQ ID NO: 910826 - RNA, 22 nt, Human
ugcuuaaaauuuuccaaggauu

SEQ ID NO: 910827 - RNA, 22 nt, Human
ggcaguguuccagaccuucacc

SEQ ID NO: 910828 - RNA, 20 nt, Human
ccaggcaacuauccugucuc

SEQ ID NO: 910829 - RNA, 22 nt, Human
acuaaguuguagucacacaucc

SEQ ID NO: 910830 - RNA, 18 nt, Human
aaauuauucuuccuuuuc

SEQ ID NO: 910831 - RNA, 22 nt, Human
cccuggagcaucucugcugucu

SEQ ID NO: 910832 - RNA, 22 nt, Human
gugcaggaguaggagagggcuu

SEQ ID NO: 910833 - RNA, 22 nt, Human
uuuaacagaugaggaggugagg

SEQ ID NO: 910834 - RNA, 22 nt, Human
auacacuuguacauuuuuuaau

SEQ ID NO: 910835 - RNA, 21 nt, Human
cuacacagcuuucuauaggaa

SEQ ID NO: 910836 - RNA, 23 nt, Human
ugacccuugaugguugacgugca

SEQ ID NO: 910837 - RNA, 22 nt, Human
acauuuuucuaggaggcaaggu

SEQ ID NO: 910838 - RNA, 22 nt, Human
acuucaugaacauguggccugu

SEQ ID NO: 910839 - RNA, 22 nt, Human
gcaguguuaggaauaaaaauga

SEQ ID NO: 910840 - RNA, 19 nt, Human
gcugccugucuuagccagu

SEQ ID NO: 910841 - RNA, 22 nt, Human
cugggccagggaggugucugua

SEQ ID NO: 910842 - RNA, 22 nt, Human
uucuucugugaggugugugccu

SEQ ID NO: 910843 - RNA, 22 nt, Human
agugacagggaaggauaggauu

SEQ ID NO: 910844 - RNA, 22 nt, Human
ggaagaaaguagaaaaccgugg

SEQ ID NO: 910845 - RNA, 22 nt, Human
caggggcgguggcucacgccug

SEQ ID NO: 910846 - RNA, 22 nt, Human
auauaauuuuugguuagcucaa

SEQ ID NO: 910847 - RNA, 22 nt, Human
uucagugagugaaugaaugaau

SEQ ID NO: 910848 - RNA, 22 nt, Human
gcagcuguaucacuuuuaaaca

SEQ ID NO: 910849 - RNA, 22 nt, Human
cucuggguguuaaugucagugu

SEQ ID NO: 910850 - RNA, 22 nt, Human
ggcagaggugaaguucacaagg

SEQ ID NO: 910851 - RNA, 22 nt, Human
uucaacaaugcacuugaguaua

SEQ ID NO: 910852 - RNA, 22 nt, Human
uucuucuuuccaauuacauggu

SEQ ID NO: 910853 - RNA, 22 nt, Human
aagcagugcgcucaucuaaggg

SEQ ID NO: 910854 - RNA, 22 nt, Human
uaauuucaauagcuugcauaau

SEQ ID NO: 910855 - RNA, 22 nt, Human
gagucuccuacuggcuguccuu

SEQ ID NO: 910856 - RNA, 22 nt, Human
caagguuucuaugcucaaagga

SEQ ID NO: 910857 - RNA, 22 nt, Human
ucacuuuuugauaucauucugc

SEQ ID NO: 910858 - RNA, 22 nt, Human
auucaaacaggaagaaaucauu

SEQ ID NO: 910859 - RNA, 22 nt, Human
uagcccagaaagcaaaugucuc

SEQ ID NO: 910860 - RNA, 22 nt, Human
uguaaacuagggcugauaaggg

SEQ ID NO: 910861 - RNA, 20 nt, Human
gccuggaggcagagauaaag

SEQ ID NO: 910862 - RNA, 22 nt, Human
ggcagcuccucucagcaaaaga

SEQ ID NO: 910863 - RNA, 22 nt, Human
uggcacuggcgcaggauggcgg

SEQ ID NO: 910864 - RNA, 21 nt, Human
uuccuuuuuauggcuuagugg

SEQ ID NO: 910865 - RNA, 19 nt, Human
ccugucugucuucagcuag

SEQ ID NO: 910866 - RNA, 22 nt, Human
guaaccugucggaaagccuugu

SEQ ID NO: 910867 - RNA, 22 nt, Human
uaaauguaaauggcgucuugcg

SEQ ID NO: 910868 - RNA, 23 nt, Human
agggcugaaugcagagaagcaga

SEQ ID NO: 910869 - RNA, 22 nt, Human
agugucacaaaccugccuugua

SEQ ID NO: 910870 - RNA, 22 nt, Human
aggcuggugccugcagugaauc

SEQ ID NO: 910871 - RNA, 22 nt, Human
uuuuaugaagauaauuuucuga

SEQ ID NO: 910872 - RNA, 20 nt, Human
agugcaagaaagcacagcug

SEQ ID NO: 910873 - RNA, 22 nt, Human
cccaacacucaccuccggauua

SEQ ID NO: 910874 - RNA, 22 nt, Human
ugcuuugugauaugcugugucu

SEQ ID NO: 910875 - RNA, 22 nt, Human
aaguacauguugcucaacagcc

SEQ ID NO: 910876 - RNA, 22 nt, Human
uagcaccaugauggaagagcug

SEQ ID NO: 910877 - RNA, 22 nt, Human
agcagcucaacagugucucuau

SEQ ID NO: 910878 - RNA, 22 nt, Human
ccccagcccacaagcauauuaa

SEQ ID NO: 910879 - RNA, 22 nt, Human
aagcagcagaccugauuuugaa

SEQ ID NO: 910880 - RNA, 22 nt, Human
uggcaguguugugccacauucc

SEQ ID NO: 910881 - RNA, 22 nt, Human
ugaggcucuuccuccccugcuc

SEQ ID NO: 910882 - RNA, 22 nt, Human
caaaaguaauuaugguuuuugc

SEQ ID NO: 910883 - RNA, 22 nt, Human
uuuccuuccuugcuagccugag

SEQ ID NO: 910884 - RNA, 22 nt, Human
cuguccauugguauauuagggu

SEQ ID NO: 910885 - RNA, 22 nt, Human
auagacaaacacgaagaugaca

SEQ ID NO: 910886 - RNA, 22 nt, Human
ugacccuucccuucaguuggcu

SEQ ID NO: 910887 - RNA, 22 nt, Human
gaaggcugccaguggcccucuu

SEQ ID NO: 910888 - RNA, 22 nt, Human
uauuaucauguuaauuaguggg

SEQ ID NO: 910889 - RNA, 22 nt, Human
acugugaugaugaagcaugguu

SEQ ID NO: 910890 - RNA, 22 nt, Human
acauuuccuaacguauacacug

SEQ ID NO: 910891 - RNA, 23 nt, Human
auuuacagguuaaaugaaaucag

SEQ ID NO: 910892 - RNA, 22 nt, Human
agcaggaaagaaaaaucugugu

SEQ ID NO: 910893 - RNA, 22 nt, Human
acaguguuuuagaaaagcuuga

SEQ ID NO: 910894 - RNA, 18 nt, Human
agggccagcugugaguag

SEQ ID NO: 910895 - RNA, 22 nt, Human
ucacccaggcugguaugcagug

SEQ ID NO: 910896 - RNA, 22 nt, Human
cguuaauaggugcaagguaagg

SEQ ID NO: 910897 - RNA, 22 nt, Human
uggguguguccauauuuugacu

SEQ ID NO: 910898 - RNA, 22 nt, Human
gcaaauguggcuuccuuucuag

SEQ ID NO: 910899 - RNA, 22 nt, Human
acaauagaaggaaacugacaua

SEQ ID NO: 910900 - RNA, 21 nt, Human
aagaaguuuggauuuuguccu

SEQ ID NO: 910901 - RNA, 22 nt, Human
augcccugaggaaugucacgcu

SEQ ID NO: 910902 - RNA, 21 nt, Human
ggccaguggaauuuuauguca

SEQ ID NO: 910903 - RNA, 22 nt, Human
gccaguaagugguagagacuua

SEQ ID NO: 910904 - RNA, 22 nt, Human
cugcuugaccuguuguucucac

SEQ ID NO: 910905 - RNA, 22 nt, Human
gcauagaauuuagagacaaaag

SEQ ID NO: 910906 - RNA, 22 nt, Human
ccugggaugcuguccucaucua

SEQ ID NO: 910907 - RNA, 22 nt, Human
aacuguaauuuuuacauaguaa

SEQ ID NO: 910908 - RNA, 22 nt, Human
gccugucugcgucacgcuuauu

SEQ ID NO: 910909 - RNA, 22 nt, Human
agugucugcgggcagaggagcg

SEQ ID NO: 910910 - RNA, 22 nt, Human
ugaaggagggaagaaggcucug

SEQ ID NO: 910911 - RNA, 22 nt, Human
accuacuaauugagauaauagg

SEQ ID NO: 910912 - RNA, 22 nt, Human
auucuuucaaggaauaguuauu

SEQ ID NO: 910913 - RNA, 23 nt, Human
uccagcagccaagaaggguagaa

SEQ ID NO: 910914 - RNA, 22 nt, Human
cugcacacauauggcuucucuc

SEQ ID NO: 910915 - RNA, 22 nt, Human
gcuacagauuuaucauguuaua

SEQ ID NO: 910916 - RNA, 22 nt, Human
gcagagcucaugccugcaccuc

SEQ ID NO: 910917 - RNA, 21 nt, Human
ucugggugcuaguguuugcuu

SEQ ID NO: 910918 - RNA, 20 nt, Human
gcaaggcagguugaccaaga

SEQ ID NO: 910919 - RNA, 22 nt, Human
ucuccugguauguaugcaccug

SEQ ID NO: 910920 - RNA, 22 nt, Human
cuggcagcuuccuuugcaucug

SEQ ID NO: 910921 - RNA, 22 nt, Human
gcugaguguaaugauggcagag

SEQ ID NO: 910922 - RNA, 22 nt, Human
uguauuccaaaaugcugaggau

SEQ ID NO: 910923 - RNA, 22 nt, Human
uuucuguaaagaccaagccagc

SEQ ID NO: 910924 - RNA, 22 nt, Human
gugcugggugcugcagacaggu

SEQ ID NO: 910925 - RNA, 22 nt, Human
uuccuucucagcccucgaggau

SEQ ID NO: 910926 - RNA, 22 nt, Human
gagagaagaauguuccgaggcc

SEQ ID NO: 910927 - RNA, 22 nt, Human
cuggcccaggcuccuggggcac

SEQ ID NO: 910928 - RNA, 22 nt, Human
ucaaacaucuaaacuacccacu

SEQ ID NO: 910929 - RNA, 22 nt, Human
ucagugaaaugcauauucuucg

SEQ ID NO: 910930 - RNA, 22 nt, Human
uugguuaaaaucaaauuaauca

SEQ ID NO: 910931 - RNA, 22 nt, Human
cagcacauaagccgaagacugu

SEQ ID NO: 910932 - RNA, 22 nt, Human
uggucaaaagcuacuaugaaug

SEQ ID NO: 910933 - RNA, 19 nt, Human
auuagcagacuuccuuuca

SEQ ID NO: 910934 - RNA, 22 nt, Human
cuguccugcaguugggggcagg

SEQ ID NO: 910935 - RNA, 20 nt, Human
uccaggagaacugggagccg

SEQ ID NO: 910936 - RNA, 22 nt, Human
gcucuguguuuugcccaggaga

SEQ ID NO: 910937 - RNA, 22 nt, Human
agacaauggcuaaguaaccugu

SEQ ID NO: 910938 - RNA, 22 nt, Human
auacaucauuuauggaauaagg

SEQ ID NO: 910939 - RNA, 22 nt, Human
uaacuucugcacagaaaauuug

SEQ ID NO: 910940 - RNA, 22 nt, Human
auucuuuccagacacugauugc

SEQ ID NO: 910941 - RNA, 19 nt, Human
agaguuuaggucuaucagg

SEQ ID NO: 910942 - RNA, 22 nt, Human
agcuugcacagagaauacagua

SEQ ID NO: 910943 - RNA, 22 nt, Human
ucagaggcuucuggccagucug

SEQ ID NO: 910944 - RNA, 22 nt, Human
gcaauagauuaugaucuacagu

SEQ ID NO: 910945 - RNA, 22 nt, Human
acugaauagcccuucugucucc

SEQ ID NO: 910946 - RNA, 22 nt, Human
uucuacauugugaaguucuuua

SEQ ID NO: 910947 - RNA, 22 nt, Human
agaaucugcauuuuuaauaaca

SEQ ID NO: 910948 - RNA, 22 nt, Human
uauuucuuguuauucucguuga

SEQ ID NO: 910949 - RNA, 22 nt, Human
uagcagaggaaaagagaacauu

SEQ ID NO: 910950 - RNA, 22 nt, Human
aaggcuauguguuaaggcagau

SEQ ID NO: 910951 - RNA, 22 nt, Human
cauuaugaagcaucaucuuauu

SEQ ID NO: 910952 - RNA, 23 nt, Human
gaaaucuagucauuuuuagucug

SEQ ID NO: 910953 - RNA, 22 nt, Human
gcaggagaaaugaagauugggu

SEQ ID NO: 910954 - RNA, 22 nt, Human
aagaguuaagcaacagauacca

SEQ ID NO: 910955 - RNA, 22 nt, Human
uuuauucucuaguuggucagau

SEQ ID NO: 910956 - RNA, 22 nt, Human
uuguuacaucuuauguaagugg

SEQ ID NO: 910957 - RNA, 22 nt, Human
gaguggcuaaaguaugucaugg

SEQ ID NO: 910958 - RNA, 22 nt, Human
ugucugaacaaacucugccucc

SEQ ID NO: 910959 - RNA, 23 nt, Human
uggccugcagaguuucugcuggg

SEQ ID NO: 910960 - RNA, 22 nt, Human
ggcugccuucccugagccccgg

SEQ ID NO: 910961 - RNA, 22 nt, Human
ugcagggccccucugcaugagu

SEQ ID NO: 910962 - RNA, 17 nt, Human
caggcuccuuccagauu

SEQ ID NO: 910963 - RNA, 22 nt, Human
ugucacacugaccacaucugua

SEQ ID NO: 910964 - RNA, 22 nt, Human
ugccucagucagcuucccuggg

SEQ ID NO: 910965 - RNA, 22 nt, Human
auuucuuaucugaggucuacau

SEQ ID NO: 910966 - RNA, 22 nt, Human
cucugcauuuuaacagaugauu

SEQ ID NO: 910967 - RNA, 18 nt, Human
ggacccagggccucaccc

SEQ ID NO: 910968 - RNA, 22 nt, Human
agcugucugugaacacagcauu

SEQ ID NO: 910969 - RNA, 22 nt, Human
uguccaggcucccuuggugcug

SEQ ID NO: 910970 - RNA, 22 nt, Human
ucuccacaaguguugagaguac

SEQ ID NO: 910971 - RNA, 22 nt, Human
ucugccacacugguucagugga

SEQ ID NO: 910972 - RNA, 21 nt, Human
gccagcugcagggcuuccuug

SEQ ID NO: 910973 - RNA, 22 nt, Human
gccuaagauuguguuuuccuga

SEQ ID NO: 910974 - RNA, 22 nt, Human
aaaaguaauugcaguuuuugcc

SEQ ID NO: 910975 - RNA, 19 nt, Human
aauagauuaauuauccucu

SEQ ID NO: 910976 - RNA, 22 nt, Human
ucucagaaaaaggagaaacugg

SEQ ID NO: 910977 - RNA, 22 nt, Human
aucuuaugagacccauaaagau

SEQ ID NO: 910978 - RNA, 22 nt, Human
cagagcuucugacagcugcugc

SEQ ID NO: 910979 - RNA, 22 nt, Human
ggcugaguugagaggauuacuu

SEQ ID NO: 910980 - RNA, 22 nt, Human
cacaggcucuccagggccugga

SEQ ID NO: 910981 - RNA, 22 nt, Human
cagauauuaggagcucaauaau

SEQ ID NO: 910982 - RNA, 22 nt, Human
agagacagaggcaauauagcuu

SEQ ID NO: 910983 - RNA, 22 nt, Human
agguauuucauggagcaagcag

SEQ ID NO: 910984 - RNA, 22 nt, Human
ugugucaggccuuaucgguggc

SEQ ID NO: 910985 - RNA, 22 nt, Human
cugcccacuuggccaccuucua

SEQ ID NO: 910986 - RNA, 22 nt, Human
ggugcugauauuguuuugguga

SEQ ID NO: 910987 - RNA, 20 nt, Human
uggagcugugguaaggagca

SEQ ID NO: 910988 - RNA, 22 nt, Human
uagauuuguuuccuucucucca

SEQ ID NO: 910989 - RNA, 22 nt, Human
uuuccaaauaaggucacacuca

SEQ ID NO: 910990 - RNA, 21 nt, Human
ggugcagguaaugaugauaua

SEQ ID NO: 910991 - RNA, 22 nt, Human
gaaggcauuucagagaucucug

SEQ ID NO: 910992 - RNA, 22 nt, Human
agaaucaaagagaaauacuuug

SEQ ID NO: 910993 - RNA, 22 nt, Human
uuucaguugcagugguugucua

SEQ ID NO: 910994 - RNA, 22 nt, Human
ugacagggggcagagguggcug

SEQ ID NO: 910995 - RNA, 20 nt, Human
ucuuuagauuuaucuuaugu

SEQ ID NO: 910996 - RNA, 22 nt, Human
ugagguagcugcuauuuguagu

SEQ ID NO: 910997 - RNA, 22 nt, Human
aagggaaacuuucacaaugucc

SEQ ID NO: 910998 - RNA, 19 nt, Human
uugaaauuguuugauaugg

SEQ ID NO: 910999 - RNA, 22 nt, Human
cuagcaucucacugauuuacug

SEQ ID NO: 911000 - RNA, 21 nt, Human
uacaacagguuuuauuucgau

SEQ ID NO: 911001 - RNA, 19 nt, Human
uacaggcaguuucuacaau

SEQ ID NO: 911002 - RNA, 22 nt, Human
auccaauggggagugaguucuu

SEQ ID NO: 911003 - RNA, 22 nt, Human
aauagccaaagugcauuuauga

SEQ ID NO: 911004 - RNA, 22 nt, Human
gucuuucuaugaugaacuguug

SEQ ID NO: 911005 - RNA, 22 nt, Human
agagauauggaugucagaaacu

SEQ ID NO: 911006 - RNA, 22 nt, Human
guauggaucaccugaggucagc

SEQ ID NO: 911007 - RNA, 22 nt, Human
ucaaauggguaugcuuuauaau

SEQ ID NO: 911008 - RNA, 22 nt, Human
ucagucacuuuugccugcuaca

SEQ ID NO: 911009 - RNA, 22 nt, Human
gagggcacaaaggcaacauuca

SEQ ID NO: 911010 - RNA, 22 nt, Human
ugggaagggucaguuucuucau

SEQ ID NO: 911011 - RNA, 22 nt, Human
acagccuguuugaucuggugcu

SEQ ID NO: 911012 - RNA, 22 nt, Human
uacaggaaguaaguaaugaaau

SEQ ID NO: 911013 - RNA, 22 nt, Human
uucuacacaccucugaggacau

SEQ ID NO: 911014 - RNA, 22 nt, Human
guggcagggcaaugcucccucu

SEQ ID NO: 911015 - RNA, 23 nt, Human
gcagagguuuuucaguaugguuu

SEQ ID NO: 911016 - RNA, 22 nt, Human
acaggcugacuuccugccaugu

SEQ ID NO: 911017 - RNA, 22 nt, Human
ucaggcaggcagagggcaaaug

SEQ ID NO: 911018 - RNA, 22 nt, Human
uuuagaaauucaucuauggccu

SEQ ID NO: 911019 - RNA, 22 nt, Human
agggagaggagggucuuguuga

SEQ ID NO: 911020 - RNA, 22 nt, Human
aaccauugauacaugcaacaau

SEQ ID NO: 911021 - RNA, 22 nt, Human
uguuaaaaaugcagauuccuau

SEQ ID NO: 911022 - RNA, 22 nt, Human
gccugccugaaggcuguaccag

SEQ ID NO: 911023 - RNA, 22 nt, Human
cugccugggccaugcccagucc

SEQ ID NO: 911024 - RNA, 22 nt, Human
ugaaggcauuugaguuggugag

SEQ ID NO: 911025 - RNA, 18 nt, Human
uuacuacagcacuuucuu

SEQ ID NO: 911026 - RNA, 23 nt, Human
agcuccagcugacgugggcagcc

SEQ ID NO: 911027 - RNA, 22 nt, Human
cuguuguucaucaucugucauu

SEQ ID NO: 911028 - RNA, 22 nt, Human
cuuaaacugaaagcuacaagau

SEQ ID NO: 911029 - RNA, 22 nt, Human
ucgcagaccgcggugcacgugg

SEQ ID NO: 911030 - RNA, 22 nt, Human
cucugccaucaguuuuucuuug

SEQ ID NO: 911031 - RNA, 22 nt, Human
ugugugugaaccauugagggcu

SEQ ID NO: 911032 - RNA, 22 nt, Human
cagcagcuaccugcucuugugg

SEQ ID NO: 911033 - RNA, 22 nt, Human
ugguauauuuugcucuauggug

SEQ ID NO: 911034 - RNA, 21 nt, Human
uagaaugcuauugucuuuucu

SEQ ID NO: 911035 - RNA, 22 nt, Human
acaagcuuauuaaguuaucugu

SEQ ID NO: 911036 - RNA, 22 nt, Human
gagccaggggucagcuccgagg

SEQ ID NO: 911037 - RNA, 22 nt, Human
cccuggagaggacucaccccug

SEQ ID NO: 911038 - RNA, 19 nt, Human
aggcaaccaaugaggcaaa

SEQ ID NO: 911039 - RNA, 22 nt, Human
uaacaguacauccuuuucucuu

SEQ ID NO: 911040 - RNA, 22 nt, Human
auacaaauccucugggauggua

SEQ ID NO: 911041 - RNA, 22 nt, Human
auuaugucuuuagauauuuggu

SEQ ID NO: 911042 - RNA, 22 nt, Human
cugggccacuccagaugcccac

SEQ ID NO: 911043 - RNA, 22 nt, Human
gaggccaggggccuggagauga

SEQ ID NO: 911044 - RNA, 22 nt, Human
aagauauagauaaaacuaugca

SEQ ID NO: 911045 - RNA, 22 nt, Human
ggcugcucugccuuccagcugg

SEQ ID NO: 911046 - RNA, 22 nt, Human
gggagggccaggcucacccagg

SEQ ID NO: 911047 - RNA, 22 nt, Human
cugggcucccucaugugucugc

SEQ ID NO: 911048 - RNA, 22 nt, Human
gaggccaggaggaucucucuaa

SEQ ID NO: 911049 - RNA, 22 nt, Human
uagcagcucacagccucccauu

SEQ ID NO: 911050 - RNA, 22 nt, Human
cccaggcuccugacucauucua

SEQ ID NO: 911051 - RNA, 22 nt, Human
ggugccuguauuuggggcacag

SEQ ID NO: 911052 - RNA, 22 nt, Human
gcagagccaggcuggggcaggu

SEQ ID NO: 911053 - RNA, 22 nt, Human
cuguaggagugggaauuuauug

SEQ ID NO: 911054 - RNA, 22 nt, Human
uuggcagcagggaguuggccgc

SEQ ID NO: 911055 - RNA, 22 nt, Human
gaaacuucuugucucacaguuc

SEQ ID NO: 911056 - RNA, 22 nt, Human
ugccugagggaguaagaguccu

SEQ ID NO: 911057 - RNA, 22 nt, Human
uaguuucuuucacguaguaaua

SEQ ID NO: 911058 - RNA, 22 nt, Human
ccaggagcccugccacaauggu

SEQ ID NO: 911059 - RNA, 22 nt, Human
cagagcccugcaugcuccaucu

SEQ ID NO: 911060 - RNA, 22 nt, Human
aaauaauuauagcgagucuauc

SEQ ID NO: 911061 - RNA, 22 nt, Human
ggagacagugacuuagagacug

SEQ ID NO: 911062 - RNA, 23 nt, Human
ugacaacagcucucagccauguc

SEQ ID NO: 911063 - RNA, 22 nt, Human
aucaaaaccuugacuuuuaaug

SEQ ID NO: 911064 - RNA, 22 nt, Human
gcuguggguaaacgcugagggu

SEQ ID NO: 911065 - RNA, 22 nt, Human
auugcuuuguacaugccuagca

SEQ ID NO: 911066 - RNA, 22 nt, Human
ucugggcugggagcguguggac

SEQ ID NO: 911067 - RNA, 22 nt, Human
cacuuagagccagaugcauagu

SEQ ID NO: 911068 - RNA, 22 nt, Human
ggacugggagaauggaggcaag

SEQ ID NO: 911069 - RNA, 22 nt, Human
cucuggguggucucacugagug

SEQ ID NO: 911070 - RNA, 22 nt, Human
cugcugggcagaggcugcauga

SEQ ID NO: 911071 - RNA, 22 nt, Human
aggaaacagagugaagcuuggg

SEQ ID NO: 911072 - RNA, 22 nt, Human
cuguuuuaugaagggaaugaga

SEQ ID NO: 911073 - RNA, 22 nt, Human
aggccuggcaugagaccugaga

SEQ ID NO: 911074 - RNA, 22 nt, Human
ugugacuguggacuuuuguggg

SEQ ID NO: 911075 - RNA, 22 nt, Human
guaucacacuagaaugcauuca

SEQ ID NO: 911076 - RNA, 22 nt, Human
uagagguguucauucucuccau

SEQ ID NO: 911077 - RNA, 22 nt, Human
ucagggcacguuucugcaaugc

SEQ ID NO: 911078 - RNA, 22 nt, Human
ugugggcaaaggguagcugggu

SEQ ID NO: 911079 - RNA, 22 nt, Human
gaggaaggucccaucagaauuu

SEQ ID NO: 911080 - RNA, 22 nt, Human
cugggcagagcuaacaccugag

SEQ ID NO: 911081 - RNA, 22 nt, Human
agcccucugagcuagucaccau

SEQ ID NO: 911082 - RNA, 22 nt, Human
agagcuguucaacguagcaaug

SEQ ID NO: 911083 - RNA, 22 nt, Human
uaacagaaauagaaaugagagu

SEQ ID NO: 911084 - RNA, 23 nt, Human
uggacccugcacaccagcucuac

SEQ ID NO: 911085 - RNA, 22 nt, Human
aaguaucuuucuagcaacuaaa

SEQ ID NO: 911086 - RNA, 22 nt, Human
aacagauuugugaagcuacuca

SEQ ID NO: 911087 - RNA, 22 nt, Human
ccagccagcugguuggacgccu

SEQ ID NO: 911088 - RNA, 22 nt, Human
gcgcgcuaccgccagggcugca

SEQ ID NO: 911089 - RNA, 22 nt, Human
uggcagagacaaggccgggccu

SEQ ID NO: 911090 - RNA, 22 nt, Human
ggcaguggugggaggcucgcuc

SEQ ID NO: 911091 - RNA, 22 nt, Human
aaagcaucagaucugacacuuc

SEQ ID NO: 911092 - RNA, 22 nt, Human
caggcacugugcugagcucugc

SEQ ID NO: 911093 - RNA, 22 nt, Human
cuggcuccacucccugccugac

SEQ ID NO: 911094 - RNA, 22 nt, Human
aagccacaaucugcaucagcau

SEQ ID NO: 911095 - RNA, 22 nt, Human
guguuuaacaucugguuuauac

SEQ ID NO: 911096 - RNA, 22 nt, Human
ucaaagcaucagucaauuuagg

SEQ ID NO: 911097 - RNA, 22 nt, Human
cugaggaggggccugagugaga

SEQ ID NO: 911098 - RNA, 22 nt, Human
uugcccagagucacccagcuca

SEQ ID NO: 911099 - RNA, 22 nt, Human
ucucuguaaggaagaauuagau

SEQ ID NO: 911100 - RNA, 22 nt, Human
agaggaagcugagaugccucuu

SEQ ID NO: 911101 - RNA, 22 nt, Human
acugaaauggggacaguccuua

SEQ ID NO: 911102 - RNA, 22 nt, Human
cccaggacucggcacucuccuu

SEQ ID NO: 911103 - RNA, 22 nt, Human
auucucaauggcuacuuucaua

SEQ ID NO: 911104 - RNA, 22 nt, Human
gagcugagauuugaagcaaguu

SEQ ID NO: 911105 - RNA, 22 nt, Human
uuucuuccuggauuccuacuuc

SEQ ID NO: 911106 - RNA, 22 nt, Human
gaacacugggguaucauugagc

SEQ ID NO: 911107 - RNA, 22 nt, Human
auguauaugcaugcauucaaag

SEQ ID NO: 911108 - RNA, 22 nt, Human
uuccugugguccagagucaucc

SEQ ID NO: 911109 - RNA, 22 nt, Human
ucccuguggaagacugccagag

SEQ ID NO: 911110 - RNA, 22 nt, Human
auacucaagguuaaugauugaa

SEQ ID NO: 911111 - RNA, 22 nt, Human
uucugauaacaaacaccaauuu

SEQ ID NO: 911112 - RNA, 22 nt, Human
guuucacagucugcagaauuuu

SEQ ID NO: 911113 - RNA, 22 nt, Human
gcccaauaguggggauauaccu

SEQ ID NO: 911114 - RNA, 22 nt, Human
caguguuuagaucaagaaggcc

SEQ ID NO: 911115 - RNA, 22 nt, Human
ccugugugauuggaagcugaga

SEQ ID NO: 911116 - RNA, 22 nt, Human
uggaugaguucaaugaggcaga

SEQ ID NO: 911117 - RNA, 22 nt, Human
guccaggcugcccaggguccug

SEQ ID NO: 911118 - RNA, 23 nt, Human
caggacaugggaggaaguauggc

SEQ ID NO: 911119 - RNA, 22 nt, Human
aaaggcuccuucucccaugacc

SEQ ID NO: 911120 - RNA, 22 nt, Human
agcagcaagcagugcacggguu

SEQ ID NO: 911121 - RNA, 22 nt, Human
gcuggcuccucuguccucacgg

SEQ ID NO: 911122 - RNA, 22 nt, Human
uccaacuccaccuuugucuccc

SEQ ID NO: 911123 - RNA, 22 nt, Human
ugaucuuugguaaucuggcaca

SEQ ID NO: 911124 - RNA, 18 nt, Human
agccugggcucugccugg

SEQ ID NO: 911125 - RNA, 22 nt, Human
uucaugugauaaaugugugacu

SEQ ID NO: 911126 - RNA, 22 nt, Human
cacacaugugagcagagaggcg

SEQ ID NO: 911127 - RNA, 22 nt, Human
agcagcagucaugccuaugcuc

SEQ ID NO: 911128 - RNA, 22 nt, Human
uacaguaccugccacguuguug

SEQ ID NO: 911129 - RNA, 22 nt, Human
ucaugauacccaaguaccuaga

SEQ ID NO: 911130 - RNA, 22 nt, Human
uuaggaauauuuucugaguagu

SEQ ID NO: 911131 - RNA, 22 nt, Human
gugugucuugaccaggaucgga

SEQ ID NO: 911132 - RNA, 22 nt, Human
gugccugcugcagagucgcugu

SEQ ID NO: 911133 - RNA, 22 nt, Human
aucacugggcuucuaaucacug

SEQ ID NO: 911134 - RNA, 22 nt, Human
uaaggcuuuauuuuuacaaugc

SEQ ID NO: 911135 - RNA, 22 nt, Human
ucugucacuauuggccagaaca

SEQ ID NO: 911136 - RNA, 22 nt, Human
auucaaagaucaugaucucuac

SEQ ID NO: 911137 - RNA, 22 nt, Human
agaggcugcacuugcucaugau

SEQ ID NO: 911138 - RNA, 22 nt, Human
caaagugcugagauuacaggua

SEQ ID NO: 911139 - RNA, 22 nt, Human
ccagcucugccaagcgucagcu

SEQ ID NO: 911140 - RNA, 22 nt, Human
ugguggcaaaguacaaagugac

SEQ ID NO: 911141 - RNA, 22 nt, Human
uaucaguuuauucuauaaauag

SEQ ID NO: 911142 - RNA, 22 nt, Human
gccucccuuggugucucccggg

SEQ ID NO: 911143 - RNA, 22 nt, Human
ccucacagagcccagaugucua

SEQ ID NO: 911144 - RNA, 22 nt, Human
ucaggcagcauuaaacuucagc

SEQ ID NO: 911145 - RNA, 22 nt, Human
guuuccuggagguuauuuuuga

SEQ ID NO: 911146 - RNA, 21 nt, Human
aaaaggaggcaggugaacagc

SEQ ID NO: 911147 - RNA, 22 nt, Human
cugugcuucgcaacuccaaggu

SEQ ID NO: 911148 - RNA, 22 nt, Human
aggcagcaaaugucuggaacag

SEQ ID NO: 911149 - RNA, 17 nt, Human
guuugcaugguguuaac

SEQ ID NO: 911150 - RNA, 22 nt, Human
aaaagcaguaaauguaugaccu

SEQ ID NO: 911151 - RNA, 22 nt, Human
uuucaaagucaauaucauuacc

SEQ ID NO: 911152 - RNA, 22 nt, Human
ucaaacugaauuaaacacuugu

SEQ ID NO: 911153 - RNA, 22 nt, Human
agcacagagaagauuucaauua

SEQ ID NO: 911154 - RNA, 22 nt, Human
caggcugucugaauggaggccc

SEQ ID NO: 911155 - RNA, 22 nt, Human
gugcucuagggucauuauggua

SEQ ID NO: 911156 - RNA, 22 nt, Human
uagagaaaagcagggaucagga

SEQ ID NO: 911157 - RNA, 22 nt, Human
ucugggagguacugggaggugu

SEQ ID NO: 911158 - RNA, 22 nt, Human
ugcacuccaggcugggugacag

SEQ ID NO: 911159 - RNA, 21 nt, Human
ugcaccuguucacugcaguuc

SEQ ID NO: 911160 - RNA, 22 nt, Human
gugugccuuaagcucuauagac

SEQ ID NO: 911161 - RNA, 22 nt, Human
ugaaacuucuaauaugaauagu

SEQ ID NO: 911162 - RNA, 22 nt, Human
agucuucacaucagucuaaaga

SEQ ID NO: 911163 - RNA, 22 nt, Human
uuuaagaaguuauguuauaaau

SEQ ID NO: 911164 - RNA, 22 nt, Human
uuucuaggauacucuaaaugua

SEQ ID NO: 911165 - RNA, 22 nt, Human
guaugugugcaaauguaaauau

SEQ ID NO: 911166 - RNA, 17 nt, Human
cuccucucuggguuacu

SEQ ID NO: 911167 - RNA, 22 nt, Human
aauaauguugacgauagucuua

SEQ ID NO: 911168 - RNA, 22 nt, Human
auucuagcccuggaacggcgac

SEQ ID NO: 911169 - RNA, 22 nt, Human
ugaauuaucuuguaauuuugaa

SEQ ID NO: 911170 - RNA, 22 nt, Human
acuagaacuucuaacuaagguc

SEQ ID NO: 911171 - RNA, 22 nt, Human
gagaggcaggaauccuggguga

SEQ ID NO: 911172 - RNA, 22 nt, Human
ccucugaggugagcccagcugg

SEQ ID NO: 911173 - RNA, 22 nt, Human
gacaggcaugcuuucaggacua

SEQ ID NO: 911174 - RNA, 22 nt, Human
ugagacaaccuaauuaaacacc

SEQ ID NO: 911175 - RNA, 22 nt, Human
uaaaggucaagagaugcugucu

SEQ ID NO: 911176 - RNA, 22 nt, Human
ucgucaacuguagugacuuaga

SEQ ID NO: 911177 - RNA, 17 nt, Human
aggccagaugaggcaag

SEQ ID NO: 911178 - RNA, 22 nt, Human
ccacauucaguccaggcuugga

SEQ ID NO: 911179 - RNA, 22 nt, Human
ucuaggaauguucuuagggauu

SEQ ID NO: 911180 - RNA, 22 nt, Human
aagccaggaauggagucuucgc

SEQ ID NO: 911181 - RNA, 22 nt, Human
gccagaaagaggaggaccuggg

SEQ ID NO: 911182 - RNA, 22 nt, Human
gggcagguuggcaucccgggca

SEQ ID NO: 911183 - RNA, 22 nt, Human
aaguuguagucagaugucaguu

SEQ ID NO: 911184 - RNA, 22 nt, Human
gaggcagugucgguggcaggau

SEQ ID NO: 911185 - RNA, 20 nt, Human
cagaaagcauguuccagggc

SEQ ID NO: 911186 - RNA, 22 nt, Human
gcuggaguaucuggggaaggag

SEQ ID NO: 911187 - RNA, 22 nt, Human
ggugaaggcacaagagggcaag

SEQ ID NO: 911188 - RNA, 22 nt, Human
acagucaaugagugagugaaug

SEQ ID NO: 911189 - RNA, 22 nt, Human
aucuugaaauacuuucuagaau

SEQ ID NO: 911190 - RNA, 22 nt, Human
aguucuugcuauaaaaacaaau

SEQ ID NO: 911191 - RNA, 22 nt, Human
agagggugggcacgugauggau

SEQ ID NO: 911192 - RNA, 22 nt, Human
uggucccugccugccaagugcu

SEQ ID NO: 911193 - RNA, 22 nt, Human
aaaccuuucugcucucagcgua

SEQ ID NO: 911194 - RNA, 22 nt, Human
cugggcagcuguaucagggagu

SEQ ID NO: 911195 - RNA, 22 nt, Human
guacaguaguaaaagugaauga

SEQ ID NO: 911196 - RNA, 22 nt, Human
cuugacaacuggcagauauaua

SEQ ID NO: 911197 - RNA, 22 nt, Human
ugcugugcuggcggcagaggcc

SEQ ID NO: 911198 - RNA, 22 nt, Human
aaggcauucaagauggaaguug

SEQ ID NO: 911199 - RNA, 22 nt, Human
uuacuucagauuguggaaggca

SEQ ID NO: 911200 - RNA, 22 nt, Human
uuuauuguguugaaacugaauu

SEQ ID NO: 911201 - RNA, 22 nt, Human
ucuguggcuguuaucuuuauau

SEQ ID NO: 911202 - RNA, 22 nt, Human
ggccuugguucugucacagccg

SEQ ID NO: 911203 - RNA, 18 nt, Human
cuggucagggcaaugggc

SEQ ID NO: 911204 - RNA, 22 nt, Human
ugcaggcugccuucacagagcc

SEQ ID NO: 911205 - RNA, 22 nt, Human
ggcagcacgacaggaguggaag

SEQ ID NO: 911206 - RNA, 17 nt, Human
acccaggcucuaucuug

SEQ ID NO: 911207 - RNA, 22 nt, Human
uccagacuggggccaugucugc

SEQ ID NO: 911208 - RNA, 22 nt, Human
gauguagacacuuggaggcuua

SEQ ID NO: 911209 - RNA, 22 nt, Human
aguuuggaaaaugagacaagga

SEQ ID NO: 911210 - RNA, 22 nt, Human
uauguguauguacauacauaca

SEQ ID NO: 911211 - RNA, 22 nt, Human
gcacagagucacuagcuaagca

SEQ ID NO: 911212 - RNA, 22 nt, Human
uuacucagucucccauacauug

SEQ ID NO: 911213 - RNA, 22 nt, Human
uucaaagugugaccugacaagc

SEQ ID NO: 911214 - RNA, 19 nt, Human
augauacaggugaaaauug

SEQ ID NO: 911215 - RNA, 22 nt, Human
cauaaaguguauaagugaagaa

SEQ ID NO: 911216 - RNA, 22 nt, Human
aaugguuuggacuauucaauag

SEQ ID NO: 911217 - RNA, 22 nt, Human
uaccaaaaagugagccccagag

SEQ ID NO: 911218 - RNA, 22 nt, Human
guaaauauuaaaggcugcuaga

SEQ ID NO: 911219 - RNA, 22 nt, Human
gugugcaugcauagacaccaca

SEQ ID NO: 911220 - RNA, 22 nt, Human
gcaaacauuccacagaaggaag

SEQ ID NO: 911221 - RNA, 22 nt, Human
auacagaucccacagcauguga

SEQ ID NO: 911222 - RNA, 22 nt, Human
auaaggaaugauguaucaguuu

SEQ ID NO: 911223 - RNA, 20 nt, Human
agaaaugugaaaggcugagu

SEQ ID NO: 911224 - RNA, 17 nt, Human
gcugccugcaacugacu

SEQ ID NO: 911225 - RNA, 22 nt, Human
uuggaggaugcaaugagggagu

SEQ ID NO: 911226 - RNA, 22 nt, Human
guggcaggggcgggcuguuccg

SEQ ID NO: 911227 - RNA, 19 nt, Human
gacuccaacuuuaagcaug

SEQ ID NO: 911228 - RNA, 18 nt, Human
acauuucuaggugaaagc

SEQ ID NO: 911229 - RNA, 22 nt, Human
cucccccuuagcucuugucuuu

SEQ ID NO: 911230 - RNA, 23 nt, Human
cacauggaggaccguucuuauaa

SEQ ID NO: 911231 - RNA, 22 nt, Human
cagacaggguccuguccgucac

SEQ ID NO: 911232 - RNA, 22 nt, Human
gacauaaaccuugagauauuaa

SEQ ID NO: 911233 - RNA, 22 nt, Human
cauccagaguccaaggcugggc

SEQ ID NO: 911234 - RNA, 22 nt, Human
aacauuucugagaauaucaguu

SEQ ID NO: 911235 - RNA, 22 nt, Human
cugauccuccuuuaaguagcug

SEQ ID NO: 911236 - RNA, 22 nt, Human
cauggcagugauucagccuuug

SEQ ID NO: 911237 - RNA, 22 nt, Human
cauuguuaauugguaucuuaca

SEQ ID NO: 911238 - RNA, 22 nt, Human
caaaggagguaaugggugugag

SEQ ID NO: 911239 - RNA, 22 nt, Human
aacuagaaaacaagaugcugau

SEQ ID NO: 911240 - RNA, 22 nt, Human
ugagcccagcgucccguucugu

SEQ ID NO: 911241 - RNA, 22 nt, Human
caaauaagaaccacaggggagu

SEQ ID NO: 911242 - RNA, 22 nt, Human
aauaacuuuuaaaagacccugg

SEQ ID NO: 911243 - RNA, 22 nt, Human
aggcgcagaaggccaggggccu

SEQ ID NO: 911244 - RNA, 22 nt, Human
uugauguaaaagccuugguggc

SEQ ID NO: 911245 - RNA, 22 nt, Human
ucuacaguguuugguuugagga

SEQ ID NO: 911246 - RNA, 22 nt, Human
gcaaggagacuguagggccaag

SEQ ID NO: 911247 - RNA, 22 nt, Human
gugaggcagcaggagccucugu

SEQ ID NO: 911248 - RNA, 22 nt, Human
auauuguacuaggguuacaugu

SEQ ID NO: 911249 - RNA, 22 nt, Human
uucuaugaagguaagauguacg

SEQ ID NO: 911250 - RNA, 22 nt, Human
gacacagaaggucacauguuca

SEQ ID NO: 911251 - RNA, 15 nt, Human
cucucaggcaggcag

SEQ ID NO: 911252 - RNA, 22 nt, Human
aggcccugaagucggccccuca

SEQ ID NO: 911253 - RNA, 22 nt, Human
ucucucugugacagcuuugcug

SEQ ID NO: 911254 - RNA, 22 nt, Human
gccagcucccaagugagccccu

SEQ ID NO: 911255 - RNA, 22 nt, Human
ugccaggcgauugcuaucagca

SEQ ID NO: 911256 - RNA, 22 nt, Human
agguggggcccaccaauuugca

SEQ ID NO: 911257 - RNA, 22 nt, Human
cuggaagacguuugaagccaug

SEQ ID NO: 911258 - RNA, 22 nt, Human
ucugaagguugagaagggcuga

SEQ ID NO: 911259 - RNA, 22 nt, Human
ucaauuaagaggcuaaguuacu

SEQ ID NO: 911260 - RNA, 22 nt, Human
gccaggcaauguguuagaagcg

SEQ ID NO: 911261 - RNA, 22 nt, Human
acuugcaugucaggaaauuaac

SEQ ID NO: 911262 - RNA, 22 nt, Human
acaaaguaggaagauuagcuga

SEQ ID NO: 911263 - RNA, 23 nt, Human
ccagggcuacgggcaccguccug

SEQ ID NO: 911264 - RNA, 22 nt, Human
accugagagcuauaagguuuua

SEQ ID NO: 911265 - RNA, 22 nt, Human
uagauguaagcagaagaacagc

SEQ ID NO: 911266 - RNA, 22 nt, Human
uuacaagcuaauuguuucagcu

SEQ ID NO: 911267 - RNA, 22 nt, Human
auacacagccauuaugaauuag

SEQ ID NO: 911268 - RNA, 22 nt, Human
augcugugucuagcaggaacac

SEQ ID NO: 911269 - RNA, 19 nt, Human
gcauuucauuuaaccauca

SEQ ID NO: 911270 - RNA, 22 nt, Human
uggcugagaaaaaagagcuaua

SEQ ID NO: 911271 - RNA, 22 nt, Human
cugcuucuagcaccaagucccu

SEQ ID NO: 911272 - RNA, 21 nt, Human
gccaaggaggcuagagaacau

SEQ ID NO: 911273 - RNA, 22 nt, Human
ugccuucaagacccauccucca

SEQ ID NO: 911274 - RNA, 22 nt, Human
ggggacagucgaucuagugauu

SEQ ID NO: 911275 - RNA, 22 nt, Human
ugucuugauugaagagauagaa

SEQ ID NO: 911276 - RNA, 22 nt, Human
acaggcacugucaagucaugaa

SEQ ID NO: 911277 - RNA, 19 nt, Human
ggcagcuugggaagguagc

SEQ ID NO: 911278 - RNA, 19 nt, Human
agcugcuggcccagggacc

SEQ ID NO: 911279 - RNA, 22 nt, Human
gccagagaaugaaaaucagauu

SEQ ID NO: 911280 - RNA, 22 nt, Human
auccuuggcacaguggaauuca

SEQ ID NO: 911281 - RNA, 22 nt, Human
caggccugggcuggguaucagg

SEQ ID NO: 911282 - RNA, 22 nt, Human
uguuuacuuuccuucucacagg

SEQ ID NO: 911283 - RNA, 22 nt, Human
uuggcaggaugauagcuuugug

SEQ ID NO: 911284 - RNA, 22 nt, Human
agucccagccuaggcugugcug

SEQ ID NO: 911285 - RNA, 22 nt, Human
ucaaaaauguuuuauauuggua

SEQ ID NO: 911286 - RNA, 22 nt, Human
aggaggcugcaacccugaggcc

SEQ ID NO: 911287 - RNA, 22 nt, Human
aaggcaacuguaaaacaugcac

SEQ ID NO: 911288 - RNA, 22 nt, Human
auacaugugucccugauuuauu

SEQ ID NO: 911289 - RNA, 22 nt, Human
ucagcuccucaugcaggggaua

SEQ ID NO: 911290 - RNA, 23 nt, Human
ugcuggagaagcaaaguucugag

SEQ ID NO: 911291 - RNA, 22 nt, Human
cugugucggacgugggcagcag

SEQ ID NO: 911292 - RNA, 22 nt, Human
aacuguauacaauugucagaca

SEQ ID NO: 911293 - RNA, 22 nt, Human
uuagggaaauauuuauauacuu

SEQ ID NO: 911294 - RNA, 22 nt, Human
ucgucugugaaauugggauaag

SEQ ID NO: 911295 - RNA, 22 nt, Human
aaagacugaggggaaagugaug

SEQ ID NO: 911296 - RNA, 22 nt, Human
ggcugcuucacuuuuuugagcc

SEQ ID NO: 911297 - RNA, 22 nt, Human
uaaucuagaacauaugagagca

SEQ ID NO: 911298 - RNA, 23 nt, Human
ucagagagcuguugagagcugcc

SEQ ID NO: 911299 - RNA, 22 nt, Human
guauuccauuaguguuaauauc

SEQ ID NO: 911300 - RNA, 22 nt, Human
acgcagcacaaaggaaaggauc

SEQ ID NO: 911301 - RNA, 22 nt, Human
ugcaaauggagcauguauaaga

SEQ ID NO: 911302 - RNA, 22 nt, Human
guuuucuaccagggaagagagu

SEQ ID NO: 911303 - RNA, 22 nt, Human
uaauuuacaguucgccaugucu

SEQ ID NO: 911304 - RNA, 22 nt, Human
uuagguauuuuguuaugucagc

SEQ ID NO: 911305 - RNA, 22 nt, Human
uggagaauauuuccaaaucuaa

SEQ ID NO: 911306 - RNA, 22 nt, Human
gcacagagagggaagguaacuu

SEQ ID NO: 911307 - RNA, 22 nt, Human
gcuggccagcccucuuccucca

SEQ ID NO: 911308 - RNA, 22 nt, Human
uguucuuugcuguugauguaga

SEQ ID NO: 911309 - RNA, 22 nt, Human
acagagacugggagcaagaggc

SEQ ID NO: 911310 - RNA, 22 nt, Human
guaggagcauugaggguaugga

SEQ ID NO: 911311 - RNA, 22 nt, Human
cagcucugguuccugggcccag

SEQ ID NO: 911312 - RNA, 17 nt, Human
uucagaagcauuuuggc

SEQ ID NO: 911313 - RNA, 22 nt, Human
cauuuguugggacaaugaaaag

SEQ ID NO: 911314 - RNA, 22 nt, Human
gagccagacugccugaagcuca

SEQ ID NO: 911315 - RNA, 22 nt, Human
auuugcuugacuauggcuugca

SEQ ID NO: 911316 - RNA, 22 nt, Human
gcugccauccccugcugggcug

SEQ ID NO: 911317 - RNA, 22 nt, Human
aaaggcaugcauggucugcucc

SEQ ID NO: 911318 - RNA, 22 nt, Human
agaaagaacgcacuugugcugc

SEQ ID NO: 911319 - RNA, 22 nt, Human
cuggccccaggcagccugcugg

SEQ ID NO: 911320 - RNA, 22 nt, Human
ccuagaacacaaccuauauuag

SEQ ID NO: 911321 - RNA, 22 nt, Human
guauuuuaagugacuacuaggu

SEQ ID NO: 911322 - RNA, 22 nt, Human
agacuuagugaguucuaaguuu

SEQ ID NO: 911323 - RNA, 22 nt, Human
cagagaaagaagcccauucauu

SEQ ID NO: 911324 - RNA, 22 nt, Human
gggccagugaacaaugagggaa

SEQ ID NO: 911325 - RNA, 22 nt, Human
gaauaucccgcuaugcaaagua

SEQ ID NO: 911326 - RNA, 20 nt, Human
aaaagagugcuucaacugcu

SEQ ID NO: 911327 - RNA, 22 nt, Human
gaguccaguuguucacagaggc

SEQ ID NO: 911328 - RNA, 22 nt, Human
augucaguugcugcuugaggua

SEQ ID NO: 911329 - RNA, 22 nt, Human
uaagugcaucugaucuuucaug

SEQ ID NO: 911330 - RNA, 22 nt, Human
ggucucagugaaggagugugcu

SEQ ID NO: 911331 - RNA, 22 nt, Human
gugucuguuauacagaggagac

SEQ ID NO: 911332 - RNA, 22 nt, Human
uucauuuuauaaacccugcuga

SEQ ID NO: 911333 - RNA, 22 nt, Human
gaggaacuucaucucuaugcca

SEQ ID NO: 911334 - RNA, 22 nt, Human
uggaaggcagugauauuguuga

SEQ ID NO: 911335 - RNA, 22 nt, Human
caugugugcaccaacccuaugu

SEQ ID NO: 911336 - RNA, 19 nt, Human
ggcuggaguggccaucugu

SEQ ID NO: 911337 - RNA, 22 nt, Human
uucuggagaaucaccaccaggc

SEQ ID NO: 911338 - RNA, 22 nt, Human
agcaggugacagggcuguggug

SEQ ID NO: 911339 - RNA, 22 nt, Human
cgugcaugauauaugaguuguu

SEQ ID NO: 911340 - RNA, 22 nt, Human
uuuucaguuccaucucugcucu

SEQ ID NO: 911341 - RNA, 22 nt, Human
gcagguggugggggagccguuc

SEQ ID NO: 911342 - RNA, 22 nt, Human
ccaaggcagaagauggcucuug

SEQ ID NO: 911343 - RNA, 22 nt, Human
aaggaagacucgcaggucuaug

SEQ ID NO: 911344 - RNA, 22 nt, Human
agggcuuguggucguggcugug

SEQ ID NO: 911345 - RNA, 22 nt, Human
ccaaugcauaaugauccccuaa

SEQ ID NO: 911346 - RNA, 22 nt, Human
gaagcuuugucuugucuccugg

SEQ ID NO: 911347 - RNA, 22 nt, Human
ggcaggaggaagaguuagcacc

SEQ ID NO: 911348 - RNA, 22 nt, Human
uuaagugucauaauuuccaaga

SEQ ID NO: 911349 - RNA, 22 nt, Human
ggugcauggaaagaguaaguaa

SEQ ID NO: 911350 - RNA, 22 nt, Human
aacacaggaaauugguaaaugg

SEQ ID NO: 911351 - RNA, 22 nt, Human
caccagcccccucacgcuguca

SEQ ID NO: 911352 - RNA, 22 nt, Human
ggccuuagguucccugccucca

SEQ ID NO: 911353 - RNA, 22 nt, Human
agcuggggguuggauaagggua

SEQ ID NO: 911354 - RNA, 22 nt, Human
cagaaagccaacuccaacuguc

SEQ ID NO: 911355 - RNA, 22 nt, Human
ucaguuagcguaaucacugggg

SEQ ID NO: 911356 - RNA, 22 nt, Human
aaggcagaaagggaugugagug

SEQ ID NO: 911357 - RNA, 22 nt, Human
ggugugugguuuugauacaguc

SEQ ID NO: 911358 - RNA, 22 nt, Human
agguuuggguucauugcuggcu

SEQ ID NO: 911359 - RNA, 22 nt, Human
cccaggcuggaauuccaggccu

SEQ ID NO: 911360 - RNA, 22 nt, Human
ggcauucuaggccaaaaucagg

SEQ ID NO: 911361 - RNA, 22 nt, Human
cagcaguggcugcaggcagcug

SEQ ID NO: 911362 - RNA, 22 nt, Human
gccuuaauugcagagcaauaua

SEQ ID NO: 911363 - RNA, 22 nt, Human
agugugaguaauucagggaggg

SEQ ID NO: 911364 - RNA, 22 nt, Human
ucaggaggccggcaggauuuga

SEQ ID NO: 911365 - RNA, 22 nt, Human
uaaaguagcgccuaacuaaugu

SEQ ID NO: 911366 - RNA, 22 nt, Human
gcucugcuggaaguucucugga

SEQ ID NO: 911367 - RNA, 22 nt, Human
ggaggugcugaucccagucaac

SEQ ID NO: 911368 - RNA, 22 nt, Human
ggaaaggagauauuggagagug

SEQ ID NO: 911369 - RNA, 22 nt, Human
aaagcaugcuacuuuauauagg

SEQ ID NO: 911370 - RNA, 22 nt, Human
gcugcaaguuaguauacauucu

SEQ ID NO: 911371 - RNA, 19 nt, Human
aaugguuugaugaaguaua

SEQ ID NO: 911372 - RNA, 22 nt, Human
gggagcuccacugccucucauu

SEQ ID NO: 911373 - RNA, 22 nt, Human
agacagugauucuucacauuuc

SEQ ID NO: 911374 - RNA, 22 nt, Human
uguauuuaagcuuuaccuaaaa

SEQ ID NO: 911375 - RNA, 22 nt, Human
auacauguuguaccauauguuu

SEQ ID NO: 911376 - RNA, 20 nt, Human
uaaagcagccguggagggua

SEQ ID NO: 911377 - RNA, 22 nt, Human
cugaagcagggagugaugaagu

SEQ ID NO: 911378 - RNA, 22 nt, Human
guacaagaggagaaaauggagu

SEQ ID NO: 911379 - RNA, 22 nt, Human
gcaggugguggggcuaugaucu

SEQ ID NO: 911380 - RNA, 22 nt, Human
auuuccaggcuguuuugugaau

SEQ ID NO: 911381 - RNA, 22 nt, Human
cagcccuguccaaugucugcuc

SEQ ID NO: 911382 - RNA, 22 nt, Human
acucuaacuaauuaauaaagcc

SEQ ID NO: 911383 - RNA, 22 nt, Human
caggggcucugggugaugugag

SEQ ID NO: 911384 - RNA, 18 nt, Human
gggagcugggaagcuggu

SEQ ID NO: 911385 - RNA, 22 nt, Human
gagagugauucccucccauaga

SEQ ID NO: 911386 - RNA, 22 nt, Human
gcaggcuggaggcuguucuggg

SEQ ID NO: 911387 - RNA, 22 nt, Human
gcuuucaugaaaauaaucuacu

SEQ ID NO: 911388 - RNA, 22 nt, Human
gaaagggucuuugauuucccuc

SEQ ID NO: 911389 - RNA, 22 nt, Human
gugcaggugguuggcccagccg

SEQ ID NO: 911390 - RNA, 22 nt, Human
agagcugcaauuucauguggug

SEQ ID NO: 911391 - RNA, 22 nt, Human
uuguccuggagguuaauagagu

SEQ ID NO: 911392 - RNA, 22 nt, Human
ugagggagagggcgaaaaugaa

SEQ ID NO: 911393 - RNA, 22 nt, Human
cuggcccaguucugcguuuugc

SEQ ID NO: 911394 - RNA, 22 nt, Human
uuccauaauaggcuuaagugaa

SEQ ID NO: 911395 - RNA, 22 nt, Human
uacauguacaugcauagguaga

SEQ ID NO: 911396 - RNA, 22 nt, Human
augcuuaacuuccuagucuaua

SEQ ID NO: 911397 - RNA, 20 nt, Human
agguguccacguggcagggu

SEQ ID NO: 911398 - RNA, 22 nt, Human
ugggccugccccaggcuucagc

SEQ ID NO: 911399 - RNA, 22 nt, Human
uccuuuguggaaauacuugugg

SEQ ID NO: 911400 - RNA, 22 nt, Human
cuggagugaggucugggagccu

SEQ ID NO: 911401 - RNA, 22 nt, Human
cacuguuuuauuccaacauagg

SEQ ID NO: 911402 - RNA, 22 nt, Human
uuucacauucagauauagacuu

SEQ ID NO: 911403 - RNA, 22 nt, Human
aaaucgcuugaacccaggaagu

SEQ ID NO: 911404 - RNA, 22 nt, Human
ggcagcuggggcagugcccugu

SEQ ID NO: 911405 - RNA, 22 nt, Human
caauuucaugccauguauugcu

SEQ ID NO: 911406 - RNA, 22 nt, Human
agaagucuggaauuccugcagg

SEQ ID NO: 911407 - RNA, 22 nt, Human
ccagaggagcaggcuggcucca

SEQ ID NO: 911408 - RNA, 23 nt, Human
uggagcugggauuugauuugauu

SEQ ID NO: 911409 - RNA, 22 nt, Human
uucugggcucacagagcagcag

SEQ ID NO: 911410 - RNA, 22 nt, Human
augaaauguuggucccaaucgc

SEQ ID NO: 911411 - RNA, 22 nt, Human
uccacuuuagcaaugauugaau

SEQ ID NO: 911412 - RNA, 22 nt, Human
auuuuaugacacgauucuucca

SEQ ID NO: 911413 - RNA, 22 nt, Human
gggcugccaagccugccugccu

SEQ ID NO: 911414 - RNA, 22 nt, Human
gguuuccaccuugcuaugagaa

SEQ ID NO: 911415 - RNA, 22 nt, Human
uagguauacagagauuucuggg

SEQ ID NO: 911416 - RNA, 22 nt, Human
ugcugugacgccucaggaaucc

SEQ ID NO: 911417 - RNA, 22 nt, Human
ggccacagcagaugcuucagau

SEQ ID NO: 911418 - RNA, 22 nt, Human
ugccagaguuacaugaggguca

SEQ ID NO: 911419 - RNA, 22 nt, Human
ucaagcagagucaaaaguacca

SEQ ID NO: 911420 - RNA, 22 nt, Human
ggagggaaccuuggcuggauug

SEQ ID NO: 911421 - RNA, 22 nt, Human
ucugugcaccagaaugauauuu

SEQ ID NO: 911422 - RNA, 22 nt, Human
gcuuccuguaggcagguccaag

SEQ ID NO: 911423 - RNA, 21 nt, Human
ugacauuuggauucauaguaa

SEQ ID NO: 911424 - RNA, 18 nt, Human
auugcuuuuguaccaacc

SEQ ID NO: 911425 - RNA, 22 nt, Human
auauuacuuccugguauaaaau

SEQ ID NO: 911426 - RNA, 22 nt, Human
auucuuggagcagucaaagaag

SEQ ID NO: 911427 - RNA, 22 nt, Human
uggggcugugagacuacaggau

SEQ ID NO: 911428 - RNA, 22 nt, Human
cucccaggguagggagagacua

SEQ ID NO: 911429 - RNA, 22 nt, Human
accugggaggcggagguugcag

SEQ ID NO: 911430 - RNA, 22 nt, Human
gcugaggccccagggugauggg

SEQ ID NO: 911431 - RNA, 22 nt, Human
ccacugaaaaauuugagaugga

SEQ ID NO: 911432 - RNA, 22 nt, Human
ugagaacauuccucuuccuggc

SEQ ID NO: 911433 - RNA, 22 nt, Human
gcaguggugggacaguggaaaa

SEQ ID NO: 911434 - RNA, 22 nt, Human
ugagaaagguauuucaugcacu

SEQ ID NO: 911435 - RNA, 22 nt, Human
aauuuagaauucgcuagcuaau

SEQ ID NO: 911436 - RNA, 20 nt, Human
uguguccaucaucugggcac

SEQ ID NO: 911437 - RNA, 22 nt, Human
ugcagcaccuauggacacuugu

SEQ ID NO: 911438 - RNA, 20 nt, Human
gagcugugcucucaggagcc

SEQ ID NO: 911439 - RNA, 22 nt, Human
aaugcuuugauugauuaaaaca

SEQ ID NO: 911440 - RNA, 22 nt, Human
gugccugggacuugcuccggau

SEQ ID NO: 911441 - RNA, 22 nt, Human
uuucuguaaguggcaaauaaug

SEQ ID NO: 911442 - RNA, 22 nt, Human
augacaguacuggugacaauac

SEQ ID NO: 911443 - RNA, 22 nt, Human
ucuccccagcugagcugcccuu

SEQ ID NO: 911444 - RNA, 22 nt, Human
ucaauacauacaauguauagug

SEQ ID NO: 911445 - RNA, 22 nt, Human
cacauuuuuacugccaacuuaa

SEQ ID NO: 911446 - RNA, 22 nt, Human
aucuagcaguguuauaauugga

SEQ ID NO: 911447 - RNA, 22 nt, Human
acagggcauuuccucuaugugu

SEQ ID NO: 911448 - RNA, 22 nt, Human
acuaguauucuuggucuuguau

SEQ ID NO: 911449 - RNA, 22 nt, Human
guguucugcagaccagcaucau

SEQ ID NO: 911450 - RNA, 22 nt, Human
guagaaaaagcaguaagucuca

SEQ ID NO: 911451 - RNA, 22 nt, Human
aagcaauugguuuuaguaaaau

SEQ ID NO: 911452 - RNA, 22 nt, Human
acaggaaauuggcauaucaguu

SEQ ID NO: 911453 - RNA, 22 nt, Human
agcugaagggaggauauguaca

SEQ ID NO: 911454 - RNA, 22 nt, Human
auauaaaguguuuagaaagcug

SEQ ID NO: 911455 - RNA, 22 nt, Human
cagucacuggaauagcugagga

SEQ ID NO: 911456 - RNA, 22 nt, Human
ucuaaggacaaggucuuggaga

SEQ ID NO: 911457 - RNA, 19 nt, Human
aggucccugucaccucuca

SEQ ID NO: 911458 - RNA, 22 nt, Human
cggggcugacagcaggugugcu

SEQ ID NO: 911459 - RNA, 22 nt, Human
aagcccagcaucccugcaccag

SEQ ID NO: 911460 - RNA, 18 nt, Human
ugucucuucuuauguggg

SEQ ID NO: 911461 - RNA, 22 nt, Human
uacaacauuuacguuaggcugu

SEQ ID NO: 911462 - RNA, 23 nt, Human
uguuccagauacgccuuuuccuc

SEQ ID NO: 911463 - RNA, 22 nt, Human
gggagcuggagcuggaagacuc

SEQ ID NO: 911464 - RNA, 22 nt, Human
ucaaaauucuagggagaauggu

SEQ ID NO: 911465 - RNA, 22 nt, Human
caaaggcuuugcuaugaugcau

SEQ ID NO: 911466 - RNA, 22 nt, Human
ccacaguguucuuuuuaaaauu

SEQ ID NO: 911467 - RNA, 22 nt, Human
caccagggacaaugcuaggggu

SEQ ID NO: 911468 - RNA, 17 nt, Human
ggagacagggucuuuaa

SEQ ID NO: 911469 - RNA, 22 nt, Human
ugaaauauuuagagaguaaguu

SEQ ID NO: 911470 - RNA, 22 nt, Human
uuacugaacccuacuuuuacag

SEQ ID NO: 911471 - RNA, 22 nt, Human
uccugaccacacugccuucugc

SEQ ID NO: 911472 - RNA, 22 nt, Human
ucugaggcauaaccuguucugc

SEQ ID NO: 911473 - RNA, 22 nt, Human
uuuauagaugucuguauuauaa

SEQ ID NO: 911474 - RNA, 22 nt, Human
guaacgaauaaacaagugauaa

SEQ ID NO: 911475 - RNA, 17 nt, Human
cuuuggcaggagggagg

SEQ ID NO: 911476 - RNA, 22 nt, Human
auugugaauagugccgcaguaa

SEQ ID NO: 911477 - RNA, 18 nt, Human
ggagcccacggcguccca

SEQ ID NO: 911478 - RNA, 20 nt, Human
ugagccagucaagcuacauu

SEQ ID NO: 911479 - RNA, 22 nt, Human
aaaccauuugaauuauuacuga

SEQ ID NO: 911480 - RNA, 22 nt, Human
cagacauauguuuuaacagauu

SEQ ID NO: 911481 - RNA, 22 nt, Human
gcccugugcgacucuagagguu

SEQ ID NO: 911482 - RNA, 22 nt, Human
aggagccauugcaggauggcag

SEQ ID NO: 911483 - RNA, 22 nt, Human
gcaaagcaaaugccugaaggcg

SEQ ID NO: 911484 - RNA, 17 nt, Human
acaagcaguggccaugg

SEQ ID NO: 911485 - RNA, 22 nt, Human
uggccugcaaagucuucuugcu

SEQ ID NO: 911486 - RNA, 22 nt, Human
guauuuauaggggaaugagagu

SEQ ID NO: 911487 - RNA, 22 nt, Human
gaggcugaacagguucucauga

SEQ ID NO: 911488 - RNA, 22 nt, Human
ucccauugccauagauaggaca

SEQ ID NO: 911489 - RNA, 22 nt, Human
ucugggagauccaagcagaacu

SEQ ID NO: 911490 - RNA, 22 nt, Human
cauacauacugaguggacugau

SEQ ID NO: 911491 - RNA, 21 nt, Human
uuaaaaugaggaagugguggc

SEQ ID NO: 911492 - RNA, 22 nt, Human
uucugugugccagaguugugcu

SEQ ID NO: 911493 - RNA, 22 nt, Human
ugaaauggcccaaacacccagu

SEQ ID NO: 911494 - RNA, 22 nt, Human
uucuuuccuugccucagugaag

SEQ ID NO: 911495 - RNA, 22 nt, Human
auguaugucugaugcacaugca

SEQ ID NO: 911496 - RNA, 22 nt, Human
aaagggaaaauauuuagacaua

SEQ ID NO: 911497 - RNA, 22 nt, Human
agcugggagcugaaggcugauu

SEQ ID NO: 911498 - RNA, 22 nt, Human
ucagaaagcuuuuacuuaaaca

SEQ ID NO: 911499 - RNA, 18 nt, Human
gcucugugaccuugagca

SEQ ID NO: 911500 - RNA, 22 nt, Human
aaauaugugaucagugaauaaa

SEQ ID NO: 911501 - RNA, 22 nt, Human
aagguuucuccgaggcuauuuu

SEQ ID NO: 911502 - RNA, 22 nt, Human
uggcucuguugcucgcaguuuu

SEQ ID NO: 911503 - RNA, 22 nt, Human
cagcugccccuccagggcuggg

SEQ ID NO: 911504 - RNA, 22 nt, Human
uggcagcaaguucuugggaggu

SEQ ID NO: 911505 - RNA, 22 nt, Human
uaagauguacaaccacuucucu

SEQ ID NO: 911506 - RNA, 22 nt, Human
ggcuagcaagguagcagaaugc

SEQ ID NO: 911507 - RNA, 22 nt, Human
ggcuucucugucuaguuucuac

SEQ ID NO: 911508 - RNA, 21 nt, Human
uacaccaguuuacacuuccuc

SEQ ID NO: 911509 - RNA, 22 nt, Human
uaaaugcucaauaaauguugcu

SEQ ID NO: 911510 - RNA, 22 nt, Human
guuugaaagaccaauuagauuu

SEQ ID NO: 911511 - RNA, 20 nt, Human
acagauaccagggacauggg

SEQ ID NO: 911512 - RNA, 22 nt, Human
ucagacaggcuggacagcuugc

SEQ ID NO: 911513 - RNA, 22 nt, Human
aggcuggaguguagcagugcag

SEQ ID NO: 911514 - RNA, 22 nt, Human
gccucagugauaugugggacaa

SEQ ID NO: 911515 - RNA, 23 nt, Human
agcuucauugaccuccgcagggg

SEQ ID NO: 911516 - RNA, 22 nt, Human
ucugaaauccuuuaucuuggcu

SEQ ID NO: 911517 - RNA, 22 nt, Human
acugucuuguguuaaagaacca

SEQ ID NO: 911518 - RNA, 22 nt, Human
ugauuuccuaggucuggagaag

SEQ ID NO: 911519 - RNA, 22 nt, Human
caguggucugugcuucuguaca

SEQ ID NO: 911520 - RNA, 22 nt, Human
cggcuucaucuuuacuucaaga

SEQ ID NO: 911521 - RNA, 22 nt, Human
ugagacaguucugcagcugggu

SEQ ID NO: 911522 - RNA, 22 nt, Human
agauacaugucaagagacuuau

SEQ ID NO: 911523 - RNA, 22 nt, Human
gucauucagagaugcagguaga

SEQ ID NO: 911524 - RNA, 22 nt, Human
ccuggcucagaguaugucaucg

SEQ ID NO: 911525 - RNA, 19 nt, Human
gcagccaggugcucuaccu

SEQ ID NO: 911526 - RNA, 22 nt, Human
ccugagcagggcucugcagggc

SEQ ID NO: 911527 - RNA, 22 nt, Human
uuccucaucuagcacagaaauu

SEQ ID NO: 911528 - RNA, 22 nt, Human
uuuaacagguaaaguaaaugug

SEQ ID NO: 911529 - RNA, 22 nt, Human
caguuuauuuccaagaugacaa

SEQ ID NO: 911530 - RNA, 22 nt, Human
acugggccuugccauggcagcc

SEQ ID NO: 911531 - RNA, 22 nt, Human
guacgugcaugcacgugugccu

SEQ ID NO: 911532 - RNA, 22 nt, Human
ccaggaggcggaagguacagug

SEQ ID NO: 911533 - RNA, 22 nt, Human
ucaccuguauuaauacagaacu

SEQ ID NO: 911534 - RNA, 22 nt, Human
aagagguuuaacugacucacag

SEQ ID NO: 911535 - RNA, 22 nt, Human
ugagcaucaaauugaugggacu

SEQ ID NO: 911536 - RNA, 22 nt, Human
caggagcucaagaccacccugg

SEQ ID NO: 911537 - RNA, 20 nt, Human
cugugggccucacuuggggu

SEQ ID NO: 911538 - RNA, 22 nt, Human
agacccagagggcugcugggag

SEQ ID NO: 911539 - RNA, 22 nt, Human
ugacaacagccaucacuuuuag

SEQ ID NO: 911540 - RNA, 22 nt, Human
gaaagccagagagaaagggcuc

SEQ ID NO: 911541 - RNA, 22 nt, Human
auaaaacuuggguaugaucccu

SEQ ID NO: 911542 - RNA, 22 nt, Human
ugguccugagcaccagccugac

SEQ ID NO: 911543 - RNA, 21 nt, Human
ucugggacagggccugaggag

SEQ ID NO: 911544 - RNA, 22 nt, Human
cugcaucucugugccagagggc

SEQ ID NO: 911545 - RNA, 22 nt, Human
agggcuuguuaacauagagauu

SEQ ID NO: 911546 - RNA, 22 nt, Human
cagcugcuguaacagaauacuu

SEQ ID NO: 911547 - RNA, 22 nt, Human
cugugcagugugggguaggccu

SEQ ID NO: 911548 - RNA, 22 nt, Human
guccucaggaaggcuuucugac

SEQ ID NO: 911549 - RNA, 22 nt, Human
ucugggcacugcugagccugua

SEQ ID NO: 911550 - RNA, 22 nt, Human
gugccuuugugucuaaaacagc

SEQ ID NO: 911551 - RNA, 22 nt, Human
uuacagaaaggaaggacugacu

SEQ ID NO: 911552 - RNA, 22 nt, Human
gucauucaacugcacauuaggu

SEQ ID NO: 911553 - RNA, 22 nt, Human
auauguguacgugcaguauaua

SEQ ID NO: 911554 - RNA, 22 nt, Human
uuagaacugaagaagauuaagg

SEQ ID NO: 911555 - RNA, 22 nt, Human
cacaaggcuuucaucuggcaua

SEQ ID NO: 911556 - RNA, 22 nt, Human
agaggccagcuagcgggccauc

SEQ ID NO: 911557 - RNA, 22 nt, Human
aauauauuugaaucaggaacaa

SEQ ID NO: 911558 - RNA, 22 nt, Human
auuauauugaguauaaccagag

SEQ ID NO: 911559 - RNA, 21 nt, Human
aucuagaaucucucuccccac

SEQ ID NO: 911560 - RNA, 22 nt, Human
ggcagcagaccccuaagucuac

SEQ ID NO: 911561 - RNA, 23 nt, Human
gccagccuugcucuccugcagcc

SEQ ID NO: 911562 - RNA, 22 nt, Human
cuguaaccuccucuuuccauuc

SEQ ID NO: 911563 - RNA, 22 nt, Human
ucuacuagguguacuacugcag

SEQ ID NO: 911564 - RNA, 22 nt, Human
cuggaggcaaagcagaggcaug

SEQ ID NO: 911565 - RNA, 22 nt, Human
cuagaaucugggauuucugacu

SEQ ID NO: 911566 - RNA, 22 nt, Human
ccuaggagagguaaugaaguuc

SEQ ID NO: 911567 - RNA, 22 nt, Human
aaaguuuaucauagccggggac

SEQ ID NO: 911568 - RNA, 22 nt, Human
aguccaaggccauacaguugug

SEQ ID NO: 911569 - RNA, 20 nt, Human
ggggcagguuuuuauggcua

SEQ ID NO: 911570 - RNA, 22 nt, Human
cagguuggggacuuaggaugac

SEQ ID NO: 911571 - RNA, 22 nt, Human
ucaaacuguuagauuucagcuc

SEQ ID NO: 911572 - RNA, 22 nt, Human
aagaacugugcuccaggcucca

SEQ ID NO: 911573 - RNA, 21 nt, Human
cugcaggaugcugaagccagg

SEQ ID NO: 911574 - RNA, 23 nt, Human
auugaacagagagaaaaacaucc

SEQ ID NO: 911575 - RNA, 22 nt, Human
cacccugcccacuagcaaucug

SEQ ID NO: 911576 - RNA, 22 nt, Human
ccucugggcagguagcagcagc

SEQ ID NO: 911577 - RNA, 22 nt, Human
guacaaauugauacagguuuuc

SEQ ID NO: 911578 - RNA, 22 nt, Human
aguguauuaucagaaacugugg

SEQ ID NO: 911579 - RNA, 22 nt, Human
ccggucccaggugccccgguga

SEQ ID NO: 911580 - RNA, 19 nt, Human
aagauuuggucauugauaa

SEQ ID NO: 911581 - RNA, 22 nt, Human
auagagcucuucuucuuuuaac

SEQ ID NO: 911582 - RNA, 22 nt, Human
uaaucuguuguuaauauugacu

SEQ ID NO: 911583 - RNA, 22 nt, Human
agucaucucagguagcauuuac

SEQ ID NO: 911584 - RNA, 22 nt, Human
caaaauaccacgacuuguuuua

SEQ ID NO: 911585 - RNA, 22 nt, Human
gugugagccaugauguguccag

SEQ ID NO: 911586 - RNA, 22 nt, Human
acagagcauaaugucuagcaca

SEQ ID NO: 911587 - RNA, 22 nt, Human
ucacagcaccaggaucucucca

SEQ ID NO: 911588 - RNA, 22 nt, Human
cuaaacacuauguaagcaagaa

SEQ ID NO: 911589 - RNA, 22 nt, Human
uagucacuuuuuuaccaugugc

SEQ ID NO: 911590 - RNA, 22 nt, Human
ugcagccaucgcagagucugua

SEQ ID NO: 911591 - RNA, 22 nt, Human
uggaaugaaaauggagaucuug

SEQ ID NO: 911592 - RNA, 22 nt, Human
gcuguagggugucauaugaagc

SEQ ID NO: 911593 - RNA, 20 nt, Human
acuguguaaacaugauucau

SEQ ID NO: 911594 - RNA, 22 nt, Human
gaagccuuugccuaaaacauua

SEQ ID NO: 911595 - RNA, 22 nt, Human
uagaggugagccaucaaggggc

SEQ ID NO: 911596 - RNA, 22 nt, Human
agcugccugcauuuauauccug

SEQ ID NO: 911597 - RNA, 22 nt, Human
gcagcugccuucagcuggaugg

SEQ ID NO: 911598 - RNA, 22 nt, Human
ugauaaacauuuuaggaacuaa

SEQ ID NO: 911599 - RNA, 22 nt, Human
ccagggcuuaacuuuucaggag

SEQ ID NO: 911600 - RNA, 22 nt, Human
gcuuccagaccccagucccuca

SEQ ID NO: 911601 - RNA, 22 nt, Human
agggugccugcugcagguucag

SEQ ID NO: 911602 - RNA, 22 nt, Human
agaaaugacacacaugagacau

SEQ ID NO: 911603 - RNA, 21 nt, Human
uaucagagacauugagaggca

SEQ ID NO: 911604 - RNA, 22 nt, Human
ccuuagaggcaggaagaauugc

SEQ ID NO: 911605 - RNA, 22 nt, Human
cuccagggaaaggggcguccgc

SEQ ID NO: 911606 - RNA, 22 nt, Human
ggaagccaugagggacaguucu

SEQ ID NO: 911607 - RNA, 21 nt, Human
agcaccuuacagcuauaaugg

SEQ ID NO: 911608 - RNA, 22 nt, Human
ucuauguaaagccauauugaua

SEQ ID NO: 911609 - RNA, 22 nt, Human
gugcaucaauuucccauguguc

SEQ ID NO: 911610 - RNA, 23 nt, Human
acagcaagaggaccagaugugag

SEQ ID NO: 911611 - RNA, 22 nt, Human
uuuugcuguuauaugcuauuau

SEQ ID NO: 911612 - RNA, 22 nt, Human
aguacaaaaugcagcaucauca

SEQ ID NO: 911613 - RNA, 22 nt, Human
ucuuuugagggccagaggaaga

SEQ ID NO: 911614 - RNA, 22 nt, Human
auucugcuaguuaauaucucuc

SEQ ID NO: 911615 - RNA, 22 nt, Human
gaaacuguuucuggcuuuggug

SEQ ID NO: 911616 - RNA, 22 nt, Human
gacuagggaaucauucuuggau

SEQ ID NO: 911617 - RNA, 23 nt, Human
ccauuuuguguuuuggagaaaca

SEQ ID NO: 911618 - RNA, 22 nt, Human
ucccagacaaucauuggccacc

SEQ ID NO: 911619 - RNA, 22 nt, Human
guauucauauuaaacauaucaa

SEQ ID NO: 911620 - RNA, 22 nt, Human
uagaugaaauguguguuauuau

SEQ ID NO: 911621 - RNA, 22 nt, Human
cuguggcuuugugucuauugua

SEQ ID NO: 911622 - RNA, 22 nt, Human
gguggguauugaauacaggugu

SEQ ID NO: 911623 - RNA, 22 nt, Human
aacauugagaaacauugggaua

SEQ ID NO: 911624 - RNA, 22 nt, Human
ccaggcaguggaagcuaaaauu

SEQ ID NO: 911625 - RNA, 22 nt, Human
ugguccagugacagauaggcac

SEQ ID NO: 911626 - RNA, 22 nt, Human
aacacaggggguuacaaauugu

SEQ ID NO: 911627 - RNA, 22 nt, Human
acagagcucccagccaucuccu

SEQ ID NO: 911628 - RNA, 22 nt, Human
aggguagggcccggagacagac

SEQ ID NO: 911629 - RNA, 22 nt, Human
ccugagcuggaagagcuugugc

SEQ ID NO: 911630 - RNA, 22 nt, Human
gauaacauacuugcauguguau

SEQ ID NO: 911631 - RNA, 22 nt, Human
aggcaacaaggguagucaguga

SEQ ID NO: 911632 - RNA, 19 nt, Human
ucagcagcacugugauuuc

SEQ ID NO: 911633 - RNA, 22 nt, Human
aaguaugucuuuggguauuauu

SEQ ID NO: 911634 - RNA, 22 nt, Human
agcauccuccuucccagagaug

SEQ ID NO: 911635 - RNA, 22 nt, Human
augugucugauggcccugaauu

SEQ ID NO: 911636 - RNA, 22 nt, Human
gcagaggugucaccuuccagga

SEQ ID NO: 911637 - RNA, 22 nt, Human
aauguacaucucaguguaguac

SEQ ID NO: 911638 - RNA, 22 nt, Human
uggcuccagaucugucuccugu

SEQ ID NO: 911639 - RNA, 22 nt, Human
ucacaaauagcuauauuaagga

SEQ ID NO: 911640 - RNA, 22 nt, Human
acaguuuaugccucugagccug

SEQ ID NO: 911641 - RNA, 22 nt, Human
uggcugggugcuauccaguacu

SEQ ID NO: 911642 - RNA, 22 nt, Human
ucauugaguugcacuuuuacua

SEQ ID NO: 911643 - RNA, 22 nt, Human
ggcagugucaaaauaggcagaa

SEQ ID NO: 911644 - RNA, 22 nt, Human
gucaugugaaauuuggcaggcc

SEQ ID NO: 911645 - RNA, 22 nt, Human
auacaacugccuuagaaggaaa

SEQ ID NO: 911646 - RNA, 22 nt, Human
augcuuccucccuuccacucaa

SEQ ID NO: 911647 - RNA, 22 nt, Human
caggcagggagccacuguauaa

SEQ ID NO: 911648 - RNA, 22 nt, Human
uagaauaugauuaauuuucuua

SEQ ID NO: 911649 - RNA, 21 nt, Human
aaagauguuucaucugagaaa

SEQ ID NO: 911650 - RNA, 17 nt, Human
gcaguggagggguaguu

SEQ ID NO: 911651 - RNA, 22 nt, Human
gguccagguccugugacagcag

SEQ ID NO: 911652 - RNA, 22 nt, Human
ccaccauuauaucucccaugcc

SEQ ID NO: 911653 - RNA, 22 nt, Human
aagguuuauuaaaaguugaugg

SEQ ID NO: 911654 - RNA, 22 nt, Human
aaugucaaaggcuauacauuca

SEQ ID NO: 911655 - RNA, 22 nt, Human
gacccuuagaaugugaucuuau

SEQ ID NO: 911656 - RNA, 22 nt, Human
uggggcaagaagugcccugaag

SEQ ID NO: 911657 - RNA, 22 nt, Human
cacauugaaaugacccaauaau

SEQ ID NO: 911658 - RNA, 22 nt, Human
aaagcaagacaggaguuucaga

SEQ ID NO: 911659 - RNA, 22 nt, Human
ugggccuggacaaggccacuag

SEQ ID NO: 911660 - RNA, 22 nt, Human
uuugcaagaagaauggcacaaa

SEQ ID NO: 911661 - RNA, 22 nt, Human
agcauuagguguguuucagagg

SEQ ID NO: 911662 - RNA, 22 nt, Human
gcagcuucagccagagggccag

SEQ ID NO: 911663 - RNA, 22 nt, Human
gaggggaaagugugaggcugcg

SEQ ID NO: 911664 - RNA, 22 nt, Human
guguacaguuagccaccaaauu

SEQ ID NO: 911665 - RNA, 22 nt, Human
agcugcaguaaagcucuccagg

SEQ ID NO: 911666 - RNA, 22 nt, Human
ccugggagugugccaucucugu

SEQ ID NO: 911667 - RNA, 22 nt, Human
cuggccugaggccgccuucaga

SEQ ID NO: 911668 - RNA, 22 nt, Human
cucuacagcugcugccccuggu

SEQ ID NO: 911669 - RNA, 22 nt, Human
ucacaggcuccagggccuggau

SEQ ID NO: 911670 - RNA, 22 nt, Human
cagauuuugaugaauguggaaa

SEQ ID NO: 911671 - RNA, 22 nt, Human
gcucacagucugcugagugcag

SEQ ID NO: 911672 - RNA, 22 nt, Human
aguccagggcuuagucagcggg

SEQ ID NO: 911673 - RNA, 22 nt, Human
uuuacuuuugguaaggucauuu

SEQ ID NO: 911674 - RNA, 22 nt, Human
aaggaagagaauccuucucaga

SEQ ID NO: 911675 - RNA, 23 nt, Human
ugcaguaggauggggcugggccu

SEQ ID NO: 911676 - RNA, 22 nt, Human
gcugggacugagacagugaccu

SEQ ID NO: 911677 - RNA, 22 nt, Human
cacuguaagaugagcuuuuuua

SEQ ID NO: 911678 - RNA, 19 nt, Human
agcaggcuaggcugccucu

SEQ ID NO: 911679 - RNA, 22 nt, Human
gcugugugcugggcauggcacu

SEQ ID NO: 911680 - RNA, 22 nt, Human
aaacaugagcaucucuucaagc

SEQ ID NO: 911681 - RNA, 22 nt, Human
cugggccuugccaggggugucu

SEQ ID NO: 911682 - RNA, 22 nt, Human
gagccacagcaaccucaaagga

SEQ ID NO: 911683 - RNA, 22 nt, Human
gcugcuggggucacaugguaag

SEQ ID NO: 911684 - RNA, 21 nt, Human
ucagcuuugcaacugcacauc

SEQ ID NO: 911685 - RNA, 22 nt, Human
gccuggguuccaugaucuccag

SEQ ID NO: 911686 - RNA, 22 nt, Human
cucugugugguaugauugucau

SEQ ID NO: 911687 - RNA, 22 nt, Human
cuggaagugggguuggcuugaa

SEQ ID NO: 911688 - RNA, 22 nt, Human
agcugcaguuagccccagauga

SEQ ID NO: 911689 - RNA, 22 nt, Human
agcuucugagaauaguaaaugc

SEQ ID NO: 911690 - RNA, 22 nt, Human
uaccuagaccaguuacaaugca

SEQ ID NO: 911691 - RNA, 22 nt, Human
ugaauagacaucuggccauaga

SEQ ID NO: 911692 - RNA, 21 nt, Human
gcagccagccgagaccaugcc

SEQ ID NO: 911693 - RNA, 22 nt, Human
uuucagagaggcuucaaaucuu

SEQ ID NO: 911694 - RNA, 22 nt, Human
uagaaacauauguuugagacau

SEQ ID NO: 911695 - RNA, 22 nt, Human
aaacucagacacaguaucuguu

SEQ ID NO: 911696 - RNA, 22 nt, Human
gucucccaugucccuguccagu

SEQ ID NO: 911697 - RNA, 22 nt, Human
uuuguucacauuuaggacucuc

SEQ ID NO: 911698 - RNA, 22 nt, Human
uucuuuuacauuaagauuucag

SEQ ID NO: 911699 - RNA, 22 nt, Human
uuccacagauguaugaaguggu

SEQ ID NO: 911700 - RNA, 22 nt, Human
gucuuucuaugcauagagcaga

SEQ ID NO: 911701 - RNA, 22 nt, Human
cauucuuacacaauauuuuaau

SEQ ID NO: 911702 - RNA, 22 nt, Human
aaggucauuuuuuccucuguug

SEQ ID NO: 911703 - RNA, 22 nt, Human
uugaaaguuaucuagauucuga

SEQ ID NO: 911704 - RNA, 22 nt, Human
accuugaacccagcuugcugca

SEQ ID NO: 911705 - RNA, 22 nt, Human
aagaggucacacuagguccuag

SEQ ID NO: 911706 - RNA, 22 nt, Human
ugggaggaucgcuugagcccag

SEQ ID NO: 911707 - RNA, 22 nt, Human
uucugugauugacauguggcuu

SEQ ID NO: 911708 - RNA, 22 nt, Human
auuuagccucauuuuugacaua

SEQ ID NO: 911709 - RNA, 22 nt, Human
aagaaucuccaucugauucacu

SEQ ID NO: 911710 - RNA, 22 nt, Human
ggugaagguggaacgcagagca

SEQ ID NO: 911711 - RNA, 22 nt, Human
auggggugcaugcagauuggga

SEQ ID NO: 911712 - RNA, 22 nt, Human
ugcuggugagguccuugcugga

SEQ ID NO: 911713 - RNA, 22 nt, Human
uuugaaaggaauuaggaugaca

SEQ ID NO: 911714 - RNA, 22 nt, Human
aucagaguguaaguucuuuccu

SEQ ID NO: 911715 - RNA, 22 nt, Human
aaaggcuuuaaagaaccagaac

SEQ ID NO: 911716 - RNA, 22 nt, Human
uauugucuguccgggucaaagc

SEQ ID NO: 911717 - RNA, 20 nt, Human
ggaaacauuuuuauuuccau

SEQ ID NO: 911718 - RNA, 22 nt, Human
ucaaggugcugugcugugcuag

SEQ ID NO: 911719 - RNA, 22 nt, Human
aguagaaauguaguguagagaa

SEQ ID NO: 911720 - RNA, 20 nt, Human
auagaaguauuauguaaugu

SEQ ID NO: 911721 - RNA, 22 nt, Human
guccugggaacuggacagcuaa

SEQ ID NO: 911722 - RNA, 22 nt, Human
auguguccacaggugugagaga

SEQ ID NO: 911723 - RNA, 22 nt, Human
uuggaauccugagaugagaauu

SEQ ID NO: 911724 - RNA, 22 nt, Human
gagagcugucagcguagcaccg

SEQ ID NO: 911725 - RNA, 22 nt, Human
uuccaaguagaagcauuugcau

SEQ ID NO: 911726 - RNA, 22 nt, Human
cuuaagaaauugcauucuaauc

SEQ ID NO: 911727 - RNA, 22 nt, Human
ugcaaaggcaucugggaagguu

SEQ ID NO: 911728 - RNA, 22 nt, Human
guggggcucccaucuccuggcu

SEQ ID NO: 911729 - RNA, 22 nt, Human
aaagcuguaaugcaugcuuucu

SEQ ID NO: 911730 - RNA, 22 nt, Human
caauucugaggccugcuuuguu

SEQ ID NO: 911731 - RNA, 22 nt, Human
gaaaggagucagucuuacugaa

SEQ ID NO: 911732 - RNA, 22 nt, Human
uacaagaaggaaaacuagcaau

SEQ ID NO: 911733 - RNA, 22 nt, Human
ugauuaaguugcauuuuaauau

SEQ ID NO: 911734 - RNA, 22 nt, Human
acauucugaauaggcauuuuau

SEQ ID NO: 911735 - RNA, 23 nt, Human
cauguacagaguuugauaaagug

SEQ ID NO: 911736 - RNA, 22 nt, Human
agaacagcaguuaugguucauu

SEQ ID NO: 911737 - RNA, 22 nt, Human
aaucucuucccaguaaaaaugg

SEQ ID NO: 911738 - RNA, 22 nt, Human
auggcccaagugcccugaccug

SEQ ID NO: 911739 - RNA, 22 nt, Human
cauuggaagacauaucaugcua

SEQ ID NO: 911740 - RNA, 22 nt, Human
cacacaugucucuccaugcucu

SEQ ID NO: 911741 - RNA, 22 nt, Human
auuagcuuugguggaaaggagu

SEQ ID NO: 911742 - RNA, 22 nt, Human
aagccagccagugccagucuua

SEQ ID NO: 911743 - RNA, 22 nt, Human
uggcucaggcuugaaaauagau

SEQ ID NO: 911744 - RNA, 22 nt, Human
gagugagggcagcaggggcugc

SEQ ID NO: 911745 - RNA, 22 nt, Human
gucugugugcacagagcuuugg

SEQ ID NO: 911746 - RNA, 22 nt, Human
acauuagaacauuaauauuggg

SEQ ID NO: 911747 - RNA, 23 nt, Human
auaugucaugcaccagcacuuua

SEQ ID NO: 911748 - RNA, 22 nt, Human
agauaaaaugguucaaaggcua

SEQ ID NO: 911749 - RNA, 22 nt, Human
uacaagaauuucuuucugguug

SEQ ID NO: 911750 - RNA, 22 nt, Human
ggagggagggcuagaccaaaga

SEQ ID NO: 911751 - RNA, 17 nt, Human
uuauugcagugcugaag

SEQ ID NO: 911752 - RNA, 22 nt, Human
uuccucuguaguugcugaugaa

SEQ ID NO: 911753 - RNA, 20 nt, Human
gaggcugcggacugcuggac

SEQ ID NO: 911754 - RNA, 22 nt, Human
aauuucaaacucuugcccucag

SEQ ID NO: 911755 - RNA, 22 nt, Human
acccucaagauggaagcaguuu

SEQ ID NO: 911756 - RNA, 22 nt, Human
cagagcagcagagcuuccaugg

SEQ ID NO: 911757 - RNA, 20 nt, Human
gggugugggcccggccaggc

SEQ ID NO: 911758 - RNA, 20 nt, Human
agugugucucggagguaagu

SEQ ID NO: 911759 - RNA, 20 nt, Human
uuccauagcacccugugggu

SEQ ID NO: 911760 - RNA, 22 nt, Human
uggagaaggacagccugagaaa

SEQ ID NO: 911761 - RNA, 22 nt, Human
gaggaagaagggauuagaacuc

SEQ ID NO: 911762 - RNA, 22 nt, Human
aaggagaaggcaucauucaagu

SEQ ID NO: 911763 - RNA, 22 nt, Human
agacugaaacaaucugcaggca

SEQ ID NO: 911764 - RNA, 22 nt, Human
ugcauaacuagaguaauuacag

SEQ ID NO: 911765 - RNA, 22 nt, Human
aagcagcugugugacauaaucu

SEQ ID NO: 911766 - RNA, 23 nt, Human
ugcuuugccagagcaaaagucua

SEQ ID NO: 911767 - RNA, 22 nt, Human
gagcagcucagaggacuagugu

SEQ ID NO: 911768 - RNA, 22 nt, Human
gaaguucuuaugaaaacuugag

SEQ ID NO: 911769 - RNA, 22 nt, Human
acuguuaacgguaugaugcucg

SEQ ID NO: 911770 - RNA, 22 nt, Human
ccucugggugacagacucuugg

SEQ ID NO: 911771 - RNA, 18 nt, Human
gggcauggaugcagcauc

SEQ ID NO: 911772 - RNA, 22 nt, Human
aauacuuaugugaccucauuuu

SEQ ID NO: 911773 - RNA, 22 nt, Human
gagugcugaaugcgagaacaga

SEQ ID NO: 911774 - RNA, 22 nt, Human
cugaaguuauucagugggcuga

SEQ ID NO: 911775 - RNA, 22 nt, Human
aacccaggagacagguugcagu

SEQ ID NO: 911776 - RNA, 21 nt, Human
ucaggcagugcaaauacaugg

SEQ ID NO: 911777 - RNA, 22 nt, Human
gugagcugggugaaugguaggg

SEQ ID NO: 911778 - RNA, 22 nt, Human
gccaccucuuugucucugccgc

SEQ ID NO: 911779 - RNA, 19 nt, Human
aagcguuucccacuugcuu

SEQ ID NO: 911780 - RNA, 20 nt, Human
cuuuaguuauuaacagcacu

SEQ ID NO: 911781 - RNA, 22 nt, Human
acacaguucaggaucaaauagc

SEQ ID NO: 911782 - RNA, 22 nt, Human
agccuguccagaggacagggcu

SEQ ID NO: 911783 - RNA, 22 nt, Human
ccagagcaauucucacagaacu

SEQ ID NO: 911784 - RNA, 19 nt, Human
ugcucucuggugcuucaug

SEQ ID NO: 911785 - RNA, 22 nt, Human
aggcagcaagauuauuuaaucc

SEQ ID NO: 911786 - RNA, 19 nt, Human
gggcccagcauggaggguu

SEQ ID NO: 911787 - RNA, 22 nt, Human
aucagcaggaagggcaccuuua

SEQ ID NO: 911788 - RNA, 21 nt, Human
aaugaaguggcuauuuugagg

SEQ ID NO: 911789 - RNA, 22 nt, Human
gagcuuccagagacaucagagu

SEQ ID NO: 911790 - RNA, 22 nt, Human
caguucuuuguggggaguucuc

SEQ ID NO: 911791 - RNA, 22 nt, Human
acagcaggauuuggcgauguug

SEQ ID NO: 911792 - RNA, 22 nt, Human
gaggcugcuuuccuccuauccu

SEQ ID NO: 911793 - RNA, 22 nt, Human
accccaaaagaguaauagaauu

SEQ ID NO: 911794 - RNA, 22 nt, Human
uggcaguugaguuacuggguga

SEQ ID NO: 911795 - RNA, 22 nt, Human
acagaaauugggcaaauggaag

SEQ ID NO: 911796 - RNA, 20 nt, Human
ccucucugcaugcucccuga

SEQ ID NO: 911797 - RNA, 22 nt, Human
gaagguuuacugaagauuuaaa

SEQ ID NO: 911798 - RNA, 22 nt, Human
cuuccugcaggacagccaucug

SEQ ID NO: 911799 - RNA, 22 nt, Human
uguuugcuaggguugguauuua

SEQ ID NO: 911800 - RNA, 22 nt, Human
cuuucaaugugccugccuuggg

SEQ ID NO: 911801 - RNA, 22 nt, Human
gaaaucuuuuaaccauucauuu

SEQ ID NO: 911802 - RNA, 22 nt, Human
auguuuuccugggagagcacuc

SEQ ID NO: 911803 - RNA, 22 nt, Human
ucuuugcauggacauguguuuu

SEQ ID NO: 911804 - RNA, 22 nt, Human
ucagaguuggcaguaaaacaca

SEQ ID NO: 911805 - RNA, 21 nt, Human
ugcagcuggguucugguuugc

SEQ ID NO: 911806 - RNA, 22 nt, Human
aacaguaucuuuuaucagaaau

SEQ ID NO: 911807 - RNA, 22 nt, Human
uggcugagggggcucugcucag

SEQ ID NO: 911808 - RNA, 22 nt, Human
uccaggacagaguagaagcagc

SEQ ID NO: 911809 - RNA, 22 nt, Human
guuagacaugcagaaucucagg

SEQ ID NO: 911810 - RNA, 22 nt, Human
augugucugguuauugacaugc

SEQ ID NO: 911811 - RNA, 22 nt, Human
ccagcucucagcgggagacuca

SEQ ID NO: 911812 - RNA, 16 nt, Human
cuucacagaggagagu

SEQ ID NO: 911813 - RNA, 22 nt, Human
cacaggagagguuaaugggggc

SEQ ID NO: 911814 - RNA, 21 nt, Human
gggcuaagagugaccaggcag

SEQ ID NO: 911815 - RNA, 22 nt, Human
aucuuugggauauuugugauua

SEQ ID NO: 911816 - RNA, 22 nt, Human
ggagccuuagacaucugauccu

SEQ ID NO: 911817 - RNA, 22 nt, Human
uuacuagcugagggaacuuggg

SEQ ID NO: 911818 - RNA, 22 nt, Human
uuccagaggggagguggcagcc

SEQ ID NO: 911819 - RNA, 22 nt, Human
gcagggauugucaaugcugcuc

SEQ ID NO: 911820 - RNA, 22 nt, Human
acuaaagcucacagaguugaac

SEQ ID NO: 911821 - RNA, 18 nt, Human
cagcugccagcucaugga

SEQ ID NO: 911822 - RNA, 22 nt, Human
gagggagcuaugaauagaagaa

SEQ ID NO: 911823 - RNA, 22 nt, Human
agcagcccgaggaucauguguc

SEQ ID NO: 911824 - RNA, 22 nt, Human
uucccaagucuccaauguggga

SEQ ID NO: 911825 - RNA, 22 nt, Human
ucaggaguaaagacagaguucc

SEQ ID NO: 911826 - RNA, 22 nt, Human
uccugcaggccuguucccagua

SEQ ID NO: 911827 - RNA, 22 nt, Human
uacacaggggagcaugguugac

SEQ ID NO: 911828 - RNA, 22 nt, Human
aggaaagcaauggcugagaaca

SEQ ID NO: 911829 - RNA, 22 nt, Human
ccugagccgagcgcucuuucuc

SEQ ID NO: 911830 - RNA, 23 nt, Human
acucagagaccccgggaagugac

SEQ ID NO: 911831 - RNA, 22 nt, Human
caaggccugccucuggcagaaa

SEQ ID NO: 911832 - RNA, 22 nt, Human
agcagggcagcugaugcgcacg

SEQ ID NO: 911833 - RNA, 22 nt, Human
gagcaggaugggagcuggggcc

SEQ ID NO: 911834 - RNA, 22 nt, Human
uuuagcauauuuaaggaaugau

SEQ ID NO: 911835 - RNA, 22 nt, Human
gauuucuaguaagucaugaagg

SEQ ID NO: 911836 - RNA, 23 nt, Human
aaagaucaaaguggcaggccugu

SEQ ID NO: 911837 - RNA, 22 nt, Human
acacauuugcuaaaaugagcuc

SEQ ID NO: 911838 - RNA, 22 nt, Human
guuccuaagcuguggcccugga

SEQ ID NO: 911839 - RNA, 20 nt, Human
auaauuuacccugcaccacu

SEQ ID NO: 911840 - RNA, 22 nt, Human
agggcucauaauuccugacuuc

SEQ ID NO: 911841 - RNA, 22 nt, Human
augcuauuuaccacacaucauu

SEQ ID NO: 911842 - RNA, 22 nt, Human
uuuuucugccauucaaagagga

SEQ ID NO: 911843 - RNA, 22 nt, Human
ccaggagccacucaggcccaca

SEQ ID NO: 911844 - RNA, 22 nt, Human
cagauaacacaaagaaaugggc

SEQ ID NO: 911845 - RNA, 19 nt, Human
ggauaagguuggagugauc

SEQ ID NO: 911846 - RNA, 22 nt, Human
aagauagaugucaucagcauau

SEQ ID NO: 911847 - RNA, 22 nt, Human
uuaguuuauaauucauuucugu

SEQ ID NO: 911848 - RNA, 22 nt, Human
aaggcagcacagcaacugcuca

SEQ ID NO: 911849 - RNA, 22 nt, Human
aaaggcuuaacagaagaccuuu

SEQ ID NO: 911850 - RNA, 22 nt, Human
aggaggaggugggacacaguga

SEQ ID NO: 911851 - RNA, 22 nt, Human
caggcagagugagguggucuaa

SEQ ID NO: 911852 - RNA, 22 nt, Human
agugaucagcuugaaguaguuu

SEQ ID NO: 911853 - RNA, 22 nt, Human
agugucuguuguucagaacucu

SEQ ID NO: 911854 - RNA, 22 nt, Human
agacacauaggaccacacugug

SEQ ID NO: 911855 - RNA, 20 nt, Human
ggaggguggaagaaagcaag

SEQ ID NO: 911856 - RNA, 22 nt, Human
aggcccuguaagguguggagau

SEQ ID NO: 911857 - RNA, 22 nt, Human
uugggggguugaggaguagaua

SEQ ID NO: 911858 - RNA, 22 nt, Human
augaaagcaacuuauuugagau

SEQ ID NO: 911859 - RNA, 21 nt, Human
ucucacaauaugaugccagau

SEQ ID NO: 911860 - RNA, 22 nt, Human
cugugcauuguugaguguuuag

SEQ ID NO: 911861 - RNA, 22 nt, Human
acuagaaaauuccuagaaacua

SEQ ID NO: 911862 - RNA, 22 nt, Human
ggccagggccuggggacugucc

SEQ ID NO: 911863 - RNA, 22 nt, Human
ccaggugucuguggccagcccu

SEQ ID NO: 911864 - RNA, 22 nt, Human
acucaggcuucaggcacagcug

SEQ ID NO: 911865 - RNA, 22 nt, Human
cugugaauugaauaugacuaug

SEQ ID NO: 911866 - RNA, 22 nt, Human
gagaaaauagcauguguaguau

SEQ ID NO: 911867 - RNA, 22 nt, Human
guacacagaugcuugagaaucu

SEQ ID NO: 911868 - RNA, 22 nt, Human
gaagcagccacggggagacaga

SEQ ID NO: 911869 - RNA, 22 nt, Human
aggcuucuucucuauguacaag

SEQ ID NO: 911870 - RNA, 22 nt, Human
ugggauggcauccugggccuug

SEQ ID NO: 911871 - RNA, 22 nt, Human
cuggaaggcagagguugcagug

SEQ ID NO: 911872 - RNA, 19 nt, Human
ucuuuggcuucuggaucag

SEQ ID NO: 911873 - RNA, 22 nt, Human
gacugaaggucucagcauguga

SEQ ID NO: 911874 - RNA, 22 nt, Human
ugcagcaaggggcccugauagg

SEQ ID NO: 911875 - RNA, 22 nt, Human
aaacugucauuuuauauaguua

SEQ ID NO: 911876 - RNA, 22 nt, Human
uuauguaauuuguuugcucuuc

SEQ ID NO: 911877 - RNA, 23 nt, Human
acagaaaguucugcuggacagag

SEQ ID NO: 911878 - RNA, 22 nt, Human
agcuccugauacaugcaggaau

SEQ ID NO: 911879 - RNA, 22 nt, Human
ugggcugccggcaggcucugcc

SEQ ID NO: 911880 - RNA, 22 nt, Human
cuccugagcucugaggaagcuu

SEQ ID NO: 911881 - RNA, 17 nt, Human
gagccccuuuccaaguu

SEQ ID NO: 911882 - RNA, 19 nt, Human
ucaaagcaagcauguucug

SEQ ID NO: 911883 - RNA, 22 nt, Human
ggcauuuagagggcuuuucuga

SEQ ID NO: 911884 - RNA, 22 nt, Human
cucagugcugaggaaaguugaa

SEQ ID NO: 911885 - RNA, 20 nt, Human
uucaugggagcaaagaggcc

SEQ ID NO: 911886 - RNA, 22 nt, Human
ggccuguguccuccuugcccug

SEQ ID NO: 911887 - RNA, 22 nt, Human
aggugggcacaccucccuucuc

SEQ ID NO: 911888 - RNA, 20 nt, Human
uaggaaauauguuuuuaccc

SEQ ID NO: 911889 - RNA, 23 nt, Human
agaggccagccuuuggagacacc

SEQ ID NO: 911890 - RNA, 22 nt, Human
caugggcugcugacaggggcuc

SEQ ID NO: 911891 - RNA, 22 nt, Human
cuuucuuucgaagacgugauua

SEQ ID NO: 911892 - RNA, 22 nt, Human
uauacagucuuuugcuauauuc

SEQ ID NO: 911893 - RNA, 22 nt, Human
agagagaauuggauaaauuggu

SEQ ID NO: 911894 - RNA, 22 nt, Human
gcugaaguugccuauuuuaaua

SEQ ID NO: 911895 - RNA, 22 nt, Human
gcagaugaggaagcuaaugcug

SEQ ID NO: 911896 - RNA, 19 nt, Human
auggccaguuuagagguuu

SEQ ID NO: 911897 - RNA, 22 nt, Human
ucuuucuugguauaaagcaggg

SEQ ID NO: 911898 - RNA, 22 nt, Human
ugcuuccugcuaaggcugccug

SEQ ID NO: 911899 - RNA, 22 nt, Human
uaacaacucaguuuguuccuug

SEQ ID NO: 911900 - RNA, 19 nt, Human
ucaugcauuucuaagugca

SEQ ID NO: 911901 - RNA, 22 nt, Human
uccagagcuaauucagcagcug

SEQ ID NO: 911902 - RNA, 22 nt, Human
ccccagcacaggcuccucagau

SEQ ID NO: 911903 - RNA, 22 nt, Human
uugggcuggagaugaucugcug

SEQ ID NO: 911904 - RNA, 22 nt, Human
guccagcauuuaggcuugcuga

SEQ ID NO: 911905 - RNA, 22 nt, Human
aaagcuagaaggaaauuuuaug

SEQ ID NO: 911906 - RNA, 22 nt, Human
aggggcucugagugggccagga

SEQ ID NO: 911907 - RNA, 22 nt, Human
gcggugggggaaaggagcgguu

SEQ ID NO: 911908 - RNA, 22 nt, Human
caaccccacuacacguuggaga

SEQ ID NO: 911909 - RNA, 22 nt, Human
auguagauuugcuucuccugcc

SEQ ID NO: 911910 - RNA, 19 nt, Human
gaucagagugucagcuugu

SEQ ID NO: 911911 - RNA, 22 nt, Human
guguccacggcugagaaugauu

SEQ ID NO: 911912 - RNA, 22 nt, Human
aaggccagagcagacuggaguu

SEQ ID NO: 911913 - RNA, 22 nt, Human
aaaguacccaagaacagaguga

SEQ ID NO: 911914 - RNA, 22 nt, Human
gggguagggcgauugcugcuuu

SEQ ID NO: 911915 - RNA, 22 nt, Human
cagcagagacgguaagcagaac

SEQ ID NO: 911916 - RNA, 22 nt, Human
ggcacaggaaucugugaagugc

SEQ ID NO: 911917 - RNA, 22 nt, Human
agaaaugcucuuccugaccaga

SEQ ID NO: 911918 - RNA, 22 nt, Human
ggaggaggcaaguaccagaugc

SEQ ID NO: 911919 - RNA, 22 nt, Human
guauuuaauuccauuaaguuag

SEQ ID NO: 911920 - RNA, 22 nt, Human
uuucuuugagucucaguuugcu

SEQ ID NO: 911921 - RNA, 22 nt, Human
ggugcugaggccuuggcaggga

SEQ ID NO: 911922 - RNA, 22 nt, Human
ucuuuggcacuucuguuuuaag

SEQ ID NO: 911923 - RNA, 22 nt, Human
uguucauugcccccuguguaaa

SEQ ID NO: 911924 - RNA, 22 nt, Human
acagucucuguugcugcuguuu

SEQ ID NO: 911925 - RNA, 22 nt, Human
aucuuacacgauaacuguuagu

SEQ ID NO: 911926 - RNA, 22 nt, Human
uagaggagaguugcuggaugga

SEQ ID NO: 911927 - RNA, 22 nt, Human
agagaacaugacguaauagugg

SEQ ID NO: 911928 - RNA, 22 nt, Human
gucuccugagacugcagucacc

SEQ ID NO: 911929 - RNA, 22 nt, Human
ccagcagggcagugcccuggac

SEQ ID NO: 911930 - RNA, 22 nt, Human
aaacauguaaguucagaucacc

SEQ ID NO: 911931 - RNA, 22 nt, Human
ugcugggcuggggccucagacc

SEQ ID NO: 911932 - RNA, 22 nt, Human
uuacugcuaauucuguagguuu

SEQ ID NO: 911933 - RNA, 22 nt, Human
ggccccaggucugaacacgcug

SEQ ID NO: 911934 - RNA, 22 nt, Human
ccuccaaguuugacucaggaca

SEQ ID NO: 911935 - RNA, 22 nt, Human
cccugagccgccugccgugucc

SEQ ID NO: 911936 - RNA, 22 nt, Human
uccagcucugauucucacuagc

SEQ ID NO: 911937 - RNA, 22 nt, Human
ucauaaauuaucuauuuggcua

SEQ ID NO: 911938 - RNA, 20 nt, Human
uugcaauaaaugaaagacca

SEQ ID NO: 911939 - RNA, 22 nt, Human
gagcuaggcuagggggagucgc

SEQ ID NO: 911940 - RNA, 22 nt, Human
guguuuaauagguagcugaauc

SEQ ID NO: 911941 - RNA, 22 nt, Human
acagugugguuguuucugguua

SEQ ID NO: 911942 - RNA, 22 nt, Human
ccacagcaugcaggccugacac

SEQ ID NO: 911943 - RNA, 21 nt, Human
ugacagguuuaggauuaaaau

SEQ ID NO: 911944 - RNA, 22 nt, Human
acugggaggcaaagagcaagga

SEQ ID NO: 911945 - RNA, 22 nt, Human
cucagcugcagccuggcuggca

SEQ ID NO: 911946 - RNA, 22 nt, Human
uggggacauucaugcagguugu

SEQ ID NO: 911947 - RNA, 22 nt, Human
uccacagggaugccugcggcuu

SEQ ID NO: 911948 - RNA, 22 nt, Human
ggagauuuauagcacacuucag

SEQ ID NO: 911949 - RNA, 22 nt, Human
acacagaguuauuaugugaacu

SEQ ID NO: 911950 - RNA, 22 nt, Human
cacaaaggagaaugucagcaua

SEQ ID NO: 911951 - RNA, 22 nt, Human
auuguacauaugauguauguaa

SEQ ID NO: 911952 - RNA, 22 nt, Human
cuggaucaugcauugcuugucc

SEQ ID NO: 911953 - RNA, 22 nt, Human
gugugccugacaugaugguuaa

SEQ ID NO: 911954 - RNA, 22 nt, Human
uacauugaggcaguagcuggag

SEQ ID NO: 911955 - RNA, 22 nt, Human
ugaaggccaaaagacgggcuuc

SEQ ID NO: 911956 - RNA, 22 nt, Human
ucuucuuuuugucccacagaau

SEQ ID NO: 911957 - RNA, 22 nt, Human
agccuuagauuugggcaagaac

SEQ ID NO: 911958 - RNA, 22 nt, Human
aaucagaaauugagggucuggu

SEQ ID NO: 911959 - RNA, 22 nt, Human
auggcagacacaggcaggcaga

SEQ ID NO: 911960 - RNA, 22 nt, Human
aaggcaaugagggagauagagu

SEQ ID NO: 911961 - RNA, 22 nt, Human
cuuuugauggaguucaagaagc

SEQ ID NO: 911962 - RNA, 17 nt, Human
acaugacugcacaaagu

SEQ ID NO: 911963 - RNA, 22 nt, Human
agccccaggaugggccgcagga

SEQ ID NO: 911964 - RNA, 22 nt, Human
ggaaucuuaauggcauggaguu

SEQ ID NO: 911965 - RNA, 22 nt, Human
acauugagaguuuugaagagua

SEQ ID NO: 911966 - RNA, 22 nt, Human
cugggugagcuggccagagggu

SEQ ID NO: 911967 - RNA, 22 nt, Human
uguccuccaggaccugcagggc

SEQ ID NO: 911968 - RNA, 22 nt, Human
cuagagaaaauguuaauacagu

SEQ ID NO: 911969 - RNA, 22 nt, Human
ugucugccugucucugugcaaa

SEQ ID NO: 911970 - RNA, 22 nt, Human
gaugucuuguugauuucauucu

SEQ ID NO: 911971 - RNA, 22 nt, Human
cagugggaagaaugcagccucc

SEQ ID NO: 911972 - RNA, 22 nt, Human
cacacaugaaucccuaguaccu

SEQ ID NO: 911973 - RNA, 22 nt, Human
gucuccugccacacucaguccc

SEQ ID NO: 911974 - RNA, 22 nt, Human
gacuguguccaugugcuggauu

SEQ ID NO: 911975 - RNA, 22 nt, Human
uuaauuuauguccaaaccagau

SEQ ID NO: 911976 - RNA, 22 nt, Human
cuggagcaaaagugacuccucu

SEQ ID NO: 911977 - RNA, 22 nt, Human
cagcccaggucucucuuccagu

SEQ ID NO: 911978 - RNA, 22 nt, Human
aguguuguaauaaauaucaucu

SEQ ID NO: 911979 - RNA, 23 nt, Human
cugcauauggagguuagcaacuc

SEQ ID NO: 911980 - RNA, 22 nt, Human
guggcccaggcuuggcgcuggc

SEQ ID NO: 911981 - RNA, 22 nt, Human
aagcagagcaagcguauuuauu

SEQ ID NO: 911982 - RNA, 22 nt, Human
ucaggaaagaguguauccauca

SEQ ID NO: 911983 - RNA, 22 nt, Human
cucuuucucauugucagcagaa

SEQ ID NO: 911984 - RNA, 22 nt, Human
gucuuguuugggauguggaugg

SEQ ID NO: 911985 - RNA, 22 nt, Human
ucccagccuuccagucugguuu

SEQ ID NO: 911986 - RNA, 22 nt, Human
uggaggauuaaucuggaaagau

SEQ ID NO: 911987 - RNA, 22 nt, Human
ugcagcuguaacagaggccuca

SEQ ID NO: 911988 - RNA, 22 nt, Human
ucuggguggcagugauggcgug

SEQ ID NO: 911989 - RNA, 23 nt, Human
agggcugaugccauugcagcucu

SEQ ID NO: 911990 - RNA, 22 nt, Human
cauacauugcucauucaguauc

SEQ ID NO: 911991 - RNA, 20 nt, Human
agcugaggcaccugagguua

SEQ ID NO: 911992 - RNA, 22 nt, Human
ggccggggccuccccgcgucgc

SEQ ID NO: 911993 - RNA, 22 nt, Human
ucccacuggacgucugugcugg

SEQ ID NO: 911994 - RNA, 22 nt, Human
acaguauauaugguuaucugau

SEQ ID NO: 911995 - RNA, 22 nt, Human
cguguacacgcacacguguccu

SEQ ID NO: 911996 - RNA, 22 nt, Human
auuucuacaguacacaugcauu

SEQ ID NO: 911997 - RNA, 22 nt, Human
acaaauggaagguguucucuuc

SEQ ID NO: 911998 - RNA, 22 nt, Human
auuuuuccauucucuguuagua

SEQ ID NO: 911999 - RNA, 22 nt, Human
cucuuagagaguuguugaucag

SEQ ID NO: 912000 - RNA, 22 nt, Human
cugagccagggccacacaugga

SEQ ID NO: 912001 - RNA, 22 nt, Human
auaucuuuuagagcaagcuugu

SEQ ID NO: 912002 - RNA, 20 nt, Human
uccagcacccucacagagaa

SEQ ID NO: 912003 - RNA, 22 nt, Human
uuguuuuauucugcaauuuccc

SEQ ID NO: 912004 - RNA, 22 nt, Human
cagcuccccucuguggggcagu

SEQ ID NO: 912005 - RNA, 22 nt, Human
cuuuacuaucaggaauaaacaa

SEQ ID NO: 912006 - RNA, 22 nt, Human
uuucuggcagcgggacaggggu

SEQ ID NO: 912007 - RNA, 22 nt, Human
auugagcaggcaaaguaucaua

SEQ ID NO: 912008 - RNA, 22 nt, Human
ucucugggaaauggagaauuuu

SEQ ID NO: 912009 - RNA, 22 nt, Human
cuuuaauuaggaaguauaauga

SEQ ID NO: 912010 - RNA, 22 nt, Human
ucugcucugggccagcuauuaa

SEQ ID NO: 912011 - RNA, 21 nt, Human
agaaacaugaucaaaggaacc

SEQ ID NO: 912012 - RNA, 22 nt, Human
uggaaaacauaaagcuuuuccu

SEQ ID NO: 912013 - RNA, 22 nt, Human
gucuccugaggcauccauugaa

SEQ ID NO: 912014 - RNA, 22 nt, Human
aaaggcucacgcaguuagugau

SEQ ID NO: 912015 - RNA, 21 nt, Human
ucucacugucugcuuuguuua

SEQ ID NO: 912016 - RNA, 22 nt, Human
agccacagucaaccuguccaua

SEQ ID NO: 912017 - RNA, 22 nt, Human
gaaauguagaguaucugaggau

SEQ ID NO: 912018 - RNA, 22 nt, Human
auuauuauuguugauguuaggg

SEQ ID NO: 912019 - RNA, 22 nt, Human
ugccugggaaccaauccuggcu

SEQ ID NO: 912020 - RNA, 22 nt, Human
agccagaugugagaaagaacac

SEQ ID NO: 912021 - RNA, 22 nt, Human
aguaaacaguuucuuagaagaa

SEQ ID NO: 912022 - RNA, 22 nt, Human
ucuuucucucuaaucaagcaca

SEQ ID NO: 912023 - RNA, 22 nt, Human
gacagggcgagacucagucuca

SEQ ID NO: 912024 - RNA, 22 nt, Human
guuuagcaauaaaaacacauga

SEQ ID NO: 912025 - RNA, 22 nt, Human
cacugugucagaguaugaugau

SEQ ID NO: 912026 - RNA, 22 nt, Human
cugcugugccucuuuucacgug

SEQ ID NO: 912027 - RNA, 19 nt, Human
gucaggcacgugagagcau

SEQ ID NO: 912028 - RNA, 22 nt, Human
ggcugggacgaugaggauuagu

SEQ ID NO: 912029 - RNA, 22 nt, Human
uucauucccaagaguaaacaua

SEQ ID NO: 912030 - RNA, 22 nt, Human
auauuuauaagcaagcaggacu

SEQ ID NO: 912031 - RNA, 22 nt, Human
agcagacaauugccuggaugga

SEQ ID NO: 912032 - RNA, 22 nt, Human
cucucagugccacacagccauu

SEQ ID NO: 912033 - RNA, 22 nt, Human
ucaggcuggaaugcaguggggc

SEQ ID NO: 912034 - RNA, 22 nt, Human
acauuuguacauuggcaugucu

SEQ ID NO: 912035 - RNA, 22 nt, Human
gucaauauauucugucucuuug

SEQ ID NO: 912036 - RNA, 22 nt, Human
cuuauuuccugacauggaaaga

SEQ ID NO: 912037 - RNA, 22 nt, Human
ggggagaauaaaucagauuuua

SEQ ID NO: 912038 - RNA, 22 nt, Human
ucuucagagugagcagugucau

SEQ ID NO: 912039 - RNA, 18 nt, Human
uaaauauauuucccccuu

SEQ ID NO: 912040 - RNA, 18 nt, Human
auccuagaccauacacag

SEQ ID NO: 912041 - RNA, 22 nt, Human
aaauuucaguuggaaugagcuc

SEQ ID NO: 912042 - RNA, 22 nt, Human
aaugcugcaagaggugaaaaga

SEQ ID NO: 912043 - RNA, 22 nt, Human
aagugugggaaguagguggcga

SEQ ID NO: 912044 - RNA, 22 nt, Human
uuucaagaauugaagaggauuu

SEQ ID NO: 912045 - RNA, 22 nt, Human
agcaguuuuccugagcuccuca

SEQ ID NO: 912046 - RNA, 22 nt, Human
uggcuucucccgacacccuggc

SEQ ID NO: 912047 - RNA, 22 nt, Human
ugugccugcuagaugguugucg

SEQ ID NO: 912048 - RNA, 21 nt, Human
gacaggacuagaccagagcuc

SEQ ID NO: 912049 - RNA, 22 nt, Human
uucccacaaucugcguguguau

SEQ ID NO: 912050 - RNA, 22 nt, Human
gcucugguaccagcuacuccua

SEQ ID NO: 912051 - RNA, 22 nt, Human
cccagcuccaagggacagcgaa

SEQ ID NO: 912052 - RNA, 22 nt, Human
ucuggagucugagaucugagga

SEQ ID NO: 912053 - RNA, 22 nt, Human
gcucugcccagugcccugagac

SEQ ID NO: 912054 - RNA, 22 nt, Human
uccaggcuggagugcaguggca

SEQ ID NO: 912055 - RNA, 22 nt, Human
uuccuuagcagaccugguaucc

SEQ ID NO: 912056 - RNA, 19 nt, Human
uccauaagcuuguguucau

SEQ ID NO: 912057 - RNA, 22 nt, Human
ugggagcaguugugaagcucag

SEQ ID NO: 912058 - RNA, 22 nt, Human
gucuccuuguggaucucaagga

SEQ ID NO: 912059 - RNA, 22 nt, Human
uuacaagacacugcugacacag

SEQ ID NO: 912060 - RNA, 20 nt, Human
uacaacaaguagagacauac

SEQ ID NO: 912061 - RNA, 22 nt, Human
cagggcugucuccaaaggcccc

SEQ ID NO: 912062 - RNA, 20 nt, Human
uuacaagccuuguuaaaucu

SEQ ID NO: 912063 - RNA, 22 nt, Human
aacaauguucuuuuagcuugaa

SEQ ID NO: 912064 - RNA, 22 nt, Human
agugacagucugauuucucaaa

SEQ ID NO: 912065 - RNA, 22 nt, Human
ugcuggagaggaaggugggguc

SEQ ID NO: 912066 - RNA, 22 nt, Human
acaggacagguaggauucgcag

SEQ ID NO: 912067 - RNA, 21 nt, Human
agcugcuguggccagaaucca

SEQ ID NO: 912068 - RNA, 22 nt, Human
caggcacacccacuggugcaga

SEQ ID NO: 912069 - RNA, 22 nt, Human
ggcuggcuugcggagucacaga

SEQ ID NO: 912070 - RNA, 22 nt, Human
uuucuaggacaugauaggauau

SEQ ID NO: 912071 - RNA, 17 nt, Human
agagauaaggcggagaa

SEQ ID NO: 912072 - RNA, 22 nt, Human
cacagguugggggaguugauaa

SEQ ID NO: 912073 - RNA, 22 nt, Human
aggggcaaaugugagccuggaa

SEQ ID NO: 912074 - RNA, 23 nt, Human
cccugagcugguccaggcucaac

SEQ ID NO: 912075 - RNA, 22 nt, Human
uugaucuuacaguguucuucca

SEQ ID NO: 912076 - RNA, 22 nt, Human
uuucagacugcccauguuugcc

SEQ ID NO: 912077 - RNA, 22 nt, Human
uggaagugaugcugaggugacg

SEQ ID NO: 912078 - RNA, 22 nt, Human
gggucugagcugaggggaaauc

SEQ ID NO: 912079 - RNA, 22 nt, Human
uugauuuguauugcaggccccu

SEQ ID NO: 912080 - RNA, 22 nt, Human
acccaggcuggaaugcaguggu

SEQ ID NO: 912081 - RNA, 22 nt, Human
aggcuggcucggcuuuucuguc

SEQ ID NO: 912082 - RNA, 22 nt, Human
guaguguguaggcacugugcuc

SEQ ID NO: 912083 - RNA, 21 nt, Human
agucuguuaggaugacucuga

SEQ ID NO: 912084 - RNA, 22 nt, Human
ggcagagacuggguuggcagag

SEQ ID NO: 912085 - RNA, 22 nt, Human
gcagcuguagaggggagaaaga

SEQ ID NO: 912086 - RNA, 22 nt, Human
uuucacacccacuaggacuguu

SEQ ID NO: 912087 - RNA, 22 nt, Human
agaaaggguucucugaggugcu

SEQ ID NO: 912088 - RNA, 22 nt, Human
uugauuugcagaagguguagag

SEQ ID NO: 912089 - RNA, 22 nt, Human
uagugugguaaauaaauguuuu

SEQ ID NO: 912090 - RNA, 22 nt, Human
ugggccagaaguaugcauguuu

SEQ ID NO: 912091 - RNA, 22 nt, Human
ccuuccagauguaagagcugau

SEQ ID NO: 912092 - RNA, 22 nt, Human
aguguccaacucagcuugucaa

SEQ ID NO: 912093 - RNA, 22 nt, Human
aauauuucaaaaggaaacacag

SEQ ID NO: 912094 - RNA, 22 nt, Human
gaagagaugacaaaggagcaug

SEQ ID NO: 912095 - RNA, 22 nt, Human
gcucccugccuacacggaccuu

SEQ ID NO: 912096 - RNA, 22 nt, Human
gagagaaaggauaacagcucaa

SEQ ID NO: 912097 - RNA, 22 nt, Human
cucugggguuagaucugaugcu

SEQ ID NO: 912098 - RNA, 22 nt, Human
acccaggcagcaggagcuaaag

SEQ ID NO: 912099 - RNA, 22 nt, Human
aggagucuguugaaaugucuau

SEQ ID NO: 912100 - RNA, 22 nt, Human
aggcacagagaaugcccuccau

SEQ ID NO: 912101 - RNA, 17 nt, Human
uuucugcaugauuggac

SEQ ID NO: 912102 - RNA, 22 nt, Human
agguacauggggugugugcacg

SEQ ID NO: 912103 - RNA, 22 nt, Human
auggcaguugcccagccaaucc

SEQ ID NO: 912104 - RNA, 22 nt, Human
uagaaaguagggaagguaggau

SEQ ID NO: 912105 - RNA, 22 nt, Human
gcacacaugcaugcacaggagu

SEQ ID NO: 912106 - RNA, 22 nt, Human
ccacagaguccgcauuugaggc

SEQ ID NO: 912107 - RNA, 22 nt, Human
uuccaaguguugagauuagagg

SEQ ID NO: 912108 - RNA, 22 nt, Human
ccaagcaaggcuaauucacuug

SEQ ID NO: 912109 - RNA, 22 nt, Human
uaaacauggauucugaucacag

SEQ ID NO: 912110 - RNA, 22 nt, Human
ucugagacuuuaaccuggggcc

SEQ ID NO: 912111 - RNA, 22 nt, Human
aggaagccuggggcugcccucg

SEQ ID NO: 912112 - RNA, 22 nt, Human
ucucaugugauucccgugcaug

SEQ ID NO: 912113 - RNA, 22 nt, Human
gucaggauuuuaaaaucccagu

SEQ ID NO: 912114 - RNA, 22 nt, Human
auggcccaaaaccuccucccuc

SEQ ID NO: 912115 - RNA, 22 nt, Human
agucuuauguuugugaagaacu

SEQ ID NO: 912116 - RNA, 22 nt, Human
aggcugagacugugcauuagug

SEQ ID NO: 912117 - RNA, 22 nt, Human
cccaguggaaggaguagaagac

SEQ ID NO: 912118 - RNA, 22 nt, Human
ggccuggccucccuuccuagcg

SEQ ID NO: 912119 - RNA, 22 nt, Human
gaagcugcguguagccauacuu

SEQ ID NO: 912120 - RNA, 22 nt, Human
aaguguuuaaauuauuugcagg

SEQ ID NO: 912121 - RNA, 22 nt, Human
aaggggugggcauuagagcagu

SEQ ID NO: 912122 - RNA, 21 nt, Human
uaguuucuacccaguuaaugg

SEQ ID NO: 912123 - RNA, 22 nt, Human
uucuggaaaagaaaguuaagau

SEQ ID NO: 912124 - RNA, 21 nt, Human
augggcagaggcagagaggcu

SEQ ID NO: 912125 - RNA, 22 nt, Human
uaguuuccuaggcuguauuguu

SEQ ID NO: 912126 - RNA, 21 nt, Human
auguuauucuguuccuccagc

SEQ ID NO: 912127 - RNA, 22 nt, Human
uucuguuaucauuaagcauuau

SEQ ID NO: 912128 - RNA, 22 nt, Human
cuggcacagccacugcaggcag

SEQ ID NO: 912129 - RNA, 22 nt, Human
uuucauuuugguuaugccauaa

SEQ ID NO: 912130 - RNA, 22 nt, Human
ggccaggcuggucucagacuuc

SEQ ID NO: 912131 - RNA, 22 nt, Human
cauggcuggugcaccucuggga

SEQ ID NO: 912132 - RNA, 21 nt, Human
uagagauguuugcuaaguagc

SEQ ID NO: 912133 - RNA, 22 nt, Human
auguccugguccuccaccaugg

SEQ ID NO: 912134 - RNA, 22 nt, Human
gcucaaagcacuuugcaaauau

SEQ ID NO: 912135 - RNA, 17 nt, Human
cucagagcaggacagaa

SEQ ID NO: 912136 - RNA, 22 nt, Human
gcugagggggaaggaaagcuga

SEQ ID NO: 912137 - RNA, 22 nt, Human
ugucuguccccugccuugaggg

SEQ ID NO: 912138 - RNA, 21 nt, Human
cauuucaaagagcuggaaauc

SEQ ID NO: 912139 - RNA, 22 nt, Human
ggcagcucugcuccuuggcucc

SEQ ID NO: 912140 - RNA, 23 nt, Human
uauccaguagggcccagagcuga

SEQ ID NO: 912141 - RNA, 22 nt, Human
cucaggucacaggauggccagg

SEQ ID NO: 912142 - RNA, 22 nt, Human
caggagcuacucagguuggguu

SEQ ID NO: 912143 - RNA, 22 nt, Human
aaacacugucucugguauugaa

SEQ ID NO: 912144 - RNA, 22 nt, Human
aggcuccagucuccucuggcag

SEQ ID NO: 912145 - RNA, 19 nt, Human
augaaggcacugaguggga

SEQ ID NO: 912146 - RNA, 22 nt, Human
ugcuccacuugggcacccccca

SEQ ID NO: 912147 - RNA, 22 nt, Human
agcauuugaaaacuauuuaauu

SEQ ID NO: 912148 - RNA, 22 nt, Human
gcuggccugggcagccugucgg

SEQ ID NO: 912149 - RNA, 22 nt, Human
uggaaagguguaaagcagaacc

SEQ ID NO: 912150 - RNA, 22 nt, Human
uuacacagaaacacuguucaga

SEQ ID NO: 912151 - RNA, 22 nt, Human
aggcugugggugauuuacugug

SEQ ID NO: 912152 - RNA, 22 nt, Human
ccaggugguucaggucaccaua

SEQ ID NO: 912153 - RNA, 22 nt, Human
uucugagguccaugcaguacug

SEQ ID NO: 912154 - RNA, 19 nt, Human
ugagaaggcaguggggagc

SEQ ID NO: 912155 - RNA, 22 nt, Human
uucaaaugcaaguuacuacuuu

SEQ ID NO: 912156 - RNA, 22 nt, Human
agccacagagguugaugugguu

SEQ ID NO: 912157 - RNA, 19 nt, Human
agcuggagauuggagggca

SEQ ID NO: 912158 - RNA, 22 nt, Human
uacagaguggugagaucuuuug

SEQ ID NO: 912159 - RNA, 22 nt, Human
uuacaaugagaaaugguuggca

SEQ ID NO: 912160 - RNA, 22 nt, Human
ugcugcuggaucuuacucaucu

SEQ ID NO: 912161 - RNA, 23 nt, Human
augugugggaggucagagagcca

SEQ ID NO: 912162 - RNA, 22 nt, Human
acugucaccaucagagcgggaa

SEQ ID NO: 912163 - RNA, 22 nt, Human
agaagccaaucagcucucugcu

SEQ ID NO: 912164 - RNA, 22 nt, Human
aaaauagcuauggaaugucacu

SEQ ID NO: 912165 - RNA, 22 nt, Human
uggaaggggccaggcgcggagu

SEQ ID NO: 912166 - RNA, 20 nt, Human
aaaugcugagaaguccuuaa

SEQ ID NO: 912167 - RNA, 22 nt, Human
uuggauucacuguugguagagu

SEQ ID NO: 912168 - RNA, 22 nt, Human
gccuuuauuuucaacggagugu

SEQ ID NO: 912169 - RNA, 22 nt, Human
cccagcucaucaggagccgccc

SEQ ID NO: 912170 - RNA, 22 nt, Human
ucugacccucagaucaugucca

SEQ ID NO: 912171 - RNA, 22 nt, Human
uuaguuauacuacugaauggag

SEQ ID NO: 912172 - RNA, 22 nt, Human
acugggcuuaugcuguggagua

SEQ ID NO: 912173 - RNA, 23 nt, Human
uguguacauacauauguacacac

SEQ ID NO: 912174 - RNA, 22 nt, Human
auauauaauacuugcugugggc

SEQ ID NO: 912175 - RNA, 22 nt, Human
ggcagggguucauuuugucuua

SEQ ID NO: 912176 - RNA, 18 nt, Human
ggcaggcucucuggguca

SEQ ID NO: 912177 - RNA, 22 nt, Human
gaacauaauuaaauguccuggg

SEQ ID NO: 912178 - RNA, 22 nt, Human
aaagguaugauacugugacaug

SEQ ID NO: 912179 - RNA, 22 nt, Human
ccacuuuuucagugugcaugca

SEQ ID NO: 912180 - RNA, 22 nt, Human
cauauggacaagaacauuuaug

SEQ ID NO: 912181 - RNA, 22 nt, Human
aggagaaauccaucgagaaugg

SEQ ID NO: 912182 - RNA, 22 nt, Human
acauggaauguguacuaaguua

SEQ ID NO: 912183 - RNA, 22 nt, Human
uguggggcugugguguucuucu

SEQ ID NO: 912184 - RNA, 22 nt, Human
gagcagagacaguacaacuggc

SEQ ID NO: 912185 - RNA, 22 nt, Human
acacaggagauauguaauggcu

SEQ ID NO: 912186 - RNA, 22 nt, Human
uaucaaauugaggcagcugggg

SEQ ID NO: 912187 - RNA, 22 nt, Human
uggaaccuggcauuagggacac

SEQ ID NO: 912188 - RNA, 22 nt, Human
aaggggccucacagaugggcuu

SEQ ID NO: 912189 - RNA, 22 nt, Human
ucuuuguaaguuauauguagua

SEQ ID NO: 912190 - RNA, 22 nt, Human
uacacaugaucauuuaguagca

SEQ ID NO: 912191 - RNA, 22 nt, Human
aagaaaucauaucauuucuugg

SEQ ID NO: 912192 - RNA, 22 nt, Human
guuacaaaggucauaaaagugu

SEQ ID NO: 912193 - RNA, 22 nt, Human
aggcuggaguacaguggcuauu

SEQ ID NO: 912194 - RNA, 19 nt, Human
gagaaucucuuugauguuu

SEQ ID NO: 912195 - RNA, 22 nt, Human
ugugaaauguguguauaauuaa

SEQ ID NO: 912196 - RNA, 22 nt, Human
cuucccugauaagagccucaga

SEQ ID NO: 912197 - RNA, 22 nt, Human
uaaaguguguauauacauaugg

SEQ ID NO: 912198 - RNA, 22 nt, Human
uaaguauguuagaaaaucaagu

SEQ ID NO: 912199 - RNA, 19 nt, Human
guguauguaaguugugagg

SEQ ID NO: 912200 - RNA, 22 nt, Human
gaauuagguaauagaacuagua

SEQ ID NO: 912201 - RNA, 19 nt, Human
ggcuucaguuuagcaggcu

SEQ ID NO: 912202 - RNA, 22 nt, Human
ccucucucuccugcacacacac

SEQ ID NO: 912203 - RNA, 23 nt, Human
gaggucaaggcugcagugauugc

SEQ ID NO: 912204 - RNA, 22 nt, Human
accagugucuuauugaccaucu

SEQ ID NO: 912205 - RNA, 19 nt, Human
ugugugguuggugaaacuc

SEQ ID NO: 912206 - RNA, 22 nt, Human
guaaaguacaagccucauuaca

SEQ ID NO: 912207 - RNA, 22 nt, Human
cggcugugucuucacaggagcc

SEQ ID NO: 912208 - RNA, 22 nt, Human
ccagagguuacacccucagccc

SEQ ID NO: 912209 - RNA, 20 nt, Human
cugacagaaaauauuucauc

SEQ ID NO: 912210 - RNA, 22 nt, Human
augaggcaggagugcaguggca

SEQ ID NO: 912211 - RNA, 22 nt, Human
ugggaguuaguuauacugugac

SEQ ID NO: 912212 - RNA, 22 nt, Human
aguucucauuucacaggcagug

SEQ ID NO: 912213 - RNA, 19 nt, Human
acuguucuguauguugauu

SEQ ID NO: 912214 - RNA, 22 nt, Human
cugcuccucugagguagccaca

SEQ ID NO: 912215 - RNA, 19 nt, Human
ugaggccagcuggcauuuu

SEQ ID NO: 912216 - RNA, 22 nt, Human
aacaggaaugaggagaaaaggu

SEQ ID NO: 912217 - RNA, 22 nt, Human
ucuggcccagccccugauccca

SEQ ID NO: 912218 - RNA, 22 nt, Human
uaguuaauucuuuaagaacaag

SEQ ID NO: 912219 - RNA, 22 nt, Human
cuagcaguguacucaacaaggg

SEQ ID NO: 912220 - RNA, 22 nt, Human
uguauaaauuuaaauuccugcu

SEQ ID NO: 912221 - RNA, 19 nt, Human
uccugaaaacuucuggaau

SEQ ID NO: 912222 - RNA, 22 nt, Human
cugaagcaauugagagauguuu

SEQ ID NO: 912223 - RNA, 22 nt, Human
cagagccuuccuagcagacucu

SEQ ID NO: 912224 - RNA, 22 nt, Human
cuggcagcuucaggacacucgg

SEQ ID NO: 912225 - RNA, 22 nt, Human
aagcuguaugaccuaaaucuug

SEQ ID NO: 912226 - RNA, 22 nt, Human
uuuaauguagcgugaaaugauu

SEQ ID NO: 912227 - RNA, 22 nt, Human
agcagagcggggccuccggaag

SEQ ID NO: 912228 - RNA, 22 nt, Human
uggaaguggcagaaaaugaaca

SEQ ID NO: 912229 - RNA, 22 nt, Human
ggaauguuuuagcuugacuuuu

SEQ ID NO: 912230 - RNA, 22 nt, Human
ggcuccagaggccuuaccugca

SEQ ID NO: 912231 - RNA, 22 nt, Human
acuuuugaagaauuaugcaaaa

SEQ ID NO: 912232 - RNA, 22 nt, Human
auguguauacuugugcuuacuc

SEQ ID NO: 912233 - RNA, 22 nt, Human
uugugcauggcuacuuuuuaug

SEQ ID NO: 912234 - RNA, 22 nt, Human
gcaggacacagaugcaaggcca

SEQ ID NO: 912235 - RNA, 22 nt, Human
aagcagcugcagguucaaagga

SEQ ID NO: 912236 - RNA, 22 nt, Human
uugcacaaaaaauuguugaaua

SEQ ID NO: 912237 - RNA, 22 nt, Human
acaguaauugugaacuuaacgu

SEQ ID NO: 912238 - RNA, 22 nt, Human
cuggccagggugcgaucguggu

SEQ ID NO: 912239 - RNA, 22 nt, Human
ugagagaugaaguuaguuguuc

SEQ ID NO: 912240 - RNA, 22 nt, Human
accugcugaggagggggaauua

SEQ ID NO: 912241 - RNA, 22 nt, Human
cagacacagauaugcauauggc

SEQ ID NO: 912242 - RNA, 22 nt, Human
ucuuccuuucauucauguguua

SEQ ID NO: 912243 - RNA, 22 nt, Human
agugauuaaagcuaggauaaaa

SEQ ID NO: 912244 - RNA, 22 nt, Human
caggcagacauuuuugacauag

SEQ ID NO: 912245 - RNA, 22 nt, Human
uauguucugucuguacagauuu

SEQ ID NO: 912246 - RNA, 22 nt, Human
gcuucuguauuuauuguccuuu

SEQ ID NO: 912247 - RNA, 22 nt, Human
uugcagggaaaucagugaggau

SEQ ID NO: 912248 - RNA, 22 nt, Human
gugcaugcacacaugugugagg

SEQ ID NO: 912249 - RNA, 22 nt, Human
cugacagaaucauuaagaccau

SEQ ID NO: 912250 - RNA, 23 nt, Human
uaagugauaaagaguagagaugg

SEQ ID NO: 912251 - RNA, 22 nt, Human
acuuggccuuauuuccacagaa

SEQ ID NO: 912252 - RNA, 22 nt, Human
ggcagguggaaggucuccauuc

SEQ ID NO: 912253 - RNA, 22 nt, Human
uguaucagaucaaauacuggcu

SEQ ID NO: 912254 - RNA, 22 nt, Human
ucuguggcuuccuauuucuugg

SEQ ID NO: 912255 - RNA, 22 nt, Human
cacauccuucauacucagcucu

SEQ ID NO: 912256 - RNA, 22 nt, Human
cuggcuuuguucugauugcuuc

SEQ ID NO: 912257 - RNA, 16 nt, Human
uagcuuuuuccuaugu

SEQ ID NO: 912258 - RNA, 22 nt, Human
gcuccagguauuugcccuuuua

SEQ ID NO: 912259 - RNA, 21 nt, Human
cuggcucuguugucacccggc

SEQ ID NO: 912260 - RNA, 22 nt, Human
aaaaccauguaucuauuuccuu

SEQ ID NO: 912261 - RNA, 22 nt, Human
uuagguauucauuuacauguuc

SEQ ID NO: 912262 - RNA, 22 nt, Human
agcagggcugugcuccuuccga

SEQ ID NO: 912263 - RNA, 21 nt, Human
uggccagcuggagucuccaca

SEQ ID NO: 912264 - RNA, 22 nt, Human
caggcagagacgucaguguagg

SEQ ID NO: 912265 - RNA, 22 nt, Human
ucucuaacaguggcugcugccu

SEQ ID NO: 912266 - RNA, 22 nt, Human
ggugaaauguagucuugugaga

SEQ ID NO: 912267 - RNA, 22 nt, Human
uuugcuaaaagugaugaagaca

SEQ ID NO: 912268 - RNA, 22 nt, Human
ucugggcacacaccaugcccac

SEQ ID NO: 912269 - RNA, 22 nt, Human
uggggccugagguggagcugca

SEQ ID NO: 912270 - RNA, 22 nt, Human
aacuacagaaaagguaagcucu

SEQ ID NO: 912271 - RNA, 22 nt, Human
cuuccuggaugagcaggcugau

SEQ ID NO: 912272 - RNA, 22 nt, Human
aaaaguucccugguuagaaaag

SEQ ID NO: 912273 - RNA, 22 nt, Human
uaguacagugcucuguaaguuu

SEQ ID NO: 912274 - RNA, 22 nt, Human
uggcagcagacaaaaggccauu

SEQ ID NO: 912275 - RNA, 22 nt, Human
uggcccuggguggaauguccca

SEQ ID NO: 912276 - RNA, 22 nt, Human
gccuuagaaaaauaagauuuua

SEQ ID NO: 912277 - RNA, 22 nt, Human
gauuucaaggauguuagaggug

SEQ ID NO: 912278 - RNA, 22 nt, Human
uuaaguauauccauuugacugg

SEQ ID NO: 912279 - RNA, 20 nt, Human
auuugcuuaccuuguuucua

SEQ ID NO: 912280 - RNA, 22 nt, Human
ucucaaguuauguaacagcugu

SEQ ID NO: 912281 - RNA, 22 nt, Human
ugauauuugcugacugcauugu

SEQ ID NO: 912282 - RNA, 22 nt, Human
uggcagaccaucuuauuaacaa

SEQ ID NO: 912283 - RNA, 22 nt, Human
caaguuuacaauguguaugugu

SEQ ID NO: 912284 - RNA, 22 nt, Human
acacaguggugagucuggaccu

SEQ ID NO: 912285 - RNA, 22 nt, Human
acaaauguuggauuugucuucc

SEQ ID NO: 912286 - RNA, 22 nt, Human
ugcuggaggccgagaagcagca

SEQ ID NO: 912287 - RNA, 19 nt, Human
guuuccuuggguguaggga

SEQ ID NO: 912288 - RNA, 22 nt, Human
agcagguguagggcucuuugua

SEQ ID NO: 912289 - RNA, 22 nt, Human
caggagugcagguggugaggca

SEQ ID NO: 912290 - RNA, 22 nt, Human
auguguaugauaccuuugcuga

SEQ ID NO: 912291 - RNA, 22 nt, Human
aaguagcagggauuacaggugu

SEQ ID NO: 912292 - RNA, 22 nt, Human
ccuguguucuaauccaucucag

SEQ ID NO: 912293 - RNA, 23 nt, Human
uguuuucuuguccugguauaauu

SEQ ID NO: 912294 - RNA, 22 nt, Human
cucucuccuuagcugcagacca

SEQ ID NO: 912295 - RNA, 22 nt, Human
gagacagcacaggccacuggga

SEQ ID NO: 912296 - RNA, 22 nt, Human
ccugcacuaccuggggcugcug

SEQ ID NO: 912297 - RNA, 22 nt, Human
aagggacauagacuguacaucu

SEQ ID NO: 912298 - RNA, 18 nt, Human
gagaaagcagggaauguu

SEQ ID NO: 912299 - RNA, 22 nt, Human
ggaugugaaucugggcugagac

SEQ ID NO: 912300 - RNA, 22 nt, Human
ccccagggaagcuuugcuuacu

SEQ ID NO: 912301 - RNA, 18 nt, Human
cuggcauucuucccugga

SEQ ID NO: 912302 - RNA, 22 nt, Human
agggaggaccaaugugugguua

SEQ ID NO: 912303 - RNA, 22 nt, Human
ugagcccuaauuuacaacaucu

SEQ ID NO: 912304 - RNA, 22 nt, Human
guggcagaacuaugugauugcu

SEQ ID NO: 912305 - RNA, 22 nt, Human
cacagggcuucucauggggugc

SEQ ID NO: 912306 - RNA, 22 nt, Human
uuuauguuugacaaugaucugg

SEQ ID NO: 912307 - RNA, 22 nt, Human
auccuugggucucuggaaauug

SEQ ID NO: 912308 - RNA, 18 nt, Human
ugcuccaggcccaugggc

SEQ ID NO: 912309 - RNA, 22 nt, Human
caggcuggagugaguguagugg

SEQ ID NO: 912310 - RNA, 22 nt, Human
agacacugaaucagagggacau

SEQ ID NO: 912311 - RNA, 23 nt, Human
cccagcgcugagcccugcaggca

SEQ ID NO: 912312 - RNA, 18 nt, Human
cuguugagauguggcuga

SEQ ID NO: 912313 - RNA, 22 nt, Human
cagcugucugaagcaggagucc

SEQ ID NO: 912314 - RNA, 22 nt, Human
auaagugagaacaaaaauuaga

SEQ ID NO: 912315 - RNA, 22 nt, Human
ccugaguggccaggcagcugug

SEQ ID NO: 912316 - RNA, 22 nt, Human
aauugucaaacacaaauaagag

SEQ ID NO: 912317 - RNA, 22 nt, Human
cuggagggggaaauguucauug

SEQ ID NO: 912318 - RNA, 19 nt, Human
aaaauugcguauuuugagg

SEQ ID NO: 912319 - RNA, 22 nt, Human
accuguuuuagucuuuaaucau

SEQ ID NO: 912320 - RNA, 22 nt, Human
gaaggcaagcagcauaaauguc

SEQ ID NO: 912321 - RNA, 22 nt, Human
uagaaucugaauauucuuauuu

SEQ ID NO: 912322 - RNA, 22 nt, Human
gaacaaauuggagaaaucagga

SEQ ID NO: 912323 - RNA, 22 nt, Human
agcuacaguggacaagugaacu

SEQ ID NO: 912324 - RNA, 22 nt, Human
uuuaugagccucaaaucugagu

SEQ ID NO: 912325 - RNA, 22 nt, Human
ccagcuccaaguuugggcauca

SEQ ID NO: 912326 - RNA, 22 nt, Human
gagcuguccgccccugggccga

SEQ ID NO: 912327 - RNA, 21 nt, Human
ggcaguaagccaaauccauuu

SEQ ID NO: 912328 - RNA, 22 nt, Human
ucucagggagagcugcuggcau

SEQ ID NO: 912329 - RNA, 21 nt, Human
gcucuguuauuuucuaugcag

SEQ ID NO: 912330 - RNA, 22 nt, Human
agcaccuggucuccuggcgcug

SEQ ID NO: 912331 - RNA, 20 nt, Human
aggaagccaaaggcugucuu

SEQ ID NO: 912332 - RNA, 22 nt, Human
aauagaacaauaauuguaaacu

SEQ ID NO: 912333 - RNA, 22 nt, Human
ugacaaagccucauccuucaga

SEQ ID NO: 912334 - RNA, 22 nt, Human
agggccagaggcaccuugcagc

SEQ ID NO: 912335 - RNA, 19 nt, Human
uggcagaggcaguuuguac

SEQ ID NO: 912336 - RNA, 22 nt, Human
gauguaaaaccuauggagcuga

SEQ ID NO: 912337 - RNA, 22 nt, Human
uucuuucaauagcuggcauaug

SEQ ID NO: 912338 - RNA, 22 nt, Human
uuccagaguccauguuggcuca

SEQ ID NO: 912339 - RNA, 22 nt, Human
gaugacaaaacuuuugccagca

SEQ ID NO: 912340 - RNA, 23 nt, Human
auuuccuaaaagauaaucauuac

SEQ ID NO: 912341 - RNA, 22 nt, Human
acuuccaacuucaguccugagc

SEQ ID NO: 912342 - RNA, 22 nt, Human
agucagugggagaagugugaag

SEQ ID NO: 912343 - RNA, 22 nt, Human
ucuuggcaugcaugggcaauca

SEQ ID NO: 912344 - RNA, 22 nt, Human
ucuguuucuauaaagacaagag

SEQ ID NO: 912345 - RNA, 22 nt, Human
agugucaauucucaaaucucgg

SEQ ID NO: 912346 - RNA, 22 nt, Human
gcaauaaaguagcagcucauca

SEQ ID NO: 912347 - RNA, 22 nt, Human
uuccuguuucauagaaaacuga

SEQ ID NO: 912348 - RNA, 22 nt, Human
gcaggaguuaggcgucguggau

SEQ ID NO: 912349 - RNA, 22 nt, Human
aucuauuucugcuaauaacaau

SEQ ID NO: 912350 - RNA, 19 nt, Human
ggcagguagagggccaguc

SEQ ID NO: 912351 - RNA, 22 nt, Human
agcuuucaggauaaugaaaaag

SEQ ID NO: 912352 - RNA, 22 nt, Human
gccagguggcugagcagcugca

SEQ ID NO: 912353 - RNA, 19 nt, Human
agcuggcagcuuccacuuc

SEQ ID NO: 912354 - RNA, 22 nt, Human
aagcagagugauauaaacaugg

SEQ ID NO: 912355 - RNA, 22 nt, Human
auguauauacuuacaugugugg

SEQ ID NO: 912356 - RNA, 22 nt, Human
cugucaauuuauguugacaugc

SEQ ID NO: 912357 - RNA, 18 nt, Human
gccugcaggcacgggggu

SEQ ID NO: 912358 - RNA, 22 nt, Human
aaggcuucuggagcuugcuggc

SEQ ID NO: 912359 - RNA, 22 nt, Human
aucaggaagaauuggaugcuac

SEQ ID NO: 912360 - RNA, 22 nt, Human
gauuuguaguuuuaugugucag

SEQ ID NO: 912361 - RNA, 22 nt, Human
ucacacagcugacagagccuuu

SEQ ID NO: 912362 - RNA, 22 nt, Human
uuagauacauucucauuuguuu

SEQ ID NO: 912363 - RNA, 22 nt, Human
ggagagucugagccugcuggag

SEQ ID NO: 912364 - RNA, 22 nt, Human
uuaguaaauaaagucuacuuuc

SEQ ID NO: 912365 - RNA, 22 nt, Human
cugcuguagccacugggcucag

SEQ ID NO: 912366 - RNA, 22 nt, Human
agcugcuguuucuugcacguau

SEQ ID NO: 912367 - RNA, 22 nt, Human
cugggacuugggcuaugcucug

SEQ ID NO: 912368 - RNA, 22 nt, Human
cccugugucuucuugccuuugu

SEQ ID NO: 912369 - RNA, 23 nt, Human
uggcaaggaaugggauggagacu

SEQ ID NO: 912370 - RNA, 22 nt, Human
ugugacuggaguccagcccacu

SEQ ID NO: 912371 - RNA, 22 nt, Human
caggcccucaggcaagggcucu

SEQ ID NO: 912372 - RNA, 22 nt, Human
uagggaggcuacuucuuguagg

SEQ ID NO: 912373 - RNA, 22 nt, Human
ucccuccuggugagcaggggcu

SEQ ID NO: 912374 - RNA, 22 nt, Human
ggagggguggaaggagugccug

SEQ ID NO: 912375 - RNA, 22 nt, Human
cguguguguaccugcgcauuua

SEQ ID NO: 912376 - RNA, 22 nt, Human
gagacugauggggcucccagaa

SEQ ID NO: 912377 - RNA, 22 nt, Human
caaagauaaucacagaauaccc

SEQ ID NO: 912378 - RNA, 22 nt, Human
ccaggaagcucugcuccacggg

SEQ ID NO: 912379 - RNA, 22 nt, Human
auguguauauuuggugucaaua

SEQ ID NO: 912380 - RNA, 22 nt, Human
acccaggaggugacacagggcu

SEQ ID NO: 912381 - RNA, 22 nt, Human
uucacagggcagaucauuucug

SEQ ID NO: 912382 - RNA, 22 nt, Human
auacacuggacaucauugcauu

SEQ ID NO: 912383 - RNA, 22 nt, Human
aggagccaaauuuuagacucug

SEQ ID NO: 912384 - RNA, 22 nt, Human
agaaaguuaaacagugauaaga

SEQ ID NO: 912385 - RNA, 22 nt, Human
ugaguguggggaaugucaugag

SEQ ID NO: 912386 - RNA, 22 nt, Human
agcccagcacugggggcccagc

SEQ ID NO: 912387 - RNA, 22 nt, Human
agggaacagugaaaggcaucag

SEQ ID NO: 912388 - RNA, 22 nt, Human
ucuagcaggcaaaagcucggca

SEQ ID NO: 912389 - RNA, 22 nt, Human
aucugccuguauuuaccaucau

SEQ ID NO: 912390 - RNA, 22 nt, Human
aaagcaaucagauucagauguc

SEQ ID NO: 912391 - RNA, 19 nt, Human
cuugaaaugagacugaagg

SEQ ID NO: 912392 - RNA, 22 nt, Human
uucacauugugguucaugugaa

SEQ ID NO: 912393 - RNA, 22 nt, Human
uacaugaauguuucaauauugu

SEQ ID NO: 912394 - RNA, 22 nt, Human
caaauaguuuuucauguauuau

SEQ ID NO: 912395 - RNA, 22 nt, Human
acaagguacaaaacagagcaca

SEQ ID NO: 912396 - RNA, 22 nt, Human
caacacugacaauggacugauu

SEQ ID NO: 912397 - RNA, 22 nt, Human
ugugugucauuuaggguggagc

SEQ ID NO: 912398 - RNA, 22 nt, Human
agaggcaacauggggaacagau

SEQ ID NO: 912399 - RNA, 22 nt, Human
cucugcuguucuuauguguccu

SEQ ID NO: 912400 - RNA, 22 nt, Human
acguugaauguccauuugagau

SEQ ID NO: 912401 - RNA, 22 nt, Human
gcuuaggaaaaugguggaguug

SEQ ID NO: 912402 - RNA, 22 nt, Human
aguauacauagugcuuccucuu

SEQ ID NO: 912403 - RNA, 22 nt, Human
agcugcagagguuugugcaaca

SEQ ID NO: 912404 - RNA, 22 nt, Human
ucaaaggcuugugguucuggga

SEQ ID NO: 912405 - RNA, 21 nt, Human
ugcagcagaguaagcagggga

SEQ ID NO: 912406 - RNA, 22 nt, Human
guuccaggcaagugggauagga

SEQ ID NO: 912407 - RNA, 22 nt, Human
auguguuaguuugugauuauac

SEQ ID NO: 912408 - RNA, 22 nt, Human
gugguuuuacaaagagaaagau

SEQ ID NO: 912409 - RNA, 22 nt, Human
agccagcugcucgggggaaaca

SEQ ID NO: 912410 - RNA, 22 nt, Human
acagugcagggugggaagaagg

SEQ ID NO: 912411 - RNA, 22 nt, Human
uucugcaucucacagccagugc

SEQ ID NO: 912412 - RNA, 22 nt, Human
acaaaugaacauauaagcuuga

SEQ ID NO: 912413 - RNA, 22 nt, Human
ccaggcccaggguacugaccaa

SEQ ID NO: 912414 - RNA, 22 nt, Human
guggcagcauggcuuuuagcug

SEQ ID NO: 912415 - RNA, 22 nt, Human
agauuuauguggucacacucag

SEQ ID NO: 912416 - RNA, 22 nt, Human
aacuuuucauugaaucauguca

SEQ ID NO: 912417 - RNA, 22 nt, Human
ggcuccaggguaccccuggaug

SEQ ID NO: 912418 - RNA, 22 nt, Human
aauuugauucagcaaauguuca

SEQ ID NO: 912419 - RNA, 18 nt, Human
agaaggagcuaugggcag

SEQ ID NO: 912420 - RNA, 22 nt, Human
gauuuacagcuauacccaaugg

SEQ ID NO: 912421 - RNA, 19 nt, Human
uuggaugcuaccagguacc

SEQ ID NO: 912422 - RNA, 22 nt, Human
ggacaggguaaguacuagugug

SEQ ID NO: 912423 - RNA, 22 nt, Human
uuucacaggaugcuguuuuaua

SEQ ID NO: 912424 - RNA, 22 nt, Human
auagauacuuauaacaauugug

SEQ ID NO: 912425 - RNA, 22 nt, Human
aaagagcucacaguccacugga

SEQ ID NO: 912426 - RNA, 22 nt, Human
uagagcuggaauuugcagcaag

SEQ ID NO: 912427 - RNA, 21 nt, Human
cccaggagaagaaaagaugca

SEQ ID NO: 912428 - RNA, 22 nt, Human
accacaggacccaugagucagu

SEQ ID NO: 912429 - RNA, 22 nt, Human
auucuuauuauaguaaaacagu

SEQ ID NO: 912430 - RNA, 22 nt, Human
aacuacagcaucuauacaaaua

SEQ ID NO: 912431 - RNA, 22 nt, Human
augcauauaaggcacauguauu

SEQ ID NO: 912432 - RNA, 22 nt, Human
gcuggccauucucuuugagaug

SEQ ID NO: 912433 - RNA, 22 nt, Human
gauccaaauuauuuuuuagagg

SEQ ID NO: 912434 - RNA, 22 nt, Human
ugucugugaccucuuaggcaag

SEQ ID NO: 912435 - RNA, 22 nt, Human
agcagagguguuuauuauggga

SEQ ID NO: 912436 - RNA, 18 nt, Human
cccggcuaauuuuuggua

SEQ ID NO: 912437 - RNA, 22 nt, Human
uccugcagcucugagaagcauc

SEQ ID NO: 912438 - RNA, 22 nt, Human
auauguauagccagucuuuagg

SEQ ID NO: 912439 - RNA, 22 nt, Human
aggccaggauagcauggaucag

SEQ ID NO: 912440 - RNA, 18 nt, Human
gcagagcagaagcucaag

SEQ ID NO: 912441 - RNA, 22 nt, Human
aucuggagugggacacagaaau

SEQ ID NO: 912442 - RNA, 22 nt, Human
agacuacaggagaaacucacuc

SEQ ID NO: 912443 - RNA, 22 nt, Human
uggguaggggacguggaagaaa

SEQ ID NO: 912444 - RNA, 22 nt, Human
auauucaaauuacauuuacuaa

SEQ ID NO: 912445 - RNA, 22 nt, Human
gcucucuggaggccauggacag

SEQ ID NO: 912446 - RNA, 22 nt, Human
ccugcucugccaaguccucuuu

SEQ ID NO: 912447 - RNA, 22 nt, Human
gcaagaacaggugcuuggcaag

SEQ ID NO: 912448 - RNA, 22 nt, Human
uaugaagugauguugaauuuug

SEQ ID NO: 912449 - RNA, 22 nt, Human
acauucaugucccacuucuagc

SEQ ID NO: 912450 - RNA, 22 nt, Human
acauuuuuauccugagugccag

SEQ ID NO: 912451 - RNA, 22 nt, Human
gaugaugugucccaagaaguag

SEQ ID NO: 912452 - RNA, 22 nt, Human
aguaacaagugccaacguuaga

SEQ ID NO: 912453 - RNA, 22 nt, Human
ggcuggcaagugucugcucaug

SEQ ID NO: 912454 - RNA, 22 nt, Human
gcaggccucuguugagggccuu

SEQ ID NO: 912455 - RNA, 22 nt, Human
gcucuguggcaggaggucuugu

SEQ ID NO: 912456 - RNA, 22 nt, Human
ggcagagugcucugggcagggg

SEQ ID NO: 912457 - RNA, 20 nt, Human
uggcacagaacccuugccua

SEQ ID NO: 912458 - RNA, 22 nt, Human
gagacacaguuaucaggcauac

SEQ ID NO: 912459 - RNA, 21 nt, Human
ugccugccuccuuuggcuagg

SEQ ID NO: 912460 - RNA, 22 nt, Human
ugcagcagacauaauguggauu

SEQ ID NO: 912461 - RNA, 22 nt, Human
ggcuucagaggggagguagugc

SEQ ID NO: 912462 - RNA, 22 nt, Human
ucucauaauuguuucccagcua

SEQ ID NO: 912463 - RNA, 22 nt, Human
ucuccagggugagcuaggccag

SEQ ID NO: 912464 - RNA, 22 nt, Human
agccacagucugaugccugaga

SEQ ID NO: 912465 - RNA, 22 nt, Human
agcugccagaugacagugcuau

SEQ ID NO: 912466 - RNA, 22 nt, Human
auucaguuguaaucuuuguuag

SEQ ID NO: 912467 - RNA, 22 nt, Human
uuucuucuuucccagugauggg

SEQ ID NO: 912468 - RNA, 22 nt, Human
auaccugcaguauuuuauuguu

SEQ ID NO: 912469 - RNA, 22 nt, Human
cucaggauugugccuagggaga

SEQ ID NO: 912470 - RNA, 22 nt, Human
cagcaaaguaagcugacaugua

SEQ ID NO: 912471 - RNA, 22 nt, Human
augguuuuauuucucuauagcu

SEQ ID NO: 912472 - RNA, 22 nt, Human
uacagauauguuccaugcaucg

SEQ ID NO: 912473 - RNA, 22 nt, Human
cuugauauuuuaaacauacagu

SEQ ID NO: 912474 - RNA, 22 nt, Human
uuucccaauugagagguucugu

SEQ ID NO: 912475 - RNA, 22 nt, Human
uacuuugguugaauauguaaug

SEQ ID NO: 912476 - RNA, 17 nt, Human
agccaggcauaugaagu

SEQ ID NO: 912477 - RNA, 20 nt, Human
ugcuuuaugcuauacuuugu

SEQ ID NO: 912478 - RNA, 22 nt, Human
cugcuguguaucauuuuagaug

SEQ ID NO: 912479 - RNA, 22 nt, Human
caagggcauugcuugggaccuu

SEQ ID NO: 912480 - RNA, 23 nt, Human
cccugcagucagggugagauggu

SEQ ID NO: 912481 - RNA, 22 nt, Human
ucuucaugcaccucacagcuag

SEQ ID NO: 912482 - RNA, 22 nt, Human
aggcugugggacaguuaggaga

SEQ ID NO: 912483 - RNA, 22 nt, Human
augcauaugccguagaauaagu

SEQ ID NO: 912484 - RNA, 22 nt, Human
cugagguauugggaaguggacu

SEQ ID NO: 912485 - RNA, 22 nt, Human
gcuggagccaagcugcucuugg

SEQ ID NO: 912486 - RNA, 22 nt, Human
agcaaucagcuucuuuguguuu

SEQ ID NO: 912487 - RNA, 22 nt, Human
aguggcagguguguaguauccc

SEQ ID NO: 912488 - RNA, 22 nt, Human
gcagagccccauugcuggcggg

SEQ ID NO: 912489 - RNA, 22 nt, Human
uuacaguaccuguauggccacu

SEQ ID NO: 912490 - RNA, 22 nt, Human
cguccuuugaauugaggucuuu

SEQ ID NO: 912491 - RNA, 22 nt, Human
cucuggaccucagcuacagacu

SEQ ID NO: 912492 - RNA, 22 nt, Human
uauguauucugaguacaaguuc

SEQ ID NO: 912493 - RNA, 22 nt, Human
aggcuucagaggaagugcggcc

SEQ ID NO: 912494 - RNA, 22 nt, Human
caaauacucuggauguguuugu

SEQ ID NO: 912495 - RNA, 21 nt, Human
cuacagaggagagggaaaggc

SEQ ID NO: 912496 - RNA, 22 nt, Human
gccaggcugcuggcugcugucc

SEQ ID NO: 912497 - RNA, 22 nt, Human
agacagagauacuauguuguca

SEQ ID NO: 912498 - RNA, 22 nt, Human
ugacacaggcagcucccagcac

SEQ ID NO: 912499 - RNA, 22 nt, Human
ucagcagaaguauagaggccau

SEQ ID NO: 912500 - RNA, 22 nt, Human
ucugcagaagaauuaaggacag

SEQ ID NO: 912501 - RNA, 22 nt, Human
uugaaauaaggaagcucgaaau

SEQ ID NO: 912502 - RNA, 22 nt, Human
acacauauguaugcaucaugug

SEQ ID NO: 912503 - RNA, 22 nt, Human
agaguggagagaaacaacucug

SEQ ID NO: 912504 - RNA, 22 nt, Human
augugcuucaggaugucagugu

SEQ ID NO: 912505 - RNA, 22 nt, Human
cccugacccuaucagagggcca

SEQ ID NO: 912506 - RNA, 22 nt, Human
agggaaaggcugaugcuguggg

SEQ ID NO: 912507 - RNA, 22 nt, Human
ggcagaguugguggagucaguu

SEQ ID NO: 912508 - RNA, 22 nt, Human
uuaauccaauauccuggcuauu

SEQ ID NO: 912509 - RNA, 21 nt, Human
acagaugugauaugcagucuu

SEQ ID NO: 912510 - RNA, 22 nt, Human
uuuuccucugagcuuugaauaa

SEQ ID NO: 912511 - RNA, 22 nt, Human
aaaugcagacagcuucacacac

SEQ ID NO: 912512 - RNA, 22 nt, Human
aggacagguguagugggcucug

SEQ ID NO: 912513 - RNA, 18 nt, Human
ccccaaaagucacccugg

SEQ ID NO: 912514 - RNA, 22 nt, Human
acaguuuacagggauuugagcu

SEQ ID NO: 912515 - RNA, 22 nt, Human
augcugaagagugcacaggcua

SEQ ID NO: 912516 - RNA, 22 nt, Human
agcaacauuuuucaauuaacau

SEQ ID NO: 912517 - RNA, 22 nt, Human
uguuccagauuuagccaaccga

SEQ ID NO: 912518 - RNA, 22 nt, Human
agcuauuucaaaguuugagaca

SEQ ID NO: 912519 - RNA, 22 nt, Human
ucagaggcuggaagagccuccu

SEQ ID NO: 912520 - RNA, 22 nt, Human
uccugggcugugugccacucug

SEQ ID NO: 912521 - RNA, 22 nt, Human
aacagauauaggcagaacuuug

SEQ ID NO: 912522 - RNA, 20 nt, Human
ugucagugccugaggcacag

SEQ ID NO: 912523 - RNA, 22 nt, Human
gggcuccagcuguuugccauga

SEQ ID NO: 912524 - RNA, 22 nt, Human
gagcugaagcgcuacagcaucc

SEQ ID NO: 912525 - RNA, 22 nt, Human
cugccaucgggggccccacugc

SEQ ID NO: 912526 - RNA, 22 nt, Human
ugauuuccccagucuugcugcu

SEQ ID NO: 912527 - RNA, 22 nt, Human
uuugucagggaucagaucggua

SEQ ID NO: 912528 - RNA, 22 nt, Human
caaccucauagaaagaaaaugu

SEQ ID NO: 912529 - RNA, 22 nt, Human
ccucgugugcuaggauccaggu

SEQ ID NO: 912530 - RNA, 22 nt, Human
ggcugccugugcccaggcacac

SEQ ID NO: 912531 - RNA, 22 nt, Human
ucacucagagauagccucauuu

SEQ ID NO: 912532 - RNA, 22 nt, Human
cacacaggaugaagcagcagaa

SEQ ID NO: 912533 - RNA, 22 nt, Human
uuaaguccuugguaauuuucuu

SEQ ID NO: 912534 - RNA, 22 nt, Human
ccucugggaagccaguccugcu

SEQ ID NO: 912535 - RNA, 22 nt, Human
gcagggcagaaggugcugagga

SEQ ID NO: 912536 - RNA, 22 nt, Human
ucuuauuugcaacuggcucaga

SEQ ID NO: 912537 - RNA, 16 nt, Human
gaggggagcaguaggc

SEQ ID NO: 912538 - RNA, 22 nt, Human
uucaguguauauuuuuugagua

SEQ ID NO: 912539 - RNA, 22 nt, Human
augguaaacauuuaacaacuag

SEQ ID NO: 912540 - RNA, 22 nt, Human
ucccuggcagcuaagggugguc

SEQ ID NO: 912541 - RNA, 21 nt, Human
augauacugaagcacaacuau

SEQ ID NO: 912542 - RNA, 19 nt, Human
uccuuccccccagcacaga

SEQ ID NO: 912543 - RNA, 22 nt, Human
ucaaaugaggcugaugaaugug

SEQ ID NO: 912544 - RNA, 22 nt, Human
uggcacagacugggccaaggaa

SEQ ID NO: 912545 - RNA, 22 nt, Human
cccuugcuugcccagucacagg

SEQ ID NO: 912546 - RNA, 22 nt, Human
ucagugcugccauggcagggcc

SEQ ID NO: 912547 - RNA, 22 nt, Human
ucuggagaaaguugaguuugug

SEQ ID NO: 912548 - RNA, 22 nt, Human
cucaggaggaggaaguucauug

SEQ ID NO: 912549 - RNA, 22 nt, Human
aguuuauucugcuuggcccucc

SEQ ID NO: 912550 - RNA, 23 nt, Human
gugagucuugccuuugcugugga

SEQ ID NO: 912551 - RNA, 22 nt, Human
uucugucuggaaaaggacauag

SEQ ID NO: 912552 - RNA, 22 nt, Human
guggcgcagaggguggcagaga

SEQ ID NO: 912553 - RNA, 22 nt, Human
uccuguggcguuaucaugugau

SEQ ID NO: 912554 - RNA, 22 nt, Human
guuuggugacacauaguuugau

SEQ ID NO: 912555 - RNA, 22 nt, Human
guuccugagaaauaaagagaga

SEQ ID NO: 912556 - RNA, 22 nt, Human
agccccacacucucucugagaa

SEQ ID NO: 912557 - RNA, 22 nt, Human
gucuuauuaaaaugcaguuucu

SEQ ID NO: 912558 - RNA, 21 nt, Human
agggccugugcucuccagguc

SEQ ID NO: 912559 - RNA, 22 nt, Human
cuccugggcugggaacucagcc

SEQ ID NO: 912560 - RNA, 22 nt, Human
gaaaggggcauguagggaucac

SEQ ID NO: 912561 - RNA, 22 nt, Human
uccacagguaugaggccccacc

SEQ ID NO: 912562 - RNA, 22 nt, Human
ucacaugcccuaccuaaucuua

SEQ ID NO: 912563 - RNA, 22 nt, Human
auuucucaaaggaauagaguga

SEQ ID NO: 912564 - RNA, 22 nt, Human
auagaauuugcacuaaaucugc

SEQ ID NO: 912565 - RNA, 22 nt, Human
aagcuuuuauuaaaaucuugcc

SEQ ID NO: 912566 - RNA, 22 nt, Human
ggguggcauagggugauggcuu

SEQ ID NO: 912567 - RNA, 22 nt, Human
auuuccaugccuuagcuuaagg

SEQ ID NO: 912568 - RNA, 22 nt, Human
agggcugucagacugaggaggc

SEQ ID NO: 912569 - RNA, 22 nt, Human
gaaagggagugaagaugguaua

SEQ ID NO: 912570 - RNA, 22 nt, Human
uuuacauugcauuagguauuau

SEQ ID NO: 912571 - RNA, 19 nt, Human
gaaggagagcugaguuagg

SEQ ID NO: 912572 - RNA, 22 nt, Human
auuacuaugauuugaucauuac

SEQ ID NO: 912573 - RNA, 22 nt, Human
ggagaagggcaugguaguuuua

SEQ ID NO: 912574 - RNA, 22 nt, Human
aaauguuucuacuugugagcau

SEQ ID NO: 912575 - RNA, 22 nt, Human
uagaacaugcucauguauaaau

SEQ ID NO: 912576 - RNA, 22 nt, Human
auuuggaagaaaucugucacag

SEQ ID NO: 912577 - RNA, 22 nt, Human
uucaguuucaaauccugugaag

SEQ ID NO: 912578 - RNA, 22 nt, Human
agcagcaguugcugacguucua

SEQ ID NO: 912579 - RNA, 22 nt, Human
uggccuggaaaaaugcagaugg

SEQ ID NO: 912580 - RNA, 22 nt, Human
gcuuuggaguuaggacucggcc

SEQ ID NO: 912581 - RNA, 19 nt, Human
ccuuccccuucagccucug

SEQ ID NO: 912582 - RNA, 22 nt, Human
ugaucacaagucugaagaauga

SEQ ID NO: 912583 - RNA, 22 nt, Human
agcuggcugggugccagucucc

SEQ ID NO: 912584 - RNA, 22 nt, Human
cgcugccaggucaccaggggua

SEQ ID NO: 912585 - RNA, 22 nt, Human
gaggggcagagguagagaacaa

SEQ ID NO: 912586 - RNA, 22 nt, Human
caugaacauucagaaauacagc

SEQ ID NO: 912587 - RNA, 22 nt, Human
guucucauauggcagagagagu

SEQ ID NO: 912588 - RNA, 22 nt, Human
uuccugugucccgggcacccug

SEQ ID NO: 912589 - RNA, 22 nt, Human
gcaugcacggggcauaugggac

SEQ ID NO: 912590 - RNA, 22 nt, Human
gaaggcauuuuaugccuuauag

SEQ ID NO: 912591 - RNA, 22 nt, Human
ucuuccucuucugcugagaagu

SEQ ID NO: 912592 - RNA, 22 nt, Human
agcugaggguucgguguccaca

SEQ ID NO: 912593 - RNA, 22 nt, Human
agauaagauaguccagcacaau

SEQ ID NO: 912594 - RNA, 22 nt, Human
auuucucuuagcaagacauuac

SEQ ID NO: 912595 - RNA, 22 nt, Human
agcaacagcccugagguucaug

SEQ ID NO: 912596 - RNA, 22 nt, Human
gggcucugggauucagagcaag

SEQ ID NO: 912597 - RNA, 22 nt, Human
agcuuuaugcuuccuacaagcu

SEQ ID NO: 912598 - RNA, 22 nt, Human
uggucccauuguucugcccagg

SEQ ID NO: 912599 - RNA, 22 nt, Human
augaaauuugaccaauuauuua

SEQ ID NO: 912600 - RNA, 22 nt, Human
caggacagcugggccaccacca

SEQ ID NO: 912601 - RNA, 22 nt, Human
auuuuucucucacacuuaccag

SEQ ID NO: 912602 - RNA, 22 nt, Human
ccucaggcccugucccugcgcc

SEQ ID NO: 912603 - RNA, 22 nt, Human
cugggaagccacaggguguggg

SEQ ID NO: 912604 - RNA, 22 nt, Human
uuaugucugugaauuggcaagc

SEQ ID NO: 912605 - RNA, 22 nt, Human
ugcugggcacacaguaggugcu

SEQ ID NO: 912606 - RNA, 22 nt, Human
cugggccuccagcucugccagc

SEQ ID NO: 912607 - RNA, 22 nt, Human
aaaguuguuguucacagguuau

SEQ ID NO: 912608 - RNA, 22 nt, Human
cagcugcagaucauguuuacag

SEQ ID NO: 912609 - RNA, 22 nt, Human
agccugggcaacaacacagcga

SEQ ID NO: 912610 - RNA, 21 nt, Human
uuuauuuauauaggacacaug

SEQ ID NO: 912611 - RNA, 17 nt, Human
aacaauaggauguguau

SEQ ID NO: 912612 - RNA, 22 nt, Human
ucagaaauuuucucaguaguuc

SEQ ID NO: 912613 - RNA, 22 nt, Human
uacaacuuacuugaauggcuuu

SEQ ID NO: 912614 - RNA, 22 nt, Human
acagcuggcaggggggcaugaa

SEQ ID NO: 912615 - RNA, 22 nt, Human
gaugcuuuucuuuucagcaaga

SEQ ID NO: 912616 - RNA, 22 nt, Human
ggguuggggcccagcagucugc

SEQ ID NO: 912617 - RNA, 22 nt, Human
cccagcaguuugcuuagaguga

SEQ ID NO: 912618 - RNA, 22 nt, Human
aacaggcuaaguauuugguagc

SEQ ID NO: 912619 - RNA, 22 nt, Human
gcugugugaccugggcaagucu

SEQ ID NO: 912620 - RNA, 22 nt, Human
uuaggaauauguauuuuaaagu

SEQ ID NO: 912621 - RNA, 22 nt, Human
uuuaugacuucuaaucugaagc

SEQ ID NO: 912622 - RNA, 22 nt, Human
ugucagugcacagaugguugau

SEQ ID NO: 912623 - RNA, 22 nt, Human
uuucuucucaucccugaaauca

SEQ ID NO: 912624 - RNA, 22 nt, Human
uggcaggucaugaguggccacc

SEQ ID NO: 912625 - RNA, 22 nt, Human
acauagaaccuggcacauagua

SEQ ID NO: 912626 - RNA, 22 nt, Human
agcagccagaaagggcagucga

SEQ ID NO: 912627 - RNA, 22 nt, Human
gagagugaggcaucaggggcag

SEQ ID NO: 912628 - RNA, 22 nt, Human
augacagaugcuguggggaggu

SEQ ID NO: 912629 - RNA, 22 nt, Human
caggcacugugcuagauccuug

SEQ ID NO: 912630 - RNA, 22 nt, Human
uguggcagucucacuggagggc

SEQ ID NO: 912631 - RNA, 19 nt, Human
gaaggggaagguggguacc

SEQ ID NO: 912632 - RNA, 22 nt, Human
uaagaaacaugauacuuuuccu

SEQ ID NO: 912633 - RNA, 22 nt, Human
cuguuucuccacacucuuccca

SEQ ID NO: 912634 - RNA, 22 nt, Human
uuucaaagagaggcagaaggaa

SEQ ID NO: 912635 - RNA, 22 nt, Human
cccaggaguuugaguucagcau

SEQ ID NO: 912636 - RNA, 22 nt, Human
aaacugcagccuugaguucagg

SEQ ID NO: 912637 - RNA, 23 nt, Human
aaaugucuucuagcucuugagaa

SEQ ID NO: 912638 - RNA, 22 nt, Human
uauugagacuuccaguauauga

SEQ ID NO: 912639 - RNA, 23 nt, Human
ugcaucaauaaagccaggguuug

SEQ ID NO: 912640 - RNA, 22 nt, Human
ucuguccaugcuuuucucucac

SEQ ID NO: 912641 - RNA, 22 nt, Human
caggcacuucugcugcuugucu

SEQ ID NO: 912642 - RNA, 22 nt, Human
gccacagggcgagcggaggcca

SEQ ID NO: 912643 - RNA, 22 nt, Human
caggcucagcucuggccagugc

SEQ ID NO: 912644 - RNA, 22 nt, Human
aagaagcauucuuucauugguu

SEQ ID NO: 912645 - RNA, 22 nt, Human
cacagucaauguagaaauauga

SEQ ID NO: 912646 - RNA, 21 nt, Human
uccagaggaggacagacucag

SEQ ID NO: 912647 - RNA, 22 nt, Human
aaugguuuguaccuguccuugg

SEQ ID NO: 912648 - RNA, 22 nt, Human
cugggggcagcaagaagccaug

SEQ ID NO: 912649 - RNA, 22 nt, Human
gacacugugcuagcugggcuua

SEQ ID NO: 912650 - RNA, 22 nt, Human
aggcuccaaauuaccaagcucu

SEQ ID NO: 912651 - RNA, 22 nt, Human
gcugagggcuguaacagcagag

SEQ ID NO: 912652 - RNA, 22 nt, Human
gaaguacagggguucuuaggua

SEQ ID NO: 912653 - RNA, 22 nt, Human
caaagcugacgaggucagcauc

SEQ ID NO: 912654 - RNA, 22 nt, Human
cccugcagggaggauucugaag

SEQ ID NO: 912655 - RNA, 22 nt, Human
caggcucuuuugguggcaagga

SEQ ID NO: 912656 - RNA, 22 nt, Human
uuucauucagcacccugaggug

SEQ ID NO: 912657 - RNA, 22 nt, Human
ggucugagugccagggagagaa

SEQ ID NO: 912658 - RNA, 22 nt, Human
acagugauucugcaaaccauau

SEQ ID NO: 912659 - RNA, 22 nt, Human
caugcaggugaccagguguggg

SEQ ID NO: 912660 - RNA, 22 nt, Human
gcuugcagugguuggcaugacc

SEQ ID NO: 912661 - RNA, 22 nt, Human
uuuuauguaauaaacuguacac

SEQ ID NO: 912662 - RNA, 22 nt, Human
gguuuuauuaccccuuaaacac

SEQ ID NO: 912663 - RNA, 22 nt, Human
uauuuaagaugugucauaaaga

SEQ ID NO: 912664 - RNA, 22 nt, Human
ccugcccuagagaugacacaau

SEQ ID NO: 912665 - RNA, 23 nt, Human
auagaagauuauugcaacagucc

SEQ ID NO: 912666 - RNA, 22 nt, Human
cagagccucccuccucugccau

SEQ ID NO: 912667 - RNA, 22 nt, Human
augcagaacguuugugaaacuu

SEQ ID NO: 912668 - RNA, 22 nt, Human
gaccuggaagaacugaggccuu

SEQ ID NO: 912669 - RNA, 23 nt, Human
acaggcaggcauggccaaaugug

SEQ ID NO: 912670 - RNA, 22 nt, Human
gcugaugcaggguugagaggag

SEQ ID NO: 912671 - RNA, 22 nt, Human
cagcagcugguuauaccugugg

SEQ ID NO: 912672 - RNA, 22 nt, Human
ggagaagaggagcuggaagccu

SEQ ID NO: 912673 - RNA, 22 nt, Human
agugcaggagccuggccagagc

SEQ ID NO: 912674 - RNA, 22 nt, Human
agcacugauuuuguugcacuua

SEQ ID NO: 912675 - RNA, 22 nt, Human
agugcugacucugggcacagug

SEQ ID NO: 912676 - RNA, 22 nt, Human
aauguuccacagauauagcaug

SEQ ID NO: 912677 - RNA, 20 nt, Human
ucuaaaguacaguuugugug

SEQ ID NO: 912678 - RNA, 22 nt, Human
aaaugcacagguuuuaaauccu

SEQ ID NO: 912679 - RNA, 22 nt, Human
ucugccuggauuuuggaaagcu

SEQ ID NO: 912680 - RNA, 22 nt, Human
acccaggacaugggcacccgug

SEQ ID NO: 912681 - RNA, 22 nt, Human
uaugaacugcucuuguguuuug

SEQ ID NO: 912682 - RNA, 22 nt, Human
uucaaauccugcuuaugcuacc

SEQ ID NO: 912683 - RNA, 22 nt, Human
ugcccuggaaccaucuacaguc

SEQ ID NO: 912684 - RNA, 22 nt, Human
cagcuggcagcccuggcccugc

SEQ ID NO: 912685 - RNA, 22 nt, Human
cucuggagagguucccauggga

SEQ ID NO: 912686 - RNA, 22 nt, Human
ggccccacgggggaguccuagu

SEQ ID NO: 912687 - RNA, 22 nt, Human
auguuuccuguuggauuggccc

SEQ ID NO: 912688 - RNA, 22 nt, Human
cuguggagcuuguggcaguggg

SEQ ID NO: 912689 - RNA, 22 nt, Human
gcugccuguccugaggaguccg

SEQ ID NO: 912690 - RNA, 22 nt, Human
uggaaauauuugcucauuaucu

SEQ ID NO: 912691 - RNA, 22 nt, Human
gcugcacagaacagucauuggc

SEQ ID NO: 912692 - RNA, 22 nt, Human
ccacuuuguaauguguuauguu

SEQ ID NO: 912693 - RNA, 20 nt, Human
gucuacacgggcaguguaga

SEQ ID NO: 912694 - RNA, 22 nt, Human
gggagggaaggaggcgccgugu

SEQ ID NO: 912695 - RNA, 17 nt, Human
cuggccaguguacuugg

SEQ ID NO: 912696 - RNA, 22 nt, Human
ccagaagacaagaauguucuua

SEQ ID NO: 912697 - RNA, 22 nt, Human
gagccuuugaagcccucagaga

SEQ ID NO: 912698 - RNA, 22 nt, Human
ucuugauuuguaaaagaaggau

SEQ ID NO: 912699 - RNA, 22 nt, Human
cauuucagugucuugugaugaa

SEQ ID NO: 912700 - RNA, 22 nt, Human
uguguccacgcacuggcaugau

SEQ ID NO: 912701 - RNA, 19 nt, Human
acccagagcccuuugcagg

SEQ ID NO: 912702 - RNA, 23 nt, Human
uauuugucucuuaccacugcugu

SEQ ID NO: 912703 - RNA, 22 nt, Human
caggaacgccugguguuggccu

SEQ ID NO: 912704 - RNA, 22 nt, Human
caaggaaguuuuaggagaggaa

SEQ ID NO: 912705 - RNA, 22 nt, Human
uugcauauauuucuaaggaggu

SEQ ID NO: 912706 - RNA, 22 nt, Human
auuagaaaccaagaggcaggcu

SEQ ID NO: 912707 - RNA, 22 nt, Human
ugagggaguguggauacaguag

SEQ ID NO: 912708 - RNA, 17 nt, Human
agccugcugaucucaca

SEQ ID NO: 912709 - RNA, 21 nt, Human
uuucccagcagagauagcugg

SEQ ID NO: 912710 - RNA, 22 nt, Human
agcugaguuaauucaucacuua

SEQ ID NO: 912711 - RNA, 22 nt, Human
uguacaguuuuaacucugaggg

SEQ ID NO: 912712 - RNA, 22 nt, Human
ugagggggguaaucacuggguu

SEQ ID NO: 912713 - RNA, 19 nt, Human
aaguucucagaguucaaag

SEQ ID NO: 912714 - RNA, 22 nt, Human
gcaugcaauguaucagugauag

SEQ ID NO: 912715 - RNA, 22 nt, Human
gccaggccacucccggguccug

SEQ ID NO: 912716 - RNA, 22 nt, Human
acaguuuagaaugccacauagu

SEQ ID NO: 912717 - RNA, 21 nt, Human
uacaaagggaaauucuggcuc

SEQ ID NO: 912718 - RNA, 22 nt, Human
cccccauccaugucaggagagg

SEQ ID NO: 912719 - RNA, 20 nt, Human
uuccacaucuuugcacaugc

SEQ ID NO: 912720 - RNA, 22 nt, Human
uucaaggagauuggagucuacu

SEQ ID NO: 912721 - RNA, 22 nt, Human
agugucaaugcucuguuaaaaa

SEQ ID NO: 912722 - RNA, 22 nt, Human
aagguaauccauaauaguuacu

SEQ ID NO: 912723 - RNA, 22 nt, Human
cagagcuggagaaguggauuua

SEQ ID NO: 912724 - RNA, 22 nt, Human
acacaaacugcuagaaaauugg

SEQ ID NO: 912725 - RNA, 21 nt, Human
ugugugggcauaucugcugca

SEQ ID NO: 912726 - RNA, 22 nt, Human
ugacaguauugauggcaggauu

SEQ ID NO: 912727 - RNA, 22 nt, Human
ugucauaaaacacaagcuguug

SEQ ID NO: 912728 - RNA, 22 nt, Human
cagccuggacagcgaccagagu

SEQ ID NO: 912729 - RNA, 22 nt, Human
ucagaggacuaccuucuccagu

SEQ ID NO: 912730 - RNA, 22 nt, Human
caaagaugccaaaaggaagaca

SEQ ID NO: 912731 - RNA, 22 nt, Human
cucuuuggggugccccacuggu

SEQ ID NO: 912732 - RNA, 22 nt, Human
ucugaggccccugggcaggaug

SEQ ID NO: 912733 - RNA, 18 nt, Human
uuccuaggaacuaagcuu

SEQ ID NO: 912734 - RNA, 22 nt, Human
agccacagagagggagcugcaa

SEQ ID NO: 912735 - RNA, 22 nt, Human
ccacagugaucccugccugcga

SEQ ID NO: 912736 - RNA, 22 nt, Human
agggccagccgacuuccagccu

SEQ ID NO: 912737 - RNA, 22 nt, Human
ggccagcuguggggccgagccu

SEQ ID NO: 912738 - RNA, 22 nt, Human
caggaacaacucccagcaucuc

SEQ ID NO: 912739 - RNA, 22 nt, Human
ugagugccugaacauagaguag

SEQ ID NO: 912740 - RNA, 22 nt, Human
ugcccagcagggagcuaccugg

SEQ ID NO: 912741 - RNA, 22 nt, Human
guuaacacaggacucucugccu

SEQ ID NO: 912742 - RNA, 22 nt, Human
auaauaucgcuccuuuuuuuga

SEQ ID NO: 912743 - RNA, 22 nt, Human
uaggcugggagccugaggcuag

SEQ ID NO: 912744 - RNA, 23 nt, Human
ccucaugaaggucugcuuccugg

SEQ ID NO: 912745 - RNA, 22 nt, Human
agaggcaguauacaauccgagc

SEQ ID NO: 912746 - RNA, 22 nt, Human
aaagaugaucuacaaguucauu

SEQ ID NO: 912747 - RNA, 22 nt, Human
uguuugcauuguuaauucaguc

SEQ ID NO: 912748 - RNA, 22 nt, Human
gcuuggcauuugcugggagcug

SEQ ID NO: 912749 - RNA, 22 nt, Human
ggaucuucagccagcaggugcc

SEQ ID NO: 912750 - RNA, 22 nt, Human
acuagggagaagcacuuacaca

SEQ ID NO: 912751 - RNA, 22 nt, Human
caagaaggcuauaugggccagg

SEQ ID NO: 912752 - RNA, 22 nt, Human
acuccaggauguagaaucagag

SEQ ID NO: 912753 - RNA, 22 nt, Human
ccuauuuguaggcugggccagu

SEQ ID NO: 912754 - RNA, 22 nt, Human
uuaacuuuuauuucugcucgcc

SEQ ID NO: 912755 - RNA, 17 nt, Human
gcuguuucuccagaagu

SEQ ID NO: 912756 - RNA, 22 nt, Human
ugagaauuuucaguuucacuuu

SEQ ID NO: 912757 - RNA, 19 nt, Human
uccuuucuguuccugagau

SEQ ID NO: 912758 - RNA, 22 nt, Human
ccuccuuccugggacagagcug

SEQ ID NO: 912759 - RNA, 17 nt, Human
cagucacaggucuuuuc

SEQ ID NO: 912760 - RNA, 22 nt, Human
gaacuacagugcauuuucuuaa

SEQ ID NO: 912761 - RNA, 21 nt, Human
uggcuucauuugcaacccacu

SEQ ID NO: 912762 - RNA, 20 nt, Human
ggcagcucacuacuuucugu

SEQ ID NO: 912763 - RNA, 22 nt, Human
cauugacaguucuuuaaguugc

SEQ ID NO: 912764 - RNA, 22 nt, Human
cugaggcagagggcagaccaga

SEQ ID NO: 912765 - RNA, 22 nt, Human
ucagaauaaguuaugaaaugaa

SEQ ID NO: 912766 - RNA, 22 nt, Human
uggcagggucuugcuguguugc

SEQ ID NO: 912767 - RNA, 22 nt, Human
agggaggucuggcugcccugag

SEQ ID NO: 912768 - RNA, 22 nt, Human
cccugaugacacgggcaucagg

SEQ ID NO: 912769 - RNA, 22 nt, Human
aauagcuuuggucaccaucugg

SEQ ID NO: 912770 - RNA, 22 nt, Human
guagcuucaaguacucucccug

SEQ ID NO: 912771 - RNA, 23 nt, Human
cagaaaacccagagcucaguccc

SEQ ID NO: 912772 - RNA, 22 nt, Human
ugagcaggugagucuagggcag

SEQ ID NO: 912773 - RNA, 22 nt, Human
aaagaacuuaagaaauuaggcu

SEQ ID NO: 912774 - RNA, 22 nt, Human
acaaggacgucacuuccacggu

SEQ ID NO: 912775 - RNA, 22 nt, Human
aggcccagcugggccaggaaca

SEQ ID NO: 912776 - RNA, 22 nt, Human
aaauugcagaugcuaaaugacu

SEQ ID NO: 912777 - RNA, 22 nt, Human
uccugucugcucacagagcugg

SEQ ID NO: 912778 - RNA, 19 nt, Human
uucauucuuucuacuuacc

SEQ ID NO: 912779 - RNA, 22 nt, Human
ccucugugccucguguccucug

SEQ ID NO: 912780 - RNA, 22 nt, Human
acagcagcuugcgugucugguc

SEQ ID NO: 912781 - RNA, 22 nt, Human
uaacaaguuucauuuauagaau

SEQ ID NO: 912782 - RNA, 22 nt, Human
guagaaucccaguggcuauauu

SEQ ID NO: 912783 - RNA, 22 nt, Human
cacuaaaacuacauuggaaaca

SEQ ID NO: 912784 - RNA, 22 nt, Human
uuauaguaugugcauaugugug

SEQ ID NO: 912785 - RNA, 22 nt, Human
agcuggguggugcugagccuug

SEQ ID NO: 912786 - RNA, 22 nt, Human
agauacaagaggccugacgugu

SEQ ID NO: 912787 - RNA, 22 nt, Human
gagauuucuuuugaugccuguc

SEQ ID NO: 912788 - RNA, 19 nt, Human
caauauauagugaguggau

SEQ ID NO: 912789 - RNA, 22 nt, Human
aaggaggagcggaggcuuguug

SEQ ID NO: 912790 - RNA, 22 nt, Human
ugucuuuagcccauauagacuu

SEQ ID NO: 912791 - RNA, 23 nt, Human
uuuagucaguugacagccauaua

SEQ ID NO: 912792 - RNA, 19 nt, Human
ucagcccaucagacucaca

SEQ ID NO: 912793 - RNA, 22 nt, Human
caaagaaucacucaucuuuagc

SEQ ID NO: 912794 - RNA, 20 nt, Human
ggccucaguguccuuguuug

SEQ ID NO: 912795 - RNA, 22 nt, Human
agcagggcucacauuaguggau

SEQ ID NO: 912796 - RNA, 16 nt, Human
ucccaggccaggugga

SEQ ID NO: 912797 - RNA, 22 nt, Human
cagaacagaaucguguggugag

SEQ ID NO: 912798 - RNA, 22 nt, Human
caguguccucagccagcagcua

SEQ ID NO: 912799 - RNA, 22 nt, Human
ugcagccaucuuucuuggagga

SEQ ID NO: 912800 - RNA, 22 nt, Human
gggggaaguaauuauaaaccaa

SEQ ID NO: 912801 - RNA, 19 nt, Human
agacaugagacacaggaug

SEQ ID NO: 912802 - RNA, 21 nt, Human
cagaggggcuagccuggcugc

SEQ ID NO: 912803 - RNA, 22 nt, Human
gugcccaggcccaaggcaccac

SEQ ID NO: 912804 - RNA, 20 nt, Human
ccugucucacguuccgcccc

SEQ ID NO: 912805 - RNA, 22 nt, Human
uggcaauacauaaucuuaaugg

SEQ ID NO: 912806 - RNA, 22 nt, Human
auuuauguaucuguguagauca

SEQ ID NO: 912807 - RNA, 22 nt, Human
gcagcaaucuucacagugucau

SEQ ID NO: 912808 - RNA, 22 nt, Human
ggcacacaaaggcagcauuuga

SEQ ID NO: 912809 - RNA, 23 nt, Human
aagaaucaguaaguaaggagacc

SEQ ID NO: 912810 - RNA, 22 nt, Human
augggcuguccuaguccagccc

SEQ ID NO: 912811 - RNA, 22 nt, Human
caccagagugaguggacugucg

SEQ ID NO: 912812 - RNA, 21 nt, Human
agcagcagcaguggggcuucu

SEQ ID NO: 912813 - RNA, 22 nt, Human
agaagcacuagaggguauggaa

SEQ ID NO: 912814 - RNA, 22 nt, Human
cagaggccuggcuuggacaccu

SEQ ID NO: 912815 - RNA, 17 nt, Human
aggcuggccuucacagu

SEQ ID NO: 912816 - RNA, 22 nt, Human
auuagaagauagugauuucugc

SEQ ID NO: 912817 - RNA, 22 nt, Human
accuugauggggcuguuggagu

SEQ ID NO: 912818 - RNA, 22 nt, Human
aaagaggauggaguagucagcu

SEQ ID NO: 912819 - RNA, 22 nt, Human
cagccagaaccuaggaugagcu

SEQ ID NO: 912820 - RNA, 22 nt, Human
uguaucuuagugugaaaauauu

SEQ ID NO: 912821 - RNA, 22 nt, Human
acagcucugggugcaggaggug

SEQ ID NO: 912822 - RNA, 22 nt, Human
cauucacaauggauugcuucaa

SEQ ID NO: 912823 - RNA, 22 nt, Human
caugaaacaucagagauuucuc

SEQ ID NO: 912824 - RNA, 22 nt, Human
uuguguacuacaguaugccaca

SEQ ID NO: 912825 - RNA, 22 nt, Human
ccaggccugcaucugcugcgca

SEQ ID NO: 912826 - RNA, 22 nt, Human
ccauuguuuauuuagacuuaau

SEQ ID NO: 912827 - RNA, 22 nt, Human
uccaggagugcugguuagagua

SEQ ID NO: 912828 - RNA, 22 nt, Human
aaagcaaacagaaccccaagcu

SEQ ID NO: 912829 - RNA, 22 nt, Human
caaucuguuagaaaugcagaca

SEQ ID NO: 912830 - RNA, 22 nt, Human
caguugaauggucagacaaggc

SEQ ID NO: 912831 - RNA, 22 nt, Human
uuacacagcuucuauccuugaa

SEQ ID NO: 912832 - RNA, 22 nt, Human
aucuuugcuauuguaaaucacg

SEQ ID NO: 912833 - RNA, 22 nt, Human
cuaagaaauguugugaaugcca

SEQ ID NO: 912834 - RNA, 22 nt, Human
ggugagggaguggaacgaggug

SEQ ID NO: 912835 - RNA, 19 nt, Human
uuagaagccauagguacag

SEQ ID NO: 912836 - RNA, 20 nt, Human
agcccaggccugugugaguc

SEQ ID NO: 912837 - RNA, 22 nt, Human
ucaggagacuuaugucacagug

SEQ ID NO: 912838 - RNA, 22 nt, Human
ccugaccuauuuuucucagcug

SEQ ID NO: 912839 - RNA, 22 nt, Human
guguggggaggagagagcccuu

SEQ ID NO: 912840 - RNA, 19 nt, Human
ccagccuuuccagugauug

SEQ ID NO: 912841 - RNA, 21 nt, Human
ugggccagaucugaguuucua

SEQ ID NO: 912842 - RNA, 23 nt, Human
cuugcagggcuggaggcuuagaa

SEQ ID NO: 912843 - RNA, 22 nt, Human
guuuuccacuggauuguuugga

SEQ ID NO: 912844 - RNA, 22 nt, Human
uuugacagaaaguuauuauuuu

SEQ ID NO: 912845 - RNA, 22 nt, Human
ugcaagaaaugugaagcuacaa

SEQ ID NO: 912846 - RNA, 22 nt, Human
ucccaggcuaccagugagguca

SEQ ID NO: 912847 - RNA, 21 nt, Human
gugcaucagaucaguggaguc

SEQ ID NO: 912848 - RNA, 22 nt, Human
aaguaguuaguccgccugcucu

SEQ ID NO: 912849 - RNA, 20 nt, Human
acaaagacuggaaaagcaag

SEQ ID NO: 912850 - RNA, 22 nt, Human
uuccuucugaagccuuuguguu

SEQ ID NO: 912851 - RNA, 17 nt, Human
uccugugggugcagcag

SEQ ID NO: 912852 - RNA, 22 nt, Human
gccaggcuggccagcaccuucu

SEQ ID NO: 912853 - RNA, 22 nt, Human
cugagcagcuguuacagagugu

SEQ ID NO: 912854 - RNA, 22 nt, Human
acaauaauguauugccaaaagu

SEQ ID NO: 912855 - RNA, 22 nt, Human
agucaggagcugcugcauugua

SEQ ID NO: 912856 - RNA, 22 nt, Human
ggaaaagaaagggacugauugg

SEQ ID NO: 912857 - RNA, 22 nt, Human
gccacucaugggaggugugcaa

SEQ ID NO: 912858 - RNA, 22 nt, Human
agagccacaguggauaggagcc

SEQ ID NO: 912859 - RNA, 22 nt, Human
uuuggucaggguaggacaguug

SEQ ID NO: 912860 - RNA, 22 nt, Human
ggcugcaggcuucccuccagca

SEQ ID NO: 912861 - RNA, 22 nt, Human
agggagcucacaguccaguaga

SEQ ID NO: 912862 - RNA, 22 nt, Human
cuuggaaucaaguuuuuggaga

SEQ ID NO: 912863 - RNA, 21 nt, Human
aauuacagauggaauuacaga

SEQ ID NO: 912864 - RNA, 22 nt, Human
caggaaugaaaggucaggguug

SEQ ID NO: 912865 - RNA, 22 nt, Human
cugggccagucucggccgcucu

SEQ ID NO: 912866 - RNA, 22 nt, Human
ccuccagcauuacuggcccaug

SEQ ID NO: 912867 - RNA, 22 nt, Human
ucuucugagacuucucuuuggu

SEQ ID NO: 912868 - RNA, 22 nt, Human
gcggagggagauaggccuugcu

SEQ ID NO: 912869 - RNA, 22 nt, Human
uuaauuaacuagccaaccacua

SEQ ID NO: 912870 - RNA, 18 nt, Human
uaaguaaggucauauggg

SEQ ID NO: 912871 - RNA, 22 nt, Human
ucugcacauuuuaccaauacuc

SEQ ID NO: 912872 - RNA, 22 nt, Human
gagguggugguggaggcauagc

SEQ ID NO: 912873 - RNA, 22 nt, Human
aacagcuauuagaacuucaugg

SEQ ID NO: 912874 - RNA, 22 nt, Human
cugcuguguuccuccugcaucu

SEQ ID NO: 912875 - RNA, 22 nt, Human
ugucucuagggcaaugugaacu

SEQ ID NO: 912876 - RNA, 22 nt, Human
ugccugagguggucugcaaaug

SEQ ID NO: 912877 - RNA, 23 nt, Human
aggguccagggaucaccaggugu

SEQ ID NO: 912878 - RNA, 22 nt, Human
aguuuuuccugauuuuacagaa

SEQ ID NO: 912879 - RNA, 22 nt, Human
uucaaacacuggcuuagccaau

SEQ ID NO: 912880 - RNA, 22 nt, Human
uacagaaugauguguuuaaaua

SEQ ID NO: 912881 - RNA, 22 nt, Human
gcaggcuaugaguuucucacca

SEQ ID NO: 912882 - RNA, 22 nt, Human
auauuugcugagaaggagggag

SEQ ID NO: 912883 - RNA, 19 nt, Human
ucacagacagagcaaucac

SEQ ID NO: 912884 - RNA, 17 nt, Human
aaacuucacggucagcc

SEQ ID NO: 912885 - RNA, 22 nt, Human
cccagccuacucugccauagca

SEQ ID NO: 912886 - RNA, 20 nt, Human
aggcccagugaauauauugc

SEQ ID NO: 912887 - RNA, 19 nt, Human
agcagcuggagguggagug

SEQ ID NO: 912888 - RNA, 22 nt, Human
uugagaggcuguugacauucug

SEQ ID NO: 912889 - RNA, 22 nt, Human
uucauaaguugguguugacuuu

SEQ ID NO: 912890 - RNA, 22 nt, Human
gugugagcagaaaccaugagua

SEQ ID NO: 912891 - RNA, 22 nt, Human
aagggcuggaauaucucuuaga

SEQ ID NO: 912892 - RNA, 22 nt, Human
ccagaaccaaaagcauggagua

SEQ ID NO: 912893 - RNA, 22 nt, Human
guuuaaucagaggaauuauaga

SEQ ID NO: 912894 - RNA, 22 nt, Human
acaguguggugauggcacuugc

SEQ ID NO: 912895 - RNA, 22 nt, Human
ggcaggcaaugaggaugggaag

SEQ ID NO: 912896 - RNA, 22 nt, Human
gagcaagauccuguuuuucuau

SEQ ID NO: 912897 - RNA, 22 nt, Human
caggagcugggucuggaagcag

SEQ ID NO: 912898 - RNA, 22 nt, Human
aguuauuuuacauggaaguuug

SEQ ID NO: 912899 - RNA, 22 nt, Human
gaaggaggcguuagcccuagga

SEQ ID NO: 912900 - RNA, 22 nt, Human
gcauucauguccuuccugaacg

SEQ ID NO: 912901 - RNA, 22 nt, Human
uuacauaaaaguucacguaggc

SEQ ID NO: 912902 - RNA, 22 nt, Human
cagcagcaaggugaggguggag

SEQ ID NO: 912903 - RNA, 22 nt, Human
ucucacaguuguccacugaaaa

SEQ ID NO: 912904 - RNA, 22 nt, Human
cagcaggcagccauuucacugu

SEQ ID NO: 912905 - RNA, 22 nt, Human
uggagcugguucuggggaagcu

SEQ ID NO: 912906 - RNA, 22 nt, Human
ggcaggcagauggcugcaccaa

SEQ ID NO: 912907 - RNA, 22 nt, Human
cgagguauagggaggguaucuc

SEQ ID NO: 912908 - RNA, 22 nt, Human
acagugauugguuuggggguga

SEQ ID NO: 912909 - RNA, 22 nt, Human
gaggggagcaugaucuagauug

SEQ ID NO: 912910 - RNA, 22 nt, Human
ucuucaaaaacugcaccuugcu

SEQ ID NO: 912911 - RNA, 22 nt, Human
gggcugcuugcuggagacagac

SEQ ID NO: 912912 - RNA, 22 nt, Human
auguucuuugugauucugagcu

SEQ ID NO: 912913 - RNA, 22 nt, Human
agaccucugcucccuucauggu

SEQ ID NO: 912914 - RNA, 22 nt, Human
acagugcuucugauaugaugcc

SEQ ID NO: 912915 - RNA, 22 nt, Human
ggaauguucuggucugguucau

SEQ ID NO: 912916 - RNA, 22 nt, Human
cuagucacgucuuucaguuacc

SEQ ID NO: 912917 - RNA, 22 nt, Human
aaagagaaaaugaucuguacau

SEQ ID NO: 912918 - RNA, 22 nt, Human
ggaaggcuugaguucccagguc

SEQ ID NO: 912919 - RNA, 22 nt, Human
auccauuuucucucuguggggu

SEQ ID NO: 912920 - RNA, 22 nt, Human
ucuuugcaggccaaauuguuaa

SEQ ID NO: 912921 - RNA, 22 nt, Human
cacaggaagcaagccuggggcc

SEQ ID NO: 912922 - RNA, 22 nt, Human
cugaaaggguuacauaguaagu

SEQ ID NO: 912923 - RNA, 22 nt, Human
uguacagaaggcacuaagguca

SEQ ID NO: 912924 - RNA, 22 nt, Human
ugcagcugcugguggcugaaag

SEQ ID NO: 912925 - RNA, 22 nt, Human
uacacauaaaaugcucauggua

SEQ ID NO: 912926 - RNA, 22 nt, Human
acaggcaagucacacaacuugu

SEQ ID NO: 912927 - RNA, 22 nt, Human
accagagcuuacaugcuagaaa

SEQ ID NO: 912928 - RNA, 22 nt, Human
ugcauauuugauugagauaccu

SEQ ID NO: 912929 - RNA, 22 nt, Human
accagaggcucugccaccucca

SEQ ID NO: 912930 - RNA, 21 nt, Human
ugcucacagaugugcucagug

SEQ ID NO: 912931 - RNA, 22 nt, Human
cuuggaaaguuaucauuuuccu

SEQ ID NO: 912932 - RNA, 22 nt, Human
acaaggcucuaauuucauugaa

SEQ ID NO: 912933 - RNA, 20 nt, Human
cccuccagcaaccaggacuu

SEQ ID NO: 912934 - RNA, 22 nt, Human
ugcuucuguuucauugaucuua

SEQ ID NO: 912935 - RNA, 22 nt, Human
ugaggaugguuaaagaacauug

SEQ ID NO: 912936 - RNA, 22 nt, Human
uuuguucaacaggugaaauaga

SEQ ID NO: 912937 - RNA, 22 nt, Human
uucacaagucuggaauaugcua

SEQ ID NO: 912938 - RNA, 22 nt, Human
cagcagagguuggaacaguucu

SEQ ID NO: 912939 - RNA, 22 nt, Human
cugugucugccugggauccauu

SEQ ID NO: 912940 - RNA, 22 nt, Human
agggacaguuacaucaucagac

SEQ ID NO: 912941 - RNA, 22 nt, Human
auacaucuugucagauucaugu

SEQ ID NO: 912942 - RNA, 22 nt, Human
uggcccagugcuuaugcucuga

SEQ ID NO: 912943 - RNA, 22 nt, Human
aguaugaagaauacauagauga

SEQ ID NO: 912944 - RNA, 22 nt, Human
gcuggucacucugggagcugcu

SEQ ID NO: 912945 - RNA, 22 nt, Human
cacagaaaaaggcuugaaaauc

SEQ ID NO: 912946 - RNA, 22 nt, Human
agugggggcuggcucugucugu

SEQ ID NO: 912947 - RNA, 22 nt, Human
aaugaacaaauggugcugcuug

SEQ ID NO: 912948 - RNA, 22 nt, Human
uggccugggccugccggugcaa

SEQ ID NO: 912949 - RNA, 22 nt, Human
gauaaagcaaggaugacugaag

SEQ ID NO: 912950 - RNA, 20 nt, Human
ugagccuugaggagugacug

SEQ ID NO: 912951 - RNA, 20 nt, Human
ccuuccccacccgcugaggu

SEQ ID NO: 912952 - RNA, 22 nt, Human
ugggagagcuucaugccuucag

SEQ ID NO: 912953 - RNA, 22 nt, Human
aguggggagguccaggccaccc

SEQ ID NO: 912954 - RNA, 22 nt, Human
acacuuaacuucugagaauaaa

SEQ ID NO: 912955 - RNA, 17 nt, Human
ucaauacacugcuuuua

SEQ ID NO: 912956 - RNA, 22 nt, Human
guuuccucugcugguuuucauu

SEQ ID NO: 912957 - RNA, 22 nt, Human
ccacugucagaggggcugugcc

SEQ ID NO: 912958 - RNA, 22 nt, Human
ugcagcaauggucccugcccuc

SEQ ID NO: 912959 - RNA, 22 nt, Human
ucuccugacaugucuggaggaa

SEQ ID NO: 912960 - RNA, 22 nt, Human
aucuacagcugucugcacagua

SEQ ID NO: 912961 - RNA, 22 nt, Human
agcagacauaucucaugucaca

SEQ ID NO: 912962 - RNA, 22 nt, Human
gucauuuugcugcauauuuaga

SEQ ID NO: 912963 - RNA, 22 nt, Human
gucucaguccgugcuguucagg

SEQ ID NO: 912964 - RNA, 22 nt, Human
ucauggauuaaauuauuaaguu

SEQ ID NO: 912965 - RNA, 22 nt, Human
gucuguguuuucaggccuuugu

SEQ ID NO: 912966 - RNA, 22 nt, Human
ucugaagcagaaaauggggaua

SEQ ID NO: 912967 - RNA, 22 nt, Human
gcugagcagccuaagcaaauuu

SEQ ID NO: 912968 - RNA, 22 nt, Human
uaagauaauaaguaugucuaug

SEQ ID NO: 912969 - RNA, 22 nt, Human
cccugggacccgcugcagaggc

SEQ ID NO: 912970 - RNA, 22 nt, Human
aucuguguaugugaccuuaucu

SEQ ID NO: 912971 - RNA, 22 nt, Human
gcuguguggcaaagggauuaca

SEQ ID NO: 912972 - RNA, 22 nt, Human
accaggagcauuuuuuauuagu

SEQ ID NO: 912973 - RNA, 23 nt, Human
uggacaggguaacuggugguuuu

SEQ ID NO: 912974 - RNA, 22 nt, Human
uuugacuucugggcauuuuggu

SEQ ID NO: 912975 - RNA, 22 nt, Human
cuacccaggcuuagagggcugg

SEQ ID NO: 912976 - RNA, 22 nt, Human
agugucuguguuuucuauugcu

SEQ ID NO: 912977 - RNA, 19 nt, Human
ucucucuguacauuagaua

SEQ ID NO: 912978 - RNA, 21 nt, Human
ugcuuuaugggaaaaauguca

SEQ ID NO: 912979 - RNA, 22 nt, Human
acagauaaauuuauaggagugu

SEQ ID NO: 912980 - RNA, 22 nt, Human
aaugcuucaaccucccacaugu

SEQ ID NO: 912981 - RNA, 22 nt, Human
auucuucaccauggauaauuug

SEQ ID NO: 912982 - RNA, 22 nt, Human
gaaaugucauagucuucaagcc

SEQ ID NO: 912983 - RNA, 21 nt, Human
caggccaaaagguucaacauu

SEQ ID NO: 912984 - RNA, 22 nt, Human
uuuacagagagagaacuggacu

SEQ ID NO: 912985 - RNA, 22 nt, Human
ucuuucagcucuucaggaccca

SEQ ID NO: 912986 - RNA, 22 nt, Human
cuggauaagaguuuuacuuccu

SEQ ID NO: 912987 - RNA, 22 nt, Human
aggcugcguuagccucacuccc

SEQ ID NO: 912988 - RNA, 22 nt, Human
cagggccuccuaaggcaucuaa

SEQ ID NO: 912989 - RNA, 19 nt, Human
ugccugucaguagaucuca

SEQ ID NO: 912990 - RNA, 22 nt, Human
ugacagcugaggcccagaguac

SEQ ID NO: 912991 - RNA, 22 nt, Human
gccucugauggaggccagcgcu

SEQ ID NO: 912992 - RNA, 22 nt, Human
aucacauugccagugauuaccc

SEQ ID NO: 912993 - RNA, 22 nt, Human
ugcucaugcuggggacagaugu

SEQ ID NO: 912994 - RNA, 22 nt, Human
agccaggaagagaggccucacc

SEQ ID NO: 912995 - RNA, 20 nt, Human
gcucugugguuugagucucc

SEQ ID NO: 912996 - RNA, 22 nt, Human
gggcuggaaaaacaacauacaa

SEQ ID NO: 912997 - RNA, 22 nt, Human
uuggaagaccagaggccuuguc

SEQ ID NO: 912998 - RNA, 22 nt, Human
auuauauaaaauucuggaagcu

SEQ ID NO: 912999 - RNA, 22 nt, Human
aacuguggcauguugaauuugu

SEQ ID NO: 913000 - RNA, 22 nt, Human
aaucuucacagagaaaauuagg

SEQ ID NO: 913001 - RNA, 22 nt, Human
gagaaagcuucagaaauggccu

SEQ ID NO: 913002 - RNA, 22 nt, Human
uaggacuuagaacuggaagaca

SEQ ID NO: 913003 - RNA, 19 nt, Human
ugcaggaggacugagcaga

SEQ ID NO: 913004 - RNA, 22 nt, Human
uuauguguguguauacauacaa

SEQ ID NO: 913005 - RNA, 22 nt, Human
uuagaaacuuuggaggauagau

SEQ ID NO: 913006 - RNA, 22 nt, Human
ucuggucccuuuuccugcaguc

SEQ ID NO: 913007 - RNA, 22 nt, Human
uacuuuuagccuauuugauucu

SEQ ID NO: 913008 - RNA, 22 nt, Human
aaggcacuugcccagagcugca

SEQ ID NO: 913009 - RNA, 22 nt, Human
ucccagaguucaaugggaaggu

SEQ ID NO: 913010 - RNA, 22 nt, Human
gcgguggggaaaggaggugcug

SEQ ID NO: 913011 - RNA, 22 nt, Human
ggagaugccagaauugcaaauu

SEQ ID NO: 913012 - RNA, 22 nt, Human
agucaggagauauuuugauaug

SEQ ID NO: 913013 - RNA, 22 nt, Human
ggccugcuucucagugagcuug

SEQ ID NO: 913014 - RNA, 22 nt, Human
ccauggagcgggugagugagug

SEQ ID NO: 913015 - RNA, 22 nt, Human
uggggagagguaucauugagau

SEQ ID NO: 913016 - RNA, 22 nt, Human
caggcacugcacuaccacuuuu

SEQ ID NO: 913017 - RNA, 18 nt, Human
ucaggagacacagacgca

SEQ ID NO: 913018 - RNA, 22 nt, Human
gagcugcugugaggggagcuuc

SEQ ID NO: 913019 - RNA, 19 nt, Human
uucuugaacauguuucuca

SEQ ID NO: 913020 - RNA, 22 nt, Human
acaugucuccacccaucuuaaa

SEQ ID NO: 913021 - RNA, 22 nt, Human
gcucagcuggagagggacgggu

SEQ ID NO: 913022 - RNA, 22 nt, Human
ccagggcacuuaggcccagccc

SEQ ID NO: 913023 - RNA, 22 nt, Human
uagggaggaggguuuucaaauc

SEQ ID NO: 913024 - RNA, 22 nt, Human
guggcaggagacuggaagaugg

SEQ ID NO: 913025 - RNA, 22 nt, Human
cucuggagggaggcugagcugg

SEQ ID NO: 913026 - RNA, 22 nt, Human
aaguuuuaacaaguacuuacua

SEQ ID NO: 913027 - RNA, 23 nt, Human
ccugccuguucuaacuccauuuc

SEQ ID NO: 913028 - RNA, 22 nt, Human
uggcucugaccagguagaggag

SEQ ID NO: 913029 - RNA, 22 nt, Human
aggcuuggagguucuguagcca

SEQ ID NO: 913030 - RNA, 22 nt, Human
aaggagcucccggcagaccagg

SEQ ID NO: 913031 - RNA, 22 nt, Human
acugucaugcauuauggcaugu

SEQ ID NO: 913032 - RNA, 22 nt, Human
gcuagcuggguuucacugugga

SEQ ID NO: 913033 - RNA, 22 nt, Human
aacacaguuuuccaaaauagag

SEQ ID NO: 913034 - RNA, 22 nt, Human
gccuguguccuucccagugggg

SEQ ID NO: 913035 - RNA, 22 nt, Human
uuuccuucccuggaugagaagu

SEQ ID NO: 913036 - RNA, 22 nt, Human
cuagagaauggcaaagauuaga

SEQ ID NO: 913037 - RNA, 22 nt, Human
uuucuucuguuuguaguuacac

SEQ ID NO: 913038 - RNA, 22 nt, Human
gagcugcugguugcuggugccu

SEQ ID NO: 913039 - RNA, 22 nt, Human
uaagguuuguggggagcaaaag

SEQ ID NO: 913040 - RNA, 22 nt, Human
agggggcaucagguccuggcuc

SEQ ID NO: 913041 - RNA, 22 nt, Human
aucaucuugcuuucuguuuacu

SEQ ID NO: 913042 - RNA, 22 nt, Human
cacuaaauguuucaauguggga

SEQ ID NO: 913043 - RNA, 22 nt, Human
agugggcagugcgcucggaugc

SEQ ID NO: 913044 - RNA, 22 nt, Human
cugggcucugcaguugauguuu

SEQ ID NO: 913045 - RNA, 22 nt, Human
ugggcucuccuggaggacaaca

SEQ ID NO: 913046 - RNA, 22 nt, Human
aacaaaugauaccaguucucaa

SEQ ID NO: 913047 - RNA, 22 nt, Human
aggcaggcaaguucauaugagg

SEQ ID NO: 913048 - RNA, 20 nt, Human
acacaguagcaauuagugca

SEQ ID NO: 913049 - RNA, 22 nt, Human
ucucugggaucagguggcccag

SEQ ID NO: 913050 - RNA, 22 nt, Human
gagcuuuuauaccuucucucag

SEQ ID NO: 913051 - RNA, 20 nt, Human
aaauguauaggacccuucua

SEQ ID NO: 913052 - RNA, 20 nt, Human
guggaaugcacucugugcug

SEQ ID NO: 913053 - RNA, 21 nt, Human
cccuguguuccacagcagaca

SEQ ID NO: 913054 - RNA, 18 nt, Human
gggcugugagaugggaag

SEQ ID NO: 913055 - RNA, 22 nt, Human
auaaugugaagauaaugcaaga

SEQ ID NO: 913056 - RNA, 22 nt, Human
gguucucuaacuuugacuggag

SEQ ID NO: 913057 - RNA, 22 nt, Human
caaaugaagggagcugaagucu

SEQ ID NO: 913058 - RNA, 22 nt, Human
agcuaucucaggcacucacauu

SEQ ID NO: 913059 - RNA, 22 nt, Human
auuagcaaucacgcagucauuu

SEQ ID NO: 913060 - RNA, 22 nt, Human
acagccaggcccagcacgcagg

SEQ ID NO: 913061 - RNA, 22 nt, Human
uaucaaaaggaguugaaagggg

SEQ ID NO: 913062 - RNA, 22 nt, Human
uaguggagguggucugugaacu

SEQ ID NO: 913063 - RNA, 22 nt, Human
aagacacuaagcuuucaggaua

SEQ ID NO: 913064 - RNA, 22 nt, Human
acaggggcuccgaaggugaggg

SEQ ID NO: 913065 - RNA, 22 nt, Human
ccugcacaugugugcgccugua

SEQ ID NO: 913066 - RNA, 22 nt, Human
gaggguggguuucuugcacguc

SEQ ID NO: 913067 - RNA, 22 nt, Human
gggucacuuuugcuauguuggc

SEQ ID NO: 913068 - RNA, 22 nt, Human
agcccugccucuccaaugccca

SEQ ID NO: 913069 - RNA, 22 nt, Human
ucccagcagggccgaccagccu

SEQ ID NO: 913070 - RNA, 22 nt, Human
gggcuccaucggacuuggguuu

SEQ ID NO: 913071 - RNA, 22 nt, Human
uuagaaccaggguuacgauucu

SEQ ID NO: 913072 - RNA, 22 nt, Human
cagcugcuuucagcaggaggga

SEQ ID NO: 913073 - RNA, 22 nt, Human
ggaggccaaagugugggcggcu

SEQ ID NO: 913074 - RNA, 22 nt, Human
uuaaucaaauuuacaacccagu

SEQ ID NO: 913075 - RNA, 21 nt, Human
cucaggcuggcagcaggcuag

SEQ ID NO: 913076 - RNA, 22 nt, Human
auaaggaauuuagaauagggaa

SEQ ID NO: 913077 - RNA, 22 nt, Human
ccccaggaagccucagauuugc

SEQ ID NO: 913078 - RNA, 22 nt, Human
caggggcuguuugccucaggcc

SEQ ID NO: 913079 - RNA, 22 nt, Human
acagaauacucauaagaagggg

SEQ ID NO: 913080 - RNA, 22 nt, Human
aacuguaagugguuggaagaag

SEQ ID NO: 913081 - RNA, 22 nt, Human
ucauaaaaugcuccugauauug

SEQ ID NO: 913082 - RNA, 22 nt, Human
ugucaccuugcucauccucgga

SEQ ID NO: 913083 - RNA, 19 nt, Human
acagggcuuggccugacau

SEQ ID NO: 913084 - RNA, 22 nt, Human
ucaagaacuuaggagcaagcca

SEQ ID NO: 913085 - RNA, 22 nt, Human
cuauucugcuugaaauuauucu

SEQ ID NO: 913086 - RNA, 22 nt, Human
gcuuuggaugugugccugaggu

SEQ ID NO: 913087 - RNA, 17 nt, Human
cauccgugagcucggca

SEQ ID NO: 913088 - RNA, 22 nt, Human
gaaggcauucuauucuacauau

SEQ ID NO: 913089 - RNA, 22 nt, Human
auuauucaacacuugagaaauu

SEQ ID NO: 913090 - RNA, 18 nt, Human
cucugaccgccacuugcu

SEQ ID NO: 913091 - RNA, 22 nt, Human
gcugccugcuucaugugggaga

SEQ ID NO: 913092 - RNA, 22 nt, Human
ggccagaguugauggcaucuug

SEQ ID NO: 913093 - RNA, 22 nt, Human
cagacauggcgccaagugcuag

SEQ ID NO: 913094 - RNA, 22 nt, Human
agaggccagcaaccacaguaaa

SEQ ID NO: 913095 - RNA, 22 nt, Human
cagaggccuuucuacagugaua

SEQ ID NO: 913096 - RNA, 22 nt, Human
ucaugcaguuucuuaucugcca

SEQ ID NO: 913097 - RNA, 22 nt, Human
uugcuguaguguucugauguca

SEQ ID NO: 913098 - RNA, 17 nt, Human
gugcagggaugaaggau

SEQ ID NO: 913099 - RNA, 22 nt, Human
uucuaugcuaguggaaagcuuc

SEQ ID NO: 913100 - RNA, 22 nt, Human
agcccaaggcuucccugcuggc

SEQ ID NO: 913101 - RNA, 22 nt, Human
augagguaguuuggagaagagc

SEQ ID NO: 913102 - RNA, 22 nt, Human
uaaagugcucauaaaaauggau

SEQ ID NO: 913103 - RNA, 22 nt, Human
cuggcucccagcuuucagggag

SEQ ID NO: 913104 - RNA, 22 nt, Human
ccccagagugagggauugagug

SEQ ID NO: 913105 - RNA, 22 nt, Human
ugacaaguacauaauuucaugu

SEQ ID NO: 913106 - RNA, 22 nt, Human
cauauuucagucuaagaugugu

SEQ ID NO: 913107 - RNA, 22 nt, Human
ggcucaggacugcagcguagag

SEQ ID NO: 913108 - RNA, 22 nt, Human
uucuuaagaggguuaagugaag

SEQ ID NO: 913109 - RNA, 22 nt, Human
ucaguguuuaccguauguuguu

SEQ ID NO: 913110 - RNA, 22 nt, Human
agagccuguuuugugggagaug

SEQ ID NO: 913111 - RNA, 22 nt, Human
acuuuccugccaaggccagagu

SEQ ID NO: 913112 - RNA, 22 nt, Human
agcuguggauuggguacuuucu

SEQ ID NO: 913113 - RNA, 22 nt, Human
cagcugcugaggaagggguugg

SEQ ID NO: 913114 - RNA, 22 nt, Human
uguggggacugaguggaggcuu

SEQ ID NO: 913115 - RNA, 22 nt, Human
aacugcuuugugagcuuucugg

SEQ ID NO: 913116 - RNA, 22 nt, Human
uuaacauuuaguguaccccugu

SEQ ID NO: 913117 - RNA, 22 nt, Human
ucauguacauguaagucagaaa

SEQ ID NO: 913118 - RNA, 22 nt, Human
aauucuagcccaggcaaaacua

SEQ ID NO: 913119 - RNA, 22 nt, Human
aaguuuagaacuauaagaguga

SEQ ID NO: 913120 - RNA, 22 nt, Human
aucagaauggagcccacauggu

SEQ ID NO: 913121 - RNA, 22 nt, Human
caaauagaagguacucagagaa

SEQ ID NO: 913122 - RNA, 22 nt, Human
gcagacacuugaggugggcuuu

SEQ ID NO: 913123 - RNA, 22 nt, Human
ggaagcugaacuuagcaaggaa

SEQ ID NO: 913124 - RNA, 22 nt, Human
aaauggguuugauucucagcca

SEQ ID NO: 913125 - RNA, 22 nt, Human
acaucaucgugcacauacauaa

SEQ ID NO: 913126 - RNA, 19 nt, Human
aggcuggagacaccaggcc

SEQ ID NO: 913127 - RNA, 22 nt, Human
auggggagagaagggcugagcu

SEQ ID NO: 913128 - RNA, 22 nt, Human
ggcucccacccauagggcgagu

SEQ ID NO: 913129 - RNA, 22 nt, Human
uugcucuccagaggcucacagc

SEQ ID NO: 913130 - RNA, 22 nt, Human
ugacagcugagccccaggcaag

SEQ ID NO: 913131 - RNA, 22 nt, Human
agguuaggaaugggagguaaug

SEQ ID NO: 913132 - RNA, 22 nt, Human
cagaggccaggcugccugacug

SEQ ID NO: 913133 - RNA, 22 nt, Human
uggaaugucauaccauaaaaga

SEQ ID NO: 913134 - RNA, 22 nt, Human
aaacagugcaggaaguuaagca

SEQ ID NO: 913135 - RNA, 22 nt, Human
gguggcagaggugcaucagccc

SEQ ID NO: 913136 - RNA, 22 nt, Human
gugugcauggagggggcaguga

SEQ ID NO: 913137 - RNA, 22 nt, Human
agugaggaaauccauuaucaag

SEQ ID NO: 913138 - RNA, 22 nt, Human
auguacaaucuaucacaagaag

SEQ ID NO: 913139 - RNA, 22 nt, Human
uucuacaaauauuuacuguucc

SEQ ID NO: 913140 - RNA, 23 nt, Human
ucucaagccagaccaggccucgc

SEQ ID NO: 913141 - RNA, 22 nt, Human
uuuaguuauugcacagaauuag

SEQ ID NO: 913142 - RNA, 20 nt, Human
uacagaaacaggacuuuugg

SEQ ID NO: 913143 - RNA, 21 nt, Human
cugauaauuguuaaauuauuu

SEQ ID NO: 913144 - RNA, 22 nt, Human
cuguccauggcaaugaugcaga

SEQ ID NO: 913145 - RNA, 22 nt, Human
caugugggacaaucucagguau

SEQ ID NO: 913146 - RNA, 22 nt, Human
ugaacagucauuuagaaugugc

SEQ ID NO: 913147 - RNA, 22 nt, Human
aauccacggcaacacugggccc

SEQ ID NO: 913148 - RNA, 22 nt, Human
aaaguucuaaaacucuuuguga

SEQ ID NO: 913149 - RNA, 23 nt, Human
aggcagcuggguagcaucuuucu

SEQ ID NO: 913150 - RNA, 22 nt, Human
ugcacacauuaaggauacacag

SEQ ID NO: 913151 - RNA, 22 nt, Human
uacuuguucuuucaagagauag

SEQ ID NO: 913152 - RNA, 22 nt, Human
uggcuucacaauuucauaacua

SEQ ID NO: 913153 - RNA, 22 nt, Human
agacccugcauuuuccaggguu

SEQ ID NO: 913154 - RNA, 22 nt, Human
ucagccagguaauguggagaug

SEQ ID NO: 913155 - RNA, 22 nt, Human
aggugcuggaguagaagaaaaa

SEQ ID NO: 913156 - RNA, 22 nt, Human
cuggcugcuuguagacucgacu

SEQ ID NO: 913157 - RNA, 22 nt, Human
guuuccuacacuguaguauuau

SEQ ID NO: 913158 - RNA, 22 nt, Human
uaagaacaucuguccccagauu

SEQ ID NO: 913159 - RNA, 22 nt, Human
caaaauguucuggcaccuuuaa

SEQ ID NO: 913160 - RNA, 22 nt, Human
ucugucuuugagaucucagccu

SEQ ID NO: 913161 - RNA, 22 nt, Human
ucaggacacuuggcacaagguc

SEQ ID NO: 913162 - RNA, 22 nt, Human
uuguagaaucauuauuucuagu

SEQ ID NO: 913163 - RNA, 22 nt, Human
uagguuuuccuaaaauucuggu

SEQ ID NO: 913164 - RNA, 22 nt, Human
aauguuuugcauuaguuuucua

SEQ ID NO: 913165 - RNA, 22 nt, Human
ugagaugguucacagagaaggc

SEQ ID NO: 913166 - RNA, 22 nt, Human
auucacaaaaugauauagauac

SEQ ID NO: 913167 - RNA, 16 nt, Human
gcugaagugaguauag

SEQ ID NO: 913168 - RNA, 22 nt, Human
aggcuuuaagcaagcauauugu

SEQ ID NO: 913169 - RNA, 20 nt, Human
augauucugggcuacacugg

SEQ ID NO: 913170 - RNA, 22 nt, Human
cagcaccuccgcaguucaccug

SEQ ID NO: 913171 - RNA, 22 nt, Human
uacauucccccaauuaccaaug

SEQ ID NO: 913172 - RNA, 22 nt, Human
cuucagggaggagcauggguuc

SEQ ID NO: 913173 - RNA, 22 nt, Human
ucagaaauagcucuaagcuccu

SEQ ID NO: 913174 - RNA, 22 nt, Human
ugaucauccaguuucuugucca

SEQ ID NO: 913175 - RNA, 22 nt, Human
ccaggcugccgaggaaagaaag

SEQ ID NO: 913176 - RNA, 22 nt, Human
gaggggcaaugagggaaagagu

SEQ ID NO: 913177 - RNA, 22 nt, Human
gcucggagucccaccugggaaa

SEQ ID NO: 913178 - RNA, 22 nt, Human
gugcauauguguguauacaaac

SEQ ID NO: 913179 - RNA, 22 nt, Human
uccaggccuggcuccauucagu

SEQ ID NO: 913180 - RNA, 22 nt, Human
ugcauacugaaucugccaucac

SEQ ID NO: 913181 - RNA, 22 nt, Human
cugaucccauuggcaguccagu

SEQ ID NO: 913182 - RNA, 20 nt, Human
uacuugaauguugcagcagu

SEQ ID NO: 913183 - RNA, 22 nt, Human
agucaggacacagcaugaacau

SEQ ID NO: 913184 - RNA, 22 nt, Human
auuucuguggcuucauucuccu

SEQ ID NO: 913185 - RNA, 22 nt, Human
uuuguucugaaaaucuucccuu

SEQ ID NO: 913186 - RNA, 22 nt, Human
uagcaaggacaacauaugagag

SEQ ID NO: 913187 - RNA, 22 nt, Human
gacugccuuuuugagcaaaaug

SEQ ID NO: 913188 - RNA, 22 nt, Human
ucugcccuuggcucucuuguug

SEQ ID NO: 913189 - RNA, 22 nt, Human
cagguauaacgugcauguugua

SEQ ID NO: 913190 - RNA, 22 nt, Human
cagaggaaggcucugggaaugu

SEQ ID NO: 913191 - RNA, 22 nt, Human
ggccacauguggcugcucguau

SEQ ID NO: 913192 - RNA, 22 nt, Human
ugguaaauauguccauucucuu

SEQ ID NO: 913193 - RNA, 22 nt, Human
uacacccacaugccuaggaggg

SEQ ID NO: 913194 - RNA, 22 nt, Human
agaaaaagaaaguggauuuguc

SEQ ID NO: 913195 - RNA, 22 nt, Human
acauucugaaauccaugugggu

SEQ ID NO: 913196 - RNA, 22 nt, Human
gacaggugagaugaggaacacc

SEQ ID NO: 913197 - RNA, 22 nt, Human
ggguaggagaggugucugugug

SEQ ID NO: 913198 - RNA, 22 nt, Human
caaguucacuugucuacaaggg

SEQ ID NO: 913199 - RNA, 23 nt, Human
ccagcgcucacucagagcauguu

SEQ ID NO: 913200 - RNA, 21 nt, Human
agggaaaaggcugagugaggg

SEQ ID NO: 913201 - RNA, 22 nt, Human
ggccucugcaggccucgacaag

SEQ ID NO: 913202 - RNA, 22 nt, Human
gauguacuugccuuaucuaucc

SEQ ID NO: 913203 - RNA, 22 nt, Human
uuaaaagaauccuguuauccuc

SEQ ID NO: 913204 - RNA, 22 nt, Human
uuugagucugcuuccauuuuca

SEQ ID NO: 913205 - RNA, 20 nt, Human
ugggucccugcaguuugaag

SEQ ID NO: 913206 - RNA, 22 nt, Human
caggcagcagccacucugguau

SEQ ID NO: 913207 - RNA, 22 nt, Human
ggcuccagggucucuccuugug

SEQ ID NO: 913208 - RNA, 22 nt, Human
ugaggcuuagagaauuaaguga

SEQ ID NO: 913209 - RNA, 20 nt, Human
uuucagugguuugugccuag

SEQ ID NO: 913210 - RNA, 22 nt, Human
cugaggcucagcgugaggaaag

SEQ ID NO: 913211 - RNA, 22 nt, Human
uggggccagguggcugcagguc

SEQ ID NO: 913212 - RNA, 20 nt, Human
aggcccugugcaucuuguuu

SEQ ID NO: 913213 - RNA, 22 nt, Human
acaguuaauccuaaaggcggua

SEQ ID NO: 913214 - RNA, 18 nt, Human
gccuguguucagccuuuc

SEQ ID NO: 913215 - RNA, 22 nt, Human
ggcugccagugagugcagaccg

SEQ ID NO: 913216 - RNA, 22 nt, Human
uacuuacauaaaaacugaaugu

SEQ ID NO: 913217 - RNA, 22 nt, Human
aucugaaaguuuagaauucuug

SEQ ID NO: 913218 - RNA, 22 nt, Human
gcauggcagugaggauggugcu

SEQ ID NO: 913219 - RNA, 20 nt, Human
cacaacuguccacaugcucc

SEQ ID NO: 913220 - RNA, 22 nt, Human
gagcuucacgggggacagcauu

SEQ ID NO: 913221 - RNA, 22 nt, Human
caggcugaucagggcugggaug

SEQ ID NO: 913222 - RNA, 22 nt, Human
ggaggggcauaguucaccauca

SEQ ID NO: 913223 - RNA, 22 nt, Human
gcccgugucuccugcucugugg

SEQ ID NO: 913224 - RNA, 22 nt, Human
uagggggcuguccugugcauua

SEQ ID NO: 913225 - RNA, 23 nt, Human
uguucucuuguccaggccuuaac

SEQ ID NO: 913226 - RNA, 22 nt, Human
cagcauuuuccauagaaagaag

SEQ ID NO: 913227 - RNA, 22 nt, Human
uccugggccuguacuccauccg

SEQ ID NO: 913228 - RNA, 22 nt, Human
ucauauaccagagaguuuauau

SEQ ID NO: 913229 - RNA, 22 nt, Human
auucugagaggcacaaugugga

SEQ ID NO: 913230 - RNA, 22 nt, Human
uugauuugauugaugaacuaag

SEQ ID NO: 913231 - RNA, 17 nt, Human
ggcaccagacggagagu

SEQ ID NO: 913232 - RNA, 22 nt, Human
uucuaggacccugcgugagaac

SEQ ID NO: 913233 - RNA, 22 nt, Human
aaugggcucacaagaccugaau

SEQ ID NO: 913234 - RNA, 22 nt, Human
agauaauuauuuacuucaaagu

SEQ ID NO: 913235 - RNA, 22 nt, Human
uagcaaauaaaacaguauugaa

SEQ ID NO: 913236 - RNA, 22 nt, Human
aggugucuuugcggcccgccgc

SEQ ID NO: 913237 - RNA, 22 nt, Human
aaauguuagguuguacugaguc

SEQ ID NO: 913238 - RNA, 22 nt, Human
ccucucuccaauuuucaccuca

SEQ ID NO: 913239 - RNA, 17 nt, Human
ucuagagcacuuugaga

SEQ ID NO: 913240 - RNA, 22 nt, Human
uacuuuggggacaauauggaau

SEQ ID NO: 913241 - RNA, 22 nt, Human
gucuuguuaagauuuuggaaua

SEQ ID NO: 913242 - RNA, 22 nt, Human
gcauguggccuucaggcuggaa

SEQ ID NO: 913243 - RNA, 22 nt, Human
cagcugcccugccuugcccuua

SEQ ID NO: 913244 - RNA, 22 nt, Human
cugggccuagaggaagcugaca

SEQ ID NO: 913245 - RNA, 22 nt, Human
cagccuuuauggaaaggccugg

SEQ ID NO: 913246 - RNA, 22 nt, Human
agacauuuugcaauggguagcu

SEQ ID NO: 913247 - RNA, 22 nt, Human
uuaaagcugcugaauccuauuu

SEQ ID NO: 913248 - RNA, 21 nt, Human
ucaaagacuggggcugugugc

SEQ ID NO: 913249 - RNA, 22 nt, Human
guuuccaagaugcugccaucag

SEQ ID NO: 913250 - RNA, 19 nt, Human
uuaagaguaggcauugugc

SEQ ID NO: 913251 - RNA, 22 nt, Human
acaggcugaggaugauugcauc

SEQ ID NO: 913252 - RNA, 17 nt, Human
aggaagcgagcuggccu

SEQ ID NO: 913253 - RNA, 17 nt, Human
cagcuuuaugcuacugu

SEQ ID NO: 913254 - RNA, 22 nt, Human
aggcagagcuaggaagaauugu

SEQ ID NO: 913255 - RNA, 22 nt, Human
agucauuacagcaggcagaagg

SEQ ID NO: 913256 - RNA, 23 nt, Human
ggggaaagaccaugcuugaggac

SEQ ID NO: 913257 - RNA, 22 nt, Human
ggccuuagcugucuuuccuuug

SEQ ID NO: 913258 - RNA, 22 nt, Human
gcugacugauggacacagcacc

SEQ ID NO: 913259 - RNA, 22 nt, Human
aggggaggagcuuuucuugccu

SEQ ID NO: 913260 - RNA, 22 nt, Human
caggagcaaauccaaaagaauu

SEQ ID NO: 913261 - RNA, 22 nt, Human
uauuguuucuggcuguggcagc

SEQ ID NO: 913262 - RNA, 15 nt, Human
gcagguggaucacuu

SEQ ID NO: 913263 - RNA, 22 nt, Human
uuugcauuuugauaagaucacu

SEQ ID NO: 913264 - RNA, 19 nt, Human
aacaucuguaacuauuuuc

SEQ ID NO: 913265 - RNA, 22 nt, Human
ucuucagauugcacugagcaag

SEQ ID NO: 913266 - RNA, 17 nt, Human
auugucucuucacuuau

SEQ ID NO: 913267 - RNA, 22 nt, Human
ugcaggugguuuggacacugcu

SEQ ID NO: 913268 - RNA, 19 nt, Human
augagcaggcaagacaagc

SEQ ID NO: 913269 - RNA, 17 nt, Human
gcaagggaugggagauu

SEQ ID NO: 913270 - RNA, 22 nt, Human
uggcagcuacagacagagguga

SEQ ID NO: 913271 - RNA, 22 nt, Human
uauuggaaggaagcaagagagg

SEQ ID NO: 913272 - RNA, 22 nt, Human
aggaggccaggcccucaagccu

SEQ ID NO: 913273 - RNA, 22 nt, Human
uucuuuuggacucaaagagaac

SEQ ID NO: 913274 - RNA, 22 nt, Human
aggaggccuguuuucuccugga

SEQ ID NO: 913275 - RNA, 23 nt, Human
agacauuuuaauaaggacuuuuu

SEQ ID NO: 913276 - RNA, 21 nt, Human
gggcuccagagauguagcuuc

SEQ ID NO: 913277 - RNA, 22 nt, Human
uuggcucccacuaacuccagca

SEQ ID NO: 913278 - RNA, 22 nt, Human
cuucagaaccagccagaagagg

SEQ ID NO: 913279 - RNA, 22 nt, Human
gcugggugucacggggcucgug

SEQ ID NO: 913280 - RNA, 22 nt, Human
gccagggcaggggagcaucugc

SEQ ID NO: 913281 - RNA, 23 nt, Human
acacauuuuucccguucugaggu

SEQ ID NO: 913282 - RNA, 22 nt, Human
ucuucuuugaaucauagugacc

SEQ ID NO: 913283 - RNA, 19 nt, Human
ugcagcugucucuauauua

SEQ ID NO: 913284 - RNA, 22 nt, Human
ggcagugaugucaaacagugaa

SEQ ID NO: 913285 - RNA, 18 nt, Human
uccagcucugccacuuac

SEQ ID NO: 913286 - RNA, 18 nt, Human
gcuggcugcacuucugcu

SEQ ID NO: 913287 - RNA, 22 nt, Human
auuagaagcgugaauccuuuca

SEQ ID NO: 913288 - RNA, 22 nt, Human
acuuuccuagacuucagugaca

SEQ ID NO: 913289 - RNA, 22 nt, Human
cagaacaugauauaaacagaag

SEQ ID NO: 913290 - RNA, 22 nt, Human
gagcugagacacacuuuggcaa

SEQ ID NO: 913291 - RNA, 20 nt, Human
ccagcacccucucagcugaa

SEQ ID NO: 913292 - RNA, 22 nt, Human
cugcaggacugaaagaugaggu

SEQ ID NO: 913293 - RNA, 22 nt, Human
cuguauuuaguuaaaaugcuaa

SEQ ID NO: 913294 - RNA, 22 nt, Human
uccagggcaggugcugggcucu

SEQ ID NO: 913295 - RNA, 22 nt, Human
caugugugugagggaaacaugu

SEQ ID NO: 913296 - RNA, 22 nt, Human
ugugucugcccuuaguacaucu

SEQ ID NO: 913297 - RNA, 22 nt, Human
cacaggaggcaaugguaagauu

SEQ ID NO: 913298 - RNA, 22 nt, Human
uuauggaauuugcaaaagguua

SEQ ID NO: 913299 - RNA, 22 nt, Human
aggcuggugucucuguccuguc

SEQ ID NO: 913300 - RNA, 22 nt, Human
gcugcaaguccuucccucucuu

SEQ ID NO: 913301 - RNA, 22 nt, Human
ugaucagcaucuucccagcucg

SEQ ID NO: 913302 - RNA, 22 nt, Human
uggcucccaaggagcuccugcc

SEQ ID NO: 913303 - RNA, 23 nt, Human
cacaggcugcgcauaagcuucuc

SEQ ID NO: 913304 - RNA, 22 nt, Human
guuagugcuuauuaaauaguau

SEQ ID NO: 913305 - RNA, 22 nt, Human
aaguguacaugaacacaugaca

SEQ ID NO: 913306 - RNA, 22 nt, Human
uaugugcaguuugcucuuaaca

SEQ ID NO: 913307 - RNA, 22 nt, Human
uggaaucuugcgggcacauggc

SEQ ID NO: 913308 - RNA, 22 nt, Human
aaaguggccauccucugcaucg

SEQ ID NO: 913309 - RNA, 22 nt, Human
acagagagggagugauaaaucc

SEQ ID NO: 913310 - RNA, 22 nt, Human
ggagggcaacuuuucaguaggu

SEQ ID NO: 913311 - RNA, 22 nt, Human
uguucauuauucuucaucugcc

SEQ ID NO: 913312 - RNA, 22 nt, Human
gaugauuuugaugcaguaaaga

SEQ ID NO: 913313 - RNA, 22 nt, Human
cuggguggcagagccugcagug

SEQ ID NO: 913314 - RNA, 22 nt, Human
gaauaauuuugaucagaaggga

SEQ ID NO: 913315 - RNA, 23 nt, Human
cauaugaauuuuagaggcaguuu

SEQ ID NO: 913316 - RNA, 22 nt, Human
ucagccaggccaggcauucaca

SEQ ID NO: 913317 - RNA, 22 nt, Human
aaugagcuucuauaaucuuguc

SEQ ID NO: 913318 - RNA, 22 nt, Human
aguguuucaauccuagggguug

SEQ ID NO: 913319 - RNA, 22 nt, Human
agauacauggaacgucaaaccu

SEQ ID NO: 913320 - RNA, 22 nt, Human
uacugugacagaguacuuaaac

SEQ ID NO: 913321 - RNA, 22 nt, Human
acuucacauuugcaagucuugg

SEQ ID NO: 913322 - RNA, 20 nt, Human
ugacacaaauugcuuucuca

SEQ ID NO: 913323 - RNA, 22 nt, Human
cuuuguccauugauucguucaa

SEQ ID NO: 913324 - RNA, 22 nt, Human
ggcuccaggcuccuauuucacu

SEQ ID NO: 913325 - RNA, 22 nt, Human
aauccaauccuacucagaaagu

SEQ ID NO: 913326 - RNA, 22 nt, Human
gggcugagagugacuguucugu

SEQ ID NO: 913327 - RNA, 22 nt, Human
acgaaauacuuugcacaguuuu

SEQ ID NO: 913328 - RNA, 22 nt, Human
auuuccaacuaccccuccauuu

SEQ ID NO: 913329 - RNA, 22 nt, Human
uauuuugugccaugcacugccu

SEQ ID NO: 913330 - RNA, 22 nt, Human
caggacagagcccagacugugu

SEQ ID NO: 913331 - RNA, 22 nt, Human
augcagcagcuacuugggaagg

SEQ ID NO: 913332 - RNA, 22 nt, Human
cagccaggagccucugcaacua

SEQ ID NO: 913333 - RNA, 22 nt, Human
ucuucaaacccuggcucuuccu

SEQ ID NO: 913334 - RNA, 22 nt, Human
uugcaucaaauauguaccacag

SEQ ID NO: 913335 - RNA, 22 nt, Human
agccagcaggugggaaacugga

SEQ ID NO: 913336 - RNA, 22 nt, Human
uuguucuuaguaugcauuguuu

SEQ ID NO: 913337 - RNA, 22 nt, Human
gagauaacucuaggucuucgag

SEQ ID NO: 913338 - RNA, 22 nt, Human
ggccugcugcuaugacuuccug

SEQ ID NO: 913339 - RNA, 22 nt, Human
cuauuuuaacuugauuaccucu

SEQ ID NO: 913340 - RNA, 22 nt, Human
guuucuuaccacuuggaccucu

SEQ ID NO: 913341 - RNA, 22 nt, Human
agagaguuuaagugacuugccg

SEQ ID NO: 913342 - RNA, 22 nt, Human
uucuggaauucuugcagccacu

SEQ ID NO: 913343 - RNA, 22 nt, Human
gaacuauucauucucauuagcg

SEQ ID NO: 913344 - RNA, 22 nt, Human
uaaguucugaguaaauacuguu

SEQ ID NO: 913345 - RNA, 22 nt, Human
uaaagcaggccacauaugugau

SEQ ID NO: 913346 - RNA, 22 nt, Human
aacacuccguggaggcaugcag

SEQ ID NO: 913347 - RNA, 22 nt, Human
acaaggauuuguuccuaauguu

SEQ ID NO: 913348 - RNA, 22 nt, Human
gcagcucucuggccugcccugg

SEQ ID NO: 913349 - RNA, 22 nt, Human
aaguuuaugaagucuaagccaa

SEQ ID NO: 913350 - RNA, 22 nt, Human
uccuuuguuguacaauuauuuu

SEQ ID NO: 913351 - RNA, 22 nt, Human
gaugcugaagugaagugaucuu

SEQ ID NO: 913352 - RNA, 22 nt, Human
gcaugcaaaaaauguauuuguu

SEQ ID NO: 913353 - RNA, 22 nt, Human
uuggaaggagccuaaaagagac

SEQ ID NO: 913354 - RNA, 22 nt, Human
cacaugcaggagccaauguaca

SEQ ID NO: 913355 - RNA, 22 nt, Human
aggugggcuuggugccaacaug

SEQ ID NO: 913356 - RNA, 20 nt, Human
acauuugaguaucaucuacu

SEQ ID NO: 913357 - RNA, 20 nt, Human
aacacugcuucuauauuuuc

SEQ ID NO: 913358 - RNA, 22 nt, Human
cugcuuccacacaagcaaagcu

SEQ ID NO: 913359 - RNA, 22 nt, Human
cagugauggauauggagaaguc

SEQ ID NO: 913360 - RNA, 22 nt, Human
acuagcagucagcgguuggcaa

SEQ ID NO: 913361 - RNA, 22 nt, Human
gcauucaucaaaaauguuccuc

SEQ ID NO: 913362 - RNA, 22 nt, Human
gagugagugcugggcugaggcu

SEQ ID NO: 913363 - RNA, 22 nt, Human
auuagcauaaguguucggugca

SEQ ID NO: 913364 - RNA, 22 nt, Human
uagaaucuccagcauugguugu

SEQ ID NO: 913365 - RNA, 22 nt, Human
gcagggccuuggucaucuuuuu

SEQ ID NO: 913366 - RNA, 22 nt, Human
cacagcaauagcuaacugauac

SEQ ID NO: 913367 - RNA, 22 nt, Human
agcaauuucccaucucuucugc

SEQ ID NO: 913368 - RNA, 22 nt, Human
acuucuguaaagggaagacagu

SEQ ID NO: 913369 - RNA, 22 nt, Human
acuuucuaggucucaguccuuu

SEQ ID NO: 913370 - RNA, 22 nt, Human
agccugcuuccucagggaacaa

SEQ ID NO: 913371 - RNA, 22 nt, Human
gccaaggccucugcaggaugag

SEQ ID NO: 913372 - RNA, 22 nt, Human
uugaucaaaucagcuacugagg

SEQ ID NO: 913373 - RNA, 21 nt, Human
cuacuuaaguaggggauuagg

SEQ ID NO: 913374 - RNA, 22 nt, Human
uggcccugugacugaguucuag

SEQ ID NO: 913375 - RNA, 22 nt, Human
auaagacacgccccacucacuc

SEQ ID NO: 913376 - RNA, 22 nt, Human
agagagaggggcgagcaaacac

SEQ ID NO: 913377 - RNA, 21 nt, Human
ccugugccaaaguguguuagg

SEQ ID NO: 913378 - RNA, 22 nt, Human
uuucagaugaaauguguauauu

SEQ ID NO: 913379 - RNA, 22 nt, Human
ugucuuacagcaaucuguucug

SEQ ID NO: 913380 - RNA, 22 nt, Human
agacaggagagggaacugccgg

SEQ ID NO: 913381 - RNA, 20 nt, Human
cuucuucagccuaugcuuca

SEQ ID NO: 913382 - RNA, 22 nt, Human
guuuuuucaugaguaguuaucu

SEQ ID NO: 913383 - RNA, 22 nt, Human
gauguauacuuuucuuucucug

SEQ ID NO: 913384 - RNA, 22 nt, Human
aucaaaaugcuccagugauggu

SEQ ID NO: 913385 - RNA, 22 nt, Human
aagcugugagcuggaugcucca

SEQ ID NO: 913386 - RNA, 22 nt, Human
gaaggaggugucaguuggacug

SEQ ID NO: 913387 - RNA, 22 nt, Human
cugggguggauggguccaaguu

SEQ ID NO: 913388 - RNA, 22 nt, Human
cagcagagcuuauuaacuaaaa

SEQ ID NO: 913389 - RNA, 22 nt, Human
cagcauuuagaauuugaagugu

SEQ ID NO: 913390 - RNA, 22 nt, Human
ggacagagggcaggagcccaga

SEQ ID NO: 913391 - RNA, 22 nt, Human
aucaggaaugaauacuuuugga

SEQ ID NO: 913392 - RNA, 22 nt, Human
aaguugcuaaugauguguuugc

SEQ ID NO: 913393 - RNA, 22 nt, Human
uggucagaacucagcgugcuug

SEQ ID NO: 913394 - RNA, 23 nt, Human
uggucugaagccucagguuccuc

SEQ ID NO: 913395 - RNA, 22 nt, Human
aagacaauccuggacagucagc

SEQ ID NO: 913396 - RNA, 19 nt, Human
gcuggccacgccccaguug

SEQ ID NO: 913397 - RNA, 22 nt, Human
auggaauguuuauacacaguug

SEQ ID NO: 913398 - RNA, 21 nt, Human
ugcugccauagaccugaggga

SEQ ID NO: 913399 - RNA, 22 nt, Human
caacagaccuggauucaaaaac

SEQ ID NO: 913400 - RNA, 21 nt, Human
ugugugcauaugcauguacau

SEQ ID NO: 913401 - RNA, 22 nt, Human
ucucuucugaccuagccuugga

SEQ ID NO: 913402 - RNA, 22 nt, Human
caaucuguacuugaaaaauuau

SEQ ID NO: 913403 - RNA, 18 nt, Human
cugugggaaggcuuucua

SEQ ID NO: 913404 - RNA, 22 nt, Human
ugagaugaauaacuccugcuaa

SEQ ID NO: 913405 - RNA, 22 nt, Human
aggugcagcugacaccaugugg

SEQ ID NO: 913406 - RNA, 22 nt, Human
uuucaguguaagguuuccagga

SEQ ID NO: 913407 - RNA, 22 nt, Human
uguagaaauuaguaagaucaac

SEQ ID NO: 913408 - RNA, 22 nt, Human
aagcagcacgcuuugccaacaa

SEQ ID NO: 913409 - RNA, 17 nt, Human
cuggucccaccaagccc

SEQ ID NO: 913410 - RNA, 22 nt, Human
uugggagauggggagauaauau

SEQ ID NO: 913411 - RNA, 23 nt, Human
ccaggaagaggccauccacaguc

SEQ ID NO: 913412 - RNA, 21 nt, Human
uaauuagcaaagcugagauuc

SEQ ID NO: 913413 - RNA, 22 nt, Human
ucuugcagagggcccuucugcu

SEQ ID NO: 913414 - RNA, 22 nt, Human
ugguugaauaagauaguuuuau

SEQ ID NO: 913415 - RNA, 22 nt, Human
uaagcuaacguccauggaaaug

SEQ ID NO: 913416 - RNA, 22 nt, Human
acauguacauacacauauguaa

SEQ ID NO: 913417 - RNA, 22 nt, Human
aaagcagcagcacguggaagag

SEQ ID NO: 913418 - RNA, 22 nt, Human
cccugugauguagcuagaguag

SEQ ID NO: 913419 - RNA, 22 nt, Human
caguccuguuccuggaguaguu

SEQ ID NO: 913420 - RNA, 22 nt, Human
guuuggaauagcaguaaacauu

SEQ ID NO: 913421 - RNA, 20 nt, Human
gaaaggagugucccugugag

SEQ ID NO: 913422 - RNA, 22 nt, Human
uagaggaacugccuuucuucug

SEQ ID NO: 913423 - RNA, 22 nt, Human
agcucucaagauaagaaagaac

SEQ ID NO: 913424 - RNA, 22 nt, Human
gcagauuucuaauaagcaaugu

SEQ ID NO: 913425 - RNA, 22 nt, Human
cagcuguugcagcacugagaga

SEQ ID NO: 913426 - RNA, 22 nt, Human
gaggggcugggguugacuccaa

SEQ ID NO: 913427 - RNA, 22 nt, Human
ucuaaugaaagauguaggaacu

SEQ ID NO: 913428 - RNA, 22 nt, Human
aguaguggggccaggguuugaa

SEQ ID NO: 913429 - RNA, 22 nt, Human
ggccagcggcacagccuggccc

SEQ ID NO: 913430 - RNA, 22 nt, Human
ccugccugucaucgccugcgcc

SEQ ID NO: 913431 - RNA, 21 nt, Human
aguuuuuacucuuaacugugg

SEQ ID NO: 913432 - RNA, 22 nt, Human
cuguggcucuccaauggaggga

SEQ ID NO: 913433 - RNA, 22 nt, Human
uuuggaauuaugcuuaaaguuu

SEQ ID NO: 913434 - RNA, 22 nt, Human
ccaaaauguuugaaugcaugug

SEQ ID NO: 913435 - RNA, 22 nt, Human
uguaugaagccagaaucuguuu

SEQ ID NO: 913436 - RNA, 22 nt, Human
ucuagagauacauuggucauuu

SEQ ID NO: 913437 - RNA, 22 nt, Human
ugcaaggcuugcaauggugauc

SEQ ID NO: 913438 - RNA, 22 nt, Human
acuguguauuccuauauaguaa

SEQ ID NO: 913439 - RNA, 20 nt, Human
ucucuguaaaucuucuuuua

SEQ ID NO: 913440 - RNA, 22 nt, Human
cagagcugacccaaggauugaa

SEQ ID NO: 913441 - RNA, 23 nt, Human
uguguucucacacagaugcagua

SEQ ID NO: 913442 - RNA, 22 nt, Human
uaagaugggggaaagaaauagu

SEQ ID NO: 913443 - RNA, 22 nt, Human
uuugugugcaacgcauggaguc

SEQ ID NO: 913444 - RNA, 22 nt, Human
uggccagugugugcugccggcu

SEQ ID NO: 913445 - RNA, 22 nt, Human
uuugaugaguuuaauaacagcc

SEQ ID NO: 913446 - RNA, 22 nt, Human
caucaaguagguccuuucaaga

SEQ ID NO: 913447 - RNA, 22 nt, Human
agaagcagaaaagggcacuuuu

SEQ ID NO: 913448 - RNA, 22 nt, Human
gugaaggaggggccacagauau

SEQ ID NO: 913449 - RNA, 22 nt, Human
uucucagggucuugugcaaggg

SEQ ID NO: 913450 - RNA, 22 nt, Human
ucucacaucugcccugugcugg

SEQ ID NO: 913451 - RNA, 22 nt, Human
uauaaacuauauguuagccaga

SEQ ID NO: 913452 - RNA, 22 nt, Human
ccaggccauucccagaguugcu

SEQ ID NO: 913453 - RNA, 22 nt, Human
uuguucuauggugaggcagcca

SEQ ID NO: 913454 - RNA, 22 nt, Human
ucugaugcaauguaagucuugg

SEQ ID NO: 913455 - RNA, 22 nt, Human
acuuaaaaccagacagcgucau

SEQ ID NO: 913456 - RNA, 22 nt, Human
uaaacagaauucaggcaagaua

SEQ ID NO: 913457 - RNA, 22 nt, Human
guuccacaaaaggucuaguuua

SEQ ID NO: 913458 - RNA, 22 nt, Human
aaggagcuuucauuacagccuu

SEQ ID NO: 913459 - RNA, 20 nt, Human
cccaggagcugugccccauc

SEQ ID NO: 913460 - RNA, 22 nt, Human
aucuucccaggcuggggagagg

SEQ ID NO: 913461 - RNA, 22 nt, Human
gggacagacccaugggccaggu

SEQ ID NO: 913462 - RNA, 22 nt, Human
uggaggacguguccaccaugaa

SEQ ID NO: 913463 - RNA, 22 nt, Human
aucuuaaucgaguccaugaaaa

SEQ ID NO: 913464 - RNA, 22 nt, Human
aaacaaugaaauucauucuuca

SEQ ID NO: 913465 - RNA, 22 nt, Human
ccucuggggcaucagacaaagg

SEQ ID NO: 913466 - RNA, 18 nt, Human
uuccuucugauguauaug

SEQ ID NO: 913467 - RNA, 22 nt, Human
aggagggcuaggaaaaccagga

SEQ ID NO: 913468 - RNA, 22 nt, Human
ucucagugacacucuucauaca

SEQ ID NO: 913469 - RNA, 22 nt, Human
ggugaggggcuccucugcccgg

SEQ ID NO: 913470 - RNA, 22 nt, Human
gcgcugaggcuggaggcgcacg

SEQ ID NO: 913471 - RNA, 22 nt, Human
aguuuaauccuccagcccaacu

SEQ ID NO: 913472 - RNA, 22 nt, Human
acugggaguucuccaugucccu

SEQ ID NO: 913473 - RNA, 22 nt, Human
acaguguuuuaugagaauuguu

SEQ ID NO: 913474 - RNA, 22 nt, Human
cugguuugcccacaccagccac

SEQ ID NO: 913475 - RNA, 22 nt, Human
ucuggcucugaauucacuucug

SEQ ID NO: 913476 - RNA, 22 nt, Human
cagagguggggaguauuucaag

SEQ ID NO: 913477 - RNA, 23 nt, Human
ugauuuuaaaaaguaaguuauca

SEQ ID NO: 913478 - RNA, 22 nt, Human
cggcuggguagaggugccgggu

SEQ ID NO: 913479 - RNA, 22 nt, Human
ucugcaaguuuaucacuuggga

SEQ ID NO: 913480 - RNA, 22 nt, Human
agcugccuggccggagccacug

SEQ ID NO: 913481 - RNA, 22 nt, Human
uagaaagcuggaggaauucuuu

SEQ ID NO: 913482 - RNA, 22 nt, Human
ucugaaauguucucuuguuuug

SEQ ID NO: 913483 - RNA, 22 nt, Human
auuuccuaauuuagggauagac

SEQ ID NO: 913484 - RNA, 22 nt, Human
gaggugugcacagcgugcugac

SEQ ID NO: 913485 - RNA, 23 nt, Human
agcaacagugggugaguguugcu

SEQ ID NO: 913486 - RNA, 22 nt, Human
agcagcaguacauauaagacua

SEQ ID NO: 913487 - RNA, 22 nt, Human
agggcuccaggggcugggugac

SEQ ID NO: 913488 - RNA, 22 nt, Human
ucuuguauuugauuccuuccaa

SEQ ID NO: 913489 - RNA, 22 nt, Human
cucuggaagaugaccuggguaa

SEQ ID NO: 913490 - RNA, 22 nt, Human
uucuucaaaacaacacuggccu

SEQ ID NO: 913491 - RNA, 22 nt, Human
caucagaagauggcucuggaaa

SEQ ID NO: 913492 - RNA, 22 nt, Human
aucagugcuucauagcccuggu

SEQ ID NO: 913493 - RNA, 22 nt, Human
gccaggcucuugguuauguuuu

SEQ ID NO: 913494 - RNA, 22 nt, Human
uaaaagaucacuggcugcuuua

SEQ ID NO: 913495 - RNA, 22 nt, Human
ucaguuuucucauuuaugagau

SEQ ID NO: 913496 - RNA, 22 nt, Human
ugugcauguucucauuucuaac

SEQ ID NO: 913497 - RNA, 22 nt, Human
gcaguaagaaagucaagcaguu

SEQ ID NO: 913498 - RNA, 22 nt, Human
aaaggcucagaaucggcagacc

SEQ ID NO: 913499 - RNA, 22 nt, Human
uccugaggcucacuuugaaugu

SEQ ID NO: 913500 - RNA, 22 nt, Human
caagauuugacuucgugguuug

SEQ ID NO: 913501 - RNA, 22 nt, Human
agaggaggcuggguccagauaa

SEQ ID NO: 913502 - RNA, 22 nt, Human
caguggagugggacuggucuga

SEQ ID NO: 913503 - RNA, 22 nt, Human
auuauaaagaacaugugugugg

SEQ ID NO: 913504 - RNA, 22 nt, Human
auguuaaauagccauuuguuug

SEQ ID NO: 913505 - RNA, 22 nt, Human
ugagguagaaaaagcuuguagu

SEQ ID NO: 913506 - RNA, 22 nt, Human
cucccaggcagggcugcccacu

SEQ ID NO: 913507 - RNA, 22 nt, Human
ucauggauggccgggaggugau

SEQ ID NO: 913508 - RNA, 22 nt, Human
cuugugauugagaaagucuaaa

SEQ ID NO: 913509 - RNA, 22 nt, Human
ucuagaaugacaugcaagagua

SEQ ID NO: 913510 - RNA, 22 nt, Human
ugaggucaccuggaggcagccu

SEQ ID NO: 913511 - RNA, 22 nt, Human
ucacuaaguuacauuuaguauu

SEQ ID NO: 913512 - RNA, 22 nt, Human
uuuacaugaguagcagauguuc

SEQ ID NO: 913513 - RNA, 22 nt, Human
cacuccuauaauuaaagaugca

SEQ ID NO: 913514 - RNA, 19 nt, Human
uuucuguuagaaggauaca

SEQ ID NO: 913515 - RNA, 22 nt, Human
gccgugcgugcgcaggugcugu

SEQ ID NO: 913516 - RNA, 19 nt, Human
ccucccacggauuccuucc

SEQ ID NO: 913517 - RNA, 22 nt, Human
uccagcaccaccacagggaaga

SEQ ID NO: 913518 - RNA, 22 nt, Human
ggcugcaggaacgacggagggg

SEQ ID NO: 913519 - RNA, 22 nt, Human
aauauuuauauuucucuucccu

SEQ ID NO: 913520 - RNA, 17 nt, Human
uacauguguaucugauu

SEQ ID NO: 913521 - RNA, 22 nt, Human
aauguguaaaagguuuucuuca

SEQ ID NO: 913522 - RNA, 22 nt, Human
guccccucagccacccaugggg

SEQ ID NO: 913523 - RNA, 22 nt, Human
guuuauuccagcaaucugcuua

SEQ ID NO: 913524 - RNA, 22 nt, Human
aaggugugaacugauucauugg

SEQ ID NO: 913525 - RNA, 22 nt, Human
uaggcagauguuaacaggaaaa

SEQ ID NO: 913526 - RNA, 22 nt, Human
aaaagagugacugauaaguaua

SEQ ID NO: 913527 - RNA, 22 nt, Human
gacuuugcugugucagcuucag

SEQ ID NO: 913528 - RNA, 22 nt, Human
uauguucuuggaaaugaagcuu

SEQ ID NO: 913529 - RNA, 19 nt, Human
ucauggaucagguaguuua

SEQ ID NO: 913530 - RNA, 22 nt, Human
cccuggcucuucaccaccugcc

SEQ ID NO: 913531 - RNA, 22 nt, Human
aguaggaugcuuuauaugaaag

SEQ ID NO: 913532 - RNA, 22 nt, Human
gccucugcggagcuguacauca

SEQ ID NO: 913533 - RNA, 22 nt, Human
ugggguggaacccuucugcugg

SEQ ID NO: 913534 - RNA, 22 nt, Human
guuuauugauaaaagcuggaca

SEQ ID NO: 913535 - RNA, 22 nt, Human
cauuuucaugaguuucuguuca

SEQ ID NO: 913536 - RNA, 20 nt, Human
ugaaaggugggaauuguggg

SEQ ID NO: 913537 - RNA, 22 nt, Human
ucauagaaauggaaaguauauu

SEQ ID NO: 913538 - RNA, 17 nt, Human
cagugaggccuuuccuc

SEQ ID NO: 913539 - RNA, 22 nt, Human
uuacacaauuacucacuccugg

SEQ ID NO: 913540 - RNA, 22 nt, Human
cuaaagagaguucaagacuccu

SEQ ID NO: 913541 - RNA, 22 nt, Human
ucauaaaacacaccagguaguu

SEQ ID NO: 913542 - RNA, 21 nt, Human
gucuuggcaccaggagagaga

SEQ ID NO: 913543 - RNA, 22 nt, Human
ucagauggauucauuacaugac

SEQ ID NO: 913544 - RNA, 22 nt, Human
gcuggcauuacaggagagaacc

SEQ ID NO: 913545 - RNA, 22 nt, Human
uggagagaaaaaagacaguucu

SEQ ID NO: 913546 - RNA, 22 nt, Human
aaccagcacugcuggggccugc

SEQ ID NO: 913547 - RNA, 23 nt, Human
aaauauucuuuuuuaguaagugc

SEQ ID NO: 913548 - RNA, 22 nt, Human
agagcacagugcaggauccccg

SEQ ID NO: 913549 - RNA, 22 nt, Human
acuguccugaauacugcaugac

SEQ ID NO: 913550 - RNA, 22 nt, Human
uuccaggguuaauuuauauggu

SEQ ID NO: 913551 - RNA, 17 nt, Human
cuggagccaagagggcc

SEQ ID NO: 913552 - RNA, 22 nt, Human
aacugcaauaacuugugcacca

SEQ ID NO: 913553 - RNA, 22 nt, Human
gagugagggccaacauccagcu

SEQ ID NO: 913554 - RNA, 21 nt, Human
gcucuaucaggccaaaauguc

SEQ ID NO: 913555 - RNA, 22 nt, Human
ggaagaggcugguagugcccgu

SEQ ID NO: 913556 - RNA, 23 nt, Human
gaaucaguggcuaacaaggaaac

SEQ ID NO: 913557 - RNA, 22 nt, Human
cagaauuuagaaaacaacauaa

SEQ ID NO: 913558 - RNA, 22 nt, Human
ugagcugugaggguacagauau

SEQ ID NO: 913559 - RNA, 22 nt, Human
cccaguggggaaauagcuagcu

SEQ ID NO: 913560 - RNA, 22 nt, Human
auacagaagaccccuccgucau

SEQ ID NO: 913561 - RNA, 22 nt, Human
aaaaguaauugcaguuuugcca

SEQ ID NO: 913562 - RNA, 22 nt, Human
uccugcccagagcucuccacuc

SEQ ID NO: 913563 - RNA, 22 nt, Human
agggggcuccuccggugcuucc

SEQ ID NO: 913564 - RNA, 22 nt, Human
agggcagcagcccauggcucug

SEQ ID NO: 913565 - RNA, 22 nt, Human
cagcccugcuuccccgcuaguu

SEQ ID NO: 913566 - RNA, 22 nt, Human
uguguuaaguauuugauacacu

SEQ ID NO: 913567 - RNA, 17 nt, Human
aagaacacucaauagca

SEQ ID NO: 913568 - RNA, 22 nt, Human
acuucuucuucagcugggggau

SEQ ID NO: 913569 - RNA, 22 nt, Human
gagguagguguaggaggccugc

SEQ ID NO: 913570 - RNA, 22 nt, Human
aggauuuaaucaguuggcauuu

SEQ ID NO: 913571 - RNA, 22 nt, Human
gugugugucuccgcggccguag

SEQ ID NO: 913572 - RNA, 22 nt, Human
aaagauuugaguucugcuuaua

SEQ ID NO: 913573 - RNA, 23 nt, Human
cauggcagcaagagcucauggcc

SEQ ID NO: 913574 - RNA, 22 nt, Human
ugccugugcccuuugcugggag

SEQ ID NO: 913575 - RNA, 22 nt, Human
ggugacaguuccggagguacag

SEQ ID NO: 913576 - RNA, 22 nt, Human
uucauacaguggcugcacucca

SEQ ID NO: 913577 - RNA, 22 nt, Human
ucauuuuuagcgcgcaaaaguu

SEQ ID NO: 913578 - RNA, 22 nt, Human
uaggcuucacuuccaguuauuc

SEQ ID NO: 913579 - RNA, 22 nt, Human
uguguaugcauacacacauaga

SEQ ID NO: 913580 - RNA, 22 nt, Human
cugggccuugccuugcccacag

SEQ ID NO: 913581 - RNA, 22 nt, Human
gucaggcuggggcugcugccag

SEQ ID NO: 913582 - RNA, 22 nt, Human
uagcaagagugggcuuuguggg

SEQ ID NO: 913583 - RNA, 22 nt, Human
aaugauauagcagacauagccu

SEQ ID NO: 913584 - RNA, 22 nt, Human
auuuuguuauaggagcugaaau

SEQ ID NO: 913585 - RNA, 22 nt, Human
ugggccugggcuggacagccug

SEQ ID NO: 913586 - RNA, 23 nt, Human
uucuacagcuucuucaguuaagg

SEQ ID NO: 913587 - RNA, 18 nt, Human
ccuguguguguugcaggc

SEQ ID NO: 913588 - RNA, 22 nt, Human
gcauuucaugcuccuuggaacc

SEQ ID NO: 913589 - RNA, 22 nt, Human
ggaaaggagaugaauaggauua

SEQ ID NO: 913590 - RNA, 22 nt, Human
cagcaggcuguggaaauccugg

SEQ ID NO: 913591 - RNA, 22 nt, Human
gcagcacuaaugggccccagaa

SEQ ID NO: 913592 - RNA, 22 nt, Human
uucucuuuucaccaguugcuaa

SEQ ID NO: 913593 - RNA, 19 nt, Human
gcuugggagagggagcuaa

SEQ ID NO: 913594 - RNA, 22 nt, Human
ucaggagagaaagaauacaauu

SEQ ID NO: 913595 - RNA, 22 nt, Human
aguacuuuuuguucaauugugc

SEQ ID NO: 913596 - RNA, 22 nt, Human
uccaggcuaauuuugcauuguu

SEQ ID NO: 913597 - RNA, 22 nt, Human
gccaggcugcuccagggaggcc

SEQ ID NO: 913598 - RNA, 22 nt, Human
ggugagugucaaugguuagagu

SEQ ID NO: 913599 - RNA, 22 nt, Human
cuucuuaucugaaaguaauauu

SEQ ID NO: 913600 - RNA, 22 nt, Human
gcuggcuguaucaccuggccag

SEQ ID NO: 913601 - RNA, 22 nt, Human
ucuucaggaagggaaaucaucc

SEQ ID NO: 913602 - RNA, 22 nt, Human
uggcagcuccuggggccagcac

SEQ ID NO: 913603 - RNA, 20 nt, Human
uguggcaggaugagggcgga

SEQ ID NO: 913604 - RNA, 19 nt, Human
acuggcaaaaaagguuaau

SEQ ID NO: 913605 - RNA, 21 nt, Human
uacaagauagagguaauauau

SEQ ID NO: 913606 - RNA, 22 nt, Human
ccugaggcuccaccuccagaga

SEQ ID NO: 913607 - RNA, 22 nt, Human
acaggaucgcccuguugcccag

SEQ ID NO: 913608 - RNA, 20 nt, Human
cccaggaguuugcucuuacu

SEQ ID NO: 913609 - RNA, 22 nt, Human
gugcuucucuucacacccaacu

SEQ ID NO: 913610 - RNA, 16 nt, Human
ucuuccuuuugauuuu

SEQ ID NO: 913611 - RNA, 21 nt, Human
uugcucuacagugagggcagc

SEQ ID NO: 913612 - RNA, 22 nt, Human
cuguggcugcgcccugggggag

SEQ ID NO: 913613 - RNA, 22 nt, Human
caagcagacaguaggccuagaa

SEQ ID NO: 913614 - RNA, 22 nt, Human
uguguguauaugcauuuaucua

SEQ ID NO: 913615 - RNA, 22 nt, Human
uuuacaauugguuuucucuaau

SEQ ID NO: 913616 - RNA, 22 nt, Human
uaggaaugaagaaguaugauau

SEQ ID NO: 913617 - RNA, 22 nt, Human
aaagaaggaugggagaaauccu

SEQ ID NO: 913618 - RNA, 22 nt, Human
ugagaggcagaauggugccugc

SEQ ID NO: 913619 - RNA, 19 nt, Human
uagggcuggccgggcggug

SEQ ID NO: 913620 - RNA, 19 nt, Human
gugcuuuuuaagagcucag

SEQ ID NO: 913621 - RNA, 22 nt, Human
ggcugaggcucaugccaucuug

SEQ ID NO: 913622 - RNA, 22 nt, Human
aaguucuagguagugcucuuuc

SEQ ID NO: 913623 - RNA, 22 nt, Human
uucaaagcaauagaaagaguga

SEQ ID NO: 913624 - RNA, 22 nt, Human
uuaaauuaggacucuaguucug

SEQ ID NO: 913625 - RNA, 22 nt, Human
ugugugcaugcuuggggcagca

SEQ ID NO: 913626 - RNA, 22 nt, Human
ucagggauugcaaaauucaucc

SEQ ID NO: 913627 - RNA, 22 nt, Human
ccacuuuuuucuccaucucuga

SEQ ID NO: 913628 - RNA, 22 nt, Human
agcucuccaucuaucugugaug

SEQ ID NO: 913629 - RNA, 22 nt, Human
ucagaagcugggucucagaagc

SEQ ID NO: 913630 - RNA, 22 nt, Human
gcuggcugugggcuccacgcuc

SEQ ID NO: 913631 - RNA, 22 nt, Human
cucuuccuuaagacuauaaaga

SEQ ID NO: 913632 - RNA, 22 nt, Human
ugcauauuauaaagagaauuag

SEQ ID NO: 913633 - RNA, 22 nt, Human
aaggcagugguugugauacugu

SEQ ID NO: 913634 - RNA, 22 nt, Human
cgugggucgggacuccgccucg

SEQ ID NO: 913635 - RNA, 22 nt, Human
uacauugugucucuaucuaguc

SEQ ID NO: 913636 - RNA, 22 nt, Human
cagcugcaggagaaacagaggc

SEQ ID NO: 913637 - RNA, 19 nt, Human
uggcuuggcugcagaugcu

SEQ ID NO: 913638 - RNA, 22 nt, Human
ucacaggaggaaccuggccugg

SEQ ID NO: 913639 - RNA, 22 nt, Human
uucuuguauauaaaaaucauuu

SEQ ID NO: 913640 - RNA, 22 nt, Human
uccaggcccagacggggugagg

SEQ ID NO: 913641 - RNA, 22 nt, Human
ucugcucuaguugcuuccugcc

SEQ ID NO: 913642 - RNA, 22 nt, Human
gaaguggaauuacugggucaua

SEQ ID NO: 913643 - RNA, 22 nt, Human
uauacacauguguguauucaua

SEQ ID NO: 913644 - RNA, 22 nt, Human
ucaguguuagacaaguuuggaa

SEQ ID NO: 913645 - RNA, 22 nt, Human
uggcagagcccagacuccaguc

SEQ ID NO: 913646 - RNA, 22 nt, Human
ggugcccagcaagcuuucaaug

SEQ ID NO: 913647 - RNA, 22 nt, Human
cugggccaucagaggggcugga

SEQ ID NO: 913648 - RNA, 22 nt, Human
gugauguggggaccguccuggc

SEQ ID NO: 913649 - RNA, 22 nt, Human
cuggcccagagcucuggccuuu

SEQ ID NO: 913650 - RNA, 22 nt, Human
aucuccagugaggcagauucug

SEQ ID NO: 913651 - RNA, 22 nt, Human
uucacacagaaucugaggagcu

SEQ ID NO: 913652 - RNA, 22 nt, Human
caauacaucaggucaaaaugug

SEQ ID NO: 913653 - RNA, 22 nt, Human
acauauauuacuaguaaagaca

SEQ ID NO: 913654 - RNA, 22 nt, Human
ugugucagcaggggagggaacu

SEQ ID NO: 913655 - RNA, 21 nt, Human
uuccaguuuuaauuaaauugu

SEQ ID NO: 913656 - RNA, 22 nt, Human
auggcagaccuccuggccacaa

SEQ ID NO: 913657 - RNA, 21 nt, Human
caauuacagauggcucagggg

SEQ ID NO: 913658 - RNA, 17 nt, Human
uagcacaaagcaggauu

SEQ ID NO: 913659 - RNA, 22 nt, Human
gcuuggggucaugaggcugcug

SEQ ID NO: 913660 - RNA, 22 nt, Human
gggaguggagagcaauggauga

SEQ ID NO: 913661 - RNA, 22 nt, Human
auggcaguagaaugggggaaaa

SEQ ID NO: 913662 - RNA, 22 nt, Human
cugugagaccugauuucuucau

SEQ ID NO: 913663 - RNA, 22 nt, Human
ugcccagcaauaaaccagaaga

SEQ ID NO: 913664 - RNA, 22 nt, Human
gugcccugcaugccccggguau

SEQ ID NO: 913665 - RNA, 22 nt, Human
aacaaacaaacauuuugucauc

SEQ ID NO: 913666 - RNA, 22 nt, Human
uguggaaugcuccuaagugaau

SEQ ID NO: 913667 - RNA, 22 nt, Human
agaaaucuuggagucuguggua

SEQ ID NO: 913668 - RNA, 22 nt, Human
ucagcuggcagguucugggaag

SEQ ID NO: 913669 - RNA, 22 nt, Human
agaugcuggauggaaaaugauc

SEQ ID NO: 913670 - RNA, 23 nt, Human
aaaguuugaagcaacaguaguug

SEQ ID NO: 913671 - RNA, 22 nt, Human
agcuggaacccgggugggcagc

SEQ ID NO: 913672 - RNA, 22 nt, Human
aaagaaggggucuacauccaau

SEQ ID NO: 913673 - RNA, 22 nt, Human
ggagcagaugucuucauggccu

SEQ ID NO: 913674 - RNA, 22 nt, Human
caucucaguguacagggagucu

SEQ ID NO: 913675 - RNA, 22 nt, Human
gaggagaagggcacggagaaaa

SEQ ID NO: 913676 - RNA, 22 nt, Human
cccaggggagguccucagggaa

SEQ ID NO: 913677 - RNA, 22 nt, Human
ugguguuuaaugggcuguuuau

SEQ ID NO: 913678 - RNA, 20 nt, Human
acagauggcaguuauuacau

SEQ ID NO: 913679 - RNA, 22 nt, Human
uuccuggugagauuucguucug

SEQ ID NO: 913680 - RNA, 22 nt, Human
aaacacagguacugcagaagug

SEQ ID NO: 913681 - RNA, 20 nt, Human
cacaggcuauaugagagcca

SEQ ID NO: 913682 - RNA, 22 nt, Human
guugugaauagugccgcaauaa

SEQ ID NO: 913683 - RNA, 22 nt, Human
agcugugggagaaucucugggu

SEQ ID NO: 913684 - RNA, 22 nt, Human
ucuucuggaucgaucacauugu

SEQ ID NO: 913685 - RNA, 22 nt, Human
aaucaucacgaacacaacagcg

SEQ ID NO: 913686 - RNA, 22 nt, Human
cugaggucuagacaccccaggg

SEQ ID NO: 913687 - RNA, 22 nt, Human
gaggaagaaagcauaggugggg

SEQ ID NO: 913688 - RNA, 22 nt, Human
auuuugcuggucugaauuacuu

SEQ ID NO: 913689 - RNA, 22 nt, Human
agagacaggaauggcauuaaga

SEQ ID NO: 913690 - RNA, 22 nt, Human
ccaggaggaugauuuuaagagg

SEQ ID NO: 913691 - RNA, 22 nt, Human
cagccaggagcucccccugcuc

SEQ ID NO: 913692 - RNA, 22 nt, Human
cacccagagccugagagggaua

SEQ ID NO: 913693 - RNA, 22 nt, Human
cuggcuuugcuggacugggagu

SEQ ID NO: 913694 - RNA, 22 nt, Human
ucaguauuccuggaaauacaag

SEQ ID NO: 913695 - RNA, 22 nt, Human
ucuggugucaguauucuuugaa

SEQ ID NO: 913696 - RNA, 22 nt, Human
gcccagguuucaucugcuccgu

SEQ ID NO: 913697 - RNA, 22 nt, Human
cuguaucugucagcuggucucg

SEQ ID NO: 913698 - RNA, 20 nt, Human
agggaggugcugggccugag

SEQ ID NO: 913699 - RNA, 22 nt, Human
aucugucuugccuugcauauuu

SEQ ID NO: 913700 - RNA, 22 nt, Human
ugguaaggucuucacucagauu

SEQ ID NO: 913701 - RNA, 22 nt, Human
gggcucagacaucccuccugga

SEQ ID NO: 913702 - RNA, 22 nt, Human
cacucugguucugaacaggauc

SEQ ID NO: 913703 - RNA, 22 nt, Human
gugugggcugcagaggcacagc

SEQ ID NO: 913704 - RNA, 22 nt, Human
ucagugauuucuggggugaggg

SEQ ID NO: 913705 - RNA, 22 nt, Human
agguggcaguuguggaaccauc

SEQ ID NO: 913706 - RNA, 22 nt, Human
cagacacacaagcaaucuaagu

SEQ ID NO: 913707 - RNA, 19 nt, Human
guacaacaaugcugagcau

SEQ ID NO: 913708 - RNA, 22 nt, Human
ucaaucuagagauuaaaauagg

SEQ ID NO: 913709 - RNA, 22 nt, Human
aucuggugcuaacaaaugugga

SEQ ID NO: 913710 - RNA, 22 nt, Human
uagauuucaggagacaaaaugg

SEQ ID NO: 913711 - RNA, 22 nt, Human
aggcugugaaauguggcaagga

SEQ ID NO: 913712 - RNA, 22 nt, Human
gcugccagcgucagaccugggg

SEQ ID NO: 913713 - RNA, 20 nt, Human
gugcugagugaaaugagauu

SEQ ID NO: 913714 - RNA, 22 nt, Human
auacaguguacuauuuagcagu

SEQ ID NO: 913715 - RNA, 22 nt, Human
agguuauuuuugcuuagaaaga

SEQ ID NO: 913716 - RNA, 22 nt, Human
gaugcaaagaggaccuucagua

SEQ ID NO: 913717 - RNA, 22 nt, Human
ggaagggguuaggggucccuga

SEQ ID NO: 913718 - RNA, 19 nt, Human
ggcugccuggagcgagggc

SEQ ID NO: 913719 - RNA, 19 nt, Human
ucagggccaugagcgccac

SEQ ID NO: 913720 - RNA, 22 nt, Human
ucagguucuggugagggcccuu

SEQ ID NO: 913721 - RNA, 22 nt, Human
aauacuauguugugacacauga

SEQ ID NO: 913722 - RNA, 22 nt, Human
agcagcuguuagaaacaggaag

SEQ ID NO: 913723 - RNA, 22 nt, Human
cagcaucucguggcuggauaga

SEQ ID NO: 913724 - RNA, 22 nt, Human
cucccuggcuuuguccugaggc

SEQ ID NO: 913725 - RNA, 22 nt, Human
uucaaaccuaucuaagaaauag

SEQ ID NO: 913726 - RNA, 22 nt, Human
auaucuucuuuauuuugugagg

SEQ ID NO: 913727 - RNA, 22 nt, Human
aauaaaugaacaaagcagguug

SEQ ID NO: 913728 - RNA, 22 nt, Human
caauauagagagaaaauuaugu

SEQ ID NO: 913729 - RNA, 22 nt, Human
uuuccugugcuuaacaaauauu

SEQ ID NO: 913730 - RNA, 22 nt, Human
uugcuguagcucauuucacucu

SEQ ID NO: 913731 - RNA, 22 nt, Human
uuuuauugguaaugauaaaagu

SEQ ID NO: 913732 - RNA, 22 nt, Human
agcaggguuccuuaaggccaua

SEQ ID NO: 913733 - RNA, 20 nt, Human
ggacugaaaacacaaaccug

SEQ ID NO: 913734 - RNA, 22 nt, Human
gaucuuuauacuguaauaauga

SEQ ID NO: 913735 - RNA, 22 nt, Human
uccugggaugaggaaacaagga

SEQ ID NO: 913736 - RNA, 22 nt, Human
cugaacacugagucuaccuccc

SEQ ID NO: 913737 - RNA, 22 nt, Human
ugcuggcuacugauggcaggcc

SEQ ID NO: 913738 - RNA, 22 nt, Human
cuggccugcagaucccaggguc

SEQ ID NO: 913739 - RNA, 22 nt, Human
ucugaagcacagcaggaagggu

SEQ ID NO: 913740 - RNA, 22 nt, Human
gcagacugcgagcgugcuggug

SEQ ID NO: 913741 - RNA, 22 nt, Human
caaguuuuagaaauaucuggau

SEQ ID NO: 913742 - RNA, 22 nt, Human
ccaucccuucucuggccagcag

SEQ ID NO: 913743 - RNA, 22 nt, Human
ggaggccaaggcgggcggauca

SEQ ID NO: 913744 - RNA, 22 nt, Human
gcaaagacugcaauuacuuuug

SEQ ID NO: 913745 - RNA, 22 nt, Human
uguucuugagccuuuagaccua

SEQ ID NO: 913746 - RNA, 22 nt, Human
cugggccaggaccaggguugaa

SEQ ID NO: 913747 - RNA, 22 nt, Human
augucugucuauagccaugaga

SEQ ID NO: 913748 - RNA, 22 nt, Human
caucagagugguggccuggugu

SEQ ID NO: 913749 - RNA, 21 nt, Human
uggcaggcagcuggaagcuug

SEQ ID NO: 913750 - RNA, 22 nt, Human
uucucuuaguauugcuaguuua

SEQ ID NO: 913751 - RNA, 23 nt, Human
uauugcacaaagagaugcacagg

SEQ ID NO: 913752 - RNA, 22 nt, Human
gccuggaggaauguagcugagg

SEQ ID NO: 913753 - RNA, 22 nt, Human
acuaaaguccuguuguagcaua

SEQ ID NO: 913754 - RNA, 22 nt, Human
cccauucauccucgcuuccuuc

SEQ ID NO: 913755 - RNA, 16 nt, Human
gcuaggcaacaggcug

SEQ ID NO: 913756 - RNA, 22 nt, Human
cacagcaagagcuaaaugacca

SEQ ID NO: 913757 - RNA, 22 nt, Human
ugaguuauggagaauaaaguca

SEQ ID NO: 913758 - RNA, 22 nt, Human
guuaacauuucuaggugcaggg

SEQ ID NO: 913759 - RNA, 22 nt, Human
aucauaaaccacuuuguaaucu

SEQ ID NO: 913760 - RNA, 22 nt, Human
uuacagaaaauguguuuuaacu

SEQ ID NO: 913761 - RNA, 22 nt, Human
ugugaggauaaaaaggaaggag

SEQ ID NO: 913762 - RNA, 22 nt, Human
agcacagagaaacuaagacauu

SEQ ID NO: 913763 - RNA, 22 nt, Human
ugaagccagcuuuggaagacac

SEQ ID NO: 913764 - RNA, 22 nt, Human
cagaauuugaaguaauauucca

SEQ ID NO: 913765 - RNA, 22 nt, Human
auggccaggguggcacuguggu

SEQ ID NO: 913766 - RNA, 22 nt, Human
uacuuaaaacugauagaaucuc

SEQ ID NO: 913767 - RNA, 22 nt, Human
ucugagaaauuucuuugugaug

SEQ ID NO: 913768 - RNA, 22 nt, Human
acauaaugagcucuuuauaaau

SEQ ID NO: 913769 - RNA, 22 nt, Human
ugagacgaagucuugcucuguu

SEQ ID NO: 913770 - RNA, 22 nt, Human
aggaaagacuggggccccagaa

SEQ ID NO: 913771 - RNA, 22 nt, Human
cccacaggugugagcuugcugg

SEQ ID NO: 913772 - RNA, 22 nt, Human
agcuucauaauuccuugacuca

SEQ ID NO: 913773 - RNA, 22 nt, Human
ggcugaagaacugggagucuca

SEQ ID NO: 913774 - RNA, 22 nt, Human
cugucugucaaguucaucucca

SEQ ID NO: 913775 - RNA, 22 nt, Human
acaccuuucagguccagacagu

SEQ ID NO: 913776 - RNA, 18 nt, Human
auguucauauuuuuaggg

SEQ ID NO: 913777 - RNA, 22 nt, Human
aaacaggcgcuuacuaagaaaa

SEQ ID NO: 913778 - RNA, 22 nt, Human
ucuggcucuguguccucaccca

SEQ ID NO: 913779 - RNA, 22 nt, Human
caguggguccugcgucugccag

SEQ ID NO: 913780 - RNA, 22 nt, Human
uucuagucuauggcuagauagu

SEQ ID NO: 913781 - RNA, 22 nt, Human
ugcuccugagcgguuuccauga

SEQ ID NO: 913782 - RNA, 22 nt, Human
aaggcugaggagggccugcagg

SEQ ID NO: 913783 - RNA, 22 nt, Human
aagccaaaggcuccagugaccu

SEQ ID NO: 913784 - RNA, 19 nt, Human
gagcugagaguagcacugg

SEQ ID NO: 913785 - RNA, 22 nt, Human
ccugcuguccccugagccugga

SEQ ID NO: 913786 - RNA, 22 nt, Human
aacaucuuugccaaauugcuau

SEQ ID NO: 913787 - RNA, 22 nt, Human
aggcuucacauuuucuaggccu

SEQ ID NO: 913788 - RNA, 22 nt, Human
guuauuuuaucucugagagguu

SEQ ID NO: 913789 - RNA, 22 nt, Human
auacguaaguugaacaucagaa

SEQ ID NO: 913790 - RNA, 22 nt, Human
ugacaggcuaggaggcugaagg

SEQ ID NO: 913791 - RNA, 22 nt, Human
accuucaggugagcacacagau

SEQ ID NO: 913792 - RNA, 22 nt, Human
augugugugaugggcgccgcca

SEQ ID NO: 913793 - RNA, 22 nt, Human
ucuucuguuuuagauugcauac

SEQ ID NO: 913794 - RNA, 22 nt, Human
caagauuuccaacccuggguaa

SEQ ID NO: 913795 - RNA, 22 nt, Human
uacugaaagaauacauaauuuc

SEQ ID NO: 913796 - RNA, 22 nt, Human
acuucaugcagaagagagcugu

SEQ ID NO: 913797 - RNA, 22 nt, Human
ccugggaggcggagguugcagu

SEQ ID NO: 913798 - RNA, 22 nt, Human
cccaggaggcggagguuguggu

SEQ ID NO: 913799 - RNA, 22 nt, Human
aauugacaaaucauacuuguau

SEQ ID NO: 913800 - RNA, 22 nt, Human
cugccacuagcuuucacaucuu

SEQ ID NO: 913801 - RNA, 22 nt, Human
agcuccugggccaagcccaugc

SEQ ID NO: 913802 - RNA, 22 nt, Human
aaggcccacagaacugucucca

SEQ ID NO: 913803 - RNA, 22 nt, Human
ccuggcuccgguucaagggaaa

SEQ ID NO: 913804 - RNA, 22 nt, Human
cagggucugaugguccucacuu

SEQ ID NO: 913805 - RNA, 22 nt, Human
uuuuguguagagauggggucuu

SEQ ID NO: 913806 - RNA, 22 nt, Human
uguuuugucuaaucuaaauucu

SEQ ID NO: 913807 - RNA, 22 nt, Human
agcucaauuuaaggcuuggcuu

SEQ ID NO: 913808 - RNA, 22 nt, Human
gguccuugcuucgguccaguac

SEQ ID NO: 913809 - RNA, 22 nt, Human
agcaggggcuccuccacagcca

SEQ ID NO: 913810 - RNA, 22 nt, Human
ucucuuaauaaguaaauacuga

SEQ ID NO: 913811 - RNA, 22 nt, Human
agcccuggcccggcugugcuuu

SEQ ID NO: 913812 - RNA, 22 nt, Human
ugugcauggcaucauugcagcc

SEQ ID NO: 913813 - RNA, 18 nt, Human
aucuuaacuugauggagu

SEQ ID NO: 913814 - RNA, 22 nt, Human
aguaacaaaugcaucugggcau

SEQ ID NO: 913815 - RNA, 22 nt, Human
agggccagaugaagccacaagc

SEQ ID NO: 913816 - RNA, 22 nt, Human
gauguauaguauguaauuucug

SEQ ID NO: 913817 - RNA, 22 nt, Human
uccauaaauuuuaugaacauau

SEQ ID NO: 913818 - RNA, 22 nt, Human
uucaggauuauacucucuuccc

SEQ ID NO: 913819 - RNA, 22 nt, Human
ugggagugauacaguauggaau

SEQ ID NO: 913820 - RNA, 22 nt, Human
ugcuucugcugauauuuuguga

SEQ ID NO: 913821 - RNA, 22 nt, Human
ugugcucuggaguugccuucac

SEQ ID NO: 913822 - RNA, 22 nt, Human
uuguacuagaaaggaugucaaa

SEQ ID NO: 913823 - RNA, 22 nt, Human
ucagcaaaauguggcuagugcu

SEQ ID NO: 913824 - RNA, 22 nt, Human
caugauuuacuaaaauuuguuu

SEQ ID NO: 913825 - RNA, 22 nt, Human
caucuuuaguagguucuggaga

SEQ ID NO: 913826 - RNA, 22 nt, Human
uggcaugauaggaggugcagaa

SEQ ID NO: 913827 - RNA, 22 nt, Human
auguaaacaagguuauugucca

SEQ ID NO: 913828 - RNA, 22 nt, Human
aacugcagagaacaucuggguu

SEQ ID NO: 913829 - RNA, 22 nt, Human
cccaggcugguccugaacuccu

SEQ ID NO: 913830 - RNA, 22 nt, Human
uggaaaaaacccagacucuaga

SEQ ID NO: 913831 - RNA, 22 nt, Human
aggagcugcaaauauuaguaau

SEQ ID NO: 913832 - RNA, 22 nt, Human
cuacauaaucuggauuugucug

SEQ ID NO: 913833 - RNA, 22 nt, Human
ugggcagaggcucugaagucca

SEQ ID NO: 913834 - RNA, 18 nt, Human
gaggaucagaaaucugua

SEQ ID NO: 913835 - RNA, 22 nt, Human
cuauacaguaaccacagugauu

SEQ ID NO: 913836 - RNA, 19 nt, Human
ugcugacacuagaugugca

SEQ ID NO: 913837 - RNA, 22 nt, Human
cauaaguuggguaauauaauga

SEQ ID NO: 913838 - RNA, 22 nt, Human
gaaauucaggacaaagacucuu

SEQ ID NO: 913839 - RNA, 22 nt, Human
ucuaauccuugcuaccugggug

SEQ ID NO: 913840 - RNA, 18 nt, Human
gcacauguaagaguaaag

SEQ ID NO: 913841 - RNA, 18 nt, Human
ugagaaccauguucauuc

SEQ ID NO: 913842 - RNA, 22 nt, Human
cauugaaauauggaaacugaug

SEQ ID NO: 913843 - RNA, 22 nt, Human
gacagcuggcaguggaaaggug

SEQ ID NO: 913844 - RNA, 22 nt, Human
uugauucuauguuguugucuca

SEQ ID NO: 913845 - RNA, 22 nt, Human
ggcagccagcaaugagaaguuu

SEQ ID NO: 913846 - RNA, 22 nt, Human
aagaaucuccauuccuguuuua

SEQ ID NO: 913847 - RNA, 22 nt, Human
cugggcucaguggcucauggcu

SEQ ID NO: 913848 - RNA, 22 nt, Human
ugaaaugucaguguuuuauaag

SEQ ID NO: 913849 - RNA, 22 nt, Human
uccagaggcucugagggagagu

SEQ ID NO: 913850 - RNA, 22 nt, Human
cacaggagaacccacagauucu

SEQ ID NO: 913851 - RNA, 22 nt, Human
ugaggcagugugagauaauaaa

SEQ ID NO: 913852 - RNA, 22 nt, Human
cuucuuuacuuucuagaaauaa

SEQ ID NO: 913853 - RNA, 21 nt, Human
agagggcgaaggcgggguccg

SEQ ID NO: 913854 - RNA, 22 nt, Human
gagacacacacaggagguggca

SEQ ID NO: 913855 - RNA, 22 nt, Human
gccuccugagaagccacaggcu

SEQ ID NO: 913856 - RNA, 22 nt, Human
cugugucuucuguuuugaaguu

SEQ ID NO: 913857 - RNA, 22 nt, Human
cacccaggcuggagugcauugg

SEQ ID NO: 913858 - RNA, 22 nt, Human
ucucuucauagugacacccauc

SEQ ID NO: 913859 - RNA, 22 nt, Human
gcuguguguucaauaaugugau

SEQ ID NO: 913860 - RNA, 22 nt, Human
ucucagggcaauucucagcgac

SEQ ID NO: 913861 - RNA, 22 nt, Human
uuuaguucucccagucuugauu

SEQ ID NO: 913862 - RNA, 22 nt, Human
augucacugugaggcagcuguc

SEQ ID NO: 913863 - RNA, 22 nt, Human
uaagaaacaugauuaauggcag

SEQ ID NO: 913864 - RNA, 22 nt, Human
ucacacagauugguagagcuga

SEQ ID NO: 913865 - RNA, 22 nt, Human
cuagaacagucaaagugagcuc

SEQ ID NO: 913866 - RNA, 22 nt, Human
gcucacuaaauaacaggaagaa

SEQ ID NO: 913867 - RNA, 22 nt, Human
uggaggagggcuggugucugua

SEQ ID NO: 913868 - RNA, 22 nt, Human
gcuggccaggugcuuugguucu

SEQ ID NO: 913869 - RNA, 22 nt, Human
aggcugagccacggggcuggcu

SEQ ID NO: 913870 - RNA, 22 nt, Human
acuaggaaggcauaugggcaga

SEQ ID NO: 913871 - RNA, 23 nt, Human
auggacaggguuucagggucaca

SEQ ID NO: 913872 - RNA, 19 nt, Human
cauaaauguacaagauaca

SEQ ID NO: 913873 - RNA, 20 nt, Human
ccugggguacacuggcaugu

SEQ ID NO: 913874 - RNA, 21 nt, Human
ccaaaggcuauguaucuucug

SEQ ID NO: 913875 - RNA, 22 nt, Human
uucucaaagggugguuugcaaa

SEQ ID NO: 913876 - RNA, 22 nt, Human
uuucauugcagagucugugugc

SEQ ID NO: 913877 - RNA, 22 nt, Human
gaguggcuccuuacaaguucca

SEQ ID NO: 913878 - RNA, 22 nt, Human
cagagcuguugcggggcuuggc

SEQ ID NO: 913879 - RNA, 22 nt, Human
gugucauguagaaauugaugaa

SEQ ID NO: 913880 - RNA, 22 nt, Human
ccugggcuguugcaucauccuu

SEQ ID NO: 913881 - RNA, 22 nt, Human
ugaaaauauaguuuuccagacu

SEQ ID NO: 913882 - RNA, 20 nt, Human
gcagcagacagacaggggac

SEQ ID NO: 913883 - RNA, 22 nt, Human
uguuaugaacuucuagaaaaca

SEQ ID NO: 913884 - RNA, 22 nt, Human
gugcugagugcagagugcagag

SEQ ID NO: 913885 - RNA, 22 nt, Human
ggcucauguaugaaagggugug

SEQ ID NO: 913886 - RNA, 22 nt, Human
cugagaaaauuucaggaagugu

SEQ ID NO: 913887 - RNA, 21 nt, Human
ggcauggcaccucugggcagg

SEQ ID NO: 913888 - RNA, 22 nt, Human
gauaaaauauguggccuuuagu

SEQ ID NO: 913889 - RNA, 22 nt, Human
uaggcuaggcugaagguuuugg

SEQ ID NO: 913890 - RNA, 22 nt, Human
agcucccugagaugccacagca

SEQ ID NO: 913891 - RNA, 22 nt, Human
caucuacacugauuaggugaac

SEQ ID NO: 913892 - RNA, 22 nt, Human
cauagaaucauagcacauuuga

SEQ ID NO: 913893 - RNA, 18 nt, Human
gagacacaagggccugga

SEQ ID NO: 913894 - RNA, 22 nt, Human
aauguucucaacaaaaggaagc

SEQ ID NO: 913895 - RNA, 23 nt, Human
uggcaguuuucuuuugugccagc

SEQ ID NO: 913896 - RNA, 22 nt, Human
augguauagagccacauguauu

SEQ ID NO: 913897 - RNA, 22 nt, Human
gcuggcagguaaagccccgggg

SEQ ID NO: 913898 - RNA, 22 nt, Human
uucuuaaaauucaagcuagguu

SEQ ID NO: 913899 - RNA, 22 nt, Human
ggcugaggcggcgaugcccuug

SEQ ID NO: 913900 - RNA, 22 nt, Human
gaggcagcuuggggcugugggu

SEQ ID NO: 913901 - RNA, 22 nt, Human
cagugcaguugguggcaggggu

SEQ ID NO: 913902 - RNA, 22 nt, Human
ucuagagaaguuuccuuuugaa

SEQ ID NO: 913903 - RNA, 22 nt, Human
cugccucugcgucccacagagu

SEQ ID NO: 913904 - RNA, 22 nt, Human
uagcaaggacguccaaagaacu

SEQ ID NO: 913905 - RNA, 22 nt, Human
augcaguguuuggaagcuuaag

SEQ ID NO: 913906 - RNA, 22 nt, Human
gaauacaagccaggcacaaggc

SEQ ID NO: 913907 - RNA, 22 nt, Human
aguuuuauugucccagagguga

SEQ ID NO: 913908 - RNA, 22 nt, Human
auuccagagagguucuggaggu

SEQ ID NO: 913909 - RNA, 21 nt, Human
aaaaugugagcgugaugcuua

SEQ ID NO: 913910 - RNA, 22 nt, Human
gaggcagugaacaauuccugug

SEQ ID NO: 913911 - RNA, 22 nt, Human
uggagagcaagucgcagacaug

SEQ ID NO: 913912 - RNA, 22 nt, Human
ggaugagguagaugaacaaggg

SEQ ID NO: 913913 - RNA, 22 nt, Human
ucucucuucagagauaccuugc

SEQ ID NO: 913914 - RNA, 22 nt, Human
acaaggcuucacacaguaugaa

SEQ ID NO: 913915 - RNA, 22 nt, Human
ugguccaggguguaguacagag

SEQ ID NO: 913916 - RNA, 22 nt, Human
gaggcugguaggaaaggaaaca

SEQ ID NO: 913917 - RNA, 22 nt, Human
uuaguaagcacucacacauucc

SEQ ID NO: 913918 - RNA, 21 nt, Human
uuuggugcuggaaaugccauu

SEQ ID NO: 913919 - RNA, 22 nt, Human
agcagcuagacuucagaaucug

SEQ ID NO: 913920 - RNA, 22 nt, Human
auuacaagaugcauccauauuu

SEQ ID NO: 913921 - RNA, 22 nt, Human
agccuguggaucccugcacugg

SEQ ID NO: 913922 - RNA, 22 nt, Human
gcuauuucuauauuauaaagaa

SEQ ID NO: 913923 - RNA, 22 nt, Human
ucauguuucucuuacagcagcu

SEQ ID NO: 913924 - RNA, 22 nt, Human
uacauugauggaguaccuagcu

SEQ ID NO: 913925 - RNA, 22 nt, Human
ccagagaggggaagggcuugcc

SEQ ID NO: 913926 - RNA, 22 nt, Human
ugacuucaaaggcucuacuccu

SEQ ID NO: 913927 - RNA, 22 nt, Human
agaaaucacuuagaggaaguga

SEQ ID NO: 913928 - RNA, 22 nt, Human
gaaaguuucuucauuaagaugu

SEQ ID NO: 913929 - RNA, 22 nt, Human
ccaggcucacugacuaccacau

SEQ ID NO: 913930 - RNA, 22 nt, Human
uguagugugacauaggugucca

SEQ ID NO: 913931 - RNA, 19 nt, Human
ugccuggcaccagcuccac

SEQ ID NO: 913932 - RNA, 22 nt, Human
aaguuccucaaauaaaacauga

SEQ ID NO: 913933 - RNA, 22 nt, Human
gcaggugguuaaggucccaugu

SEQ ID NO: 913934 - RNA, 22 nt, Human
ugccuaggaaaccucaugcuuc

SEQ ID NO: 913935 - RNA, 22 nt, Human
gggcuuggcucauaaguggaug

SEQ ID NO: 913936 - RNA, 22 nt, Human
ugucugaaucgcuuccuagagg

SEQ ID NO: 913937 - RNA, 22 nt, Human
aggucagguaucagcagguauu

SEQ ID NO: 913938 - RNA, 22 nt, Human
ugugcgcuccggcgagucagcg

SEQ ID NO: 913939 - RNA, 22 nt, Human
cagcagaucaauguagaauauu

SEQ ID NO: 913940 - RNA, 22 nt, Human
auacuucuuugauguucacagg

SEQ ID NO: 913941 - RNA, 22 nt, Human
ugcaggcugcuggcaguagcuu

SEQ ID NO: 913942 - RNA, 22 nt, Human
gggcucuguuuagaccagagau

SEQ ID NO: 913943 - RNA, 22 nt, Human
caaugguggugucagaagagau

SEQ ID NO: 913944 - RNA, 22 nt, Human
auggcuuuuuagacuuugguac

SEQ ID NO: 913945 - RNA, 22 nt, Human
augucucugcugugguuagcuu

SEQ ID NO: 913946 - RNA, 22 nt, Human
caugaauauacauccugauggc

SEQ ID NO: 913947 - RNA, 22 nt, Human
agcacugauuuaaacuggauuu

SEQ ID NO: 913948 - RNA, 23 nt, Human
ugagaagccaggggagcgugagg

SEQ ID NO: 913949 - RNA, 22 nt, Human
ucacagcaaaagugugcagagc

SEQ ID NO: 913950 - RNA, 19 nt, Human
uucuaugauuaacaugaga

SEQ ID NO: 913951 - RNA, 22 nt, Human
caugugguauugugagauccac

SEQ ID NO: 913952 - RNA, 22 nt, Human
agagccccugguggagugagaa

SEQ ID NO: 913953 - RNA, 22 nt, Human
aggggccaccaccaaggaaggu

SEQ ID NO: 913954 - RNA, 22 nt, Human
uggcuugucauguaucugaggc

SEQ ID NO: 913955 - RNA, 21 nt, Human
acuuuacaauuuacauaguga

SEQ ID NO: 913956 - RNA, 22 nt, Human
ccauucugagucuuaugucuuu

SEQ ID NO: 913957 - RNA, 22 nt, Human
acaaaagcacugcagaguaagc

SEQ ID NO: 913958 - RNA, 22 nt, Human
cacauagauaggcagaagaaca

SEQ ID NO: 913959 - RNA, 22 nt, Human
cagggccaugaggcacaggguc

SEQ ID NO: 913960 - RNA, 22 nt, Human
gagguggcuggcucagagccag

SEQ ID NO: 913961 - RNA, 22 nt, Human
cccuccagggagccaugcuggg

SEQ ID NO: 913962 - RNA, 22 nt, Human
caggcucugcugcuacagcugu

SEQ ID NO: 913963 - RNA, 22 nt, Human
agcagcagcucaguucucagcu

SEQ ID NO: 913964 - RNA, 22 nt, Human
ugggccucaugcccagccaccc

SEQ ID NO: 913965 - RNA, 22 nt, Human
uuacaguaauguauuauuuaac

SEQ ID NO: 913966 - RNA, 20 nt, Human
uagcuaccuugauccccugg

SEQ ID NO: 913967 - RNA, 22 nt, Human
aauguguaaaugaggagucuug

SEQ ID NO: 913968 - RNA, 22 nt, Human
cuuguagaauugaaauggucuc

SEQ ID NO: 913969 - RNA, 22 nt, Human
guuuuauaggugaaauauuacu

SEQ ID NO: 913970 - RNA, 20 nt, Human
ugcugcuuugccacuaguug

SEQ ID NO: 913971 - RNA, 22 nt, Human
uugggcagauguuuccugugga

SEQ ID NO: 913972 - RNA, 22 nt, Human
uguauacaugucugugugcaca

SEQ ID NO: 913973 - RNA, 22 nt, Human
cuucuguguuuuacuauaugua

SEQ ID NO: 913974 - RNA, 22 nt, Human
cccaggcuggagugcaauggug

SEQ ID NO: 913975 - RNA, 22 nt, Human
gcagagaggaaugaagccaucc

SEQ ID NO: 913976 - RNA, 22 nt, Human
uuuggcagagucauuucagaaa

SEQ ID NO: 913977 - RNA, 22 nt, Human
caggccacagcuaaagaggauu

SEQ ID NO: 913978 - RNA, 21 nt, Human
cuacagaaucgagcauucugg

SEQ ID NO: 913979 - RNA, 22 nt, Human
aaugucuucaguguauacaugg

SEQ ID NO: 913980 - RNA, 22 nt, Human
acugugugaggcugggugaguc

SEQ ID NO: 913981 - RNA, 22 nt, Human
ccucccaccguaucucaguggc

SEQ ID NO: 913982 - RNA, 22 nt, Human
guguuguggagcuugucagggg

SEQ ID NO: 913983 - RNA, 22 nt, Human
aaguucuagagguugauuuggu

SEQ ID NO: 913984 - RNA, 21 nt, Human
gcacagugccaggcacacagu

SEQ ID NO: 913985 - RNA, 22 nt, Human
cagguccacagcccaucacugc

SEQ ID NO: 913986 - RNA, 22 nt, Human
cccaacuacucucaggcagcuu

SEQ ID NO: 913987 - RNA, 21 nt, Human
uugaccaagggugcgugcucc

SEQ ID NO: 913988 - RNA, 22 nt, Human
aaguaaaagcuuuaccaugcgc

SEQ ID NO: 913989 - RNA, 22 nt, Human
agcuuuauauaaaagaguacau

SEQ ID NO: 913990 - RNA, 22 nt, Human
gugggcagugccugacggauga

SEQ ID NO: 913991 - RNA, 22 nt, Human
auacacuuuagaaaaacgcugc

SEQ ID NO: 913992 - RNA, 22 nt, Human
agagacuguggcucuuugaagg

SEQ ID NO: 913993 - RNA, 22 nt, Human
aagauacauguuaggagcaacc

SEQ ID NO: 913994 - RNA, 18 nt, Human
ugcagccuguagucuugu

SEQ ID NO: 913995 - RNA, 22 nt, Human
aucuguggcgcaaacaaaggcu

SEQ ID NO: 913996 - RNA, 22 nt, Human
augcacaugaggcaagcaaaau

SEQ ID NO: 913997 - RNA, 22 nt, Human
aucaggaagaagaauguguugg

SEQ ID NO: 913998 - RNA, 22 nt, Human
gaagggaaauucagaucuucag

SEQ ID NO: 913999 - RNA, 22 nt, Human
uauaaauuaaugugcccaugag

SEQ ID NO: 914000 - RNA, 22 nt, Human
uagauucucccaucaugagaug

SEQ ID NO: 914001 - RNA, 22 nt, Human
ugucagugaaaaauugugauag

SEQ ID NO: 914002 - RNA, 22 nt, Human
uccaggcauaaugcccaguggu

SEQ ID NO: 914003 - RNA, 22 nt, Human
auauauagagcuagauguuaaa

SEQ ID NO: 914004 - RNA, 22 nt, Human
ccuggccaggcucucagcacug

SEQ ID NO: 914005 - RNA, 22 nt, Human
cuuggggcugucacucuggcau

SEQ ID NO: 914006 - RNA, 22 nt, Human
gcaggcaguugcaguuuucuag

SEQ ID NO: 914007 - RNA, 22 nt, Human
gagcugugagggacacauugcu

SEQ ID NO: 914008 - RNA, 22 nt, Human
ugucacuuuggccaagccauug

SEQ ID NO: 914009 - RNA, 22 nt, Human
ugaaugaauccuaacaaagaca

SEQ ID NO: 914010 - RNA, 22 nt, Human
ugggacaggaggccucuggaga

SEQ ID NO: 914011 - RNA, 23 nt, Human
cacuguguuacauguugaagaug

SEQ ID NO: 914012 - RNA, 22 nt, Human
cugucuguggagcuucugaugu

SEQ ID NO: 914013 - RNA, 22 nt, Human
ugaggcuccagccaggccagca

SEQ ID NO: 914014 - RNA, 22 nt, Human
ucacaaacaaugcuuuggaauu

SEQ ID NO: 914015 - RNA, 20 nt, Human
uuucugugcccaggucuguu

SEQ ID NO: 914016 - RNA, 22 nt, Human
ggagagguuauccguguuaugu

SEQ ID NO: 914017 - RNA, 22 nt, Human
cacaucugaaaagaugcacaag

SEQ ID NO: 914018 - RNA, 22 nt, Human
cacagggcagaggguccguggc

SEQ ID NO: 914019 - RNA, 22 nt, Human
agccuuagagacuuaaaacagg

SEQ ID NO: 914020 - RNA, 22 nt, Human
agggccagccaggcccuacaaa

SEQ ID NO: 914021 - RNA, 22 nt, Human
aguuaacacaaguaagauucca

SEQ ID NO: 914022 - RNA, 22 nt, Human
ccaggagaauaauggcagauua

SEQ ID NO: 914023 - RNA, 22 nt, Human
gccugggacugcagauccccag

SEQ ID NO: 914024 - RNA, 22 nt, Human
caggucagcuggugccccaggu

SEQ ID NO: 914025 - RNA, 22 nt, Human
aauuucacuggaaaagauaauu

SEQ ID NO: 914026 - RNA, 22 nt, Human
agcccaggugagggguucgaaa

SEQ ID NO: 914027 - RNA, 22 nt, Human
gcugcagagggucuuagagagg

SEQ ID NO: 914028 - RNA, 22 nt, Human
gugcauuuggugacucucaccc

SEQ ID NO: 914029 - RNA, 23 nt, Human
ucuuuccuaaugaaacagugaaa

SEQ ID NO: 914030 - RNA, 22 nt, Human
uggguccuugccaucuuggagu

SEQ ID NO: 914031 - RNA, 22 nt, Human
auauaucuucauuaggucgaga

SEQ ID NO: 914032 - RNA, 22 nt, Human
uguggaacaccuagaaugggua

SEQ ID NO: 914033 - RNA, 22 nt, Human
aggccugcugucuugaggccaa

SEQ ID NO: 914034 - RNA, 22 nt, Human
uacagaagcugagacacugaga

SEQ ID NO: 914035 - RNA, 22 nt, Human
gggagggauuaguucugccugg

SEQ ID NO: 914036 - RNA, 22 nt, Human
ugagcaagagaaacugacugua

SEQ ID NO: 914037 - RNA, 22 nt, Human
ucaggcuguagggccccuggag

SEQ ID NO: 914038 - RNA, 22 nt, Human
ucagggugaaccaggcaggaau

SEQ ID NO: 914039 - RNA, 22 nt, Human
ggccuaggauucugcauuucua

SEQ ID NO: 914040 - RNA, 22 nt, Human
ugcaggugucucugucuagcgu

SEQ ID NO: 914041 - RNA, 22 nt, Human
uagcuucuauacaacuucagca

SEQ ID NO: 914042 - RNA, 22 nt, Human
cuuaaucucaccugcaaagucc

SEQ ID NO: 914043 - RNA, 22 nt, Human
uucuuuuaaugucuggcuuuca

SEQ ID NO: 914044 - RNA, 22 nt, Human
auggaaugggaagaguguguga

SEQ ID NO: 914045 - RNA, 22 nt, Human
cucucuuugauguauaaauaau

SEQ ID NO: 914046 - RNA, 19 nt, Human
aagcccaguguaugcucuu

SEQ ID NO: 914047 - RNA, 23 nt, Human
ccuuaaauaucuacccuguggca

SEQ ID NO: 914048 - RNA, 22 nt, Human
ugggccuggcccuguggaggag

SEQ ID NO: 914049 - RNA, 22 nt, Human
gaagcuccguacuaugacuuuu

SEQ ID NO: 914050 - RNA, 22 nt, Human
gagagcuguccggcugagcagc

SEQ ID NO: 914051 - RNA, 22 nt, Human
guacagugccagacuucuaggu

SEQ ID NO: 914052 - RNA, 22 nt, Human
aagguauagcuugcauacagaa

SEQ ID NO: 914053 - RNA, 22 nt, Human
uggcccugucccuggagccugg

SEQ ID NO: 914054 - RNA, 22 nt, Human
cuccccagcauucugacuuccu

SEQ ID NO: 914055 - RNA, 22 nt, Human
cuggcugguuggggagaagaca

SEQ ID NO: 914056 - RNA, 22 nt, Human
aagggugaagggugguggccua

SEQ ID NO: 914057 - RNA, 22 nt, Human
ugucuucacucaagucucuugg

SEQ ID NO: 914058 - RNA, 22 nt, Human
aaaaagguugauccagauuagg

SEQ ID NO: 914059 - RNA, 22 nt, Human
cggcagagacggcgcuuugaac

SEQ ID NO: 914060 - RNA, 22 nt, Human
ggugcugagagccuaggagggc

SEQ ID NO: 914061 - RNA, 22 nt, Human
uuccuaacaagggguauucauc

SEQ ID NO: 914062 - RNA, 22 nt, Human
uaguuacaauggguucugugac

SEQ ID NO: 914063 - RNA, 22 nt, Human
auuuacagaaacuuaaucauag

SEQ ID NO: 914064 - RNA, 22 nt, Human
aggaggaauugacacagaagcc

SEQ ID NO: 914065 - RNA, 22 nt, Human
auauaacauacauacagaaaag

SEQ ID NO: 914066 - RNA, 22 nt, Human
aaauguguuucuuugugaaugg

SEQ ID NO: 914067 - RNA, 22 nt, Human
gggcuggugaggcugcccugca

SEQ ID NO: 914068 - RNA, 22 nt, Human
auuguugaucuucugguaagcc

SEQ ID NO: 914069 - RNA, 22 nt, Human
aacaguaauuugcgguuuuugc

SEQ ID NO: 914070 - RNA, 22 nt, Human
gcuguggaaaugccuaacauga

SEQ ID NO: 914071 - RNA, 22 nt, Human
auggacagguacugcagugggu

SEQ ID NO: 914072 - RNA, 22 nt, Human
aaguccuaaacacacacaaggc

SEQ ID NO: 914073 - RNA, 23 nt, Human
aaaguucucuugcgugugggaaa

SEQ ID NO: 914074 - RNA, 22 nt, Human
aguuugacaaaguaaaaugaca

SEQ ID NO: 914075 - RNA, 22 nt, Human
ccauggagcaccucacagaggc

SEQ ID NO: 914076 - RNA, 22 nt, Human
caguaaacacuagcauucuugg

SEQ ID NO: 914077 - RNA, 22 nt, Human
gaggccugguuuccagcauccu

SEQ ID NO: 914078 - RNA, 22 nt, Human
uuaacuggggaagcauuucaug

SEQ ID NO: 914079 - RNA, 18 nt, Human
ugguuugucaugagaauu

SEQ ID NO: 914080 - RNA, 21 nt, Human
gagagggcauuauaggaagug

SEQ ID NO: 914081 - RNA, 22 nt, Human
guccaggccugccucugaggag

SEQ ID NO: 914082 - RNA, 23 nt, Human
agacaucaggaugguggcuggga

SEQ ID NO: 914083 - RNA, 22 nt, Human
cacugaaaauuagcuuuccuga

SEQ ID NO: 914084 - RNA, 22 nt, Human
agaagaaaugaggccguucugc

SEQ ID NO: 914085 - RNA, 22 nt, Human
cucacaguguaauauugaaccc

SEQ ID NO: 914086 - RNA, 22 nt, Human
ccacugaaggucaacauagagc

SEQ ID NO: 914087 - RNA, 22 nt, Human
ucagaggcuugaagcccaagcc

SEQ ID NO: 914088 - RNA, 22 nt, Human
aacaucuaguuccuauauaaua

SEQ ID NO: 914089 - RNA, 18 nt, Human
uguuaaaugaagauuugc

SEQ ID NO: 914090 - RNA, 22 nt, Human
gcucugguggugaucagacgcu

SEQ ID NO: 914091 - RNA, 22 nt, Human
uguugaaucagaaguccuggcu

SEQ ID NO: 914092 - RNA, 22 nt, Human
uuuaauauccaguggauacaaa

SEQ ID NO: 914093 - RNA, 22 nt, Human
caugcaaaauguauuuuauuag

SEQ ID NO: 914094 - RNA, 19 nt, Human
ucaggaguuaguugugcuc

SEQ ID NO: 914095 - RNA, 18 nt, Human
cugugcagcaaacugagc

SEQ ID NO: 914096 - RNA, 21 nt, Human
ugccagcauguaggcuaguug

SEQ ID NO: 914097 - RNA, 22 nt, Human
ucauuucagccauuuuuaaaug

SEQ ID NO: 914098 - RNA, 22 nt, Human
aaaguguagagugccucaaaau

SEQ ID NO: 914099 - RNA, 22 nt, Human
auauucuugaaagauccuggua

SEQ ID NO: 914100 - RNA, 17 nt, Human
uaguggcaggaaaugaa

SEQ ID NO: 914101 - RNA, 22 nt, Human
aaggcccuuuagcagaggaggg

SEQ ID NO: 914102 - RNA, 22 nt, Human
acaauuccacauggcaugcagg

SEQ ID NO: 914103 - RNA, 22 nt, Human
uucuuuauguuaaugaaucuau

SEQ ID NO: 914104 - RNA, 22 nt, Human
agaaguuuccagucuaguaagg

SEQ ID NO: 914105 - RNA, 22 nt, Human
uacuccaggacuccauuugaaa

SEQ ID NO: 914106 - RNA, 22 nt, Human
gaggcuguuagggccugaggua

SEQ ID NO: 914107 - RNA, 22 nt, Human
cauagauucuuauuuccaucuu

SEQ ID NO: 914108 - RNA, 22 nt, Human
uugugcugagcuucuagcugug

SEQ ID NO: 914109 - RNA, 22 nt, Human
uugagguaguacuuauuauugg

SEQ ID NO: 914110 - RNA, 17 nt, Human
uuuuguucaucuucaaa

SEQ ID NO: 914111 - RNA, 22 nt, Human
uagaaacccauguuuauucagu

SEQ ID NO: 914112 - RNA, 20 nt, Human
agagcugggaagcucccuau

SEQ ID NO: 914113 - RNA, 21 nt, Human
auaucacaaacauauggucug

SEQ ID NO: 914114 - RNA, 22 nt, Human
guguagcauauagcaagagcau

SEQ ID NO: 914115 - RNA, 22 nt, Human
aaauggcaggcucuuugcuagu

SEQ ID NO: 914116 - RNA, 22 nt, Human
gugagaauaccagcagugagaa

SEQ ID NO: 914117 - RNA, 22 nt, Human
aaucacaaauuuagacagagcu

SEQ ID NO: 914118 - RNA, 22 nt, Human
uugagaaauacuuuuguagccu

SEQ ID NO: 914119 - RNA, 22 nt, Human
acaaggcgugacggagagagga

SEQ ID NO: 914120 - RNA, 19 nt, Human
agguccuuggcuggaaguu

SEQ ID NO: 914121 - RNA, 22 nt, Human
ucugcagacuugauaaccacug

SEQ ID NO: 914122 - RNA, 22 nt, Human
cuaaaugucagaguagcuugca

SEQ ID NO: 914123 - RNA, 18 nt, Human
gcuccuggagucugacuc

SEQ ID NO: 914124 - RNA, 22 nt, Human
agcuccagagccacauccauca

SEQ ID NO: 914125 - RNA, 22 nt, Human
uugcucauuccgugagaagauc

SEQ ID NO: 914126 - RNA, 22 nt, Human
acauuucagauucaugaaguga

SEQ ID NO: 914127 - RNA, 22 nt, Human
uucuaguuuugccuuaucaaca

SEQ ID NO: 914128 - RNA, 23 nt, Human
acagacauuccauaauguacacc

SEQ ID NO: 914129 - RNA, 22 nt, Human
acuaaaguucacggucagcuuu

SEQ ID NO: 914130 - RNA, 22 nt, Human
acuccgggagccaggagaggcu

SEQ ID NO: 914131 - RNA, 22 nt, Human
uacauagaggguaauagcauca

SEQ ID NO: 914132 - RNA, 22 nt, Human
ucauuuauauuguauucuguag

SEQ ID NO: 914133 - RNA, 23 nt, Human
aaagagacugauacggaaguucc

SEQ ID NO: 914134 - RNA, 22 nt, Human
ccacugagugagcagagcaggg

SEQ ID NO: 914135 - RNA, 22 nt, Human
ucaggauaccucaguuuuagcu

SEQ ID NO: 914136 - RNA, 22 nt, Human
caguugaaaagauuuuauucug

SEQ ID NO: 914137 - RNA, 22 nt, Human
cuggaaaguagauguacuaagg

SEQ ID NO: 914138 - RNA, 23 nt, Human
ugacagcaggaacugauuaugua

SEQ ID NO: 914139 - RNA, 22 nt, Human
aauggcucugauguuguuguga

SEQ ID NO: 914140 - RNA, 21 nt, Human
ucacugaagccuaagauguuu

SEQ ID NO: 914141 - RNA, 22 nt, Human
agugacuuuaguugaaucuugu

SEQ ID NO: 914142 - RNA, 22 nt, Human
uuagaacauagcaacagaauua

SEQ ID NO: 914143 - RNA, 20 nt, Human
caaggcagaccagagugagu

SEQ ID NO: 914144 - RNA, 21 nt, Human
cuuaagauggcauaguacgaa

SEQ ID NO: 914145 - RNA, 22 nt, Human
aaaguuuguugcuuacaaagaa

SEQ ID NO: 914146 - RNA, 22 nt, Human
uacugugcagcugugcuuuggg

SEQ ID NO: 914147 - RNA, 22 nt, Human
caucuuuguucuguaaacuuuu

SEQ ID NO: 914148 - RNA, 22 nt, Human
uuauguaccugaauuaguaaag

SEQ ID NO: 914149 - RNA, 22 nt, Human
aaagcuauagggucaagcauuu

SEQ ID NO: 914150 - RNA, 22 nt, Human
ccugguccccaucggcccagcg

SEQ ID NO: 914151 - RNA, 22 nt, Human
gguggcccuaaccgcagccucc

SEQ ID NO: 914152 - RNA, 22 nt, Human
cucuucauguguuuaauuuuua

SEQ ID NO: 914153 - RNA, 22 nt, Human
gcagugugcauggcuuuuggcc

SEQ ID NO: 914154 - RNA, 22 nt, Human
gcaggaguguggugggacaucc

SEQ ID NO: 914155 - RNA, 22 nt, Human
uuauacagcauugcuagugaug

SEQ ID NO: 914156 - RNA, 22 nt, Human
uccagagaauucuacgcagugc

SEQ ID NO: 914157 - RNA, 22 nt, Human
uccaucuguuuacuauaaagau

SEQ ID NO: 914158 - RNA, 22 nt, Human
ucuuucaauccauucauauguc

SEQ ID NO: 914159 - RNA, 22 nt, Human
ggccagcccagugguccucucu

SEQ ID NO: 914160 - RNA, 22 nt, Human
uagcacaaagagucuuucagag

SEQ ID NO: 914161 - RNA, 22 nt, Human
ucuguaggguaguaguggagau

SEQ ID NO: 914162 - RNA, 22 nt, Human
aaaguccuguuaacuguuaaca

SEQ ID NO: 914163 - RNA, 22 nt, Human
ugggccacauuccaaaccagcu

SEQ ID NO: 914164 - RNA, 22 nt, Human
gacauuuagaagucuaauggcc

SEQ ID NO: 914165 - RNA, 22 nt, Human
uagcaagaaguagcucuggauu

SEQ ID NO: 914166 - RNA, 22 nt, Human
uugaagaaguaauuuuaagucu

SEQ ID NO: 914167 - RNA, 22 nt, Human
uguaacaaaauaccuuggauug

SEQ ID NO: 914168 - RNA, 22 nt, Human
cauucucuacacuccugcccug

SEQ ID NO: 914169 - RNA, 22 nt, Human
ugaaaucugcaugcaaaguccu

SEQ ID NO: 914170 - RNA, 22 nt, Human
cagggccugagggcugcucugc

SEQ ID NO: 914171 - RNA, 22 nt, Human
caggcaagauccagaggcugcu

SEQ ID NO: 914172 - RNA, 22 nt, Human
cuuugcaaaaguuaauuguuga

SEQ ID NO: 914173 - RNA, 22 nt, Human
acaucgagucugaguugcuaug

SEQ ID NO: 914174 - RNA, 22 nt, Human
aguggcuagaucaugagugagc

SEQ ID NO: 914175 - RNA, 22 nt, Human
aggcuucauuguggcaucagga

SEQ ID NO: 914176 - RNA, 22 nt, Human
caucaaauuaugugucaaagca

SEQ ID NO: 914177 - RNA, 22 nt, Human
caaguauauuugaacauguaaa

SEQ ID NO: 914178 - RNA, 22 nt, Human
gaaauacagaaagggcugaaug

SEQ ID NO: 914179 - RNA, 22 nt, Human
uccaggagugugugcuaauggg

SEQ ID NO: 914180 - RNA, 22 nt, Human
ucagggcauucaagaggccugg

SEQ ID NO: 914181 - RNA, 22 nt, Human
auuucacaucuaucucagauuu

SEQ ID NO: 914182 - RNA, 18 nt, Human
ucugucucuguccuugcu

SEQ ID NO: 914183 - RNA, 22 nt, Human
cacauugauucaguccugugug

SEQ ID NO: 914184 - RNA, 20 nt, Human
aagcaauauagugcaaaugu

SEQ ID NO: 914185 - RNA, 22 nt, Human
ggguggcaggauuggcaggagu

SEQ ID NO: 914186 - RNA, 22 nt, Human
uguucccauuuucugcauaauc

SEQ ID NO: 914187 - RNA, 22 nt, Human
cuuccugggucuggagacugga

SEQ ID NO: 914188 - RNA, 22 nt, Human
augagcucauccgagucacacu

SEQ ID NO: 914189 - RNA, 22 nt, Human
uauuugaauccugguucuucag

SEQ ID NO: 914190 - RNA, 22 nt, Human
gucauaaucacaguuuuaugca

SEQ ID NO: 914191 - RNA, 22 nt, Human
gaagauaccucaauucuuugaa

SEQ ID NO: 914192 - RNA, 22 nt, Human
cagcauacugcaucaaaugagg

SEQ ID NO: 914193 - RNA, 22 nt, Human
guugucuuagucagaaauaugc

SEQ ID NO: 914194 - RNA, 22 nt, Human
agacauuuggaagauacacaua

SEQ ID NO: 914195 - RNA, 22 nt, Human
cuuuggcugacagguuucuggu

SEQ ID NO: 914196 - RNA, 22 nt, Human
uccuggcuggaauuucucacuc

SEQ ID NO: 914197 - RNA, 22 nt, Human
ugucuuauuccuucuguucagc

SEQ ID NO: 914198 - RNA, 22 nt, Human
gugcaugucuuuggaggccucc

SEQ ID NO: 914199 - RNA, 22 nt, Human
agacacuggugaagaaaucagg

SEQ ID NO: 914200 - RNA, 22 nt, Human
cacccaggcuggagugcagggg

SEQ ID NO: 914201 - RNA, 22 nt, Human
uucuuacacucuuaaaaaucau

SEQ ID NO: 914202 - RNA, 22 nt, Human
aacauaagggagcuucaaaacu

SEQ ID NO: 914203 - RNA, 20 nt, Human
agccaggguucuggaugcac

SEQ ID NO: 914204 - RNA, 22 nt, Human
auguagaagcugacagugcugu

SEQ ID NO: 914205 - RNA, 22 nt, Human
uacagaaguaaauaccaaaagc

SEQ ID NO: 914206 - RNA, 22 nt, Human
gucaaaacaaaguuaagaauuc

SEQ ID NO: 914207 - RNA, 22 nt, Human
ucuccugggaggacaaggaagg

SEQ ID NO: 914208 - RNA, 22 nt, Human
ucuccuuuaagauuuccucagg

SEQ ID NO: 914209 - RNA, 22 nt, Human
acaaaugugauuguuucugaaa

SEQ ID NO: 914210 - RNA, 22 nt, Human
uuuuaugcaaguuaugauuaaa

SEQ ID NO: 914211 - RNA, 22 nt, Human
ucugucaucaaauaugcuuucu

SEQ ID NO: 914212 - RNA, 22 nt, Human
agcugccuggagucauuuccug

SEQ ID NO: 914213 - RNA, 22 nt, Human
cuuuuuuccuaaggcaacauga

SEQ ID NO: 914214 - RNA, 22 nt, Human
ggcuccagcuaaugguuucuau

SEQ ID NO: 914215 - RNA, 22 nt, Human
gcuggccucgcaggcaggaugu

SEQ ID NO: 914216 - RNA, 22 nt, Human
acaugcauacguguguuuaaaa

SEQ ID NO: 914217 - RNA, 22 nt, Human
gcucaggggaaugggcugccgu

SEQ ID NO: 914218 - RNA, 22 nt, Human
gagaaggaggcgaagcgugugc

SEQ ID NO: 914219 - RNA, 22 nt, Human
uagaaacuacuagaauaagaga

SEQ ID NO: 914220 - RNA, 22 nt, Human
ggaagaaagacauuuauuuuga

SEQ ID NO: 914221 - RNA, 22 nt, Human
caaagcuauaaauucagacaga

SEQ ID NO: 914222 - RNA, 22 nt, Human
cagcaucucccaggcauuugcc

SEQ ID NO: 914223 - RNA, 22 nt, Human
cacuuuauaaaauuggugugag

SEQ ID NO: 914224 - RNA, 20 nt, Human
agggccugcucugugguguc

SEQ ID NO: 914225 - RNA, 22 nt, Human
gcuccagggaacagaauguacu

SEQ ID NO: 914226 - RNA, 22 nt, Human
agaugcugauugaauagauuuc

SEQ ID NO: 914227 - RNA, 22 nt, Human
aacuccagguccuuugaaucug

SEQ ID NO: 914228 - RNA, 22 nt, Human
auguuuguugaacaucuacugc

SEQ ID NO: 914229 - RNA, 22 nt, Human
ucugacagcuccaggcagcaau

SEQ ID NO: 914230 - RNA, 22 nt, Human
ucuauaaaugcagauaugugug

SEQ ID NO: 914231 - RNA, 22 nt, Human
cuuuucagagcugagaucaccg

SEQ ID NO: 914232 - RNA, 22 nt, Human
cagcucaggaaggaaggccggc

SEQ ID NO: 914233 - RNA, 22 nt, Human
aucagaaauagucauguuacuu

SEQ ID NO: 914234 - RNA, 22 nt, Human
guacuaaaaaaugaucaguuug

SEQ ID NO: 914235 - RNA, 22 nt, Human
gcacagaaccagacaugaggca

SEQ ID NO: 914236 - RNA, 22 nt, Human
cucaggauucucgacacucaca

SEQ ID NO: 914237 - RNA, 22 nt, Human
agcaaacacaagagguaauuuc

SEQ ID NO: 914238 - RNA, 22 nt, Human
ggcaccagggcaagggucuuuc

SEQ ID NO: 914239 - RNA, 22 nt, Human
aggcugagucaaguuaggguga

SEQ ID NO: 914240 - RNA, 22 nt, Human
ucuaggggugcagaagggaucc

SEQ ID NO: 914241 - RNA, 22 nt, Human
uuggaauuuaguaaaauaaugc

SEQ ID NO: 914242 - RNA, 22 nt, Human
aaugaagacacaucuuucucau

SEQ ID NO: 914243 - RNA, 22 nt, Human
aaucugagggaacuugaacucc

SEQ ID NO: 914244 - RNA, 22 nt, Human
ucaaaggcauugccaauaagua

SEQ ID NO: 914245 - RNA, 22 nt, Human
agaagccauucccuguaggcuc

SEQ ID NO: 914246 - RNA, 22 nt, Human
uccaaggacgcuggaccccugc

SEQ ID NO: 914247 - RNA, 20 nt, Human
uggcuagcauuaaaaugacu

SEQ ID NO: 914248 - RNA, 22 nt, Human
guuuuccuguugaguaguauuc

SEQ ID NO: 914249 - RNA, 22 nt, Human
ggaagaggcucucauugagggc

SEQ ID NO: 914250 - RNA, 16 nt, Human
gaagaaggaaaacuac

SEQ ID NO: 914251 - RNA, 22 nt, Human
gaggcagagaccuucaggaccu

SEQ ID NO: 914252 - RNA, 18 nt, Human
cuucaguggcugcucugc

SEQ ID NO: 914253 - RNA, 22 nt, Human
gcuucuguucaaggauauaagg

SEQ ID NO: 914254 - RNA, 22 nt, Human
aaagaaucuauauaucaccacc

SEQ ID NO: 914255 - RNA, 22 nt, Human
auuccaaagguuaaugcccauu

SEQ ID NO: 914256 - RNA, 22 nt, Human
ucuagaauguuccaccuuguuu

SEQ ID NO: 914257 - RNA, 22 nt, Human
uccccaggggccugggcacagu

SEQ ID NO: 914258 - RNA, 22 nt, Human
uuccagggcuagguaaugggua

SEQ ID NO: 914259 - RNA, 22 nt, Human
cuacauuuugugauuaugaaau

SEQ ID NO: 914260 - RNA, 22 nt, Human
cagguucuuguuucaaacagac

SEQ ID NO: 914261 - RNA, 22 nt, Human
gcccugcagugcggagguggca

SEQ ID NO: 914262 - RNA, 22 nt, Human
agggugggcuagacucuucccc

SEQ ID NO: 914263 - RNA, 21 nt, Human
agaccagugggauaaauaggu

SEQ ID NO: 914264 - RNA, 22 nt, Human
auaaguaggaaaauuugaauau

SEQ ID NO: 914265 - RNA, 22 nt, Human
ugcagcuccucuggcugccuga

SEQ ID NO: 914266 - RNA, 22 nt, Human
guacagaaugcuugguaaggca

SEQ ID NO: 914267 - RNA, 22 nt, Human
ucugggaugagaucagagacac

SEQ ID NO: 914268 - RNA, 22 nt, Human
ggugucuggacagugagccagg

SEQ ID NO: 914269 - RNA, 22 nt, Human
ccaggaggaugguuguuaggug

SEQ ID NO: 914270 - RNA, 22 nt, Human
acaguacaaaacccaccagagg

SEQ ID NO: 914271 - RNA, 20 nt, Human
ugcugaagaaucacagaugg

SEQ ID NO: 914272 - RNA, 22 nt, Human
aaaguuuuguugauuguggaau

SEQ ID NO: 914273 - RNA, 22 nt, Human
aacuagaacgucuaguugcugg

SEQ ID NO: 914274 - RNA, 22 nt, Human
uuuguuucgcagccucucucug

SEQ ID NO: 914275 - RNA, 22 nt, Human
ucaucuuccucauuucuccagg

SEQ ID NO: 914276 - RNA, 20 nt, Human
aggcacuggggauagguaag

SEQ ID NO: 914277 - RNA, 22 nt, Human
caccaggcacagcucuccugcu

SEQ ID NO: 914278 - RNA, 22 nt, Human
ucaccaggcuggaaugcagugg

SEQ ID NO: 914279 - RNA, 22 nt, Human
cagagaagagucuggccucucu

SEQ ID NO: 914280 - RNA, 22 nt, Human
ucaaagauagauguugagaaau

SEQ ID NO: 914281 - RNA, 22 nt, Human
ccaaggcaacguuggugucagg

SEQ ID NO: 914282 - RNA, 22 nt, Human
ucuggaagaacggggcaugcug

SEQ ID NO: 914283 - RNA, 22 nt, Human
aagggcugagcacagugagcca

SEQ ID NO: 914284 - RNA, 22 nt, Human
ugcuguggauucagagaugaaa

SEQ ID NO: 914285 - RNA, 22 nt, Human
ggguggagcuuggacaccagua

SEQ ID NO: 914286 - RNA, 22 nt, Human
aggaagcucucugcuuuuaaga

SEQ ID NO: 914287 - RNA, 22 nt, Human
uuuagcaucgaaguaaauuuag

SEQ ID NO: 914288 - RNA, 21 nt, Human
acagcuggugcagggcgggga

SEQ ID NO: 914289 - RNA, 22 nt, Human
uagggcugcugcagaugacagg

SEQ ID NO: 914290 - RNA, 22 nt, Human
uucuggcaugagagaugggggu

SEQ ID NO: 914291 - RNA, 19 nt, Human
ggccagcugucuccugcua

SEQ ID NO: 914292 - RNA, 22 nt, Human
caacaguucucauagcagauuc

SEQ ID NO: 914293 - RNA, 21 nt, Human
ugagcaggugcagggaagugg

SEQ ID NO: 914294 - RNA, 22 nt, Human
ccaugggaauugggagguccca

SEQ ID NO: 914295 - RNA, 18 nt, Human
gcacucugacugcagagc

SEQ ID NO: 914296 - RNA, 22 nt, Human
gccuggcugcuuagccuacuuc

SEQ ID NO: 914297 - RNA, 19 nt, Human
agagaccacagagcugccu

SEQ ID NO: 914298 - RNA, 22 nt, Human
cagcugagaguagaaauggagg

SEQ ID NO: 914299 - RNA, 22 nt, Human
cagaagaggacuggguagcuca

SEQ ID NO: 914300 - RNA, 22 nt, Human
ugcagugguguccagguguacu

SEQ ID NO: 914301 - RNA, 21 nt, Human
uggcucaguugcugggcacag

SEQ ID NO: 914302 - RNA, 22 nt, Human
agaguggcagcaaaaagugugc

SEQ ID NO: 914303 - RNA, 22 nt, Human
uucagugcuuacagguuucuuu

SEQ ID NO: 914304 - RNA, 23 nt, Human
uggcugagauccuacuguuugcu

SEQ ID NO: 914305 - RNA, 22 nt, Human
auuagcaauugugcaucuagua

SEQ ID NO: 914306 - RNA, 22 nt, Human
auuucauggacaucuuuggagg

SEQ ID NO: 914307 - RNA, 22 nt, Human
aauuaguucaauggaugauaga

SEQ ID NO: 914308 - RNA, 22 nt, Human
gugggcugcccuugaggucagc

SEQ ID NO: 914309 - RNA, 22 nt, Human
agccuggaggaggaguugagca

SEQ ID NO: 914310 - RNA, 22 nt, Human
auuuuaucugcuuacuuucagg

SEQ ID NO: 914311 - RNA, 22 nt, Human
ugggaggaagugcuaaugggag

SEQ ID NO: 914312 - RNA, 22 nt, Human
ggccacuguuuccugggcaguu

SEQ ID NO: 914313 - RNA, 20 nt, Human
ggggcaguggcucaugccug

SEQ ID NO: 914314 - RNA, 22 nt, Human
gugcucuaugaggauauagggu

SEQ ID NO: 914315 - RNA, 22 nt, Human
gucuacaaagcuucaagucucu

SEQ ID NO: 914316 - RNA, 22 nt, Human
gcaaacaaggacauacauccug

SEQ ID NO: 914317 - RNA, 22 nt, Human
ucugaaauggcagcgggaauga

SEQ ID NO: 914318 - RNA, 22 nt, Human
cauccaaagcaaauaucuuaaa

SEQ ID NO: 914319 - RNA, 22 nt, Human
aacaacaacggagaaaggguug

SEQ ID NO: 914320 - RNA, 22 nt, Human
ugcuauaaguagacauucaaca

SEQ ID NO: 914321 - RNA, 16 nt, Human
acagacaugagugagc

SEQ ID NO: 914322 - RNA, 22 nt, Human
gcuccagggucagcucagaacu

SEQ ID NO: 914323 - RNA, 22 nt, Human
uaccauuucuacauaucuuguc

SEQ ID NO: 914324 - RNA, 22 nt, Human
agucauuucuguagucauguuu

SEQ ID NO: 914325 - RNA, 22 nt, Human
gccaggaauuucaagagccacu

SEQ ID NO: 914326 - RNA, 22 nt, Human
auuaucuauguagaaugauuuu

SEQ ID NO: 914327 - RNA, 22 nt, Human
gcgcucaggugccaggccugcg

SEQ ID NO: 914328 - RNA, 22 nt, Human
gaggcucacgacgggacgaacu

SEQ ID NO: 914329 - RNA, 22 nt, Human
auacagauauaagauugaggag

SEQ ID NO: 914330 - RNA, 22 nt, Human
cacagagaaugaugagucacug

SEQ ID NO: 914331 - RNA, 22 nt, Human
aaugggaaagagacuagaugcu

SEQ ID NO: 914332 - RNA, 21 nt, Human
agacagacugccugacccacg

SEQ ID NO: 914333 - RNA, 22 nt, Human
cuucuuaaauuggauugcuauu

SEQ ID NO: 914334 - RNA, 22 nt, Human
cagcacaucugauuauaugacu

SEQ ID NO: 914335 - RNA, 20 nt, Human
ggccagcuggaggcgccggg

SEQ ID NO: 914336 - RNA, 22 nt, Human
acugggcuguggacacccagcg

SEQ ID NO: 914337 - RNA, 22 nt, Human
aaguuucuauuauuacauucgu

SEQ ID NO: 914338 - RNA, 22 nt, Human
gaggucaucaccaauauaugcc

SEQ ID NO: 914339 - RNA, 22 nt, Human
uccauccauguaggaagauggu

SEQ ID NO: 914340 - RNA, 21 nt, Human
ucuugugugcugcccugcuac

SEQ ID NO: 914341 - RNA, 22 nt, Human
guuccuaagcacugugcauucu

SEQ ID NO: 914342 - RNA, 22 nt, Human
auucuaaaucagagagcucugu

SEQ ID NO: 914343 - RNA, 22 nt, Human
cugggagaucuguugggacugg

SEQ ID NO: 914344 - RNA, 22 nt, Human
auuuugcacacuaugcagcuuu

SEQ ID NO: 914345 - RNA, 22 nt, Human
gcccagugcugagggugcugcu

SEQ ID NO: 914346 - RNA, 22 nt, Human
aagggcuguaagccaaguaaag

SEQ ID NO: 914347 - RNA, 22 nt, Human
ccagcugcaggggagcagugga

SEQ ID NO: 914348 - RNA, 22 nt, Human
gccacagacagagagucuagug

SEQ ID NO: 914349 - RNA, 22 nt, Human
caggaggugacuuccagggguu

SEQ ID NO: 914350 - RNA, 22 nt, Human
cuguuauuuagaacauggaauc

SEQ ID NO: 914351 - RNA, 21 nt, Human
gacuucaugggucaaccaauu

SEQ ID NO: 914352 - RNA, 22 nt, Human
ucugagcuuacucagggauaca

SEQ ID NO: 914353 - RNA, 22 nt, Human
ugccuaaaccauuccccuuccu

SEQ ID NO: 914354 - RNA, 22 nt, Human
uuauuuccugacacagcugauu

SEQ ID NO: 914355 - RNA, 20 nt, Human
uuuauagugaucaauuuaua

SEQ ID NO: 914356 - RNA, 22 nt, Human
agaugaaagauuuuuauagaga

SEQ ID NO: 914357 - RNA, 22 nt, Human
aggcaguuucugggacagcaua

SEQ ID NO: 914358 - RNA, 22 nt, Human
cucugcuuucucaaacccugug

SEQ ID NO: 914359 - RNA, 22 nt, Human
gaggacgggcuucauggggccu

SEQ ID NO: 914360 - RNA, 22 nt, Human
acaguucugccuguuugagaag

SEQ ID NO: 914361 - RNA, 22 nt, Human
caugaaauuugaaguacagcaa

SEQ ID NO: 914362 - RNA, 23 nt, Human
ugcaauggcaugauuucagcuca

SEQ ID NO: 914363 - RNA, 22 nt, Human
uucauuccuucccuaagcaacu

SEQ ID NO: 914364 - RNA, 22 nt, Human
agguacagggugaaaguuuaug

SEQ ID NO: 914365 - RNA, 22 nt, Human
gcugccguuggcucuucaggcc

SEQ ID NO: 914366 - RNA, 21 nt, Human
ugugucacuaacuagaggcua

SEQ ID NO: 914367 - RNA, 22 nt, Human
cacuuuguuuauugugcaguua

SEQ ID NO: 914368 - RNA, 22 nt, Human
cacuggcaugugaggcgguggc

SEQ ID NO: 914369 - RNA, 22 nt, Human
acagaugaauuuauggauggaa

SEQ ID NO: 914370 - RNA, 22 nt, Human
ucugagcagcuuuguuuugugu

SEQ ID NO: 914371 - RNA, 22 nt, Human
ucuggcccaugauccugcuaac

SEQ ID NO: 914372 - RNA, 22 nt, Human
uauuuaaaauaagccccagugg

SEQ ID NO: 914373 - RNA, 22 nt, Human
ggcucuggggggaagucuguug

SEQ ID NO: 914374 - RNA, 22 nt, Human
aggacuggcagugugagggguc

SEQ ID NO: 914375 - RNA, 22 nt, Human
ccuuuucuacaagcaaaugugc

SEQ ID NO: 914376 - RNA, 20 nt, Human
ucuaauuaaaauugucuagu

SEQ ID NO: 914377 - RNA, 23 nt, Human
ucuggaggggacacugcagaugc

SEQ ID NO: 914378 - RNA, 22 nt, Human
caugugugaaucuugugaucau

SEQ ID NO: 914379 - RNA, 22 nt, Human
ucaacauauaggcaaccuguaa

SEQ ID NO: 914380 - RNA, 22 nt, Human
aaucucaagcuguaaauaccuc

SEQ ID NO: 914381 - RNA, 21 nt, Human
agauuaaaaucugugagaagg

SEQ ID NO: 914382 - RNA, 22 nt, Human
aguauauaguggcgcuguaugc

SEQ ID NO: 914383 - RNA, 22 nt, Human
uuggcagcggggacccuggcug

SEQ ID NO: 914384 - RNA, 20 nt, Human
gccacaguuuucucacugca

SEQ ID NO: 914385 - RNA, 22 nt, Human
gcagcacugucuugucuuagga

SEQ ID NO: 914386 - RNA, 22 nt, Human
uguacaaugccagggaacacca

SEQ ID NO: 914387 - RNA, 22 nt, Human
cauuuuguagcaaugacuguug

SEQ ID NO: 914388 - RNA, 22 nt, Human
ucuaaagauuuggauucauuug

SEQ ID NO: 914389 - RNA, 21 nt, Human
aucccagcacccaggagugca

SEQ ID NO: 914390 - RNA, 22 nt, Human
caguccugggcaggucaggcca

SEQ ID NO: 914391 - RNA, 22 nt, Human
agcuggccauugugaguggccu

SEQ ID NO: 914392 - RNA, 22 nt, Human
uuagauauguuuuugcuaaugc

SEQ ID NO: 914393 - RNA, 22 nt, Human
uaagaauauugggaauggaugg

SEQ ID NO: 914394 - RNA, 22 nt, Human
gccugggagcacaucggggucc

SEQ ID NO: 914395 - RNA, 22 nt, Human
aguguggcugcguagggcucuc

SEQ ID NO: 914396 - RNA, 22 nt, Human
cucuuugaaauccaucacugcu

SEQ ID NO: 914397 - RNA, 22 nt, Human
aaauacaauuucaggcuguaau

SEQ ID NO: 914398 - RNA, 22 nt, Human
cuuuucuuacucccgcaaggca

SEQ ID NO: 914399 - RNA, 22 nt, Human
agucacaggcaagagggcucca

SEQ ID NO: 914400 - RNA, 22 nt, Human
ggccaggugcgguggcucacac

SEQ ID NO: 914401 - RNA, 22 nt, Human
ggcauguuguuuauguuucugg

SEQ ID NO: 914402 - RNA, 22 nt, Human
acagcugcucaccugugagccc

SEQ ID NO: 914403 - RNA, 22 nt, Human
cugcaugucacucugcuguccc

SEQ ID NO: 914404 - RNA, 22 nt, Human
uugaagcaggaaaauuucuauu

SEQ ID NO: 914405 - RNA, 22 nt, Human
uauuguaucuuaccacauguau

SEQ ID NO: 914406 - RNA, 22 nt, Human
aagagcaucuauuucacagugg

SEQ ID NO: 914407 - RNA, 22 nt, Human
gaugacagcagcuguggcucac

SEQ ID NO: 914408 - RNA, 21 nt, Human
gggcuggaggaugggaagccc

SEQ ID NO: 914409 - RNA, 22 nt, Human
auuucuguaacuuaugaaaguu

SEQ ID NO: 914410 - RNA, 22 nt, Human
cugcaguguucuggaaugcauu

SEQ ID NO: 914411 - RNA, 22 nt, Human
gacaggugcuaagggaccuggc

SEQ ID NO: 914412 - RNA, 22 nt, Human
cagguggguacaucacagagac

SEQ ID NO: 914413 - RNA, 20 nt, Human
aaguauauguccguguacuu

SEQ ID NO: 914414 - RNA, 22 nt, Human
auuuggugagguagccauuguu

SEQ ID NO: 914415 - RNA, 22 nt, Human
uacagagagagggguuaccagg

SEQ ID NO: 914416 - RNA, 22 nt, Human
cuuagaagugggcuauaauuag

SEQ ID NO: 914417 - RNA, 22 nt, Human
ucaguggauuguagaaggcuua

SEQ ID NO: 914418 - RNA, 22 nt, Human
guggaagggacugccuagagga

SEQ ID NO: 914419 - RNA, 20 nt, Human
aggcaagguagaugucugcu

SEQ ID NO: 914420 - RNA, 22 nt, Human
uucagaaauaaaauaucccaac

SEQ ID NO: 914421 - RNA, 22 nt, Human
auguauuuugccagacugucuc

SEQ ID NO: 914422 - RNA, 22 nt, Human
agaagccauucucaguuccuga

SEQ ID NO: 914423 - RNA, 22 nt, Human
uucugggacaucuggacaguuu

SEQ ID NO: 914424 - RNA, 22 nt, Human
uauuccugucaagaucuuacaa

SEQ ID NO: 914425 - RNA, 22 nt, Human
uuuacgaauggggugacaacuu

SEQ ID NO: 914426 - RNA, 22 nt, Human
gcucacagccggcuggcagggg

SEQ ID NO: 914427 - RNA, 22 nt, Human
uaaguuaacccuguuaauagau

SEQ ID NO: 914428 - RNA, 22 nt, Human
ggcaggcaucauguggucauua

SEQ ID NO: 914429 - RNA, 22 nt, Human
caggccaacugcauggugacca

SEQ ID NO: 914430 - RNA, 22 nt, Human
acugccuucugcucaggguuca

SEQ ID NO: 914431 - RNA, 22 nt, Human
acagauuuauugaagcugcugc

SEQ ID NO: 914432 - RNA, 22 nt, Human
gagaggugaaggcugcccuggg

SEQ ID NO: 914433 - RNA, 22 nt, Human
ucucugugucucauguuccuau

SEQ ID NO: 914434 - RNA, 22 nt, Human
ugagaagcugcuugugcuguau

SEQ ID NO: 914435 - RNA, 22 nt, Human
cccagcucucgcacuuacuagc

SEQ ID NO: 914436 - RNA, 22 nt, Human
caggucucggguucagcaguga

SEQ ID NO: 914437 - RNA, 22 nt, Human
gagagagaggugcugccaggca

SEQ ID NO: 914438 - RNA, 18 nt, Human
cucagggugaccaaugca

SEQ ID NO: 914439 - RNA, 22 nt, Human
uuuaucacagaauaagaaguca

SEQ ID NO: 914440 - RNA, 23 nt, Human
ugcaggggaggcuuaaagcaggu

SEQ ID NO: 914441 - RNA, 22 nt, Human
uuguguguacugguuaugggca

SEQ ID NO: 914442 - RNA, 22 nt, Human
ccaaaaauuagauacacauaua

SEQ ID NO: 914443 - RNA, 22 nt, Human
acacaguaguguggaaaaacau

SEQ ID NO: 914444 - RNA, 22 nt, Human
gucuucuggggccaggcccgcu

SEQ ID NO: 914445 - RNA, 22 nt, Human
aaggcugagagucacaguccua

SEQ ID NO: 914446 - RNA, 22 nt, Human
ggccuuagcggucauagcaaag

SEQ ID NO: 914447 - RNA, 22 nt, Human
aucauucuauuguugagcugcc

SEQ ID NO: 914448 - RNA, 22 nt, Human
ccuugaaagccaggcagaggaa

SEQ ID NO: 914449 - RNA, 21 nt, Human
gcucugucccugcuguguguc

SEQ ID NO: 914450 - RNA, 22 nt, Human
agcgugugugcgggucuucuuu

SEQ ID NO: 914451 - RNA, 22 nt, Human
caggcacacaggcucccugggc

SEQ ID NO: 914452 - RNA, 22 nt, Human
uggcuucuugaucuuggacuug

SEQ ID NO: 914453 - RNA, 22 nt, Human
cacagugcucaaacacaagugc

SEQ ID NO: 914454 - RNA, 22 nt, Human
ggccaaauuuggccaugagcau

SEQ ID NO: 914455 - RNA, 22 nt, Human
uggagcaggacggggaguggua

SEQ ID NO: 914456 - RNA, 21 nt, Human
gcuuuagauuuagugagccag

SEQ ID NO: 914457 - RNA, 22 nt, Human
augcacuacuuggcuuuacuga

SEQ ID NO: 914458 - RNA, 20 nt, Human
uauuaugaccuguguucugg

SEQ ID NO: 914459 - RNA, 22 nt, Human
ucuuuacaaucuaagcauaguu

SEQ ID NO: 914460 - RNA, 22 nt, Human
uuuacccauucagacucacuug

SEQ ID NO: 914461 - RNA, 22 nt, Human
cuugucuugcacacgguugcca

SEQ ID NO: 914462 - RNA, 22 nt, Human
uuguuuccuuucuauacaggau

SEQ ID NO: 914463 - RNA, 22 nt, Human
gcaucucuuacccacgagccag

SEQ ID NO: 914464 - RNA, 22 nt, Human
ccagacucaucugccauugcug

SEQ ID NO: 914465 - RNA, 22 nt, Human
gauacaguauuuaaagagcaac

SEQ ID NO: 914466 - RNA, 22 nt, Human
caggaagcuggucagauccugu

SEQ ID NO: 914467 - RNA, 22 nt, Human
agaaaucuuaucaagaaaugcc

SEQ ID NO: 914468 - RNA, 22 nt, Human
uagcccagcaugagcagagcug

SEQ ID NO: 914469 - RNA, 22 nt, Human
cugugggcgccugucagccuca

SEQ ID NO: 914470 - RNA, 23 nt, Human
ccuggggcacuugaguccucauc

SEQ ID NO: 914471 - RNA, 22 nt, Human
uggcaguuggggaugaagugag

SEQ ID NO: 914472 - RNA, 22 nt, Human
agagggcagucucagauuggga

SEQ ID NO: 914473 - RNA, 22 nt, Human
cuuggacuggacccgaggaaug

SEQ ID NO: 914474 - RNA, 22 nt, Human
aaggaaaugagguugauggaug

SEQ ID NO: 914475 - RNA, 22 nt, Human
acaguguucugaaaguugaggg

SEQ ID NO: 914476 - RNA, 22 nt, Human
uggaaacuuaucugacacgaac

SEQ ID NO: 914477 - RNA, 22 nt, Human
uucacauaaauagaucacauca

SEQ ID NO: 914478 - RNA, 22 nt, Human
aguaguuuuuaagagguauaaa

SEQ ID NO: 914479 - RNA, 18 nt, Human
gcaaggcagcucucuggg

SEQ ID NO: 914480 - RNA, 19 nt, Human
gauauaaagagauggugaa

SEQ ID NO: 914481 - RNA, 22 nt, Human
uuuacacaaaauguuaguagau

SEQ ID NO: 914482 - RNA, 22 nt, Human
agccuguguccucaucugcagc

SEQ ID NO: 914483 - RNA, 22 nt, Human
ugaggcaggaaguuauauaaug

SEQ ID NO: 914484 - RNA, 22 nt, Human
uucacauugaaggugcuuucuu

SEQ ID NO: 914485 - RNA, 22 nt, Human
uauguguaaucaaacacaugcu

SEQ ID NO: 914486 - RNA, 22 nt, Human
aaagauuuaagaauaauuugug

SEQ ID NO: 914487 - RNA, 22 nt, Human
aauggaauaccuagguggccca

SEQ ID NO: 914488 - RNA, 22 nt, Human
agaauagagaaaaagguuauuu

SEQ ID NO: 914489 - RNA, 22 nt, Human
gauauuuauuaagugguuggua

SEQ ID NO: 914490 - RNA, 19 nt, Human
cagaacagcugggaagaga

SEQ ID NO: 914491 - RNA, 22 nt, Human
ucuccacacuuucucucccagg

SEQ ID NO: 914492 - RNA, 22 nt, Human
caaagggaaacgcagugucaag

SEQ ID NO: 914493 - RNA, 22 nt, Human
gaaucuuaccucucuauuguug

SEQ ID NO: 914494 - RNA, 22 nt, Human
uuauuuauaucucugcaguuua

SEQ ID NO: 914495 - RNA, 17 nt, Human
cuguuuguucugggagc

SEQ ID NO: 914496 - RNA, 19 nt, Human
agaggccucagcagcuggc

SEQ ID NO: 914497 - RNA, 22 nt, Human
uccagggcauccacgcgugggg

SEQ ID NO: 914498 - RNA, 22 nt, Human
uggaccagcagccccagugccu

SEQ ID NO: 914499 - RNA, 22 nt, Human
aggcaucuaacagagaucuuua

SEQ ID NO: 914500 - RNA, 22 nt, Human
aggguagcuacccaacuccaga

SEQ ID NO: 914501 - RNA, 22 nt, Human
ucugcuguugccaugaguaaua

SEQ ID NO: 914502 - RNA, 22 nt, Human
gugcugaacuauaaaaagcuuu

SEQ ID NO: 914503 - RNA, 22 nt, Human
cacugagaaagugaccugccaa

SEQ ID NO: 914504 - RNA, 22 nt, Human
cugaggcaugaaugugggcuuu

SEQ ID NO: 914505 - RNA, 22 nt, Human
uucuccagaccacugccucugu

SEQ ID NO: 914506 - RNA, 22 nt, Human
uggcccugugugcaggcugcac

SEQ ID NO: 914507 - RNA, 22 nt, Human
gucaggagagaccuguucuccu

SEQ ID NO: 914508 - RNA, 22 nt, Human
ugcuguguucuccugacucacc

SEQ ID NO: 914509 - RNA, 22 nt, Human
uucaaguaugagaaaggggacu

SEQ ID NO: 914510 - RNA, 22 nt, Human
uccaucucaccugcacucugcg

SEQ ID NO: 914511 - RNA, 22 nt, Human
ucuuuugugauucuuuaguuac

SEQ ID NO: 914512 - RNA, 18 nt, Human
ccucagggagauccagug

SEQ ID NO: 914513 - RNA, 22 nt, Human
gggaggugauggcaagcagcgg

SEQ ID NO: 914514 - RNA, 22 nt, Human
uuuguucaauccagacaauagc

SEQ ID NO: 914515 - RNA, 20 nt, Human
gccugauggacauuucaguu

SEQ ID NO: 914516 - RNA, 22 nt, Human
gcuccuccaauauggacuccuc

SEQ ID NO: 914517 - RNA, 18 nt, Human
uccgaggcaccauaaaaa

SEQ ID NO: 914518 - RNA, 22 nt, Human
agaaaggagaccagcucugccc

SEQ ID NO: 914519 - RNA, 20 nt, Human
gugcauuucaccuguacugu

SEQ ID NO: 914520 - RNA, 18 nt, Human
uuuccuuguaugaacaua

SEQ ID NO: 914521 - RNA, 22 nt, Human
gagaaguuucuuccuagguuug

SEQ ID NO: 914522 - RNA, 22 nt, Human
agaaggcuaaagaaacagauug

SEQ ID NO: 914523 - RNA, 22 nt, Human
aucaaaguaucucaauauggua

SEQ ID NO: 914524 - RNA, 22 nt, Human
gugugcucccucugucgucaua

SEQ ID NO: 914525 - RNA, 22 nt, Human
gauacuuucucauuuacccaag

SEQ ID NO: 914526 - RNA, 22 nt, Human
uuuuuuccaacuuaagacuuca

SEQ ID NO: 914527 - RNA, 22 nt, Human
gauggcagguaguggucucauc

SEQ ID NO: 914528 - RNA, 22 nt, Human
cuucuggguugcaggucuuggc

SEQ ID NO: 914529 - RNA, 22 nt, Human
aaauugcaaaaguacuuuuagg

SEQ ID NO: 914530 - RNA, 21 nt, Human
cccaggcugaauuaaaaauau

SEQ ID NO: 914531 - RNA, 22 nt, Human
ggacugaauggaagauauaugg

SEQ ID NO: 914532 - RNA, 22 nt, Human
cccagcuccuuacagggccgaa

SEQ ID NO: 914533 - RNA, 22 nt, Human
cugccuuggcccuaguucaugg

SEQ ID NO: 914534 - RNA, 22 nt, Human
auuaaggcguuggcgugcuuau

SEQ ID NO: 914535 - RNA, 22 nt, Human
auaugcuugacucuuucacauc

SEQ ID NO: 914536 - RNA, 22 nt, Human
cuccacagagaugcugauugua

SEQ ID NO: 914537 - RNA, 23 nt, Human
uaugucaugagcauauugaaugu

SEQ ID NO: 914538 - RNA, 22 nt, Human
cucugugucugaguuauggucu

SEQ ID NO: 914539 - RNA, 22 nt, Human
ugaggugggugucaggucagag

SEQ ID NO: 914540 - RNA, 22 nt, Human
ucugagguggggcuggagcauu

SEQ ID NO: 914541 - RNA, 22 nt, Human
uuuugccuaggguugacccguu

SEQ ID NO: 914542 - RNA, 22 nt, Human
ugaggcagucacccccuccugc

SEQ ID NO: 914543 - RNA, 23 nt, Human
aagugcuuugggauggagucugg

SEQ ID NO: 914544 - RNA, 20 nt, Human
ugucagcaauuaggagaaaa

SEQ ID NO: 914545 - RNA, 22 nt, Human
acaggcuuuauguagugacuua

SEQ ID NO: 914546 - RNA, 22 nt, Human
uauaagccucgaugguaagccu

SEQ ID NO: 914547 - RNA, 18 nt, Human
acuccccacaggcucugu

SEQ ID NO: 914548 - RNA, 22 nt, Human
ucccaggacuuccaguuggagg

SEQ ID NO: 914549 - RNA, 22 nt, Human
gcacugagcaccagccacagau

SEQ ID NO: 914550 - RNA, 22 nt, Human
gcuggggagggcgucaaggcca

SEQ ID NO: 914551 - RNA, 23 nt, Human
ccuggcagcaaacgaggagguua

SEQ ID NO: 914552 - RNA, 22 nt, Human
gugcugggcuccaccccagagg

SEQ ID NO: 914553 - RNA, 22 nt, Human
aggagguggcaacugucgacag

SEQ ID NO: 914554 - RNA, 22 nt, Human
gcaagcaauggacggugacuuu

SEQ ID NO: 914555 - RNA, 22 nt, Human
caaguuauuccuuuacacuaua

SEQ ID NO: 914556 - RNA, 22 nt, Human
agggaauucacuggaacgcccu

SEQ ID NO: 914557 - RNA, 22 nt, Human
acagagcaauaacagggagagg

SEQ ID NO: 914558 - RNA, 22 nt, Human
cuaggaggcgggggcugcagua

SEQ ID NO: 914559 - RNA, 22 nt, Human
auguguguacacacgugacucu

SEQ ID NO: 914560 - RNA, 22 nt, Human
aaauugugucucaggcaguggu

SEQ ID NO: 914561 - RNA, 22 nt, Human
gaaguucuggcucagagaggaa

SEQ ID NO: 914562 - RNA, 22 nt, Human
ucuguccagcucuggggcucac

SEQ ID NO: 914563 - RNA, 22 nt, Human
uaucuguuggcuuuggaaauaa

SEQ ID NO: 914564 - RNA, 20 nt, Human
cgcuccagucgcuggugugu

SEQ ID NO: 914565 - RNA, 22 nt, Human
uggcacuguagccacuacugcc

SEQ ID NO: 914566 - RNA, 20 nt, Human
gagugcuuuggcuugcucuc

SEQ ID NO: 914567 - RNA, 18 nt, Human
uucaagaguuucucuagg

SEQ ID NO: 914568 - RNA, 22 nt, Human
ucugaaguucuuaaauuaguuu

SEQ ID NO: 914569 - RNA, 16 nt, Human
ccacaguaagaaauac

SEQ ID NO: 914570 - RNA, 22 nt, Human
ucugauaaaugccaucuuuuug

SEQ ID NO: 914571 - RNA, 22 nt, Human
agcugccuggagccagaguuga

SEQ ID NO: 914572 - RNA, 22 nt, Human
gugugccaagagauaguugcug

SEQ ID NO: 914573 - RNA, 22 nt, Human
ucccagccugacagugcaucaa

SEQ ID NO: 914574 - RNA, 22 nt, Human
ggcagguacagcaagaggacaa

SEQ ID NO: 914575 - RNA, 22 nt, Human
acugcagggcauccuggccaag

SEQ ID NO: 914576 - RNA, 22 nt, Human
gggagggacacaaagaguuccc

SEQ ID NO: 914577 - RNA, 22 nt, Human
cugcuaggguucagcagugccu

SEQ ID NO: 914578 - RNA, 22 nt, Human
gcacuggauuuugaucugcaag

SEQ ID NO: 914579 - RNA, 22 nt, Human
gcugaaggagccugggguggga

SEQ ID NO: 914580 - RNA, 18 nt, Human
ucaggcugcccugugucu

SEQ ID NO: 914581 - RNA, 22 nt, Human
agggucugacaaugugacuuag

SEQ ID NO: 914582 - RNA, 22 nt, Human
uaagaaguacaaaaauuuucug

SEQ ID NO: 914583 - RNA, 22 nt, Human
cagauguggaaugcagcaggcu

SEQ ID NO: 914584 - RNA, 22 nt, Human
uggcuccagcccugagcaagcu

SEQ ID NO: 914585 - RNA, 22 nt, Human
aggugagggugccagugcaugg

SEQ ID NO: 914586 - RNA, 22 nt, Human
agccugugugcuuuggacaggg

SEQ ID NO: 914587 - RNA, 22 nt, Human
uccuggcuuccacaccugucau

SEQ ID NO: 914588 - RNA, 22 nt, Human
agcuagcaaauagcauguagga

SEQ ID NO: 914589 - RNA, 22 nt, Human
cugccaggugagcuccaggccu

SEQ ID NO: 914590 - RNA, 22 nt, Human
gggaaggcaggccucuguugga

SEQ ID NO: 914591 - RNA, 22 nt, Human
ugagagcuugaguaucacuggc

SEQ ID NO: 914592 - RNA, 22 nt, Human
uugcaagggauaccauacuaag

SEQ ID NO: 914593 - RNA, 19 nt, Human
ugccagcucacaggagcuc

SEQ ID NO: 914594 - RNA, 22 nt, Human
aucugaaaaaucuccuuuguca

SEQ ID NO: 914595 - RNA, 22 nt, Human
agggacacgagguccugcuggg

SEQ ID NO: 914596 - RNA, 22 nt, Human
uccaggcugcagucuugcccuc

SEQ ID NO: 914597 - RNA, 20 nt, Human
caugccaugucuacugaggc

SEQ ID NO: 914598 - RNA, 17 nt, Human
uuuguacaacauuuuaa

SEQ ID NO: 914599 - RNA, 22 nt, Human
gcugaggcaaaccaagaaugua

SEQ ID NO: 914600 - RNA, 21 nt, Human
ucacacacguuuccaagggca

SEQ ID NO: 914601 - RNA, 22 nt, Human
gggcagugguccaggcuacagc

SEQ ID NO: 914602 - RNA, 22 nt, Human
aacagagaggccaccucagcag

SEQ ID NO: 914603 - RNA, 20 nt, Human
aucuuuggcucagaagccuu

SEQ ID NO: 914604 - RNA, 22 nt, Human
agauguggcugcacccaccgcu

SEQ ID NO: 914605 - RNA, 22 nt, Human
uaggaagaucaaguuuaucuca

SEQ ID NO: 914606 - RNA, 22 nt, Human
uggggaagggcacccuggagac

SEQ ID NO: 914607 - RNA, 22 nt, Human
aaaaguuauugaugcaggacaa

SEQ ID NO: 914608 - RNA, 22 nt, Human
uuugcaaguaucaaacauguca

SEQ ID NO: 914609 - RNA, 22 nt, Human
gcauaacaaauaugcuuuaaau

SEQ ID NO: 914610 - RNA, 22 nt, Human
uucacaaacaccagaauggcua

SEQ ID NO: 914611 - RNA, 22 nt, Human
ucagcaggcugucagcaggggc

SEQ ID NO: 914612 - RNA, 22 nt, Human
cauuucaaaagaauugccagaa

SEQ ID NO: 914613 - RNA, 22 nt, Human
acagaguagcucaagaagauug

SEQ ID NO: 914614 - RNA, 22 nt, Human
uccagggagucaaaugaacuac

SEQ ID NO: 914615 - RNA, 22 nt, Human
aagcaaggcccagagcaucagc

SEQ ID NO: 914616 - RNA, 22 nt, Human
gccugaaguuucaugccucuau

SEQ ID NO: 914617 - RNA, 22 nt, Human
aauguguaugaggaagagagaa

SEQ ID NO: 914618 - RNA, 22 nt, Human
guuaaacaagcuggacacugaa

SEQ ID NO: 914619 - RNA, 22 nt, Human
caggaugggauguagugggccc

SEQ ID NO: 914620 - RNA, 22 nt, Human
cugcuguaauaggagcguuuug

SEQ ID NO: 914621 - RNA, 17 nt, Human
agacacugagccaagua

SEQ ID NO: 914622 - RNA, 21 nt, Human
ggcugccugggaagaagaaga

SEQ ID NO: 914623 - RNA, 22 nt, Human
gcuucucccuacagaugucagu

SEQ ID NO: 914624 - RNA, 22 nt, Human
aaggcuguuugagcacuggagc

SEQ ID NO: 914625 - RNA, 22 nt, Human
cuucauuacuugcucguagcac

SEQ ID NO: 914626 - RNA, 22 nt, Human
acuaaguaguuuguuccucuuu

SEQ ID NO: 914627 - RNA, 17 nt, Human
agacagaccucugcauc

SEQ ID NO: 914628 - RNA, 22 nt, Human
ugugugaccuggggugagauag

SEQ ID NO: 914629 - RNA, 22 nt, Human
cugggaccagugaagcaacuca

SEQ ID NO: 914630 - RNA, 22 nt, Human
aacaagaagagagggacguaau

SEQ ID NO: 914631 - RNA, 22 nt, Human
ucucugucacacaaucuacaca

SEQ ID NO: 914632 - RNA, 22 nt, Human
aauaauaguugcaaaguguuua

SEQ ID NO: 914633 - RNA, 22 nt, Human
cacauguaguaagcaggcaaug

SEQ ID NO: 914634 - RNA, 22 nt, Human
aggcucagcaucugauucauau

SEQ ID NO: 914635 - RNA, 22 nt, Human
cuaaauacuagccuucagauuu

SEQ ID NO: 914636 - RNA, 22 nt, Human
auguucaucuacaaggcauugu

SEQ ID NO: 914637 - RNA, 22 nt, Human
uguuucuuuguagauauucuuu

SEQ ID NO: 914638 - RNA, 23 nt, Human
agcagcuguggaguuuugcauuu

SEQ ID NO: 914639 - RNA, 22 nt, Human
aacuuaguguaaugcaguacag

SEQ ID NO: 914640 - RNA, 22 nt, Human
gacuuagacccugucuuuauuc

SEQ ID NO: 914641 - RNA, 22 nt, Human
aaggggauuuaagguaagaaga

SEQ ID NO: 914642 - RNA, 22 nt, Human
cccagcagggucucugugucua

SEQ ID NO: 914643 - RNA, 23 nt, Human
uuacaguaggaguuggaaaacca

SEQ ID NO: 914644 - RNA, 22 nt, Human
gacccugaggaugcaccagcag

SEQ ID NO: 914645 - RNA, 23 nt, Human
aguccuuuuuauaaaauugagga

SEQ ID NO: 914646 - RNA, 18 nt, Human
cugucccauccucagguu

SEQ ID NO: 914647 - RNA, 20 nt, Human
cuggggagcugcucccacga

SEQ ID NO: 914648 - RNA, 22 nt, Human
uguauauuguucugucucuuca

SEQ ID NO: 914649 - RNA, 19 nt, Human
gccaggcucuuauucugug

SEQ ID NO: 914650 - RNA, 22 nt, Human
agucugugagugauguaccugc

SEQ ID NO: 914651 - RNA, 22 nt, Human
aacaguaacgagauguccuaac

SEQ ID NO: 914652 - RNA, 18 nt, Human
uaaaccagaugacaguug

SEQ ID NO: 914653 - RNA, 22 nt, Human
gcauggccuccagccaacagca

SEQ ID NO: 914654 - RNA, 22 nt, Human
ugaaacaaaaguauguagcuug

SEQ ID NO: 914655 - RNA, 22 nt, Human
gagauguacaauguguauuaau

SEQ ID NO: 914656 - RNA, 22 nt, Human
gagaagcuggacuuuccaaacu

SEQ ID NO: 914657 - RNA, 16 nt, Human
gcacacacaucaauga

SEQ ID NO: 914658 - RNA, 22 nt, Human
gguuccaccuggcgagggguau

SEQ ID NO: 914659 - RNA, 22 nt, Human
ugcaugcguuaguuggcguguu

SEQ ID NO: 914660 - RNA, 22 nt, Human
gugcagaggacguggcggccuc

SEQ ID NO: 914661 - RNA, 21 nt, Human
uugugaaaguccaggaacaac

SEQ ID NO: 914662 - RNA, 22 nt, Human
cauuguuuugagaacaaccuga

SEQ ID NO: 914663 - RNA, 22 nt, Human
cugaaggauuagagagcacuua

SEQ ID NO: 914664 - RNA, 22 nt, Human
aggcuugggacugcuuaggagc

SEQ ID NO: 914665 - RNA, 22 nt, Human
uuggaaggcugaauggccucuc

SEQ ID NO: 914666 - RNA, 22 nt, Human
cugccuugguucccagccagca

SEQ ID NO: 914667 - RNA, 22 nt, Human
ugguaaaaacugcaauuacuuu

SEQ ID NO: 914668 - RNA, 22 nt, Human
cuagaaauauuuuacagucaag

SEQ ID NO: 914669 - RNA, 22 nt, Human
agcagcagcucuguugcccuac

SEQ ID NO: 914670 - RNA, 22 nt, Human
acauugaccugauuuugaagac

SEQ ID NO: 914671 - RNA, 22 nt, Human
guguuucccuggcacaagaacc

SEQ ID NO: 914672 - RNA, 22 nt, Human
ucuguuauucugcucaguauag

SEQ ID NO: 914673 - RNA, 22 nt, Human
ggcuaggcaggcucagagccua

SEQ ID NO: 914674 - RNA, 22 nt, Human
ccugcugucagcauccucgcga

SEQ ID NO: 914675 - RNA, 22 nt, Human
gaggaagcagggcuuggcugag

SEQ ID NO: 914676 - RNA, 19 nt, Human
ucuagucagucagucauuc

SEQ ID NO: 914677 - RNA, 22 nt, Human
uccucaggauguggaguagaau

SEQ ID NO: 914678 - RNA, 20 nt, Human
aaaggaauauaugaaguaua

SEQ ID NO: 914679 - RNA, 22 nt, Human
gagacacagagaggcuguguga

SEQ ID NO: 914680 - RNA, 19 nt, Human
cagguggcgcucuacaggg

SEQ ID NO: 914681 - RNA, 21 nt, Human
acagaugggaugagcacacug

SEQ ID NO: 914682 - RNA, 19 nt, Human
uuacaugacauaugaagga

SEQ ID NO: 914683 - RNA, 22 nt, Human
auuccaauuguacuugcuuuua

SEQ ID NO: 914684 - RNA, 22 nt, Human
caguuguccuuuguaccaaguu

SEQ ID NO: 914685 - RNA, 22 nt, Human
gcagaugagugagauagacuuc

SEQ ID NO: 914686 - RNA, 21 nt, Human
ugcugccaucaugcagagaug

SEQ ID NO: 914687 - RNA, 22 nt, Human
acagaugguagcauuauguugg

SEQ ID NO: 914688 - RNA, 22 nt, Human
cagaugugccuccagggcuuug

SEQ ID NO: 914689 - RNA, 22 nt, Human
ugaaauauccagcccagcagga

SEQ ID NO: 914690 - RNA, 23 nt, Human
gcucugcucuguuucauagacag

SEQ ID NO: 914691 - RNA, 22 nt, Human
aguuaaaucauuacugacagag

SEQ ID NO: 914692 - RNA, 22 nt, Human
augagguagcuuggcccagggg

SEQ ID NO: 914693 - RNA, 20 nt, Human
uguucacaguaguugcugcu

SEQ ID NO: 914694 - RNA, 23 nt, Human
uggaaugagcugggaagcugagc

SEQ ID NO: 914695 - RNA, 22 nt, Human
cagaaauauuccaaguacugca

SEQ ID NO: 914696 - RNA, 22 nt, Human
uuucugcaaguguagauaccca

SEQ ID NO: 914697 - RNA, 22 nt, Human
ugugacugaggcuccaagcuag

SEQ ID NO: 914698 - RNA, 22 nt, Human
cccaggaggcagagauagcagu

SEQ ID NO: 914699 - RNA, 22 nt, Human
augaggcaaggaucagguaagg

SEQ ID NO: 914700 - RNA, 22 nt, Human
cacaguuugggucuccggggca

SEQ ID NO: 914701 - RNA, 22 nt, Human
ggcugugccucaaggcuacuca

SEQ ID NO: 914702 - RNA, 22 nt, Human
cuguggcuccagugaaccaaug

SEQ ID NO: 914703 - RNA, 22 nt, Human
gaagauuuauaggagccuauua

SEQ ID NO: 914704 - RNA, 22 nt, Human
ccugccugucuuuauccccugu

SEQ ID NO: 914705 - RNA, 22 nt, Human
guccugagggcccaggcauucu

SEQ ID NO: 914706 - RNA, 22 nt, Human
acagacgggacaacgugcagcu

SEQ ID NO: 914707 - RNA, 23 nt, Human
uuauuuugucagaagggacuuuu

SEQ ID NO: 914708 - RNA, 22 nt, Human
aaagaggaaccaagagcacgug

SEQ ID NO: 914709 - RNA, 22 nt, Human
uuauuccauucaguucaacaag

SEQ ID NO: 914710 - RNA, 22 nt, Human
uuugaauauacuucaaacaaag

SEQ ID NO: 914711 - RNA, 22 nt, Human
cugcccugcuucugagggaagc

SEQ ID NO: 914712 - RNA, 22 nt, Human
ucugccucgcuaacagcagcca

SEQ ID NO: 914713 - RNA, 22 nt, Human
uggaagggaacagguggguguu

SEQ ID NO: 914714 - RNA, 22 nt, Human
uuuguguuggaagaaaugcuac

SEQ ID NO: 914715 - RNA, 22 nt, Human
gcagucuugccacaggguuuca

SEQ ID NO: 914716 - RNA, 22 nt, Human
ggcaggugcucugugggccugg

SEQ ID NO: 914717 - RNA, 22 nt, Human
ucugaaauuuuaguuauagaaa

SEQ ID NO: 914718 - RNA, 17 nt, Human
ggaacaaauacuaugca

SEQ ID NO: 914719 - RNA, 22 nt, Human
augagcugugggauuccagagg

SEQ ID NO: 914720 - RNA, 22 nt, Human
ucagugacuggguauuaaauca

SEQ ID NO: 914721 - RNA, 22 nt, Human
guugaaagaugucuugguuccc

SEQ ID NO: 914722 - RNA, 22 nt, Human
ggagagcaggguccugagauac

SEQ ID NO: 914723 - RNA, 22 nt, Human
ucaccaggcuccuguuaagaug

SEQ ID NO: 914724 - RNA, 22 nt, Human
aggggcaggugcugcacuuaga

SEQ ID NO: 914725 - RNA, 19 nt, Human
aacuguaaagaucuguagc

SEQ ID NO: 914726 - RNA, 22 nt, Human
cagcucuccacccuccugguuc

SEQ ID NO: 914727 - RNA, 22 nt, Human
acagguuugcugcuguuuuagg

SEQ ID NO: 914728 - RNA, 17 nt, Human
agcagcugaagcagcca

SEQ ID NO: 914729 - RNA, 22 nt, Human
ucuaaacucucuuugaauuaug

SEQ ID NO: 914730 - RNA, 22 nt, Human
uccuggcuccagcagcucuucc

SEQ ID NO: 914731 - RNA, 22 nt, Human
gcuuuugucauggugacucagu

SEQ ID NO: 914732 - RNA, 22 nt, Human
ugugucagaauuuuuguggcaa

SEQ ID NO: 914733 - RNA, 22 nt, Human
cuggcuccaaggaagagguuuu

SEQ ID NO: 914734 - RNA, 22 nt, Human
ggugcugacugaggauggcuug

SEQ ID NO: 914735 - RNA, 22 nt, Human
ggguuaggucccucccuucugg

SEQ ID NO: 914736 - RNA, 22 nt, Human
uggcugggccgggccuugugcc

SEQ ID NO: 914737 - RNA, 22 nt, Human
aacuacaucacccuauuucugu

SEQ ID NO: 914738 - RNA, 21 nt, Human
cuggaagaagcagcaggauuc

SEQ ID NO: 914739 - RNA, 22 nt, Human
aaagaagggacagacugccucu

SEQ ID NO: 914740 - RNA, 22 nt, Human
aggccagaguuaaggagaacag

SEQ ID NO: 914741 - RNA, 22 nt, Human
aagagcaggacagaaucagaac

SEQ ID NO: 914742 - RNA, 22 nt, Human
aaauuugccagaucaauucuga

SEQ ID NO: 914743 - RNA, 22 nt, Human
agagaacauauuuuguaugauu

SEQ ID NO: 914744 - RNA, 22 nt, Human
caaugguucucaaacuaucaug

SEQ ID NO: 914745 - RNA, 22 nt, Human
ccuccagggccccucucacugg

SEQ ID NO: 914746 - RNA, 22 nt, Human
uaaggcagaaauaugagcaggg

SEQ ID NO: 914747 - RNA, 22 nt, Human
auuaaaagcuucccaagaguua

SEQ ID NO: 914748 - RNA, 22 nt, Human
uguuuaucaggguaaaguguag

SEQ ID NO: 914749 - RNA, 22 nt, Human
ggaagagccuggggugucaggc

SEQ ID NO: 914750 - RNA, 22 nt, Human
aaguaaaagcaggugugcuggg

SEQ ID NO: 914751 - RNA, 22 nt, Human
gucuucuaaguaucaaagcaga

SEQ ID NO: 914752 - RNA, 22 nt, Human
aggcagcuuucagugucucuca

SEQ ID NO: 914753 - RNA, 22 nt, Human
gccagcugaagggaagcuccug

SEQ ID NO: 914754 - RNA, 22 nt, Human
ccacugccgauguuccaucuug

SEQ ID NO: 914755 - RNA, 23 nt, Human
acagaauaccauugacuaggugu

SEQ ID NO: 914756 - RNA, 23 nt, Human
ugcagagggacugaagccagcuu

SEQ ID NO: 914757 - RNA, 22 nt, Human
cagagucagcuagucuugggau

SEQ ID NO: 914758 - RNA, 22 nt, Human
gcuccucuuauuucaucagggc

SEQ ID NO: 914759 - RNA, 22 nt, Human
gcagggguggaggcuguccugu

SEQ ID NO: 914760 - RNA, 22 nt, Human
aguaacuaugcuugagaaucag

SEQ ID NO: 914761 - RNA, 22 nt, Human
cuugauggaggggccaggcuuu

SEQ ID NO: 914762 - RNA, 22 nt, Human
cuuaggauuuaauuucagacuc

SEQ ID NO: 914763 - RNA, 22 nt, Human
ugggaaccauguagcugagaug

SEQ ID NO: 914764 - RNA, 22 nt, Human
ggcuucauggaggaggugaguc

SEQ ID NO: 914765 - RNA, 22 nt, Human
uaguucuagaccaguuaauagu

SEQ ID NO: 914766 - RNA, 22 nt, Human
cuggcagcgguuugcagccugg

SEQ ID NO: 914767 - RNA, 18 nt, Human
agcagagcccaugcauuc

SEQ ID NO: 914768 - RNA, 22 nt, Human
ugaugcuguguaccucauggga

SEQ ID NO: 914769 - RNA, 22 nt, Human
aaggacagagagccauuccaga

SEQ ID NO: 914770 - RNA, 22 nt, Human
uucugcauugacuuuuauuucc

SEQ ID NO: 914771 - RNA, 22 nt, Human
uuuggaaaguguacaaauuuga

SEQ ID NO: 914772 - RNA, 22 nt, Human
cuggagugauacucagaaugug

SEQ ID NO: 914773 - RNA, 18 nt, Human
cugaggccaacuacacug

SEQ ID NO: 914774 - RNA, 19 nt, Human
cugcuuccuucccucacug

SEQ ID NO: 914775 - RNA, 22 nt, Human
cacaagggagcuuagaaaacau

SEQ ID NO: 914776 - RNA, 22 nt, Human
cagcucugaggaacacuccuuu

SEQ ID NO: 914777 - RNA, 22 nt, Human
agagcaaauagagaagccagcu

SEQ ID NO: 914778 - RNA, 22 nt, Human
ugucucuugguguccagaggag

SEQ ID NO: 914779 - RNA, 21 nt, Human
ccaugucagaugugggcugug

SEQ ID NO: 914780 - RNA, 22 nt, Human
uggagcccacggaugucgcuuu

SEQ ID NO: 914781 - RNA, 19 nt, Human
cccagagcauccugaacuu

SEQ ID NO: 914782 - RNA, 22 nt, Human
aaguucaucaaagaguaaauau

SEQ ID NO: 914783 - RNA, 22 nt, Human
ucagugcuuccuggaggaagcc

SEQ ID NO: 914784 - RNA, 22 nt, Human
ggggcagaaagcccacagagug

SEQ ID NO: 914785 - RNA, 22 nt, Human
cccugcuguguagcggaggaac

SEQ ID NO: 914786 - RNA, 22 nt, Human
aggcuggcccaccucuugucuu

SEQ ID NO: 914787 - RNA, 22 nt, Human
gaggccacuuccuacuggagga

SEQ ID NO: 914788 - RNA, 22 nt, Human
aggaggcugggcacaguggccu

SEQ ID NO: 914789 - RNA, 22 nt, Human
aaaaccucaguucugcucuuaa

SEQ ID NO: 914790 - RNA, 22 nt, Human
uugagcuguauaccuaugacug

SEQ ID NO: 914791 - RNA, 22 nt, Human
aaauugcugacacuugaccauu

SEQ ID NO: 914792 - RNA, 22 nt, Human
ucucagggccccaaaggcuagu

SEQ ID NO: 914793 - RNA, 22 nt, Human
gccagcaguauguccuggcagu

SEQ ID NO: 914794 - RNA, 22 nt, Human
ucagaacagcgagaauauucac

SEQ ID NO: 914795 - RNA, 22 nt, Human
cugugucucuccuuacaagacu

SEQ ID NO: 914796 - RNA, 22 nt, Human
uaucauaaguuaauuaaacagu

SEQ ID NO: 914797 - RNA, 20 nt, Human
cauuugggaucaugagguuu

SEQ ID NO: 914798 - RNA, 22 nt, Human
gagcugaggugauguggucguu

SEQ ID NO: 914799 - RNA, 22 nt, Human
cuucagagaguccagggacugc

SEQ ID NO: 914800 - RNA, 22 nt, Human
uauuccuaauuugcagggcaug

SEQ ID NO: 914801 - RNA, 22 nt, Human
gucagagacaaacuuccucucu

SEQ ID NO: 914802 - RNA, 22 nt, Human
gcugcagaccucaugcaggugg

SEQ ID NO: 914803 - RNA, 22 nt, Human
uugucaucaagaugcauugguc

SEQ ID NO: 914804 - RNA, 22 nt, Human
ugguuccucagggcagcuguac

SEQ ID NO: 914805 - RNA, 22 nt, Human
agcacccuuugugagcauaagu

SEQ ID NO: 914806 - RNA, 22 nt, Human
ugaggaggugggcacacagagu

SEQ ID NO: 914807 - RNA, 22 nt, Human
cacaaacaucaauccuguuuuc

SEQ ID NO: 914808 - RNA, 22 nt, Human
ugcagcugguuuagaacuagau

SEQ ID NO: 914809 - RNA, 22 nt, Human
ugaaguuuaauuuuggacauga

SEQ ID NO: 914810 - RNA, 22 nt, Human
ugcaaauauuagcauucgauau

SEQ ID NO: 914811 - RNA, 22 nt, Human
auaaugcauuuagaauaauuca

SEQ ID NO: 914812 - RNA, 22 nt, Human
aucaaagugauuuguaaacagg

SEQ ID NO: 914813 - RNA, 22 nt, Human
uuucuuuaggcuguguugccaa

SEQ ID NO: 914814 - RNA, 22 nt, Human
cugggccaucucucugcaagug

SEQ ID NO: 914815 - RNA, 22 nt, Human
guagaguugaguagugguaaca

SEQ ID NO: 914816 - RNA, 22 nt, Human
gugagcagggcaggacugggga

SEQ ID NO: 914817 - RNA, 18 nt, Human
guucaucuuuuucuaaag

SEQ ID NO: 914818 - RNA, 22 nt, Human
ugggugaguggagggcauucua

SEQ ID NO: 914819 - RNA, 17 nt, Human
agggacagcaguuuagg

SEQ ID NO: 914820 - RNA, 22 nt, Human
ccucucucuuguagucccugcc

SEQ ID NO: 914821 - RNA, 22 nt, Human
acagugcacauccugagugauu

SEQ ID NO: 914822 - RNA, 22 nt, Human
ugagauggcaacaccagcuuug

SEQ ID NO: 914823 - RNA, 22 nt, Human
ucuugggaaauaaacagauuga

SEQ ID NO: 914824 - RNA, 21 nt, Human
uagcaauuauagaugucuaaa

SEQ ID NO: 914825 - RNA, 22 nt, Human
guggcacauugguagggucugu

SEQ ID NO: 914826 - RNA, 20 nt, Human
acaaauuggcagaaugacaa

SEQ ID NO: 914827 - RNA, 22 nt, Human
cucagugucacguuuugccuua

SEQ ID NO: 914828 - RNA, 22 nt, Human
aagccacuguuuuggagugcuu

SEQ ID NO: 914829 - RNA, 22 nt, Human
uggcuguggacucagauggcuc

SEQ ID NO: 914830 - RNA, 23 nt, Human
agcagcagugagaggugucuuac

SEQ ID NO: 914831 - RNA, 22 nt, Human
ugcacagagcaggcaccagcgg

SEQ ID NO: 914832 - RNA, 23 nt, Human
aaggugucauugaugggauucua

SEQ ID NO: 914833 - RNA, 22 nt, Human
cugaagccaugugcucacuggu

SEQ ID NO: 914834 - RNA, 18 nt, Human
uauauuucacacauauuc

SEQ ID NO: 914835 - RNA, 22 nt, Human
ugaggcagggaguuuaauuguc

SEQ ID NO: 914836 - RNA, 22 nt, Human
agcgcugugggcgugcgaggag

SEQ ID NO: 914837 - RNA, 22 nt, Human
acuauuuacucaaaugagguug

SEQ ID NO: 914838 - RNA, 22 nt, Human
aucaucaucaacaagaaacauu

SEQ ID NO: 914839 - RNA, 22 nt, Human
gugcagagaggaccuuggggag

SEQ ID NO: 914840 - RNA, 22 nt, Human
auaguaaauuaucguggagaga

SEQ ID NO: 914841 - RNA, 22 nt, Human
ucugugucguucugugcucugg

SEQ ID NO: 914842 - RNA, 22 nt, Human
ucucugcucaggcaccagcccu

SEQ ID NO: 914843 - RNA, 22 nt, Human
gcccccagaagggccacagauu

SEQ ID NO: 914844 - RNA, 22 nt, Human
uucuuuucggccugugagaagg

SEQ ID NO: 914845 - RNA, 22 nt, Human
agacccucuccucauggacaug

SEQ ID NO: 914846 - RNA, 22 nt, Human
cccucacucugccuccuggggu

SEQ ID NO: 914847 - RNA, 22 nt, Human
aauacuguaaauggagcagcca

SEQ ID NO: 914848 - RNA, 22 nt, Human
cugaaacauugcaauaacaaag

SEQ ID NO: 914849 - RNA, 22 nt, Human
uuuccuaacucaucggauguac

SEQ ID NO: 914850 - RNA, 19 nt, Human
cuuuuucaccuucuagaag

SEQ ID NO: 914851 - RNA, 21 nt, Human
uucaaagagugggcauuguca

SEQ ID NO: 914852 - RNA, 22 nt, Human
gugagcaggauuucauggugua

SEQ ID NO: 914853 - RNA, 21 nt, Human
guccuguuccugaaccuuccc

SEQ ID NO: 914854 - RNA, 22 nt, Human
cauuacaacaaucugccauggc

SEQ ID NO: 914855 - RNA, 22 nt, Human
gcccucuguguaacaauccaga

SEQ ID NO: 914856 - RNA, 22 nt, Human
gucaaauauaugcaaaacuauu

SEQ ID NO: 914857 - RNA, 22 nt, Human
ggagcagacauaaccuuacaga

SEQ ID NO: 914858 - RNA, 22 nt, Human
gagaaggauguggcucauagcu

SEQ ID NO: 914859 - RNA, 22 nt, Human
agcagccagagucugaacauua

SEQ ID NO: 914860 - RNA, 22 nt, Human
ccagcccaaacaagccgccuuc

SEQ ID NO: 914861 - RNA, 22 nt, Human
acaguguucucuuccuguauag

SEQ ID NO: 914862 - RNA, 22 nt, Human
guggauggagcuggaagccauu

SEQ ID NO: 914863 - RNA, 18 nt, Human
agcccagcggagugaauc

SEQ ID NO: 914864 - RNA, 22 nt, Human
cacaggaaucugcauuuugacc

SEQ ID NO: 914865 - RNA, 22 nt, Human
uccaggccauugacugcauccu

SEQ ID NO: 914866 - RNA, 22 nt, Human
auaaagcuaagacuuacaugaa

SEQ ID NO: 914867 - RNA, 22 nt, Human
ccaggcagggagcuguuuggcc

SEQ ID NO: 914868 - RNA, 22 nt, Human
cauuuuaccuagaagcugaaag

SEQ ID NO: 914869 - RNA, 22 nt, Human
augucacauggccuguacuuug

SEQ ID NO: 914870 - RNA, 20 nt, Human
uuucacuguggugcuggaga

SEQ ID NO: 914871 - RNA, 20 nt, Human
uucaaaguguaugauaugca

SEQ ID NO: 914872 - RNA, 22 nt, Human
ucccagcagaugagcugaccua

SEQ ID NO: 914873 - RNA, 22 nt, Human
ugcccaugcaugacagauggcu

SEQ ID NO: 914874 - RNA, 22 nt, Human
caauaauuuacauuggauacca

SEQ ID NO: 914875 - RNA, 22 nt, Human
uguggggaccuggcugccaccc

SEQ ID NO: 914876 - RNA, 22 nt, Human
aaguacuagaaauagcagugcc

SEQ ID NO: 914877 - RNA, 22 nt, Human
uagaaaaguaugggacugacau

SEQ ID NO: 914878 - RNA, 22 nt, Human
ccagggcuucaguuagugguga

SEQ ID NO: 914879 - RNA, 22 nt, Human
gcacugccuguguucaggguaa

SEQ ID NO: 914880 - RNA, 18 nt, Human
ugggcugccuggccucug

SEQ ID NO: 914881 - RNA, 22 nt, Human
auguuuuucauaccaguguugg

SEQ ID NO: 914882 - RNA, 22 nt, Human
uaacaauggaguuuugagaaag

SEQ ID NO: 914883 - RNA, 22 nt, Human
uauuuugagccccugacaucua

SEQ ID NO: 914884 - RNA, 22 nt, Human
gaaacguuaaaccauauguaau

SEQ ID NO: 914885 - RNA, 22 nt, Human
ugcuauuagaagccaugcuguu

SEQ ID NO: 914886 - RNA, 22 nt, Human
guacauuuacugaugaaaagua

SEQ ID NO: 914887 - RNA, 22 nt, Human
gcagaggggguacuucggcccu

SEQ ID NO: 914888 - RNA, 22 nt, Human
guguggcccugcguccugaguc

SEQ ID NO: 914889 - RNA, 22 nt, Human
accaguuuguaaccuguuuuca

SEQ ID NO: 914890 - RNA, 22 nt, Human
ugggccaguccugccuaaggug

SEQ ID NO: 914891 - RNA, 22 nt, Human
gugugugcuccccaggagagcu

SEQ ID NO: 914892 - RNA, 22 nt, Human
ccagaaagacuuuuuagguacg

SEQ ID NO: 914893 - RNA, 22 nt, Human
ugucuuuucuacuguaagcaua

SEQ ID NO: 914894 - RNA, 22 nt, Human
ccucaggcuagcuacugucccu

SEQ ID NO: 914895 - RNA, 22 nt, Human
uccaaagaaccuggcuacuguc

SEQ ID NO: 914896 - RNA, 23 nt, Human
ugaguguggggacagugguuugc

SEQ ID NO: 914897 - RNA, 22 nt, Human
aagaaauuaaugugccauuacu

SEQ ID NO: 914898 - RNA, 22 nt, Human
aacaaaguuucaggaagauaga

SEQ ID NO: 914899 - RNA, 22 nt, Human
gccagaggcucagguugccaug

SEQ ID NO: 914900 - RNA, 22 nt, Human
gaugacaagcauaugacacguc

SEQ ID NO: 914901 - RNA, 22 nt, Human
cagucccagacccagaaggugg

SEQ ID NO: 914902 - RNA, 18 nt, Human
ucacucauagacaucuau

SEQ ID NO: 914903 - RNA, 22 nt, Human
uguuuucuguguagagaucaca

SEQ ID NO: 914904 - RNA, 18 nt, Human
gcccaugguaaaugcugu

SEQ ID NO: 914905 - RNA, 20 nt, Human
auccaugagagucuggauuc

SEQ ID NO: 914906 - RNA, 22 nt, Human
cagggauggcugucaggaugua

SEQ ID NO: 914907 - RNA, 22 nt, Human
augaaugcugggacaaauauau

SEQ ID NO: 914908 - RNA, 22 nt, Human
auuuauugagacuuaacaaccc

SEQ ID NO: 914909 - RNA, 22 nt, Human
caguacuaagacuccaccuagc

SEQ ID NO: 914910 - RNA, 18 nt, Human
agcaacagaaacauaugg

SEQ ID NO: 914911 - RNA, 22 nt, Human
gagcugugccaaucugucuggg

SEQ ID NO: 914912 - RNA, 22 nt, Human
gagcagcugcagugcagacccu

SEQ ID NO: 914913 - RNA, 22 nt, Human
uuucaucuuccuuggcauaggu

SEQ ID NO: 914914 - RNA, 22 nt, Human
aggcacacagaccccagcaagu

SEQ ID NO: 914915 - RNA, 22 nt, Human
cuguggcuaggauuauuccuga

SEQ ID NO: 914916 - RNA, 22 nt, Human
ugcuuccuauccacacaaugcc

SEQ ID NO: 914917 - RNA, 23 nt, Human
uggaagcagaaguuucaauaucc

SEQ ID NO: 914918 - RNA, 22 nt, Human
ugggggugguucuugccuccag

SEQ ID NO: 914919 - RNA, 22 nt, Human
gugagguccuaauagacaucga

SEQ ID NO: 914920 - RNA, 22 nt, Human
ccagacuggggcuccuugaggg

SEQ ID NO: 914921 - RNA, 22 nt, Human
augacacauuugugcuguugaa

SEQ ID NO: 914922 - RNA, 22 nt, Human
gagucgagcagaaagccgucgg

SEQ ID NO: 914923 - RNA, 22 nt, Human
ucagugcaggaaucucuagcca

SEQ ID NO: 914924 - RNA, 22 nt, Human
ugggggcugugcacaggcucac

SEQ ID NO: 914925 - RNA, 22 nt, Human
uggggaggauaugugaguuauu

SEQ ID NO: 914926 - RNA, 22 nt, Human
auuauuuccuugcuuugaggaa

SEQ ID NO: 914927 - RNA, 22 nt, Human
aaucuguagggaacaacuguac

SEQ ID NO: 914928 - RNA, 22 nt, Human
caauagugucugcuuguuucua

SEQ ID NO: 914929 - RNA, 22 nt, Human
aagcuguucucuaaguuucaug

SEQ ID NO: 914930 - RNA, 22 nt, Human
aaacuggauuaccaggcuggug

SEQ ID NO: 914931 - RNA, 22 nt, Human
ccccaggacguggcccucauag

SEQ ID NO: 914932 - RNA, 22 nt, Human
acacauucaugagugcaugcac

SEQ ID NO: 914933 - RNA, 22 nt, Human
uggccagucuuagcugugccug

SEQ ID NO: 914934 - RNA, 22 nt, Human
aggacagagggaccagagccca

SEQ ID NO: 914935 - RNA, 22 nt, Human
agugaggauaccaauguguaga

SEQ ID NO: 914936 - RNA, 22 nt, Human
ggcuaaggaacgcaggcuucuc

SEQ ID NO: 914937 - RNA, 18 nt, Human
uuaggaaguuucuccguc

SEQ ID NO: 914938 - RNA, 22 nt, Human
augaaauuuuaauuauaccucu

SEQ ID NO: 914939 - RNA, 22 nt, Human
gcacuguagugggggagaaaug

SEQ ID NO: 914940 - RNA, 22 nt, Human
cccauuuaucccaagguuacuc

SEQ ID NO: 914941 - RNA, 22 nt, Human
cugagcagaggucaagauacuu

SEQ ID NO: 914942 - RNA, 22 nt, Human
aacaguaaaaaucauuuaguug

SEQ ID NO: 914943 - RNA, 22 nt, Human
agcugcccccagggcugugcuu

SEQ ID NO: 914944 - RNA, 23 nt, Human
cugagguggagagugagguaagu

SEQ ID NO: 914945 - RNA, 22 nt, Human
caucuguucuauccacguugcu

SEQ ID NO: 914946 - RNA, 22 nt, Human
gaggcugcugagagcccuguuu

SEQ ID NO: 914947 - RNA, 22 nt, Human
uaggucugauuuccauucaguc

SEQ ID NO: 914948 - RNA, 22 nt, Human
uauauuuaaauccagguugaaa

SEQ ID NO: 914949 - RNA, 22 nt, Human
cucagccccaauucuccccauu

SEQ ID NO: 914950 - RNA, 18 nt, Human
uccaggacucugcguggc

SEQ ID NO: 914951 - RNA, 22 nt, Human
ggcugaggguauagcuguccca

SEQ ID NO: 914952 - RNA, 20 nt, Human
ucugggcuucccccagcucc

SEQ ID NO: 914953 - RNA, 22 nt, Human
caggccuugaaggccugcggga

SEQ ID NO: 914954 - RNA, 20 nt, Human
ggcacuggaagcacacagga

SEQ ID NO: 914955 - RNA, 22 nt, Human
ggcaguguggcauaacauguag

SEQ ID NO: 914956 - RNA, 22 nt, Human
caguuuugguccuuucuaggua

SEQ ID NO: 914957 - RNA, 22 nt, Human
cugcaucacuggccaagggugu

SEQ ID NO: 914958 - RNA, 22 nt, Human
uuguaacaucaccaucaaaauc

SEQ ID NO: 914959 - RNA, 22 nt, Human
guccucuuagccacuuaauuau

SEQ ID NO: 914960 - RNA, 20 nt, Human
ucagcucugugccugggaug

SEQ ID NO: 914961 - RNA, 21 nt, Human
acagcaagccuucacaugagu

SEQ ID NO: 914962 - RNA, 22 nt, Human
ucugggaagugagaugcugugu

SEQ ID NO: 914963 - RNA, 22 nt, Human
cugggaugcuccggccuggaug

SEQ ID NO: 914964 - RNA, 22 nt, Human
uuuuucuacugguguuggugua

SEQ ID NO: 914965 - RNA, 22 nt, Human
cccagagccgcuccccuacuuc

SEQ ID NO: 914966 - RNA, 22 nt, Human
auacacaugcacacaugugugu

SEQ ID NO: 914967 - RNA, 22 nt, Human
ugugccugucacccucagagag

SEQ ID NO: 914968 - RNA, 22 nt, Human
ugucugugcccaaggcucccgg

SEQ ID NO: 914969 - RNA, 18 nt, Human
ugugguggagcugccuuc

SEQ ID NO: 914970 - RNA, 22 nt, Human
caggagcuggauaggaccacaa

SEQ ID NO: 914971 - RNA, 22 nt, Human
aagcagcuuucuuuccugugaa

SEQ ID NO: 914972 - RNA, 22 nt, Human
guaacauuuugagcaguaggcu

SEQ ID NO: 914973 - RNA, 22 nt, Human
caggagaagucucuagggggug

SEQ ID NO: 914974 - RNA, 22 nt, Human
ccuggugccacuagagaauguc

SEQ ID NO: 914975 - RNA, 22 nt, Human
uuauguuugaguauaugacuca

SEQ ID NO: 914976 - RNA, 22 nt, Human
cagucccaaggaggaagcaguc

SEQ ID NO: 914977 - RNA, 22 nt, Human
auacagagacacuugagacugg

SEQ ID NO: 914978 - RNA, 22 nt, Human
uuuacaaguuuacagaaugaug

SEQ ID NO: 914979 - RNA, 22 nt, Human
ucuuugaugcuucugaaggugu

SEQ ID NO: 914980 - RNA, 22 nt, Human
cauggcugaggcagaggacuga

SEQ ID NO: 914981 - RNA, 22 nt, Human
gucuagaaaugccauacgugcc

SEQ ID NO: 914982 - RNA, 22 nt, Human
aagaaugauuacaaagcaacga

SEQ ID NO: 914983 - RNA, 19 nt, Human
ucacccaggcugcuggcuc

SEQ ID NO: 914984 - RNA, 22 nt, Human
uuuacagucugucuagcaaugu

SEQ ID NO: 914985 - RNA, 22 nt, Human
uugcuuuugggaaaacaugccu

SEQ ID NO: 914986 - RNA, 20 nt, Human
cuuuagaagaacccaagcau

SEQ ID NO: 914987 - RNA, 22 nt, Human
acccugggaccuggagguggau

SEQ ID NO: 914988 - RNA, 22 nt, Human
aggagcucugggcagggccucc

SEQ ID NO: 914989 - RNA, 22 nt, Human
gagaaucauuuacagaaugauu

SEQ ID NO: 914990 - RNA, 22 nt, Human
acacauaagccuaaucaucucc

SEQ ID NO: 914991 - RNA, 22 nt, Human
uuaaauuucuacgugauccagg

SEQ ID NO: 914992 - RNA, 21 nt, Human
ugaggccucuccugggcuggc

SEQ ID NO: 914993 - RNA, 21 nt, Human
auucugagucuuggggucuca

SEQ ID NO: 914994 - RNA, 21 nt, Human
gagacagcccagugccagggc

SEQ ID NO: 914995 - RNA, 20 nt, Human
agcaggugacggggccugcu

SEQ ID NO: 914996 - RNA, 22 nt, Human
ucacagaagcuugaagauuuuc

SEQ ID NO: 914997 - RNA, 22 nt, Human
gccugggauagaggcaaugcau

SEQ ID NO: 914998 - RNA, 22 nt, Human
uuugucuuaaaucuuguuacug

SEQ ID NO: 914999 - RNA, 22 nt, Human
acagcagcgugaaguguguuau

SEQ ID NO: 915000 - RNA, 22 nt, Human
uaaagacacccagggagggacu

SEQ ID NO: 915001 - RNA, 22 nt, Human
auuagaaaauacaugggcuguc

SEQ ID NO: 915002 - RNA, 20 nt, Human
ugcagagcuggcuggcuccu

SEQ ID NO: 915003 - RNA, 22 nt, Human
acaggggcaggcaggacccuuu

SEQ ID NO: 915004 - RNA, 22 nt, Human
uuuacagagguguccugcauug

SEQ ID NO: 915005 - RNA, 22 nt, Human
uucugagacagcaaagauucuu

SEQ ID NO: 915006 - RNA, 22 nt, Human
ucagaggagaugguuaccaggg

SEQ ID NO: 915007 - RNA, 22 nt, Human
uacauagcuccuagugaugcau

SEQ ID NO: 915008 - RNA, 19 nt, Human
uuuuccuucuccucuuaau

SEQ ID NO: 915009 - RNA, 22 nt, Human
aaacuucagacuccccacuucu

SEQ ID NO: 915010 - RNA, 22 nt, Human
agugggagccagcagcuugggg

SEQ ID NO: 915011 - RNA, 22 nt, Human
ugcaaauagccugaugaaagaa

SEQ ID NO: 915012 - RNA, 22 nt, Human
acagaacaggcugagaaaaaca

SEQ ID NO: 915013 - RNA, 22 nt, Human
ugcauguguguuaagaugcuuu

SEQ ID NO: 915014 - RNA, 19 nt, Human
guguggcagagagugacca

SEQ ID NO: 915015 - RNA, 22 nt, Human
auuucucauuaagaucuuccaa

SEQ ID NO: 915016 - RNA, 22 nt, Human
agcaguuuagcuauacugcuug

SEQ ID NO: 915017 - RNA, 22 nt, Human
agucaguguucuccggagaggc

SEQ ID NO: 915018 - RNA, 23 nt, Human
cacaaagguuccauucucucacc

SEQ ID NO: 915019 - RNA, 22 nt, Human
agacagcacuuuuguauggggg

SEQ ID NO: 915020 - RNA, 22 nt, Human
ggcugccucugaugugcagacg

SEQ ID NO: 915021 - RNA, 22 nt, Human
ggcugccucagauuugcugacu

SEQ ID NO: 915022 - RNA, 22 nt, Human
aggaggccgggauucuggagau

SEQ ID NO: 915023 - RNA, 22 nt, Human
gcucuguaugagggugagagau

SEQ ID NO: 915024 - RNA, 19 nt, Human
agcuggggcgguguguguu

SEQ ID NO: 915025 - RNA, 19 nt, Human
gcaucugcaugaugggguu

SEQ ID NO: 915026 - RNA, 22 nt, Human
ggcugagacaaccugggaccca

SEQ ID NO: 915027 - RNA, 22 nt, Human
gcuuuaaaccucuacucugucc

SEQ ID NO: 915028 - RNA, 22 nt, Human
ucuuuauuucugaaucccccau

SEQ ID NO: 915029 - RNA, 22 nt, Human
uaacaaaguaccauagacugga

SEQ ID NO: 915030 - RNA, 22 nt, Human
uuuuuauacuuugcucaagauu

SEQ ID NO: 915031 - RNA, 21 nt, Human
gccaccucaaucuucuagcgc

SEQ ID NO: 915032 - RNA, 22 nt, Human
aauucucuccaggguaacauca

SEQ ID NO: 915033 - RNA, 22 nt, Human
acaguguagugugaugucaaaa

SEQ ID NO: 915034 - RNA, 22 nt, Human
cccagcauggagugaggacuca

SEQ ID NO: 915035 - RNA, 22 nt, Human
ucugaggcccaguucaacucuu

SEQ ID NO: 915036 - RNA, 22 nt, Human
gccaggucugcaggcauccuga

SEQ ID NO: 915037 - RNA, 22 nt, Human
caggaagcucuuagcagucacc

SEQ ID NO: 915038 - RNA, 22 nt, Human
uuucuauaugaggagcuaaagu

SEQ ID NO: 915039 - RNA, 22 nt, Human
agggcagagaucugagugggca

SEQ ID NO: 915040 - RNA, 22 nt, Human
uccaggggacacuguuucucca

SEQ ID NO: 915041 - RNA, 21 nt, Human
uggaccaggaaggugguggug

SEQ ID NO: 915042 - RNA, 22 nt, Human
cuuggcuccaaucccagcucug

SEQ ID NO: 915043 - RNA, 22 nt, Human
cagagugauggcaccugcuggg

SEQ ID NO: 915044 - RNA, 22 nt, Human
ggcagaagauaggacagggaau

SEQ ID NO: 915045 - RNA, 22 nt, Human
ggugugucugccaggaacugca

SEQ ID NO: 915046 - RNA, 22 nt, Human
agauaucuccagugaugcucgu

SEQ ID NO: 915047 - RNA, 22 nt, Human
uagcgcaacugcagagaaguag

SEQ ID NO: 915048 - RNA, 22 nt, Human
uauuuagugauagaagcaagga

SEQ ID NO: 915049 - RNA, 22 nt, Human
acauguguuuuccuacuuauga

SEQ ID NO: 915050 - RNA, 22 nt, Human
acagagcaguaagaacacagcu

SEQ ID NO: 915051 - RNA, 22 nt, Human
uccucugcuccaggcuggacuu

SEQ ID NO: 915052 - RNA, 22 nt, Human
auugacaauguauuuguaucug

SEQ ID NO: 915053 - RNA, 21 nt, Human
ccauaauuuuguuucagaagu

SEQ ID NO: 915054 - RNA, 22 nt, Human
uccaggccacgaccuccuggau

SEQ ID NO: 915055 - RNA, 23 nt, Human
aaaugugagggaaaaucuuucug

SEQ ID NO: 915056 - RNA, 22 nt, Human
cauucacaaagcugauugaugg

SEQ ID NO: 915057 - RNA, 22 nt, Human
gagacagaguuucacucuuguu

SEQ ID NO: 915058 - RNA, 22 nt, Human
guacacauauauuaaaaauugu

SEQ ID NO: 915059 - RNA, 22 nt, Human
ucugccuggaugauggcagggc

SEQ ID NO: 915060 - RNA, 22 nt, Human
acugaggauggauaggucauau

SEQ ID NO: 915061 - RNA, 23 nt, Human
ucauguggaaaaggaucuggucu

SEQ ID NO: 915062 - RNA, 22 nt, Human
ggcuucuuccugugaacauguu

SEQ ID NO: 915063 - RNA, 22 nt, Human
cauggcagaaaccugagcugcu

SEQ ID NO: 915064 - RNA, 22 nt, Human
ccagggcagggaccacgugucu

SEQ ID NO: 915065 - RNA, 22 nt, Human
aggccacaagaacuaccccauc

SEQ ID NO: 915066 - RNA, 22 nt, Human
aaauucaauuaacuuucaugcu

SEQ ID NO: 915067 - RNA, 22 nt, Human
cucagaaagugacaggggggug

SEQ ID NO: 915068 - RNA, 22 nt, Human
gauuugucuaggucaugacuuu

SEQ ID NO: 915069 - RNA, 22 nt, Human
uccaugggaagauuuugagugg

SEQ ID NO: 915070 - RNA, 22 nt, Human
gcagugcucugccuauaaugga

SEQ ID NO: 915071 - RNA, 22 nt, Human
ucugccuggguguggagcagag

SEQ ID NO: 915072 - RNA, 22 nt, Human
uucuggagucccacagccaggg

SEQ ID NO: 915073 - RNA, 22 nt, Human
uggcugccaugacgccugggga

SEQ ID NO: 915074 - RNA, 22 nt, Human
acuuagaauuaaauauuuuugg

SEQ ID NO: 915075 - RNA, 22 nt, Human
augaggcauucacagaaggcac

SEQ ID NO: 915076 - RNA, 22 nt, Human
ugggaagggccgauggagccuc

SEQ ID NO: 915077 - RNA, 22 nt, Human
cacaggguuguucugaggauuc

SEQ ID NO: 915078 - RNA, 22 nt, Human
uguauuuucugaggagcauuag

SEQ ID NO: 915079 - RNA, 22 nt, Human
uuucaaaauuuugcagugguaa

SEQ ID NO: 915080 - RNA, 22 nt, Human
ucucuuugacccuuuagcucca

SEQ ID NO: 915081 - RNA, 22 nt, Human
gccaccagcagaaaaggggcca

SEQ ID NO: 915082 - RNA, 22 nt, Human
uuuuccaccuucuagagauugu

SEQ ID NO: 915083 - RNA, 22 nt, Human
guggcagauugcucaccauggu

SEQ ID NO: 915084 - RNA, 22 nt, Human
gacccuuuggagguagucacca

SEQ ID NO: 915085 - RNA, 22 nt, Human
agcuuguguuuuucuaaguauc

SEQ ID NO: 915086 - RNA, 22 nt, Human
ggagggugcagacccuuugcaa

SEQ ID NO: 915087 - RNA, 22 nt, Human
uuuucuauuaacucauuuugca

SEQ ID NO: 915088 - RNA, 22 nt, Human
aauuagcauuucccauauaaau

SEQ ID NO: 915089 - RNA, 21 nt, Human
uuagaagcuaaugcagcuggu

SEQ ID NO: 915090 - RNA, 22 nt, Human
aacacagaucaaaauauuuccu

SEQ ID NO: 915091 - RNA, 22 nt, Human
ugggccuguggggaucuugaag

SEQ ID NO: 915092 - RNA, 22 nt, Human
ucuugcagaggcacugugucag

SEQ ID NO: 915093 - RNA, 22 nt, Human
agggucaguucugugagguguu

SEQ ID NO: 915094 - RNA, 22 nt, Human
aaagguuuugcccuggguauuc

SEQ ID NO: 915095 - RNA, 22 nt, Human
caucaaauaggaauauuuggca

SEQ ID NO: 915096 - RNA, 21 nt, Human
gaaguucaugaucuuucugcu

SEQ ID NO: 915097 - RNA, 22 nt, Human
ucuucucuacaccagcagcccc

SEQ ID NO: 915098 - RNA, 22 nt, Human
uguugguuuaaaaugcugauuu

SEQ ID NO: 915099 - RNA, 22 nt, Human
cuggaggaccacagaagcuggu

SEQ ID NO: 915100 - RNA, 22 nt, Human
guuuauuggguauuguggagcc

SEQ ID NO: 915101 - RNA, 22 nt, Human
aggagaguaccauugggccgca

SEQ ID NO: 915102 - RNA, 22 nt, Human
cugcuugucuucgaggggugca

SEQ ID NO: 915103 - RNA, 22 nt, Human
caggggcagucugugugcgugg

SEQ ID NO: 915104 - RNA, 23 nt, Human
uuccagaggaagaagucaugacu

SEQ ID NO: 915105 - RNA, 22 nt, Human
ugucucuuguuaaugauuacua

SEQ ID NO: 915106 - RNA, 18 nt, Human
uggcagggaggaaauaua

SEQ ID NO: 915107 - RNA, 22 nt, Human
aggcagcuggaggcagagacua

SEQ ID NO: 915108 - RNA, 22 nt, Human
cagaccagaaggaagccgacaa

SEQ ID NO: 915109 - RNA, 22 nt, Human
uuucauuaaagucaaaucuggu

SEQ ID NO: 915110 - RNA, 22 nt, Human
aagccacuauggugauucucaa

SEQ ID NO: 915111 - RNA, 22 nt, Human
aaugaucauuauaaagugcucu

SEQ ID NO: 915112 - RNA, 22 nt, Human
ggccugagcuugggcagcguau

SEQ ID NO: 915113 - RNA, 22 nt, Human
ucaguguccaaaaagaggcaag

SEQ ID NO: 915114 - RNA, 22 nt, Human
uuggcuucaaugucagagacag

SEQ ID NO: 915115 - RNA, 22 nt, Human
aguuuucaguaaauauuaguga

SEQ ID NO: 915116 - RNA, 21 nt, Human
uuuaauuugcauguaugacgc

SEQ ID NO: 915117 - RNA, 22 nt, Human
cagacaguggacuugauaaagg

SEQ ID NO: 915118 - RNA, 22 nt, Human
ccugggcuuugcuggcaaggcc

SEQ ID NO: 915119 - RNA, 22 nt, Human
cccagccuggugcacugugggg

SEQ ID NO: 915120 - RNA, 22 nt, Human
ugucaucucacugauauagaug

SEQ ID NO: 915121 - RNA, 22 nt, Human
uacaccauucccagguggauuu

SEQ ID NO: 915122 - RNA, 22 nt, Human
ucuccagguaaauggcauccug

SEQ ID NO: 915123 - RNA, 22 nt, Human
ccagggcaauuauuuggagggu

SEQ ID NO: 915124 - RNA, 22 nt, Human
aaagguuaauguugucauguua

SEQ ID NO: 915125 - RNA, 22 nt, Human
uacacaguuccauuuaagccag

SEQ ID NO: 915126 - RNA, 22 nt, Human
uuuacccauauuagcaucaagu

SEQ ID NO: 915127 - RNA, 22 nt, Human
ugucaaaggguaagcuggauaa

SEQ ID NO: 915128 - RNA, 22 nt, Human
aguucuaauugcguuuucuugc

SEQ ID NO: 915129 - RNA, 22 nt, Human
uccugggauuugcccuuuucuc

SEQ ID NO: 915130 - RNA, 22 nt, Human
ggaaagaguuuugguauauuug

SEQ ID NO: 915131 - RNA, 22 nt, Human
uuuuccucuguaugcgugagau

SEQ ID NO: 915132 - RNA, 22 nt, Human
aaaugucuuucaauagagaaau

SEQ ID NO: 915133 - RNA, 20 nt, Human
ugggcucugcuuccuggagu

SEQ ID NO: 915134 - RNA, 23 nt, Human
ucagccucuuaggacuucucacc

SEQ ID NO: 915135 - RNA, 22 nt, Human
ccuggcucauuaugugccccca

SEQ ID NO: 915136 - RNA, 22 nt, Human
uggcaguucagguuggacucuu

SEQ ID NO: 915137 - RNA, 22 nt, Human
ccaggcuggagugcaauggugc

SEQ ID NO: 915138 - RNA, 22 nt, Human
caggggcuuuuccucuauaagg

SEQ ID NO: 915139 - RNA, 22 nt, Human
uaaacugaagcucaacucaaau

SEQ ID NO: 915140 - RNA, 22 nt, Human
cugggaccugugugccugggcc

SEQ ID NO: 915141 - RNA, 20 nt, Human
aacagugaaugaggccagag

SEQ ID NO: 915142 - RNA, 22 nt, Human
auuaauuuuaccuuuguaaaca

SEQ ID NO: 915143 - RNA, 22 nt, Human
acauuugucuucuuucagauua

SEQ ID NO: 915144 - RNA, 22 nt, Human
uuagcagcuaagucaugcugca

SEQ ID NO: 915145 - RNA, 22 nt, Human
ugguggagaccucgcuaacccc

SEQ ID NO: 915146 - RNA, 22 nt, Human
ugcuuaaagcugcucaguugua

SEQ ID NO: 915147 - RNA, 22 nt, Human
uugcucauuugccuuuagguuu

SEQ ID NO: 915148 - RNA, 22 nt, Human
auggcagcuuucauuguccaca

SEQ ID NO: 915149 - RNA, 22 nt, Human
cuagcuagcagcauuacaacaa

SEQ ID NO: 915150 - RNA, 23 nt, Human
ugcuccagccucuuugauagugu

SEQ ID NO: 915151 - RNA, 22 nt, Human
agcagggaggcggugugcuggc

SEQ ID NO: 915152 - RNA, 22 nt, Human
uuugggcucacuaugcugaaga

SEQ ID NO: 915153 - RNA, 22 nt, Human
ugcaguggaggccgugagacag

SEQ ID NO: 915154 - RNA, 22 nt, Human
gccaaaguccacuugcuuucug

SEQ ID NO: 915155 - RNA, 22 nt, Human
cagugcuuuucaaaguucuaug

SEQ ID NO: 915156 - RNA, 22 nt, Human
agggcuccuccccggccuccac

SEQ ID NO: 915157 - RNA, 22 nt, Human
acaaugcaauuguaaggugugu

SEQ ID NO: 915158 - RNA, 21 nt, Human
uggcagcacccacacccucug

SEQ ID NO: 915159 - RNA, 22 nt, Human
ucuagaaaaacaaaguaucuga

SEQ ID NO: 915160 - RNA, 22 nt, Human
ucggagcuguagaugaaacccu

SEQ ID NO: 915161 - RNA, 22 nt, Human
cugugcccuggccaggccucuc

SEQ ID NO: 915162 - RNA, 22 nt, Human
uucaguuucuaaagauguuccu

SEQ ID NO: 915163 - RNA, 22 nt, Human
agggcagcaaugcagcugcugc

SEQ ID NO: 915164 - RNA, 22 nt, Human
ugagugugaggugggagcuugg

SEQ ID NO: 915165 - RNA, 22 nt, Human
gacauuuagaaguuagauucaa

SEQ ID NO: 915166 - RNA, 22 nt, Human
uagggcuguggucaguccucua

SEQ ID NO: 915167 - RNA, 17 nt, Human
ucaggcugggugcagug

SEQ ID NO: 915168 - RNA, 22 nt, Human
cuaaaguccuuaucaaguguaa

SEQ ID NO: 915169 - RNA, 22 nt, Human
uuuuuccuaagcaguggagcug

SEQ ID NO: 915170 - RNA, 22 nt, Human
guauuuaauucugugcuucuag

SEQ ID NO: 915171 - RNA, 22 nt, Human
uucugaaauucgacuauccaau

SEQ ID NO: 915172 - RNA, 21 nt, Human
acacugcuguagcauauuggg

SEQ ID NO: 915173 - RNA, 22 nt, Human
cuggggcauugggagaggccug

SEQ ID NO: 915174 - RNA, 22 nt, Human
gagaggugaauguggaugccac

SEQ ID NO: 915175 - RNA, 22 nt, Human
ccaguggguaggccauggugag

SEQ ID NO: 915176 - RNA, 22 nt, Human
ugaaaccauucucagguacacu

SEQ ID NO: 915177 - RNA, 22 nt, Human
gcuaggugcagcagacagcuua

SEQ ID NO: 915178 - RNA, 22 nt, Human
ugugaauagauugaagcuuugg

SEQ ID NO: 915179 - RNA, 22 nt, Human
cuguuacauagcuuuucuuaac

SEQ ID NO: 915180 - RNA, 22 nt, Human
gcuuuggagggcaagagcuguu

SEQ ID NO: 915181 - RNA, 22 nt, Human
ccauccaggcugugggugagcu

SEQ ID NO: 915182 - RNA, 22 nt, Human
agggagugguuaagaaggugca

SEQ ID NO: 915183 - RNA, 22 nt, Human
cacagugcuguuuguaaagaga

SEQ ID NO: 915184 - RNA, 22 nt, Human
ugggauucaccaugggcuucag

SEQ ID NO: 915185 - RNA, 22 nt, Human
ugucucuuuggccucccauaug

SEQ ID NO: 915186 - RNA, 22 nt, Human
auuauuuacagugugcucgaag

SEQ ID NO: 915187 - RNA, 22 nt, Human
aaaguucuauuggauagugcug

SEQ ID NO: 915188 - RNA, 22 nt, Human
uuagacaggauguaugaaagcu

SEQ ID NO: 915189 - RNA, 22 nt, Human
gugauucugaccuucagggagu

SEQ ID NO: 915190 - RNA, 22 nt, Human
ucuggcucucucaucacccaau

SEQ ID NO: 915191 - RNA, 22 nt, Human
ucuaacuugugaguauagauga

SEQ ID NO: 915192 - RNA, 22 nt, Human
ucuucaugccaaaugaguuuug

SEQ ID NO: 915193 - RNA, 20 nt, Human
cugggaggucuuccaaauca

SEQ ID NO: 915194 - RNA, 22 nt, Human
ccaggcugcuuuauuacucugu

SEQ ID NO: 915195 - RNA, 22 nt, Human
gaagugaagagauuagaaauca

SEQ ID NO: 915196 - RNA, 21 nt, Human
agaagccuggggaauguggcu

SEQ ID NO: 915197 - RNA, 22 nt, Human
gcagaauacugagagcugauug

SEQ ID NO: 915198 - RNA, 22 nt, Human
aggggcaguuccaaguuuugug

SEQ ID NO: 915199 - RNA, 22 nt, Human
uacaugcaugauacaaaguugc

SEQ ID NO: 915200 - RNA, 22 nt, Human
cucagggcuggaaagccaggaa

SEQ ID NO: 915201 - RNA, 22 nt, Human
ucucccaagggcacauucaagg

SEQ ID NO: 915202 - RNA, 22 nt, Human
uuacaguauuggucacguuugu

SEQ ID NO: 915203 - RNA, 20 nt, Human
uggcucucacccugugcgau

SEQ ID NO: 915204 - RNA, 22 nt, Human
gagagccuuugaagggaaguga

SEQ ID NO: 915205 - RNA, 22 nt, Human
ggcuugaucacauaggucuccc

SEQ ID NO: 915206 - RNA, 22 nt, Human
aagaaucaucugaacuuugagg

SEQ ID NO: 915207 - RNA, 22 nt, Human
ccaggccccagggcuggcuuuc

SEQ ID NO: 915208 - RNA, 20 nt, Human
ucugugugccaucaccuaac

SEQ ID NO: 915209 - RNA, 22 nt, Human
uacacagaaccugguguacagu

SEQ ID NO: 915210 - RNA, 22 nt, Human
agaggggcagggucuccggauu

SEQ ID NO: 915211 - RNA, 22 nt, Human
uaggaaugauuggaauuccagg

SEQ ID NO: 915212 - RNA, 20 nt, Human
gacauucauaguuauuacca

SEQ ID NO: 915213 - RNA, 23 nt, Human
gccuuggcgauccguggggcauc

SEQ ID NO: 915214 - RNA, 22 nt, Human
uacaauguucgcauucucucug

SEQ ID NO: 915215 - RNA, 22 nt, Human
gaacacauuagucugaguuggc

SEQ ID NO: 915216 - RNA, 22 nt, Human
uucaacauagcugaggcauaua

SEQ ID NO: 915217 - RNA, 22 nt, Human
uccugcuuugugccucacacuu

SEQ ID NO: 915218 - RNA, 22 nt, Human
ucacagaagggaaagaugccaa

SEQ ID NO: 915219 - RNA, 22 nt, Human
gcagugccuugcuucucugucu

SEQ ID NO: 915220 - RNA, 22 nt, Human
ucagugcuugccucuggaggag

SEQ ID NO: 915221 - RNA, 22 nt, Human
cucuuauagacacucuucuaua

SEQ ID NO: 915222 - RNA, 22 nt, Human
accacaggguaaaguuagauau

SEQ ID NO: 915223 - RNA, 22 nt, Human
guuuccuguggccacagaauaa

SEQ ID NO: 915224 - RNA, 22 nt, Human
agucagagaauguuuucaugga

SEQ ID NO: 915225 - RNA, 22 nt, Human
ccaucauuugauacagcugucu

SEQ ID NO: 915226 - RNA, 22 nt, Human
cuuuauggaaucaaagacugga

SEQ ID NO: 915227 - RNA, 22 nt, Human
aaaugucuacuucccaucugua

SEQ ID NO: 915228 - RNA, 22 nt, Human
guguguguaucugccuaucaca

SEQ ID NO: 915229 - RNA, 22 nt, Human
gcacagggagacagccguggcc

SEQ ID NO: 915230 - RNA, 22 nt, Human
aaaaugaugcuguaauuuggca

SEQ ID NO: 915231 - RNA, 22 nt, Human
gcuugcugaacaggaaccuggc

SEQ ID NO: 915232 - RNA, 22 nt, Human
uagcaucuguuucucuuuguga

SEQ ID NO: 915233 - RNA, 22 nt, Human
uuauagcaggugacuaaugagu

SEQ ID NO: 915234 - RNA, 22 nt, Human
cucugcaguguaacagcgcuug

SEQ ID NO: 915235 - RNA, 22 nt, Human
agcuuuauagaaaggaucagug

SEQ ID NO: 915236 - RNA, 22 nt, Human
caugucagggaagagagucagu

SEQ ID NO: 915237 - RNA, 20 nt, Human
uggccuuggggagcucacac

SEQ ID NO: 915238 - RNA, 22 nt, Human
uugcaaagaauuuuacauucua

SEQ ID NO: 915239 - RNA, 22 nt, Human
aagcauggccucuccgcucccc

SEQ ID NO: 915240 - RNA, 22 nt, Human
ugaguuaucuaaaauagucaaa

SEQ ID NO: 915241 - RNA, 18 nt, Human
guuaauuuugaaguucau

SEQ ID NO: 915242 - RNA, 22 nt, Human
uggaacaauucuugaagggaau

SEQ ID NO: 915243 - RNA, 22 nt, Human
ugcuggcuguguaccaucucaa

SEQ ID NO: 915244 - RNA, 21 nt, Human
ggccaacauggucucaucucu

SEQ ID NO: 915245 - RNA, 22 nt, Human
aguggcuuuucuugcuucuggc

SEQ ID NO: 915246 - RNA, 22 nt, Human
uuucacagguaagcaauacagg

SEQ ID NO: 915247 - RNA, 22 nt, Human
uggcagggccugaaucuuauac

SEQ ID NO: 915248 - RNA, 22 nt, Human
acagaggucauggagaguucuc

SEQ ID NO: 915249 - RNA, 22 nt, Human
gcugcuggcacuggagugagcc

SEQ ID NO: 915250 - RNA, 22 nt, Human
cucagggcuugaguguccagga

SEQ ID NO: 915251 - RNA, 22 nt, Human
aacagcuaccuucucacugugc

SEQ ID NO: 915252 - RNA, 22 nt, Human
caccaggaccccacgguggguu

SEQ ID NO: 915253 - RNA, 22 nt, Human
uuagaaccauaaugaaucaaug

SEQ ID NO: 915254 - RNA, 20 nt, Human
uguccaggggaucguuggcc

SEQ ID NO: 915255 - RNA, 22 nt, Human
caagcugguaucagcuagagcg

SEQ ID NO: 915256 - RNA, 22 nt, Human
caaggcugcugcgggucgcacc

SEQ ID NO: 915257 - RNA, 22 nt, Human
augucaguuucauuuuaaguca

SEQ ID NO: 915258 - RNA, 23 nt, Human
ugauucagcaaguccacuucugg

SEQ ID NO: 915259 - RNA, 22 nt, Human
cuuggcacuugggcagugagca

SEQ ID NO: 915260 - RNA, 22 nt, Human
guguguauguagaacuauguau

SEQ ID NO: 915261 - RNA, 19 nt, Human
cgguccauccgauuuuaca

SEQ ID NO: 915262 - RNA, 22 nt, Human
aauacauguuuucuacuauucu

SEQ ID NO: 915263 - RNA, 22 nt, Human
uauuuuguuuuguauccacugu

SEQ ID NO: 915264 - RNA, 22 nt, Human
agcuguuuuuccagucucugga

SEQ ID NO: 915265 - RNA, 22 nt, Human
guggccagaagacugcaaugcu

SEQ ID NO: 915266 - RNA, 17 nt, Human
caggcagacauguaagc

SEQ ID NO: 915267 - RNA, 22 nt, Human
ggaagaaaucugguuaagagau

SEQ ID NO: 915268 - RNA, 22 nt, Human
augcuauuccagaauguaaauu

SEQ ID NO: 915269 - RNA, 22 nt, Human
cuccaggaaaauagggaaugag

SEQ ID NO: 915270 - RNA, 22 nt, Human
ugcuucauuuugacuuagccag

SEQ ID NO: 915271 - RNA, 22 nt, Human
ugcagccugguggucacuggag

SEQ ID NO: 915272 - RNA, 22 nt, Human
ccugagcucaaagggugccugg

SEQ ID NO: 915273 - RNA, 22 nt, Human
ccauucugugucucuccacagc

SEQ ID NO: 915274 - RNA, 22 nt, Human
ugcagcuagcgugccuagugaa

SEQ ID NO: 915275 - RNA, 22 nt, Human
cagacugugagcuccuugaggg

SEQ ID NO: 915276 - RNA, 21 nt, Human
cugcaucugagucauuaugcc

SEQ ID NO: 915277 - RNA, 22 nt, Human
uuucuuuaauucucacagcaau

SEQ ID NO: 915278 - RNA, 22 nt, Human
auauggacuuaaaauuugaugu

SEQ ID NO: 915279 - RNA, 22 nt, Human
uuuguucuauuuuagagaugaa

SEQ ID NO: 915280 - RNA, 22 nt, Human
uucgcagccagugagcagagga

SEQ ID NO: 915281 - RNA, 20 nt, Human
ccauucugggugcagucugg

SEQ ID NO: 915282 - RNA, 20 nt, Human
cagcugccuggcucugggau

SEQ ID NO: 915283 - RNA, 22 nt, Human
auuuccaugaaguuuaguuaua

SEQ ID NO: 915284 - RNA, 22 nt, Human
uuuugcuuaaucuagauuuugc

SEQ ID NO: 915285 - RNA, 22 nt, Human
ccucaugaguucuucugcccau

SEQ ID NO: 915286 - RNA, 22 nt, Human
aaacucagaagguacagaaggg

SEQ ID NO: 915287 - RNA, 22 nt, Human
uauuucagaguuguuuucuguc

SEQ ID NO: 915288 - RNA, 22 nt, Human
cugccagcacugccuccugagg

SEQ ID NO: 915289 - RNA, 22 nt, Human
ugguggagcuguggccacgacc

SEQ ID NO: 915290 - RNA, 22 nt, Human
ucacccagguaauagcaguuug

SEQ ID NO: 915291 - RNA, 22 nt, Human
gaaaggcaggcaggguguccau

SEQ ID NO: 915292 - RNA, 20 nt, Human
gggcuagaccagggcagagg

SEQ ID NO: 915293 - RNA, 22 nt, Human
ucuucacaguccuggucagugg

SEQ ID NO: 915294 - RNA, 17 nt, Human
cagaggagcuuuggggg

SEQ ID NO: 915295 - RNA, 22 nt, Human
aagucuuuugcuaagaguaaug

SEQ ID NO: 915296 - RNA, 22 nt, Human
agugacaauaugugcuagguau

SEQ ID NO: 915297 - RNA, 22 nt, Human
ucccuggguuaccuuucaaggu

SEQ ID NO: 915298 - RNA, 22 nt, Human
aguaacaaagaaagccuuugga

SEQ ID NO: 915299 - RNA, 22 nt, Human
aggcuuccgaguagcugggacu

SEQ ID NO: 915300 - RNA, 23 nt, Human
auugagaaggauacauuguucuc

SEQ ID NO: 915301 - RNA, 22 nt, Human
ucauaacacuggugauuaagaa

SEQ ID NO: 915302 - RNA, 22 nt, Human
ugagcuggcacuuuuccuggga

SEQ ID NO: 915303 - RNA, 22 nt, Human
agucaccaacaugguucccagg

SEQ ID NO: 915304 - RNA, 22 nt, Human
aguuugaagauuaugccagagu

SEQ ID NO: 915305 - RNA, 22 nt, Human
ggcucugggaaauggucuuccu

SEQ ID NO: 915306 - RNA, 22 nt, Human
gccugggugcucuguguaaggg

SEQ ID NO: 915307 - RNA, 22 nt, Human
gaggcugugucuugggguggaa

SEQ ID NO: 915308 - RNA, 22 nt, Human
gccacagcuuuuaaccucgggg

SEQ ID NO: 915309 - RNA, 22 nt, Human
gcugcuguguuggagagggacu

SEQ ID NO: 915310 - RNA, 22 nt, Human
uggaagggggaagacagcucug

SEQ ID NO: 915311 - RNA, 20 nt, Human
ugacucuggucccaguauga

SEQ ID NO: 915312 - RNA, 22 nt, Human
gcuguggguuuccaauccugga

SEQ ID NO: 915313 - RNA, 22 nt, Human
aggcagguuacaaaaacuuuau

SEQ ID NO: 915314 - RNA, 22 nt, Human
uaggugugggcucaggaaugug

SEQ ID NO: 915315 - RNA, 22 nt, Human
cccaugagugcugcucagaggc

SEQ ID NO: 915316 - RNA, 22 nt, Human
caaauguauaaauguacuuucu

SEQ ID NO: 915317 - RNA, 22 nt, Human
auacaucaauuucuuaguuauc

SEQ ID NO: 915318 - RNA, 22 nt, Human
gggcccagcccucugcucacug

SEQ ID NO: 915319 - RNA, 22 nt, Human
uagacauuggccauuccugugg

SEQ ID NO: 915320 - RNA, 22 nt, Human
gggcuucaguaccaaaguuuga

SEQ ID NO: 915321 - RNA, 22 nt, Human
ggugcaggcgguggggcaagua

SEQ ID NO: 915322 - RNA, 22 nt, Human
augaagcagacucagguggugc

SEQ ID NO: 915323 - RNA, 22 nt, Human
gcacugcuccagguguggcuug

SEQ ID NO: 915324 - RNA, 22 nt, Human
aaggcuccuuuguaguucuuuu

SEQ ID NO: 915325 - RNA, 22 nt, Human
cauggccacaucuagcugcaag

SEQ ID NO: 915326 - RNA, 22 nt, Human
ugaaggugaccugacaguggcu

SEQ ID NO: 915327 - RNA, 22 nt, Human
ucugaaauaagggagaagggaa

SEQ ID NO: 915328 - RNA, 22 nt, Human
ggagagguguauucaguggguc

SEQ ID NO: 915329 - RNA, 22 nt, Human
gagcugugugccuggauggucu

SEQ ID NO: 915330 - RNA, 22 nt, Human
ucuauguauaucuuuccauuca

SEQ ID NO: 915331 - RNA, 22 nt, Human
uuuagcauccaagguuaugacu

SEQ ID NO: 915332 - RNA, 22 nt, Human
ccagccacagcuuccagcuccu

SEQ ID NO: 915333 - RNA, 19 nt, Human
aaggcagaaguuggauaug

SEQ ID NO: 915334 - RNA, 22 nt, Human
acagaggaagcauauagcacaa

SEQ ID NO: 915335 - RNA, 22 nt, Human
augcagagacagauguggcaug

SEQ ID NO: 915336 - RNA, 22 nt, Human
aacagugucaggauuacagaua

SEQ ID NO: 915337 - RNA, 22 nt, Human
ugggcccaagagagucuccaac

SEQ ID NO: 915338 - RNA, 22 nt, Human
acacauguuuguguagucaguu

SEQ ID NO: 915339 - RNA, 22 nt, Human
auuucccacucuacuacaugcu

SEQ ID NO: 915340 - RNA, 22 nt, Human
ugccucuguugagccuuggcug

SEQ ID NO: 915341 - RNA, 22 nt, Human
gcuuugcauuguuuaaucagga

SEQ ID NO: 915342 - RNA, 22 nt, Human
cuggcugcgcuaguccagaaga

SEQ ID NO: 915343 - RNA, 20 nt, Human
ucacagaguagccuugucug

SEQ ID NO: 915344 - RNA, 20 nt, Human
cugcugugugugccucagcc

SEQ ID NO: 915345 - RNA, 22 nt, Human
ucagaccuggccgccuccaucc

SEQ ID NO: 915346 - RNA, 22 nt, Human
uagagcugggcagugcucugag

SEQ ID NO: 915347 - RNA, 22 nt, Human
cacaguugucugauuucuuccu

SEQ ID NO: 915348 - RNA, 22 nt, Human
ccuggcagacagcacugaagcu

SEQ ID NO: 915349 - RNA, 22 nt, Human
cugggacuugaugaaaugacug

SEQ ID NO: 915350 - RNA, 22 nt, Human
uaagaggauauuuggccagaag

SEQ ID NO: 915351 - RNA, 22 nt, Human
uuaaagcuguagaguuacuugc

SEQ ID NO: 915352 - RNA, 22 nt, Human
ccugggcucuauccugacccag

SEQ ID NO: 915353 - RNA, 22 nt, Human
uaagacauuugacaaaccauuu

SEQ ID NO: 915354 - RNA, 22 nt, Human
ggcagccaugucccagggcuuc

SEQ ID NO: 915355 - RNA, 22 nt, Human
auuggugcauguaggugaugcu

SEQ ID NO: 915356 - RNA, 22 nt, Human
acaacuuuguagcaauuccacg

SEQ ID NO: 915357 - RNA, 22 nt, Human
ucccauuuaucuagaugucaga

SEQ ID NO: 915358 - RNA, 22 nt, Human
ccucugggagacugcuacugag

SEQ ID NO: 915359 - RNA, 22 nt, Human
ugguugaacaaguuggguauau

SEQ ID NO: 915360 - RNA, 22 nt, Human
aucacugaaauacugaaauuac

SEQ ID NO: 915361 - RNA, 22 nt, Human
cuggcagcagcuucuggaucga

SEQ ID NO: 915362 - RNA, 22 nt, Human
uccagagguauguagagaguau

SEQ ID NO: 915363 - RNA, 22 nt, Human
uguauacauguguguucacgca

SEQ ID NO: 915364 - RNA, 22 nt, Human
caaauguuugguggcauuuugu

SEQ ID NO: 915365 - RNA, 22 nt, Human
auuuucaguugaaaaaguuggu

SEQ ID NO: 915366 - RNA, 22 nt, Human
guauuucccccagacucccugg

SEQ ID NO: 915367 - RNA, 22 nt, Human
gggaaauuuuagguuugucucg

SEQ ID NO: 915368 - RNA, 22 nt, Human
ucacuccaaaccccaggcuugu

SEQ ID NO: 915369 - RNA, 22 nt, Human
aguacuuagaaaguuaauauaa

SEQ ID NO: 915370 - RNA, 22 nt, Human
caguuuaaccuauccauuaugu

SEQ ID NO: 915371 - RNA, 22 nt, Human
aaaacauucugugaacucucaa

SEQ ID NO: 915372 - RNA, 22 nt, Human
agagaagugagcuuguucacuc

SEQ ID NO: 915373 - RNA, 20 nt, Human
cucagaaaagcuaaggagaa

SEQ ID NO: 915374 - RNA, 22 nt, Human
gggaaggccgguccagucaggu

SEQ ID NO: 915375 - RNA, 22 nt, Human
ucagaggauagaaauacuuauu

SEQ ID NO: 915376 - RNA, 22 nt, Human
gcuggccauauauuuugcuguu

SEQ ID NO: 915377 - RNA, 22 nt, Human
auuuccuucaucagccuauccu

SEQ ID NO: 915378 - RNA, 22 nt, Human
uuacagaaugugccauuugguc

SEQ ID NO: 915379 - RNA, 22 nt, Human
guucuggguagauguaucuuuu

SEQ ID NO: 915380 - RNA, 22 nt, Human
uugagcaggaacuagaagauag

SEQ ID NO: 915381 - RNA, 22 nt, Human
ugucagcaccauggguagugau

SEQ ID NO: 915382 - RNA, 22 nt, Human
ugcaucacuuagcugcacaacu

SEQ ID NO: 915383 - RNA, 22 nt, Human
gccuucccucucauccugcugg

SEQ ID NO: 915384 - RNA, 22 nt, Human
guuuuucugugagcgguaaagg

SEQ ID NO: 915385 - RNA, 22 nt, Human
caguaacacaaccacuccguga

SEQ ID NO: 915386 - RNA, 22 nt, Human
ccauuugugguuuauuugcucu

SEQ ID NO: 915387 - RNA, 22 nt, Human
acuguucuucauuuagcaaaga

SEQ ID NO: 915388 - RNA, 22 nt, Human
ggugcccagagccaggaaugag

SEQ ID NO: 915389 - RNA, 22 nt, Human
cacauaaauggugccauguuuu

SEQ ID NO: 915390 - RNA, 22 nt, Human
gccagcuguuucagagcccagu

SEQ ID NO: 915391 - RNA, 20 nt, Human
ucugaggcugagcucuacuu

SEQ ID NO: 915392 - RNA, 22 nt, Human
ucaggcugaaaggacuccaguu

SEQ ID NO: 915393 - RNA, 22 nt, Human
cuugaaaauaagaaagacuuuc

SEQ ID NO: 915394 - RNA, 22 nt, Human
uucuucagugacaaaggcaaaa

SEQ ID NO: 915395 - RNA, 22 nt, Human
uauaaguaguuguugaagacuu

SEQ ID NO: 915396 - RNA, 22 nt, Human
cacauaaucaccaaguccuuuc

SEQ ID NO: 915397 - RNA, 19 nt, Human
aagggucacaagcagcaga

SEQ ID NO: 915398 - RNA, 22 nt, Human
ucacaacaggaaggaccagcug

SEQ ID NO: 915399 - RNA, 22 nt, Human
gggaaauugugugagaucuuug

SEQ ID NO: 915400 - RNA, 22 nt, Human
uguuugugcugccuggugggca

SEQ ID NO: 915401 - RNA, 22 nt, Human
uguuaccaaggcugcuucuagu

SEQ ID NO: 915402 - RNA, 22 nt, Human
uuucaguguaucuuccaaaagc

SEQ ID NO: 915403 - RNA, 22 nt, Human
aguuuucuuucgcaaagguaca

SEQ ID NO: 915404 - RNA, 22 nt, Human
uacaaagugcuuuagaaaugaa

SEQ ID NO: 915405 - RNA, 22 nt, Human
cucuuuccucagccacagucua

SEQ ID NO: 915406 - RNA, 22 nt, Human
gugccucagcaccgccugcagc

SEQ ID NO: 915407 - RNA, 22 nt, Human
aacugaggccaagugaggaaag

SEQ ID NO: 915408 - RNA, 22 nt, Human
caggcugugaaacugagaugcg

SEQ ID NO: 915409 - RNA, 22 nt, Human
uaaaguuuggcagacaauaaca

SEQ ID NO: 915410 - RNA, 22 nt, Human
cugcagcuguagaggacagugg

SEQ ID NO: 915411 - RNA, 22 nt, Human
cauaauccugguguagcccucu

SEQ ID NO: 915412 - RNA, 22 nt, Human
uuugaaacaggugauucagcua

SEQ ID NO: 915413 - RNA, 22 nt, Human
aacaguaguauuuaaacugaac

SEQ ID NO: 915414 - RNA, 22 nt, Human
augucucucucugagugccaga

SEQ ID NO: 915415 - RNA, 22 nt, Human
cagaagcaagagccggagcuag

SEQ ID NO: 915416 - RNA, 22 nt, Human
aggcagugagaaauagcaagau

SEQ ID NO: 915417 - RNA, 22 nt, Human
cuauuaaacacuacugugcacu

SEQ ID NO: 915418 - RNA, 22 nt, Human
agggaugggaacuccuccagca

SEQ ID NO: 915419 - RNA, 22 nt, Human
auuaucagaaauucaaagggug

SEQ ID NO: 915420 - RNA, 22 nt, Human
aguugagggugggagagaaaug

SEQ ID NO: 915421 - RNA, 22 nt, Human
uauagacaagcguaacaagaag

SEQ ID NO: 915422 - RNA, 22 nt, Human
cacaggccugggguugagcggg

SEQ ID NO: 915423 - RNA, 22 nt, Human
agcccccaaaagugcuuaugau

SEQ ID NO: 915424 - RNA, 22 nt, Human
ugggccagcacugggugcucau

SEQ ID NO: 915425 - RNA, 22 nt, Human
auccccagggagugagcugucu

SEQ ID NO: 915426 - RNA, 18 nt, Human
gcccugguggagcuggug

SEQ ID NO: 915427 - RNA, 22 nt, Human
caccucugcuguccacaggaug

SEQ ID NO: 915428 - RNA, 21 nt, Human
acacccacuuaugcccgcuug

SEQ ID NO: 915429 - RNA, 22 nt, Human
aauagcaaaugcucauuugaaa

SEQ ID NO: 915430 - RNA, 22 nt, Human
agugcauuugggguaguggaag

SEQ ID NO: 915431 - RNA, 22 nt, Human
gaccuucaagcaccauauuuau

SEQ ID NO: 915432 - RNA, 21 nt, Human
ucaggaaacaccucuuaagga

SEQ ID NO: 915433 - RNA, 22 nt, Human
agcguguggagaacuaagcaga

SEQ ID NO: 915434 - RNA, 22 nt, Human
ugucaauaacuggagucauuau

SEQ ID NO: 915435 - RNA, 22 nt, Human
agaaggaaacagcugugcuuug

SEQ ID NO: 915436 - RNA, 22 nt, Human
ugaggccagacugaaaccaaca

SEQ ID NO: 915437 - RNA, 22 nt, Human
aagauucucagagugaaagaau

SEQ ID NO: 915438 - RNA, 22 nt, Human
ugauugacuuuagaauagcacu

SEQ ID NO: 915439 - RNA, 22 nt, Human
uggcugccugaucgagcaggug

SEQ ID NO: 915440 - RNA, 22 nt, Human
gggcucugcgcucagcuccagc

SEQ ID NO: 915441 - RNA, 22 nt, Human
cagggacaugacuggucucugu

SEQ ID NO: 915442 - RNA, 22 nt, Human
gugcuggggagauaggaagaga

SEQ ID NO: 915443 - RNA, 21 nt, Human
auuuccaaauaaggucacauu

SEQ ID NO: 915444 - RNA, 22 nt, Human
accugcagccacuucucuccuu

SEQ ID NO: 915445 - RNA, 22 nt, Human
ucucuugaagauugaagacaaa

SEQ ID NO: 915446 - RNA, 22 nt, Human
auguagcaugcauguuguuuug

SEQ ID NO: 915447 - RNA, 23 nt, Human
aaucagugcaguuuuaugccaag

SEQ ID NO: 915448 - RNA, 22 nt, Human
auuucuuacauaacaaauuguu

SEQ ID NO: 915449 - RNA, 22 nt, Human
uuuagacaagauccuucugaau

SEQ ID NO: 915450 - RNA, 22 nt, Human
cugccaggggccucacaggcca

SEQ ID NO: 915451 - RNA, 22 nt, Human
aucuagaggcaaugaaggaggu

SEQ ID NO: 915452 - RNA, 22 nt, Human
cucuuuggcccccgaugauuca

SEQ ID NO: 915453 - RNA, 22 nt, Human
augcaaaaguaauugcaauuuu

SEQ ID NO: 915454 - RNA, 22 nt, Human
acuugccuguuacauuucuagu

SEQ ID NO: 915455 - RNA, 22 nt, Human
gagguggcugggaguagggaau

SEQ ID NO: 915456 - RNA, 23 nt, Human
caaauguaguguguccaccccug

SEQ ID NO: 915457 - RNA, 21 nt, Human
aggaaguggccagauugggaa

SEQ ID NO: 915458 - RNA, 22 nt, Human
ugggggagagaggcauucuuuc

SEQ ID NO: 915459 - RNA, 21 nt, Human
agcugcuccagggagcucagg

SEQ ID NO: 915460 - RNA, 22 nt, Human
acagcacuggucccgcaagccu

SEQ ID NO: 915461 - RNA, 22 nt, Human
aguaaaaauugaggugcaaaau

SEQ ID NO: 915462 - RNA, 22 nt, Human
uguccugggaaaucccuuaggc

SEQ ID NO: 915463 - RNA, 22 nt, Human
uggagagcgugcuuagcacucu

SEQ ID NO: 915464 - RNA, 20 nt, Human
uagagcuuagguuuuauucu

SEQ ID NO: 915465 - RNA, 22 nt, Human
acacaggacagggauguguuuu

SEQ ID NO: 915466 - RNA, 22 nt, Human
guaguacagugagacaauguuu

SEQ ID NO: 915467 - RNA, 23 nt, Human
aaccuagacuacuuacuaugugg

SEQ ID NO: 915468 - RNA, 22 nt, Human
uaucuuuguaucaaucuccauu

SEQ ID NO: 915469 - RNA, 22 nt, Human
agauaaaaugauuuucuggauc

SEQ ID NO: 915470 - RNA, 22 nt, Human
cccaggagguggagguugcagc

SEQ ID NO: 915471 - RNA, 22 nt, Human
uggagaaggggcagggucucca

SEQ ID NO: 915472 - RNA, 22 nt, Human
gcugcccagggcugaguguccu

SEQ ID NO: 915473 - RNA, 22 nt, Human
cuggcuggucaucagcaguacg

SEQ ID NO: 915474 - RNA, 22 nt, Human
ugaaacaaugugaaguugcuga

SEQ ID NO: 915475 - RNA, 22 nt, Human
cuucuccucugaguccugggag

SEQ ID NO: 915476 - RNA, 22 nt, Human
gaguucuauuaugguuagaagu

SEQ ID NO: 915477 - RNA, 22 nt, Human
aacauucaauugaggaaguuaa

SEQ ID NO: 915478 - RNA, 22 nt, Human
aucuguggcuggugagaggcag

SEQ ID NO: 915479 - RNA, 19 nt, Human
ucuguggcaccugggaggg

SEQ ID NO: 915480 - RNA, 22 nt, Human
cacaguugaggucugguuguuu

SEQ ID NO: 915481 - RNA, 22 nt, Human
ucuguuuaggcaaaauagcuac

SEQ ID NO: 915482 - RNA, 22 nt, Human
agagcugggaccgucuggaagu

SEQ ID NO: 915483 - RNA, 22 nt, Human
guugcugcaaaggaguguaggu

SEQ ID NO: 915484 - RNA, 18 nt, Human
gcugcgugggaugugacc

SEQ ID NO: 915485 - RNA, 22 nt, Human
uauaggaccgacuuguuuauag

SEQ ID NO: 915486 - RNA, 22 nt, Human
ccuccuggugggcgcuucuggc

SEQ ID NO: 915487 - RNA, 22 nt, Human
gauuuugucaaauuccaaaugu

SEQ ID NO: 915488 - RNA, 22 nt, Human
aagcugccuagaguugaauguc

SEQ ID NO: 915489 - RNA, 22 nt, Human
gucaugaaauucuagagcuuga

SEQ ID NO: 915490 - RNA, 23 nt, Human
auugagcuaguaauauagaccag

SEQ ID NO: 915491 - RNA, 22 nt, Human
acacagaagcuuuuucuauucc

SEQ ID NO: 915492 - RNA, 22 nt, Human
acacagaggcaugacaguggcu

SEQ ID NO: 915493 - RNA, 22 nt, Human
acucugcucuuauaguguuaua

SEQ ID NO: 915494 - RNA, 22 nt, Human
uaagugucuaaaaggcagaacu

SEQ ID NO: 915495 - RNA, 22 nt, Human
guacagagguugcuggaggcuc

SEQ ID NO: 915496 - RNA, 20 nt, Human
gcugaggggucuauggcaua

SEQ ID NO: 915497 - RNA, 22 nt, Human
gacagcagaugaagccugcaga

SEQ ID NO: 915498 - RNA, 22 nt, Human
auuacaguaacagcuacaaugc

SEQ ID NO: 915499 - RNA, 22 nt, Human
cagaggauucccuagugaccug

SEQ ID NO: 915500 - RNA, 22 nt, Human
ugagcagauuuguucuaggggu

SEQ ID NO: 915501 - RNA, 22 nt, Human
guuucaaaagucaggcuauucu

SEQ ID NO: 915502 - RNA, 22 nt, Human
cugcaagauuggaagaugcaau

SEQ ID NO: 915503 - RNA, 22 nt, Human
uacuucauuauucuaguuuuga

SEQ ID NO: 915504 - RNA, 22 nt, Human
aaaguguugaagaaaauguuca

SEQ ID NO: 915505 - RNA, 22 nt, Human
ucugggagcacacgcagugauc

SEQ ID NO: 915506 - RNA, 22 nt, Human
aaggcaauuuggaagaggcaga

SEQ ID NO: 915507 - RNA, 22 nt, Human
cugcguguuccugaagcgcgcu

SEQ ID NO: 915508 - RNA, 22 nt, Human
aguuacaagcuauuuuacuuaa

SEQ ID NO: 915509 - RNA, 22 nt, Human
acuuuggacgccaugcuguuug

SEQ ID NO: 915510 - RNA, 22 nt, Human
uaagagcauaggcuugaaaaua

SEQ ID NO: 915511 - RNA, 22 nt, Human
uucucaggugaggcugaggcug

SEQ ID NO: 915512 - RNA, 22 nt, Human
ucuguccauuuauaagccccca

SEQ ID NO: 915513 - RNA, 22 nt, Human
augcuacagagauagguugggu

SEQ ID NO: 915514 - RNA, 22 nt, Human
agucccagaugacccagcuacu

SEQ ID NO: 915515 - RNA, 22 nt, Human
gccuggagggcucuagagaggc

SEQ ID NO: 915516 - RNA, 22 nt, Human
gcuuuaugggccaugcgguguc

SEQ ID NO: 915517 - RNA, 22 nt, Human
caagguuuugcuuguaagggaa

SEQ ID NO: 915518 - RNA, 22 nt, Human
ggcuggcuccaccuagguagcu

SEQ ID NO: 915519 - RNA, 22 nt, Human
aaagccaugaauguuauagagg

SEQ ID NO: 915520 - RNA, 22 nt, Human
gagaggcauggaacagauucuu

SEQ ID NO: 915521 - RNA, 21 nt, Human
gcugucucuggcuccugggaa

SEQ ID NO: 915522 - RNA, 22 nt, Human
ucacagaaguugaauuugcaug

SEQ ID NO: 915523 - RNA, 22 nt, Human
ggaaccuugcuagaugcugagg

SEQ ID NO: 915524 - RNA, 22 nt, Human
gcuggcucaagugugcuuccca

SEQ ID NO: 915525 - RNA, 22 nt, Human
uuuguuuagaugguaaaucagu

SEQ ID NO: 915526 - RNA, 22 nt, Human
augucacaugagagcgcagcac

SEQ ID NO: 915527 - RNA, 22 nt, Human
gcccauggcagaacugugagca

SEQ ID NO: 915528 - RNA, 22 nt, Human
gacaguaagguggcuucuucuu

SEQ ID NO: 915529 - RNA, 22 nt, Human
ucuggguguagggccuggcaac

SEQ ID NO: 915530 - RNA, 22 nt, Human
ugaaccuuuguguuggaccugg

SEQ ID NO: 915531 - RNA, 22 nt, Human
gggagggaagguaccuguguga

SEQ ID NO: 915532 - RNA, 22 nt, Human
uucuauguggauauagaacugc

SEQ ID NO: 915533 - RNA, 22 nt, Human
cuggggcugugggagacaaggc

SEQ ID NO: 915534 - RNA, 22 nt, Human
caaggccaugagcagcgagugu

SEQ ID NO: 915535 - RNA, 22 nt, Human
ugcagccaccaccucugcugaa

SEQ ID NO: 915536 - RNA, 22 nt, Human
uuucagaaauuauauuagaugc

SEQ ID NO: 915537 - RNA, 20 nt, Human
gugggcagaugugugcaugg

SEQ ID NO: 915538 - RNA, 22 nt, Human
gcuggaacagucuuuaagcagg

SEQ ID NO: 915539 - RNA, 22 nt, Human
uuuauccauugguuagaaaauc

SEQ ID NO: 915540 - RNA, 22 nt, Human
guauuuuguuagggugugguau

SEQ ID NO: 915541 - RNA, 22 nt, Human
uggggaccagauuagaccaugg

SEQ ID NO: 915542 - RNA, 22 nt, Human
gagcagaacaggccggguggga

SEQ ID NO: 915543 - RNA, 22 nt, Human
cuuggggaggacgcaguguccu

SEQ ID NO: 915544 - RNA, 22 nt, Human
uuacacucauauugcacuuacc

SEQ ID NO: 915545 - RNA, 22 nt, Human
acucugaaccagagaucauacc

SEQ ID NO: 915546 - RNA, 22 nt, Human
cuguuuaaccagaucucauauc

SEQ ID NO: 915547 - RNA, 22 nt, Human
agcacagaguugcagagagcgu

SEQ ID NO: 915548 - RNA, 17 nt, Human
ccagcccucgcgcuuuu

SEQ ID NO: 915549 - RNA, 22 nt, Human
cgaaaauagaucuguuucccag

SEQ ID NO: 915550 - RNA, 22 nt, Human
agagagcccgggccagggcaca

SEQ ID NO: 915551 - RNA, 22 nt, Human
aagauacaucauucaggaguga

SEQ ID NO: 915552 - RNA, 22 nt, Human
aagagagagugcgcucacagaa

SEQ ID NO: 915553 - RNA, 22 nt, Human
uuucauaaggguuucuagacuu

SEQ ID NO: 915554 - RNA, 22 nt, Human
uuuauuauagugguggggacug

SEQ ID NO: 915555 - RNA, 22 nt, Human
uguccauggagaagcucagggc

SEQ ID NO: 915556 - RNA, 21 nt, Human
uaaucuucgaaaauguauuag

SEQ ID NO: 915557 - RNA, 22 nt, Human
gcuuccuguauccuccuguacc

SEQ ID NO: 915558 - RNA, 22 nt, Human
uacauuccacaagcauugcuuu

SEQ ID NO: 915559 - RNA, 22 nt, Human
ucuugcuaggagcuauggaaga

SEQ ID NO: 915560 - RNA, 23 nt, Human
gcacagagcaguuaggggaagau

SEQ ID NO: 915561 - RNA, 22 nt, Human
ugagggacuugcuaguucucug

SEQ ID NO: 915562 - RNA, 22 nt, Human
cuggugcccuguguggcaggag

SEQ ID NO: 915563 - RNA, 22 nt, Human
caggacagaaauaaggaauaua

SEQ ID NO: 915564 - RNA, 22 nt, Human
augcagcagccccuugaggugc

SEQ ID NO: 915565 - RNA, 22 nt, Human
ucaguuaagaggccacggcagu

SEQ ID NO: 915566 - RNA, 22 nt, Human
cuggcuccaggucaugcacuca

SEQ ID NO: 915567 - RNA, 22 nt, Human
acagaaacccagaaaaccucuc

SEQ ID NO: 915568 - RNA, 22 nt, Human
cagaguuuuauguaugcaugua

SEQ ID NO: 915569 - RNA, 22 nt, Human
ucugcucuguacugcacuggcc

SEQ ID NO: 915570 - RNA, 22 nt, Human
acaggcagggaccuuggcuaag

SEQ ID NO: 915571 - RNA, 22 nt, Human
acccaggaggcaagguugcagu

SEQ ID NO: 915572 - RNA, 22 nt, Human
aucaccaggcaaaaugucagag

SEQ ID NO: 915573 - RNA, 22 nt, Human
ugggguccagugccuggcaagg

SEQ ID NO: 915574 - RNA, 19 nt, Human
cugucaggggcuggauguu

SEQ ID NO: 915575 - RNA, 22 nt, Human
uaaaauugcggugaauauuucc

SEQ ID NO: 915576 - RNA, 22 nt, Human
gccuccucacaauguacccacg

SEQ ID NO: 915577 - RNA, 22 nt, Human
ucacaagguucacuauaaauug

SEQ ID NO: 915578 - RNA, 23 nt, Human
gcugagguccugcugaguggugg

SEQ ID NO: 915579 - RNA, 22 nt, Human
acuagggauuacacuguauuca

SEQ ID NO: 915580 - RNA, 22 nt, Human
uguuuccuuucuggugagcaua

SEQ ID NO: 915581 - RNA, 22 nt, Human
cagcaugagaaaaugaaucaga

SEQ ID NO: 915582 - RNA, 21 nt, Human
uucauaaaccauucucaugca

SEQ ID NO: 915583 - RNA, 22 nt, Human
acugugugcuggacaugauguu

SEQ ID NO: 915584 - RNA, 22 nt, Human
agacaaguucugugggucaccu

SEQ ID NO: 915585 - RNA, 22 nt, Human
cucugaccucuagccagcucug

SEQ ID NO: 915586 - RNA, 22 nt, Human
ggguaaggucagccagaaguuc

SEQ ID NO: 915587 - RNA, 22 nt, Human
ccaacaccaucugagcuccagc

SEQ ID NO: 915588 - RNA, 22 nt, Human
acauguaacauauauguagcau

SEQ ID NO: 915589 - RNA, 22 nt, Human
ugauuuaggaaacagcuacagg

SEQ ID NO: 915590 - RNA, 22 nt, Human
uuuacagcuacuguccuauuuc

SEQ ID NO: 915591 - RNA, 22 nt, Human
aaaugcuugcucuugauuauuu

SEQ ID NO: 915592 - RNA, 22 nt, Human
gcuccuucuggcucccuuuugg

SEQ ID NO: 915593 - RNA, 22 nt, Human
acagggcagagugaaaugcuau

SEQ ID NO: 915594 - RNA, 22 nt, Human
agcauguggcuaucuuuggggg

SEQ ID NO: 915595 - RNA, 22 nt, Human
uucuguaauucuguuaguuuca

SEQ ID NO: 915596 - RNA, 22 nt, Human
uucucugcagcuuaggcccagu

SEQ ID NO: 915597 - RNA, 22 nt, Human
cugcugugagcacuccagccug

SEQ ID NO: 915598 - RNA, 22 nt, Human
cuuggucuauaggagagauugu

SEQ ID NO: 915599 - RNA, 22 nt, Human
cccuaagaaucucccuuguagc

SEQ ID NO: 915600 - RNA, 22 nt, Human
agggcagcucucaccucuggcc

SEQ ID NO: 915601 - RNA, 22 nt, Human
ccugcagguaaggcuaacugcc

SEQ ID NO: 915602 - RNA, 22 nt, Human
ugugacacugacaucugcuccc

SEQ ID NO: 915603 - RNA, 22 nt, Human
ccauucaugugagcaagaacug

SEQ ID NO: 915604 - RNA, 22 nt, Human
cugaagcugaaaacuuccagca

SEQ ID NO: 915605 - RNA, 22 nt, Human
uacaguuuagaaccauagaugg

SEQ ID NO: 915606 - RNA, 22 nt, Human
gugcucuacaugcuccauguuu

SEQ ID NO: 915607 - RNA, 22 nt, Human
gugagauuugaguggggauaca

SEQ ID NO: 915608 - RNA, 22 nt, Human
aaagaaaccuaucagccacaug

SEQ ID NO: 915609 - RNA, 22 nt, Human
uccugcagugugucuccugcac

SEQ ID NO: 915610 - RNA, 17 nt, Human
aggcaaugacugugguu

SEQ ID NO: 915611 - RNA, 23 nt, Human
ugggccucuccacccuuuucugu

SEQ ID NO: 915612 - RNA, 22 nt, Human
agccacagccugacuuaacugu

SEQ ID NO: 915613 - RNA, 22 nt, Human
gaacccaguccaggugcagccu

SEQ ID NO: 915614 - RNA, 22 nt, Human
agcaacgagaagcacaaaauaa

SEQ ID NO: 915615 - RNA, 22 nt, Human
ggcugccugaggcagugagaga

SEQ ID NO: 915616 - RNA, 22 nt, Human
cacagguuagguauuauacuau

SEQ ID NO: 915617 - RNA, 22 nt, Human
uugcucauauuugcauguguuu

SEQ ID NO: 915618 - RNA, 22 nt, Human
uacaguaaccagucuacuuaga

SEQ ID NO: 915619 - RNA, 22 nt, Human
aggcugaggagggauguugcuu

SEQ ID NO: 915620 - RNA, 22 nt, Human
acuggggcaggaaaguaugcug

SEQ ID NO: 915621 - RNA, 22 nt, Human
uaugaacugugagugugauggg

SEQ ID NO: 915622 - RNA, 22 nt, Human
uggcugcaguucacaggagcaa

SEQ ID NO: 915623 - RNA, 22 nt, Human
augggcugaggaagcuccugag

SEQ ID NO: 915624 - RNA, 22 nt, Human
uucaagugaggcugucuuuaga

SEQ ID NO: 915625 - RNA, 22 nt, Human
aucuaaaaugugguuaguuggu

SEQ ID NO: 915626 - RNA, 22 nt, Human
gagauaaagcuaccauguugau

SEQ ID NO: 915627 - RNA, 22 nt, Human
ugaacauuccugaaugaagcau

SEQ ID NO: 915628 - RNA, 22 nt, Human
acacugaauaauugagaguuga

SEQ ID NO: 915629 - RNA, 22 nt, Human
uggcuggcuguccagcugggca

SEQ ID NO: 915630 - RNA, 22 nt, Human
cugggcaggagggcucuaugga

SEQ ID NO: 915631 - RNA, 22 nt, Human
caauuucaagauucuguucuuu

SEQ ID NO: 915632 - RNA, 22 nt, Human
gauuauuuugugcaauaaucgg

SEQ ID NO: 915633 - RNA, 21 nt, Human
uuagaacacuugcucuuggaa

SEQ ID NO: 915634 - RNA, 22 nt, Human
acaggagccaaacacaugccag

SEQ ID NO: 915635 - RNA, 22 nt, Human
uacaguauauacuguguguaga

SEQ ID NO: 915636 - RNA, 22 nt, Human
agaguucugaaauuaucuuuac

SEQ ID NO: 915637 - RNA, 22 nt, Human
ugucucuucugccuccagcugu

SEQ ID NO: 915638 - RNA, 22 nt, Human
uagcugagaggccaauugaacu

SEQ ID NO: 915639 - RNA, 22 nt, Human
ucagcaaugugauacugugcaa

SEQ ID NO: 915640 - RNA, 22 nt, Human
uugggcagggaaaggacaggca

SEQ ID NO: 915641 - RNA, 22 nt, Human
agcccugcaggaggugggagag

SEQ ID NO: 915642 - RNA, 22 nt, Human
caccugccugcuagagccugac

SEQ ID NO: 915643 - RNA, 22 nt, Human
aacaaugaguccucugagguua

SEQ ID NO: 915644 - RNA, 22 nt, Human
gcacagagcuggcccuccaggc

SEQ ID NO: 915645 - RNA, 22 nt, Human
aucuaagacaaugagugagacu

SEQ ID NO: 915646 - RNA, 22 nt, Human
acagggaaagggacagcagcag

SEQ ID NO: 915647 - RNA, 23 nt, Human
aaagcuuaacuggguaauaaagc

SEQ ID NO: 915648 - RNA, 20 nt, Human
aacuuuagacauaaucucuu

SEQ ID NO: 915649 - RNA, 22 nt, Human
gggcuuggccccagaagagcua

SEQ ID NO: 915650 - RNA, 22 nt, Human
ugggcacuggaagccugcugug

SEQ ID NO: 915651 - RNA, 22 nt, Human
ugcagcugccuagggcuggcuu

SEQ ID NO: 915652 - RNA, 22 nt, Human
agcacacaguauuagccauugu

SEQ ID NO: 915653 - RNA, 23 nt, Human
gggcagguuuuuauaggcuucag

SEQ ID NO: 915654 - RNA, 22 nt, Human
uuauuuccuagggaauuugccu

SEQ ID NO: 915655 - RNA, 22 nt, Human
ucuucuaguaggccaagaagcu

SEQ ID NO: 915656 - RNA, 22 nt, Human
uucaaucauuuuuacauagucc

SEQ ID NO: 915657 - RNA, 20 nt, Human
agccugccagcuggcccaga

SEQ ID NO: 915658 - RNA, 23 nt, Human
ucagagaacucgggcagaugacc

SEQ ID NO: 915659 - RNA, 22 nt, Human
ucacagcuaagcuuggucacug

SEQ ID NO: 915660 - RNA, 22 nt, Human
gagggaugucaggggaccuugg

SEQ ID NO: 915661 - RNA, 22 nt, Human
uuccuuccccuagcugagaaac

SEQ ID NO: 915662 - RNA, 22 nt, Human
ccugucuguucugacuggucag

SEQ ID NO: 915663 - RNA, 22 nt, Human
aggguguguucuccuaugagaa

SEQ ID NO: 915664 - RNA, 20 nt, Human
agaaucagaguggaaaggaa

SEQ ID NO: 915665 - RNA, 22 nt, Human
aaacaauuuccaccucuccuga

SEQ ID NO: 915666 - RNA, 22 nt, Human
gaccugaaauuugugguagaac

SEQ ID NO: 915667 - RNA, 20 nt, Human
agggaacaauggacgcuguc

SEQ ID NO: 915668 - RNA, 22 nt, Human
aucuucaucaaguucacagugg

SEQ ID NO: 915669 - RNA, 22 nt, Human
acuuugaaacuaaaauucauua

SEQ ID NO: 915670 - RNA, 22 nt, Human
ucacacagcuuggaguuauggu

SEQ ID NO: 915671 - RNA, 22 nt, Human
ugaggccagucucaucacaggc

SEQ ID NO: 915672 - RNA, 22 nt, Human
uccugacuuggcuguuggcccu

SEQ ID NO: 915673 - RNA, 22 nt, Human
ucacauuuuaucuauuuuaagu

SEQ ID NO: 915674 - RNA, 22 nt, Human
agugacaguauuuguugccaau

SEQ ID NO: 915675 - RNA, 22 nt, Human
auuaucaaguuuacugugugga

SEQ ID NO: 915676 - RNA, 22 nt, Human
cacauucagggcagaccacuca

SEQ ID NO: 915677 - RNA, 22 nt, Human
uaaguaaauuuauaaugugauu

SEQ ID NO: 915678 - RNA, 22 nt, Human
ugucugcuagcugguggcaauu

SEQ ID NO: 915679 - RNA, 22 nt, Human
uuggccagcgacgaccuucuua

SEQ ID NO: 915680 - RNA, 22 nt, Human
aaaucuaggcucauccuggucc

SEQ ID NO: 915681 - RNA, 22 nt, Human
gcacagacuuugauugcaguca

SEQ ID NO: 915682 - RNA, 22 nt, Human
gaguggcauaugugccugugaa

SEQ ID NO: 915683 - RNA, 18 nt, Human
gacaguaaacuuccccau

SEQ ID NO: 915684 - RNA, 22 nt, Human
gauaauccaagauugccucacu

SEQ ID NO: 915685 - RNA, 22 nt, Human
gaaauaauacagugcucuucuc

SEQ ID NO: 915686 - RNA, 22 nt, Human
caggccaaaauucaggcauucu

SEQ ID NO: 915687 - RNA, 22 nt, Human
acaguugaggacuuaaacaaaa

SEQ ID NO: 915688 - RNA, 22 nt, Human
ugucauacaugcuugagcuaca

SEQ ID NO: 915689 - RNA, 22 nt, Human
cugaggagaccaucaacuaauu

SEQ ID NO: 915690 - RNA, 16 nt, Human
gcagggguggguggag

SEQ ID NO: 915691 - RNA, 22 nt, Human
uggcucuguugugcugagccag

SEQ ID NO: 915692 - RNA, 22 nt, Human
agcuggcuuuugugaagguuuu

SEQ ID NO: 915693 - RNA, 22 nt, Human
gagcagaugugugccaggaugc

SEQ ID NO: 915694 - RNA, 22 nt, Human
gaggcucagagggacuuucaag

SEQ ID NO: 915695 - RNA, 22 nt, Human
uucagagaugacaccugguguu

SEQ ID NO: 915696 - RNA, 22 nt, Human
aauaagccagcccaugugaccc

SEQ ID NO: 915697 - RNA, 22 nt, Human
gcugccaguaguuggagcucca

SEQ ID NO: 915698 - RNA, 19 nt, Human
cagaccuguccagccugug

SEQ ID NO: 915699 - RNA, 22 nt, Human
auguaugggguguaugggauca

SEQ ID NO: 915700 - RNA, 21 nt, Human
ugaauuucccucuaucauucu

SEQ ID NO: 915701 - RNA, 22 nt, Human
acucugagcaucccaagucuua

SEQ ID NO: 915702 - RNA, 22 nt, Human
uuuaccaucugccacagauaug

SEQ ID NO: 915703 - RNA, 22 nt, Human
gggacuggauagauguggguga

SEQ ID NO: 915704 - RNA, 22 nt, Human
aacuguucuuguguuugcuaug

SEQ ID NO: 915705 - RNA, 22 nt, Human
augcacaguauguagggucuau

SEQ ID NO: 915706 - RNA, 22 nt, Human
uuuguucauuuugagcucauca

SEQ ID NO: 915707 - RNA, 22 nt, Human
gacuucaugacauucaggucag

SEQ ID NO: 915708 - RNA, 22 nt, Human
guacaaauugauacagauuuga

SEQ ID NO: 915709 - RNA, 22 nt, Human
ccugcagagggacuggcaggaa

SEQ ID NO: 915710 - RNA, 22 nt, Human
uuucuucacaggguauugggug

SEQ ID NO: 915711 - RNA, 22 nt, Human
ucuacagaaacuggcuacucuc

SEQ ID NO: 915712 - RNA, 22 nt, Human
gcagaggcuguagggaagguug

SEQ ID NO: 915713 - RNA, 22 nt, Human
cacaggaaaugauucugcagca

SEQ ID NO: 915714 - RNA, 22 nt, Human
ggcagagaugugggucagaauc

SEQ ID NO: 915715 - RNA, 18 nt, Human
agaauuauucuuguccuc

SEQ ID NO: 915716 - RNA, 22 nt, Human
gaggcuggcagaaaagcacagg

SEQ ID NO: 915717 - RNA, 22 nt, Human
cucugccucagugauuucuuua

SEQ ID NO: 915718 - RNA, 22 nt, Human
gcacccagggacuuggcuggcc

SEQ ID NO: 915719 - RNA, 20 nt, Human
uuguaucagugucucccaaa

SEQ ID NO: 915720 - RNA, 22 nt, Human
uagugucuguccaucaguaacu

SEQ ID NO: 915721 - RNA, 22 nt, Human
ccaggcaagcucugcugugccc

SEQ ID NO: 915722 - RNA, 22 nt, Human
uuuacugucucagagagacaaa

SEQ ID NO: 915723 - RNA, 19 nt, Human
ccuggguccacucagacua

SEQ ID NO: 915724 - RNA, 22 nt, Human
gcugaagagagaugcguccagc

SEQ ID NO: 915725 - RNA, 22 nt, Human
aaagaguuguuguauaacagga

SEQ ID NO: 915726 - RNA, 22 nt, Human
ccagggcaugggaagaacugaa

SEQ ID NO: 915727 - RNA, 22 nt, Human
cacgagggcacacgugggaggg

SEQ ID NO: 915728 - RNA, 22 nt, Human
acauugaagggcuauccaauag

SEQ ID NO: 915729 - RNA, 22 nt, Human
cagcccugcugguuuugggcaa

SEQ ID NO: 915730 - RNA, 22 nt, Human
aaugucauuuaggauuauguuu

SEQ ID NO: 915731 - RNA, 20 nt, Human
uugagcagcagugcuguguc

SEQ ID NO: 915732 - RNA, 22 nt, Human
aaggagcuaugcauaacugauc

SEQ ID NO: 915733 - RNA, 20 nt, Human
acucaaaucaccugccucaa

SEQ ID NO: 915734 - RNA, 22 nt, Human
uuccugaagucaaagaucuaaa

SEQ ID NO: 915735 - RNA, 20 nt, Human
guuuccaaauugugcauuuu

SEQ ID NO: 915736 - RNA, 22 nt, Human
ucacauuuggagaaagccugcc

SEQ ID NO: 915737 - RNA, 22 nt, Human
auaaaugugaauuagagcuuug

SEQ ID NO: 915738 - RNA, 22 nt, Human
ugucaaauaguagaaagauggc

SEQ ID NO: 915739 - RNA, 22 nt, Human
aacagcuguauacuguagcugu

SEQ ID NO: 915740 - RNA, 22 nt, Human
cccaggagguggagcuugcagu

SEQ ID NO: 915741 - RNA, 22 nt, Human
cuggccagccugucgaugcccu

SEQ ID NO: 915742 - RNA, 22 nt, Human
ucagauuucuagcguuuggcca

SEQ ID NO: 915743 - RNA, 22 nt, Human
ggugggggagacuuggucaaga

SEQ ID NO: 915744 - RNA, 22 nt, Human
aaaucugagaaauauuguccag

SEQ ID NO: 915745 - RNA, 22 nt, Human
gcagaggccuagguggaaggcc

SEQ ID NO: 915746 - RNA, 22 nt, Human
uucucuuucuacagugugauug

SEQ ID NO: 915747 - RNA, 20 nt, Human
gagcugaguguggucauggg

SEQ ID NO: 915748 - RNA, 23 nt, Human
uaucuguauuuguucacugcugu

SEQ ID NO: 915749 - RNA, 22 nt, Human
aggcaggcaaccaccugggaag

SEQ ID NO: 915750 - RNA, 23 nt, Human
cuugagcucaggaagagcugagu

SEQ ID NO: 915751 - RNA, 22 nt, Human
cagccauacugacaucaacaaa

SEQ ID NO: 915752 - RNA, 22 nt, Human
aguguuucugugccccaguguu

SEQ ID NO: 915753 - RNA, 22 nt, Human
uaguaaaucucagaaaaagauc

SEQ ID NO: 915754 - RNA, 22 nt, Human
aguugaaagccuuauuucucug

SEQ ID NO: 915755 - RNA, 22 nt, Human
uguaaacauaucagacuuucuu

SEQ ID NO: 915756 - RNA, 22 nt, Human
ugaggggagguuggggcacauc

SEQ ID NO: 915757 - RNA, 22 nt, Human
ccagggcauccucacaucgcag

SEQ ID NO: 915758 - RNA, 22 nt, Human
agaaacauuuagauuauauguc

SEQ ID NO: 915759 - RNA, 22 nt, Human
uguggguccuccugugugcccg

SEQ ID NO: 915760 - RNA, 22 nt, Human
uuucuagaaaguucauguguuu

SEQ ID NO: 915761 - RNA, 22 nt, Human
ucaucaucugcaagcucauguc

SEQ ID NO: 915762 - RNA, 22 nt, Human
acagagcccuuccuugcaccau

SEQ ID NO: 915763 - RNA, 22 nt, Human
ccaguguguuuaaugcauucca

SEQ ID NO: 915764 - RNA, 22 nt, Human
acgugcaggaucugguuggcga

SEQ ID NO: 915765 - RNA, 22 nt, Human
augcucuaagcuuagugaggca

SEQ ID NO: 915766 - RNA, 22 nt, Human
acaguguugaggugcuuguuuc

SEQ ID NO: 915767 - RNA, 20 nt, Human
uuuucugugccaagaaaacu

SEQ ID NO: 915768 - RNA, 22 nt, Human
gcaaacugauuuccaaguccgu

SEQ ID NO: 915769 - RNA, 22 nt, Human
aggucaggagguuaagagucuu

SEQ ID NO: 915770 - RNA, 22 nt, Human
aaacucuagggcuccacauucc

SEQ ID NO: 915771 - RNA, 22 nt, Human
gcugccugcacagagcugcuuu

SEQ ID NO: 915772 - RNA, 22 nt, Human
uccauuuucaucucauguauaa

SEQ ID NO: 915773 - RNA, 22 nt, Human
caguacaauguugaaaaggagu

SEQ ID NO: 915774 - RNA, 22 nt, Human
cuguccuguggaccugaggacg

SEQ ID NO: 915775 - RNA, 22 nt, Human
augaggcucucaggggagcugu

SEQ ID NO: 915776 - RNA, 22 nt, Human
uauuguacugaggaauaaagcu

SEQ ID NO: 915777 - RNA, 22 nt, Human
ugaagcaggaaacuucuuguuu

SEQ ID NO: 915778 - RNA, 22 nt, Human
auucuggacaaggcaagcuccu

SEQ ID NO: 915779 - RNA, 22 nt, Human
ucucucugccaacucacagcca

SEQ ID NO: 915780 - RNA, 22 nt, Human
agcaccugugugagcuagaugu

SEQ ID NO: 915781 - RNA, 22 nt, Human
uccuuccuuccugaaauuuuag

SEQ ID NO: 915782 - RNA, 22 nt, Human
ucugaggcauacccaggccccc

SEQ ID NO: 915783 - RNA, 22 nt, Human
gaccccaggcagaucagggggu

SEQ ID NO: 915784 - RNA, 22 nt, Human
aaugucauagcauuucuucaau

SEQ ID NO: 915785 - RNA, 22 nt, Human
cccaggcucagacuggcuuguu

SEQ ID NO: 915786 - RNA, 22 nt, Human
cugcucugugguccaugagaca

SEQ ID NO: 915787 - RNA, 22 nt, Human
ggccagcucagucuccaucagg

SEQ ID NO: 915788 - RNA, 22 nt, Human
cuugggcaggggaaacagcugc

SEQ ID NO: 915789 - RNA, 22 nt, Human
acagagucugacagguaggcgc

SEQ ID NO: 915790 - RNA, 22 nt, Human
cugcugacuuacacuguuuauu

SEQ ID NO: 915791 - RNA, 22 nt, Human
ccugccugaaggucagccaccc

SEQ ID NO: 915792 - RNA, 22 nt, Human
cccaggcuaguaugauaucagu

SEQ ID NO: 915793 - RNA, 22 nt, Human
acugaaaaagacaucuugguaa

SEQ ID NO: 915794 - RNA, 22 nt, Human
ggcacagaguuggcagagcugc

SEQ ID NO: 915795 - RNA, 22 nt, Human
cugcagagcuaggcugagugaa

SEQ ID NO: 915796 - RNA, 22 nt, Human
uacaaaaaauugauacugacga

SEQ ID NO: 915797 - RNA, 20 nt, Human
auauguguacguguauacau

SEQ ID NO: 915798 - RNA, 22 nt, Human
cugggcacacagugacucugca

SEQ ID NO: 915799 - RNA, 22 nt, Human
uauagguagccauauuugauag

SEQ ID NO: 915800 - RNA, 22 nt, Human
cacacauuagagccaaugucag

SEQ ID NO: 915801 - RNA, 22 nt, Human
auaauguuucaguacugucugu

SEQ ID NO: 915802 - RNA, 22 nt, Human
cagagggcucaguccugcugga

SEQ ID NO: 915803 - RNA, 22 nt, Human
ugggggcacuucgaggucgccu

SEQ ID NO: 915804 - RNA, 23 nt, Human
agccaaaucuuaacuucuguuac

SEQ ID NO: 915805 - RNA, 22 nt, Human
agagacccgcagccucggagcu

SEQ ID NO: 915806 - RNA, 22 nt, Human
agaaaacugcagaguagccuca

SEQ ID NO: 915807 - RNA, 21 nt, Human
ccagaagcugcuugcaggcua

SEQ ID NO: 915808 - RNA, 22 nt, Human
acuuagaacaggcagaauucca

SEQ ID NO: 915809 - RNA, 22 nt, Human
uccugggcgagguacuggggcu

SEQ ID NO: 915810 - RNA, 22 nt, Human
aagguggcgcuggagcuggucc

SEQ ID NO: 915811 - RNA, 22 nt, Human
aaaguugugaaaccgaacaugu

SEQ ID NO: 915812 - RNA, 22 nt, Human
cugugccugcaggccacaucaa

SEQ ID NO: 915813 - RNA, 22 nt, Human
gauuuauugucccuguccugcu

SEQ ID NO: 915814 - RNA, 22 nt, Human
aggccagcaagaaagagagucu

SEQ ID NO: 915815 - RNA, 22 nt, Human
ugaaagguguccaauauuucuc

SEQ ID NO: 915816 - RNA, 23 nt, Human
agcuccaggugauuguaaugugu

SEQ ID NO: 915817 - RNA, 22 nt, Human
uuucagggagccuagaagagcu

SEQ ID NO: 915818 - RNA, 22 nt, Human
uuucuagcaagaaagaggugga

SEQ ID NO: 915819 - RNA, 22 nt, Human
gcagggguagagauugcuggug

SEQ ID NO: 915820 - RNA, 22 nt, Human
gucuguccuguacccagcaucu

SEQ ID NO: 915821 - RNA, 22 nt, Human
cuauucugauuaccagauauug

SEQ ID NO: 915822 - RNA, 22 nt, Human
ugcuguagcccugcacagugca

SEQ ID NO: 915823 - RNA, 22 nt, Human
ugugugcuaauguaugcucuaa

SEQ ID NO: 915824 - RNA, 21 nt, Human
uggcacagcaagugggcucau

SEQ ID NO: 915825 - RNA, 22 nt, Human
cucugcuucauccaccacuggc

SEQ ID NO: 915826 - RNA, 22 nt, Human
aauucccaccuucucucuuuug

SEQ ID NO: 915827 - RNA, 22 nt, Human
aaaugccuagaaaucacgcaga

SEQ ID NO: 915828 - RNA, 22 nt, Human
caaacauuccgcuucucccagg

SEQ ID NO: 915829 - RNA, 22 nt, Human
agcagcaucugguucugaugug

SEQ ID NO: 915830 - RNA, 22 nt, Human
agugagguaauuagagcugcug

SEQ ID NO: 915831 - RNA, 19 nt, Human
auaacuacauuggcucagu

SEQ ID NO: 915832 - RNA, 22 nt, Human
uggcaggcaggcagccuucuga

SEQ ID NO: 915833 - RNA, 22 nt, Human
acacagugucagggcaggggcc

SEQ ID NO: 915834 - RNA, 22 nt, Human
auauauucuuaaagaaucugac

SEQ ID NO: 915835 - RNA, 22 nt, Human
guaaauguccugcuacagagug

SEQ ID NO: 915836 - RNA, 22 nt, Human
guggcacaggguuguuggucau

SEQ ID NO: 915837 - RNA, 22 nt, Human
uggagcagcuaagccucugaga

SEQ ID NO: 915838 - RNA, 22 nt, Human
aaaggcuucacuuauuuauuuu

SEQ ID NO: 915839 - RNA, 22 nt, Human
ugaaacaaauuuggaaaaucua

SEQ ID NO: 915840 - RNA, 22 nt, Human
aagacacuuucuaaauagaagu

SEQ ID NO: 915841 - RNA, 22 nt, Human
uguagaaaauuggagcauucau

SEQ ID NO: 915842 - RNA, 22 nt, Human
uucauucuguuuggaaaggugg

SEQ ID NO: 915843 - RNA, 22 nt, Human
gcugcuuuuuggauuuggcaca

SEQ ID NO: 915844 - RNA, 22 nt, Human
aauguacagcugucuuuccucc

SEQ ID NO: 915845 - RNA, 22 nt, Human
aaaacagacagccaguguagag

SEQ ID NO: 915846 - RNA, 22 nt, Human
ucaaauuauuuaggauagugcu

SEQ ID NO: 915847 - RNA, 22 nt, Human
agaacuuaggaacaacagcuua

SEQ ID NO: 915848 - RNA, 22 nt, Human
cuuagagcuuaggcuagccauu

SEQ ID NO: 915849 - RNA, 17 nt, Human
ugaggccauggcaccau

SEQ ID NO: 915850 - RNA, 22 nt, Human
auaguuguguggggauucuggu

SEQ ID NO: 915851 - RNA, 22 nt, Human
aaggcccuggcaggaagcagga

SEQ ID NO: 915852 - RNA, 22 nt, Human
agguaaagacagugaaagaggg

SEQ ID NO: 915853 - RNA, 22 nt, Human
caucauaauaacccagacacag

SEQ ID NO: 915854 - RNA, 22 nt, Human
augaggcaguacacacaaagcc

SEQ ID NO: 915855 - RNA, 22 nt, Human
ggcacagcaccuuuucacauug

SEQ ID NO: 915856 - RNA, 23 nt, Human
ccaagacuguuaggaguggggag

SEQ ID NO: 915857 - RNA, 22 nt, Human
cuggcagcuuauuagaaaugca

SEQ ID NO: 915858 - RNA, 22 nt, Human
uagcaucuaacaucuuaggacu

SEQ ID NO: 915859 - RNA, 22 nt, Human
uucauuugaguuuauaguugcu

SEQ ID NO: 915860 - RNA, 22 nt, Human
agugauggagcuuccucugcua

SEQ ID NO: 915861 - RNA, 22 nt, Human
uuucuuuauccuccuuugcaca

SEQ ID NO: 915862 - RNA, 22 nt, Human
aaggccagcgcagaccauuguc

SEQ ID NO: 915863 - RNA, 20 nt, Human
guuaggagguuggacaugga

SEQ ID NO: 915864 - RNA, 22 nt, Human
cugcagcuuuuugugcuuguaa

SEQ ID NO: 915865 - RNA, 22 nt, Human
uuaaagcaaccucagcccucuu

SEQ ID NO: 915866 - RNA, 22 nt, Human
aucugucugggugcagcagucc

SEQ ID NO: 915867 - RNA, 22 nt, Human
guggcugagcagcagagagcug

SEQ ID NO: 915868 - RNA, 22 nt, Human
uuuggaauaaucagauccuagu

SEQ ID NO: 915869 - RNA, 22 nt, Human
gugugccucgccaagcugucgg

SEQ ID NO: 915870 - RNA, 22 nt, Human
agauucucaacaaagaguagca

SEQ ID NO: 915871 - RNA, 22 nt, Human
cugaacuucucugagccucagu

SEQ ID NO: 915872 - RNA, 22 nt, Human
augucaaaugcugcaaacucau

SEQ ID NO: 915873 - RNA, 18 nt, Human
uuggggugaggccaggaa

SEQ ID NO: 915874 - RNA, 18 nt, Human
uucuuuaauucaguuuga

SEQ ID NO: 915875 - RNA, 22 nt, Human
aagaugauguuguguuuucacu

SEQ ID NO: 915876 - RNA, 22 nt, Human
cuggaaggagaaggaggcugug

SEQ ID NO: 915877 - RNA, 22 nt, Human
agcugaggacgugaagggcggc

SEQ ID NO: 915878 - RNA, 22 nt, Human
uggggcuggcacagucucuauu

SEQ ID NO: 915879 - RNA, 22 nt, Human
cagcugcagucaucuucuagaa

SEQ ID NO: 915880 - RNA, 18 nt, Human
cauucuuggcagcuuuug

SEQ ID NO: 915881 - RNA, 22 nt, Human
agaccauggccauccuaggaaa

SEQ ID NO: 915882 - RNA, 22 nt, Human
uaaagcaaaaaugaacugccau

SEQ ID NO: 915883 - RNA, 22 nt, Human
aagugcauacacuaguuaauug

SEQ ID NO: 915884 - RNA, 22 nt, Human
ucaaaagacacaggaggcuagu

SEQ ID NO: 915885 - RNA, 23 nt, Human
aguauucaaaaggcaagcuauau

SEQ ID NO: 915886 - RNA, 22 nt, Human
ucucuggcuggcaccccaggga

SEQ ID NO: 915887 - RNA, 22 nt, Human
auuaaaugguggucauucauuu

SEQ ID NO: 915888 - RNA, 22 nt, Human
gucuggacugcaaaauaaggau

SEQ ID NO: 915889 - RNA, 22 nt, Human
aaguucuaaggugcauuauucu

SEQ ID NO: 915890 - RNA, 22 nt, Human
agcauuaagccuggcucagagg

SEQ ID NO: 915891 - RNA, 19 nt, Human
ucuguggcuguggggagga

SEQ ID NO: 915892 - RNA, 22 nt, Human
uuucacaagacagcuacuguug

SEQ ID NO: 915893 - RNA, 22 nt, Human
uguuuacuccagcugauggaac

SEQ ID NO: 915894 - RNA, 22 nt, Human
aggcucugguucaucaugaugg

SEQ ID NO: 915895 - RNA, 22 nt, Human
ugaggaaaaugucuuauagauu

SEQ ID NO: 915896 - RNA, 22 nt, Human
uagaacuuauuuggcauuauuu

SEQ ID NO: 915897 - RNA, 22 nt, Human
uuaccaauucagacaucucuuc

SEQ ID NO: 915898 - RNA, 22 nt, Human
ucugccagaaguucugagagua

SEQ ID NO: 915899 - RNA, 17 nt, Human
ggaaaagaagaguagga

SEQ ID NO: 915900 - RNA, 22 nt, Human
ucagggagauuuggggacucaa

SEQ ID NO: 915901 - RNA, 21 nt, Human
ccacauucucauucugacugc

SEQ ID NO: 915902 - RNA, 22 nt, Human
aaggcuucuuuaguguccuaau

SEQ ID NO: 915903 - RNA, 22 nt, Human
caguuuaaagaaggaugggagu

SEQ ID NO: 915904 - RNA, 22 nt, Human
uagauacaguguuaagugugga

SEQ ID NO: 915905 - RNA, 22 nt, Human
gugagugucagucaaagguuuu

SEQ ID NO: 915906 - RNA, 17 nt, Human
ucugagaaaggagaauc

SEQ ID NO: 915907 - RNA, 22 nt, Human
guccagagaagggaggggacuc

SEQ ID NO: 915908 - RNA, 22 nt, Human
uucucuaagaguuauaugaauu

SEQ ID NO: 915909 - RNA, 22 nt, Human
uuauugcuagugucauuucaca

SEQ ID NO: 915910 - RNA, 19 nt, Human
accugcaguaauaauuccu

SEQ ID NO: 915911 - RNA, 22 nt, Human
aaauacuagaauucagaguuga

SEQ ID NO: 915912 - RNA, 22 nt, Human
agaggagcugggaggcccucgu

SEQ ID NO: 915913 - RNA, 22 nt, Human
ggccaagaaugauaggcucagu

SEQ ID NO: 915914 - RNA, 22 nt, Human
ugcauuuucuuccaccaauauc

SEQ ID NO: 915915 - RNA, 22 nt, Human
gugguccucuucuucuguuugg

SEQ ID NO: 915916 - RNA, 22 nt, Human
caggugggcugccucuccagcu

SEQ ID NO: 915917 - RNA, 22 nt, Human
gcugucucggggcuuucuccug

SEQ ID NO: 915918 - RNA, 22 nt, Human
gaguucuguuacgugucaccaa

SEQ ID NO: 915919 - RNA, 22 nt, Human
gcccuagggcuuuugggccugu

SEQ ID NO: 915920 - RNA, 22 nt, Human
auuugaaaucccuucuacugua

SEQ ID NO: 915921 - RNA, 22 nt, Human
uggcagcagggccccuggagga

SEQ ID NO: 915922 - RNA, 22 nt, Human
cagacacuaggugacagagugc

SEQ ID NO: 915923 - RNA, 22 nt, Human
cacaguguagacuaauaauaga

SEQ ID NO: 915924 - RNA, 22 nt, Human
guguauguucuacuuaauauua

SEQ ID NO: 915925 - RNA, 22 nt, Human
gagcugaagaugucagaaccgu

SEQ ID NO: 915926 - RNA, 22 nt, Human
uaacagaaguuguucauugugg

SEQ ID NO: 915927 - RNA, 22 nt, Human
ucacugaagucuucaaguagga

SEQ ID NO: 915928 - RNA, 22 nt, Human
gcccagccccuggguggacgug

SEQ ID NO: 915929 - RNA, 22 nt, Human
uccuagaacagcccaccuggaa

SEQ ID NO: 915930 - RNA, 22 nt, Human
ggggcagggagguuaucgccga

SEQ ID NO: 915931 - RNA, 22 nt, Human
auuucacagcugcuguucaggu

SEQ ID NO: 915932 - RNA, 22 nt, Human
acaggagggacaccuuccugcu

SEQ ID NO: 915933 - RNA, 22 nt, Human
gcagaauuuucuguuuucuaga

SEQ ID NO: 915934 - RNA, 22 nt, Human
uguacagaaauuccuacuacau

SEQ ID NO: 915935 - RNA, 22 nt, Human
ucuuccuugccuugcuucauca

SEQ ID NO: 915936 - RNA, 22 nt, Human
cugggcagugguggcccuuccc

SEQ ID NO: 915937 - RNA, 22 nt, Human
agaaaaggauugauggaucaga

SEQ ID NO: 915938 - RNA, 22 nt, Human
cauuucaaacaguuacagcugc

SEQ ID NO: 915939 - RNA, 22 nt, Human
agacaucuaccuuucauucaaa

SEQ ID NO: 915940 - RNA, 22 nt, Human
uggugcugagaugaagugcucc

SEQ ID NO: 915941 - RNA, 22 nt, Human
uucacauugguucuugauagcu

SEQ ID NO: 915942 - RNA, 22 nt, Human
aaugguuuugcagguuugugga

SEQ ID NO: 915943 - RNA, 22 nt, Human
uauuugcugacagugcuggagc

SEQ ID NO: 915944 - RNA, 22 nt, Human
auccauuuuugcaaaguuguuc

SEQ ID NO: 915945 - RNA, 22 nt, Human
cuauuuaucuauuucugaauga

SEQ ID NO: 915946 - RNA, 22 nt, Human
uugaggccugcuggaagguguu

SEQ ID NO: 915947 - RNA, 22 nt, Human
guaguaauaguacauuagaaug

SEQ ID NO: 915948 - RNA, 22 nt, Human
acaaagugcacaagaugagaac

SEQ ID NO: 915949 - RNA, 22 nt, Human
ccaggucccuggaauuuaugag

SEQ ID NO: 915950 - RNA, 20 nt, Human
gggcaguggcgcuaucucag

SEQ ID NO: 915951 - RNA, 22 nt, Human
auggcagcaaagaggccuucuu

SEQ ID NO: 915952 - RNA, 22 nt, Human
ccugcccagggucaccacagag

SEQ ID NO: 915953 - RNA, 22 nt, Human
aacagauuuaagaagccaaggu

SEQ ID NO: 915954 - RNA, 22 nt, Human
caggcacucauucagagaggug

SEQ ID NO: 915955 - RNA, 22 nt, Human
gacuccccugggccccauccag

SEQ ID NO: 915956 - RNA, 22 nt, Human
gcuauacacauuucuugguagu

SEQ ID NO: 915957 - RNA, 22 nt, Human
ccagagagaguacugggcucug

SEQ ID NO: 915958 - RNA, 22 nt, Human
uuauuucauguaaaauuuaugu

SEQ ID NO: 915959 - RNA, 22 nt, Human
cuggcugggagcgagcugcuca

SEQ ID NO: 915960 - RNA, 22 nt, Human
ugcuggcuuuuccuucaggcag

SEQ ID NO: 915961 - RNA, 22 nt, Human
cuccagcugcuggucugagacu

SEQ ID NO: 915962 - RNA, 22 nt, Human
augugaaaaauuucuuauuaca

SEQ ID NO: 915963 - RNA, 23 nt, Human
gugagcagcccacuaggaaugcc

SEQ ID NO: 915964 - RNA, 22 nt, Human
ucaaaguaagaauuuauuacaa

SEQ ID NO: 915965 - RNA, 22 nt, Human
ucacaggacagccuuccacccg

SEQ ID NO: 915966 - RNA, 22 nt, Human
uaauaauuaacagugauggguc

SEQ ID NO: 915967 - RNA, 19 nt, Human
cucuggagcagacacugga

SEQ ID NO: 915968 - RNA, 22 nt, Human
aucucuguaaaccauaaauuga

SEQ ID NO: 915969 - RNA, 22 nt, Human
uuugcaaauacagaggucuugc

SEQ ID NO: 915970 - RNA, 22 nt, Human
cagugccuggauagcaacauga

SEQ ID NO: 915971 - RNA, 22 nt, Human
guguguguguaaaaauccagag

SEQ ID NO: 915972 - RNA, 22 nt, Human
caagggcagaggcagggccccg

SEQ ID NO: 915973 - RNA, 19 nt, Human
aagagggaaagugcuaugc

SEQ ID NO: 915974 - RNA, 22 nt, Human
acuagaaccagaggaggcaggu

SEQ ID NO: 915975 - RNA, 22 nt, Human
ccugagccugaguggugcaggg

SEQ ID NO: 915976 - RNA, 22 nt, Human
cuggagaacagagcuguuuaga

SEQ ID NO: 915977 - RNA, 22 nt, Human
uggcugccuagucccucagccu

SEQ ID NO: 915978 - RNA, 22 nt, Human
aaaugcauggcuguuuuaaagc

SEQ ID NO: 915979 - RNA, 22 nt, Human
uagcagcuggggcuauucauca

SEQ ID NO: 915980 - RNA, 22 nt, Human
gaagggaacugggucuccuugu

SEQ ID NO: 915981 - RNA, 22 nt, Human
uguucauuugcaacaaccaaau

SEQ ID NO: 915982 - RNA, 22 nt, Human
agggcugcuccuccuucaggcc

SEQ ID NO: 915983 - RNA, 22 nt, Human
gcucucucuuggggauucagca

SEQ ID NO: 915984 - RNA, 22 nt, Human
aagaaaguguggagagccuagc

SEQ ID NO: 915985 - RNA, 22 nt, Human
aggcaacuguuugauaauguug

SEQ ID NO: 915986 - RNA, 22 nt, Human
auuuaacaagacagagaacugg

SEQ ID NO: 915987 - RNA, 22 nt, Human
ugaaucucgaggcuauagaagu

SEQ ID NO: 915988 - RNA, 21 nt, Human
uauaguguggauaugcugaug

SEQ ID NO: 915989 - RNA, 22 nt, Human
uguuuguggaauauucuuuaag

SEQ ID NO: 915990 - RNA, 19 nt, Human
gagacauguagauagaaga

SEQ ID NO: 915991 - RNA, 22 nt, Human
ugcuuuauguuaucagaagggu

SEQ ID NO: 915992 - RNA, 22 nt, Human
ccagcuggcccagcugugcucc

SEQ ID NO: 915993 - RNA, 22 nt, Human
ggagccuguggccgucacgacu

SEQ ID NO: 915994 - RNA, 22 nt, Human
uaagcauaacuaaaaaugauuu

SEQ ID NO: 915995 - RNA, 22 nt, Human
ucauggggugacagaagggagg

SEQ ID NO: 915996 - RNA, 18 nt, Human
cuuauuguuuaaauggcc

SEQ ID NO: 915997 - RNA, 20 nt, Human
ccuggcaggcggguuacuua

SEQ ID NO: 915998 - RNA, 22 nt, Human
agacuucucuuggcuauauuau

SEQ ID NO: 915999 - RNA, 22 nt, Human
ccaggagcuauguacacacuau

SEQ ID NO: 916000 - RNA, 22 nt, Human
cagagguuaccuagagcaagaa

SEQ ID NO: 916001 - RNA, 22 nt, Human
gcuggaucccugugggaguggu

SEQ ID NO: 916002 - RNA, 22 nt, Human
gggcuccaacggugagcaugga

SEQ ID NO: 916003 - RNA, 22 nt, Human
ugggccuuacuuggggcugacu

SEQ ID NO: 916004 - RNA, 22 nt, Human
ccacagcuccucagccucuuuc

SEQ ID NO: 916005 - RNA, 22 nt, Human
ggcugcucaaggacucugaucg

SEQ ID NO: 916006 - RNA, 22 nt, Human
uacacaacugacaaccauucug

SEQ ID NO: 916007 - RNA, 22 nt, Human
gaaacagucaacuuucuuuccc

SEQ ID NO: 916008 - RNA, 22 nt, Human
gcagcugguuaaugggagaauu

SEQ ID NO: 916009 - RNA, 22 nt, Human
agccaagacauuuagaaaagcu

SEQ ID NO: 916010 - RNA, 22 nt, Human
uacauucacuuguugaaggugg

SEQ ID NO: 916011 - RNA, 22 nt, Human
gggugagggaugagccuucuuc

SEQ ID NO: 916012 - RNA, 22 nt, Human
gacacauaugcguauaguuuag

SEQ ID NO: 916013 - RNA, 22 nt, Human
gcugugggccacacggcugagu

SEQ ID NO: 916014 - RNA, 22 nt, Human
gauggcagcagcagccagggau

SEQ ID NO: 916015 - RNA, 22 nt, Human
ucggccacgggguuuccuccaa

SEQ ID NO: 916016 - RNA, 22 nt, Human
uccagcagccacaccucuggac

SEQ ID NO: 916017 - RNA, 22 nt, Human
cucugggcacuguauggguucu

SEQ ID NO: 916018 - RNA, 22 nt, Human
ugugcaugugucuuuauaguag

SEQ ID NO: 916019 - RNA, 22 nt, Human
ucucuuucucaaaauguaagca

SEQ ID NO: 916020 - RNA, 22 nt, Human
gagaggagucccuaucacaguu

SEQ ID NO: 916021 - RNA, 22 nt, Human
auacauuauuguuaaagaacau

SEQ ID NO: 916022 - RNA, 22 nt, Human
guccucagggaauguggcgggu

SEQ ID NO: 916023 - RNA, 22 nt, Human
uggccaccccuuucucugcacu

SEQ ID NO: 916024 - RNA, 22 nt, Human
ugguaugaccguggugcaagca

SEQ ID NO: 916025 - RNA, 22 nt, Human
aacacagggcagcugcugggaa

SEQ ID NO: 916026 - RNA, 19 nt, Human
uaaguagucaaauaguaac

SEQ ID NO: 916027 - RNA, 22 nt, Human
agcgguggugucggcagcggcu

SEQ ID NO: 916028 - RNA, 22 nt, Human
ucugcaccuuucuuaaaaaucg

SEQ ID NO: 916029 - RNA, 19 nt, Human
auuuuucuuccucugugca

SEQ ID NO: 916030 - RNA, 22 nt, Human
ggaagauuucccguagcugugc

SEQ ID NO: 916031 - RNA, 23 nt, Human
cagaacaguaaaagaugccaugg

SEQ ID NO: 916032 - RNA, 22 nt, Human
cauuugaacuaauaacugugcu

SEQ ID NO: 916033 - RNA, 22 nt, Human
uuugcuauuuuucugugcagcu

SEQ ID NO: 916034 - RNA, 22 nt, Human
aggagcuguuuuguucagcaaa

SEQ ID NO: 916035 - RNA, 22 nt, Human
uuuuucuggauaacuguaucuc

SEQ ID NO: 916036 - RNA, 22 nt, Human
cucuagacaacuugcugugggu

SEQ ID NO: 916037 - RNA, 22 nt, Human
uuuccaauuuuuaaguggauga

SEQ ID NO: 916038 - RNA, 22 nt, Human
ugcagugaugcuucuggcucag

SEQ ID NO: 916039 - RNA, 22 nt, Human
cauuuacuguugaaucccuagc

SEQ ID NO: 916040 - RNA, 22 nt, Human
uuuaucagaggcuauguuucau

SEQ ID NO: 916041 - RNA, 22 nt, Human
acuguuuuccuaaugagcaaga

SEQ ID NO: 916042 - RNA, 22 nt, Human
ggaggccaguccuggccgggcu

SEQ ID NO: 916043 - RNA, 22 nt, Human
ccuacacaugaaugcgagaaau

SEQ ID NO: 916044 - RNA, 22 nt, Human
ucauuuguuacagccacauacc

SEQ ID NO: 916045 - RNA, 22 nt, Human
guggcccagcccuacagaggac

SEQ ID NO: 916046 - RNA, 18 nt, Human
aaugaaauguacaccuuu

SEQ ID NO: 916047 - RNA, 22 nt, Human
aggggccugguuggccucuguu

SEQ ID NO: 916048 - RNA, 22 nt, Human
cggcagugggcgccaggucucc

SEQ ID NO: 916049 - RNA, 19 nt, Human
uggccagguacugucugcu

SEQ ID NO: 916050 - RNA, 22 nt, Human
agcuaaggaacucuguaacacc

SEQ ID NO: 916051 - RNA, 22 nt, Human
ccucccacuucuugcugagguc

SEQ ID NO: 916052 - RNA, 22 nt, Human
uugaaacugucagcuuuuacgc

SEQ ID NO: 916053 - RNA, 22 nt, Human
ccuccuagaggaaccccagggc

SEQ ID NO: 916054 - RNA, 22 nt, Human
agagaacagcauugcagcuuug

SEQ ID NO: 916055 - RNA, 22 nt, Human
gggacacuggacccagugucca

SEQ ID NO: 916056 - RNA, 22 nt, Human
cuccucugucuggcccugagcc

SEQ ID NO: 916057 - RNA, 22 nt, Human
ucaguguuauuagaugagguuu

SEQ ID NO: 916058 - RNA, 22 nt, Human
uacauuauuucaucagucaucu

SEQ ID NO: 916059 - RNA, 20 nt, Human
cugccaugauugauagagug

SEQ ID NO: 916060 - RNA, 22 nt, Human
uggcaacaagaaaggcagaggg

SEQ ID NO: 916061 - RNA, 22 nt, Human
gagcuuggugcugccuguuguc

SEQ ID NO: 916062 - RNA, 18 nt, Human
ucagcccagagcccaguu

SEQ ID NO: 916063 - RNA, 22 nt, Human
agcagcuggggccugugacgau

SEQ ID NO: 916064 - RNA, 22 nt, Human
aaagcuauuugugaguuauaga

SEQ ID NO: 916065 - RNA, 22 nt, Human
uuauaggaaucugcauguguga

SEQ ID NO: 916066 - RNA, 21 nt, Human
uguggucuuuuaguuccauca

SEQ ID NO: 916067 - RNA, 22 nt, Human
cacugcuuuuucuccucacugg

SEQ ID NO: 916068 - RNA, 22 nt, Human
aacuacaggggguggcaggcgg

SEQ ID NO: 916069 - RNA, 22 nt, Human
cugcccguaaguuagaaaagca

SEQ ID NO: 916070 - RNA, 22 nt, Human
uugcagggaccugcagaaagcu

SEQ ID NO: 916071 - RNA, 22 nt, Human
gcugagguaggagguugcagug

SEQ ID NO: 916072 - RNA, 22 nt, Human
ggcagaggaggggugaauuugc

SEQ ID NO: 916073 - RNA, 22 nt, Human
uaagaaacuauugucucugaac

SEQ ID NO: 916074 - RNA, 22 nt, Human
gaaagaaugcugggagccaucu

SEQ ID NO: 916075 - RNA, 22 nt, Human
gucaauaucuugguuguacuau

SEQ ID NO: 916076 - RNA, 22 nt, Human
aucuuuagauuagaaacucuaa

SEQ ID NO: 916077 - RNA, 22 nt, Human
ccaguggccaugcacgagcagc

SEQ ID NO: 916078 - RNA, 22 nt, Human
cugaggccucucuccuuggcuu

SEQ ID NO: 916079 - RNA, 22 nt, Human
aagagcuggucacagguccauu

SEQ ID NO: 916080 - RNA, 22 nt, Human
ggauguggaccuugccugguga

SEQ ID NO: 916081 - RNA, 22 nt, Human
auggggagagccucugucccca

SEQ ID NO: 916082 - RNA, 22 nt, Human
uuuaguuuuaacugaaagcuau

SEQ ID NO: 916083 - RNA, 22 nt, Human
uuugucuuuccccuccucauug

SEQ ID NO: 916084 - RNA, 22 nt, Human
cucuuccaccuccuucaggaga

SEQ ID NO: 916085 - RNA, 20 nt, Human
gugaagggagucaggugugc

SEQ ID NO: 916086 - RNA, 22 nt, Human
cuccuccuggacacaggcugug

SEQ ID NO: 916087 - RNA, 22 nt, Human
uuuaagcuaaugucauaauuag

SEQ ID NO: 916088 - RNA, 22 nt, Human
cucugaaagaguuuaguauuau

SEQ ID NO: 916089 - RNA, 22 nt, Human
agcagcuggaacauaugaagaa

SEQ ID NO: 916090 - RNA, 22 nt, Human
uagucaagauuggaauaaugua

SEQ ID NO: 916091 - RNA, 22 nt, Human
cacaaaccuucugcagccugua

SEQ ID NO: 916092 - RNA, 22 nt, Human
gcuccagcucguggcucccagc

SEQ ID NO: 916093 - RNA, 22 nt, Human
cuauuucugccuaaugaccugu

SEQ ID NO: 916094 - RNA, 22 nt, Human
cugagccagcuggcaugugcua

SEQ ID NO: 916095 - RNA, 22 nt, Human
gcucccagucugauggaggaga

SEQ ID NO: 916096 - RNA, 20 nt, Human
acuccagguggcaugaggac

SEQ ID NO: 916097 - RNA, 21 nt, Human
ugcaguucaagucaaucuacu

SEQ ID NO: 916098 - RNA, 22 nt, Human
gguaacuuagcucauggcugug

SEQ ID NO: 916099 - RNA, 22 nt, Human
caucuuaauuucuaacaggcac

SEQ ID NO: 916100 - RNA, 22 nt, Human
uauuaguaauaccugucucaua

SEQ ID NO: 916101 - RNA, 22 nt, Human
gaggcuguaaguguggagccua

SEQ ID NO: 916102 - RNA, 22 nt, Human
uuccacaaaucaauucugcuga

SEQ ID NO: 916103 - RNA, 22 nt, Human
aucuuucucugcacuauacaau

SEQ ID NO: 916104 - RNA, 22 nt, Human
acagcuucucugaaauucaugu

SEQ ID NO: 916105 - RNA, 22 nt, Human
cccaggaggugugcccaacucg

SEQ ID NO: 916106 - RNA, 22 nt, Human
cagcagugcuucagugugagau

SEQ ID NO: 916107 - RNA, 22 nt, Human
cagagccauuauggagacuugc

SEQ ID NO: 916108 - RNA, 22 nt, Human
gccaggcagcagcgaggauggu

SEQ ID NO: 916109 - RNA, 22 nt, Human
cccagcaucccagugggcagca

SEQ ID NO: 916110 - RNA, 22 nt, Human
acuggggaauggaacugggaau

SEQ ID NO: 916111 - RNA, 22 nt, Human
cacagcugggaaaauuuguaca

SEQ ID NO: 916112 - RNA, 22 nt, Human
ucugacagucacaguggaggau

SEQ ID NO: 916113 - RNA, 22 nt, Human
ccugaccacccuuggacaaggu

SEQ ID NO: 916114 - RNA, 22 nt, Human
ggggacugaggcacugaaggug

SEQ ID NO: 916115 - RNA, 22 nt, Human
ugaacaguuacuuuguagaaga

SEQ ID NO: 916116 - RNA, 22 nt, Human
aauguggacucuuguauuuuuc

SEQ ID NO: 916117 - RNA, 22 nt, Human
ucucuacauaaccucaauacuc

SEQ ID NO: 916118 - RNA, 22 nt, Human
aggagcugggcugcugcuggga

SEQ ID NO: 916119 - RNA, 22 nt, Human
ugguaagauaagagccaggccu

SEQ ID NO: 916120 - RNA, 22 nt, Human
uggcccaggugcacccagaggc

SEQ ID NO: 916121 - RNA, 22 nt, Human
gccugagcaggcguggaccaug

SEQ ID NO: 916122 - RNA, 22 nt, Human
gcugcugucacggugcuaaggg

SEQ ID NO: 916123 - RNA, 22 nt, Human
ucccaggcucuucaaggaagac

SEQ ID NO: 916124 - RNA, 22 nt, Human
uuucagacugcugugugaaacu

SEQ ID NO: 916125 - RNA, 22 nt, Human
aauuccagcugauugacuuucc

SEQ ID NO: 916126 - RNA, 22 nt, Human
caggacugaagggcacagggaa

SEQ ID NO: 916127 - RNA, 22 nt, Human
uuuggaaaaagacagcuuauga

SEQ ID NO: 916128 - RNA, 22 nt, Human
gcuggggccucugugagguuaa

SEQ ID NO: 916129 - RNA, 22 nt, Human
cagagcuuuggcuagaugguug

SEQ ID NO: 916130 - RNA, 22 nt, Human
ucaggggaaaucucucagcgaa

SEQ ID NO: 916131 - RNA, 22 nt, Human
gugcugagauuacaggugugag

SEQ ID NO: 916132 - RNA, 22 nt, Human
aggguccuucuguuccugagca

SEQ ID NO: 916133 - RNA, 22 nt, Human
caauuucagguggauagguuuu

SEQ ID NO: 916134 - RNA, 22 nt, Human
gugaggcagagaugccaaaacu

SEQ ID NO: 916135 - RNA, 22 nt, Human
ccucacagucaguucuuagucu

SEQ ID NO: 916136 - RNA, 22 nt, Human
cagccagaggggccagagucgg

SEQ ID NO: 916137 - RNA, 22 nt, Human
ggagaggcuuggcccagccugg

SEQ ID NO: 916138 - RNA, 22 nt, Human
agggcacagccuaaagccuaug

SEQ ID NO: 916139 - RNA, 22 nt, Human
uguuaaucaaucaacaguauua

SEQ ID NO: 916140 - RNA, 23 nt, Human
aauuuaguuugagacauuagccu

SEQ ID NO: 916141 - RNA, 22 nt, Human
cucugccaucucacuggguccu

SEQ ID NO: 916142 - RNA, 22 nt, Human
caaccugaugaauugaauuuaa

SEQ ID NO: 916143 - RNA, 22 nt, Human
agaggcacuaagggaagagcag

SEQ ID NO: 916144 - RNA, 22 nt, Human
guugcuuuucuccaucacaugg

SEQ ID NO: 916145 - RNA, 22 nt, Human
augaaaguaccuguaauauguu

SEQ ID NO: 916146 - RNA, 22 nt, Human
aaguuacuuuauguagaagaaa

SEQ ID NO: 916147 - RNA, 22 nt, Human
ugaggacauugagacuggagac

SEQ ID NO: 916148 - RNA, 21 nt, Human
gcuauacagaauggccagagg

SEQ ID NO: 916149 - RNA, 22 nt, Human
uuagaaagaacuuuagauauca

SEQ ID NO: 916150 - RNA, 22 nt, Human
ugaggcuaaaggugaccagauu

SEQ ID NO: 916151 - RNA, 22 nt, Human
agacccacacuuugaguagcaa

SEQ ID NO: 916152 - RNA, 18 nt, Human
uccugccugugccccagg

SEQ ID NO: 916153 - RNA, 22 nt, Human
caacuuuaugauugguuuguca

SEQ ID NO: 916154 - RNA, 22 nt, Human
ggcagcaguuacaaaugugcag

SEQ ID NO: 916155 - RNA, 22 nt, Human
agaaguuugcucacuugggaca

SEQ ID NO: 916156 - RNA, 22 nt, Human
gcacccaggcuugggcagcaac

SEQ ID NO: 916157 - RNA, 22 nt, Human
ggagccugguauaguguugcau

SEQ ID NO: 916158 - RNA, 22 nt, Human
aacacagguuugugguaaauaa

SEQ ID NO: 916159 - RNA, 22 nt, Human
cugcaggggcuggaguuggcuu

SEQ ID NO: 916160 - RNA, 22 nt, Human
guuuguguaacaugaugaugau

SEQ ID NO: 916161 - RNA, 22 nt, Human
gccagccccagacauccuaucg

SEQ ID NO: 916162 - RNA, 22 nt, Human
guuuccuaggcuuauacagcug

SEQ ID NO: 916163 - RNA, 22 nt, Human
gccuggggucccuuguuggcac

SEQ ID NO: 916164 - RNA, 22 nt, Human
uuaguuuccuguggugugaagu

SEQ ID NO: 916165 - RNA, 22 nt, Human
ggcccugagcacagcuccucuc

SEQ ID NO: 916166 - RNA, 22 nt, Human
gggcucugcagugacuugaggg

SEQ ID NO: 916167 - RNA, 22 nt, Human
ugcuuuuauuuaauaucuugca

SEQ ID NO: 916168 - RNA, 22 nt, Human
accuuagaccagcaagauauuu

SEQ ID NO: 916169 - RNA, 22 nt, Human
gcacguggaaugcucaugagcc

SEQ ID NO: 916170 - RNA, 22 nt, Human
aaggacaaagcagagcuggaug

SEQ ID NO: 916171 - RNA, 22 nt, Human
ucagagaguuagugucuuagcu

SEQ ID NO: 916172 - RNA, 22 nt, Human
uggcaggauuugcccggaagga

SEQ ID NO: 916173 - RNA, 22 nt, Human
aggcugugauuccaccacucuc

SEQ ID NO: 916174 - RNA, 22 nt, Human
accucuuaauauugcaccuucu

SEQ ID NO: 916175 - RNA, 22 nt, Human
gugugccagacaugaugcuaug

SEQ ID NO: 916176 - RNA, 22 nt, Human
uuuccuuguucauuugcccuau

SEQ ID NO: 916177 - RNA, 20 nt, Human
ggggaagucacugcagucag

SEQ ID NO: 916178 - RNA, 22 nt, Human
caaggcccugcaaccugacuug

SEQ ID NO: 916179 - RNA, 22 nt, Human
agacacagaacacaaaagcaua

SEQ ID NO: 916180 - RNA, 22 nt, Human
uuccaacuuuaaaauucauucu

SEQ ID NO: 916181 - RNA, 22 nt, Human
aagauacucaguggauaugcau

SEQ ID NO: 916182 - RNA, 22 nt, Human
auggcuuuccggacuuuggcca

SEQ ID NO: 916183 - RNA, 22 nt, Human
aaccaaggacagcuagugaugc

SEQ ID NO: 916184 - RNA, 22 nt, Human
agcugcucucacuggacgccug

SEQ ID NO: 916185 - RNA, 22 nt, Human
uagugccaugcgagggguggga

SEQ ID NO: 916186 - RNA, 22 nt, Human
gccagcugaaauuucaguucug

SEQ ID NO: 916187 - RNA, 22 nt, Human
ugugugaggacucagugaaaca

SEQ ID NO: 916188 - RNA, 22 nt, Human
ccuaagagauuauugcuccugc

SEQ ID NO: 916189 - RNA, 22 nt, Human
ucaaagucauggcaggcucaga

SEQ ID NO: 916190 - RNA, 22 nt, Human
ugagccugcugucgcuggaccc

SEQ ID NO: 916191 - RNA, 22 nt, Human
gggagcugaaguagggguaaau

SEQ ID NO: 916192 - RNA, 22 nt, Human
uccugagguauaugcuuugcag

SEQ ID NO: 916193 - RNA, 22 nt, Human
agcuguuuuugucugcugaucc

SEQ ID NO: 916194 - RNA, 22 nt, Human
auucuacaggacuggcaauccc

SEQ ID NO: 916195 - RNA, 20 nt, Human
accagaggaaagagcaguga

SEQ ID NO: 916196 - RNA, 22 nt, Human
aacuuuggcaagucagacuucu

SEQ ID NO: 916197 - RNA, 22 nt, Human
uccagccuaauguucuucccac

SEQ ID NO: 916198 - RNA, 22 nt, Human
acugauucaaguuaugcaucuu

SEQ ID NO: 916199 - RNA, 22 nt, Human
aggcgcugaguaggcaaggagg

SEQ ID NO: 916200 - RNA, 22 nt, Human
ccuaaacagaacaaagaggcag

SEQ ID NO: 916201 - RNA, 22 nt, Human
acuagcagggauauuauauaag

SEQ ID NO: 916202 - RNA, 22 nt, Human
caauuucauuaauagauauaga

SEQ ID NO: 916203 - RNA, 22 nt, Human
cugggggcaauggucagagugu

SEQ ID NO: 916204 - RNA, 21 nt, Human
aggcccagcuuuccucuugcu

SEQ ID NO: 916205 - RNA, 22 nt, Human
uguuuauuuucaggauggauug

SEQ ID NO: 916206 - RNA, 22 nt, Human
gccaggcugacucccccggccu

SEQ ID NO: 916207 - RNA, 19 nt, Human
ugcaaaugcuguugagaau

SEQ ID NO: 916208 - RNA, 22 nt, Human
aucuaggauuugaaugcacagu

SEQ ID NO: 916209 - RNA, 22 nt, Human
ccuggccugugaaucugagagc

SEQ ID NO: 916210 - RNA, 22 nt, Human
agcuguguagggaaucagagaa

SEQ ID NO: 916211 - RNA, 22 nt, Human
uuucuucauugaugucaggugg

SEQ ID NO: 916212 - RNA, 22 nt, Human
ccugggugaaauaguccucaag

SEQ ID NO: 916213 - RNA, 22 nt, Human
ugugcguggauuccuguacuca

SEQ ID NO: 916214 - RNA, 22 nt, Human
agaggggcccgguucuccgucu

SEQ ID NO: 916215 - RNA, 22 nt, Human
agagggcuucccuaggagugag

SEQ ID NO: 916216 - RNA, 22 nt, Human
ucuaccacucaugcuacuuacu

SEQ ID NO: 916217 - RNA, 22 nt, Human
acauggauuguuuuaaaagaug

SEQ ID NO: 916218 - RNA, 22 nt, Human
acccaggacucucuuccaguag

SEQ ID NO: 916219 - RNA, 22 nt, Human
agccaagagaugaggcugcagg

SEQ ID NO: 916220 - RNA, 22 nt, Human
cuuuccuucucgugguucucac

SEQ ID NO: 916221 - RNA, 22 nt, Human
agcagcaggaggcuguccacca

SEQ ID NO: 916222 - RNA, 22 nt, Human
ggcugagcuuauauaugugcug

SEQ ID NO: 916223 - RNA, 21 nt, Human
ugccaggccugagcugggguc

SEQ ID NO: 916224 - RNA, 22 nt, Human
gcagauggugggggaggaguac

SEQ ID NO: 916225 - RNA, 22 nt, Human
aucugucuaugauauagucugu

SEQ ID NO: 916226 - RNA, 18 nt, Human
gcaaggcucaggccaggc

SEQ ID NO: 916227 - RNA, 22 nt, Human
cuggccaguugccuuccugggu

SEQ ID NO: 916228 - RNA, 22 nt, Human
cucuuugugcuauuaugauccu

SEQ ID NO: 916229 - RNA, 22 nt, Human
ucccggcgcugggagguggguc

SEQ ID NO: 916230 - RNA, 22 nt, Human
uccaggagggauugggcugugg

SEQ ID NO: 916231 - RNA, 22 nt, Human
aguaaagcagaguugcaguaca

SEQ ID NO: 916232 - RNA, 22 nt, Human
gaagaaagaucaaauaguuucc

SEQ ID NO: 916233 - RNA, 23 nt, Human
uaaagcaaagucaagugcacucc

SEQ ID NO: 916234 - RNA, 22 nt, Human
cagaucaugaaugacugacaga

SEQ ID NO: 916235 - RNA, 22 nt, Human
agcaccuugaucuuggacuucc

SEQ ID NO: 916236 - RNA, 22 nt, Human
cagaacauccccacugcuaccu

SEQ ID NO: 916237 - RNA, 22 nt, Human
gcuggcuggaggugaggaagaa

SEQ ID NO: 916238 - RNA, 22 nt, Human
cugcuguguuucugcuagaaaa

SEQ ID NO: 916239 - RNA, 22 nt, Human
uggcucuggagcuggcggcuga

SEQ ID NO: 916240 - RNA, 22 nt, Human
cuucucagcauuuugucagucu

SEQ ID NO: 916241 - RNA, 22 nt, Human
uucacauaaucugcagcaagcg

SEQ ID NO: 916242 - RNA, 20 nt, Human
gcccucugccucccucagcg

SEQ ID NO: 916243 - RNA, 22 nt, Human
uguuuuuuuauauaccugaagu

SEQ ID NO: 916244 - RNA, 22 nt, Human
aguaaacacugucuuuauauau

SEQ ID NO: 916245 - RNA, 22 nt, Human
gauuuccuagacauggggcaga

SEQ ID NO: 916246 - RNA, 22 nt, Human
acuggaaauaaauuuugaaugu

SEQ ID NO: 916247 - RNA, 22 nt, Human
gggcuucaguucugaccaucuu

SEQ ID NO: 916248 - RNA, 22 nt, Human
augcaagcaacauuuugcacau

SEQ ID NO: 916249 - RNA, 22 nt, Human
aauaagugaguuuagcaaguuu

SEQ ID NO: 916250 - RNA, 22 nt, Human
ucugggagcuggcuuugccuca

SEQ ID NO: 916251 - RNA, 22 nt, Human
acgcagaagggccuggcgugcc

SEQ ID NO: 916252 - RNA, 22 nt, Human
uucaaacaguugcacaacuuau

SEQ ID NO: 916253 - RNA, 22 nt, Human
cccugugacgagcacggccagu

SEQ ID NO: 916254 - RNA, 22 nt, Human
gccaggaaaaaggguggccaau

SEQ ID NO: 916255 - RNA, 22 nt, Human
uaauaauuuuaaagaaggcuag

SEQ ID NO: 916256 - RNA, 22 nt, Human
agccaggggagucagcugcugg

SEQ ID NO: 916257 - RNA, 22 nt, Human
gggccaggaguggagauauggg

SEQ ID NO: 916258 - RNA, 21 nt, Human
uccucugcagugagguggccu

SEQ ID NO: 916259 - RNA, 22 nt, Human
caggcaaggacucugguaauuu

SEQ ID NO: 916260 - RNA, 22 nt, Human
ggaauguaacgugaccaaguuc

SEQ ID NO: 916261 - RNA, 22 nt, Human
uggccagcuuugacuguaaacc

SEQ ID NO: 916262 - RNA, 22 nt, Human
uuuaagcacagggauaaaguua

SEQ ID NO: 916263 - RNA, 22 nt, Human
cuccagcuucccucagcugugg

SEQ ID NO: 916264 - RNA, 22 nt, Human
ugauuuccacagucaggggugc

SEQ ID NO: 916265 - RNA, 22 nt, Human
ggcucugaauuauuccugaguc

SEQ ID NO: 916266 - RNA, 22 nt, Human
ugucauuuaugcuucuucagug

SEQ ID NO: 916267 - RNA, 22 nt, Human
ccagcccugucaccaacuggag

SEQ ID NO: 916268 - RNA, 22 nt, Human
gaggcugggaaguccaagacca

SEQ ID NO: 916269 - RNA, 22 nt, Human
uccugaggucugaaaaaggagc

SEQ ID NO: 916270 - RNA, 22 nt, Human
agaaaucucuagcacaucgaau

SEQ ID NO: 916271 - RNA, 22 nt, Human
gggauggacugacgguagcgcg

SEQ ID NO: 916272 - RNA, 22 nt, Human
gccaauuuauagccaaaaauca

SEQ ID NO: 916273 - RNA, 21 nt, Human
agguacaggucuugugagucu

SEQ ID NO: 916274 - RNA, 22 nt, Human
acagacuggccugucucgcacc

SEQ ID NO: 916275 - RNA, 20 nt, Human
ucuugcagcuccuguaccau

SEQ ID NO: 916276 - RNA, 22 nt, Human
gaauuaaaauaguuuuggucga

SEQ ID NO: 916277 - RNA, 17 nt, Human
accaggcaacacgccca

SEQ ID NO: 916278 - RNA, 22 nt, Human
auauguauguguuuucuuugga

SEQ ID NO: 916279 - RNA, 22 nt, Human
gcuccaggccccagcguuccgc

SEQ ID NO: 916280 - RNA, 22 nt, Human
gcacugcagccucagauggugg

SEQ ID NO: 916281 - RNA, 20 nt, Human
gcugggcuuugacugacaca

SEQ ID NO: 916282 - RNA, 22 nt, Human
gagaaggcugauccuuggaguu

SEQ ID NO: 916283 - RNA, 22 nt, Human
gcuuuuauuucuucacaaaagu

SEQ ID NO: 916284 - RNA, 22 nt, Human
agcagggcaguuaaaggguccu

SEQ ID NO: 916285 - RNA, 22 nt, Human
ugcuagcacugugcagucuacg

SEQ ID NO: 916286 - RNA, 22 nt, Human
gcuguucuuugcaucucuggug

SEQ ID NO: 916287 - RNA, 22 nt, Human
agcagcacgaguccacaaaucc

SEQ ID NO: 916288 - RNA, 22 nt, Human
uucauugaguuacugccugggc

SEQ ID NO: 916289 - RNA, 22 nt, Human
guccccucaaaauucauauguu

SEQ ID NO: 916290 - RNA, 21 nt, Human
uaacaaagacuucuggucagg

SEQ ID NO: 916291 - RNA, 22 nt, Human
agaugggcgcccuggacugagg

SEQ ID NO: 916292 - RNA, 22 nt, Human
agacuuuagggccaugguaggu

SEQ ID NO: 916293 - RNA, 20 nt, Human
uuucuuguacuuggagaagg

SEQ ID NO: 916294 - RNA, 22 nt, Human
agucagugucaacaggaaguag

SEQ ID NO: 916295 - RNA, 22 nt, Human
ugugccuggaucucugugacaa

SEQ ID NO: 916296 - RNA, 22 nt, Human
gacaggcuuucucaggaugagc

SEQ ID NO: 916297 - RNA, 22 nt, Human
gcggaaaugcagggcuagggug

SEQ ID NO: 916298 - RNA, 22 nt, Human
uuagccauauagugcucuugua

SEQ ID NO: 916299 - RNA, 22 nt, Human
uuuaucuuuggaucuucagaaa

SEQ ID NO: 916300 - RNA, 22 nt, Human
cgccaguauguggcugucuuug

SEQ ID NO: 916301 - RNA, 22 nt, Human
agaaagcuuaugaaugggcaag

SEQ ID NO: 916302 - RNA, 22 nt, Human
gcugcuguccuucaagucugcg

SEQ ID NO: 916303 - RNA, 20 nt, Human
agcuggcccacagguguggg

SEQ ID NO: 916304 - RNA, 22 nt, Human
aguguucaggaucugaggccag

SEQ ID NO: 916305 - RNA, 22 nt, Human
uucuuuuuggauagcugaugaa

SEQ ID NO: 916306 - RNA, 22 nt, Human
augucauauuacuaaugcuggc

SEQ ID NO: 916307 - RNA, 22 nt, Human
uauaaagaaguguaaacaggaa

SEQ ID NO: 916308 - RNA, 21 nt, Human
uggcugaguggaugcaugaau

SEQ ID NO: 916309 - RNA, 22 nt, Human
gcuguggcggcagcagcuggug

SEQ ID NO: 916310 - RNA, 22 nt, Human
ggccccagguagaagauauaga

SEQ ID NO: 916311 - RNA, 22 nt, Human
cuuccugggcccugcuuaagca

SEQ ID NO: 916312 - RNA, 22 nt, Human
ggcucuggguaaggcguuugac

SEQ ID NO: 916313 - RNA, 22 nt, Human
uuggaaggagucuuuggggaug

SEQ ID NO: 916314 - RNA, 22 nt, Human
gccagcaaguaucaccaaagcc

SEQ ID NO: 916315 - RNA, 22 nt, Human
uuacaguuucuaguaauacuug

SEQ ID NO: 916316 - RNA, 22 nt, Human
aucuucaacuuuggggcugccu

SEQ ID NO: 916317 - RNA, 22 nt, Human
uuaaacagagucugaaauguaa

SEQ ID NO: 916318 - RNA, 22 nt, Human
ugcacacacgcggcacaucugu

SEQ ID NO: 916319 - RNA, 22 nt, Human
ggccagcucagacuccacuugc

SEQ ID NO: 916320 - RNA, 22 nt, Human
aagaguuucugauucaguaggu

SEQ ID NO: 916321 - RNA, 22 nt, Human
gcacaaggagcaguguaugaaa

SEQ ID NO: 916322 - RNA, 22 nt, Human
acugugaacggacugaagccca

SEQ ID NO: 916323 - RNA, 22 nt, Human
uuaggaaaauggaguccuuuua

SEQ ID NO: 916324 - RNA, 22 nt, Human
agguuuaucucauagaaagaau

SEQ ID NO: 916325 - RNA, 20 nt, Human
ccuuuagaaacucauaugua

SEQ ID NO: 916326 - RNA, 22 nt, Human
cauuugcauaugaagaaguaag

SEQ ID NO: 916327 - RNA, 22 nt, Human
acucugggccccagguggagcu

SEQ ID NO: 916328 - RNA, 22 nt, Human
cuggguuccauguagccaagag

SEQ ID NO: 916329 - RNA, 22 nt, Human
agauucauuguggauauuuucu

SEQ ID NO: 916330 - RNA, 22 nt, Human
agucuugucuugcaagggcuga

SEQ ID NO: 916331 - RNA, 22 nt, Human
cuggcuggccaugcagcgccag

SEQ ID NO: 916332 - RNA, 22 nt, Human
uuuguacaggugcaggcauuug

SEQ ID NO: 916333 - RNA, 22 nt, Human
ccugcagagcaggagaggcauc

SEQ ID NO: 916334 - RNA, 22 nt, Human
uguucccaagauaagauuauga

SEQ ID NO: 916335 - RNA, 22 nt, Human
uggacagguuugggugccuguu

SEQ ID NO: 916336 - RNA, 22 nt, Human
acaccccaccaguaacugaggg

SEQ ID NO: 916337 - RNA, 22 nt, Human
ugaugaaugucauacauaauga

SEQ ID NO: 916338 - RNA, 22 nt, Human
ggaaagagggacccagcuuggu

SEQ ID NO: 916339 - RNA, 22 nt, Human
cucuuagaaacuauagagauua

SEQ ID NO: 916340 - RNA, 22 nt, Human
aauucugauuagaugccuuugu

SEQ ID NO: 916341 - RNA, 22 nt, Human
gcaaacaucuuagccauagagu

SEQ ID NO: 916342 - RNA, 22 nt, Human
acagugugggacauuaggaaau

SEQ ID NO: 916343 - RNA, 22 nt, Human
cugaaugaaaucaaggacugag

SEQ ID NO: 916344 - RNA, 22 nt, Human
aacugauaauggacacauaaaa

SEQ ID NO: 916345 - RNA, 22 nt, Human
auuacucugucugccucugacc

SEQ ID NO: 916346 - RNA, 22 nt, Human
gccuggggucucugacucacag

SEQ ID NO: 916347 - RNA, 22 nt, Human
gucccagcuucccacuagcagc

SEQ ID NO: 916348 - RNA, 22 nt, Human
caagacauugauuuuguacaga

SEQ ID NO: 916349 - RNA, 22 nt, Human
ggcuccugauaggagaaugcgg

SEQ ID NO: 916350 - RNA, 20 nt, Human
cucagugcuuucauugccuc

SEQ ID NO: 916351 - RNA, 22 nt, Human
cagcagccuggccccuccucgg

SEQ ID NO: 916352 - RNA, 22 nt, Human
ucuuuccucugagcuccuguag

SEQ ID NO: 916353 - RNA, 22 nt, Human
aagcagcacagcaaugacucua

SEQ ID NO: 916354 - RNA, 22 nt, Human
cuggcauuuagacccacagcaa

SEQ ID NO: 916355 - RNA, 22 nt, Human
ggaaguguuugugcagauggcc

SEQ ID NO: 916356 - RNA, 22 nt, Human
cauugagaggcugccugccuga

SEQ ID NO: 916357 - RNA, 19 nt, Human
uagcagagaugacuccagc

SEQ ID NO: 916358 - RNA, 22 nt, Human
cuaggaagcugugcggacccug

SEQ ID NO: 916359 - RNA, 22 nt, Human
ucuucaggcucuggcugccuuu

SEQ ID NO: 916360 - RNA, 22 nt, Human
cccaggaagggaugccaaggaa

SEQ ID NO: 916361 - RNA, 22 nt, Human
uauuaacaugaacugacuuuuc

SEQ ID NO: 916362 - RNA, 22 nt, Human
acaguuauuuacugcauaaacu

SEQ ID NO: 916363 - RNA, 22 nt, Human
uggcuccaaaaacaaaugacau

SEQ ID NO: 916364 - RNA, 22 nt, Human
uccugggccaagggcugugagg

SEQ ID NO: 916365 - RNA, 21 nt, Human
agcagacagcccaagaaaauc

SEQ ID NO: 916366 - RNA, 22 nt, Human
cagcacagcugaggggcugucu

SEQ ID NO: 916367 - RNA, 19 nt, Human
ucugacacuuacacacccc

SEQ ID NO: 916368 - RNA, 22 nt, Human
caugugugagugagcagucuuc

SEQ ID NO: 916369 - RNA, 22 nt, Human
aaaguuuauuuucccugguuag

SEQ ID NO: 916370 - RNA, 22 nt, Human
aguucuauaauuaaaaugaagg

SEQ ID NO: 916371 - RNA, 21 nt, Human
auucuagacaacacugaaauc

SEQ ID NO: 916372 - RNA, 22 nt, Human
uuugagguuagcuagcagauca

SEQ ID NO: 916373 - RNA, 22 nt, Human
gaaaugucauugccuucagccc

SEQ ID NO: 916374 - RNA, 22 nt, Human
uguccagcugaaggcagccuca

SEQ ID NO: 916375 - RNA, 22 nt, Human
acaaauuauagaaaauugagcu

SEQ ID NO: 916376 - RNA, 22 nt, Human
aguuaacauuugagcuaaaagg

SEQ ID NO: 916377 - RNA, 22 nt, Human
ccuggggaaaagcaggcauuua

SEQ ID NO: 916378 - RNA, 22 nt, Human
cuucaaauucgaggaguagaug

SEQ ID NO: 916379 - RNA, 19 nt, Human
acaugcauauggacaguug

SEQ ID NO: 916380 - RNA, 22 nt, Human
gaccugcuccacgacaaguggu

SEQ ID NO: 916381 - RNA, 22 nt, Human
auguucugaaucaagcaacucu

SEQ ID NO: 916382 - RNA, 22 nt, Human
acagaugauuuuuaugaaaaca

SEQ ID NO: 916383 - RNA, 22 nt, Human
ucugggugaugaaaugcacugu

SEQ ID NO: 916384 - RNA, 22 nt, Human
uuauucacucauuaaagcagga

SEQ ID NO: 916385 - RNA, 22 nt, Human
gugagggcagcuuggucagugu

SEQ ID NO: 916386 - RNA, 22 nt, Human
uacaacugcacaucugaaucac

SEQ ID NO: 916387 - RNA, 22 nt, Human
cugcucuaggggcagggcccuu

SEQ ID NO: 916388 - RNA, 22 nt, Human
ucacagcaggguaacaggaaga

SEQ ID NO: 916389 - RNA, 22 nt, Human
ucaguguuuuaacugucuuuua

SEQ ID NO: 916390 - RNA, 23 nt, Human
gacaaagcacuugaaauguguac

SEQ ID NO: 916391 - RNA, 22 nt, Human
cagagguguuggugaauggaga

SEQ ID NO: 916392 - RNA, 22 nt, Human
caaugacacucugcacagugcu

SEQ ID NO: 916393 - RNA, 22 nt, Human
acaguggugagugacugauagg

SEQ ID NO: 916394 - RNA, 22 nt, Human
aggacccugagcgggcaugccg

SEQ ID NO: 916395 - RNA, 22 nt, Human
cucugagggucuaaggagucac

SEQ ID NO: 916396 - RNA, 22 nt, Human
guucugggaagguggaccuguu

SEQ ID NO: 916397 - RNA, 22 nt, Human
aggcacagagaaguaaaguauc

SEQ ID NO: 916398 - RNA, 22 nt, Human
gcucagagaaguugugccuggc

SEQ ID NO: 916399 - RNA, 22 nt, Human
ugcagcugauuaaagggcagac

SEQ ID NO: 916400 - RNA, 22 nt, Human
ggcccaguguggguggauguug

SEQ ID NO: 916401 - RNA, 22 nt, Human
ucuguuggacauucaucugcag

SEQ ID NO: 916402 - RNA, 22 nt, Human
cagaagagaugaaauaguauua

SEQ ID NO: 916403 - RNA, 22 nt, Human
acugucucucuagcaguucagg

SEQ ID NO: 916404 - RNA, 22 nt, Human
uauuccagaugaaaucauucag

SEQ ID NO: 916405 - RNA, 19 nt, Human
uggcagugugggguaugaa

SEQ ID NO: 916406 - RNA, 21 nt, Human
uaaagaagaugaaugugauca

SEQ ID NO: 916407 - RNA, 22 nt, Human
ugauuaaaauuuaacuuaguua

SEQ ID NO: 916408 - RNA, 22 nt, Human
gagcaauagcaccaauuaacuc

SEQ ID NO: 916409 - RNA, 18 nt, Human
ugugugcaccugccuuga

SEQ ID NO: 916410 - RNA, 22 nt, Human
auggaacugagcuugccaaacu

SEQ ID NO: 916411 - RNA, 22 nt, Human
acugucacugugauguuagaga

SEQ ID NO: 916412 - RNA, 19 nt, Human
ugcagaagacacaguggug

SEQ ID NO: 916413 - RNA, 21 nt, Human
ugcgugugcauggccuucggg

SEQ ID NO: 916414 - RNA, 19 nt, Human
agaagcugugaaaugaagg

SEQ ID NO: 916415 - RNA, 22 nt, Human
ugugggagaaggaagcaagcug

SEQ ID NO: 916416 - RNA, 22 nt, Human
uacacagaaauuguguagggau

SEQ ID NO: 916417 - RNA, 22 nt, Human
ccacccugagccgcaagagcag

SEQ ID NO: 916418 - RNA, 19 nt, Human
agauaagaguugacugugg

SEQ ID NO: 916419 - RNA, 22 nt, Human
gcucuagguuccuagccaaguc

SEQ ID NO: 916420 - RNA, 22 nt, Human
uggcugagaccaucagggugua

SEQ ID NO: 916421 - RNA, 22 nt, Human
ggcaccugguaagugcucagua

SEQ ID NO: 916422 - RNA, 22 nt, Human
ggcugagcucaggggcagcagg

SEQ ID NO: 916423 - RNA, 22 nt, Human
auguuaccuuguucuccaaaaa

SEQ ID NO: 916424 - RNA, 22 nt, Human
uagcagcuuaaguaauuagaau

SEQ ID NO: 916425 - RNA, 20 nt, Human
ugcuccaucuaaagugauua

SEQ ID NO: 916426 - RNA, 22 nt, Human
ggucaucuguguauccucagug

SEQ ID NO: 916427 - RNA, 19 nt, Human
aggucuugacucuguucuu

SEQ ID NO: 916428 - RNA, 18 nt, Human
gacacaggagagaguccc

SEQ ID NO: 916429 - RNA, 22 nt, Human
aucggggaaaagggaggcugug

SEQ ID NO: 916430 - RNA, 22 nt, Human
acuucaaaaauaagugagaggu

SEQ ID NO: 916431 - RNA, 22 nt, Human
ggcauuuauuugucucauucuu

SEQ ID NO: 916432 - RNA, 22 nt, Human
cccaggaggcagagguuggagc

SEQ ID NO: 916433 - RNA, 22 nt, Human
augucuguguuaucuguagaau

SEQ ID NO: 916434 - RNA, 22 nt, Human
ugacauuugagagagauauaca

SEQ ID NO: 916435 - RNA, 22 nt, Human
augcauauauacauacacaguc

SEQ ID NO: 916436 - RNA, 22 nt, Human
aguuuuauguucacagaaggau

SEQ ID NO: 916437 - RNA, 22 nt, Human
uuauugcuuuggaaaacacuca

SEQ ID NO: 916438 - RNA, 22 nt, Human
gacaaaaguguuuugaacaagg

SEQ ID NO: 916439 - RNA, 22 nt, Human
ucaaacugaacuaagauccaac

SEQ ID NO: 916440 - RNA, 22 nt, Human
gcugggcaacggaagagagaaa

SEQ ID NO: 916441 - RNA, 22 nt, Human
agcuucuggaagccuggcagca

SEQ ID NO: 916442 - RNA, 22 nt, Human
uggccagccacaauauaaagua

SEQ ID NO: 916443 - RNA, 22 nt, Human
cagucuagaugcuagaaaauau

SEQ ID NO: 916444 - RNA, 22 nt, Human
gaagaggcuuuccuagggcaag

SEQ ID NO: 916445 - RNA, 22 nt, Human
augccagacauuaacgacuaug

SEQ ID NO: 916446 - RNA, 22 nt, Human
gagaggcuggcagugccagguu

SEQ ID NO: 916447 - RNA, 22 nt, Human
ggguucagacuaaagcuaugca

SEQ ID NO: 916448 - RNA, 21 nt, Human
ucuagaauccuguauaagacu

SEQ ID NO: 916449 - RNA, 22 nt, Human
gagcugccuacauugccaagag

SEQ ID NO: 916450 - RNA, 22 nt, Human
ucccucagcaggaacuggccug

SEQ ID NO: 916451 - RNA, 22 nt, Human
aucugaaaagcuuuaaugagcu

SEQ ID NO: 916452 - RNA, 22 nt, Human
acauuaacaccauaaguguguu

SEQ ID NO: 916453 - RNA, 22 nt, Human
ucauaaaugcagugucauaaau

SEQ ID NO: 916454 - RNA, 22 nt, Human
ccuugaaacccugacacucugu

SEQ ID NO: 916455 - RNA, 18 nt, Human
ucucuucuuggcagucaa

SEQ ID NO: 916456 - RNA, 23 nt, Human
ugccucaguggaaugugagggug

SEQ ID NO: 916457 - RNA, 22 nt, Human
cagaaauaugugccaugccuua

SEQ ID NO: 916458 - RNA, 22 nt, Human
cacagacccagaagggaugaag

SEQ ID NO: 916459 - RNA, 22 nt, Human
uguguauauuaggacacauucu

SEQ ID NO: 916460 - RNA, 19 nt, Human
acagaaauuaguuauuuuc

SEQ ID NO: 916461 - RNA, 22 nt, Human
guagaggacauuugacaugaug

SEQ ID NO: 916462 - RNA, 17 nt, Human
gcuuuccuugccccucc

SEQ ID NO: 916463 - RNA, 22 nt, Human
agagcaggcauaaagcuuugaa

SEQ ID NO: 916464 - RNA, 22 nt, Human
uucaguuucuucccugugaaau

SEQ ID NO: 916465 - RNA, 22 nt, Human
ccaggguggaggcuggauggag

SEQ ID NO: 916466 - RNA, 22 nt, Human
aaaguucugggggagaagaacg

SEQ ID NO: 916467 - RNA, 20 nt, Human
ugguggacuuuggcauggcu

SEQ ID NO: 916468 - RNA, 22 nt, Human
uacagcaagacagaccgcucaa

SEQ ID NO: 916469 - RNA, 22 nt, Human
caaaguaacugccuuuccaauu

SEQ ID NO: 916470 - RNA, 22 nt, Human
augucuguacgaguuacaaugg

SEQ ID NO: 916471 - RNA, 19 nt, Human
uugcauuucauguuugauu

SEQ ID NO: 916472 - RNA, 22 nt, Human
ugcugccagggcucugcccaca

SEQ ID NO: 916473 - RNA, 22 nt, Human
acaguaacucuuuuacccuccu

SEQ ID NO: 916474 - RNA, 22 nt, Human
gagggcagagucuaaugaugca

SEQ ID NO: 916475 - RNA, 22 nt, Human
cagcagcaugaauucgagccac

SEQ ID NO: 916476 - RNA, 22 nt, Human
cauaacuggggacacuucucua

SEQ ID NO: 916477 - RNA, 22 nt, Human
uugcuuauagagaguuucauac

SEQ ID NO: 916478 - RNA, 22 nt, Human
cacugagaguagggcacaagug

SEQ ID NO: 916479 - RNA, 22 nt, Human
aaguacaugcuuuauucagagu

SEQ ID NO: 916480 - RNA, 22 nt, Human
ugcuauguugccuaguguaaua

SEQ ID NO: 916481 - RNA, 22 nt, Human
auuuccuauagauauggugagu

SEQ ID NO: 916482 - RNA, 22 nt, Human
guucuggaaagcaagaaagagu

SEQ ID NO: 916483 - RNA, 22 nt, Human
uguguguuggcuggagagggcu

SEQ ID NO: 916484 - RNA, 19 nt, Human
gacuaucucuggagaccau

SEQ ID NO: 916485 - RNA, 22 nt, Human
acagcauaaucacuucuuucuu

SEQ ID NO: 916486 - RNA, 22 nt, Human
ucaacaauuuugagaugagaca

SEQ ID NO: 916487 - RNA, 22 nt, Human
ugugggucuuccaaagaagggc

SEQ ID NO: 916488 - RNA, 22 nt, Human
aaguuacuggcaagggcugcag

SEQ ID NO: 916489 - RNA, 22 nt, Human
caaagcagaagguucuguggua

SEQ ID NO: 916490 - RNA, 22 nt, Human
accuauuuaugcaauuaugaaa

SEQ ID NO: 916491 - RNA, 22 nt, Human
uaggaaauuagaacuuggaaac

SEQ ID NO: 916492 - RNA, 22 nt, Human
augcacacaagcuuauguauua

SEQ ID NO: 916493 - RNA, 17 nt, Human
uguucucuucagaaauc

SEQ ID NO: 916494 - RNA, 22 nt, Human
uagcugagagcucacuugagga

SEQ ID NO: 916495 - RNA, 22 nt, Human
acauucugugagucauguuuua

SEQ ID NO: 916496 - RNA, 22 nt, Human
aggcugaggcagguggaucacc

SEQ ID NO: 916497 - RNA, 22 nt, Human
cccugccuucuuggccuuuaaa

SEQ ID NO: 916498 - RNA, 22 nt, Human
gaguggcuuuggagaaguaggg

SEQ ID NO: 916499 - RNA, 22 nt, Human
uaguguaaauaacugccuagac

SEQ ID NO: 916500 - RNA, 22 nt, Human
uaaccuacaugagaacuuuaaa

SEQ ID NO: 916501 - RNA, 22 nt, Human
uggcuucucugugugagggaga

SEQ ID NO: 916502 - RNA, 22 nt, Human
ucagaaaaugaaauggacucuc

SEQ ID NO: 916503 - RNA, 22 nt, Human
uguauaguuucuuaguuacuga

SEQ ID NO: 916504 - RNA, 22 nt, Human
gaacacauuucucugacuguag

SEQ ID NO: 916505 - RNA, 22 nt, Human
auuccaaagacagaagcagcug

SEQ ID NO: 916506 - RNA, 22 nt, Human
gccacagggaggcguuuucagg

SEQ ID NO: 916507 - RNA, 22 nt, Human
uauauuaccugccugaucuaua

SEQ ID NO: 916508 - RNA, 20 nt, Human
ccugcugugcuuuccaugga

SEQ ID NO: 916509 - RNA, 22 nt, Human
acagcaauuuugugcacaagug

SEQ ID NO: 916510 - RNA, 22 nt, Human
ccagccugaaaugccucauccu

SEQ ID NO: 916511 - RNA, 22 nt, Human
uccuggaggggacagcaugggc

SEQ ID NO: 916512 - RNA, 22 nt, Human
ccugccuuccagccuugggcuc

SEQ ID NO: 916513 - RNA, 22 nt, Human
agggagcaaagguuucaggguu

SEQ ID NO: 916514 - RNA, 22 nt, Human
gcacaaggagaauucauuagug

SEQ ID NO: 916515 - RNA, 22 nt, Human
aaaugcuuguaaauuuuccaug

SEQ ID NO: 916516 - RNA, 22 nt, Human
cauaugaagaugucuuuuugua

SEQ ID NO: 916517 - RNA, 22 nt, Human
acaugauuaaaagauuuuaaag

SEQ ID NO: 916518 - RNA, 22 nt, Human
gggaagagaccguacccuggcc

SEQ ID NO: 916519 - RNA, 22 nt, Human
ugcauuugcuggggaugugauu

SEQ ID NO: 916520 - RNA, 22 nt, Human
uggcaggaaaaagggccagagg

SEQ ID NO: 916521 - RNA, 20 nt, Human
guguuucaugugauacaaug

SEQ ID NO: 916522 - RNA, 22 nt, Human
ugcccacauucaaaaggugaug

SEQ ID NO: 916523 - RNA, 22 nt, Human
ggaagaugagaaguggggcucc

SEQ ID NO: 916524 - RNA, 22 nt, Human
gaggguggccuuuagagcccau

SEQ ID NO: 916525 - RNA, 22 nt, Human
gcuucagauucuuuucaugucu

SEQ ID NO: 916526 - RNA, 22 nt, Human
gcugugugaaaacugggccugg

SEQ ID NO: 916527 - RNA, 22 nt, Human
aaucuagagugcuaggucugug

SEQ ID NO: 916528 - RNA, 22 nt, Human
agcugacagugcauggagggac

SEQ ID NO: 916529 - RNA, 21 nt, Human
ucucugagcccaccaggaucu

SEQ ID NO: 916530 - RNA, 22 nt, Human
agccuuagaggaaaacauuagu

SEQ ID NO: 916531 - RNA, 19 nt, Human
augggaagcggccagcgga

SEQ ID NO: 916532 - RNA, 22 nt, Human
gguucacagguccgacugcugg

SEQ ID NO: 916533 - RNA, 22 nt, Human
cccucgggucgcggacugcgcu

SEQ ID NO: 916534 - RNA, 22 nt, Human
auaauuuaaauuaguaugugau

SEQ ID NO: 916535 - RNA, 22 nt, Human
gaacuuuaccauuuagguaacu

SEQ ID NO: 916536 - RNA, 22 nt, Human
aaaauggauagugcgucuucuc

SEQ ID NO: 916537 - RNA, 18 nt, Human
ucuucaucuccugagcug

SEQ ID NO: 916538 - RNA, 22 nt, Human
agacaaacccaguggcuguuuu

SEQ ID NO: 916539 - RNA, 22 nt, Human
uccuguggaagacaguguuggg

SEQ ID NO: 916540 - RNA, 22 nt, Human
cuucccacagaauucaaucagu

SEQ ID NO: 916541 - RNA, 22 nt, Human
uuucauguauuucccaaagcuu

SEQ ID NO: 916542 - RNA, 22 nt, Human
agaacauuugucaaaaagccaa

SEQ ID NO: 916543 - RNA, 22 nt, Human
ucauauuucaaaauggcuggag

SEQ ID NO: 916544 - RNA, 22 nt, Human
aaacaguuuuccuagcugucug

SEQ ID NO: 916545 - RNA, 22 nt, Human
agugucuuuauagacugacaau

SEQ ID NO: 916546 - RNA, 22 nt, Human
cagaaccugugaauguguuauc

SEQ ID NO: 916547 - RNA, 22 nt, Human
uggccagccuugucaucgcuuu

SEQ ID NO: 916548 - RNA, 22 nt, Human
ccaauccucauguucaacaacc

SEQ ID NO: 916549 - RNA, 22 nt, Human
gcaaaaugaucuucuucaggcu

SEQ ID NO: 916550 - RNA, 22 nt, Human
agggccugagaccguggcuuga

SEQ ID NO: 916551 - RNA, 22 nt, Human
uggaggucgcgcgggugcugca

SEQ ID NO: 916552 - RNA, 22 nt, Human
cuuuagaauuugauauaaucaa

SEQ ID NO: 916553 - RNA, 23 nt, Human
uaggguguuaagucagugauuga

SEQ ID NO: 916554 - RNA, 22 nt, Human
uggcagaauuuuaaagacagau

SEQ ID NO: 916555 - RNA, 22 nt, Human
cacugcuuaguugguaaaugug

SEQ ID NO: 916556 - RNA, 22 nt, Human
uaagagcucccuucuccuugca

SEQ ID NO: 916557 - RNA, 22 nt, Human
cccucucucuaucgggccccag

SEQ ID NO: 916558 - RNA, 22 nt, Human
uggaggcaguuuaagucugaga

SEQ ID NO: 916559 - RNA, 20 nt, Human
gcagcugcccccagucccug

SEQ ID NO: 916560 - RNA, 22 nt, Human
uacuaguuucuaccuuacagaa

SEQ ID NO: 916561 - RNA, 21 nt, Human
ucaaacaugaucugggucauc

SEQ ID NO: 916562 - RNA, 22 nt, Human
gcuaggaacauuuauauacaaa

SEQ ID NO: 916563 - RNA, 23 nt, Human
caugauguuaacuuuguuaugcu

SEQ ID NO: 916564 - RNA, 22 nt, Human
uuugacaguccccugauguuug

SEQ ID NO: 916565 - RNA, 22 nt, Human
auucacugucagcuugcauggg

SEQ ID NO: 916566 - RNA, 22 nt, Human
cgucacuggcgugaagugagga

SEQ ID NO: 916567 - RNA, 22 nt, Human
uacaccugcugagccuguccuc

SEQ ID NO: 916568 - RNA, 22 nt, Human
aagaggagaaaggcuggcuuug

SEQ ID NO: 916569 - RNA, 22 nt, Human
aucuguccuggagcuaggcuuc

SEQ ID NO: 916570 - RNA, 22 nt, Human
ggcaggugggaacccuccccac

SEQ ID NO: 916571 - RNA, 22 nt, Human
agcuccaggugcaagucauggu

SEQ ID NO: 916572 - RNA, 22 nt, Human
ggcuuuaucaaaugagacccug

SEQ ID NO: 916573 - RNA, 22 nt, Human
gaagaugugggaacugcugaaa

SEQ ID NO: 916574 - RNA, 22 nt, Human
ucagggcaagucucagaagguu

SEQ ID NO: 916575 - RNA, 22 nt, Human
uuccggggauaguguuucccau

SEQ ID NO: 916576 - RNA, 22 nt, Human
aguagacagacagaacacagcc

SEQ ID NO: 916577 - RNA, 22 nt, Human
ucaggcagaaaaaucacuaauu

SEQ ID NO: 916578 - RNA, 22 nt, Human
gagccaagaucgcaccacugca

SEQ ID NO: 916579 - RNA, 22 nt, Human
uuacaaguucagauuuucucau

SEQ ID NO: 916580 - RNA, 22 nt, Human
gccagccacuucccagacuggc

SEQ ID NO: 916581 - RNA, 22 nt, Human
uuggaagauuacuuaguuuucu

SEQ ID NO: 916582 - RNA, 19 nt, Human
uagcucugucuuauuccaa

SEQ ID NO: 916583 - RNA, 22 nt, Human
uucuuguuccaugaaagacaga

SEQ ID NO: 916584 - RNA, 22 nt, Human
cuccugggcugucggcgcucug

SEQ ID NO: 916585 - RNA, 22 nt, Human
gaggccugucgcuaggccucug

SEQ ID NO: 916586 - RNA, 22 nt, Human
ucacacagcugcucuguuuuau

SEQ ID NO: 916587 - RNA, 22 nt, Human
acucugcucuguauuucacugu

SEQ ID NO: 916588 - RNA, 22 nt, Human
uugacacagaucaauauucaac

SEQ ID NO: 916589 - RNA, 23 nt, Human
ggagugcaauggcgccaucucgg

SEQ ID NO: 916590 - RNA, 22 nt, Human
ccacugcuagagaugcaucccc

SEQ ID NO: 916591 - RNA, 22 nt, Human
uaaguccacaggaguuguguuc

SEQ ID NO: 916592 - RNA, 21 nt, Human
auucagaaagggaauaaacuc

SEQ ID NO: 916593 - RNA, 22 nt, Human
guuaaugugucugacacaaugg

SEQ ID NO: 916594 - RNA, 22 nt, Human
aucuuccaagcucccuggugua

SEQ ID NO: 916595 - RNA, 22 nt, Human
uguccuggccaaggccuugcuu

SEQ ID NO: 916596 - RNA, 22 nt, Human
guuuagaauucuaacuuuaagg

SEQ ID NO: 916597 - RNA, 22 nt, Human
cuggagguaauguuauuuuugu

SEQ ID NO: 916598 - RNA, 22 nt, Human
uggcagaguggaccauacucaa

SEQ ID NO: 916599 - RNA, 22 nt, Human
acuuugauaguuuaaucuagga

SEQ ID NO: 916600 - RNA, 22 nt, Human
auuggugcaauuaugagggugu

SEQ ID NO: 916601 - RNA, 22 nt, Human
ugugaaaggagccauagacagu

SEQ ID NO: 916602 - RNA, 22 nt, Human
cuggccaguuguccuggcuugg

SEQ ID NO: 916603 - RNA, 22 nt, Human
agcaggggucucugcuaaugaa

SEQ ID NO: 916604 - RNA, 22 nt, Human
cuguaggugauugcuauguuau

SEQ ID NO: 916605 - RNA, 22 nt, Human
gcucuggguagccacugccugg

SEQ ID NO: 916606 - RNA, 22 nt, Human
uuuucuauucauugucuauggu

SEQ ID NO: 916607 - RNA, 22 nt, Human
aagcugccagcugagcugaggc

SEQ ID NO: 916608 - RNA, 22 nt, Human
ugccuguggaaaggcuggugcu

SEQ ID NO: 916609 - RNA, 22 nt, Human
uugaaacuuagaaauugagcug

SEQ ID NO: 916610 - RNA, 22 nt, Human
ugcacagaucugguggcaagga

SEQ ID NO: 916611 - RNA, 22 nt, Human
ucagaggucacacagcaaguuu

SEQ ID NO: 916612 - RNA, 22 nt, Human
cuguaaauaugaagaauauaug

SEQ ID NO: 916613 - RNA, 22 nt, Human
aaucuucauaaaaaucuaguag

SEQ ID NO: 916614 - RNA, 22 nt, Human
cacaggcacgccucuggccagg

SEQ ID NO: 916615 - RNA, 22 nt, Human
gucugagacugggcacauaccu

SEQ ID NO: 916616 - RNA, 22 nt, Human
uacauacagagaugcuaguuaa

SEQ ID NO: 916617 - RNA, 22 nt, Human
ucuaggcccaggccugcggcug

SEQ ID NO: 916618 - RNA, 22 nt, Human
gcagagcauguccucaggacag

SEQ ID NO: 916619 - RNA, 22 nt, Human
auaaauagugaagggagccggu

SEQ ID NO: 916620 - RNA, 22 nt, Human
agguguccaauccugguuggau

SEQ ID NO: 916621 - RNA, 18 nt, Human
gaggaacauucaccuccu

SEQ ID NO: 916622 - RNA, 22 nt, Human
agaaucaauucacugcugcagc

SEQ ID NO: 916623 - RNA, 22 nt, Human
ggcaggugugagcuguaaagga

SEQ ID NO: 916624 - RNA, 22 nt, Human
caggggcuguggcacauggugu

SEQ ID NO: 916625 - RNA, 22 nt, Human
ggcagcucacgggcauggggug

SEQ ID NO: 916626 - RNA, 22 nt, Human
agaaugugauauagugauaugu

SEQ ID NO: 916627 - RNA, 18 nt, Human
auggcacagucuuucccu

SEQ ID NO: 916628 - RNA, 18 nt, Human
uuucauuauaaagcaggc

SEQ ID NO: 916629 - RNA, 22 nt, Human
uagaauucauguuacuguuagc

SEQ ID NO: 916630 - RNA, 22 nt, Human
ucucacugggucacagcagagg

SEQ ID NO: 916631 - RNA, 22 nt, Human
gcugaaguuuaugucuucuuuu

SEQ ID NO: 916632 - RNA, 22 nt, Human
aaacagugauguugaguguaaa

SEQ ID NO: 916633 - RNA, 22 nt, Human
gcugccugccuugccuggagga

SEQ ID NO: 916634 - RNA, 22 nt, Human
acacacaauuaguuuuaugcuu

SEQ ID NO: 916635 - RNA, 22 nt, Human
gcuacaaagugguaggagguca

SEQ ID NO: 916636 - RNA, 18 nt, Human
uacaggaagggguucucg

SEQ ID NO: 916637 - RNA, 22 nt, Human
aacaaagcccugcccaagagcu

SEQ ID NO: 916638 - RNA, 22 nt, Human
aaggcuggcaauauauuuguua

SEQ ID NO: 916639 - RNA, 22 nt, Human
ggccagcucugcacagcagcug

SEQ ID NO: 916640 - RNA, 22 nt, Human
agaccaaagaaaacacaucugg

SEQ ID NO: 916641 - RNA, 22 nt, Human
ucugucuccugccagugccucu

SEQ ID NO: 916642 - RNA, 16 nt, Human
ugguggggaggacagc

SEQ ID NO: 916643 - RNA, 22 nt, Human
ucagugugaggucuuccacccg

SEQ ID NO: 916644 - RNA, 22 nt, Human
ccucagcuugauuucugcagag

SEQ ID NO: 916645 - RNA, 22 nt, Human
gcucccaccuuugcuaucagua

SEQ ID NO: 916646 - RNA, 22 nt, Human
uuauaacuuuggauaugacaag

SEQ ID NO: 916647 - RNA, 22 nt, Human
gaaggcccugguauucuugagg

SEQ ID NO: 916648 - RNA, 22 nt, Human
ccagaggucuccugcacgggau

SEQ ID NO: 916649 - RNA, 22 nt, Human
cagaacauucuugccaguacau

SEQ ID NO: 916650 - RNA, 22 nt, Human
ggaagaaaaugggcaacaggug

SEQ ID NO: 916651 - RNA, 22 nt, Human
ccauggaguuccucuggucuau

SEQ ID NO: 916652 - RNA, 22 nt, Human
aacauucaaguucugguuuaug

SEQ ID NO: 916653 - RNA, 22 nt, Human
aagauguugcaagggacucuuc

SEQ ID NO: 916654 - RNA, 22 nt, Human
auucaaaccucauuuauuguuc

SEQ ID NO: 916655 - RNA, 22 nt, Human
uaugaggcacuucauuagcugg

SEQ ID NO: 916656 - RNA, 22 nt, Human
uagaauguagugcuucaagauu

SEQ ID NO: 916657 - RNA, 22 nt, Human
uggcuucagucucaucuuggaa

SEQ ID NO: 916658 - RNA, 22 nt, Human
gcacugggaaugcugaugggcu

SEQ ID NO: 916659 - RNA, 22 nt, Human
ccugggccugaaaacauuucuc

SEQ ID NO: 916660 - RNA, 22 nt, Human
agagggcuaacugggaagcagg

SEQ ID NO: 916661 - RNA, 22 nt, Human
agguggcugguccaggcugcag

SEQ ID NO: 916662 - RNA, 22 nt, Human
ccugggucuugguucaugcucu

SEQ ID NO: 916663 - RNA, 22 nt, Human
cugugcucuggcaucgcugcaa

SEQ ID NO: 916664 - RNA, 22 nt, Human
ccacauggagcaggaggugggg

SEQ ID NO: 916665 - RNA, 22 nt, Human
caggcuccagcuuccugcucag

SEQ ID NO: 916666 - RNA, 22 nt, Human
caguccuggggaccaggcugag

SEQ ID NO: 916667 - RNA, 22 nt, Human
cacagugagcugggcaucaguu

SEQ ID NO: 916668 - RNA, 22 nt, Human
ugccagggucagcugcagcucu

SEQ ID NO: 916669 - RNA, 22 nt, Human
uugugugacuccuagaguagag

SEQ ID NO: 916670 - RNA, 22 nt, Human
gaagccagcaguggagaaagga

SEQ ID NO: 916671 - RNA, 22 nt, Human
aacagacauauuuuuaauaugc

SEQ ID NO: 916672 - RNA, 22 nt, Human
uauauguagucagucagaguaa

SEQ ID NO: 916673 - RNA, 19 nt, Human
gugcauuccaaagcaccau

SEQ ID NO: 916674 - RNA, 22 nt, Human
cugucacuuaaauucaggcuga

SEQ ID NO: 916675 - RNA, 22 nt, Human
ucuuucuuuaucaccugauaug

SEQ ID NO: 916676 - RNA, 22 nt, Human
uucucugaucuugcuagacuga

SEQ ID NO: 916677 - RNA, 21 nt, Human
ccacagcuggucucugagccc

SEQ ID NO: 916678 - RNA, 22 nt, Human
gauuucuugauaaguaguguga

SEQ ID NO: 916679 - RNA, 22 nt, Human
ggcacagggaggcccuggugug

SEQ ID NO: 916680 - RNA, 22 nt, Human
ggccagcagucacagggucaga

SEQ ID NO: 916681 - RNA, 21 nt, Human
ucacauuucucauggguaaau

SEQ ID NO: 916682 - RNA, 22 nt, Human
guuuuauaauugcuucauaaga

SEQ ID NO: 916683 - RNA, 22 nt, Human
aaauuucuguuguuuugagcca

SEQ ID NO: 916684 - RNA, 22 nt, Human
ugaaucuggaucuaugaucaau

SEQ ID NO: 916685 - RNA, 22 nt, Human
gcauccagucuuggcuccugga

SEQ ID NO: 916686 - RNA, 22 nt, Human
cucgcaggacagugcuaggacu

SEQ ID NO: 916687 - RNA, 22 nt, Human
ugaggacauuaggaagugaagg

SEQ ID NO: 916688 - RNA, 22 nt, Human
ucagggcaccaaaaaagaugcc

SEQ ID NO: 916689 - RNA, 22 nt, Human
uccagggccacagaggaugcua

SEQ ID NO: 916690 - RNA, 22 nt, Human
acacaguaaauauguauugaau

SEQ ID NO: 916691 - RNA, 22 nt, Human
agauaagcuguuuuucaagaau

SEQ ID NO: 916692 - RNA, 22 nt, Human
ugugguugaagguuauuacuua

SEQ ID NO: 916693 - RNA, 22 nt, Human
cuuggagagggagaaaaauaac

SEQ ID NO: 916694 - RNA, 22 nt, Human
auucugaguagaaauuauucuu

SEQ ID NO: 916695 - RNA, 22 nt, Human
uucauucaucacaugcagcugg

SEQ ID NO: 916696 - RNA, 22 nt, Human
gcugccaguguggcaugaugca

SEQ ID NO: 916697 - RNA, 22 nt, Human
ggugcagaaggaagggagcugg

SEQ ID NO: 916698 - RNA, 22 nt, Human
aggaagcuccaugaaggcagag

SEQ ID NO: 916699 - RNA, 22 nt, Human
aguaguuuccauuucugaguuu

SEQ ID NO: 916700 - RNA, 22 nt, Human
ccagggcaucacauccaguguu

SEQ ID NO: 916701 - RNA, 22 nt, Human
ugguuuuugguuuaacacuaug

SEQ ID NO: 916702 - RNA, 22 nt, Human
ggacacagggcucacucucucu

SEQ ID NO: 916703 - RNA, 20 nt, Human
ugugcaugaacugagggauu

SEQ ID NO: 916704 - RNA, 22 nt, Human
gcucugcccaaagcuguggcug

SEQ ID NO: 916705 - RNA, 22 nt, Human
acagcauucccuuuggcugcuu

SEQ ID NO: 916706 - RNA, 22 nt, Human
gaucugggcuggagacugagaa

SEQ ID NO: 916707 - RNA, 22 nt, Human
caaagugagagaauggcagaaa

SEQ ID NO: 916708 - RNA, 22 nt, Human
acagugcuuggcacacaguaau

SEQ ID NO: 916709 - RNA, 22 nt, Human
cccacacauuuuucacuuaccg

SEQ ID NO: 916710 - RNA, 22 nt, Human
aagcagggcuagaccaagaaga

SEQ ID NO: 916711 - RNA, 22 nt, Human
aauuuuaugccuugcacguugg

SEQ ID NO: 916712 - RNA, 22 nt, Human
aagugugauuuguagaaugccu

SEQ ID NO: 916713 - RNA, 22 nt, Human
gaaacacuaugccaagacaggg

SEQ ID NO: 916714 - RNA, 22 nt, Human
ugucuccugggcccuggcccug

SEQ ID NO: 916715 - RNA, 22 nt, Human
aggagcagaacuguuguggagg

SEQ ID NO: 916716 - RNA, 22 nt, Human
aacaaugccacauuaaguguau

SEQ ID NO: 916717 - RNA, 22 nt, Human
uucucuucccacuuucuguauu

SEQ ID NO: 916718 - RNA, 22 nt, Human
aauuaggaauaaaugaguacuu

SEQ ID NO: 916719 - RNA, 22 nt, Human
agagcagaguggcuguagcuug

SEQ ID NO: 916720 - RNA, 22 nt, Human
ugcucgagguccccaccggcuc

SEQ ID NO: 916721 - RNA, 22 nt, Human
ugcuggggauccguaccaaccc

SEQ ID NO: 916722 - RNA, 22 nt, Human
ccagcugcgggcaucgagaguu

SEQ ID NO: 916723 - RNA, 22 nt, Human
cuguggcuucagcauucagagc

SEQ ID NO: 916724 - RNA, 22 nt, Human
ucugcauuuggaucuugagcug

SEQ ID NO: 916725 - RNA, 22 nt, Human
gagcccagucugcuccugcgcc

SEQ ID NO: 916726 - RNA, 22 nt, Human
cugcccccaggcugcauggcug

SEQ ID NO: 916727 - RNA, 22 nt, Human
uuuccaauuugguagucaucgg

SEQ ID NO: 916728 - RNA, 22 nt, Human
aacauucaaaacccaguucagu

SEQ ID NO: 916729 - RNA, 22 nt, Human
uggcagcaauuagcuagagcug

SEQ ID NO: 916730 - RNA, 22 nt, Human
cugguccuccuugccuucagau

SEQ ID NO: 916731 - RNA, 22 nt, Human
ucaaccauccggcuuauccugc

SEQ ID NO: 916732 - RNA, 22 nt, Human
augcuguggccagaguucaacu

SEQ ID NO: 916733 - RNA, 22 nt, Human
cagagcagugaggaguugugua

SEQ ID NO: 916734 - RNA, 22 nt, Human
ggcugcugggucaugaugcaga

SEQ ID NO: 916735 - RNA, 22 nt, Human
uacaauguuaaggaaagagaga

SEQ ID NO: 916736 - RNA, 22 nt, Human
gaaauuauugcuagagacugca

SEQ ID NO: 916737 - RNA, 22 nt, Human
aagaacuagucuuacagccuca

SEQ ID NO: 916738 - RNA, 22 nt, Human
aggccgaaguggaugggcaucu

SEQ ID NO: 916739 - RNA, 22 nt, Human
ugcaggcagcuaaaccauguaa

SEQ ID NO: 916740 - RNA, 22 nt, Human
accagagacucuuucuaguccu

SEQ ID NO: 916741 - RNA, 22 nt, Human
agcaguguuuugauucugggag

SEQ ID NO: 916742 - RNA, 22 nt, Human
auuugcuuagauucagcacuuu

SEQ ID NO: 916743 - RNA, 22 nt, Human
caagaauaaaauacauguugau

SEQ ID NO: 916744 - RNA, 22 nt, Human
ggcggggguccaggagccugca

SEQ ID NO: 916745 - RNA, 22 nt, Human
ggcagauauauucgugaaauag

SEQ ID NO: 916746 - RNA, 22 nt, Human
uuaaaugaugcauaucauuuag

SEQ ID NO: 916747 - RNA, 22 nt, Human
uaaugacauuguauccacagag

SEQ ID NO: 916748 - RNA, 22 nt, Human
ucuuuggcuuugccacacccaa

SEQ ID NO: 916749 - RNA, 22 nt, Human
gggaaugaggcagauagauaaa

SEQ ID NO: 916750 - RNA, 22 nt, Human
aggaggcuguggagcacuccau

SEQ ID NO: 916751 - RNA, 22 nt, Human
gaggagcugucuuugugaucuu

SEQ ID NO: 916752 - RNA, 22 nt, Human
cacuuaaauguuccuacagcag

SEQ ID NO: 916753 - RNA, 22 nt, Human
aacuguagcaaagaacagcucu

SEQ ID NO: 916754 - RNA, 22 nt, Human
cagaggguugucaggcgccuug

SEQ ID NO: 916755 - RNA, 22 nt, Human
uucuucugagagaaaaagcuca

SEQ ID NO: 916756 - RNA, 22 nt, Human
ccuccagaggguuucccaugaa

SEQ ID NO: 916757 - RNA, 22 nt, Human
gcuuacaaucauuucaguuuag

SEQ ID NO: 916758 - RNA, 22 nt, Human
ugggcagcaaagacugugugcu

SEQ ID NO: 916759 - RNA, 22 nt, Human
uuugcaguuucauugcugaaau

SEQ ID NO: 916760 - RNA, 22 nt, Human
ucucugggaguugagcagcagc

SEQ ID NO: 916761 - RNA, 22 nt, Human
ucagaggucagcagcuugccca

SEQ ID NO: 916762 - RNA, 22 nt, Human
gguguucuuaguggcacuggca

SEQ ID NO: 916763 - RNA, 20 nt, Human
aggcuggcacuccuggccag

SEQ ID NO: 916764 - RNA, 22 nt, Human
ggccugcugcugguuagauggg

SEQ ID NO: 916765 - RNA, 22 nt, Human
ucagcaaggcagaagggaggua

SEQ ID NO: 916766 - RNA, 22 nt, Human
uuguggcaugugagaacuagaa

SEQ ID NO: 916767 - RNA, 22 nt, Human
gaaacagcacguuuggagagau

SEQ ID NO: 916768 - RNA, 22 nt, Human
ucuggggagucaaagagaccug

SEQ ID NO: 916769 - RNA, 22 nt, Human
ugggcagacgggagcuugccuu

SEQ ID NO: 916770 - RNA, 22 nt, Human
ucauauuaacaaugaaacucag

SEQ ID NO: 916771 - RNA, 22 nt, Human
ugcugcaggccaggucguuguc

SEQ ID NO: 916772 - RNA, 22 nt, Human
uuuguguuuucccauacuauug

SEQ ID NO: 916773 - RNA, 18 nt, Human
aaaggcauauauagaagu

SEQ ID NO: 916774 - RNA, 22 nt, Human
agcagcagaagguuugcaccca

SEQ ID NO: 916775 - RNA, 22 nt, Human
gcugugcuuuugguagauccca

SEQ ID NO: 916776 - RNA, 22 nt, Human
ugcaggcuggggaggcagacuu

SEQ ID NO: 916777 - RNA, 22 nt, Human
uuguaacagguacuaaauaacu

SEQ ID NO: 916778 - RNA, 22 nt, Human
cccaggagaauauaauguucuu

SEQ ID NO: 916779 - RNA, 20 nt, Human
ugaagcagccuugauucugu

SEQ ID NO: 916780 - RNA, 22 nt, Human
uuuuccagauggauacuagaau

SEQ ID NO: 916781 - RNA, 22 nt, Human
acagcaguuaacgaucagacuc

SEQ ID NO: 916782 - RNA, 22 nt, Human
ucugaagauuaccagcuaaaug

SEQ ID NO: 916783 - RNA, 22 nt, Human
cagcuggcuggucagugcacaa

SEQ ID NO: 916784 - RNA, 22 nt, Human
gcuggcuggaggagggagguug

SEQ ID NO: 916785 - RNA, 22 nt, Human
guuacuagggacugagaguaaa

SEQ ID NO: 916786 - RNA, 22 nt, Human
gagaggaaugagguuaaggacu

SEQ ID NO: 916787 - RNA, 22 nt, Human
aagucuggaagucucaguuuuc

SEQ ID NO: 916788 - RNA, 22 nt, Human
gaaagacauaguugcaagaugg

SEQ ID NO: 916789 - RNA, 19 nt, Human
uuauucuuaaaguagcuua

SEQ ID NO: 916790 - RNA, 22 nt, Human
aagcccuguucuuucucucacc

SEQ ID NO: 916791 - RNA, 22 nt, Human
aagcaggugugagccagugggc

SEQ ID NO: 916792 - RNA, 22 nt, Human
uggaagaauguuugccuuauaa

SEQ ID NO: 916793 - RNA, 22 nt, Human
auaauguuuuuguauaagcaug

SEQ ID NO: 916794 - RNA, 22 nt, Human
cuguucuggagacacugaugaa

SEQ ID NO: 916795 - RNA, 22 nt, Human
ucacccaggguguuuggugucu

SEQ ID NO: 916796 - RNA, 22 nt, Human
aguaucaucuccauuucacuga

SEQ ID NO: 916797 - RNA, 22 nt, Human
ccagaggagggcucugaugagg

SEQ ID NO: 916798 - RNA, 19 nt, Human
acuaaaaaugauguuugag

SEQ ID NO: 916799 - RNA, 22 nt, Human
aauugcacauuucaguguucug

SEQ ID NO: 916800 - RNA, 22 nt, Human
cuggagaccucuccugagagug

SEQ ID NO: 916801 - RNA, 22 nt, Human
uuccuggccaagcagaguggaa

SEQ ID NO: 916802 - RNA, 23 nt, Human
auguuaccaauggaggaaauugg

SEQ ID NO: 916803 - RNA, 22 nt, Human
gaauuuaucuacguuaaguaug

SEQ ID NO: 916804 - RNA, 22 nt, Human
cauagaaacugagacaaggauu

SEQ ID NO: 916805 - RNA, 22 nt, Human
ccaguuuaagacuuaucucaau

SEQ ID NO: 916806 - RNA, 22 nt, Human
ccugggcuuccacgagcagagg

SEQ ID NO: 916807 - RNA, 22 nt, Human
gcagagcucuguucuuaucucc

SEQ ID NO: 916808 - RNA, 22 nt, Human
uucaugaaaguguaucuugugg

SEQ ID NO: 916809 - RNA, 22 nt, Human
agggccucuggaacacugaggg

SEQ ID NO: 916810 - RNA, 22 nt, Human
ugggucagagcagaccucugga

SEQ ID NO: 916811 - RNA, 22 nt, Human
cagcaucuccugugcagaggga

SEQ ID NO: 916812 - RNA, 22 nt, Human
cugcuguccaaccugcacucgc

SEQ ID NO: 916813 - RNA, 21 nt, Human
aaguuuuauguugccauuugu

SEQ ID NO: 916814 - RNA, 22 nt, Human
gacagcugugcaggagaagggg

SEQ ID NO: 916815 - RNA, 22 nt, Human
cugccuggagcauucugaaggu

SEQ ID NO: 916816 - RNA, 22 nt, Human
acuggaaaacacuacuacaugc

SEQ ID NO: 916817 - RNA, 22 nt, Human
ucuacacaagugaguggcacaa

SEQ ID NO: 916818 - RNA, 22 nt, Human
aaagguuaagguguucaagaaa

SEQ ID NO: 916819 - RNA, 22 nt, Human
ucccucagcuugucuccaugca

SEQ ID NO: 916820 - RNA, 22 nt, Human
cagcacucccaggagaaccagc

SEQ ID NO: 916821 - RNA, 22 nt, Human
auaacauuuugacaacugguga

SEQ ID NO: 916822 - RNA, 22 nt, Human
acaguguucuugauauuacagu

SEQ ID NO: 916823 - RNA, 22 nt, Human
uggcugagaaugggaugaugcc

SEQ ID NO: 916824 - RNA, 22 nt, Human
ggcuggguucugagaaagagua

SEQ ID NO: 916825 - RNA, 22 nt, Human
ugcaaaaaggcagacuggugau

SEQ ID NO: 916826 - RNA, 22 nt, Human
cccagcaucuccaggcauggcc

SEQ ID NO: 916827 - RNA, 22 nt, Human
ugcaaagugcuagcccacacca

SEQ ID NO: 916828 - RNA, 22 nt, Human
uuuggaaagugugauuucaagg

SEQ ID NO: 916829 - RNA, 21 nt, Human
ggaacuuucaugaaucuagca

SEQ ID NO: 916830 - RNA, 22 nt, Human
uuagaaccagcauuuguccugg

SEQ ID NO: 916831 - RNA, 22 nt, Human
uuugcauuguaauauuuaguuc

SEQ ID NO: 916832 - RNA, 22 nt, Human
cagcuucucagaaagcugaggu

SEQ ID NO: 916833 - RNA, 22 nt, Human
acacucacccucccacugccug

SEQ ID NO: 916834 - RNA, 22 nt, Human
ucuccaaggagcuccugugccg

SEQ ID NO: 916835 - RNA, 22 nt, Human
aaagauuaggcggcaacugggc

SEQ ID NO: 916836 - RNA, 22 nt, Human
uuccaagagucagcugauccca

SEQ ID NO: 916837 - RNA, 22 nt, Human
cagggcuccccagagagccucu

SEQ ID NO: 916838 - RNA, 23 nt, Human
aagcaaugcugagccaguucuga

SEQ ID NO: 916839 - RNA, 22 nt, Human
aagcauuucaauauaauauuca

SEQ ID NO: 916840 - RNA, 22 nt, Human
acaaguuuauuugauuagaaca

SEQ ID NO: 916841 - RNA, 22 nt, Human
uccuuggcuuucuggagcuucu

SEQ ID NO: 916842 - RNA, 20 nt, Human
gcccaagguccagaaggggg

SEQ ID NO: 916843 - RNA, 22 nt, Human
aggugggacccguggggugcga

SEQ ID NO: 916844 - RNA, 22 nt, Human
gaaauguauuugacaguccuug

SEQ ID NO: 916845 - RNA, 22 nt, Human
aagcacauuaaggaacauugaa

SEQ ID NO: 916846 - RNA, 22 nt, Human
cagcuggcgggcagagccgcca

SEQ ID NO: 916847 - RNA, 20 nt, Human
uggagcuguaaucuugucug

SEQ ID NO: 916848 - RNA, 22 nt, Human
ggucuagaucaagaacagaacu

SEQ ID NO: 916849 - RNA, 22 nt, Human
aggaaaauggaccagaguuguu

SEQ ID NO: 916850 - RNA, 22 nt, Human
aaaugucaggugguggauggcu

SEQ ID NO: 916851 - RNA, 22 nt, Human
uaaaucuuguggcaaugcuucu

SEQ ID NO: 916852 - RNA, 22 nt, Human
auaauauaauccuacuucccau

SEQ ID NO: 916853 - RNA, 20 nt, Human
agcuccugaggguuacuuuc

SEQ ID NO: 916854 - RNA, 22 nt, Human
cuuguuuuggcuaguaugaugu

SEQ ID NO: 916855 - RNA, 22 nt, Human
gcaguuuuaguggaucuggggc

SEQ ID NO: 916856 - RNA, 22 nt, Human
auuaggcaauucugggcaucuc

SEQ ID NO: 916857 - RNA, 22 nt, Human
gguaacaaggccgauagaaaca

SEQ ID NO: 916858 - RNA, 22 nt, Human
aaaggcuuguacagcagccuuc

SEQ ID NO: 916859 - RNA, 22 nt, Human
acagaugacuugucugcuguaa

SEQ ID NO: 916860 - RNA, 20 nt, Human
gagccugggaagucuaaggu

SEQ ID NO: 916861 - RNA, 22 nt, Human
gagguuuuaggcugccauuauu

SEQ ID NO: 916862 - RNA, 22 nt, Human
uuccacaaacacauccugagca

SEQ ID NO: 916863 - RNA, 22 nt, Human
ccugcuggcgcuugucugggag

SEQ ID NO: 916864 - RNA, 22 nt, Human
uaucuguuguccaugcagaaag

SEQ ID NO: 916865 - RNA, 22 nt, Human
cuggcccucgucaguuucacug

SEQ ID NO: 916866 - RNA, 22 nt, Human
acuggauugggaaaguacuuca

SEQ ID NO: 916867 - RNA, 22 nt, Human
uuguuaaaacuccauugguuug

SEQ ID NO: 916868 - RNA, 22 nt, Human
ugcgggucccagggucacaggc

SEQ ID NO: 916869 - RNA, 22 nt, Human
agcaggugacccaagcaggcug

SEQ ID NO: 916870 - RNA, 22 nt, Human
cuuaacaagcccaacuuucauu

SEQ ID NO: 916871 - RNA, 22 nt, Human
aaaggcucaugaaccaggcucg

SEQ ID NO: 916872 - RNA, 22 nt, Human
cagcugugacagccaguugaug

SEQ ID NO: 916873 - RNA, 19 nt, Human
gaacaauuuguuagcucuc

SEQ ID NO: 916874 - RNA, 22 nt, Human
uuccaugugaguacacugugau

SEQ ID NO: 916875 - RNA, 22 nt, Human
uuugucaucccuuuugaaacug

SEQ ID NO: 916876 - RNA, 22 nt, Human
ggcagugagcuggagggaagga

SEQ ID NO: 916877 - RNA, 21 nt, Human
gaggcugucugcugcuggccu

SEQ ID NO: 916878 - RNA, 22 nt, Human
aagcugugcaggaacugcuugc

SEQ ID NO: 916879 - RNA, 22 nt, Human
caaugucaugauuuuccauuag

SEQ ID NO: 916880 - RNA, 19 nt, Human
uagagcuuguuuuaggaag

SEQ ID NO: 916881 - RNA, 22 nt, Human
aagcaaaacgugcucuaggagg

SEQ ID NO: 916882 - RNA, 22 nt, Human
auguuauuucugaaagaucauu

SEQ ID NO: 916883 - RNA, 22 nt, Human
aaaaaccuuucauugcaaaugu

SEQ ID NO: 916884 - RNA, 22 nt, Human
cuguuauuucugccaggugagu

SEQ ID NO: 916885 - RNA, 22 nt, Human
acaggcagcaaaaucagccuca

SEQ ID NO: 916886 - RNA, 22 nt, Human
ugaaguuuaagguuagauaagu

SEQ ID NO: 916887 - RNA, 22 nt, Human
ccugcagaccacacucaguccu

SEQ ID NO: 916888 - RNA, 22 nt, Human
aaaguccuagcgauccacagaa

SEQ ID NO: 916889 - RNA, 22 nt, Human
cagcaagauuuuuaaagcaagg

SEQ ID NO: 916890 - RNA, 22 nt, Human
gcacacacuguuuuccucacau

SEQ ID NO: 916891 - RNA, 22 nt, Human
uggcugugugccaggcugucug

SEQ ID NO: 916892 - RNA, 22 nt, Human
guacaaauguacacuuguauaa

SEQ ID NO: 916893 - RNA, 22 nt, Human
cccuggggagcaggcgaaggag

SEQ ID NO: 916894 - RNA, 22 nt, Human
augggucaguucaguggccaac

SEQ ID NO: 916895 - RNA, 22 nt, Human
ugcccaggguggagugcagcgg

SEQ ID NO: 916896 - RNA, 22 nt, Human
cagggccugcuuccuucuuguu

SEQ ID NO: 916897 - RNA, 22 nt, Human
caucuccaggaguucuacucau

SEQ ID NO: 916898 - RNA, 22 nt, Human
ugucccagacauaaguggacau

SEQ ID NO: 916899 - RNA, 22 nt, Human
gcccuucacgaugguaucuuag

SEQ ID NO: 916900 - RNA, 22 nt, Human
ccugccugucccucaguccaca

SEQ ID NO: 916901 - RNA, 22 nt, Human
ugcucuucaccauuacaucaug

SEQ ID NO: 916902 - RNA, 22 nt, Human
auugacagaaaauuggauggca

SEQ ID NO: 916903 - RNA, 22 nt, Human
agcugaggaggaaugaugggua

SEQ ID NO: 916904 - RNA, 22 nt, Human
acuagaccaaggaauccuggaa

SEQ ID NO: 916905 - RNA, 22 nt, Human
augucuuguuaaucugaagcaa

SEQ ID NO: 916906 - RNA, 18 nt, Human
uaucuuuuccagugguau

SEQ ID NO: 916907 - RNA, 22 nt, Human
uucaaugcaagggaggucugaa

SEQ ID NO: 916908 - RNA, 22 nt, Human
ucagugcuuauauucugagccu

SEQ ID NO: 916909 - RNA, 22 nt, Human
ggcuuagauugacacugaucuc

SEQ ID NO: 916910 - RNA, 22 nt, Human
agggaucaguagggacggcagc

SEQ ID NO: 916911 - RNA, 22 nt, Human
uacccagcuucaagucaggacu

SEQ ID NO: 916912 - RNA, 22 nt, Human
ucagagcugugcuucaggaaag

SEQ ID NO: 916913 - RNA, 22 nt, Human
aagcugcagguugaauccaggu

SEQ ID NO: 916914 - RNA, 22 nt, Human
uacaaaaguaauuacgguuuuu

SEQ ID NO: 916915 - RNA, 22 nt, Human
auuuuccuagucaugugcuucu

SEQ ID NO: 916916 - RNA, 19 nt, Human
uccuucuccggccaccccg

SEQ ID NO: 916917 - RNA, 22 nt, Human
uaagguuuugagaccagaacgu

SEQ ID NO: 916918 - RNA, 22 nt, Human
uuuugacaaugcuaaucucaau

SEQ ID NO: 916919 - RNA, 22 nt, Human
cuuuccaccaacucacuucccu

SEQ ID NO: 916920 - RNA, 22 nt, Human
acagaauucucucugcagaggc

SEQ ID NO: 916921 - RNA, 22 nt, Human
caggccaccagauacaugcccc

SEQ ID NO: 916922 - RNA, 22 nt, Human
guuacaaacucaggugccaaaa

SEQ ID NO: 916923 - RNA, 22 nt, Human
acacagcuuucagucauuaucu

SEQ ID NO: 916924 - RNA, 22 nt, Human
cucacagguucugcagcucaca

SEQ ID NO: 916925 - RNA, 22 nt, Human
uuuaaacauaucuguugaggga

SEQ ID NO: 916926 - RNA, 22 nt, Human
cagugaaauaguggacaucaaa

SEQ ID NO: 916927 - RNA, 22 nt, Human
gacagcaaccucaugagaaacu

SEQ ID NO: 916928 - RNA, 22 nt, Human
cuuaggcagggcuggaagaucu

SEQ ID NO: 916929 - RNA, 22 nt, Human
ccuggcucuguccucgcgcaaa

SEQ ID NO: 916930 - RNA, 23 nt, Human
acagggcauugcuggccucgagg

SEQ ID NO: 916931 - RNA, 22 nt, Human
uugcuuagagccaaucuugauu

SEQ ID NO: 916932 - RNA, 22 nt, Human
cacucugagaaacacuaaacca

SEQ ID NO: 916933 - RNA, 22 nt, Human
uguauaguguggaaagaacagu

SEQ ID NO: 916934 - RNA, 22 nt, Human
uuccaaaacaguauggcaugug

SEQ ID NO: 916935 - RNA, 22 nt, Human
uguaugcacauggauaaguaug

SEQ ID NO: 916936 - RNA, 22 nt, Human
auucacaguauggacgaaauga

SEQ ID NO: 916937 - RNA, 22 nt, Human
ugaggaagggugugacggcacc

SEQ ID NO: 916938 - RNA, 22 nt, Human
cugugacaaaagcagccugccu

SEQ ID NO: 916939 - RNA, 22 nt, Human
ucagaaguaagguucucccaag

SEQ ID NO: 916940 - RNA, 22 nt, Human
ggagggagcagagaacccaacc

SEQ ID NO: 916941 - RNA, 19 nt, Human
aggugcaggucacagggga

SEQ ID NO: 916942 - RNA, 22 nt, Human
ugcugccacugguagucucauu

SEQ ID NO: 916943 - RNA, 22 nt, Human
acaugcauuaaaaauacuugug

SEQ ID NO: 916944 - RNA, 22 nt, Human
gagcuggaggaccaggacuggg

SEQ ID NO: 916945 - RNA, 22 nt, Human
cugcccacuauguugucauggg

SEQ ID NO: 916946 - RNA, 22 nt, Human
augucuguggcauuauauguuu

SEQ ID NO: 916947 - RNA, 22 nt, Human
gccuggguuccugcuuuuguga

SEQ ID NO: 916948 - RNA, 22 nt, Human
ucaggaagcucuugcugauucu

SEQ ID NO: 916949 - RNA, 22 nt, Human
gucucuaucauagcugaacccu

SEQ ID NO: 916950 - RNA, 22 nt, Human
gagaagggggcucgaguguccu

SEQ ID NO: 916951 - RNA, 22 nt, Human
aggucagcaugaguagaaggua

SEQ ID NO: 916952 - RNA, 22 nt, Human
uaaaagacauauaacuguagga

SEQ ID NO: 916953 - RNA, 22 nt, Human
uuuauguaguuacggacuauca

SEQ ID NO: 916954 - RNA, 22 nt, Human
cuguggcuuucucugccuccuu

SEQ ID NO: 916955 - RNA, 20 nt, Human
gugcagcacuuggggguagg

SEQ ID NO: 916956 - RNA, 17 nt, Human
aucuggcugcuucuaga

SEQ ID NO: 916957 - RNA, 22 nt, Human
aaaguugugguuugaugcaguu

SEQ ID NO: 916958 - RNA, 22 nt, Human
ggcaggcaggucuucauggccc

SEQ ID NO: 916959 - RNA, 22 nt, Human
guguuaaauuucuaauuuguga

SEQ ID NO: 916960 - RNA, 22 nt, Human
gugaaggcaaugauaagaguga

SEQ ID NO: 916961 - RNA, 22 nt, Human
agugcagcuuuuucuuuacaug

SEQ ID NO: 916962 - RNA, 22 nt, Human
ucaggaagugccuaggcuggcc

SEQ ID NO: 916963 - RNA, 22 nt, Human
agagcugggacuuggacucaau

SEQ ID NO: 916964 - RNA, 22 nt, Human
cucugcucaccagccaugugau

SEQ ID NO: 916965 - RNA, 22 nt, Human
ggccagcauggcaagaccaacu

SEQ ID NO: 916966 - RNA, 22 nt, Human
ugccaggcacgugagaguggcc

SEQ ID NO: 916967 - RNA, 22 nt, Human
gauuucaaccuaacaguaugac

SEQ ID NO: 916968 - RNA, 22 nt, Human
auagaauucuuugaaauuuaug

SEQ ID NO: 916969 - RNA, 22 nt, Human
aagucguggcaggcuugcacga

SEQ ID NO: 916970 - RNA, 20 nt, Human
gagauggacagaugaagggg

SEQ ID NO: 916971 - RNA, 22 nt, Human
cucugggugucauggccucagc

SEQ ID NO: 916972 - RNA, 22 nt, Human
gcagugcuagccucacaggguc

SEQ ID NO: 916973 - RNA, 22 nt, Human
uaacacugccaugcuggaguca

SEQ ID NO: 916974 - RNA, 22 nt, Human
gagcugggauucaucuaugucu

SEQ ID NO: 916975 - RNA, 22 nt, Human
ugagguccuagagagugugugg

SEQ ID NO: 916976 - RNA, 21 nt, Human
ugguggagugugcugagcaug

SEQ ID NO: 916977 - RNA, 22 nt, Human
cagguuuacaaaguaaagugug

SEQ ID NO: 916978 - RNA, 18 nt, Human
gcugagguggugucagag

SEQ ID NO: 916979 - RNA, 22 nt, Human
caagacaagaucuaagcaugcu

SEQ ID NO: 916980 - RNA, 22 nt, Human
ucugacaaugaacaaucuauag

SEQ ID NO: 916981 - RNA, 22 nt, Human
gccuggagugguccugcugccc

SEQ ID NO: 916982 - RNA, 22 nt, Human
augcaucaaagucugaaauuuc

SEQ ID NO: 916983 - RNA, 22 nt, Human
ugaaacaauuagaauguaauga

SEQ ID NO: 916984 - RNA, 22 nt, Human
acuuagaauauguucaagauuu

SEQ ID NO: 916985 - RNA, 22 nt, Human
ucagagaugcagugccaccuac

SEQ ID NO: 916986 - RNA, 22 nt, Human
cucugggaccacgugacucugc

SEQ ID NO: 916987 - RNA, 19 nt, Human
gagcgcagagggcagggga

SEQ ID NO: 916988 - RNA, 22 nt, Human
caugaggugauaaagcugggau

SEQ ID NO: 916989 - RNA, 22 nt, Human
acaguaauuguguacgaggaca

SEQ ID NO: 916990 - RNA, 22 nt, Human
aacuguagggaucugucuuagu

SEQ ID NO: 916991 - RNA, 22 nt, Human
cacaguacugcuuugggaugug

SEQ ID NO: 916992 - RNA, 22 nt, Human
cuccagagguccccgcggcacu

SEQ ID NO: 916993 - RNA, 22 nt, Human
aauaaacugcucaauugcauca

SEQ ID NO: 916994 - RNA, 22 nt, Human
caagauuuagccugcugccugu

SEQ ID NO: 916995 - RNA, 22 nt, Human
uaaagugucugccucagcucag

SEQ ID NO: 916996 - RNA, 22 nt, Human
ugggaaauuguauuucuauuuc

SEQ ID NO: 916997 - RNA, 22 nt, Human
gagcacccgucggugguaggaa

SEQ ID NO: 916998 - RNA, 22 nt, Human
uguuuucaagucaaggccaaau

SEQ ID NO: 916999 - RNA, 22 nt, Human
aaguaacagcaucaagucucaa

SEQ ID NO: 917000 - RNA, 21 nt, Human
caaaugcuggcuggaugagga

SEQ ID NO: 917001 - RNA, 22 nt, Human
ggggcccagcaccccuccucgc

SEQ ID NO: 917002 - RNA, 22 nt, Human
gcauuuuauaaagaguuauuug

SEQ ID NO: 917003 - RNA, 21 nt, Human
ugucugagugacugggucugc

SEQ ID NO: 917004 - RNA, 22 nt, Human
agcagagccagaauuggaccag

SEQ ID NO: 917005 - RNA, 22 nt, Human
caucaagugguucuccagguug

SEQ ID NO: 917006 - RNA, 22 nt, Human
uggagcagcacaagaaagggga

SEQ ID NO: 917007 - RNA, 22 nt, Human
gcuggggaggcagcagagaaca

SEQ ID NO: 917008 - RNA, 22 nt, Human
ccaguaacaccucgcagacucc

SEQ ID NO: 917009 - RNA, 22 nt, Human
cugugggagaagcuagcacagg

SEQ ID NO: 917010 - RNA, 22 nt, Human
uuugacagacauuuacuacauu

SEQ ID NO: 917011 - RNA, 22 nt, Human
ugcucuccggcuuccguggccu

SEQ ID NO: 917012 - RNA, 23 nt, Human
agacacauaggagcagcuauugg

SEQ ID NO: 917013 - RNA, 22 nt, Human
ugcguggcuggucccugugacc

SEQ ID NO: 917014 - RNA, 22 nt, Human
gacauucagacucacauggagg

SEQ ID NO: 917015 - RNA, 22 nt, Human
ccucccugggugacgggcuccu

SEQ ID NO: 917016 - RNA, 22 nt, Human
gaaucuaugccucauauagacc

SEQ ID NO: 917017 - RNA, 22 nt, Human
gcaugcaguaaaauucagcaac

SEQ ID NO: 917018 - RNA, 19 nt, Human
ugccugcuccuggcuucca

SEQ ID NO: 917019 - RNA, 22 nt, Human
aguauaucacauguaguaaugg

SEQ ID NO: 917020 - RNA, 22 nt, Human
agagcagugcugaagaguaggg

SEQ ID NO: 917021 - RNA, 18 nt, Human
uuucauugagugugauau

SEQ ID NO: 917022 - RNA, 22 nt, Human
uacauagcaaggaaaugacaga

SEQ ID NO: 917023 - RNA, 22 nt, Human
uaguggagaaguggagucugug

SEQ ID NO: 917024 - RNA, 22 nt, Human
gaguuuuaaccucagcucucug

SEQ ID NO: 917025 - RNA, 22 nt, Human
aaauacuguuuuauuccaugau

SEQ ID NO: 917026 - RNA, 22 nt, Human
cucuagaguacgggcuggcaug

SEQ ID NO: 917027 - RNA, 22 nt, Human
uugcagaggcaaaaaugaacuc

SEQ ID NO: 917028 - RNA, 22 nt, Human
gcccaagggcaucaaguucuac

SEQ ID NO: 917029 - RNA, 22 nt, Human
ggcacagcccucucuguggaca

SEQ ID NO: 917030 - RNA, 17 nt, Human
uuccccugaccaagccu

SEQ ID NO: 917031 - RNA, 22 nt, Human
aggugacugguuuaucuggcag

SEQ ID NO: 917032 - RNA, 22 nt, Human
auuuacacugguucucagagcu

SEQ ID NO: 917033 - RNA, 17 nt, Human
cugaggagaacagaaag

SEQ ID NO: 917034 - RNA, 22 nt, Human
agcccaugcagaccuucccaga

SEQ ID NO: 917035 - RNA, 22 nt, Human
ugauuuugucauguuucugaua

SEQ ID NO: 917036 - RNA, 22 nt, Human
caggugggauuuugcugcuuga

SEQ ID NO: 917037 - RNA, 22 nt, Human
cuucagugauauaggcuucucc

SEQ ID NO: 917038 - RNA, 22 nt, Human
ucaguuuccugguuuuaauauu

SEQ ID NO: 917039 - RNA, 22 nt, Human
ugugaggcuaccugccaggguc

SEQ ID NO: 917040 - RNA, 22 nt, Human
ugugccagccucuggcuguguc

SEQ ID NO: 917041 - RNA, 20 nt, Human
cuggcuggaaacuuagccuu

SEQ ID NO: 917042 - RNA, 17 nt, Human
ugugcgcuugugugagg

SEQ ID NO: 917043 - RNA, 22 nt, Human
agcaaagcaguggcuaagcuga

SEQ ID NO: 917044 - RNA, 22 nt, Human
cugggucuaaaaauucucagau

SEQ ID NO: 917045 - RNA, 22 nt, Human
guuucucuuaacacauaaagua

SEQ ID NO: 917046 - RNA, 23 nt, Human
acacaauagaguacuauucagcc

SEQ ID NO: 917047 - RNA, 22 nt, Human
gaaaugaacugauuaucauugc

SEQ ID NO: 917048 - RNA, 22 nt, Human
uuuauuuaaagucguguguuaa

SEQ ID NO: 917049 - RNA, 22 nt, Human
uggcccugaaggccuugagcau

SEQ ID NO: 917050 - RNA, 22 nt, Human
uggggauguaaaugaggugaua

SEQ ID NO: 917051 - RNA, 22 nt, Human
gcugccugggcaggaggcgcug

SEQ ID NO: 917052 - RNA, 22 nt, Human
auggaagugcaacuugcucauc

SEQ ID NO: 917053 - RNA, 22 nt, Human
acauguaaaagauaaauuaaca

SEQ ID NO: 917054 - RNA, 22 nt, Human
cacacauugagcagcuguuugu

SEQ ID NO: 917055 - RNA, 22 nt, Human
cccugcugcaggcuucaggagg

SEQ ID NO: 917056 - RNA, 22 nt, Human
aaucaguguggugacuugucug

SEQ ID NO: 917057 - RNA, 18 nt, Human
acacuuccugguggugug

SEQ ID NO: 917058 - RNA, 22 nt, Human
uccagccugaacuuuguccaga

SEQ ID NO: 917059 - RNA, 22 nt, Human
uuuuaaagagaugcugugcaua

SEQ ID NO: 917060 - RNA, 19 nt, Human
ggagccagcuguggaaggc

SEQ ID NO: 917061 - RNA, 22 nt, Human
gcacccaggcacuuuccuuucu

SEQ ID NO: 917062 - RNA, 22 nt, Human
aacauucugguucuaaaaaccu

SEQ ID NO: 917063 - RNA, 19 nt, Human
gggguggcuggggcuccag

SEQ ID NO: 917064 - RNA, 22 nt, Human
cauaauuuuuuuaagucagaac

SEQ ID NO: 917065 - RNA, 22 nt, Human
cugggccuaggauggaagggcc

SEQ ID NO: 917066 - RNA, 22 nt, Human
uauaggaaacauacgugacuag

SEQ ID NO: 917067 - RNA, 22 nt, Human
aguuuguaaccuaagauucagg

SEQ ID NO: 917068 - RNA, 22 nt, Human
ggcuggcuggcugguagacaag

SEQ ID NO: 917069 - RNA, 22 nt, Human
aggguggcugaguagauggaag

SEQ ID NO: 917070 - RNA, 22 nt, Human
aaccccaguaccccaggauaug

SEQ ID NO: 917071 - RNA, 22 nt, Human
gccaaauacaguagucauugcc

SEQ ID NO: 917072 - RNA, 22 nt, Human
caguguuuugagaagggcacgu

SEQ ID NO: 917073 - RNA, 22 nt, Human
gacaucaggaagacaugagagg

SEQ ID NO: 917074 - RNA, 22 nt, Human
uccuggagaauccugccaccug

SEQ ID NO: 917075 - RNA, 22 nt, Human
auacagaaguuuuccacuuauu

SEQ ID NO: 917076 - RNA, 20 nt, Human
cuuguacaugauaaagauuu

SEQ ID NO: 917077 - RNA, 22 nt, Human
aggcaacaggaaaccacaugau

SEQ ID NO: 917078 - RNA, 22 nt, Human
caugccuguaaucccagcucuu

SEQ ID NO: 917079 - RNA, 22 nt, Human
agagcccugaagcagagcuaaa

SEQ ID NO: 917080 - RNA, 22 nt, Human
cugaagcuugauaaacuauaaa

SEQ ID NO: 917081 - RNA, 22 nt, Human
ucugagagccacugaacagcaa

SEQ ID NO: 917082 - RNA, 22 nt, Human
cuuuuuaucucuuaaugauguu

SEQ ID NO: 917083 - RNA, 22 nt, Human
ucauuuaucgcugccuuuuaaa

SEQ ID NO: 917084 - RNA, 22 nt, Human
gggcugagucaucuggggccuc

SEQ ID NO: 917085 - RNA, 20 nt, Human
guccaggacccagcaggagg

SEQ ID NO: 917086 - RNA, 22 nt, Human
cauuaauuguauuuuucaaagu

SEQ ID NO: 917087 - RNA, 22 nt, Human
gacugcagugaaggcacauggg

SEQ ID NO: 917088 - RNA, 23 nt, Human
gaacccagcucugccacuugcca

SEQ ID NO: 917089 - RNA, 22 nt, Human
cuaauguaucauggcucucagc

SEQ ID NO: 917090 - RNA, 22 nt, Human
caccugcugagcugcugggggu

SEQ ID NO: 917091 - RNA, 22 nt, Human
ucaucacauaugucaugauuug

SEQ ID NO: 917092 - RNA, 17 nt, Human
caacuucacaaacuguc

SEQ ID NO: 917093 - RNA, 22 nt, Human
auaauccaugucuagaguaaag

SEQ ID NO: 917094 - RNA, 22 nt, Human
aguguacaguuuguaguacuac

SEQ ID NO: 917095 - RNA, 22 nt, Human
aacauuucauuggaagcuaugu

SEQ ID NO: 917096 - RNA, 17 nt, Human
aucaguagcauaucaga

SEQ ID NO: 917097 - RNA, 22 nt, Human
gcaggcugaaacucggggucua

SEQ ID NO: 917098 - RNA, 22 nt, Human
gaagagagcagcaaacuggagu

SEQ ID NO: 917099 - RNA, 22 nt, Human
agagcuccaggguuuuguagug

SEQ ID NO: 917100 - RNA, 22 nt, Human
ugucuucuguauucaagucuau

SEQ ID NO: 917101 - RNA, 22 nt, Human
aaacaagguccuucugugacau

SEQ ID NO: 917102 - RNA, 22 nt, Human
caugaaauguuagaauuagaca

SEQ ID NO: 917103 - RNA, 22 nt, Human
uucugcucaguaguaagagugc

SEQ ID NO: 917104 - RNA, 22 nt, Human
ccuggcagguggcgcccucggc

SEQ ID NO: 917105 - RNA, 22 nt, Human
uucuaacuccacuucccacucc

SEQ ID NO: 917106 - RNA, 22 nt, Human
ugagcugcagugagcugagaug

SEQ ID NO: 917107 - RNA, 22 nt, Human
aauuucacuguggagcacauuu

SEQ ID NO: 917108 - RNA, 22 nt, Human
aggauguguucauagcugacgc

SEQ ID NO: 917109 - RNA, 22 nt, Human
agucuauuucagucuuacuagu

SEQ ID NO: 917110 - RNA, 22 nt, Human
gucaggcugccagucuuuauug

SEQ ID NO: 917111 - RNA, 22 nt, Human
ucaguaaaugaaugaauauaug

SEQ ID NO: 917112 - RNA, 22 nt, Human
ucugucacccgagcaggcgaga

SEQ ID NO: 917113 - RNA, 19 nt, Human
gaaaggcugcugcuaccug

SEQ ID NO: 917114 - RNA, 22 nt, Human
aggaugagagauacauggagca

SEQ ID NO: 917115 - RNA, 22 nt, Human
augagguggucuucaguagguc

SEQ ID NO: 917116 - RNA, 22 nt, Human
uggacccaccccagggccugcu

SEQ ID NO: 917117 - RNA, 22 nt, Human
agucuacaguucccucaggucc

SEQ ID NO: 917118 - RNA, 18 nt, Human
agccuggaggguugaagu

SEQ ID NO: 917119 - RNA, 22 nt, Human
acagagaugucagauuggcagc

SEQ ID NO: 917120 - RNA, 22 nt, Human
uucugcauuucuaauaaguucc

SEQ ID NO: 917121 - RNA, 22 nt, Human
ugcagggccuugggucuuucuu

SEQ ID NO: 917122 - RNA, 22 nt, Human
cauuucuccgccgagaucacug

SEQ ID NO: 917123 - RNA, 22 nt, Human
gcuggagggguaauaggauggg

SEQ ID NO: 917124 - RNA, 22 nt, Human
aacugcaagcucuuuacugcua

SEQ ID NO: 917125 - RNA, 22 nt, Human
cggcagagcuuccugcucagcg

SEQ ID NO: 917126 - RNA, 22 nt, Human
agccaagcaccacuggcacucg

SEQ ID NO: 917127 - RNA, 22 nt, Human
augcaauauagggaagauagau

SEQ ID NO: 917128 - RNA, 22 nt, Human
uccaauguuccugcuuucagcu

SEQ ID NO: 917129 - RNA, 22 nt, Human
uuuugaauaauucagaaacagc

SEQ ID NO: 917130 - RNA, 22 nt, Human
ugagccagaggaggcugugugg

SEQ ID NO: 917131 - RNA, 22 nt, Human
aaggccaucuacuuacggaauu

SEQ ID NO: 917132 - RNA, 22 nt, Human
aucagcugaaaaacaggcagca

SEQ ID NO: 917133 - RNA, 22 nt, Human
acaggcaggcgggacagcccga

SEQ ID NO: 917134 - RNA, 22 nt, Human
ucccauuucacaacaaaacugg

SEQ ID NO: 917135 - RNA, 20 nt, Human
cgaggccaaggggcugggcc

SEQ ID NO: 917136 - RNA, 22 nt, Human
aacuugaaacuguuccagaaaa

SEQ ID NO: 917137 - RNA, 22 nt, Human
cucuucuugcuagacugagugc

SEQ ID NO: 917138 - RNA, 22 nt, Human
gaggggaugcagagaggcuuau

SEQ ID NO: 917139 - RNA, 23 nt, Human
ucuacaaagcugugucaggaccc

SEQ ID NO: 917140 - RNA, 22 nt, Human
caggccauuaccgcugagaccc

SEQ ID NO: 917141 - RNA, 22 nt, Human
guucuuccucauugcuuugaag

SEQ ID NO: 917142 - RNA, 22 nt, Human
caggggcugagaaggaacgucc

SEQ ID NO: 917143 - RNA, 21 nt, Human
uucuucaaagaagaaggcaca

SEQ ID NO: 917144 - RNA, 22 nt, Human
gggcagcacucauaccuauauu

SEQ ID NO: 917145 - RNA, 22 nt, Human
ccugaguggagggauucugcag

SEQ ID NO: 917146 - RNA, 22 nt, Human
ugcaggcaggggaugagcagcc

SEQ ID NO: 917147 - RNA, 22 nt, Human
ugacacccauuaucugugugac

SEQ ID NO: 917148 - RNA, 20 nt, Human
agcuccucaucacuggaggu

SEQ ID NO: 917149 - RNA, 22 nt, Human
ugcagaggaccauuguccugga

SEQ ID NO: 917150 - RNA, 22 nt, Human
auucuuauuuaaauagagucug

SEQ ID NO: 917151 - RNA, 23 nt, Human
ccaguucuccuuugaacagugac

SEQ ID NO: 917152 - RNA, 22 nt, Human
uuucaauugacuuuggaagaaa

SEQ ID NO: 917153 - RNA, 22 nt, Human
ugguccagacauuucugaggua

SEQ ID NO: 917154 - RNA, 22 nt, Human
uauauguuucuuacaaaauauu

SEQ ID NO: 917155 - RNA, 22 nt, Human
aggacaugaagaaagggcaagg

SEQ ID NO: 917156 - RNA, 21 nt, Human
gcagaggaaugguauacauaa

SEQ ID NO: 917157 - RNA, 22 nt, Human
ugucuguaaucaacugaguuuc

SEQ ID NO: 917158 - RNA, 22 nt, Human
cuguuacuucaaucuucucccg

SEQ ID NO: 917159 - RNA, 22 nt, Human
aauguucaaaagcaucagugaa

SEQ ID NO: 917160 - RNA, 22 nt, Human
acauguuagggacagaguaugu

SEQ ID NO: 917161 - RNA, 22 nt, Human
ggacacaagcuccggggcugca

SEQ ID NO: 917162 - RNA, 22 nt, Human
auauagcacuuguuuugcaugu

SEQ ID NO: 917163 - RNA, 22 nt, Human
guggcaggagggcaucacuugg

SEQ ID NO: 917164 - RNA, 18 nt, Human
ugagaggcagguagagga

SEQ ID NO: 917165 - RNA, 20 nt, Human
agggcagagggauuacaggc

SEQ ID NO: 917166 - RNA, 22 nt, Human
cagagacccuucucaguggcca

SEQ ID NO: 917167 - RNA, 22 nt, Human
uucuuaaaacuuauggacaggu

SEQ ID NO: 917168 - RNA, 22 nt, Human
uugaacaauuugguauacaaac

SEQ ID NO: 917169 - RNA, 22 nt, Human
gauuuugaauauuaaagaagag

SEQ ID NO: 917170 - RNA, 22 nt, Human
ugguggggauucccucccuggc

SEQ ID NO: 917171 - RNA, 21 nt, Human
uuucuaaguaacuggcagcau

SEQ ID NO: 917172 - RNA, 22 nt, Human
acaguaaccucuccucugaagg

SEQ ID NO: 917173 - RNA, 22 nt, Human
agagccuggggauuggcaaggg

SEQ ID NO: 917174 - RNA, 22 nt, Human
uagauucuacugucacuuaguu

SEQ ID NO: 917175 - RNA, 22 nt, Human
cuuuuuauaccgugccaguuga

SEQ ID NO: 917176 - RNA, 22 nt, Human
ugcaaauauuuccuuauagcca

SEQ ID NO: 917177 - RNA, 22 nt, Human
cauauuuuaguugcugaacagc

SEQ ID NO: 917178 - RNA, 22 nt, Human
agguaaggggcucccaaguacc

SEQ ID NO: 917179 - RNA, 22 nt, Human
agaauuuaugacaacgauagcc

SEQ ID NO: 917180 - RNA, 22 nt, Human
ucucaucuucauaucugaaaga

SEQ ID NO: 917181 - RNA, 18 nt, Human
ggcaugugagugcugagg

SEQ ID NO: 917182 - RNA, 22 nt, Human
aguuuggaagagaaaaauauuu

SEQ ID NO: 917183 - RNA, 22 nt, Human
ugccuggguugacucuuagcug

SEQ ID NO: 917184 - RNA, 22 nt, Human
uacugaaaguggucaacagugg

SEQ ID NO: 917185 - RNA, 22 nt, Human
gcacuuuauaguagaaagagca

SEQ ID NO: 917186 - RNA, 22 nt, Human
auggcaguguuucaguuuuugg

SEQ ID NO: 917187 - RNA, 22 nt, Human
ucagagucuuaacuauucagag

SEQ ID NO: 917188 - RNA, 22 nt, Human
aagaguauagcuuuaggauuga

SEQ ID NO: 917189 - RNA, 22 nt, Human
ccugaggauauucaccagcaug

SEQ ID NO: 917190 - RNA, 22 nt, Human
uggcauauaaagauguguucaa

SEQ ID NO: 917191 - RNA, 22 nt, Human
aagcucauuaauuagaagcuaa

SEQ ID NO: 917192 - RNA, 22 nt, Human
uaaugaaugagaauauaacaga

SEQ ID NO: 917193 - RNA, 22 nt, Human
cacacagguauauauauguaca

SEQ ID NO: 917194 - RNA, 22 nt, Human
agucaauuaucucuaggucauc

SEQ ID NO: 917195 - RNA, 22 nt, Human
cugagcccugccucuugucacu

SEQ ID NO: 917196 - RNA, 22 nt, Human
uccaaucagcuccuaugagaau

SEQ ID NO: 917197 - RNA, 22 nt, Human
cuccugugcaugcaucucccua

SEQ ID NO: 917198 - RNA, 22 nt, Human
cuucacagccaacaugggcaca

SEQ ID NO: 917199 - RNA, 22 nt, Human
auuugcuggugaauguauagcu

SEQ ID NO: 917200 - RNA, 22 nt, Human
aacacaaucuuccaguuugcug

SEQ ID NO: 917201 - RNA, 22 nt, Human
uguaugcaauaauaacuaugug

SEQ ID NO: 917202 - RNA, 22 nt, Human
gacagacuucauauccuuccuc

SEQ ID NO: 917203 - RNA, 22 nt, Human
aaagaauacccugggucauaaa

SEQ ID NO: 917204 - RNA, 22 nt, Human
cuucacagaugcugagagggcu

SEQ ID NO: 917205 - RNA, 22 nt, Human
cugugacaguuucucagacuuu

SEQ ID NO: 917206 - RNA, 22 nt, Human
ccaugcaugccugaaauugcug

SEQ ID NO: 917207 - RNA, 22 nt, Human
ggacgcagccgagggagcaggg

SEQ ID NO: 917208 - RNA, 22 nt, Human
cacaggaggaggccagagcgua

SEQ ID NO: 917209 - RNA, 22 nt, Human
aaaucucaguguucuaagcauu

SEQ ID NO: 917210 - RNA, 22 nt, Human
uggcaauguggcaucaacgaag

SEQ ID NO: 917211 - RNA, 22 nt, Human
cuguuaaagauaguuaagcuuc

SEQ ID NO: 917212 - RNA, 22 nt, Human
caggcagugugacgcuaggguu

SEQ ID NO: 917213 - RNA, 22 nt, Human
gcauugauucugaagugaaaug

SEQ ID NO: 917214 - RNA, 22 nt, Human
gccaggagcaugucauuguuga

SEQ ID NO: 917215 - RNA, 22 nt, Human
gucagugugaguugauuccaua

SEQ ID NO: 917216 - RNA, 21 nt, Human
agcaggugcuguuggaggaaa

SEQ ID NO: 917217 - RNA, 22 nt, Human
gccaguguuuauagcagugagg

SEQ ID NO: 917218 - RNA, 22 nt, Human
cuccugggcucauaucauucag

SEQ ID NO: 917219 - RNA, 21 nt, Human
aagcaauuaccuucccaugug

SEQ ID NO: 917220 - RNA, 22 nt, Human
auccuucaauuagaaccaauug

SEQ ID NO: 917221 - RNA, 22 nt, Human
ucucugcucugugccucaguuu

SEQ ID NO: 917222 - RNA, 22 nt, Human
cagcuccuaugaguaugauucc

SEQ ID NO: 917223 - RNA, 22 nt, Human
gagaugugauccuuugcugugu

SEQ ID NO: 917224 - RNA, 22 nt, Human
cagacaggcaggugagagcucc

SEQ ID NO: 917225 - RNA, 22 nt, Human
uguauuugggucacaagauggg

SEQ ID NO: 917226 - RNA, 22 nt, Human
accugcaggcacaggugugcgc

SEQ ID NO: 917227 - RNA, 16 nt, Human
ccuggaggucacuuca

SEQ ID NO: 917228 - RNA, 22 nt, Human
ucaugucccguugcuggcugcc

SEQ ID NO: 917229 - RNA, 22 nt, Human
agcugcccagcuaggaagaagg

SEQ ID NO: 917230 - RNA, 22 nt, Human
caguuuuaaauuuugaaugucu

SEQ ID NO: 917231 - RNA, 22 nt, Human
uccaggcugcaaggccacaggg

SEQ ID NO: 917232 - RNA, 22 nt, Human
uccacagaccaguaucugcagc

SEQ ID NO: 917233 - RNA, 22 nt, Human
guacauuuaggauucauugaaa

SEQ ID NO: 917234 - RNA, 22 nt, Human
uguauacauucucuuggguuug

SEQ ID NO: 917235 - RNA, 22 nt, Human
cucagugcuacgguuaccauau

SEQ ID NO: 917236 - RNA, 22 nt, Human
cugggauggcuccgcugcugcu

SEQ ID NO: 917237 - RNA, 22 nt, Human
ugcauguguguguauuuauaaa

SEQ ID NO: 917238 - RNA, 22 nt, Human
cauucuaugaaaacuaggcaau

SEQ ID NO: 917239 - RNA, 22 nt, Human
cucccaggccaugcucuagcca

SEQ ID NO: 917240 - RNA, 21 nt, Human
uuugcugaagauuuuaggcug

SEQ ID NO: 917241 - RNA, 22 nt, Human
ggccugagaauguaccagaucu

SEQ ID NO: 917242 - RNA, 22 nt, Human
agugucugccuauuuuucaagc

SEQ ID NO: 917243 - RNA, 22 nt, Human
ccccaggagcuuguuuuagaga

SEQ ID NO: 917244 - RNA, 22 nt, Human
uguguacauugccuuuuaaagg

SEQ ID NO: 917245 - RNA, 22 nt, Human
ccuaggcccucaaagagcauaa

SEQ ID NO: 917246 - RNA, 19 nt, Human
auacagauguauccaugau

SEQ ID NO: 917247 - RNA, 22 nt, Human
uuagauaaaaguguucaauaaa

SEQ ID NO: 917248 - RNA, 23 nt, Human
acauuucauauaaaagggaucag

SEQ ID NO: 917249 - RNA, 22 nt, Human
caauaauugcuuuccagaguua

SEQ ID NO: 917250 - RNA, 22 nt, Human
gcagaggccaucaacuuugcca

SEQ ID NO: 917251 - RNA, 22 nt, Human
auuuuacauaaggaagguuuaa

SEQ ID NO: 917252 - RNA, 22 nt, Human
agugucaaauuaaauaaucugg

SEQ ID NO: 917253 - RNA, 22 nt, Human
gaugaaauuugggcagguuaaa

SEQ ID NO: 917254 - RNA, 19 nt, Human
ucugggagagugaaucuga

SEQ ID NO: 917255 - RNA, 22 nt, Human
ucaauaacuuuguuuagcauug

SEQ ID NO: 917256 - RNA, 21 nt, Human
guuuucuuugauagagggaag

SEQ ID NO: 917257 - RNA, 22 nt, Human
ccaggcagccugcuccauucug

SEQ ID NO: 917258 - RNA, 19 nt, Human
acugcagggaggaggugug

SEQ ID NO: 917259 - RNA, 20 nt, Human
uacagaaugcaauaaaaugg

SEQ ID NO: 917260 - RNA, 22 nt, Human
gagaggccauggcugugcagug

SEQ ID NO: 917261 - RNA, 22 nt, Human
gaggcagcgggucaggaccgug

SEQ ID NO: 917262 - RNA, 22 nt, Human
gggagggccagugcucucuaga

SEQ ID NO: 917263 - RNA, 22 nt, Human
aguggcagagaccccagccagc

SEQ ID NO: 917264 - RNA, 22 nt, Human
agcagcuugggucucuccugcu

SEQ ID NO: 917265 - RNA, 22 nt, Human
ccuaggccuuacuuuccugugc

SEQ ID NO: 917266 - RNA, 21 nt, Human
gaaucuuugauuuacauggga

SEQ ID NO: 917267 - RNA, 23 nt, Human
uaacaauggacuccucuuagcua

SEQ ID NO: 917268 - RNA, 22 nt, Human
guggcucuccauugacauggaa

SEQ ID NO: 917269 - RNA, 22 nt, Human
uugcugauaccaugaauguuaa

SEQ ID NO: 917270 - RNA, 22 nt, Human
cguuguuugagauuuucagaau

SEQ ID NO: 917271 - RNA, 22 nt, Human
gcucagggucccuuggugcugg

SEQ ID NO: 917272 - RNA, 22 nt, Human
acagaccaaguuuccagcaggu

SEQ ID NO: 917273 - RNA, 22 nt, Human
aguuucucucaguauagaauag

SEQ ID NO: 917274 - RNA, 22 nt, Human
agacugaacccucugcugcacu

SEQ ID NO: 917275 - RNA, 22 nt, Human
caggaagcugaugucuagucau

SEQ ID NO: 917276 - RNA, 22 nt, Human
uugugcuccugugagaaucuag

SEQ ID NO: 917277 - RNA, 22 nt, Human
ucucccucuuugucugcuuugg

SEQ ID NO: 917278 - RNA, 22 nt, Human
ggagagucugcuggccacagug

SEQ ID NO: 917279 - RNA, 22 nt, Human
uccugggucugggugucugagg

SEQ ID NO: 917280 - RNA, 22 nt, Human
caauuugguuacuuccuuagaa

SEQ ID NO: 917281 - RNA, 22 nt, Human
gcacccuguuuauccugaguuc

SEQ ID NO: 917282 - RNA, 22 nt, Human
uuccuagcuauaaagcucuucc

SEQ ID NO: 917283 - RNA, 17 nt, Human
acacaguacuuuuuugc

SEQ ID NO: 917284 - RNA, 22 nt, Human
ggggaggaagcuggaacacggg

SEQ ID NO: 917285 - RNA, 22 nt, Human
ugcagcugagucacccagccau

SEQ ID NO: 917286 - RNA, 22 nt, Human
uagauacacacacagucaugug

SEQ ID NO: 917287 - RNA, 22 nt, Human
gaaucuaaaaacgggcuugguu

SEQ ID NO: 917288 - RNA, 22 nt, Human
uccuuggcuaguacuggccagc

SEQ ID NO: 917289 - RNA, 22 nt, Human
uuaauagauuugauuuuaaagg

SEQ ID NO: 917290 - RNA, 22 nt, Human
aaacucaagucuaugaacaagg

SEQ ID NO: 917291 - RNA, 22 nt, Human
ggaggccagggacccagucagc

SEQ ID NO: 917292 - RNA, 22 nt, Human
ucuggccacccgaggccccugc

SEQ ID NO: 917293 - RNA, 22 nt, Human
uacauguuuacuccaagucagg

SEQ ID NO: 917294 - RNA, 22 nt, Human
uacagagacuuuauggcacaaa

SEQ ID NO: 917295 - RNA, 22 nt, Human
uguauguguggauagauguaua

SEQ ID NO: 917296 - RNA, 22 nt, Human
auuuuaaggcuuauuuaaaggc

SEQ ID NO: 917297 - RNA, 22 nt, Human
uuuccucuuugugacacagcug

SEQ ID NO: 917298 - RNA, 22 nt, Human
uauuucugagaaccaacuuacc

SEQ ID NO: 917299 - RNA, 22 nt, Human
caguccugugucccuugguggg

SEQ ID NO: 917300 - RNA, 22 nt, Human
uggacugauuuucauuuuaaau

SEQ ID NO: 917301 - RNA, 20 nt, Human
uccaccaggaaggguaggga

SEQ ID NO: 917302 - RNA, 22 nt, Human
gccaggaugacuauacaacagc

SEQ ID NO: 917303 - RNA, 22 nt, Human
uugguuuaguaccugccagcgu

SEQ ID NO: 917304 - RNA, 22 nt, Human
cugugcaguggggcucuggguu

SEQ ID NO: 917305 - RNA, 17 nt, Human
gcaaaggugaggagaga

SEQ ID NO: 917306 - RNA, 22 nt, Human
acaguuaaauauuucuacuggg

SEQ ID NO: 917307 - RNA, 22 nt, Human
gcucugagaggugcagcaguaa

SEQ ID NO: 917308 - RNA, 22 nt, Human
ugguggcaacauugcuggagug

SEQ ID NO: 917309 - RNA, 22 nt, Human
auccauggcuaaguauauagag

SEQ ID NO: 917310 - RNA, 22 nt, Human
gcuggcucaagagguccagagg

SEQ ID NO: 917311 - RNA, 22 nt, Human
acaaugaaccaaauuuaccaau

SEQ ID NO: 917312 - RNA, 22 nt, Human
accagaguaauguguggaaauu

SEQ ID NO: 917313 - RNA, 22 nt, Human
uauuuccaagcugaauccaaug

SEQ ID NO: 917314 - RNA, 22 nt, Human
cagcucuuuuuugcagcagcug

SEQ ID NO: 917315 - RNA, 22 nt, Human
ccacugcuguuacuuacgcaaa

SEQ ID NO: 917316 - RNA, 22 nt, Human
acaguugggcuguagcaugcuu

SEQ ID NO: 917317 - RNA, 22 nt, Human
guuuuucuaaguagcgauauuu

SEQ ID NO: 917318 - RNA, 22 nt, Human
aaugaacaugggaguacuaaua

SEQ ID NO: 917319 - RNA, 22 nt, Human
guccucuggugaaagcauuccc

SEQ ID NO: 917320 - RNA, 22 nt, Human
cucaggcugguuuggguuguuu

SEQ ID NO: 917321 - RNA, 22 nt, Human
ucuggggagggagccacagguc

SEQ ID NO: 917322 - RNA, 22 nt, Human
ucacauucuuuauuugccaucc

SEQ ID NO: 917323 - RNA, 22 nt, Human
ucccacagggcuucucuguaca

SEQ ID NO: 917324 - RNA, 20 nt, Human
ugucuccagggcugagugga

SEQ ID NO: 917325 - RNA, 22 nt, Human
gccacaugcaauugcagcacgu

SEQ ID NO: 917326 - RNA, 23 nt, Human
acccaguuagagcccuuuaggaa

SEQ ID NO: 917327 - RNA, 22 nt, Human
cccagggucccugcucucugug

SEQ ID NO: 917328 - RNA, 18 nt, Human
ggugagggagcuggaagc

SEQ ID NO: 917329 - RNA, 22 nt, Human
aggcuggacccgacaccugccc

SEQ ID NO: 917330 - RNA, 22 nt, Human
uagaaucugaaaguggcuguga

SEQ ID NO: 917331 - RNA, 22 nt, Human
ugugccugucccgcauucuggu

SEQ ID NO: 917332 - RNA, 20 nt, Human
acucuaacucuuuacaacag

SEQ ID NO: 917333 - RNA, 22 nt, Human
cuccagacagaucuucuagcag

SEQ ID NO: 917334 - RNA, 23 nt, Human
uggaaugucugauucugcucuag

SEQ ID NO: 917335 - RNA, 22 nt, Human
uguaucaaaccaaauuaauucu

SEQ ID NO: 917336 - RNA, 22 nt, Human
aacacuggaagggacaucaagu

SEQ ID NO: 917337 - RNA, 22 nt, Human
aauauaugacuccacugcauga

SEQ ID NO: 917338 - RNA, 22 nt, Human
cgagcagagcagagacgucugg

SEQ ID NO: 917339 - RNA, 22 nt, Human
cuggcagcguguuuaugaacau

SEQ ID NO: 917340 - RNA, 22 nt, Human
aauuuuaagcauaugacugguu

SEQ ID NO: 917341 - RNA, 22 nt, Human
gucuggguuaaguccugauaau

SEQ ID NO: 917342 - RNA, 22 nt, Human
ucuucuguccuaagucaaagca

SEQ ID NO: 917343 - RNA, 22 nt, Human
ucacagagagugacuuguugcu

SEQ ID NO: 917344 - RNA, 22 nt, Human
cugagguguugaugaccuaugc

SEQ ID NO: 917345 - RNA, 22 nt, Human
ccaaggcuucccagagaugcuc

SEQ ID NO: 917346 - RNA, 22 nt, Human
uauucacaugaaaacaaauuuu

SEQ ID NO: 917347 - RNA, 22 nt, Human
cuauaaaucuacccagcauugg

SEQ ID NO: 917348 - RNA, 22 nt, Human
acagggaaggacaugacuuggc

SEQ ID NO: 917349 - RNA, 22 nt, Human
uuccaagugucagaucagauuu

SEQ ID NO: 917350 - RNA, 22 nt, Human
ugcuuccugaggccgucuucuc

SEQ ID NO: 917351 - RNA, 22 nt, Human
uuaagacacauuucucagacgg

SEQ ID NO: 917352 - RNA, 22 nt, Human
cuauauugguaauauuugcuca

SEQ ID NO: 917353 - RNA, 23 nt, Human
agucaguguaaguuuggaaugca

SEQ ID NO: 917354 - RNA, 22 nt, Human
cuguucuaucauuaaaagcuau

SEQ ID NO: 917355 - RNA, 22 nt, Human
aggcagcaauugaaaucauugu

SEQ ID NO: 917356 - RNA, 22 nt, Human
uaucuuuugaguucucaagaug

SEQ ID NO: 917357 - RNA, 22 nt, Human
cuuuacaaccuaaguugaagcu

SEQ ID NO: 917358 - RNA, 22 nt, Human
ucaggaagcugcucuggguggu

SEQ ID NO: 917359 - RNA, 22 nt, Human
ucaaaaucaaagauacuugaaa

SEQ ID NO: 917360 - RNA, 22 nt, Human
agccccuguacccugagugcuu

SEQ ID NO: 917361 - RNA, 22 nt, Human
gacuggcuuauuucacuuagca

SEQ ID NO: 917362 - RNA, 18 nt, Human
auggucucauacugggag

SEQ ID NO: 917363 - RNA, 22 nt, Human
ucuaucagaguagaaggcaacg

SEQ ID NO: 917364 - RNA, 22 nt, Human
uaacacaugucugggaugugaa

SEQ ID NO: 917365 - RNA, 22 nt, Human
uugagaacuacuuuauuauucu

SEQ ID NO: 917366 - RNA, 22 nt, Human
cugagcuggucuauggacuugg

SEQ ID NO: 917367 - RNA, 22 nt, Human
uucuaggggagaggaagaagug

SEQ ID NO: 917368 - RNA, 22 nt, Human
ggccuuagugagguccugaugc

SEQ ID NO: 917369 - RNA, 22 nt, Human
gaagaauugcccauuucugucu

SEQ ID NO: 917370 - RNA, 22 nt, Human
gaggcugcccacaccugcgccg

SEQ ID NO: 917371 - RNA, 22 nt, Human
auguggcuagugcagaugaaua

SEQ ID NO: 917372 - RNA, 22 nt, Human
uucagaaaucccucuucuaccc

SEQ ID NO: 917373 - RNA, 22 nt, Human
ugcggaggucggugcugcgggc

SEQ ID NO: 917374 - RNA, 22 nt, Human
cagugagguggaguaguuccca

SEQ ID NO: 917375 - RNA, 22 nt, Human
gauguacaaguaaaauaugugu

SEQ ID NO: 917376 - RNA, 22 nt, Human
aaugacauggagcaucuuuuca

SEQ ID NO: 917377 - RNA, 22 nt, Human
ugucacaaggccaugaaaagaa

SEQ ID NO: 917378 - RNA, 22 nt, Human
aucauagaacaccuaccuaccu

SEQ ID NO: 917379 - RNA, 22 nt, Human
ccuagagugauugagagcauca

SEQ ID NO: 917380 - RNA, 22 nt, Human
acaguguuuauguacagauugu

SEQ ID NO: 917381 - RNA, 22 nt, Human
aacaauguaaucuacucugcuc

SEQ ID NO: 917382 - RNA, 21 nt, Human
ucuugguuccguguguuugau

SEQ ID NO: 917383 - RNA, 22 nt, Human
ugacacuucuccaucaagucaa

SEQ ID NO: 917384 - RNA, 22 nt, Human
aagcugaagacacagcuccagu

SEQ ID NO: 917385 - RNA, 22 nt, Human
aaauuagucauguuguauuacu

SEQ ID NO: 917386 - RNA, 22 nt, Human
caaaaguaauguaugcucaucg

SEQ ID NO: 917387 - RNA, 22 nt, Human
ugaagaggccaaacuaucauug

SEQ ID NO: 917388 - RNA, 22 nt, Human
ugggcugaacuucaucugauga

SEQ ID NO: 917389 - RNA, 22 nt, Human
aggugucuggauggguguccuu

SEQ ID NO: 917390 - RNA, 22 nt, Human
cagggagaagucuggucagucc

SEQ ID NO: 917391 - RNA, 22 nt, Human
uuucuuuugcccuguggguuag

SEQ ID NO: 917392 - RNA, 22 nt, Human
ucagcagggagaggagaaugca

SEQ ID NO: 917393 - RNA, 22 nt, Human
ccucaggcuuacgggcaaugga

SEQ ID NO: 917394 - RNA, 22 nt, Human
ucugugccaugcccgucuacca

SEQ ID NO: 917395 - RNA, 22 nt, Human
ugugugcacaggaguguuugaa

SEQ ID NO: 917396 - RNA, 22 nt, Human
ucauugaauucuggggguugag

SEQ ID NO: 917397 - RNA, 22 nt, Human
acacuucucccaucuccuguug

SEQ ID NO: 917398 - RNA, 22 nt, Human
uugcuugacuuuguguaccugu

SEQ ID NO: 917399 - RNA, 22 nt, Human
auguacagugauaagagggcag

SEQ ID NO: 917400 - RNA, 22 nt, Human
gagagggagccagccaggaacc

SEQ ID NO: 917401 - RNA, 22 nt, Human
uaaagcaaggaauagaguaguc

SEQ ID NO: 917402 - RNA, 22 nt, Human
agcagcuugguuuuaggcaugg

SEQ ID NO: 917403 - RNA, 22 nt, Human
aaguccaaggucaccauucaca

SEQ ID NO: 917404 - RNA, 22 nt, Human
gugugcagaagacacaagacau

SEQ ID NO: 917405 - RNA, 22 nt, Human
ugcccauggaccaagcaagggg

SEQ ID NO: 917406 - RNA, 22 nt, Human
gggaaggcugccugagggaugg

SEQ ID NO: 917407 - RNA, 22 nt, Human
guuuuguugcugcagagcucaa

SEQ ID NO: 917408 - RNA, 22 nt, Human
gcuagaaaucgacuucagaauu

SEQ ID NO: 917409 - RNA, 22 nt, Human
ucugagcuggagcccaucaccu

SEQ ID NO: 917410 - RNA, 22 nt, Human
aagaguuuucucugauggcauu

SEQ ID NO: 917411 - RNA, 22 nt, Human
ccacagagacucugcaggacug

SEQ ID NO: 917412 - RNA, 22 nt, Human
caacugaaaagauucuacgcag

SEQ ID NO: 917413 - RNA, 22 nt, Human
aggcagcauuucugcuuaucca

SEQ ID NO: 917414 - RNA, 22 nt, Human
cagcagugucuccagcaucaca

SEQ ID NO: 917415 - RNA, 22 nt, Human
uagaggcugggaauuauuuuca

SEQ ID NO: 917416 - RNA, 22 nt, Human
cuggcccugccagagaucaaca

SEQ ID NO: 917417 - RNA, 22 nt, Human
ccaugcuggagucccuagcugu

SEQ ID NO: 917418 - RNA, 22 nt, Human
aaaaggcauuuugucaaccaua

SEQ ID NO: 917419 - RNA, 22 nt, Human
ggccagcuggaugugggugacg

SEQ ID NO: 917420 - RNA, 22 nt, Human
aguagaaagaaggcacugggcc

SEQ ID NO: 917421 - RNA, 22 nt, Human
uccucacagucaacacuuugag

SEQ ID NO: 917422 - RNA, 22 nt, Human
uggccaguuugcucaggcaguc

SEQ ID NO: 917423 - RNA, 22 nt, Human
gaaauggugugcugugcaauga

SEQ ID NO: 917424 - RNA, 22 nt, Human
gcagggcaaauguggaaaggag

SEQ ID NO: 917425 - RNA, 22 nt, Human
ugauuuguuacacaggugugug

SEQ ID NO: 917426 - RNA, 22 nt, Human
guggggcugaguggagccagaa

SEQ ID NO: 917427 - RNA, 22 nt, Human
acagggccaaguaaacccuacc

SEQ ID NO: 917428 - RNA, 22 nt, Human
ggagggccccuccagugggcag

SEQ ID NO: 917429 - RNA, 22 nt, Human
ugcuagggauguagcagugaag

SEQ ID NO: 917430 - RNA, 22 nt, Human
agcagcauacacaucauguuga

SEQ ID NO: 917431 - RNA, 22 nt, Human
cuggauaaauguuugcuuuaga

SEQ ID NO: 917432 - RNA, 22 nt, Human
ugcaauuuaugugcaagugguu

SEQ ID NO: 917433 - RNA, 22 nt, Human
uccaagaucuacagcaguuuag

SEQ ID NO: 917434 - RNA, 22 nt, Human
agcgcgcugucagacuggcucg

SEQ ID NO: 917435 - RNA, 23 nt, Human
agguacacauuauagaaauagac

SEQ ID NO: 917436 - RNA, 22 nt, Human
ugaggcagaaaauagcaguuca

SEQ ID NO: 917437 - RNA, 22 nt, Human
acauaauaccuaggacaguuug

SEQ ID NO: 917438 - RNA, 21 nt, Human
ugcuugggggcuucaggagcu

SEQ ID NO: 917439 - RNA, 22 nt, Human
gcuguccuggggagggagaaug

SEQ ID NO: 917440 - RNA, 22 nt, Human
ccacagaaagccugggaagugg

SEQ ID NO: 917441 - RNA, 22 nt, Human
gaggacagugugaucugccagc

SEQ ID NO: 917442 - RNA, 22 nt, Human
gcaaagacccaggugucuaucc

SEQ ID NO: 917443 - RNA, 22 nt, Human
ccagccucaucgccugccuguc

SEQ ID NO: 917444 - RNA, 22 nt, Human
auggagggaaaaguggagagcc

SEQ ID NO: 917445 - RNA, 22 nt, Human
augacacccaaaaccagugcag

SEQ ID NO: 917446 - RNA, 22 nt, Human
gcucugagcugucuugcagguc

SEQ ID NO: 917447 - RNA, 22 nt, Human
aaaugcuugcaacaucccaggu

SEQ ID NO: 917448 - RNA, 22 nt, Human
aaugaaugugauuaacuucaag

SEQ ID NO: 917449 - RNA, 22 nt, Human
ggggcaaagggagagucccuac

SEQ ID NO: 917450 - RNA, 22 nt, Human
uguuuaauugggccaacagcgg

SEQ ID NO: 917451 - RNA, 22 nt, Human
aggcugccuggcugugagugaa

SEQ ID NO: 917452 - RNA, 22 nt, Human
aauuccaagagcuuccuaagug

SEQ ID NO: 917453 - RNA, 22 nt, Human
ugaggcuugucucagauggggg

SEQ ID NO: 917454 - RNA, 22 nt, Human
cugcaugagcugucaguggagg

SEQ ID NO: 917455 - RNA, 22 nt, Human
accaggcccauguggauuacua

SEQ ID NO: 917456 - RNA, 22 nt, Human
gugguccugaguagcuuuagaa

SEQ ID NO: 917457 - RNA, 22 nt, Human
ugccugggacaugcuguggacu

SEQ ID NO: 917458 - RNA, 22 nt, Human
aggaagcugcuaagaaacaaug

SEQ ID NO: 917459 - RNA, 22 nt, Human
ggggcugaaccuggaggugguc

SEQ ID NO: 917460 - RNA, 22 nt, Human
auuguguccucauugaccuuca

SEQ ID NO: 917461 - RNA, 22 nt, Human
ucugugacauugaacaucuaca

SEQ ID NO: 917462 - RNA, 22 nt, Human
aaauaugagaguaggaguuugg

SEQ ID NO: 917463 - RNA, 21 nt, Human
caggcucugcuagaggagccu

SEQ ID NO: 917464 - RNA, 22 nt, Human
gagcaacagggcgaggagaacu

SEQ ID NO: 917465 - RNA, 22 nt, Human
uucaaaacagcuagauauugga

SEQ ID NO: 917466 - RNA, 22 nt, Human
cauguaguccuaaugcugguga

SEQ ID NO: 917467 - RNA, 22 nt, Human
auucacaaaugcugccccauuc

SEQ ID NO: 917468 - RNA, 22 nt, Human
caggcagaguuagugauuuagg

SEQ ID NO: 917469 - RNA, 22 nt, Human
uuugucuuguaaguuaaauuca

SEQ ID NO: 917470 - RNA, 22 nt, Human
aaaaguuaacuguguucaugca

SEQ ID NO: 917471 - RNA, 22 nt, Human
uucuaguuacucuuaaaugcug

SEQ ID NO: 917472 - RNA, 22 nt, Human
gaggaaggcuaaggggcuuaga

SEQ ID NO: 917473 - RNA, 22 nt, Human
uucugcugguguuuugugaggc

SEQ ID NO: 917474 - RNA, 22 nt, Human
acccaggaggcagagguugcag

SEQ ID NO: 917475 - RNA, 22 nt, Human
gccagcugcuggaacagcgcga

SEQ ID NO: 917476 - RNA, 22 nt, Human
uauugcugccaggacccuaucc

SEQ ID NO: 917477 - RNA, 22 nt, Human
aaaguuuuagaacuaggaagca

SEQ ID NO: 917478 - RNA, 22 nt, Human
gucacaggaagcagcaggcacu

SEQ ID NO: 917479 - RNA, 22 nt, Human
uggugagauguauggaggguug

SEQ ID NO: 917480 - RNA, 22 nt, Human
ugugugcagcugaaaagcgcug

SEQ ID NO: 917481 - RNA, 22 nt, Human
agccaagggucagcugcacaga

SEQ ID NO: 917482 - RNA, 22 nt, Human
ugguauuacuucuagacacaag

SEQ ID NO: 917483 - RNA, 22 nt, Human
auuccugagacuuaucuguuuc

SEQ ID NO: 917484 - RNA, 19 nt, Human
guucaugugaggaaggaac

SEQ ID NO: 917485 - RNA, 22 nt, Human
caggaauucauagcauuguucu

SEQ ID NO: 917486 - RNA, 22 nt, Human
gaacaguauuuccaggaauccc

SEQ ID NO: 917487 - RNA, 22 nt, Human
uuggcagcucuugauggcaccc

SEQ ID NO: 917488 - RNA, 22 nt, Human
ucagggcauacucuucaagguc

SEQ ID NO: 917489 - RNA, 18 nt, Human
ggcuccagucuucagugg

SEQ ID NO: 917490 - RNA, 22 nt, Human
uuuuaaaucuccaguugacccc

SEQ ID NO: 917491 - RNA, 22 nt, Human
auaauccugcuuuuucacuauu

SEQ ID NO: 917492 - RNA, 22 nt, Human
uagcagggguagauagagugug

SEQ ID NO: 917493 - RNA, 22 nt, Human
cuuccuaaaagcuucaagagaa

SEQ ID NO: 917494 - RNA, 22 nt, Human
uuugcuuucuugauucagauua

SEQ ID NO: 917495 - RNA, 22 nt, Human
ccuccugggacaggcuggcaca

SEQ ID NO: 917496 - RNA, 22 nt, Human
agaaggcagaaaguccagguau

SEQ ID NO: 917497 - RNA, 22 nt, Human
auaaguguuagguaaacaucuu

SEQ ID NO: 917498 - RNA, 22 nt, Human
ggcggccugugggucggccuca

SEQ ID NO: 917499 - RNA, 22 nt, Human
uaaagcaauuugagcaaguucu

SEQ ID NO: 917500 - RNA, 22 nt, Human
ugcaaggcacccacucugcuuu

SEQ ID NO: 917501 - RNA, 22 nt, Human
aauaagacacacaacugucaag

SEQ ID NO: 917502 - RNA, 23 nt, Human
uggcucugagagguucagaugcu

SEQ ID NO: 917503 - RNA, 22 nt, Human
agcuggaggggccagcaggugu

SEQ ID NO: 917504 - RNA, 22 nt, Human
cccaggguggaugcaagcagca

SEQ ID NO: 917505 - RNA, 22 nt, Human
uugucucuguguggcuucccua

SEQ ID NO: 917506 - RNA, 22 nt, Human
uauauacaagguagguuuaggu

SEQ ID NO: 917507 - RNA, 22 nt, Human
ggcucugggguuggcccaucuc

SEQ ID NO: 917508 - RNA, 19 nt, Human
cccaggaagcggagguugc

SEQ ID NO: 917509 - RNA, 22 nt, Human
uggcugaggcacagcugccgcc

SEQ ID NO: 917510 - RNA, 22 nt, Human
uuuucaguuauagaaugguaga

SEQ ID NO: 917511 - RNA, 22 nt, Human
agcuuucucccugacgcuuugg

SEQ ID NO: 917512 - RNA, 22 nt, Human
uaugucaaaaaagauuauguuu

SEQ ID NO: 917513 - RNA, 21 nt, Human
cugcaaauguaaugaguuugg

SEQ ID NO: 917514 - RNA, 22 nt, Human
aacagaacuguuguucuggagg

SEQ ID NO: 917515 - RNA, 22 nt, Human
acuguggcacuaggcaccuuac

SEQ ID NO: 917516 - RNA, 22 nt, Human
ucuguccagagguccuggagac

SEQ ID NO: 917517 - RNA, 22 nt, Human
uuucacaaacugaggagacaau

SEQ ID NO: 917518 - RNA, 22 nt, Human
agcacaggaccaaggaagcugu

SEQ ID NO: 917519 - RNA, 22 nt, Human
cacagggcagguacucucagag

SEQ ID NO: 917520 - RNA, 22 nt, Human
aaagagcuggcauuuauagucu

SEQ ID NO: 917521 - RNA, 22 nt, Human
cggcagagcccugagucagccu

SEQ ID NO: 917522 - RNA, 22 nt, Human
agguggcaggaggucagagaaa

SEQ ID NO: 917523 - RNA, 22 nt, Human
cuguggcugcgccaucgaaaac

SEQ ID NO: 917524 - RNA, 22 nt, Human
acauucauggguuuuacauuau

SEQ ID NO: 917525 - RNA, 22 nt, Human
guggcagggguauuccagcuga

SEQ ID NO: 917526 - RNA, 22 nt, Human
uccuguuuaucugugugacucg

SEQ ID NO: 917527 - RNA, 20 nt, Human
uacaaguacauuauaguuau

SEQ ID NO: 917528 - RNA, 22 nt, Human
ccugucugaaucaugauuuccu

SEQ ID NO: 917529 - RNA, 22 nt, Human
gugcuuuuaacuuuugaaagga

SEQ ID NO: 917530 - RNA, 22 nt, Human
ggggcuggcucacuaagagacu

SEQ ID NO: 917531 - RNA, 22 nt, Human
cagauggagucccguggaguuc

SEQ ID NO: 917532 - RNA, 22 nt, Human
ggacuuuagcagcuggagagga

SEQ ID NO: 917533 - RNA, 22 nt, Human
ugugaaauugagaaacuuucac

SEQ ID NO: 917534 - RNA, 22 nt, Human
agcuggaaagaagguggcagcc

SEQ ID NO: 917535 - RNA, 22 nt, Human
uucauguaguguaaugucuuca

SEQ ID NO: 917536 - RNA, 23 nt, Human
ugcuccagguacagaacuccagg

SEQ ID NO: 917537 - RNA, 23 nt, Human
ucagucccaacagcuucuccugg

SEQ ID NO: 917538 - RNA, 22 nt, Human
aguagaaucccuugcaaugucc

SEQ ID NO: 917539 - RNA, 22 nt, Human
uuggcugguuucaagaaggcau

SEQ ID NO: 917540 - RNA, 22 nt, Human
cuuuguuaucuguaaaugguua

SEQ ID NO: 917541 - RNA, 22 nt, Human
gccuucugauaucucuuggcau

SEQ ID NO: 917542 - RNA, 22 nt, Human
uggagggcgcuuagauggaggg

SEQ ID NO: 917543 - RNA, 22 nt, Human
aggacuggcccugaggggaggc

SEQ ID NO: 917544 - RNA, 22 nt, Human
caggcugcaagaaaggcauuca

SEQ ID NO: 917545 - RNA, 22 nt, Human
ugucaguggaccuggagaggcc

SEQ ID NO: 917546 - RNA, 22 nt, Human
gaagcagcaaguauaggacagg

SEQ ID NO: 917547 - RNA, 22 nt, Human
cugguccucuccagcaggcauu

SEQ ID NO: 917548 - RNA, 20 nt, Human
gugguauucaguaacaguga

SEQ ID NO: 917549 - RNA, 20 nt, Human
ucaaagaagauucagcucaa

SEQ ID NO: 917550 - RNA, 22 nt, Human
gcacuagaaguacgccuuguaa

SEQ ID NO: 917551 - RNA, 22 nt, Human
cuuccccaaccccgacugugug

SEQ ID NO: 917552 - RNA, 22 nt, Human
acagagaaagugggcugaagau

SEQ ID NO: 917553 - RNA, 22 nt, Human
agacaauuuuugguuuugcaag

SEQ ID NO: 917554 - RNA, 22 nt, Human
aagucacagcuaaauagcuaag

SEQ ID NO: 917555 - RNA, 22 nt, Human
aggaaaaauaaggcagcagggc

SEQ ID NO: 917556 - RNA, 17 nt, Human
cagguacauugcuacug

SEQ ID NO: 917557 - RNA, 22 nt, Human
ccucaaguuggaaauaaaaugu

SEQ ID NO: 917558 - RNA, 22 nt, Human
aguugcuaucgugaagcacgug

SEQ ID NO: 917559 - RNA, 22 nt, Human
augaaagcacgugggaagauaa

SEQ ID NO: 917560 - RNA, 21 nt, Human
ugaggaugugcagcagcagga

SEQ ID NO: 917561 - RNA, 22 nt, Human
ccaaggagcaaguuuacaccug

SEQ ID NO: 917562 - RNA, 22 nt, Human
cuggcuccugaggcuuggcccc

SEQ ID NO: 917563 - RNA, 22 nt, Human
uuuaaauguuuaaaacucguga

SEQ ID NO: 917564 - RNA, 22 nt, Human
ugaucuuuacugcuguuuauaa

SEQ ID NO: 917565 - RNA, 22 nt, Human
acugccuuauaauaugucaaca

SEQ ID NO: 917566 - RNA, 22 nt, Human
agaguuaagacguacaugagug

SEQ ID NO: 917567 - RNA, 22 nt, Human
gugaccagccagugcugucugu

SEQ ID NO: 917568 - RNA, 22 nt, Human
gguggcagcgucuaucugacau

SEQ ID NO: 917569 - RNA, 22 nt, Human
cccuggaggcaaagguugcagu

SEQ ID NO: 917570 - RNA, 22 nt, Human
uuugaaagcaccauuugaguag

SEQ ID NO: 917571 - RNA, 22 nt, Human
cagugcuauuuggacacaggga

SEQ ID NO: 917572 - RNA, 22 nt, Human
ugucaauauguaauaacugaau

SEQ ID NO: 917573 - RNA, 20 nt, Human
gaagcagcuucauguagaca

SEQ ID NO: 917574 - RNA, 19 nt, Human
cucagagaggggcagugcc

SEQ ID NO: 917575 - RNA, 22 nt, Human
aacaguaaugugguguuggguu

SEQ ID NO: 917576 - RNA, 22 nt, Human
aggacaagacaaggaccagaga

SEQ ID NO: 917577 - RNA, 22 nt, Human
gaugugagugguagcugggauu

SEQ ID NO: 917578 - RNA, 22 nt, Human
aauuuaaggaggccuucacucu

SEQ ID NO: 917579 - RNA, 22 nt, Human
ggacugaaagcgaagaauuugu

SEQ ID NO: 917580 - RNA, 22 nt, Human
aaaugucagaagcuuuacuucu

SEQ ID NO: 917581 - RNA, 22 nt, Human
ucugagccaccugagcccaugg

SEQ ID NO: 917582 - RNA, 20 nt, Human
ucaauguaaucauaucauca

SEQ ID NO: 917583 - RNA, 22 nt, Human
gucuguacccacguccugcuag

SEQ ID NO: 917584 - RNA, 22 nt, Human
ugcagaggugugcauucuuaag

SEQ ID NO: 917585 - RNA, 22 nt, Human
uacaguucuuugaaggaucuag

SEQ ID NO: 917586 - RNA, 22 nt, Human
ugucuuaaguagauuacagccu

SEQ ID NO: 917587 - RNA, 18 nt, Human
agcauggcacaggcuccc

SEQ ID NO: 917588 - RNA, 17 nt, Human
uucugugcuuccuggcu

SEQ ID NO: 917589 - RNA, 22 nt, Human
agaggccagggacacugcucaa

SEQ ID NO: 917590 - RNA, 22 nt, Human
uccuuucugggccucagugacu

SEQ ID NO: 917591 - RNA, 22 nt, Human
agagacugcuuuauauuguacu

SEQ ID NO: 917592 - RNA, 22 nt, Human
uguggagguuuaaguaauggga

SEQ ID NO: 917593 - RNA, 22 nt, Human
cuguagccagaagcagaaggcc

SEQ ID NO: 917594 - RNA, 22 nt, Human
ucugucacaaguaauccuuuuc

SEQ ID NO: 917595 - RNA, 22 nt, Human
gcagagcugagcggcugcccgg

SEQ ID NO: 917596 - RNA, 19 nt, Human
ccucagagcuagugaacau

SEQ ID NO: 917597 - RNA, 22 nt, Human
ucucagagggaaacaugaguga

SEQ ID NO: 917598 - RNA, 22 nt, Human
uuggcauccacuuugcaaguuu

SEQ ID NO: 917599 - RNA, 22 nt, Human
uagcuguguaacaugagaaugu

SEQ ID NO: 917600 - RNA, 22 nt, Human
cagugcugcaggcgccugcggu

SEQ ID NO: 917601 - RNA, 22 nt, Human
ucucugaagauauuuauuauua

SEQ ID NO: 917602 - RNA, 22 nt, Human
ugaggaagccaaacagcuacac

SEQ ID NO: 917603 - RNA, 22 nt, Human
ucagcugcauaagucaccuugc

SEQ ID NO: 917604 - RNA, 22 nt, Human
aagaguaaaugucuaauuagga

SEQ ID NO: 917605 - RNA, 22 nt, Human
cacagggaggcagccaugcucc

SEQ ID NO: 917606 - RNA, 22 nt, Human
ccucagaaggacaagagacaaa

SEQ ID NO: 917607 - RNA, 22 nt, Human
uggugcugacaguucugagugc

SEQ ID NO: 917608 - RNA, 22 nt, Human
cugguucccagcaggaguguag

SEQ ID NO: 917609 - RNA, 22 nt, Human
auggaaguuggaaccauucaua

SEQ ID NO: 917610 - RNA, 22 nt, Human
uggggacugacagccaggccuc

SEQ ID NO: 917611 - RNA, 16 nt, Human
gacacaugggggaaaa

SEQ ID NO: 917612 - RNA, 22 nt, Human
aaggcaguaucuguagagugcu

SEQ ID NO: 917613 - RNA, 22 nt, Human
ugauucucuuguaagcuauguu

SEQ ID NO: 917614 - RNA, 22 nt, Human
uuucuucuccauggcagguccu

SEQ ID NO: 917615 - RNA, 22 nt, Human
cagugacagcaagcagugcugg

SEQ ID NO: 917616 - RNA, 22 nt, Human
uguggcugacuccuggucccca

SEQ ID NO: 917617 - RNA, 22 nt, Human
guguggucgaaguucucccgga

SEQ ID NO: 917618 - RNA, 22 nt, Human
uuagcauucucugugugcauaa

SEQ ID NO: 917619 - RNA, 21 nt, Human
ucuuuuaacaccaggaauucc

SEQ ID NO: 917620 - RNA, 22 nt, Human
ccucuggccagagaaaggccag

SEQ ID NO: 917621 - RNA, 22 nt, Human
uuauaaagauuguuauguaucu

SEQ ID NO: 917622 - RNA, 22 nt, Human
gcccagugguaaaagcaggccu

SEQ ID NO: 917623 - RNA, 22 nt, Human
ucuucugugaucuauguguuuu

SEQ ID NO: 917624 - RNA, 22 nt, Human
ccugggagagucuguggucucc

SEQ ID NO: 917625 - RNA, 22 nt, Human
gcagggcacagacagugccaag

SEQ ID NO: 917626 - RNA, 21 nt, Human
aucucacagcccagagaagcc

SEQ ID NO: 917627 - RNA, 22 nt, Human
uuuugguggugggcuuggcagc

SEQ ID NO: 917628 - RNA, 22 nt, Human
ggaauucuuaaaauggugugua

SEQ ID NO: 917629 - RNA, 22 nt, Human
gaguggcucccuggguuuggca

SEQ ID NO: 917630 - RNA, 22 nt, Human
agcugagagcugugucaagaua

SEQ ID NO: 917631 - RNA, 22 nt, Human
uauacagauuaacagauuuaaa

SEQ ID NO: 917632 - RNA, 22 nt, Human
auacaguauguaggcuuuucag

SEQ ID NO: 917633 - RNA, 22 nt, Human
cugagggccuuggcuccugccc

SEQ ID NO: 917634 - RNA, 22 nt, Human
uaagcaagugguagaaggacaa

SEQ ID NO: 917635 - RNA, 22 nt, Human
acagugacacucaggugggaug

SEQ ID NO: 917636 - RNA, 22 nt, Human
gcugaggccucagaaggcugag

SEQ ID NO: 917637 - RNA, 17 nt, Human
uuguguguaguucugau

SEQ ID NO: 917638 - RNA, 22 nt, Human
guucucagcgugggaggcagag

SEQ ID NO: 917639 - RNA, 22 nt, Human
caucaagugccuuucaccucua

SEQ ID NO: 917640 - RNA, 19 nt, Human
uugaacacuuucuucaagg

SEQ ID NO: 917641 - RNA, 22 nt, Human
ccuuuggagcaacugagagcua

SEQ ID NO: 917642 - RNA, 22 nt, Human
uccugccucacaguugaaguuu

SEQ ID NO: 917643 - RNA, 22 nt, Human
uuguauucuguuacagcaacau

SEQ ID NO: 917644 - RNA, 22 nt, Human
ucucuggguuuuuguccuguac

SEQ ID NO: 917645 - RNA, 22 nt, Human
gcauauuuucacaagcucuugg

SEQ ID NO: 917646 - RNA, 22 nt, Human
uuucccaaagccuggggugagu

SEQ ID NO: 917647 - RNA, 22 nt, Human
auuucuucagguucuucuagga

SEQ ID NO: 917648 - RNA, 22 nt, Human
gccugguggugugcucaagugg

SEQ ID NO: 917649 - RNA, 23 nt, Human
aggaaggagguccuaacaguauc

SEQ ID NO: 917650 - RNA, 22 nt, Human
gauuucagggugucuuccagcu

SEQ ID NO: 917651 - RNA, 23 nt, Human
ugaagugaaauuucacaagggac

SEQ ID NO: 917652 - RNA, 22 nt, Human
caaauaucuuuggcaaagagaa

SEQ ID NO: 917653 - RNA, 20 nt, Human
uagcagcagaaagaacuuag

SEQ ID NO: 917654 - RNA, 22 nt, Human
agguuccagggauuaggaugug

SEQ ID NO: 917655 - RNA, 22 nt, Human
cacgaauggaagggucuuggcu

SEQ ID NO: 917656 - RNA, 22 nt, Human
cgccuggaaccucuaggaccag

SEQ ID NO: 917657 - RNA, 22 nt, Human
cuuuggaacaagaagaaauggc

SEQ ID NO: 917658 - RNA, 22 nt, Human
aaagcugccaaggagaauacua

SEQ ID NO: 917659 - RNA, 22 nt, Human
aauacugaaaguauuuucaaau

SEQ ID NO: 917660 - RNA, 22 nt, Human
ucuugcagacucacaagguacu

SEQ ID NO: 917661 - RNA, 21 nt, Human
aaaucacuguccaaucuuggu

SEQ ID NO: 917662 - RNA, 22 nt, Human
gugcugaguagaaugaaugccu

SEQ ID NO: 917663 - RNA, 22 nt, Human
ugaauggucacugagcaucugu

SEQ ID NO: 917664 - RNA, 22 nt, Human
gucucuggcuuuaugcugguuu

SEQ ID NO: 917665 - RNA, 22 nt, Human
ccuuugugaauaugcagaaaau

SEQ ID NO: 917666 - RNA, 22 nt, Human
gcagcagcucugaaugggcccc

SEQ ID NO: 917667 - RNA, 22 nt, Human
ucugucacauacacuuuucagg

SEQ ID NO: 917668 - RNA, 22 nt, Human
auuuggggcucaccagggcuga

SEQ ID NO: 917669 - RNA, 22 nt, Human
cagaggucagguuggacauuau

SEQ ID NO: 917670 - RNA, 21 nt, Human
gccagagcaguacaaugaggu

SEQ ID NO: 917671 - RNA, 22 nt, Human
cacauuuaauccuuuauaagua

SEQ ID NO: 917672 - RNA, 22 nt, Human
ucagaggaggcauuuaaacaga

SEQ ID NO: 917673 - RNA, 22 nt, Human
uugccaucccuuaccucaguca

SEQ ID NO: 917674 - RNA, 22 nt, Human
gcuccaggugaauccucucacc

SEQ ID NO: 917675 - RNA, 22 nt, Human
uacuuaggugagauauuuucuu

SEQ ID NO: 917676 - RNA, 20 nt, Human
ccuggcuuugcagcaugaga

SEQ ID NO: 917677 - RNA, 22 nt, Human
gcugccugaagugucuacacug

SEQ ID NO: 917678 - RNA, 22 nt, Human
gcugguccucaagggcacagcc

SEQ ID NO: 917679 - RNA, 22 nt, Human
cuuucucaguguuaauuacuuu

SEQ ID NO: 917680 - RNA, 22 nt, Human
ccugggagguggagguugcagc

SEQ ID NO: 917681 - RNA, 22 nt, Human
uguacauuuagagcucaauaga

SEQ ID NO: 917682 - RNA, 17 nt, Human
agaggcagauacuugga

SEQ ID NO: 917683 - RNA, 22 nt, Human
gucuggaaagguauuugucuca

SEQ ID NO: 917684 - RNA, 21 nt, Human
agcuuccagagcacauuccau

SEQ ID NO: 917685 - RNA, 22 nt, Human
guucuauucauugcuccacgag

SEQ ID NO: 917686 - RNA, 22 nt, Human
caaucuauccucugauuuugua

SEQ ID NO: 917687 - RNA, 22 nt, Human
uaagauguuuugguuugauaag

SEQ ID NO: 917688 - RNA, 22 nt, Human
uacacaaugacuuaagauguca

SEQ ID NO: 917689 - RNA, 22 nt, Human
cuccugagaaauaagcaaguaa

SEQ ID NO: 917690 - RNA, 22 nt, Human
uugaguguaaggaauguggggc

SEQ ID NO: 917691 - RNA, 22 nt, Human
gugccugggcaugagcuuguug

SEQ ID NO: 917692 - RNA, 22 nt, Human
uuguaaacugcugcaggagugc

SEQ ID NO: 917693 - RNA, 22 nt, Human
gaagggugcauggagggaaguc

SEQ ID NO: 917694 - RNA, 22 nt, Human
ucuucaaugcauucucuuguuu

SEQ ID NO: 917695 - RNA, 22 nt, Human
caugcuugcugccucauuguuc

SEQ ID NO: 917696 - RNA, 22 nt, Human
cuuucacagcugugcuuaugau

SEQ ID NO: 917697 - RNA, 22 nt, Human
uuuaaacaaauaggauugccua

SEQ ID NO: 917698 - RNA, 17 nt, Human
cuguuaauucauuuccc

SEQ ID NO: 917699 - RNA, 22 nt, Human
auuucuacugugagaaacauga

SEQ ID NO: 917700 - RNA, 22 nt, Human
auuuucaucauggguuuaacau

SEQ ID NO: 917701 - RNA, 22 nt, Human
aggcuggccuauuucuuuaucg

SEQ ID NO: 917702 - RNA, 21 nt, Human
cuguccacaucacagagccuc

SEQ ID NO: 917703 - RNA, 22 nt, Human
cagaacagagccugaaucucuc

SEQ ID NO: 917704 - RNA, 23 nt, Human
aggcaagaacggguuguucaccc

SEQ ID NO: 917705 - RNA, 20 nt, Human
aguagcaguaauauggaaga

SEQ ID NO: 917706 - RNA, 22 nt, Human
ggagaagggccaauuccaugua

SEQ ID NO: 917707 - RNA, 22 nt, Human
gaggaggcacuugagcagaugu

SEQ ID NO: 917708 - RNA, 22 nt, Human
ugggccuggaguuuguccagag

SEQ ID NO: 917709 - RNA, 22 nt, Human
ccuuugugagguccuguggggg

SEQ ID NO: 917710 - RNA, 22 nt, Human
acagcagcuuccugacuguacu

SEQ ID NO: 917711 - RNA, 19 nt, Human
cuuauacagauuuucucau

SEQ ID NO: 917712 - RNA, 22 nt, Human
caaugguugauuaaaauuuagc

SEQ ID NO: 917713 - RNA, 22 nt, Human
ugaaggcagugaguuuguguuu

SEQ ID NO: 917714 - RNA, 22 nt, Human
ucccaaaguauuagcauuucaa

SEQ ID NO: 917715 - RNA, 22 nt, Human
cagggcagagggaaacuccuuu

SEQ ID NO: 917716 - RNA, 22 nt, Human
gcaccugggguacacagcuaca

SEQ ID NO: 917717 - RNA, 20 nt, Human
agagccuggaaaaagacauc

SEQ ID NO: 917718 - RNA, 22 nt, Human
agggcucagggucaccaucugu

SEQ ID NO: 917719 - RNA, 22 nt, Human
ugcagaaggaggaggaaaucca

SEQ ID NO: 917720 - RNA, 20 nt, Human
agcaagaguaaggacagcga

SEQ ID NO: 917721 - RNA, 22 nt, Human
uauugcaugugauagaggcagg

SEQ ID NO: 917722 - RNA, 22 nt, Human
guuauuaucuugaggaaucugu

SEQ ID NO: 917723 - RNA, 22 nt, Human
ucacagaagagcauuaagauga

SEQ ID NO: 917724 - RNA, 22 nt, Human
agugcgugguuuacagcuaguu

SEQ ID NO: 917725 - RNA, 22 nt, Human
agugcauguaucuacagucaca

SEQ ID NO: 917726 - RNA, 21 nt, Human
acagcuggaaauuacuugccc

SEQ ID NO: 917727 - RNA, 22 nt, Human
ucucagaguuuagagcugagcc

SEQ ID NO: 917728 - RNA, 22 nt, Human
ggagaugguggaagcuggugca

SEQ ID NO: 917729 - RNA, 22 nt, Human
cuucacagagucccugauuguu

SEQ ID NO: 917730 - RNA, 22 nt, Human
auguuauuuuggaaaauacaaa

SEQ ID NO: 917731 - RNA, 20 nt, Human
uuauuucucauucuccuacu

SEQ ID NO: 917732 - RNA, 22 nt, Human
guuaaagaagaauaguuccuuu

SEQ ID NO: 917733 - RNA, 22 nt, Human
uggaccagcuccucgggagacg

SEQ ID NO: 917734 - RNA, 22 nt, Human
gccagaagacuggagucagcug

SEQ ID NO: 917735 - RNA, 22 nt, Human
ucacaagggcccugcaguccac

SEQ ID NO: 917736 - RNA, 22 nt, Human
aauucacagcauuugcccaucu

SEQ ID NO: 917737 - RNA, 22 nt, Human
acauuucauguuuuccagagca

SEQ ID NO: 917738 - RNA, 22 nt, Human
acacuacuuuucauaaaaguaa

SEQ ID NO: 917739 - RNA, 22 nt, Human
aaugccuucaaguaucugagga

SEQ ID NO: 917740 - RNA, 22 nt, Human
gggagcugaucagguggauuca

SEQ ID NO: 917741 - RNA, 22 nt, Human
gaaaguauucacaaaguucuug

SEQ ID NO: 917742 - RNA, 22 nt, Human
aucccccucuuggauggcggca

SEQ ID NO: 917743 - RNA, 19 nt, Human
gcaggcuugggucucccca

SEQ ID NO: 917744 - RNA, 22 nt, Human
aauacugucuuucacagauauu

SEQ ID NO: 917745 - RNA, 23 nt, Human
aacacaaagcugauuccaguggc

SEQ ID NO: 917746 - RNA, 22 nt, Human
ccuggcugugugaccuuggcaa

SEQ ID NO: 917747 - RNA, 22 nt, Human
ggcuccaggagaugcugggcag

SEQ ID NO: 917748 - RNA, 21 nt, Human
caauaaacugcacauugagac

SEQ ID NO: 917749 - RNA, 21 nt, Human
aucaccagcagaagcugcaga

SEQ ID NO: 917750 - RNA, 20 nt, Human
uccagccacuuccgcugguc

SEQ ID NO: 917751 - RNA, 22 nt, Human
acauuugaaauaaacucaagug

SEQ ID NO: 917752 - RNA, 22 nt, Human
uuugcaaggcagcaggugcagu

SEQ ID NO: 917753 - RNA, 22 nt, Human
ucugggcucuuaguguacccuc

SEQ ID NO: 917754 - RNA, 22 nt, Human
uagcagaggaaauccagaguaa

SEQ ID NO: 917755 - RNA, 22 nt, Human
uucuggggccaauugccacugc

SEQ ID NO: 917756 - RNA, 22 nt, Human
accaggagggacccugguggcc

SEQ ID NO: 917757 - RNA, 22 nt, Human
gagccugggacugggggucaug

SEQ ID NO: 917758 - RNA, 23 nt, Human
aggaagagagagugccucuuucu

SEQ ID NO: 917759 - RNA, 22 nt, Human
gcugcccucucuggccccacac

SEQ ID NO: 917760 - RNA, 22 nt, Human
gaggccacagucaguguucauc

SEQ ID NO: 917761 - RNA, 22 nt, Human
ugcccaagccgagcucucuguu

SEQ ID NO: 917762 - RNA, 22 nt, Human
cugggcugcaggaguggggcaa

SEQ ID NO: 917763 - RNA, 22 nt, Human
gcucagccgaacuucagagcag

SEQ ID NO: 917764 - RNA, 22 nt, Human
cuguggaacuuagugggagaca

SEQ ID NO: 917765 - RNA, 22 nt, Human
ucagaccauccugcuguuagug

SEQ ID NO: 917766 - RNA, 22 nt, Human
uccagccaugcaugacaaucac

SEQ ID NO: 917767 - RNA, 19 nt, Human
uuuuaaguccucucuauuc

SEQ ID NO: 917768 - RNA, 22 nt, Human
ccacagggcacaagggagguug

SEQ ID NO: 917769 - RNA, 22 nt, Human
cucacuggcaagacuacaggug

SEQ ID NO: 917770 - RNA, 22 nt, Human
gccaggcagcuagcaaccccug

SEQ ID NO: 917771 - RNA, 22 nt, Human
guuauguaugggggccuuauga

SEQ ID NO: 917772 - RNA, 22 nt, Human
auaaacagcauaaaauacgcuu

SEQ ID NO: 917773 - RNA, 22 nt, Human
aacaggcuuccaggagggacga

SEQ ID NO: 917774 - RNA, 22 nt, Human
uucucaaagugugcucccugga

SEQ ID NO: 917775 - RNA, 22 nt, Human
acaacuuuaauggguuucagcu

SEQ ID NO: 917776 - RNA, 17 nt, Human
ugacaaugacaagcacu

SEQ ID NO: 917777 - RNA, 22 nt, Human
uuccuuuuacaaauagccuccu

SEQ ID NO: 917778 - RNA, 22 nt, Human
ugggccaggugcagugcuuuag

SEQ ID NO: 917779 - RNA, 22 nt, Human
ugcacacaggucuaggacaugg

SEQ ID NO: 917780 - RNA, 22 nt, Human
auguuuuaugcuucagaugagg

SEQ ID NO: 917781 - RNA, 22 nt, Human
ugggacuuguguggcaguauuu

SEQ ID NO: 917782 - RNA, 22 nt, Human
uacaaggcuucagcucagcuau

SEQ ID NO: 917783 - RNA, 22 nt, Human
agccccaggcccggacgccucu

SEQ ID NO: 917784 - RNA, 22 nt, Human
gcagggcuguggacacuuuggu

SEQ ID NO: 917785 - RNA, 22 nt, Human
gugcagcaaacuagugcgaggg

SEQ ID NO: 917786 - RNA, 22 nt, Human
uaaggcucccuuugccacuugu

SEQ ID NO: 917787 - RNA, 22 nt, Human
acccacgaagaugagcggcaug

SEQ ID NO: 917788 - RNA, 22 nt, Human
ugucuugaggcgcaguguagau

SEQ ID NO: 917789 - RNA, 22 nt, Human
aucucuucugagcaauuccugu

SEQ ID NO: 917790 - RNA, 22 nt, Human
caggaagcugccggugagcgag

SEQ ID NO: 917791 - RNA, 22 nt, Human
auugagaauauugugacagugu

SEQ ID NO: 917792 - RNA, 22 nt, Human
agggccaggaucacagccaaga

SEQ ID NO: 917793 - RNA, 22 nt, Human
gcuacaggagcugucacaugcu

SEQ ID NO: 917794 - RNA, 22 nt, Human
ugaagcaucuggucugagaauu

SEQ ID NO: 917795 - RNA, 20 nt, Human
cauugcaaaguagcagacug

SEQ ID NO: 917796 - RNA, 22 nt, Human
uugggugguggggagaguucag

SEQ ID NO: 917797 - RNA, 22 nt, Human
uguacaauagcuauuaucucca

SEQ ID NO: 917798 - RNA, 22 nt, Human
gagaacagauuuuucugcuguc

SEQ ID NO: 917799 - RNA, 22 nt, Human
agcuccugaaaagcgcuugcuu

SEQ ID NO: 917800 - RNA, 22 nt, Human
agugggcaugaucuggugucug

SEQ ID NO: 917801 - RNA, 18 nt, Human
uggcaaguaaugacaaaa

SEQ ID NO: 917802 - RNA, 22 nt, Human
gugggagaagauuuggucaucu

SEQ ID NO: 917803 - RNA, 22 nt, Human
agaaguuugguccuauaaacuc

SEQ ID NO: 917804 - RNA, 18 nt, Human
aggccagcccugcuacug

SEQ ID NO: 917805 - RNA, 22 nt, Human
auuauacauuuuguguagagau

SEQ ID NO: 917806 - RNA, 22 nt, Human
cccuagaaaugaaagcauacgu

SEQ ID NO: 917807 - RNA, 22 nt, Human
ugguaaggacuuaguuaucaau

SEQ ID NO: 917808 - RNA, 22 nt, Human
cagaaguugauccugcguuucc

SEQ ID NO: 917809 - RNA, 22 nt, Human
ccuggggaccugccucagcccu

SEQ ID NO: 917810 - RNA, 22 nt, Human
gagcugagucugcagucgccau

SEQ ID NO: 917811 - RNA, 22 nt, Human
uccauguguuuuccuguccaca

SEQ ID NO: 917812 - RNA, 22 nt, Human
gagcacagcuggagguagcauu

SEQ ID NO: 917813 - RNA, 20 nt, Human
uggcuucauaaugguuucug

SEQ ID NO: 917814 - RNA, 22 nt, Human
aagagaaagcagacuuugucau

SEQ ID NO: 917815 - RNA, 22 nt, Human
uacugaaauggcagauauauaa

SEQ ID NO: 917816 - RNA, 22 nt, Human
augcaaauaagugcaggcgugg

SEQ ID NO: 917817 - RNA, 22 nt, Human
ugcuucuguuacauaccagaac

SEQ ID NO: 917818 - RNA, 22 nt, Human
ugccucugguuaucugguaccu

SEQ ID NO: 917819 - RNA, 22 nt, Human
gcuggcccagcgcccagggcag

SEQ ID NO: 917820 - RNA, 22 nt, Human
ccaggagcagccggcccaccug

SEQ ID NO: 917821 - RNA, 22 nt, Human
uugacacauuagagcuuguaaa

SEQ ID NO: 917822 - RNA, 22 nt, Human
aacgagcucuccuucuuucauu

SEQ ID NO: 917823 - RNA, 19 nt, Human
aggaauggaauuaauucug

SEQ ID NO: 917824 - RNA, 22 nt, Human
aacaugaaaguugcuaagugca

SEQ ID NO: 917825 - RNA, 22 nt, Human
cccugcugacaacuugauuuug

SEQ ID NO: 917826 - RNA, 22 nt, Human
auguuaaaugguuuauuauuaa

SEQ ID NO: 917827 - RNA, 22 nt, Human
acacucuguaaugucacacucc

SEQ ID NO: 917828 - RNA, 23 nt, Human
uccagggcuggccagaccucggu

SEQ ID NO: 917829 - RNA, 22 nt, Human
ccaggccucaccugcccaccua

SEQ ID NO: 917830 - RNA, 22 nt, Human
ucuucugugagaauucaagcaa

SEQ ID NO: 917831 - RNA, 22 nt, Human
ucauggcacuuagugucucaaa

SEQ ID NO: 917832 - RNA, 22 nt, Human
agaucagaucuccuuuugcauu

SEQ ID NO: 917833 - RNA, 20 nt, Human
augugaaagaucaguugucu

SEQ ID NO: 917834 - RNA, 23 nt, Human
uugggaaauaguuaagacaugag

SEQ ID NO: 917835 - RNA, 22 nt, Human
uacaaagugaaauaauucugag

SEQ ID NO: 917836 - RNA, 22 nt, Human
acacauguauggcacuuacauu

SEQ ID NO: 917837 - RNA, 22 nt, Human
ggaaagaacccuggauggcugg

SEQ ID NO: 917838 - RNA, 22 nt, Human
gucaggucuuggaagauaggcu

SEQ ID NO: 917839 - RNA, 22 nt, Human
accuuagaaaaucaaaauuaga

SEQ ID NO: 917840 - RNA, 22 nt, Human
uucuuguucugguucuguuagc

SEQ ID NO: 917841 - RNA, 22 nt, Human
cuggguuuuauuacagugagcu

SEQ ID NO: 917842 - RNA, 22 nt, Human
acaggggaauuuacugucauua

SEQ ID NO: 917843 - RNA, 22 nt, Human
ggcugcagggcagcuggugugg

SEQ ID NO: 917844 - RNA, 22 nt, Human
aaacuugggugacccugagcaa

SEQ ID NO: 917845 - RNA, 22 nt, Human
aagcugaaauaauaucuauguu

SEQ ID NO: 917846 - RNA, 22 nt, Human
ucuagaaucuaaacuauaguuu

SEQ ID NO: 917847 - RNA, 22 nt, Human
acccaggguuugagcucugcag

SEQ ID NO: 917848 - RNA, 22 nt, Human
ucaaggaagucuuauugcacag

SEQ ID NO: 917849 - RNA, 22 nt, Human
ugugagaagggugaggcuuuua

SEQ ID NO: 917850 - RNA, 22 nt, Human
ucccuggggaagggcaagcaag

SEQ ID NO: 917851 - RNA, 22 nt, Human
agcagggccugagugaccuaac

SEQ ID NO: 917852 - RNA, 22 nt, Human
ugucaaccagguauuuuggucu

SEQ ID NO: 917853 - RNA, 22 nt, Human
uaggcuggaggaagcagugccu

SEQ ID NO: 917854 - RNA, 22 nt, Human
uauguacaucguugaauucaaa

SEQ ID NO: 917855 - RNA, 22 nt, Human
gccaggaauggagagguggccu

SEQ ID NO: 917856 - RNA, 22 nt, Human
auucugggugacuacgugauca

SEQ ID NO: 917857 - RNA, 22 nt, Human
uuaagcaacacacauuaauuau

SEQ ID NO: 917858 - RNA, 22 nt, Human
uauuuugcguugagucagauuu

SEQ ID NO: 917859 - RNA, 22 nt, Human
gugcauggggagggaagcgcuc

SEQ ID NO: 917860 - RNA, 22 nt, Human
uuaauauguugaaauuuauuag

SEQ ID NO: 917861 - RNA, 22 nt, Human
uguguuaaggugcaucuagugc

SEQ ID NO: 917862 - RNA, 22 nt, Human
gcagggccagggcucaggcugu

SEQ ID NO: 917863 - RNA, 22 nt, Human
agagcugccgagcuggggccau

SEQ ID NO: 917864 - RNA, 22 nt, Human
ugaaugauguauaauauugaga

SEQ ID NO: 917865 - RNA, 22 nt, Human
gccuggaguucagccaaguccc

SEQ ID NO: 917866 - RNA, 22 nt, Human
aauguuucaauuaagucuuuua

SEQ ID NO: 917867 - RNA, 22 nt, Human
cagucccuaguggagcucacag

SEQ ID NO: 917868 - RNA, 19 nt, Human
uuucucucccucaucccga

SEQ ID NO: 917869 - RNA, 22 nt, Human
gggcuggaucucacgugagacc

SEQ ID NO: 917870 - RNA, 22 nt, Human
ugcagcauuauguagcuguuuu

SEQ ID NO: 917871 - RNA, 22 nt, Human
uccugggucccgcacaucuguc

SEQ ID NO: 917872 - RNA, 22 nt, Human
caggucagagucccccuguccu

SEQ ID NO: 917873 - RNA, 22 nt, Human
auguacacacaaguuugcacgc

SEQ ID NO: 917874 - RNA, 22 nt, Human
ccuacacaucucaccucacagg

SEQ ID NO: 917875 - RNA, 22 nt, Human
ugacagagcauguagugacagc

SEQ ID NO: 917876 - RNA, 18 nt, Human
ugacagaaccuggagccu

SEQ ID NO: 917877 - RNA, 22 nt, Human
acuuaaagaggcuacuuuuggu

SEQ ID NO: 917878 - RNA, 22 nt, Human
cacaggaauauaaguuugaguu

SEQ ID NO: 917879 - RNA, 22 nt, Human
uacaagucacuuccuuucuaaa

SEQ ID NO: 917880 - RNA, 19 nt, Human
agagccagacagcauagga

SEQ ID NO: 917881 - RNA, 22 nt, Human
caccuggaguagcaagguaauu

SEQ ID NO: 917882 - RNA, 22 nt, Human
aggagccuggcuggcccacagg

SEQ ID NO: 917883 - RNA, 17 nt, Human
uuuguucguuaguccgg

SEQ ID NO: 917884 - RNA, 22 nt, Human
gcugcucucagagcucaugcug

SEQ ID NO: 917885 - RNA, 22 nt, Human
gaacucuugguggucauuagau

SEQ ID NO: 917886 - RNA, 22 nt, Human
caguaauagaggcuuugagucu

SEQ ID NO: 917887 - RNA, 22 nt, Human
uucaaaccuucacuugcagagu

SEQ ID NO: 917888 - RNA, 22 nt, Human
uugaggccaaaaaguccuauga

SEQ ID NO: 917889 - RNA, 22 nt, Human
aagccaaggagaauggccucag

SEQ ID NO: 917890 - RNA, 20 nt, Human
agcaagaagguugugggagc

SEQ ID NO: 917891 - RNA, 22 nt, Human
ugcgcaggagcucugccaggag

SEQ ID NO: 917892 - RNA, 22 nt, Human
gcagcugcaggcaggcuugcug

SEQ ID NO: 917893 - RNA, 22 nt, Human
ggcucugaaauucucacuuuua

SEQ ID NO: 917894 - RNA, 22 nt, Human
ccccacaacucauguugaaacu

SEQ ID NO: 917895 - RNA, 17 nt, Human
agugugugaaauggugg

SEQ ID NO: 917896 - RNA, 22 nt, Human
uauuaaagagagaaucaucauc

SEQ ID NO: 917897 - RNA, 22 nt, Human
ugcugccagagagacagggacu

SEQ ID NO: 917898 - RNA, 22 nt, Human
aggaugaggcuggcaggucuug

SEQ ID NO: 917899 - RNA, 22 nt, Human
uggagagcgcgacgggaggaag

SEQ ID NO: 917900 - RNA, 22 nt, Human
uggggcacuuaugaugugccac

SEQ ID NO: 917901 - RNA, 21 nt, Human
agcuuuucuguuuuauaucua

SEQ ID NO: 917902 - RNA, 18 nt, Human
cagcagagacauucaaaa

SEQ ID NO: 917903 - RNA, 22 nt, Human
aggcaguggcuuuuguuguguu

SEQ ID NO: 917904 - RNA, 22 nt, Human
ugagguaugguaagguaaaauc

SEQ ID NO: 917905 - RNA, 22 nt, Human
gaaaguuugccucucucuugag

SEQ ID NO: 917906 - RNA, 22 nt, Human
gauuucuaguucauuaucuauu

SEQ ID NO: 917907 - RNA, 22 nt, Human
cugguuauuauucuuggaaugc

SEQ ID NO: 917908 - RNA, 22 nt, Human
uuuuacaguuccaugcaaagcg

SEQ ID NO: 917909 - RNA, 22 nt, Human
cacaggaaugaacagggaaaga

SEQ ID NO: 917910 - RNA, 22 nt, Human
ugucuuuuauaacugacauaua

SEQ ID NO: 917911 - RNA, 22 nt, Human
gcccaugucugacagggugggg

SEQ ID NO: 917912 - RNA, 22 nt, Human
auaagcuuugcuggagagaccu

SEQ ID NO: 917913 - RNA, 22 nt, Human
uuugaaagggaaauaaacuccu

SEQ ID NO: 917914 - RNA, 21 nt, Human
cacucucccaauccuugcuga

SEQ ID NO: 917915 - RNA, 19 nt, Human
acauguuuugcagaacagc

SEQ ID NO: 917916 - RNA, 22 nt, Human
cagaggaggcgguauacacugc

SEQ ID NO: 917917 - RNA, 22 nt, Human
agccucuagacccuggccugca

SEQ ID NO: 917918 - RNA, 22 nt, Human
acuaguuuaugcucagaugucu

SEQ ID NO: 917919 - RNA, 18 nt, Human
gccaggucucucugcuuc

SEQ ID NO: 917920 - RNA, 17 nt, Human
gcacaaaucaauuacua

SEQ ID NO: 917921 - RNA, 22 nt, Human
aguggcugagugacugugacuc

SEQ ID NO: 917922 - RNA, 22 nt, Human
ugggggagauagagucugaugg

SEQ ID NO: 917923 - RNA, 19 nt, Human
ugauuuagggauccggcac

SEQ ID NO: 917924 - RNA, 22 nt, Human
gcuggagguagggagguccugu

SEQ ID NO: 917925 - RNA, 22 nt, Human
cugccucuauucacugaggcag

SEQ ID NO: 917926 - RNA, 22 nt, Human
cagcagugaugugugaggguuc

SEQ ID NO: 917927 - RNA, 22 nt, Human
aguggaaggcugggaaaugcgg

SEQ ID NO: 917928 - RNA, 22 nt, Human
cauuaaauaucaaccuagacua

SEQ ID NO: 917929 - RNA, 22 nt, Human
aggggaugauccucccgcagcg

SEQ ID NO: 917930 - RNA, 22 nt, Human
cagggugacugcccuggccacu

SEQ ID NO: 917931 - RNA, 22 nt, Human
ucuugggaagcccauuuccacc

SEQ ID NO: 917932 - RNA, 22 nt, Human
agaugcagacuugguucaggca

SEQ ID NO: 917933 - RNA, 22 nt, Human
augguauuggaguaggacuugc

SEQ ID NO: 917934 - RNA, 22 nt, Human
gucacagguguggaggugcugg

SEQ ID NO: 917935 - RNA, 22 nt, Human
ggccauggcgggagccggcguc

SEQ ID NO: 917936 - RNA, 22 nt, Human
aaccuucuugugcagaacugua

SEQ ID NO: 917937 - RNA, 20 nt, Human
ucacaggagggaaggcaggu

SEQ ID NO: 917938 - RNA, 22 nt, Human
uucccagagauaagacgucuua

SEQ ID NO: 917939 - RNA, 22 nt, Human
ggucagcaucugguugagggca

SEQ ID NO: 917940 - RNA, 22 nt, Human
acauucaaaauuagguuaguug

SEQ ID NO: 917941 - RNA, 22 nt, Human
guucacagguucucuuucuaag

SEQ ID NO: 917942 - RNA, 22 nt, Human
augaguaagauaggcaaugugu

SEQ ID NO: 917943 - RNA, 22 nt, Human
aacauguugaguugaaaguagc

SEQ ID NO: 917944 - RNA, 22 nt, Human
gccaucaucaagaauguacagc

SEQ ID NO: 917945 - RNA, 22 nt, Human
uagcagcauguaagugaguaga

SEQ ID NO: 917946 - RNA, 22 nt, Human
cagggccacccucugcugggug

SEQ ID NO: 917947 - RNA, 20 nt, Human
uccagggcaaacucaucacc

SEQ ID NO: 917948 - RNA, 20 nt, Human
gcugcuuucaaaugacacgu

SEQ ID NO: 917949 - RNA, 22 nt, Human
cucagauucugaauaauaaaca

SEQ ID NO: 917950 - RNA, 22 nt, Human
uguguauaauuagaccauuuac

SEQ ID NO: 917951 - RNA, 18 nt, Human
cgaggcaggcggaucacg

SEQ ID NO: 917952 - RNA, 22 nt, Human
ucaggcagagcuguggagcucu

SEQ ID NO: 917953 - RNA, 22 nt, Human
ccuggccaaucuagggcuguua

SEQ ID NO: 917954 - RNA, 22 nt, Human
cuuauguaaaacggaaagggaa

SEQ ID NO: 917955 - RNA, 22 nt, Human
ccugaggagauuguggcugggg

SEQ ID NO: 917956 - RNA, 22 nt, Human
uacaaaaggaagagggaucuua

SEQ ID NO: 917957 - RNA, 21 nt, Human
agaguggcaaaguguccaaga

SEQ ID NO: 917958 - RNA, 22 nt, Human
gcuucugcagagccguccugag

SEQ ID NO: 917959 - RNA, 22 nt, Human
ugugugccugagccgugccugg

SEQ ID NO: 917960 - RNA, 23 nt, Human
agggcacuguuggguguugagga

SEQ ID NO: 917961 - RNA, 22 nt, Human
cccugcagagggaugggggcag

SEQ ID NO: 917962 - RNA, 22 nt, Human
uauauuaaccauaggguucuag

SEQ ID NO: 917963 - RNA, 22 nt, Human
augaggcagucuggccugaggg

SEQ ID NO: 917964 - RNA, 22 nt, Human
uagcacaaagucuugcccuuuu

SEQ ID NO: 917965 - RNA, 22 nt, Human
gaacaguaaauuuaugcagcac

SEQ ID NO: 917966 - RNA, 22 nt, Human
uuucacagauguuuuggagucu

SEQ ID NO: 917967 - RNA, 21 nt, Human
ucugcccuccaggagcucaua

SEQ ID NO: 917968 - RNA, 22 nt, Human
gaauuauagguuugcaugcuaa

SEQ ID NO: 917969 - RNA, 22 nt, Human
cucccuggcagccgcacuccug

SEQ ID NO: 917970 - RNA, 23 nt, Human
aaucaaguuuugaugaggaagcc

SEQ ID NO: 917971 - RNA, 22 nt, Human
aggugucauuucucugcaggug

SEQ ID NO: 917972 - RNA, 22 nt, Human
agcuccagagucugaacuauuc

SEQ ID NO: 917973 - RNA, 21 nt, Human
aaaguguguggggaagaagga

SEQ ID NO: 917974 - RNA, 22 nt, Human
cuggccgguauuugccucuggg

SEQ ID NO: 917975 - RNA, 22 nt, Human
ucagggcagguuaacuugggug

SEQ ID NO: 917976 - RNA, 22 nt, Human
ucugcucuccauacuuccgcac

SEQ ID NO: 917977 - RNA, 22 nt, Human
cuguucugaacugccugcaugc

SEQ ID NO: 917978 - RNA, 22 nt, Human
cccucuggcucuucucaggccg

SEQ ID NO: 917979 - RNA, 22 nt, Human
uggcuggggccacaguuuuccu

SEQ ID NO: 917980 - RNA, 20 nt, Human
cuuuuucuccagcucugagc

SEQ ID NO: 917981 - RNA, 22 nt, Human
uucucaggcucugagacccuau

SEQ ID NO: 917982 - RNA, 22 nt, Human
uugcuguuuuacuuacaagcuc

SEQ ID NO: 917983 - RNA, 22 nt, Human
ucuagaaguccaaaguuaaaua

SEQ ID NO: 917984 - RNA, 22 nt, Human
uuacagaguggucuggcuaugu

SEQ ID NO: 917985 - RNA, 22 nt, Human
uaggacuugguuugaagauuuu

SEQ ID NO: 917986 - RNA, 22 nt, Human
auauuucagcuuuacuuaggaa

SEQ ID NO: 917987 - RNA, 22 nt, Human
ucucgacagccuggcacagugg

SEQ ID NO: 917988 - RNA, 22 nt, Human
uugaucaagugggaaauaguaa

SEQ ID NO: 917989 - RNA, 22 nt, Human
ggccacugcccuggcuacaccg

SEQ ID NO: 917990 - RNA, 22 nt, Human
cagcugaagguaggaaccagga

SEQ ID NO: 917991 - RNA, 22 nt, Human
gacuguggcuaaugguguuagg

SEQ ID NO: 917992 - RNA, 22 nt, Human
cauuaaguauuucaguuacugu

SEQ ID NO: 917993 - RNA, 22 nt, Human
ucucaucauuccuucaaagccc

SEQ ID NO: 917994 - RNA, 22 nt, Human
agaggcucuaauccccuccaca

SEQ ID NO: 917995 - RNA, 22 nt, Human
uauuuacuuuuaaauugagaac

SEQ ID NO: 917996 - RNA, 22 nt, Human
gaugucuucccauguucaugug

SEQ ID NO: 917997 - RNA, 22 nt, Human
cccaagccagacccugacccug

SEQ ID NO: 917998 - RNA, 22 nt, Human
auucuuucauauaaaggcucag

SEQ ID NO: 917999 - RNA, 22 nt, Human
ugaccgucuucccacuuucugu

SEQ ID NO: 918000 - RNA, 22 nt, Human
uugaucuuggacuuuccagccu

SEQ ID NO: 918001 - RNA, 22 nt, Human
auuguccaucuccacauuaaug

SEQ ID NO: 918002 - RNA, 22 nt, Human
agaaugcuuuggauauauugga

SEQ ID NO: 918003 - RNA, 22 nt, Human
uugccucccagcaugggcagcu

SEQ ID NO: 918004 - RNA, 22 nt, Human
gcccugagccuaugagccucuc

SEQ ID NO: 918005 - RNA, 22 nt, Human
agcaacaggguggucuucagaa

SEQ ID NO: 918006 - RNA, 22 nt, Human
ugucaguguaacucuuauagca

SEQ ID NO: 918007 - RNA, 22 nt, Human
aggcucagacaggaaaaguaac

SEQ ID NO: 918008 - RNA, 21 nt, Human
gagcugaauauguucuagggg

SEQ ID NO: 918009 - RNA, 22 nt, Human
aggcugugacagggucauggag

SEQ ID NO: 918010 - RNA, 22 nt, Human
cugcuuccauggucuggagacu

SEQ ID NO: 918011 - RNA, 22 nt, Human
gcucucuuuuuccagugguggu

SEQ ID NO: 918012 - RNA, 21 nt, Human
uucuuccuaaauacagaucuc

SEQ ID NO: 918013 - RNA, 22 nt, Human
gccugagaaggacacagcaggu

SEQ ID NO: 918014 - RNA, 17 nt, Human
gagcagggaugcgguuc

SEQ ID NO: 918015 - RNA, 22 nt, Human
agcuccaguuacuuaccuagag

SEQ ID NO: 918016 - RNA, 22 nt, Human
acagggagucugaggggauagu

SEQ ID NO: 918017 - RNA, 22 nt, Human
cucugggcaaguuucuucauga

SEQ ID NO: 918018 - RNA, 22 nt, Human
aaagugauuaugcugucaaaga

SEQ ID NO: 918019 - RNA, 22 nt, Human
ugccagcacuucuggcugucug

SEQ ID NO: 918020 - RNA, 22 nt, Human
auuguucacugugaaucuugau

SEQ ID NO: 918021 - RNA, 22 nt, Human
gccugucaauuuuguguacaau

SEQ ID NO: 918022 - RNA, 22 nt, Human
cagacuugacggcagcugcuuu

SEQ ID NO: 918023 - RNA, 22 nt, Human
uacagcaaugguucuaagaguc

SEQ ID NO: 918024 - RNA, 22 nt, Human
aucauaaagugcuaucugauug

SEQ ID NO: 918025 - RNA, 22 nt, Human
auccuuucaucugguaauauau

SEQ ID NO: 918026 - RNA, 22 nt, Human
gacugaaagcuuggaauguucc

SEQ ID NO: 918027 - RNA, 22 nt, Human
gaagccaguacugugcucugca

SEQ ID NO: 918028 - RNA, 22 nt, Human
cuguggcucaaaaucccaugau

SEQ ID NO: 918029 - RNA, 22 nt, Human
caccugcaaggagcuuucauuu

SEQ ID NO: 918030 - RNA, 22 nt, Human
aaaugcucuggggauaagacug

SEQ ID NO: 918031 - RNA, 22 nt, Human
aggucacaggcuuugaaaucaa

SEQ ID NO: 918032 - RNA, 22 nt, Human
caugcuucaugcaaaauucuga

SEQ ID NO: 918033 - RNA, 22 nt, Human
uuuaugaacuacagauauaacu

SEQ ID NO: 918034 - RNA, 22 nt, Human
ccaaauauuaacaaaguaauuu

SEQ ID NO: 918035 - RNA, 22 nt, Human
aggcucagcugguggugaucgc

SEQ ID NO: 918036 - RNA, 22 nt, Human
uaucugagaaagaagcaccaga

SEQ ID NO: 918037 - RNA, 22 nt, Human
agcugugguuagauagaguccu

SEQ ID NO: 918038 - RNA, 22 nt, Human
ugucauaugcugucauagccau

SEQ ID NO: 918039 - RNA, 22 nt, Human
augcauauucuuagccccuccu

SEQ ID NO: 918040 - RNA, 22 nt, Human
uggaaugaauuuggcuuccucc

SEQ ID NO: 918041 - RNA, 22 nt, Human
uaaaaucgcacugcuguuguua

SEQ ID NO: 918042 - RNA, 19 nt, Human
gcaggcacagcccugggug

SEQ ID NO: 918043 - RNA, 22 nt, Human
uuccagaaaaaaauguauaucu

SEQ ID NO: 918044 - RNA, 22 nt, Human
acuuguuuggucucauguuuaa

SEQ ID NO: 918045 - RNA, 22 nt, Human
cacagugauugauuuuuacuuu

SEQ ID NO: 918046 - RNA, 22 nt, Human
aucaucugccucaucacugcau

SEQ ID NO: 918047 - RNA, 22 nt, Human
caggcccugcugcugagaccuu

SEQ ID NO: 918048 - RNA, 22 nt, Human
ucaguggauugacaugaaaaag

SEQ ID NO: 918049 - RNA, 22 nt, Human
uggucauguaguagagacagcu

SEQ ID NO: 918050 - RNA, 22 nt, Human
ggcugaggguuaagaucagaca

SEQ ID NO: 918051 - RNA, 22 nt, Human
cagugggaaagugaagagcauu

SEQ ID NO: 918052 - RNA, 22 nt, Human
uguuaaaccuaguacagguccu

SEQ ID NO: 918053 - RNA, 22 nt, Human
aggaucagugaauacucagggu

SEQ ID NO: 918054 - RNA, 22 nt, Human
aagcuuuugacuugguagggaa

SEQ ID NO: 918055 - RNA, 22 nt, Human
cacaggccaguaagacuguguu

SEQ ID NO: 918056 - RNA, 22 nt, Human
auucucaaaacauaacuucacu

SEQ ID NO: 918057 - RNA, 22 nt, Human
cacaaaccugccagcccugccc

SEQ ID NO: 918058 - RNA, 22 nt, Human
cugggacugccauucacagcca

SEQ ID NO: 918059 - RNA, 22 nt, Human
gauggcacacagacauccccgc

SEQ ID NO: 918060 - RNA, 22 nt, Human
cugcacacaucgcacugcccgu

SEQ ID NO: 918061 - RNA, 22 nt, Human
agugucugugcuuugcagcaaa

SEQ ID NO: 918062 - RNA, 22 nt, Human
agucagggguuggacggggcca

SEQ ID NO: 918063 - RNA, 22 nt, Human
acacagagauguaaaguuaggc

SEQ ID NO: 918064 - RNA, 23 nt, Human
agagagaguuugugucagguacc

SEQ ID NO: 918065 - RNA, 22 nt, Human
cccuaggggcaaugauggugcu

SEQ ID NO: 918066 - RNA, 19 nt, Human
gaaugucuccuacuucuga

SEQ ID NO: 918067 - RNA, 22 nt, Human
aggguggcaguuacuggagcaa

SEQ ID NO: 918068 - RNA, 22 nt, Human
auuuucuucucucccuggcugc

SEQ ID NO: 918069 - RNA, 22 nt, Human
agagggcugccucagucagcua

SEQ ID NO: 918070 - RNA, 19 nt, Human
uaaggcagcagugacaggc

SEQ ID NO: 918071 - RNA, 22 nt, Human
uuccuaaugucuacuuuaguuc

SEQ ID NO: 918072 - RNA, 22 nt, Human
uugcaggggagaggaacaaaca

SEQ ID NO: 918073 - RNA, 22 nt, Human
ggccugaggcgucccagcugug

SEQ ID NO: 918074 - RNA, 22 nt, Human
acagcagcauaaacugacuaag

SEQ ID NO: 918075 - RNA, 22 nt, Human
cgcugcagaugggagcugguug

SEQ ID NO: 918076 - RNA, 22 nt, Human
aaugucauugguaaagauuagg

SEQ ID NO: 918077 - RNA, 22 nt, Human
gcuggccuucugcagaguucug

SEQ ID NO: 918078 - RNA, 22 nt, Human
uggcuaacaguuaagauuucau

SEQ ID NO: 918079 - RNA, 22 nt, Human
ugcaaagggcuuugcauacaga

SEQ ID NO: 918080 - RNA, 22 nt, Human
aaaauguaugauggaggugcua

SEQ ID NO: 918081 - RNA, 22 nt, Human
gcagccaggaagcccaggacac

SEQ ID NO: 918082 - RNA, 22 nt, Human
uaggcuggaacuuaggcagagg

SEQ ID NO: 918083 - RNA, 22 nt, Human
uuacaguagauuuugaaugugg

SEQ ID NO: 918084 - RNA, 19 nt, Human
gcuuuuuguugucaaaggu

SEQ ID NO: 918085 - RNA, 22 nt, Human
uauggaaagcucuuuuugauug

SEQ ID NO: 918086 - RNA, 22 nt, Human
auuaccuaugcucuaguaauca

SEQ ID NO: 918087 - RNA, 20 nt, Human
ugaacacugggguguuucag

SEQ ID NO: 918088 - RNA, 22 nt, Human
uguauaugcacuuuccuuaucc

SEQ ID NO: 918089 - RNA, 22 nt, Human
agagcagguggcaacucuggga

SEQ ID NO: 918090 - RNA, 22 nt, Human
ggcagugugcaucuguguggcc

SEQ ID NO: 918091 - RNA, 22 nt, Human
uuagccaggggagcagcuuguc

SEQ ID NO: 918092 - RNA, 22 nt, Human
caucuuuaaaggggagacaccc

SEQ ID NO: 918093 - RNA, 22 nt, Human
cagggcucaccacugggauccu

SEQ ID NO: 918094 - RNA, 23 nt, Human
uaggcuucugcuguccccgacgc

SEQ ID NO: 918095 - RNA, 22 nt, Human
agugcaaagggaucagauuggg

SEQ ID NO: 918096 - RNA, 22 nt, Human
aagggugggcaccgccagguca

SEQ ID NO: 918097 - RNA, 22 nt, Human
aaacagauaagggacaauuuca

SEQ ID NO: 918098 - RNA, 22 nt, Human
cucaggauguacuacagaaggc

SEQ ID NO: 918099 - RNA, 20 nt, Human
cugcuguguuauuguagaac

SEQ ID NO: 918100 - RNA, 22 nt, Human
uacuuuuugucucuuugaaugu

SEQ ID NO: 918101 - RNA, 22 nt, Human
ugagguggcuggaucucagccu

SEQ ID NO: 918102 - RNA, 22 nt, Human
aaguacugacagagaagaauga

SEQ ID NO: 918103 - RNA, 22 nt, Human
uuuaguacucaggggagaaguu

SEQ ID NO: 918104 - RNA, 22 nt, Human
acauuguaaauaccuuuaucac

SEQ ID NO: 918105 - RNA, 22 nt, Human
uugaugagaccauugccgcguc

SEQ ID NO: 918106 - RNA, 22 nt, Human
ggccugggccuuuguguuuuga

SEQ ID NO: 918107 - RNA, 22 nt, Human
guuuauuagaguuuucugucug

SEQ ID NO: 918108 - RNA, 22 nt, Human
agaugcugugaggaagcuagga

SEQ ID NO: 918109 - RNA, 22 nt, Human
agaaauuaggaaaguaacacuu

SEQ ID NO: 918110 - RNA, 22 nt, Human
acugggcuggggcucauucucc

SEQ ID NO: 918111 - RNA, 17 nt, Human
uuucuccuuccaucuca

SEQ ID NO: 918112 - RNA, 22 nt, Human
cuuagacauggcagcuccaagu

SEQ ID NO: 918113 - RNA, 22 nt, Human
uuuccaaaaguuuguucugugc

SEQ ID NO: 918114 - RNA, 22 nt, Human
cuggcagucugguggaaggccu

SEQ ID NO: 918115 - RNA, 20 nt, Human
gacaggagaguuagguaggu

SEQ ID NO: 918116 - RNA, 22 nt, Human
ucaagaauagcugcaaacaggg

SEQ ID NO: 918117 - RNA, 22 nt, Human
gcaaggcuggugguggugaagu

SEQ ID NO: 918118 - RNA, 22 nt, Human
uaccaaagauuaaauagcaaca

SEQ ID NO: 918119 - RNA, 22 nt, Human
cugauucuuugaagaugcaccc

SEQ ID NO: 918120 - RNA, 22 nt, Human
gcuggccugucuagagccuuac

SEQ ID NO: 918121 - RNA, 22 nt, Human
uagcaagaagcugucacaggug

SEQ ID NO: 918122 - RNA, 22 nt, Human
cuugaucuacauagugaaaccc

SEQ ID NO: 918123 - RNA, 22 nt, Human
acuggcccgggagcagaggccu

SEQ ID NO: 918124 - RNA, 19 nt, Human
agugccuugcucucuaggu

SEQ ID NO: 918125 - RNA, 22 nt, Human
ucagguggcugguugcuggcua

SEQ ID NO: 918126 - RNA, 22 nt, Human
aagucaaucacaugcacacuga

SEQ ID NO: 918127 - RNA, 22 nt, Human
guuuuacacaccuaugaaagac

SEQ ID NO: 918128 - RNA, 22 nt, Human
ucauguauugaaaagcauuuua

SEQ ID NO: 918129 - RNA, 22 nt, Human
uuuggccuuaguccagaagaag

SEQ ID NO: 918130 - RNA, 22 nt, Human
ccugggaagcccauagcagcuu

SEQ ID NO: 918131 - RNA, 21 nt, Human
agaagccauuuguuaggacuu

SEQ ID NO: 918132 - RNA, 22 nt, Human
gugcagggcagccgaaugggcu

SEQ ID NO: 918133 - RNA, 19 nt, Human
uaugacaaguacuaguucu

SEQ ID NO: 918134 - RNA, 22 nt, Human
aaaauucucuugaucuugacag

SEQ ID NO: 918135 - RNA, 23 nt, Human
acagaaaucauuuguaagguacc

SEQ ID NO: 918136 - RNA, 22 nt, Human
agauauuaccagcagucuaugc

SEQ ID NO: 918137 - RNA, 22 nt, Human
gugugcacagagcuccaguguu

SEQ ID NO: 918138 - RNA, 22 nt, Human
aaacauuguaauuuuagcaugg

SEQ ID NO: 918139 - RNA, 22 nt, Human
uccccagggcugcagagggugu

SEQ ID NO: 918140 - RNA, 22 nt, Human
gagaaagggaacuuacagagug

SEQ ID NO: 918141 - RNA, 22 nt, Human
ugggcucucaaagugcggcuug

SEQ ID NO: 918142 - RNA, 22 nt, Human
ccacccugugcaggcgugggua

SEQ ID NO: 918143 - RNA, 22 nt, Human
aagacagaccacgugacagggc

SEQ ID NO: 918144 - RNA, 18 nt, Human
gaggaaacaggcucugug

SEQ ID NO: 918145 - RNA, 22 nt, Human
agcuuugggauucaggcaggaa

SEQ ID NO: 918146 - RNA, 22 nt, Human
gcugccucugcgacucugggcg

SEQ ID NO: 918147 - RNA, 22 nt, Human
gcuuuagauacucccaaugucc

SEQ ID NO: 918148 - RNA, 22 nt, Human
acaacagagcuggacugagagg

SEQ ID NO: 918149 - RNA, 22 nt, Human
ucuggcuuuccuggagcaagaa

SEQ ID NO: 918150 - RNA, 22 nt, Human
aagguauuggucuggucuuccu

SEQ ID NO: 918151 - RNA, 22 nt, Human
ucugucuccucugaggugccag

SEQ ID NO: 918152 - RNA, 22 nt, Human
cuggggcucacuuuggucaggc

SEQ ID NO: 918153 - RNA, 22 nt, Human
aguucagagguuaauuuauuug

SEQ ID NO: 918154 - RNA, 22 nt, Human
ucaggcuggagugcaguggcgc

SEQ ID NO: 918155 - RNA, 21 nt, Human
ugguacaccuugccugucaga

SEQ ID NO: 918156 - RNA, 22 nt, Human
ggcagaaggcaauuagagacug

SEQ ID NO: 918157 - RNA, 22 nt, Human
ugaggcagguaagcaaguuuug

SEQ ID NO: 918158 - RNA, 22 nt, Human
uccucugcucagcauuccucac

SEQ ID NO: 918159 - RNA, 22 nt, Human
gcucacaggucuguggcuauug

SEQ ID NO: 918160 - RNA, 22 nt, Human
aaugucaugagccugcucuugu

SEQ ID NO: 918161 - RNA, 22 nt, Human
ggcuguggucucaucuagccuu

SEQ ID NO: 918162 - RNA, 22 nt, Human
cuuccucuguguccugggcuug

SEQ ID NO: 918163 - RNA, 23 nt, Human
aucuaaaguguuaaauagcuggg

SEQ ID NO: 918164 - RNA, 22 nt, Human
cagggccagcgcccaggcccag

SEQ ID NO: 918165 - RNA, 22 nt, Human
aacaugagugauaaaauuaccu

SEQ ID NO: 918166 - RNA, 22 nt, Human
gcugggcucguucccacacgcg

SEQ ID NO: 918167 - RNA, 22 nt, Human
aacuuaguucaauaucagugcu

SEQ ID NO: 918168 - RNA, 22 nt, Human
guggagagagauaagccugguc

SEQ ID NO: 918169 - RNA, 22 nt, Human
uguguacuugcugaucuuaucu

SEQ ID NO: 918170 - RNA, 22 nt, Human
cuacccagauccaggauggcua

SEQ ID NO: 918171 - RNA, 22 nt, Human
agccuccuguagcccucaccca

SEQ ID NO: 918172 - RNA, 22 nt, Human
caggaggguguggaaaacuggg

SEQ ID NO: 918173 - RNA, 22 nt, Human
acagaaauauucguggugcuug

SEQ ID NO: 918174 - RNA, 22 nt, Human
cugagagacuguuuguaauauu

SEQ ID NO: 918175 - RNA, 22 nt, Human
auuuuucucuccacuccauuaa

SEQ ID NO: 918176 - RNA, 22 nt, Human
gcacaggaugauggguugaggg

SEQ ID NO: 918177 - RNA, 22 nt, Human
agucccagcucugccacuuacu

SEQ ID NO: 918178 - RNA, 22 nt, Human
agaaaaagucaaggaauuggac

SEQ ID NO: 918179 - RNA, 22 nt, Human
agagguauuagauuugcauagg

SEQ ID NO: 918180 - RNA, 22 nt, Human
acauaacacucuucucuaguga

SEQ ID NO: 918181 - RNA, 22 nt, Human
acacaggaacucugagaggugg

SEQ ID NO: 918182 - RNA, 22 nt, Human
acagugaauaagacaugugcuu

SEQ ID NO: 918183 - RNA, 22 nt, Human
ugcagggucccgaagggaagac

SEQ ID NO: 918184 - RNA, 20 nt, Human
uaacaguuguagaggguuuu

SEQ ID NO: 918185 - RNA, 22 nt, Human
agaaugcaguuugaaauaaggu

SEQ ID NO: 918186 - RNA, 22 nt, Human
cagaaucucugggaguggauca

SEQ ID NO: 918187 - RNA, 22 nt, Human
aaaugucuguaugagaaagaga

SEQ ID NO: 918188 - RNA, 22 nt, Human
agguuacagucaucucagaauc

SEQ ID NO: 918189 - RNA, 22 nt, Human
agaguuuguauuuuucagugaa

SEQ ID NO: 918190 - RNA, 22 nt, Human
gcaccugcucacacaugugacu

SEQ ID NO: 918191 - RNA, 22 nt, Human
agaguggggaagguguugagaa

SEQ ID NO: 918192 - RNA, 22 nt, Human
ggcucuggcaaggggaggcuac

SEQ ID NO: 918193 - RNA, 22 nt, Human
gcuggccuugugucugaggaag

SEQ ID NO: 918194 - RNA, 22 nt, Human
ccauuuguauuacugccccagg

SEQ ID NO: 918195 - RNA, 22 nt, Human
gaaagcaguaaaugggucccau

SEQ ID NO: 918196 - RNA, 22 nt, Human
uugaaagggauauaucuuucug

SEQ ID NO: 918197 - RNA, 22 nt, Human
cacgggagacgugaucuuggac

SEQ ID NO: 918198 - RNA, 22 nt, Human
aaauaguccugggaauaguacu

SEQ ID NO: 918199 - RNA, 22 nt, Human
ugauucuuugaccaaaaaauug

SEQ ID NO: 918200 - RNA, 22 nt, Human
acagauuugaucugagaacaaa

SEQ ID NO: 918201 - RNA, 22 nt, Human
uuuaauuuguauuucuagaggg

SEQ ID NO: 918202 - RNA, 22 nt, Human
ccuucaaaguacacaucuuuau

SEQ ID NO: 918203 - RNA, 22 nt, Human
ccucggaggcggaggcugcagu

SEQ ID NO: 918204 - RNA, 22 nt, Human
gaauacaugcacgacacggggg

SEQ ID NO: 918205 - RNA, 22 nt, Human
gaggcacaauacaugucucaag

SEQ ID NO: 918206 - RNA, 22 nt, Human
gagggauggugugagaggcuca

SEQ ID NO: 918207 - RNA, 22 nt, Human
ugcuuaaacccugaucaugugu

SEQ ID NO: 918208 - RNA, 22 nt, Human
ugcccuggugaagugcucuccu

SEQ ID NO: 918209 - RNA, 19 nt, Human
cuugccuguuccuacagcu

SEQ ID NO: 918210 - RNA, 22 nt, Human
acaggcaaacacagaaaguagg

SEQ ID NO: 918211 - RNA, 22 nt, Human
gagagccaugguggagaugggg

SEQ ID NO: 918212 - RNA, 22 nt, Human
ggcaugggccgaggugccuccu

SEQ ID NO: 918213 - RNA, 22 nt, Human
uucauugauuuaacaaacaagu

SEQ ID NO: 918214 - RNA, 22 nt, Human
gcccagaguuugaagauacagu

SEQ ID NO: 918215 - RNA, 22 nt, Human
acuuagaaagggauucuagauu

SEQ ID NO: 918216 - RNA, 22 nt, Human
cccuuucccuucuggcucaggg

SEQ ID NO: 918217 - RNA, 22 nt, Human
gauaauuucuccaucucaaggu

SEQ ID NO: 918218 - RNA, 22 nt, Human
aagacauuuaugaaaagugcug

SEQ ID NO: 918219 - RNA, 20 nt, Human
agcauacaucauaagaaacc

SEQ ID NO: 918220 - RNA, 22 nt, Human
uucuucaucuguaagauaagca

SEQ ID NO: 918221 - RNA, 22 nt, Human
ggcuggguacagggcagugugc

SEQ ID NO: 918222 - RNA, 22 nt, Human
agcugccaaguuggaguagcaa

SEQ ID NO: 918223 - RNA, 22 nt, Human
uaagacacaugcguacaagaua

SEQ ID NO: 918224 - RNA, 16 nt, Human
ccccaggacuuggcac

SEQ ID NO: 918225 - RNA, 22 nt, Human
ugucucuggcugcagccuguuc

SEQ ID NO: 918226 - RNA, 22 nt, Human
uggggaagcacuuugaacuuaa

SEQ ID NO: 918227 - RNA, 22 nt, Human
uguggacuuuggcauuggacuu

SEQ ID NO: 918228 - RNA, 22 nt, Human
aggaaagcuuggcaaacuaaau

SEQ ID NO: 918229 - RNA, 22 nt, Human
ucacugaauuucaagcuagugg

SEQ ID NO: 918230 - RNA, 22 nt, Human
aauagcuuaugggauagauguu

SEQ ID NO: 918231 - RNA, 20 nt, Human
cagccuccacucacucagcu

SEQ ID NO: 918232 - RNA, 22 nt, Human
aauguucauuguuuuccauaug

SEQ ID NO: 918233 - RNA, 22 nt, Human
agccaggccagacucacacccu

SEQ ID NO: 918234 - RNA, 20 nt, Human
gagacagcaaaagccucucc

SEQ ID NO: 918235 - RNA, 22 nt, Human
cugcuuuaaaacugauacauga

SEQ ID NO: 918236 - RNA, 22 nt, Human
uuuggcacuguucuaggugcaa

SEQ ID NO: 918237 - RNA, 22 nt, Human
guacugcuguaaauauucuuca

SEQ ID NO: 918238 - RNA, 22 nt, Human
agggccugggucuguacuccuc

SEQ ID NO: 918239 - RNA, 22 nt, Human
acauucugaaaaacaguguuuu

SEQ ID NO: 918240 - RNA, 22 nt, Human
cuggguccuggugcugaguucu

SEQ ID NO: 918241 - RNA, 22 nt, Human
uuuuuguucccagagaauuugu

SEQ ID NO: 918242 - RNA, 22 nt, Human
aacuuuguguguuuaauauggc

SEQ ID NO: 918243 - RNA, 22 nt, Human
ucagcagugucaguucccagag

SEQ ID NO: 918244 - RNA, 22 nt, Human
aggcaagaaacuuucugggaga

SEQ ID NO: 918245 - RNA, 22 nt, Human
gagcuggugugugcccaagcac

SEQ ID NO: 918246 - RNA, 22 nt, Human
uucuucugauugccuucugcaa

SEQ ID NO: 918247 - RNA, 22 nt, Human
guucucucugcuuccaagaugg

SEQ ID NO: 918248 - RNA, 22 nt, Human
ggaaggcugugcaguguuugca

SEQ ID NO: 918249 - RNA, 22 nt, Human
ucuugaaaggagauuggaggca

SEQ ID NO: 918250 - RNA, 22 nt, Human
uugcaacauuguaaguuuauau

SEQ ID NO: 918251 - RNA, 22 nt, Human
aagguaauauuuuucucucuaa

SEQ ID NO: 918252 - RNA, 22 nt, Human
acacaugcagguauacauguuc

SEQ ID NO: 918253 - RNA, 22 nt, Human
gagucuucuacgcucacacaaa

SEQ ID NO: 918254 - RNA, 22 nt, Human
acagugcugaacgacauggaag

SEQ ID NO: 918255 - RNA, 22 nt, Human
acugcuuccugagaaaucaaca

SEQ ID NO: 918256 - RNA, 22 nt, Human
ccaaagugcugggguuacaggc

SEQ ID NO: 918257 - RNA, 22 nt, Human
gcugaaaugaaaacacaggucg

SEQ ID NO: 918258 - RNA, 22 nt, Human
gcugacaaugagaaagagcaaa

SEQ ID NO: 918259 - RNA, 22 nt, Human
cacacucauuagucauuucucu

SEQ ID NO: 918260 - RNA, 22 nt, Human
uuuagaauguuagcguuaaagg

SEQ ID NO: 918261 - RNA, 22 nt, Human
guccagagcuggcacacuguca

SEQ ID NO: 918262 - RNA, 22 nt, Human
gcuggcagagagcuggugagga

SEQ ID NO: 918263 - RNA, 22 nt, Human
ggaaagaccugagauaggaaua

SEQ ID NO: 918264 - RNA, 22 nt, Human
uuagaaaggggugaaucaaugg

SEQ ID NO: 918265 - RNA, 19 nt, Human
ugggaacuuguuagacaug

SEQ ID NO: 918266 - RNA, 22 nt, Human
uuccaggggcagcagugauggu

SEQ ID NO: 918267 - RNA, 22 nt, Human
ggcaggagaauggcgugaacuc

SEQ ID NO: 918268 - RNA, 22 nt, Human
cagugccagcugcuuggccuac

SEQ ID NO: 918269 - RNA, 22 nt, Human
aaaugcaauuguauguacucca

SEQ ID NO: 918270 - RNA, 22 nt, Human
uggagcuggaagacagugauau

SEQ ID NO: 918271 - RNA, 22 nt, Human
ccugggugaaaucucuccugca

SEQ ID NO: 918272 - RNA, 22 nt, Human
auuagagagagcauauuacugg

SEQ ID NO: 918273 - RNA, 22 nt, Human
gugccagggaguggaggagcuu

SEQ ID NO: 918274 - RNA, 22 nt, Human
uuauuaugguauuucuuugcag

SEQ ID NO: 918275 - RNA, 22 nt, Human
ugaucccaaucuuuccugcucc

SEQ ID NO: 918276 - RNA, 22 nt, Human
auaagugauauuuagcuauaga

SEQ ID NO: 918277 - RNA, 21 nt, Human
agcugcagcccaaaggccugu

SEQ ID NO: 918278 - RNA, 22 nt, Human
agucucaaagucagugucaugg

SEQ ID NO: 918279 - RNA, 22 nt, Human
aaucuaguuucagacuuugagu

SEQ ID NO: 918280 - RNA, 19 nt, Human
uggcugagcuggacugagg

SEQ ID NO: 918281 - RNA, 20 nt, Human
cucuuuucacucucaguggu

SEQ ID NO: 918282 - RNA, 22 nt, Human
gacaucuggaggagaugaaugg

SEQ ID NO: 918283 - RNA, 22 nt, Human
auuggucucuagagucuauugu

SEQ ID NO: 918284 - RNA, 22 nt, Human
cugggaagcauggugaugguau

SEQ ID NO: 918285 - RNA, 22 nt, Human
auucauaacggcaaaugucacc

SEQ ID NO: 918286 - RNA, 22 nt, Human
cuggcucacuagcccugcccug

SEQ ID NO: 918287 - RNA, 22 nt, Human
ugaggcuggcaaggcugguauu

SEQ ID NO: 918288 - RNA, 22 nt, Human
uugcuuuauuuggcaugccacu

SEQ ID NO: 918289 - RNA, 22 nt, Human
aaaucgguugguucaagguaau

SEQ ID NO: 918290 - RNA, 22 nt, Human
ugcucuggagggugaagcuuuu

SEQ ID NO: 918291 - RNA, 20 nt, Human
gcauuagaguacuauaugcu

SEQ ID NO: 918292 - RNA, 22 nt, Human
guccaaggaugcaggaugcugu

SEQ ID NO: 918293 - RNA, 22 nt, Human
guagcuuccagaaagugucuuu

SEQ ID NO: 918294 - RNA, 22 nt, Human
auauaugugcaggcucacacau

SEQ ID NO: 918295 - RNA, 23 nt, Human
aagcaucuuuuccuagcuccauc

SEQ ID NO: 918296 - RNA, 18 nt, Human
gugauucuuauuuguaca

SEQ ID NO: 918297 - RNA, 22 nt, Human
ccacaugugcacugcuguaugg

SEQ ID NO: 918298 - RNA, 22 nt, Human
agagaaacccuucaguguuuug

SEQ ID NO: 918299 - RNA, 21 nt, Human
aucucgggcuucucgcccagc

SEQ ID NO: 918300 - RNA, 22 nt, Human
agccaggugcaguggcacacac

SEQ ID NO: 918301 - RNA, 22 nt, Human
uuuacacagaggacacugggcu

SEQ ID NO: 918302 - RNA, 22 nt, Human
uccagggcucauucccucugca

SEQ ID NO: 918303 - RNA, 22 nt, Human
gcucucuugacagcuugcuguu

SEQ ID NO: 918304 - RNA, 22 nt, Human
augagcaaggcuuugugauagu

SEQ ID NO: 918305 - RNA, 22 nt, Human
aggcagcuggcaaauucuagag

SEQ ID NO: 918306 - RNA, 22 nt, Human
gccagcugcaaaguauguugaa

SEQ ID NO: 918307 - RNA, 20 nt, Human
acauccuggugacuagaacu

SEQ ID NO: 918308 - RNA, 22 nt, Human
ucaagcaacugaauucuaaaag

SEQ ID NO: 918309 - RNA, 22 nt, Human
acugggccuggauuggcguguc

SEQ ID NO: 918310 - RNA, 22 nt, Human
uuuacuaagcccaguuauaugc

SEQ ID NO: 918311 - RNA, 22 nt, Human
ccuggcugugcauugccggccc

SEQ ID NO: 918312 - RNA, 22 nt, Human
ucuggcuccacaccucacugca

SEQ ID NO: 918313 - RNA, 22 nt, Human
acaguagacccuggauaaacau

SEQ ID NO: 918314 - RNA, 22 nt, Human
ggguggagagaaagaaacguga

SEQ ID NO: 918315 - RNA, 22 nt, Human
cagggccuuauccugccauuga

SEQ ID NO: 918316 - RNA, 22 nt, Human
ccucugugauuucugagccaau

SEQ ID NO: 918317 - RNA, 22 nt, Human
uggaagcucaaggcagggugag

SEQ ID NO: 918318 - RNA, 22 nt, Human
ggcucuggagcacagacgucug

SEQ ID NO: 918319 - RNA, 22 nt, Human
aaauuccaccagaaucaguaau

SEQ ID NO: 918320 - RNA, 22 nt, Human
ggugcccagcgaaguggcugug

SEQ ID NO: 918321 - RNA, 22 nt, Human
uuggggaagcuuugaaauacuu

SEQ ID NO: 918322 - RNA, 20 nt, Human
augcaaaucccaaaaucagg

SEQ ID NO: 918323 - RNA, 22 nt, Human
cagggagcuggcuggcugugcc

SEQ ID NO: 918324 - RNA, 22 nt, Human
gugcuuuaccuuauuggucucg

SEQ ID NO: 918325 - RNA, 21 nt, Human
uagagcuuggcacagaguaga

SEQ ID NO: 918326 - RNA, 22 nt, Human
gccauuuucugucuuguuuauu

SEQ ID NO: 918327 - RNA, 22 nt, Human
agguacagaugaaagucuaguu

SEQ ID NO: 918328 - RNA, 22 nt, Human
cugagaaaaguaugagcucugg

SEQ ID NO: 918329 - RNA, 22 nt, Human
aaucaguguguaaaguggcugc

SEQ ID NO: 918330 - RNA, 22 nt, Human
augucagagcuuccacaauagu

SEQ ID NO: 918331 - RNA, 22 nt, Human
cagugccacaggaauggccaau

SEQ ID NO: 918332 - RNA, 22 nt, Human
ucccaaagcuacucuucugacu

SEQ ID NO: 918333 - RNA, 22 nt, Human
cuccucagcugggaggaguccc

SEQ ID NO: 918334 - RNA, 22 nt, Human
gucugcuggcacgucacagaua

SEQ ID NO: 918335 - RNA, 22 nt, Human
aaauuuaaaaagcagcauugca

SEQ ID NO: 918336 - RNA, 22 nt, Human
gcugucagugaggugagacaug

SEQ ID NO: 918337 - RNA, 22 nt, Human
aaacagcuacuucuguauaaug

SEQ ID NO: 918338 - RNA, 22 nt, Human
aaagaauacuccuuuugccuug

SEQ ID NO: 918339 - RNA, 22 nt, Human
cucuggaggcagcaccagccag

SEQ ID NO: 918340 - RNA, 22 nt, Human
ucacauugaagaaauuuuaagu

SEQ ID NO: 918341 - RNA, 22 nt, Human
gcucccacaaccuucuugcucc

SEQ ID NO: 918342 - RNA, 22 nt, Human
acacaggaagagagauaauaau

SEQ ID NO: 918343 - RNA, 20 nt, Human
agcccuguuuccuggagaga

SEQ ID NO: 918344 - RNA, 20 nt, Human
acucagaugcucacaacagg

SEQ ID NO: 918345 - RNA, 19 nt, Human
uguggaaaaaggagacauu

SEQ ID NO: 918346 - RNA, 22 nt, Human
aagaaccuauaugcugaugaau

SEQ ID NO: 918347 - RNA, 19 nt, Human
gacuuuggaaaugcuguuu

SEQ ID NO: 918348 - RNA, 20 nt, Human
uucuuuguuccuuacauuug

SEQ ID NO: 918349 - RNA, 22 nt, Human
acacaguucguuguuuucuacu

SEQ ID NO: 918350 - RNA, 22 nt, Human
aaugaccugggugucauuucau

SEQ ID NO: 918351 - RNA, 22 nt, Human
gucugggcaccuggccugggaa

SEQ ID NO: 918352 - RNA, 22 nt, Human
ccagcaagugcagauggccaag

SEQ ID NO: 918353 - RNA, 22 nt, Human
gcucgcgccgcaccgguccacc

SEQ ID NO: 918354 - RNA, 22 nt, Human
aggagcugaagucucugcacuc

SEQ ID NO: 918355 - RNA, 22 nt, Human
cccacgucgaacuugcuccaga

SEQ ID NO: 918356 - RNA, 22 nt, Human
ccaggcauugugagugggcagg

SEQ ID NO: 918357 - RNA, 22 nt, Human
ucaggcagaggauggggagcgu

SEQ ID NO: 918358 - RNA, 22 nt, Human
guaauaauuugcuaccuggugg

SEQ ID NO: 918359 - RNA, 22 nt, Human
gguggccuccagggcauaggug

SEQ ID NO: 918360 - RNA, 22 nt, Human
augcaaaugcagccauugcaga

SEQ ID NO: 918361 - RNA, 22 nt, Human
gccacaggugggcucugggaaa

SEQ ID NO: 918362 - RNA, 22 nt, Human
caggccaauaaaugugauggcc

SEQ ID NO: 918363 - RNA, 22 nt, Human
gcuggcucugccccaccuguuc

SEQ ID NO: 918364 - RNA, 22 nt, Human
cugggcaguuuacauuccuacc

SEQ ID NO: 918365 - RNA, 22 nt, Human
aaagaguuuggagacaagauca

SEQ ID NO: 918366 - RNA, 22 nt, Human
caggaggcaucauggagcggac

SEQ ID NO: 918367 - RNA, 22 nt, Human
uaaaggcucguauuguugugug

SEQ ID NO: 918368 - RNA, 22 nt, Human
guaugcauuuggcauauugucc

SEQ ID NO: 918369 - RNA, 22 nt, Human
ucuccugcuucaacugauggac

SEQ ID NO: 918370 - RNA, 20 nt, Human
aggaaaaggguggugguaga

SEQ ID NO: 918371 - RNA, 22 nt, Human
uugguaggggacuagaguccag

SEQ ID NO: 918372 - RNA, 21 nt, Human
gucagugcugaaacaccuucc

SEQ ID NO: 918373 - RNA, 22 nt, Human
ucccauguuaccaaggagucac

SEQ ID NO: 918374 - RNA, 22 nt, Human
ugacaucuggagucugggcugu

SEQ ID NO: 918375 - RNA, 20 nt, Human
aaacacuggcuggggcacag

SEQ ID NO: 918376 - RNA, 18 nt, Human
gccuggcugccaacccag

SEQ ID NO: 918377 - RNA, 22 nt, Human
uacauauacugagugauuugcu

SEQ ID NO: 918378 - RNA, 22 nt, Human
agcaggcaggcccagcggcugg

SEQ ID NO: 918379 - RNA, 22 nt, Human
acagcucugcauggcaguuauu

SEQ ID NO: 918380 - RNA, 23 nt, Human
agggccugauggcucccgcuggc

SEQ ID NO: 918381 - RNA, 23 nt, Human
gguggcaggaguggaugcugagc

SEQ ID NO: 918382 - RNA, 22 nt, Human
ugggcucugguuuccuggcugg

SEQ ID NO: 918383 - RNA, 20 nt, Human
aggaaaaauggaaacuggag

SEQ ID NO: 918384 - RNA, 22 nt, Human
auacaaaguauuaauccuggau

SEQ ID NO: 918385 - RNA, 21 nt, Human
gcuucuguaucuagcaggaac

SEQ ID NO: 918386 - RNA, 22 nt, Human
uauucuuguaccuuaaaugauu

SEQ ID NO: 918387 - RNA, 22 nt, Human
caggaguuucuauuguuccaaa

SEQ ID NO: 918388 - RNA, 16 nt, Human
aaggagggaagagaau

SEQ ID NO: 918389 - RNA, 22 nt, Human
uucuggagccccaagaucugua

SEQ ID NO: 918390 - RNA, 22 nt, Human
ugaggauggcagugugcucagc

SEQ ID NO: 918391 - RNA, 22 nt, Human
acauguguauagccuguauaga

SEQ ID NO: 918392 - RNA, 22 nt, Human
uaggaaacucucagcuggucau

SEQ ID NO: 918393 - RNA, 22 nt, Human
guccuggugcuggucauugucg

SEQ ID NO: 918394 - RNA, 18 nt, Human
gaguguggcacugggccc

SEQ ID NO: 918395 - RNA, 22 nt, Human
ugcagccaauucauucauucuu

SEQ ID NO: 918396 - RNA, 22 nt, Human
ucauaaaucauacuccauuugc

SEQ ID NO: 918397 - RNA, 20 nt, Human
uuugucuguuaaguguuucu

SEQ ID NO: 918398 - RNA, 22 nt, Human
ccccagcucagugcagggacau

SEQ ID NO: 918399 - RNA, 22 nt, Human
auauuaauuauuuacacaugag

SEQ ID NO: 918400 - RNA, 22 nt, Human
ccaucuccaguuuauucuuccu

SEQ ID NO: 918401 - RNA, 22 nt, Human
auuaaagcuauccagucaugaa

SEQ ID NO: 918402 - RNA, 22 nt, Human
uccaaagaacauugcugagacc

SEQ ID NO: 918403 - RNA, 22 nt, Human
ugcugagaugaauagggcuguc

SEQ ID NO: 918404 - RNA, 22 nt, Human
gcuuccagcaccagcagagggg

SEQ ID NO: 918405 - RNA, 22 nt, Human
augcugugcuggcuaaccaugg

SEQ ID NO: 918406 - RNA, 22 nt, Human
gaacaaacacaucccagcagug

SEQ ID NO: 918407 - RNA, 22 nt, Human
gugacagugacagcuagauagu

SEQ ID NO: 918408 - RNA, 22 nt, Human
ugcuuaaaguguuaacccuguu

SEQ ID NO: 918409 - RNA, 22 nt, Human
gaaagacuuccuuugagaguac

SEQ ID NO: 918410 - RNA, 22 nt, Human
uagaacacuugaccacugcucc

SEQ ID NO: 918411 - RNA, 22 nt, Human
agaagccucauccucucuagug

SEQ ID NO: 918412 - RNA, 22 nt, Human
ucuagacacuacuaguaaccgg

SEQ ID NO: 918413 - RNA, 22 nt, Human
caacucaggcaccucauauaag

SEQ ID NO: 918414 - RNA, 22 nt, Human
cugccacuuacuaggcauggug

SEQ ID NO: 918415 - RNA, 18 nt, Human
agcagggcauuuugccau

SEQ ID NO: 918416 - RNA, 23 nt, Human
agugucugagugcaggcugugca

SEQ ID NO: 918417 - RNA, 21 nt, Human
gccucuccaaauccugccuuc

SEQ ID NO: 918418 - RNA, 22 nt, Human
cuacauuuggagaguauaggaa

SEQ ID NO: 918419 - RNA, 22 nt, Human
agaguccauaugugggaggagu

SEQ ID NO: 918420 - RNA, 22 nt, Human
gagcagcuaaaauucucaugca

SEQ ID NO: 918421 - RNA, 22 nt, Human
auaguugguccaugaaaaaagu

SEQ ID NO: 918422 - RNA, 22 nt, Human
uaaaugagauguacauaacuca

SEQ ID NO: 918423 - RNA, 22 nt, Human
gacauuucuagcccauaaaacu

SEQ ID NO: 918424 - RNA, 22 nt, Human
ugcagcuguuacggacccuguc

SEQ ID NO: 918425 - RNA, 22 nt, Human
aguaaaaucuuaagcacagugg

SEQ ID NO: 918426 - RNA, 22 nt, Human
caaagguuucacaguagcccau

SEQ ID NO: 918427 - RNA, 22 nt, Human
ucuuuauuuuaugcuugugcaa

SEQ ID NO: 918428 - RNA, 21 nt, Human
ugcagccauucagcccuaugc

SEQ ID NO: 918429 - RNA, 22 nt, Human
acaggaagcuggagacccuuga

SEQ ID NO: 918430 - RNA, 22 nt, Human
uccugagggcugcagucauagg

SEQ ID NO: 918431 - RNA, 22 nt, Human
auuucucagugaaaugacaggc

SEQ ID NO: 918432 - RNA, 22 nt, Human
aguucagcuucccaggucacug

SEQ ID NO: 918433 - RNA, 22 nt, Human
ucuaugcuugagacagaugggg

SEQ ID NO: 918434 - RNA, 22 nt, Human
ugcaagaaugacccaucuaccc

SEQ ID NO: 918435 - RNA, 22 nt, Human
gcugccugcucggcuccuggga

SEQ ID NO: 918436 - RNA, 20 nt, Human
gcacacauagaaaugcauau

SEQ ID NO: 918437 - RNA, 22 nt, Human
caacugcugacaccaucacucc

SEQ ID NO: 918438 - RNA, 22 nt, Human
ucaggcagaccaccgugggcag

SEQ ID NO: 918439 - RNA, 22 nt, Human
acuguauacuucuguauacaau

SEQ ID NO: 918440 - RNA, 22 nt, Human
gaggcuccauggaggaguaugg

SEQ ID NO: 918441 - RNA, 22 nt, Human
cagaagcagaacacuagauuua

SEQ ID NO: 918442 - RNA, 22 nt, Human
uaggaaacagugcauauauagu

SEQ ID NO: 918443 - RNA, 20 nt, Human
gaaauacuuacccaacuguu

SEQ ID NO: 918444 - RNA, 22 nt, Human
ugugauuucaucugaggccagg

SEQ ID NO: 918445 - RNA, 22 nt, Human
acagaaagaagguguauuugag

SEQ ID NO: 918446 - RNA, 22 nt, Human
cacccagagggcuugcugaaca

SEQ ID NO: 918447 - RNA, 22 nt, Human
aggcagcagacuguuaaucaga

SEQ ID NO: 918448 - RNA, 22 nt, Human
uacuuucaugucuauacauauu

SEQ ID NO: 918449 - RNA, 22 nt, Human
uaaacaugcccagugacaggga

SEQ ID NO: 918450 - RNA, 20 nt, Human
cugcaucaugguuaagaaca

SEQ ID NO: 918451 - RNA, 22 nt, Human
uagaagaacaugucaaacuaua

SEQ ID NO: 918452 - RNA, 22 nt, Human
aaaaguauuuugagcacuuuau

SEQ ID NO: 918453 - RNA, 22 nt, Human
ucugggagacguguguugucag

SEQ ID NO: 918454 - RNA, 22 nt, Human
auuuuguggguucugcugaugu

SEQ ID NO: 918455 - RNA, 22 nt, Human
augugugcgggaaggaaaguga

SEQ ID NO: 918456 - RNA, 22 nt, Human
uggcugcacuucaacacauccu

SEQ ID NO: 918457 - RNA, 22 nt, Human
ugucacaaaaaucaguaauugc

SEQ ID NO: 918458 - RNA, 18 nt, Human
aucccaaaagacaaggaa

SEQ ID NO: 918459 - RNA, 22 nt, Human
uguggccuggaaggggcugcuc

SEQ ID NO: 918460 - RNA, 22 nt, Human
gcugggcaccggagagacccca

SEQ ID NO: 918461 - RNA, 23 nt, Human
ugggcucagcuuccaguggggag

SEQ ID NO: 918462 - RNA, 22 nt, Human
aggagcacugagccagcauggg

SEQ ID NO: 918463 - RNA, 22 nt, Human
aaagacagauggcaaggaugau

SEQ ID NO: 918464 - RNA, 22 nt, Human
aguuccaugucuggguuuguga

SEQ ID NO: 918465 - RNA, 22 nt, Human
ucugggagccaugccuuggagu

SEQ ID NO: 918466 - RNA, 22 nt, Human
gcagcccucccugggugugucu

SEQ ID NO: 918467 - RNA, 22 nt, Human
agacgcgguggugcaugccugu

SEQ ID NO: 918468 - RNA, 22 nt, Human
acagccagcagagcuguuuccu

SEQ ID NO: 918469 - RNA, 22 nt, Human
ucacccagacugucugacucuu

SEQ ID NO: 918470 - RNA, 22 nt, Human
guuuccuggaaacauuaggaga

SEQ ID NO: 918471 - RNA, 22 nt, Human
acaugauuucagggaauucuca

SEQ ID NO: 918472 - RNA, 22 nt, Human
auuuguuccacacauauuuacu

SEQ ID NO: 918473 - RNA, 22 nt, Human
cugggcuguaauguggcacuga

SEQ ID NO: 918474 - RNA, 22 nt, Human
ggccuuccuucccagccuacug

SEQ ID NO: 918475 - RNA, 20 nt, Human
uggaaggucccagaggaauu

SEQ ID NO: 918476 - RNA, 22 nt, Human
aaguacauauauuuaugauucu

SEQ ID NO: 918477 - RNA, 22 nt, Human
uauggauguuuaucuacaggcu

SEQ ID NO: 918478 - RNA, 22 nt, Human
cccacacacauuuaugauagga

SEQ ID NO: 918479 - RNA, 22 nt, Human
uuuggaaauacgcguaggcaga

SEQ ID NO: 918480 - RNA, 22 nt, Human
caaggcaggccaguuucaaggc

SEQ ID NO: 918481 - RNA, 18 nt, Human
uggaaauugaaacagaaa

SEQ ID NO: 918482 - RNA, 21 nt, Human
uagcagaaacaguucaggcca

SEQ ID NO: 918483 - RNA, 22 nt, Human
gaggggcaggauuauugggauu

SEQ ID NO: 918484 - RNA, 22 nt, Human
uguguccuucugggagucccag

SEQ ID NO: 918485 - RNA, 22 nt, Human
uauuguccaauaggauguuccu

SEQ ID NO: 918486 - RNA, 22 nt, Human
cugaggagacagaagccaaaua

SEQ ID NO: 918487 - RNA, 22 nt, Human
uacauugugauaggaagucacc

SEQ ID NO: 918488 - RNA, 22 nt, Human
ggguagcaugugucagaguuug

SEQ ID NO: 918489 - RNA, 22 nt, Human
cauuucacgcacacucauuacu

SEQ ID NO: 918490 - RNA, 22 nt, Human
agagggggugucagcacugcag

SEQ ID NO: 918491 - RNA, 22 nt, Human
caaaucauggaauaacuagaga

SEQ ID NO: 918492 - RNA, 22 nt, Human
cugaggucaauuaaucaacaac

SEQ ID NO: 918493 - RNA, 22 nt, Human
cugacagcagcaaauggagaua

SEQ ID NO: 918494 - RNA, 22 nt, Human
uauugcaucaguaauuuagugu

SEQ ID NO: 918495 - RNA, 22 nt, Human
aucugucugagugcuuaggacc

SEQ ID NO: 918496 - RNA, 18 nt, Human
cuuuaugugcagagcuuu

SEQ ID NO: 918497 - RNA, 22 nt, Human
agaguguguggggcugagguca

SEQ ID NO: 918498 - RNA, 22 nt, Human
ggcagcgcccgaguccgcagcu

SEQ ID NO: 918499 - RNA, 22 nt, Human
aaagauguguaagaaauaaaca

SEQ ID NO: 918500 - RNA, 22 nt, Human
caugcagaugucaugaggcaug

SEQ ID NO: 918501 - RNA, 22 nt, Human
uaguccauugauuagcucauuu

SEQ ID NO: 918502 - RNA, 22 nt, Human
ccagcagcugcuaugugguuuu

SEQ ID NO: 918503 - RNA, 22 nt, Human
ugagauucccauuaauuuuaua

SEQ ID NO: 918504 - RNA, 22 nt, Human
ggccucugcccucacuccuguc

SEQ ID NO: 918505 - RNA, 22 nt, Human
gggcagguggcagggucucugg

SEQ ID NO: 918506 - RNA, 22 nt, Human
gcagaccagccccuggagcugc

SEQ ID NO: 918507 - RNA, 22 nt, Human
guccuuggcauucugagucuug

SEQ ID NO: 918508 - RNA, 22 nt, Human
uugagaaaccuggcaguagaga

SEQ ID NO: 918509 - RNA, 22 nt, Human
uucuggaagccccagagucaga

SEQ ID NO: 918510 - RNA, 22 nt, Human
uaaaagaagcuucaaggccggc

SEQ ID NO: 918511 - RNA, 22 nt, Human
uagauaaaagggcaaagggcau

SEQ ID NO: 918512 - RNA, 22 nt, Human
cacaaauccaauuuaauucugg

SEQ ID NO: 918513 - RNA, 22 nt, Human
cuggacucauccauagagguga

SEQ ID NO: 918514 - RNA, 22 nt, Human
uggcuguuacucuuuucauuuc

SEQ ID NO: 918515 - RNA, 22 nt, Human
uuucagaggaggaaggcaguua

SEQ ID NO: 918516 - RNA, 22 nt, Human
aagcacuggagaugccagagug

SEQ ID NO: 918517 - RNA, 22 nt, Human
ccugaagcucuuaagaccuuua

SEQ ID NO: 918518 - RNA, 22 nt, Human
ggaacaguagacgaucuccuuu

SEQ ID NO: 918519 - RNA, 22 nt, Human
ccaggccaguguuugguccagg

SEQ ID NO: 918520 - RNA, 22 nt, Human
gaaggcuguuucugguagugau

SEQ ID NO: 918521 - RNA, 22 nt, Human
uuccuugcccucugggaucuug

SEQ ID NO: 918522 - RNA, 22 nt, Human
caaagcuggaaaaggaggcugg

SEQ ID NO: 918523 - RNA, 22 nt, Human
cuaggccuucauaggcauggaa

SEQ ID NO: 918524 - RNA, 22 nt, Human
gcagcccucgcuagcucucccc

SEQ ID NO: 918525 - RNA, 22 nt, Human
acaaugucucauauucguguuc

SEQ ID NO: 918526 - RNA, 22 nt, Human
auaacaugaccugugcuucaca

SEQ ID NO: 918527 - RNA, 23 nt, Human
agaucacauaguuaucagaugac

SEQ ID NO: 918528 - RNA, 22 nt, Human
aaaugacacucauucaguguca

SEQ ID NO: 918529 - RNA, 22 nt, Human
uugugcaugacugugaauagcu

SEQ ID NO: 918530 - RNA, 22 nt, Human
gcucucugccuuucucaaugac

SEQ ID NO: 918531 - RNA, 22 nt, Human
ucaucaaaggauugcaugauuu

SEQ ID NO: 918532 - RNA, 22 nt, Human
agacuguacuuucugcagcucu

SEQ ID NO: 918533 - RNA, 22 nt, Human
cacugcccuuacaugcccugca

SEQ ID NO: 918534 - RNA, 22 nt, Human
aaaacaguuuaggcaucacagu

SEQ ID NO: 918535 - RNA, 22 nt, Human
ucaaggaauuuaguuuaguaaa

SEQ ID NO: 918536 - RNA, 22 nt, Human
aagaaaacguuuugaggaguuu

SEQ ID NO: 918537 - RNA, 22 nt, Human
ugcugcaggaacuuaagaagcu

SEQ ID NO: 918538 - RNA, 22 nt, Human
ccugagagagaagcgaccuggu

SEQ ID NO: 918539 - RNA, 22 nt, Human
uaacugcagaggaaaugcaucu

SEQ ID NO: 918540 - RNA, 22 nt, Human
ugucacauaauuuaucuguagg

SEQ ID NO: 918541 - RNA, 22 nt, Human
ugggaacaguagcugcugagcu

SEQ ID NO: 918542 - RNA, 22 nt, Human
uugugagagccaaacauguaag

SEQ ID NO: 918543 - RNA, 22 nt, Human
auguauguaugcugugcuugca

SEQ ID NO: 918544 - RNA, 22 nt, Human
cugagaggcggagguugcagug

SEQ ID NO: 918545 - RNA, 22 nt, Human
cuggcucuugcgacucagcuug

SEQ ID NO: 918546 - RNA, 22 nt, Human
uguguggaugcagcgugggucu

SEQ ID NO: 918547 - RNA, 22 nt, Human
cagaagcacauguuuacaugua

SEQ ID NO: 918548 - RNA, 22 nt, Human
gauucacagaacuuagucaagc

SEQ ID NO: 918549 - RNA, 22 nt, Human
aauuuagauugauaaacaugga

SEQ ID NO: 918550 - RNA, 22 nt, Human
aaagauuugaaauuaggcauca

SEQ ID NO: 918551 - RNA, 22 nt, Human
auucaucagcuaauggacauuu

SEQ ID NO: 918552 - RNA, 22 nt, Human
gcccuguggacagugagaagug

SEQ ID NO: 918553 - RNA, 22 nt, Human
uuugucaggaauugaaaaguuu

SEQ ID NO: 918554 - RNA, 22 nt, Human
auugguggugaggacaugccag

SEQ ID NO: 918555 - RNA, 22 nt, Human
acaaugcagccuauggauccag

SEQ ID NO: 918556 - RNA, 22 nt, Human
uuuccuuugugcaggccuuggg

SEQ ID NO: 918557 - RNA, 22 nt, Human
ugucaccuuuacccuuuuauag

SEQ ID NO: 918558 - RNA, 22 nt, Human
cagcaugcuugggggagggagc

SEQ ID NO: 918559 - RNA, 22 nt, Human
uuugagaaaggggauuuaauuc

SEQ ID NO: 918560 - RNA, 22 nt, Human
ugcuccagcgcugccaccaguu

SEQ ID NO: 918561 - RNA, 21 nt, Human
gauauuuaugacucauuccuu

SEQ ID NO: 918562 - RNA, 22 nt, Human
aguugaagguuggcugauccau

SEQ ID NO: 918563 - RNA, 22 nt, Human
auuuagaaauuccaaaaguauu

SEQ ID NO: 918564 - RNA, 18 nt, Human
cugcugugucgucugggc

SEQ ID NO: 918565 - RNA, 22 nt, Human
uuacauaacgguaugaaaaaug

SEQ ID NO: 918566 - RNA, 22 nt, Human
cccagcagaaucugaugagggc

SEQ ID NO: 918567 - RNA, 22 nt, Human
uaagcaaucuaaaagccuuacc

SEQ ID NO: 918568 - RNA, 22 nt, Human
aaagccaucaguaaaaugauuu

SEQ ID NO: 918569 - RNA, 22 nt, Human
cagacaggcuagccagacucac

SEQ ID NO: 918570 - RNA, 22 nt, Human
gauguuaaagguugguaaguca

SEQ ID NO: 918571 - RNA, 22 nt, Human
cauuucuagagucccaagaggu

SEQ ID NO: 918572 - RNA, 22 nt, Human
cugaaguuucgagauggaugug

SEQ ID NO: 918573 - RNA, 22 nt, Human
cccagcugauuuuugcagagau

SEQ ID NO: 918574 - RNA, 22 nt, Human
uccagcauucuuagaccucuau

SEQ ID NO: 918575 - RNA, 22 nt, Human
ugagauaauaaauagcuuucuu

SEQ ID NO: 918576 - RNA, 22 nt, Human
uugauguagggauuccuguaaa

SEQ ID NO: 918577 - RNA, 22 nt, Human
cugccgggcccuggauuuggca

SEQ ID NO: 918578 - RNA, 22 nt, Human
aaggcugaguaaaacagagaac

SEQ ID NO: 918579 - RNA, 22 nt, Human
uaaggaauaucauaagaaguag

SEQ ID NO: 918580 - RNA, 22 nt, Human
uagauuucucauucauagauug

SEQ ID NO: 918581 - RNA, 22 nt, Human
ucacaugcucaccuaagccaca

SEQ ID NO: 918582 - RNA, 22 nt, Human
uccccagucccggcggugggug

SEQ ID NO: 918583 - RNA, 22 nt, Human
ccuggcccacauggcuucuccc

SEQ ID NO: 918584 - RNA, 22 nt, Human
gaugucuuaagcccagaaguuc

SEQ ID NO: 918585 - RNA, 22 nt, Human
uaacuuuaguguaugagguaag

SEQ ID NO: 918586 - RNA, 22 nt, Human
cuguggcuggcucaucauaggu

SEQ ID NO: 918587 - RNA, 22 nt, Human
gccaggcucucagugacugccc

SEQ ID NO: 918588 - RNA, 22 nt, Human
ugcuggaagcuccugcaugucu

SEQ ID NO: 918589 - RNA, 22 nt, Human
ucugguccucucugugaugcua

SEQ ID NO: 918590 - RNA, 22 nt, Human
ucuguccagcucucaggagaca

SEQ ID NO: 918591 - RNA, 22 nt, Human
ggaggcggacacagguaguguu

SEQ ID NO: 918592 - RNA, 20 nt, Human
uauuuagauucaaguaugga

SEQ ID NO: 918593 - RNA, 22 nt, Human
ucccagccuuucuuuucugcug

SEQ ID NO: 918594 - RNA, 22 nt, Human
caucugcuguaauuaacaagcc

SEQ ID NO: 918595 - RNA, 22 nt, Human
aaaggagaaaacauacaggacu

SEQ ID NO: 918596 - RNA, 22 nt, Human
ccaggcaagagaggcucuggca

SEQ ID NO: 918597 - RNA, 22 nt, Human
ucuugaaaguaucuuauuuugu

SEQ ID NO: 918598 - RNA, 22 nt, Human
accaucuuaguggccagcucuc

SEQ ID NO: 918599 - RNA, 22 nt, Human
agagccaguuguuaagcacuua

SEQ ID NO: 918600 - RNA, 22 nt, Human
aucaauaucagaucagacagga

SEQ ID NO: 918601 - RNA, 22 nt, Human
agugauuuugucagcuucugca

SEQ ID NO: 918602 - RNA, 22 nt, Human
cccccaaaguuugcacggauaa

SEQ ID NO: 918603 - RNA, 16 nt, Human
aacauucauaugagug

SEQ ID NO: 918604 - RNA, 22 nt, Human
ggccugaggccaccagcagccc

SEQ ID NO: 918605 - RNA, 22 nt, Human
uggaagggaaaguuuggggucc

SEQ ID NO: 918606 - RNA, 22 nt, Human
aaagugggaacaauggagagug

SEQ ID NO: 918607 - RNA, 22 nt, Human
aacaucuagguucucaucgaua

SEQ ID NO: 918608 - RNA, 23 nt, Human
ggggccugcaccggucugcgcgg

SEQ ID NO: 918609 - RNA, 22 nt, Human
cugagagguaaucacacaaaau

SEQ ID NO: 918610 - RNA, 22 nt, Human
aacaauaauugcgguucucuau

SEQ ID NO: 918611 - RNA, 22 nt, Human
cuguauaugugcauacacacac

SEQ ID NO: 918612 - RNA, 22 nt, Human
aucagaaucuucugaacagugg

SEQ ID NO: 918613 - RNA, 22 nt, Human
uuuagaauuggcuagugggaau

SEQ ID NO: 918614 - RNA, 22 nt, Human
uccagugucugagcccuuagcu

SEQ ID NO: 918615 - RNA, 22 nt, Human
agacgagggcccccaggacagc

SEQ ID NO: 918616 - RNA, 23 nt, Human
ucucaguuccagaggcuacaagu

SEQ ID NO: 918617 - RNA, 22 nt, Human
uugucuguccaggcaccccaag

SEQ ID NO: 918618 - RNA, 22 nt, Human
ucaggaggacagauaaggauag

SEQ ID NO: 918619 - RNA, 23 nt, Human
ugaguguguucccugugagauuu

SEQ ID NO: 918620 - RNA, 19 nt, Human
gcuaggugaccagcuggau

SEQ ID NO: 918621 - RNA, 22 nt, Human
ucuagguuagaacccagaaaag

SEQ ID NO: 918622 - RNA, 22 nt, Human
gguccucugagcacgccaggca

SEQ ID NO: 918623 - RNA, 22 nt, Human
acuuuuaaggggccuugauuua

SEQ ID NO: 918624 - RNA, 22 nt, Human
uuggcagcuguuggaccuugac

SEQ ID NO: 918625 - RNA, 22 nt, Human
aggagccaguggaguuccugcc

SEQ ID NO: 918626 - RNA, 20 nt, Human
uuggcaguuaagaaucuuac

SEQ ID NO: 918627 - RNA, 22 nt, Human
uggcuuuauacuuaagcacaau

SEQ ID NO: 918628 - RNA, 22 nt, Human
auguuaugugcaagauacauaa

SEQ ID NO: 918629 - RNA, 22 nt, Human
uggcuccaccgccgcggagcuc

SEQ ID NO: 918630 - RNA, 22 nt, Human
gcugucaccaaagcaggcacug

SEQ ID NO: 918631 - RNA, 22 nt, Human
cuuuggucuguggcuugggucu

SEQ ID NO: 918632 - RNA, 22 nt, Human
ugcuggcuguauaugugagagu

SEQ ID NO: 918633 - RNA, 22 nt, Human
uuugucuucauccuucgagcug

SEQ ID NO: 918634 - RNA, 22 nt, Human
gcuguucuuuggucaaagguau

SEQ ID NO: 918635 - RNA, 22 nt, Human
ucugacccacaagcauccugga

SEQ ID NO: 918636 - RNA, 22 nt, Human
auuugucuuuggaccugugaga

SEQ ID NO: 918637 - RNA, 22 nt, Human
ucucugagggagauggccugcc

SEQ ID NO: 918638 - RNA, 22 nt, Human
ccacuuuugggaacagugagua

SEQ ID NO: 918639 - RNA, 22 nt, Human
ucagagucuaaauagaagaaua

SEQ ID NO: 918640 - RNA, 22 nt, Human
uagcucuggcauucuuuccaaa

SEQ ID NO: 918641 - RNA, 22 nt, Human
uccauucuaugcuuacauuuau

SEQ ID NO: 918642 - RNA, 22 nt, Human
ucucauugccuucacucuucag

SEQ ID NO: 918643 - RNA, 22 nt, Human
gcugugagcacugcugggugga

SEQ ID NO: 918644 - RNA, 22 nt, Human
aaagacauggcaagagaugggg

SEQ ID NO: 918645 - RNA, 22 nt, Human
uggacaguaagagaagauguag

SEQ ID NO: 918646 - RNA, 22 nt, Human
guccccagcuaaucucuuugcc

SEQ ID NO: 918647 - RNA, 22 nt, Human
uuucuaaggugagguagaaaau

SEQ ID NO: 918648 - RNA, 22 nt, Human
agaggaacccagacagggcuuu

SEQ ID NO: 918649 - RNA, 22 nt, Human
gaggaugguaugaggcaagcaa

SEQ ID NO: 918650 - RNA, 22 nt, Human
auuuauuggaugcuuacuuggg

SEQ ID NO: 918651 - RNA, 22 nt, Human
ccuggcuccugcacagaucuuu

SEQ ID NO: 918652 - RNA, 22 nt, Human
uuccaguuaaggaagcuauucu

SEQ ID NO: 918653 - RNA, 22 nt, Human
aacuuugggccuaaguacuguu

SEQ ID NO: 918654 - RNA, 22 nt, Human
uugaaaggaauacagaggccua

SEQ ID NO: 918655 - RNA, 22 nt, Human
uggcaguggcucagagugcaga

SEQ ID NO: 918656 - RNA, 22 nt, Human
caggaggcagagguugcaguga

SEQ ID NO: 918657 - RNA, 22 nt, Human
caguuuaaguguguugaaggua

SEQ ID NO: 918658 - RNA, 22 nt, Human
gagccuggagcuggaacgaagc

SEQ ID NO: 918659 - RNA, 22 nt, Human
aagaccagaggauauaaccaga

SEQ ID NO: 918660 - RNA, 22 nt, Human
agcugccucugcugguuuagaa

SEQ ID NO: 918661 - RNA, 22 nt, Human
aaguucuacagcuucgcaggca

SEQ ID NO: 918662 - RNA, 18 nt, Human
guauaucugcacauauac

SEQ ID NO: 918663 - RNA, 22 nt, Human
cugcaggcccccuuccuggagu

SEQ ID NO: 918664 - RNA, 22 nt, Human
ugaaauguggagaugguaagua

SEQ ID NO: 918665 - RNA, 22 nt, Human
uccaccagcagccugucagccu

SEQ ID NO: 918666 - RNA, 22 nt, Human
acuucauguugcucuuggcuau

SEQ ID NO: 918667 - RNA, 22 nt, Human
uagcagcugucaguuucacaua

SEQ ID NO: 918668 - RNA, 22 nt, Human
auucaguuaaaaacuguacuuc

SEQ ID NO: 918669 - RNA, 22 nt, Human
caaugacaucucccugcucuaa

SEQ ID NO: 918670 - RNA, 22 nt, Human
uuuccuaagggaugcggcucaa

SEQ ID NO: 918671 - RNA, 20 nt, Human
ucauggcugcugagagguuc

SEQ ID NO: 918672 - RNA, 22 nt, Human
cuucucuggcuccucagcgccc

SEQ ID NO: 918673 - RNA, 22 nt, Human
acagcagcgucaacuuaaaauu

SEQ ID NO: 918674 - RNA, 22 nt, Human
uuuauucacucauucagccagu

SEQ ID NO: 918675 - RNA, 21 nt, Human
uuugugugucacgugcacagg

SEQ ID NO: 918676 - RNA, 22 nt, Human
uucugagaguaaacauagccug

SEQ ID NO: 918677 - RNA, 22 nt, Human
ccuguguggaaaccgcaugacg

SEQ ID NO: 918678 - RNA, 22 nt, Human
cagggugugaacaguguaaaac

SEQ ID NO: 918679 - RNA, 22 nt, Human
ugcugcugacauuuggggcuug

SEQ ID NO: 918680 - RNA, 22 nt, Human
uugucugaauucuucuaggcag

SEQ ID NO: 918681 - RNA, 22 nt, Human
uuaaaugaacgagauaugcaac

SEQ ID NO: 918682 - RNA, 21 nt, Human
agcaaaggcaggagagguuuc

SEQ ID NO: 918683 - RNA, 22 nt, Human
ccugucuguccuuugcauucuu

SEQ ID NO: 918684 - RNA, 22 nt, Human
aagggggcccagcacuaaguug

SEQ ID NO: 918685 - RNA, 22 nt, Human
ccucugccuuuagugaaaguug

SEQ ID NO: 918686 - RNA, 22 nt, Human
cuccaggcuggauccaagucaa

SEQ ID NO: 918687 - RNA, 22 nt, Human
uagcagcaggggaaacagcugu

SEQ ID NO: 918688 - RNA, 23 nt, Human
cugggcugcuugagucccuggcu

SEQ ID NO: 918689 - RNA, 22 nt, Human
ugguaagggcucucuuucuggc

SEQ ID NO: 918690 - RNA, 22 nt, Human
guauagaaggaucuggugaauu

SEQ ID NO: 918691 - RNA, 22 nt, Human
cugggacuuuacccuguggccc

SEQ ID NO: 918692 - RNA, 22 nt, Human
gagaaaagcgaaggaccuggag

SEQ ID NO: 918693 - RNA, 22 nt, Human
aaguaaauaucuguuuauagca

SEQ ID NO: 918694 - RNA, 18 nt, Human
gcuuuuuagugcaucuuc

SEQ ID NO: 918695 - RNA, 22 nt, Human
uggcuuggugagcagaguguag

SEQ ID NO: 918696 - RNA, 22 nt, Human
ugaagccauuacuguguuaggg

SEQ ID NO: 918697 - RNA, 22 nt, Human
aagacaagcaucaaaucaggca

SEQ ID NO: 918698 - RNA, 22 nt, Human
caguccagcccccugcuaaaag

SEQ ID NO: 918699 - RNA, 22 nt, Human
aguguauuaaugcuccaggagu

SEQ ID NO: 918700 - RNA, 22 nt, Human
ucccagaaucuuuggaagagca

SEQ ID NO: 918701 - RNA, 22 nt, Human
ggccccucagcaucugagucag

SEQ ID NO: 918702 - RNA, 22 nt, Human
cuuggugccacagcagcuugcg

SEQ ID NO: 918703 - RNA, 22 nt, Human
auuuucugugugcagauaaaua

SEQ ID NO: 918704 - RNA, 22 nt, Human
cagcuucaugacaaacaguuuu

SEQ ID NO: 918705 - RNA, 22 nt, Human
uucauggccuacuuugcuucaa

SEQ ID NO: 918706 - RNA, 22 nt, Human
ucuggccaggggucccugaagg

SEQ ID NO: 918707 - RNA, 22 nt, Human
uguuccugguuccugcaugaug

SEQ ID NO: 918708 - RNA, 22 nt, Human
cugggagugucccucugguaau

SEQ ID NO: 918709 - RNA, 22 nt, Human
ucaaauacagaagauccuuucc

SEQ ID NO: 918710 - RNA, 20 nt, Human
cuuagaagggacauccuggg

SEQ ID NO: 918711 - RNA, 22 nt, Human
cugccuggcauggagaagagaa

SEQ ID NO: 918712 - RNA, 22 nt, Human
uauguacagggauagaacuuga

SEQ ID NO: 918713 - RNA, 22 nt, Human
uagcuggcuuauauaaaagggc

SEQ ID NO: 918714 - RNA, 22 nt, Human
ggcucuggagauguccgaccug

SEQ ID NO: 918715 - RNA, 22 nt, Human
uaacagaaaagaacugaguuug

SEQ ID NO: 918716 - RNA, 22 nt, Human
auacuucuuuaagaguaagucu

SEQ ID NO: 918717 - RNA, 20 nt, Human
aaguuggcuccuccuagcaa

SEQ ID NO: 918718 - RNA, 22 nt, Human
acaaacaucuugaccucagauu

SEQ ID NO: 918719 - RNA, 22 nt, Human
aauugugcccgugacauuucau

SEQ ID NO: 918720 - RNA, 19 nt, Human
ucugcaagugucagaggcg

SEQ ID NO: 918721 - RNA, 22 nt, Human
aaggagguuaucccaguggacu

SEQ ID NO: 918722 - RNA, 22 nt, Human
cucuggcuggcaccugaucuga

SEQ ID NO: 918723 - RNA, 22 nt, Human
ggcagauggaaugagcugucua

SEQ ID NO: 918724 - RNA, 22 nt, Human
gcccacugagugacucccucag

SEQ ID NO: 918725 - RNA, 19 nt, Human
ggacacagaaagcugcauu

SEQ ID NO: 918726 - RNA, 22 nt, Human
gagaaguuuggagugaagguuu

SEQ ID NO: 918727 - RNA, 18 nt, Human
cccagcuccacuucccuc

SEQ ID NO: 918728 - RNA, 22 nt, Human
uuuuuuccagcuucuagaggcc

SEQ ID NO: 918729 - RNA, 22 nt, Human
aggcugaggcagguggaucacu

SEQ ID NO: 918730 - RNA, 22 nt, Human
agauaagucuuccauauuucua

SEQ ID NO: 918731 - RNA, 22 nt, Human
ucccuguccugggcaaucccag

SEQ ID NO: 918732 - RNA, 22 nt, Human
agggcaugcuggaggagagaca

SEQ ID NO: 918733 - RNA, 22 nt, Human
cucuuuacugcuacuacaaaga

SEQ ID NO: 918734 - RNA, 21 nt, Human
uccaggcugaugaugucaacu

SEQ ID NO: 918735 - RNA, 22 nt, Human
uaguaacagauuuauacagucu

SEQ ID NO: 918736 - RNA, 22 nt, Human
uucccaggaagccucuccaagc

SEQ ID NO: 918737 - RNA, 22 nt, Human
acugaaaguccagcaugguaca

SEQ ID NO: 918738 - RNA, 22 nt, Human
ucuggugucaggcuguccucgg

SEQ ID NO: 918739 - RNA, 22 nt, Human
auaguuuuauagauauugugua

SEQ ID NO: 918740 - RNA, 21 nt, Human
ugacccuucuagcagaacaca

SEQ ID NO: 918741 - RNA, 22 nt, Human
aacuccuguucuaugacaagag

SEQ ID NO: 918742 - RNA, 22 nt, Human
auauaguuggguuucauucuac

SEQ ID NO: 918743 - RNA, 22 nt, Human
uucaacaucaagaaugcaugga

SEQ ID NO: 918744 - RNA, 19 nt, Human
cugugggcggaggaggggc

SEQ ID NO: 918745 - RNA, 22 nt, Human
agcugagcucaggcugauguaa

SEQ ID NO: 918746 - RNA, 22 nt, Human
uuuccaaauaaggucacauucu

SEQ ID NO: 918747 - RNA, 22 nt, Human
guaugugagguugguuuccagg

SEQ ID NO: 918748 - RNA, 22 nt, Human
cuguauuuguccucuauuuauu

SEQ ID NO: 918749 - RNA, 22 nt, Human
gaaauaauucugugucugaaca

SEQ ID NO: 918750 - RNA, 22 nt, Human
cugagcccuugaacccaagucc

SEQ ID NO: 918751 - RNA, 22 nt, Human
uccaggaccugacugggccugc

SEQ ID NO: 918752 - RNA, 20 nt, Human
ggcagcaggaguuuccucuu

SEQ ID NO: 918753 - RNA, 22 nt, Human
agugucuggaggcauucuuggu

SEQ ID NO: 918754 - RNA, 22 nt, Human
aacauugaacuuggcacaccca

SEQ ID NO: 918755 - RNA, 22 nt, Human
aguauauaugaggaaccacaaa

SEQ ID NO: 918756 - RNA, 22 nt, Human
uggaaugugcuacuguugauuu

SEQ ID NO: 918757 - RNA, 22 nt, Human
aagccacuuggggaaagaugga

SEQ ID NO: 918758 - RNA, 20 nt, Human
uuacagaaaugauguuauuu

SEQ ID NO: 918759 - RNA, 18 nt, Human
ggagcccagaggacagga

SEQ ID NO: 918760 - RNA, 17 nt, Human
aggaggaucagagagua

SEQ ID NO: 918761 - RNA, 22 nt, Human
uuuaaucuauucccuaaacacc

SEQ ID NO: 918762 - RNA, 22 nt, Human
agcaggcuaagggaccuguuua

SEQ ID NO: 918763 - RNA, 22 nt, Human
uccaauguuccaggguaaaugu

SEQ ID NO: 918764 - RNA, 22 nt, Human
agccacagguguuggccagugu

SEQ ID NO: 918765 - RNA, 23 nt, Human
ggcagcugggcagcacucauggg

SEQ ID NO: 918766 - RNA, 22 nt, Human
ccugggcugcucauggggauga

SEQ ID NO: 918767 - RNA, 22 nt, Human
agaaguuguucaagguggugag

SEQ ID NO: 918768 - RNA, 22 nt, Human
ggagaaggcgaagucauucuuu

SEQ ID NO: 918769 - RNA, 22 nt, Human
gaaaguauuagccuagaaguca

SEQ ID NO: 918770 - RNA, 23 nt, Human
caaaaguuagcccuucccaucuc

SEQ ID NO: 918771 - RNA, 22 nt, Human
cagaaaacaaaccuauccugag

SEQ ID NO: 918772 - RNA, 22 nt, Human
uguaugcauaaaauuauuuaca

SEQ ID NO: 918773 - RNA, 22 nt, Human
agagaagacuuacagccacagu

SEQ ID NO: 918774 - RNA, 22 nt, Human
gccaaacuacaaguuaaauuuu

SEQ ID NO: 918775 - RNA, 22 nt, Human
agaaaucuuuccugaaguguuu

SEQ ID NO: 918776 - RNA, 22 nt, Human
acccaggagacagguugcagug

SEQ ID NO: 918777 - RNA, 22 nt, Human
ugcagagguguugcugagauaa

SEQ ID NO: 918778 - RNA, 22 nt, Human
gcacacaugcaugugugcaucc

SEQ ID NO: 918779 - RNA, 22 nt, Human
guccagcccucugccuccaggu

SEQ ID NO: 918780 - RNA, 22 nt, Human
ugagaagcagcuuacagguguc

SEQ ID NO: 918781 - RNA, 22 nt, Human
acuuuguuuuauagcacauaag

SEQ ID NO: 918782 - RNA, 22 nt, Human
auauguacacuuacguuacaaa

SEQ ID NO: 918783 - RNA, 22 nt, Human
ggagugaguggccuugucacug

SEQ ID NO: 918784 - RNA, 22 nt, Human
uucagugguuugaugauguaua

SEQ ID NO: 918785 - RNA, 22 nt, Human
ucagcugccuuucccaugcuag

SEQ ID NO: 918786 - RNA, 21 nt, Human
caguuuaauaacaaagaagga

SEQ ID NO: 918787 - RNA, 22 nt, Human
aaaaugcuauuucauggaggag

SEQ ID NO: 918788 - RNA, 22 nt, Human
ugguccuggggaucugcaguga

SEQ ID NO: 918789 - RNA, 22 nt, Human
gcccugagaggcaaugacucuu

SEQ ID NO: 918790 - RNA, 22 nt, Human
cagaagcagauucuaaagcaag

SEQ ID NO: 918791 - RNA, 22 nt, Human
uaccaaauguaaucauucuaau

SEQ ID NO: 918792 - RNA, 22 nt, Human
ugcacuauuucgccaugguugu

SEQ ID NO: 918793 - RNA, 17 nt, Human
cccagcugcgucugagg

SEQ ID NO: 918794 - RNA, 22 nt, Human
aguucuauuggguagguucugu

SEQ ID NO: 918795 - RNA, 22 nt, Human
augugucuuugagacucugcua

SEQ ID NO: 918796 - RNA, 22 nt, Human
aggcacaggaggugguaagaag

SEQ ID NO: 918797 - RNA, 22 nt, Human
ggcuccacaauuacacacugga

SEQ ID NO: 918798 - RNA, 22 nt, Human
uucaucuggucuaguuuuuagu

SEQ ID NO: 918799 - RNA, 22 nt, Human
augagguaauagggcagugggg

SEQ ID NO: 918800 - RNA, 22 nt, Human
ucucccacugcaagcccaggcu

SEQ ID NO: 918801 - RNA, 22 nt, Human
cugcagggcauuguaacucuuu

SEQ ID NO: 918802 - RNA, 22 nt, Human
ugugggucauaguaucguguua

SEQ ID NO: 918803 - RNA, 22 nt, Human
uccauccacauuaacagauacg

SEQ ID NO: 918804 - RNA, 22 nt, Human
ucagcuguacugugccauagcu

SEQ ID NO: 918805 - RNA, 22 nt, Human
cccaggagaucuggaucucguc

SEQ ID NO: 918806 - RNA, 22 nt, Human
gguuauuuugguugucuaaggc

SEQ ID NO: 918807 - RNA, 22 nt, Human
cauaacauguacauauaaaugc

SEQ ID NO: 918808 - RNA, 22 nt, Human
gccaccagccccaugcgcugug

SEQ ID NO: 918809 - RNA, 22 nt, Human
uuggaauucagcuugcuuauaa

SEQ ID NO: 918810 - RNA, 22 nt, Human
acaguaagcgggguuggagggc

SEQ ID NO: 918811 - RNA, 22 nt, Human
ucucugucugcacccaaucaau

SEQ ID NO: 918812 - RNA, 22 nt, Human
cacccacauuccaucacucugc

SEQ ID NO: 918813 - RNA, 22 nt, Human
ucaauucuagagccuuacauug

SEQ ID NO: 918814 - RNA, 18 nt, Human
uggaaucauugucaccau

SEQ ID NO: 918815 - RNA, 22 nt, Human
uggucugauaccggauuccagu

SEQ ID NO: 918816 - RNA, 20 nt, Human
ucacagcuggcuaugacagg

SEQ ID NO: 918817 - RNA, 22 nt, Human
cugcucuaggucauggguacuu

SEQ ID NO: 918818 - RNA, 22 nt, Human
uccuggauucugcccugaaggc

SEQ ID NO: 918819 - RNA, 22 nt, Human
uauaguacacuuagguacuuca

SEQ ID NO: 918820 - RNA, 22 nt, Human
cuuuaguuauuuagacuacagu

SEQ ID NO: 918821 - RNA, 22 nt, Human
caggccagagcgcgugguuggg

SEQ ID NO: 918822 - RNA, 22 nt, Human
aagaugcacaauguggcaauua

SEQ ID NO: 918823 - RNA, 22 nt, Human
acagagagaggcccgaggcugc

SEQ ID NO: 918824 - RNA, 22 nt, Human
ucuagucauucaugcuaugauu

SEQ ID NO: 918825 - RNA, 22 nt, Human
augcacaucuuacagaugcaga

SEQ ID NO: 918826 - RNA, 22 nt, Human
uuuggggcucagcaggcuguuu

SEQ ID NO: 918827 - RNA, 22 nt, Human
ccuuuagaauacagacuuucua

SEQ ID NO: 918828 - RNA, 22 nt, Human
cuguuguauuauucaauauuau

SEQ ID NO: 918829 - RNA, 22 nt, Human
aagaugauuauguagauuggga

SEQ ID NO: 918830 - RNA, 22 nt, Human
cccuggaguccuggcaguugau

SEQ ID NO: 918831 - RNA, 22 nt, Human
aggcuggggaauugaauuugcu

SEQ ID NO: 918832 - RNA, 22 nt, Human
auggcauuaggaccaugagccu

SEQ ID NO: 918833 - RNA, 22 nt, Human
uggcagcaaaaccagaaucaga

SEQ ID NO: 918834 - RNA, 22 nt, Human
cagugaggugcccagccugccc

SEQ ID NO: 918835 - RNA, 22 nt, Human
uuuaggaaugugguuuuugagc

SEQ ID NO: 918836 - RNA, 17 nt, Human
agugucagggcccuucc

SEQ ID NO: 918837 - RNA, 22 nt, Human
cucuggcugccucucaggccug

SEQ ID NO: 918838 - RNA, 22 nt, Human
uuuuaguuacugcaguagcaaa

SEQ ID NO: 918839 - RNA, 21 nt, Human
cacacagugaucuauccacau

SEQ ID NO: 918840 - RNA, 20 nt, Human
ccagaagguaggauggaaca

SEQ ID NO: 918841 - RNA, 22 nt, Human
aaacaaagccagggaaguuaug

SEQ ID NO: 918842 - RNA, 22 nt, Human
ugggccuccuggaagaaugugg

SEQ ID NO: 918843 - RNA, 22 nt, Human
gcagagugaagggagaggugug

SEQ ID NO: 918844 - RNA, 22 nt, Human
ugagcuagggcuggugaggagc

SEQ ID NO: 918845 - RNA, 22 nt, Human
ugggggugcccuaugaggaagc

SEQ ID NO: 918846 - RNA, 22 nt, Human
auuauauuugaaagguuggaag

SEQ ID NO: 918847 - RNA, 22 nt, Human
ggaggccuagaaaagugguucu

SEQ ID NO: 918848 - RNA, 22 nt, Human
aguguggucgggagcgcggggc

SEQ ID NO: 918849 - RNA, 22 nt, Human
uccaagucuuccuucccaaacc

SEQ ID NO: 918850 - RNA, 20 nt, Human
uacaaagaaugagguucagg

SEQ ID NO: 918851 - RNA, 22 nt, Human
ggcccagucuggggcccuguga

SEQ ID NO: 918852 - RNA, 22 nt, Human
guaaaucauggucagaauaaau

SEQ ID NO: 918853 - RNA, 22 nt, Human
gucauauuauaaauguucuguu

SEQ ID NO: 918854 - RNA, 22 nt, Human
ucuuaagaaagugacaaauagg

SEQ ID NO: 918855 - RNA, 22 nt, Human
caggcucccugccagggccggc

SEQ ID NO: 918856 - RNA, 22 nt, Human
ugggcuacucugggagccuaac

SEQ ID NO: 918857 - RNA, 22 nt, Human
uagaaucuaguucauucauuug

SEQ ID NO: 918858 - RNA, 22 nt, Human
gagcuggccucaggcacaggag

SEQ ID NO: 918859 - RNA, 22 nt, Human
ugugugugaguccuggcuuucc

SEQ ID NO: 918860 - RNA, 22 nt, Human
cugcaucauaaaauuuagaguu

SEQ ID NO: 918861 - RNA, 22 nt, Human
ugcugcagacgaagcccaugcc

SEQ ID NO: 918862 - RNA, 22 nt, Human
cuggcuccaucacugggugaug

SEQ ID NO: 918863 - RNA, 22 nt, Human
gucaacauuuacugcccuggcc

SEQ ID NO: 918864 - RNA, 22 nt, Human
ucuggcccaucuucugccacca

SEQ ID NO: 918865 - RNA, 22 nt, Human
ggcugcagaggucacuuuauag

SEQ ID NO: 918866 - RNA, 22 nt, Human
ggguggagaggcuaaguccagu

SEQ ID NO: 918867 - RNA, 20 nt, Human
ugccagggccagcagaggcu

SEQ ID NO: 918868 - RNA, 22 nt, Human
agggaccucuucuugcagcuga

SEQ ID NO: 918869 - RNA, 22 nt, Human
auuuuagagcuccaaguacagc

SEQ ID NO: 918870 - RNA, 22 nt, Human
uaacauuagguagacauaagcc

SEQ ID NO: 918871 - RNA, 22 nt, Human
cuagagaagagguuaagcauga

SEQ ID NO: 918872 - RNA, 22 nt, Human
ugcaaacaccacagagacaauu

SEQ ID NO: 918873 - RNA, 22 nt, Human
acauaagugcacaauaaauauu

SEQ ID NO: 918874 - RNA, 22 nt, Human
ugggaauggaugcuaagugcua

SEQ ID NO: 918875 - RNA, 22 nt, Human
uaggggagcucgggugcaaucg

SEQ ID NO: 918876 - RNA, 20 nt, Human
ugcagcagaagcccaugcuc

SEQ ID NO: 918877 - RNA, 20 nt, Human
gaaacauuggcagcaacuga

SEQ ID NO: 918878 - RNA, 22 nt, Human
cuuugccuccuagagcacguuc

SEQ ID NO: 918879 - RNA, 19 nt, Human
auuuauuguaugauuccau

SEQ ID NO: 918880 - RNA, 21 nt, Human
agcauucaaaagaugccauaa

SEQ ID NO: 918881 - RNA, 22 nt, Human
gaacauuuccagaaaggaacua

SEQ ID NO: 918882 - RNA, 22 nt, Human
uuugcaaacauucagggcucca

SEQ ID NO: 918883 - RNA, 22 nt, Human
augcacaggaccacacauaaug

SEQ ID NO: 918884 - RNA, 22 nt, Human
guccuggguccccgcaggucag

SEQ ID NO: 918885 - RNA, 22 nt, Human
ccagcuuuauagcuucaaagga

SEQ ID NO: 918886 - RNA, 19 nt, Human
cauuacaaauuuguaggga

SEQ ID NO: 918887 - RNA, 23 nt, Human
uucauugagcuguucuugaggau

SEQ ID NO: 918888 - RNA, 22 nt, Human
cuccaggacugaggacagagcu

SEQ ID NO: 918889 - RNA, 22 nt, Human
ccucccucccugcagaagccac

SEQ ID NO: 918890 - RNA, 22 nt, Human
cacagaaauauugugucccuug

SEQ ID NO: 918891 - RNA, 22 nt, Human
caguuucugggcguucacaggu

SEQ ID NO: 918892 - RNA, 22 nt, Human
gagcuguccuaccaggaguccu

SEQ ID NO: 918893 - RNA, 19 nt, Human
cucucagccugucuccuug

SEQ ID NO: 918894 - RNA, 22 nt, Human
acagugugacaauugugucaga

SEQ ID NO: 918895 - RNA, 22 nt, Human
caaauaagcaauuccauucuuc

SEQ ID NO: 918896 - RNA, 22 nt, Human
ucagaggugcaagaaguucuga

SEQ ID NO: 918897 - RNA, 22 nt, Human
cuacaguagagaggauguagaa

SEQ ID NO: 918898 - RNA, 22 nt, Human
acuggcuggccgcgcucuucgc

SEQ ID NO: 918899 - RNA, 20 nt, Human
gauacacagcacagagggcc

SEQ ID NO: 918900 - RNA, 22 nt, Human
gaacaugaaaagucuuacacgc

SEQ ID NO: 918901 - RNA, 22 nt, Human
caaaguuuaaaguagauuucag

SEQ ID NO: 918902 - RNA, 22 nt, Human
gugugccuguaucaugguaacc

SEQ ID NO: 918903 - RNA, 22 nt, Human
aacauucugucaauugaugacc

SEQ ID NO: 918904 - RNA, 22 nt, Human
auucacagaauaguuuuaccag

SEQ ID NO: 918905 - RNA, 22 nt, Human
aacaauugacacuucauuguga

SEQ ID NO: 918906 - RNA, 22 nt, Human
caagcugccaccagaagagcau

SEQ ID NO: 918907 - RNA, 22 nt, Human
uauugugaauuuggaagcaaug

SEQ ID NO: 918908 - RNA, 22 nt, Human
ucacuuauaaaaugcaagaucu

SEQ ID NO: 918909 - RNA, 23 nt, Human
uaauuagauguugauuccugaga

SEQ ID NO: 918910 - RNA, 21 nt, Human
cacuugaaugguguuuuacaa

SEQ ID NO: 918911 - RNA, 22 nt, Human
gcugggcccagaucccaggauc

SEQ ID NO: 918912 - RNA, 22 nt, Human
ugaccaggauacugcagggaug

SEQ ID NO: 918913 - RNA, 20 nt, Human
auguucuucauuuaauguuc

SEQ ID NO: 918914 - RNA, 22 nt, Human
uggcagugaugcuuaugguuug

SEQ ID NO: 918915 - RNA, 22 nt, Human
acagccaggacuuggcccucuu

SEQ ID NO: 918916 - RNA, 22 nt, Human
acuccaggguuuugcaccugga

SEQ ID NO: 918917 - RNA, 22 nt, Human
uguccaagaacagacugccagg

SEQ ID NO: 918918 - RNA, 22 nt, Human
aacauuuauugagcaccuacug

SEQ ID NO: 918919 - RNA, 22 nt, Human
gagggcugcuggaaaaaugcag

SEQ ID NO: 918920 - RNA, 22 nt, Human
ugggucaggcugggaguccuga

SEQ ID NO: 918921 - RNA, 22 nt, Human
agcagccacccagcugcucauu

SEQ ID NO: 918922 - RNA, 22 nt, Human
ggaagaaagcacacaaacuuga

SEQ ID NO: 918923 - RNA, 22 nt, Human
gccauggcccauaccaggugca

SEQ ID NO: 918924 - RNA, 22 nt, Human
uucuuaggagcauuaguaauuu

SEQ ID NO: 918925 - RNA, 22 nt, Human
auauauuuuuugagacagaguc

SEQ ID NO: 918926 - RNA, 22 nt, Human
cucugggcuccuucagcccuuu

SEQ ID NO: 918927 - RNA, 22 nt, Human
gcagacaggcccaguggaggga

SEQ ID NO: 918928 - RNA, 22 nt, Human
uucaaauuugguaugcaagcca

SEQ ID NO: 918929 - RNA, 19 nt, Human
ccccaggguaggcuagggg

SEQ ID NO: 918930 - RNA, 22 nt, Human
aagauuuguggauuuaaggaua

SEQ ID NO: 918931 - RNA, 22 nt, Human
aaggaggcacucgcucucaggg

SEQ ID NO: 918932 - RNA, 22 nt, Human
cugggcacuuuggggagccuac

SEQ ID NO: 918933 - RNA, 22 nt, Human
gcugggcuugguuucccugcuu

SEQ ID NO: 918934 - RNA, 22 nt, Human
agagaauuacagaagaauguca

SEQ ID NO: 918935 - RNA, 22 nt, Human
ugucaggucucugugaugguaa

SEQ ID NO: 918936 - RNA, 22 nt, Human
ucacaaaagcuuuugaauuugg

SEQ ID NO: 918937 - RNA, 17 nt, Human
cccugggugaguucuca

SEQ ID NO: 918938 - RNA, 22 nt, Human
cagcugagagacaaugagucau

SEQ ID NO: 918939 - RNA, 22 nt, Human
cucccaagggguaagggagcug

SEQ ID NO: 918940 - RNA, 22 nt, Human
ucugcucuguggcuucagcuaa

SEQ ID NO: 918941 - RNA, 22 nt, Human
auucaguuuuuauuggaccagc

SEQ ID NO: 918942 - RNA, 22 nt, Human
uguuaacagaggucauuuuggg

SEQ ID NO: 918943 - RNA, 22 nt, Human
agggcuccaaggaaguguagcu

SEQ ID NO: 918944 - RNA, 22 nt, Human
cucggcagguggagguuguagu

SEQ ID NO: 918945 - RNA, 22 nt, Human
ugcauauugugaaaauguagau

SEQ ID NO: 918946 - RNA, 22 nt, Human
gaggggaagacuucuggacagu

SEQ ID NO: 918947 - RNA, 22 nt, Human
ucuggagccacaaaccucagcu

SEQ ID NO: 918948 - RNA, 22 nt, Human
auguuuaaucggcugccuuucc

SEQ ID NO: 918949 - RNA, 22 nt, Human
caagaucaaguguaguaucaaa

SEQ ID NO: 918950 - RNA, 23 nt, Human
ucuucacagggcuucccaugugc

SEQ ID NO: 918951 - RNA, 22 nt, Human
cacccagcagcacuuaagacua

SEQ ID NO: 918952 - RNA, 22 nt, Human
acaagucacucuaucauuuuca

SEQ ID NO: 918953 - RNA, 22 nt, Human
uagaauauacacuacagcuuaa

SEQ ID NO: 918954 - RNA, 23 nt, Human
agggcaugaagcagaggacgugg

SEQ ID NO: 918955 - RNA, 22 nt, Human
aauuacacagggaucacuuuuu

SEQ ID NO: 918956 - RNA, 22 nt, Human
ucauggacgucaccaugguccu

SEQ ID NO: 918957 - RNA, 22 nt, Human
gaaaauguuuccuguuauuugc

SEQ ID NO: 918958 - RNA, 20 nt, Human
ggaaaaaugcaugcucaaga

SEQ ID NO: 918959 - RNA, 22 nt, Human
uacaguagcugagguucucagg

SEQ ID NO: 918960 - RNA, 22 nt, Human
agauacagccugccagguucuu

SEQ ID NO: 918961 - RNA, 22 nt, Human
ugcacacaaaugugaacgugcc

SEQ ID NO: 918962 - RNA, 22 nt, Human
cccacauuuuugagucuucauc

SEQ ID NO: 918963 - RNA, 22 nt, Human
ucuuuacuggaauggaacuuuc

SEQ ID NO: 918964 - RNA, 17 nt, Human
gagugcagacacaagca

SEQ ID NO: 918965 - RNA, 22 nt, Human
gcagccagggagagaaccaggg

SEQ ID NO: 918966 - RNA, 22 nt, Human
acaguaaaucaacagaauaucu

SEQ ID NO: 918967 - RNA, 22 nt, Human
uggaaucucuuuggggacugaa

SEQ ID NO: 918968 - RNA, 22 nt, Human
ccugaaaauauccucuccuuug

SEQ ID NO: 918969 - RNA, 21 nt, Human
aggcagccagucaugcucccu

SEQ ID NO: 918970 - RNA, 22 nt, Human
uuucaguucuguacaaguccag

SEQ ID NO: 918971 - RNA, 20 nt, Human
uggugagagcaccugauggg

SEQ ID NO: 918972 - RNA, 22 nt, Human
acuccagggguugcuauuuaca

SEQ ID NO: 918973 - RNA, 22 nt, Human
augagcaagagcuauguacaga

SEQ ID NO: 918974 - RNA, 22 nt, Human
cuguggcuaauaauuaguauuu

SEQ ID NO: 918975 - RNA, 22 nt, Human
aaguggagcuauaggcucagau

SEQ ID NO: 918976 - RNA, 22 nt, Human
uccagaaaaaguaauuuauuug

SEQ ID NO: 918977 - RNA, 22 nt, Human
agaagauuauuagagacuuugu

SEQ ID NO: 918978 - RNA, 20 nt, Human
ggcauuuaugaaccaagccu

SEQ ID NO: 918979 - RNA, 22 nt, Human
ugacaguuuauuuugcagaaug

SEQ ID NO: 918980 - RNA, 22 nt, Human
aguggcuuggcugcacuacagg

SEQ ID NO: 918981 - RNA, 22 nt, Human
uagcugugagcacccaggcugu

SEQ ID NO: 918982 - RNA, 22 nt, Human
gcaagauagaguugcaaauauu

SEQ ID NO: 918983 - RNA, 22 nt, Human
gaggccagacugccuuuuauga

SEQ ID NO: 918984 - RNA, 22 nt, Human
aggagcugauagucuauggaga

SEQ ID NO: 918985 - RNA, 22 nt, Human
ucugucugacuaccaugaggca

SEQ ID NO: 918986 - RNA, 22 nt, Human
uauuccuaauacuuguuuuggg

SEQ ID NO: 918987 - RNA, 22 nt, Human
uucuccugcgcaggcccaggga

SEQ ID NO: 918988 - RNA, 22 nt, Human
acacauuaaaacgucuacaaug

SEQ ID NO: 918989 - RNA, 19 nt, Human
uaacaggggaaaaugauca

SEQ ID NO: 918990 - RNA, 22 nt, Human
gagcacagauccuggagccaca

SEQ ID NO: 918991 - RNA, 22 nt, Human
cuucuucucaaggggcaggugg

SEQ ID NO: 918992 - RNA, 22 nt, Human
cagcagguauguuuguucagca

SEQ ID NO: 918993 - RNA, 22 nt, Human
ugagaccucuggguucugagcu

SEQ ID NO: 918994 - RNA, 22 nt, Human
uccagacucacucaugugacua

SEQ ID NO: 918995 - RNA, 22 nt, Human
ucuugcugaaaacaaaucucuu

SEQ ID NO: 918996 - RNA, 22 nt, Human
ucuaguuuucucaaaugacuug

SEQ ID NO: 918997 - RNA, 23 nt, Human
ucacuaaaguguuuagugcagau

SEQ ID NO: 918998 - RNA, 20 nt, Human
ucuggugccccuuccugaga

SEQ ID NO: 918999 - RNA, 22 nt, Human
uguuaaacagauauugcccaca

SEQ ID NO: 919000 - RNA, 22 nt, Human
aguggcaggaucucgguucacu

SEQ ID NO: 919001 - RNA, 19 nt, Human
gggaccugacuaauuggca

SEQ ID NO: 919002 - RNA, 22 nt, Human
agaaagcuccccaugagaugau

SEQ ID NO: 919003 - RNA, 22 nt, Human
cagcuucccuuggcugagcaga

SEQ ID NO: 919004 - RNA, 21 nt, Human
uccaggaguucuaauaggugu

SEQ ID NO: 919005 - RNA, 18 nt, Human
augcuacaggcagguguc

SEQ ID NO: 919006 - RNA, 22 nt, Human
ucauuucugagccuuccaugau

SEQ ID NO: 919007 - RNA, 22 nt, Human
aguggcugugaaauacauggga

SEQ ID NO: 919008 - RNA, 22 nt, Human
gccuccuauuaaaauuuaccuu

SEQ ID NO: 919009 - RNA, 22 nt, Human
ucuguggcauguugcacuugua

SEQ ID NO: 919010 - RNA, 17 nt, Human
ucugggcuucagugguc

SEQ ID NO: 919011 - RNA, 22 nt, Human
caggagcuggaucuccuugcgg

SEQ ID NO: 919012 - RNA, 22 nt, Human
agguauaacuuuaugcauggaa

SEQ ID NO: 919013 - RNA, 22 nt, Human
ucuuuaugagaaaaagauugua

SEQ ID NO: 919014 - RNA, 19 nt, Human
cauuuucucauugugcccc

SEQ ID NO: 919015 - RNA, 22 nt, Human
aagguacaaaguuauacagcgu

SEQ ID NO: 919016 - RNA, 22 nt, Human
caaauagacuuaagcaucugua

SEQ ID NO: 919017 - RNA, 23 nt, Human
ccucccaccuauuucacuuucuu

SEQ ID NO: 919018 - RNA, 22 nt, Human
aaguuauaucaucucauugacg

SEQ ID NO: 919019 - RNA, 22 nt, Human
cagccagcuucagauccaagcc

SEQ ID NO: 919020 - RNA, 20 nt, Human
ucagccagcuaacaugggga

SEQ ID NO: 919021 - RNA, 22 nt, Human
ccuuuccuguguccuuuuaagg

SEQ ID NO: 919022 - RNA, 22 nt, Human
cuuugaaaaaugguuuccuaga

SEQ ID NO: 919023 - RNA, 22 nt, Human
cuucucuaugauguucuaaggu

SEQ ID NO: 919024 - RNA, 22 nt, Human
ugccugccucaggccgagugcu

SEQ ID NO: 919025 - RNA, 22 nt, Human
aagacauugcugcuuuuaauug

SEQ ID NO: 919026 - RNA, 22 nt, Human
ccacagcugaccgcaggugagc

SEQ ID NO: 919027 - RNA, 22 nt, Human
ucuguucaguugauuagacaga

SEQ ID NO: 919028 - RNA, 22 nt, Human
gacaauguaaaucaggauagca

SEQ ID NO: 919029 - RNA, 22 nt, Human
aucugcuuuugagaauuuacuu

SEQ ID NO: 919030 - RNA, 22 nt, Human
agugucuuucucucuccaagug

SEQ ID NO: 919031 - RNA, 22 nt, Human
ucaggagugccaguaccuuuug

SEQ ID NO: 919032 - RNA, 22 nt, Human
uaucuaagagagucaauauuua

SEQ ID NO: 919033 - RNA, 22 nt, Human
ggaggaggcggcagaaguuccu

SEQ ID NO: 919034 - RNA, 22 nt, Human
ggaugcaggggcagcagagccu

SEQ ID NO: 919035 - RNA, 22 nt, Human
gaauuauaggcaaagcagucau

SEQ ID NO: 919036 - RNA, 23 nt, Human
cugugcugggucccaucuugggc

SEQ ID NO: 919037 - RNA, 22 nt, Human
gcaggcugugguauguugggca

SEQ ID NO: 919038 - RNA, 22 nt, Human
gaaaucauuagcaaagauaugu

SEQ ID NO: 919039 - RNA, 22 nt, Human
cuggagaggcugggaacagguu

SEQ ID NO: 919040 - RNA, 22 nt, Human
auuucuuaaaacuucagggaga

SEQ ID NO: 919041 - RNA, 22 nt, Human
caaguaaagaaucacauuucuu

SEQ ID NO: 919042 - RNA, 22 nt, Human
ucuguucauaguaguguauaug

SEQ ID NO: 919043 - RNA, 22 nt, Human
gaggccuggaccagccacagag

SEQ ID NO: 919044 - RNA, 17 nt, Human
guguucacaaugacugu

SEQ ID NO: 919045 - RNA, 22 nt, Human
gggcuucagcuggggauggagc

SEQ ID NO: 919046 - RNA, 22 nt, Human
uguucucuucucauugaacaug

SEQ ID NO: 919047 - RNA, 20 nt, Human
uggaaguucuguugcauugg

SEQ ID NO: 919048 - RNA, 22 nt, Human
gcagggcacacaagaaugauaa

SEQ ID NO: 919049 - RNA, 22 nt, Human
cagccucugagccuuggcagau

SEQ ID NO: 919050 - RNA, 22 nt, Human
gguaacaacccuacaaauccac

SEQ ID NO: 919051 - RNA, 22 nt, Human
uaacagaaauaguaggugaggg

SEQ ID NO: 919052 - RNA, 22 nt, Human
guuaaacaauaacuggcacaca

SEQ ID NO: 919053 - RNA, 22 nt, Human
ccagagacaaggagcuggaguc

SEQ ID NO: 919054 - RNA, 22 nt, Human
auccauucuaugugaaaugucc

SEQ ID NO: 919055 - RNA, 22 nt, Human
cuccugugggucaccaauaggc

SEQ ID NO: 919056 - RNA, 22 nt, Human
uaaaccuuauuugaauaccaac

SEQ ID NO: 919057 - RNA, 14 nt, Human
gcagguggaucacu

SEQ ID NO: 919058 - RNA, 22 nt, Human
acagcuggagugaggauggagu

SEQ ID NO: 919059 - RNA, 22 nt, Human
agugacaggggaggcaggugug

SEQ ID NO: 919060 - RNA, 22 nt, Human
uaguaaguucucgcauuguuau

SEQ ID NO: 919061 - RNA, 22 nt, Human
ugagcagagacgggggccucca

SEQ ID NO: 919062 - RNA, 22 nt, Human
auaguauuuccagaaauagucu

SEQ ID NO: 919063 - RNA, 22 nt, Human
uauugacaauaggcaacugagg

SEQ ID NO: 919064 - RNA, 22 nt, Human
gaugcauucgggauguuuacuu

SEQ ID NO: 919065 - RNA, 22 nt, Human
uuuuuucagccugucugugcca

SEQ ID NO: 919066 - RNA, 22 nt, Human
ggagcugaaggggugggcucag

SEQ ID NO: 919067 - RNA, 22 nt, Human
aaacuucuggcuacaagcaaua

SEQ ID NO: 919068 - RNA, 22 nt, Human
aaacaaugacaacacagcugcg

SEQ ID NO: 919069 - RNA, 19 nt, Human
acucuacaguguguacaac

SEQ ID NO: 919070 - RNA, 22 nt, Human
cauggggaugaggcugagacuu

SEQ ID NO: 919071 - RNA, 22 nt, Human
uucucuuuuagaggcuccauga

SEQ ID NO: 919072 - RNA, 22 nt, Human
ggccagcucuuguccacggagg

SEQ ID NO: 919073 - RNA, 18 nt, Human
cuagggcuguggcucuca

SEQ ID NO: 919074 - RNA, 22 nt, Human
ggcuccagaaaucauagagcag

SEQ ID NO: 919075 - RNA, 22 nt, Human
gucugcugugccuuggggaaaa

SEQ ID NO: 919076 - RNA, 23 nt, Human
ucaagcaauaauugguaauagug

SEQ ID NO: 919077 - RNA, 22 nt, Human
aagcucuuguugaaucuuguca

SEQ ID NO: 919078 - RNA, 22 nt, Human
cucagccccaauuugcccucuu

SEQ ID NO: 919079 - RNA, 22 nt, Human
gggcagauggggcacaggcuga

SEQ ID NO: 919080 - RNA, 22 nt, Human
agcuguuuucuucuaggaagac

SEQ ID NO: 919081 - RNA, 21 nt, Human
acucauuugucugcaucuaau

SEQ ID NO: 919082 - RNA, 22 nt, Human
ucuccaucugucauucuugucc

SEQ ID NO: 919083 - RNA, 22 nt, Human
acaacuucucacagauaaauuu

SEQ ID NO: 919084 - RNA, 22 nt, Human
uacucauugauuccuuuacuca

SEQ ID NO: 919085 - RNA, 22 nt, Human
gacaaaacacauuaguuuaaaa

SEQ ID NO: 919086 - RNA, 22 nt, Human
uuugcaaacuuuccucuggacc

SEQ ID NO: 919087 - RNA, 22 nt, Human
cauugagaaucugggcuacagc

SEQ ID NO: 919088 - RNA, 22 nt, Human
cugagaguagcuggagaacauu

SEQ ID NO: 919089 - RNA, 22 nt, Human
gccaggcuggggggagaugucu

SEQ ID NO: 919090 - RNA, 22 nt, Human
ucucuauuaauugacaauggcu

SEQ ID NO: 919091 - RNA, 22 nt, Human
cugggccugggaggccaggucu

SEQ ID NO: 919092 - RNA, 18 nt, Human
aggcagcagcaucuucuc

SEQ ID NO: 919093 - RNA, 22 nt, Human
agcagcagggugauagugccca

SEQ ID NO: 919094 - RNA, 20 nt, Human
aggagccauugacugcagca

SEQ ID NO: 919095 - RNA, 22 nt, Human
aggugggguguuggauguuuau

SEQ ID NO: 919096 - RNA, 22 nt, Human
aauucaaucuguagauugugau

SEQ ID NO: 919097 - RNA, 22 nt, Human
agcagcuugagcuggggcuggc

SEQ ID NO: 919098 - RNA, 22 nt, Human
ucugcuggaaaaccagggaauu

SEQ ID NO: 919099 - RNA, 22 nt, Human
uggcuacaguggcauaucaaau

SEQ ID NO: 919100 - RNA, 22 nt, Human
ggaccugugucuacagcaugug

SEQ ID NO: 919101 - RNA, 22 nt, Human
ucauuuaguucuuucaugucca

SEQ ID NO: 919102 - RNA, 22 nt, Human
cauucacaucuuguuccaucac

SEQ ID NO: 919103 - RNA, 22 nt, Human
gcaggacuuuguggaugaugga

SEQ ID NO: 919104 - RNA, 22 nt, Human
auucaaaagaccaugcagacuc

SEQ ID NO: 919105 - RNA, 22 nt, Human
uggcuucuuuguagaaauugaa

SEQ ID NO: 919106 - RNA, 19 nt, Human
aguggcagaucuggaagua

SEQ ID NO: 919107 - RNA, 22 nt, Human
ugcccuggcgcugucucuaugg

SEQ ID NO: 919108 - RNA, 19 nt, Human
ccugugcuaggagcugacc

SEQ ID NO: 919109 - RNA, 22 nt, Human
uggaagaggcccaugacugccu

SEQ ID NO: 919110 - RNA, 22 nt, Human
gugcucuaggcuacagggaugc

SEQ ID NO: 919111 - RNA, 22 nt, Human
guccuuggcuguggcuguaaug

SEQ ID NO: 919112 - RNA, 22 nt, Human
aagcugccagauucagucugcu

SEQ ID NO: 919113 - RNA, 22 nt, Human
auuuacagugugccuacuauau

SEQ ID NO: 919114 - RNA, 22 nt, Human
ugcuggccugggcugcaccuug

SEQ ID NO: 919115 - RNA, 22 nt, Human
ugcugugauggagaauucugga

SEQ ID NO: 919116 - RNA, 22 nt, Human
cagaacagaaacguuguuccau

SEQ ID NO: 919117 - RNA, 22 nt, Human
uaaguuaucggaguguguuuca

SEQ ID NO: 919118 - RNA, 22 nt, Human
caggcagaggcuuuucauggcu

SEQ ID NO: 919119 - RNA, 22 nt, Human
aaaggcuaguggauucauugau

SEQ ID NO: 919120 - RNA, 22 nt, Human
agucacagguucuugggauuag

SEQ ID NO: 919121 - RNA, 22 nt, Human
uguccuuugggagggcacagcu

SEQ ID NO: 919122 - RNA, 22 nt, Human
ggcaccagcaggcaccgaugcc

SEQ ID NO: 919123 - RNA, 22 nt, Human
auacaauuauucugcagauauu

SEQ ID NO: 919124 - RNA, 22 nt, Human
acucagaggaaaguugagauug

SEQ ID NO: 919125 - RNA, 22 nt, Human
cucuuagauauggagaauuacc

SEQ ID NO: 919126 - RNA, 22 nt, Human
uuaauucugccuuucauguaac

SEQ ID NO: 919127 - RNA, 22 nt, Human
uuuuaucuaccuaugcucauuu

SEQ ID NO: 919128 - RNA, 22 nt, Human
uuauguuuuaaguguguaucuu

SEQ ID NO: 919129 - RNA, 22 nt, Human
cagcuucuccauucuucuggcu

SEQ ID NO: 919130 - RNA, 22 nt, Human
gaaucacacucguaagugaguu

SEQ ID NO: 919131 - RNA, 22 nt, Human
ccagugcccagucucccugguc

SEQ ID NO: 919132 - RNA, 22 nt, Human
uauaagcacauccuugacugau

SEQ ID NO: 919133 - RNA, 22 nt, Human
auuuacacauucauaagauuuc

SEQ ID NO: 919134 - RNA, 22 nt, Human
uuuucauguuccuuguuaagug

SEQ ID NO: 919135 - RNA, 22 nt, Human
gacauugaguauuucuuuucuc

SEQ ID NO: 919136 - RNA, 23 nt, Human
guguggcagcgcugugguuagcu

SEQ ID NO: 919137 - RNA, 22 nt, Human
ggcuuggaauugguaggaugua

SEQ ID NO: 919138 - RNA, 22 nt, Human
aaggcugagacagcacaggucc

SEQ ID NO: 919139 - RNA, 22 nt, Human
uaaacagagaagacuuugagca

SEQ ID NO: 919140 - RNA, 22 nt, Human
uuagauacgcaggcaguuuuaa

SEQ ID NO: 919141 - RNA, 22 nt, Human
ugcagggauccuagcugaagag

SEQ ID NO: 919142 - RNA, 22 nt, Human
acaaaaguguaggaauuccuua

SEQ ID NO: 919143 - RNA, 22 nt, Human
gugcauauaugugcagcaucaa

SEQ ID NO: 919144 - RNA, 22 nt, Human
ugcugucccccgugucugggcu

SEQ ID NO: 919145 - RNA, 19 nt, Human
ucuacaaaguggcaucagg

SEQ ID NO: 919146 - RNA, 22 nt, Human
ugauccuuccccuugaggaugg

SEQ ID NO: 919147 - RNA, 22 nt, Human
cacaaauaccaguuuccuaaca

SEQ ID NO: 919148 - RNA, 22 nt, Human
ccagagaccagaacauggggau

SEQ ID NO: 919149 - RNA, 22 nt, Human
gaagggcuuucugggagaagag

SEQ ID NO: 919150 - RNA, 23 nt, Human
aaaguacuuccacagcuaugauc

SEQ ID NO: 919151 - RNA, 22 nt, Human
caugcaggcgcaacuucuacaa

SEQ ID NO: 919152 - RNA, 22 nt, Human
uugaaaauaucacaggagcagc

SEQ ID NO: 919153 - RNA, 22 nt, Human
aaagcuauuuuauugcagcucu

SEQ ID NO: 919154 - RNA, 22 nt, Human
gcgagaaacuaagugcccuuug

SEQ ID NO: 919155 - RNA, 22 nt, Human
aaucuguuuaguucugcguaug

SEQ ID NO: 919156 - RNA, 22 nt, Human
ccuccaggaggaaauggaacac

SEQ ID NO: 919157 - RNA, 22 nt, Human
ucagagauucacgucaguccca

SEQ ID NO: 919158 - RNA, 22 nt, Human
ugucuguccugcuuccuuggac

SEQ ID NO: 919159 - RNA, 22 nt, Human
uaucuacaguuaauaugucauc

SEQ ID NO: 919160 - RNA, 22 nt, Human
cuguggccagauggugccaguu

SEQ ID NO: 919161 - RNA, 22 nt, Human
aaacauugagcacuugcuauuu

SEQ ID NO: 919162 - RNA, 22 nt, Human
uuaguucacugcuauaucauca

SEQ ID NO: 919163 - RNA, 22 nt, Human
uuuguguaccuuguacauuugu

SEQ ID NO: 919164 - RNA, 22 nt, Human
aacuguagugcuuauagacucu

SEQ ID NO: 919165 - RNA, 22 nt, Human
gaauacaaauaauaccaaggug

SEQ ID NO: 919166 - RNA, 20 nt, Human
uccugcagucgcuagcgccc

SEQ ID NO: 919167 - RNA, 19 nt, Human
gcagcaauagaagacaaau

SEQ ID NO: 919168 - RNA, 22 nt, Human
guagucugagcaagcagugugu

SEQ ID NO: 919169 - RNA, 22 nt, Human
ccuggagguggagguugcagug

SEQ ID NO: 919170 - RNA, 22 nt, Human
guuuuguucuuguccagggaaa

SEQ ID NO: 919171 - RNA, 23 nt, Human
gugugccuuuaucuucuguacuc

SEQ ID NO: 919172 - RNA, 22 nt, Human
aagagacaugaauacucgaagg

SEQ ID NO: 919173 - RNA, 22 nt, Human
uugcaaaugugaauaauuacac

SEQ ID NO: 919174 - RNA, 19 nt, Human
ucuucugacuucaagaaac

SEQ ID NO: 919175 - RNA, 22 nt, Human
uagcauuccaucuuggacuugu

SEQ ID NO: 919176 - RNA, 22 nt, Human
cugccucagcguuguggcccua

SEQ ID NO: 919177 - RNA, 22 nt, Human
gacccuggugggcacuggcacc

SEQ ID NO: 919178 - RNA, 22 nt, Human
uuggcagcacggggaacgucug

SEQ ID NO: 919179 - RNA, 20 nt, Human
acucuguagguaaugagacu

SEQ ID NO: 919180 - RNA, 22 nt, Human
ugccugaacaugaauaguuuau

SEQ ID NO: 919181 - RNA, 22 nt, Human
uuucacacugcagcaucagaga

SEQ ID NO: 919182 - RNA, 22 nt, Human
aacauuuauauggguucaugaa

SEQ ID NO: 919183 - RNA, 22 nt, Human
ucaauauuuuuaugagcauaga

SEQ ID NO: 919184 - RNA, 22 nt, Human
auccacagaaggaacuugaaag

SEQ ID NO: 919185 - RNA, 22 nt, Human
caguuaaacagauugaguguua

SEQ ID NO: 919186 - RNA, 23 nt, Human
agugacaaugggccagagguggc

SEQ ID NO: 919187 - RNA, 22 nt, Human
agugauauuagcaaaugguuau

SEQ ID NO: 919188 - RNA, 22 nt, Human
cucccagagaccaagcugagaa

SEQ ID NO: 919189 - RNA, 22 nt, Human
gggaagguauuuagcugcugaa

SEQ ID NO: 919190 - RNA, 22 nt, Human
ugacaucugucacccugcugac

SEQ ID NO: 919191 - RNA, 22 nt, Human
cagcagcaacaauagcggucac

SEQ ID NO: 919192 - RNA, 22 nt, Human
cugucuguggucucaguaggcc

SEQ ID NO: 919193 - RNA, 22 nt, Human
caagaagucauuuagccucuca

SEQ ID NO: 919194 - RNA, 22 nt, Human
uagaagauucauuuccucugaa

SEQ ID NO: 919195 - RNA, 22 nt, Human
uguacaguguagucaugagguu

SEQ ID NO: 919196 - RNA, 20 nt, Human
cagcaacuuuggacugaguu

SEQ ID NO: 919197 - RNA, 22 nt, Human
cuggcucugaguggcucuaauu

SEQ ID NO: 919198 - RNA, 22 nt, Human
aagaaauaagacuucucugucc

SEQ ID NO: 919199 - RNA, 22 nt, Human
ucagaagucuggacugcuucuc

SEQ ID NO: 919200 - RNA, 21 nt, Human
guucuugcaggauuuccuucc

SEQ ID NO: 919201 - RNA, 22 nt, Human
caaagauuuuagaauuugcaau

SEQ ID NO: 919202 - RNA, 22 nt, Human
cagugugacuucugagcugcca

SEQ ID NO: 919203 - RNA, 19 nt, Human
uucugggcauucauauuua

SEQ ID NO: 919204 - RNA, 22 nt, Human
gagcuuccugaugccgaccagu

SEQ ID NO: 919205 - RNA, 22 nt, Human
ggaggccaggaagagccgcccu

SEQ ID NO: 919206 - RNA, 22 nt, Human
gaaugcaaauauauggaucagu

SEQ ID NO: 919207 - RNA, 22 nt, Human
cccugauguuuucucugccuuu

SEQ ID NO: 919208 - RNA, 22 nt, Human
agcugguguccuccuggagcug

SEQ ID NO: 919209 - RNA, 22 nt, Human
gugggagcccucagggaggugc

SEQ ID NO: 919210 - RNA, 22 nt, Human
uuggagaacuggcauuuuuaau

SEQ ID NO: 919211 - RNA, 22 nt, Human
cagagccagcaguggggacagg

SEQ ID NO: 919212 - RNA, 22 nt, Human
caguuucucagacuucccuugu

SEQ ID NO: 919213 - RNA, 22 nt, Human
ugucagugaacuggaaggccug

SEQ ID NO: 919214 - RNA, 22 nt, Human
cagcccugugcuaagcacccuc

SEQ ID NO: 919215 - RNA, 22 nt, Human
gcucugucuucagcacacagua

SEQ ID NO: 919216 - RNA, 22 nt, Human
uaagaacagauaaaguuucccc

SEQ ID NO: 919217 - RNA, 22 nt, Human
aacugcauguguguggcaugau

SEQ ID NO: 919218 - RNA, 22 nt, Human
ugucauuuuauguauguggucu

SEQ ID NO: 919219 - RNA, 22 nt, Human
agaacgcuauucagaacacugg

SEQ ID NO: 919220 - RNA, 22 nt, Human
gcccaagcuggacugcaguggc

SEQ ID NO: 919221 - RNA, 22 nt, Human
aggccuuccucggagacaggga

SEQ ID NO: 919222 - RNA, 22 nt, Human
augauguaaaauaaguugugag

SEQ ID NO: 919223 - RNA, 22 nt, Human
cagcccuccuuucacucccagg

SEQ ID NO: 919224 - RNA, 22 nt, Human
gaggggcagaaugugaucaggg

SEQ ID NO: 919225 - RNA, 22 nt, Human
uagaacuugauagacaguacaa

SEQ ID NO: 919226 - RNA, 23 nt, Human
ugggccuggaaagccuuagagag

SEQ ID NO: 919227 - RNA, 22 nt, Human
augcuguguuuuaaauggaaau

SEQ ID NO: 919228 - RNA, 22 nt, Human
ugaaaguugcacauaagagaau

SEQ ID NO: 919229 - RNA, 20 nt, Human
acugccuuuagguauccuug

SEQ ID NO: 919230 - RNA, 22 nt, Human
cugagcagauguugcccagaag

SEQ ID NO: 919231 - RNA, 22 nt, Human
ugucuucagcagucaucugggg

SEQ ID NO: 919232 - RNA, 22 nt, Human
uucuuuauugagacuucauugu

SEQ ID NO: 919233 - RNA, 22 nt, Human
agcugcugaagugagagaauug

SEQ ID NO: 919234 - RNA, 22 nt, Human
ccaggccuggaccaugccaggg

SEQ ID NO: 919235 - RNA, 22 nt, Human
gcauuuagcuuuaaaauauuuc

SEQ ID NO: 919236 - RNA, 22 nt, Human
cugcugugugcuuacuuggguu

SEQ ID NO: 919237 - RNA, 22 nt, Human
gagaggcuugugugaagaacaa

SEQ ID NO: 919238 - RNA, 22 nt, Human
uggcuccaggggacacgcagua

SEQ ID NO: 919239 - RNA, 22 nt, Human
uaagaaacauuuuuaugacagu

SEQ ID NO: 919240 - RNA, 22 nt, Human
uuacaaacugucauauaguauu

SEQ ID NO: 919241 - RNA, 23 nt, Human
uugagaacaggugugagaauggc

SEQ ID NO: 919242 - RNA, 22 nt, Human
auccugggaagcugacauugaa

SEQ ID NO: 919243 - RNA, 22 nt, Human
acuuuguugaagaauauguuag

SEQ ID NO: 919244 - RNA, 22 nt, Human
ucaggaaauggcuucaugguuu

SEQ ID NO: 919245 - RNA, 22 nt, Human
ugggcucuggguggccugagca

SEQ ID NO: 919246 - RNA, 22 nt, Human
cacacugccacauucacucuuc

SEQ ID NO: 919247 - RNA, 22 nt, Human
aaaauagguacggauuagaaug

SEQ ID NO: 919248 - RNA, 22 nt, Human
cucuagaaggucucccugccag

SEQ ID NO: 919249 - RNA, 20 nt, Human
ucauccaggacaggaguggc

SEQ ID NO: 919250 - RNA, 22 nt, Human
agucauuuucugccuguaaucu

SEQ ID NO: 919251 - RNA, 22 nt, Human
ccaggagcagggcuggcugcac

SEQ ID NO: 919252 - RNA, 20 nt, Human
ggauggccggaccagagccu

SEQ ID NO: 919253 - RNA, 22 nt, Human
ugcacacaccgugcuucacuga

SEQ ID NO: 919254 - RNA, 22 nt, Human
aggggauggagcuggaaggcag

SEQ ID NO: 919255 - RNA, 22 nt, Human
acauuucucccugcaugccugc

SEQ ID NO: 919256 - RNA, 22 nt, Human
gccuggaguagcauggcaagcc

SEQ ID NO: 919257 - RNA, 22 nt, Human
ugagccagaguggagugugccu

SEQ ID NO: 919258 - RNA, 22 nt, Human
cuuuggcaacacaugugggaca

SEQ ID NO: 919259 - RNA, 22 nt, Human
gucuuuggagaggugccauuuc

SEQ ID NO: 919260 - RNA, 22 nt, Human
gcauggcagaacaccucgcccg

SEQ ID NO: 919261 - RNA, 22 nt, Human
ccucugaguccucccugguugc

SEQ ID NO: 919262 - RNA, 22 nt, Human
gcucucugguuccagucaggaa

SEQ ID NO: 919263 - RNA, 22 nt, Human
aaugucaauaacuuuaucccuc

SEQ ID NO: 919264 - RNA, 22 nt, Human
cagagccucagaauccugugga

SEQ ID NO: 919265 - RNA, 22 nt, Human
ggggagcaauaguugaggugug

SEQ ID NO: 919266 - RNA, 22 nt, Human
gccuggggaacuugauccuguc

SEQ ID NO: 919267 - RNA, 22 nt, Human
agcauccugccucuccucccaa

SEQ ID NO: 919268 - RNA, 22 nt, Human
ugacauuuacuauuccugguua

SEQ ID NO: 919269 - RNA, 22 nt, Human
agauuucccucuuguauuugca

SEQ ID NO: 919270 - RNA, 22 nt, Human
acugaauuagggaacacugaac

SEQ ID NO: 919271 - RNA, 22 nt, Human
uuggcagcauccaagucucggg

SEQ ID NO: 919272 - RNA, 22 nt, Human
gcguggcuuagagugggguacc

SEQ ID NO: 919273 - RNA, 22 nt, Human
auuugucacugagagaguuaga

SEQ ID NO: 919274 - RNA, 22 nt, Human
aggcuugguuuauagaaguaau

SEQ ID NO: 919275 - RNA, 22 nt, Human
uaugcuuuaacauuaaacaaca

SEQ ID NO: 919276 - RNA, 22 nt, Human
acacaaugucaucauaauguca

SEQ ID NO: 919277 - RNA, 22 nt, Human
cuucccagaacaauguaggcuu

SEQ ID NO: 919278 - RNA, 19 nt, Human
agugucagaauucauugaa

SEQ ID NO: 919279 - RNA, 22 nt, Human
cagggcuucgcuccuggugcac

SEQ ID NO: 919280 - RNA, 22 nt, Human
uucauguguauggaacauuuuu

SEQ ID NO: 919281 - RNA, 22 nt, Human
guguuuuauggagucauaacgu

SEQ ID NO: 919282 - RNA, 22 nt, Human
uuaaagcaggcaucauuccuca

SEQ ID NO: 919283 - RNA, 22 nt, Human
gacacaggaaaagcuccagccc

SEQ ID NO: 919284 - RNA, 22 nt, Human
gccuggugcuaugagggccagc

SEQ ID NO: 919285 - RNA, 22 nt, Human
gcuggcuuugucaagggcagca

SEQ ID NO: 919286 - RNA, 22 nt, Human
ggcagggguggccuuccuuugg

SEQ ID NO: 919287 - RNA, 20 nt, Human
gcuccccuucucugggccuc

SEQ ID NO: 919288 - RNA, 22 nt, Human
uagugaaaugauaacagagcag

SEQ ID NO: 919289 - RNA, 22 nt, Human
aacuuuagcuauuuaaucugau

SEQ ID NO: 919290 - RNA, 22 nt, Human
ucacaauacucacucaauggcu

SEQ ID NO: 919291 - RNA, 22 nt, Human
augccaaagcccaaguucauca

SEQ ID NO: 919292 - RNA, 22 nt, Human
aaaaugaauaaguuaacccagg

SEQ ID NO: 919293 - RNA, 22 nt, Human
gacacagcuugaugagggcuuu

SEQ ID NO: 919294 - RNA, 22 nt, Human
ccagcagcccucuuccaagacu

SEQ ID NO: 919295 - RNA, 22 nt, Human
uaugacaaagagaggcccaugc

SEQ ID NO: 919296 - RNA, 22 nt, Human
uaaaauuugucccugaguguug

SEQ ID NO: 919297 - RNA, 22 nt, Human
agcaggcuuuccacagaaggag

SEQ ID NO: 919298 - RNA, 22 nt, Human
gaaacacauaugaacaguugau

SEQ ID NO: 919299 - RNA, 22 nt, Human
uuucuucagccacuccaaacug

SEQ ID NO: 919300 - RNA, 22 nt, Human
acguggcggccgccgugagcgg

SEQ ID NO: 919301 - RNA, 22 nt, Human
gacaacacauguaugccacucu

SEQ ID NO: 919302 - RNA, 22 nt, Human
ucucagcucuuuuuucacagaa

SEQ ID NO: 919303 - RNA, 22 nt, Human
aguugugcugugaugcaggaua

SEQ ID NO: 919304 - RNA, 22 nt, Human
caugaaaucugaguauguuucc

SEQ ID NO: 919305 - RNA, 22 nt, Human
gccuggcuacccacugaaauau

SEQ ID NO: 919306 - RNA, 22 nt, Human
uugcuguguaacuccuggccug

SEQ ID NO: 919307 - RNA, 22 nt, Human
aucauucagucucugggacagu

SEQ ID NO: 919308 - RNA, 22 nt, Human
acauuagcccaucugguauuug

SEQ ID NO: 919309 - RNA, 22 nt, Human
gacauugaauuugaauguaugu

SEQ ID NO: 919310 - RNA, 22 nt, Human
cccaggagccaucugucuuggc

SEQ ID NO: 919311 - RNA, 22 nt, Human
ccugccagcugugggccagccu

SEQ ID NO: 919312 - RNA, 22 nt, Human
gagugcuggaggugugaguggg

SEQ ID NO: 919313 - RNA, 22 nt, Human
aaguacagccagcacccagacu

SEQ ID NO: 919314 - RNA, 22 nt, Human
gaaacauuguguucuacagauu

SEQ ID NO: 919315 - RNA, 22 nt, Human
uaaggcuuuuguucagcguggg

SEQ ID NO: 919316 - RNA, 22 nt, Human
uuucauugagaauauaagauuu

SEQ ID NO: 919317 - RNA, 22 nt, Human
uuucauugucaauaaacuguau

SEQ ID NO: 919318 - RNA, 22 nt, Human
ucuucagacuccaaauguuuua

SEQ ID NO: 919319 - RNA, 22 nt, Human
guggcaggaucacggcucacug

SEQ ID NO: 919320 - RNA, 22 nt, Human
cacagcagaacuuaauuucaaa

SEQ ID NO: 919321 - RNA, 22 nt, Human
gcagacagggcuacagagguac

SEQ ID NO: 919322 - RNA, 22 nt, Human
ugaaagagugcaagucaaggag

SEQ ID NO: 919323 - RNA, 22 nt, Human
gucccugcaucaccacgggacu

SEQ ID NO: 919324 - RNA, 22 nt, Human
agcugugccuugcugcacggug

SEQ ID NO: 919325 - RNA, 22 nt, Human
uccaucaggcucgugggcucuc

SEQ ID NO: 919326 - RNA, 22 nt, Human
gcugcaggggggucuggacuug

SEQ ID NO: 919327 - RNA, 22 nt, Human
uaggccagaggagcagcuuugg

SEQ ID NO: 919328 - RNA, 22 nt, Human
caucuucauuuuguccaguacu

SEQ ID NO: 919329 - RNA, 20 nt, Human
ccuucagaacuuacauagua

SEQ ID NO: 919330 - RNA, 22 nt, Human
cuguugucccugggagcucagc

SEQ ID NO: 919331 - RNA, 22 nt, Human
acacugcauuucaacaaggccc

SEQ ID NO: 919332 - RNA, 22 nt, Human
auuccacaggagcugguuuucu

SEQ ID NO: 919333 - RNA, 21 nt, Human
ugguuuauuucacucagcaua

SEQ ID NO: 919334 - RNA, 22 nt, Human
gaacaauacaggcuuuauuccu

SEQ ID NO: 919335 - RNA, 22 nt, Human
ugucugagugugccugggcauu

SEQ ID NO: 919336 - RNA, 22 nt, Human
gcuggccagggcugcucgcgga

SEQ ID NO: 919337 - RNA, 21 nt, Human
ggugggcacaggagagcagag

SEQ ID NO: 919338 - RNA, 22 nt, Human
cuuaaaaucuggcaguuagcua

SEQ ID NO: 919339 - RNA, 22 nt, Human
gaaauacugcacacccuguaag

SEQ ID NO: 919340 - RNA, 22 nt, Human
accauggaccauaguuccuauu

SEQ ID NO: 919341 - RNA, 22 nt, Human
uuuacuguucaacuugcaagua

SEQ ID NO: 919342 - RNA, 22 nt, Human
auuuuauccccacuggauuaca

SEQ ID NO: 919343 - RNA, 22 nt, Human
cuccaaggauucuggacccuug

SEQ ID NO: 919344 - RNA, 22 nt, Human
ugagaauaacagccuguguucc

SEQ ID NO: 919345 - RNA, 18 nt, Human
agacccucuaagggcagu

SEQ ID NO: 919346 - RNA, 22 nt, Human
aacagaaaagguagguggcuuu

SEQ ID NO: 919347 - RNA, 22 nt, Human
ggccaugcucguggcuggacug

SEQ ID NO: 919348 - RNA, 22 nt, Human
acaggauggagauaauagaaaa

SEQ ID NO: 919349 - RNA, 22 nt, Human
ucaggcuuggugcuccagugcc

SEQ ID NO: 919350 - RNA, 22 nt, Human
uggggacacagagguucguugg

SEQ ID NO: 919351 - RNA, 22 nt, Human
acaggagaaaucuggucaaaag

SEQ ID NO: 919352 - RNA, 22 nt, Human
uggcuucucuguuuuaguauuu

SEQ ID NO: 919353 - RNA, 22 nt, Human
cugggagggguagccaauccua

SEQ ID NO: 919354 - RNA, 22 nt, Human
acacuuucuggagcugcacaua

SEQ ID NO: 919355 - RNA, 22 nt, Human
guuucagauauauuuguacuua

SEQ ID NO: 919356 - RNA, 22 nt, Human
uacuuagagcgauaauuuauac

SEQ ID NO: 919357 - RNA, 22 nt, Human
ggcaggugcucaaaaauauuug

SEQ ID NO: 919358 - RNA, 22 nt, Human
ugaucuuuccucuuguuugucu

SEQ ID NO: 919359 - RNA, 22 nt, Human
acaguguguccuaaaggucugg

SEQ ID NO: 919360 - RNA, 22 nt, Human
ucuggguggugucuuccaagac

SEQ ID NO: 919361 - RNA, 22 nt, Human
gcauguguuauuucucuguggg

SEQ ID NO: 919362 - RNA, 22 nt, Human
acaaucuuauuaguaguauaga

SEQ ID NO: 919363 - RNA, 22 nt, Human
aaacaguuguuauuuuuauaug

SEQ ID NO: 919364 - RNA, 22 nt, Human
uccucaggcugccuggaagacu

SEQ ID NO: 919365 - RNA, 22 nt, Human
aaggcacacaguuagauagagc

SEQ ID NO: 919366 - RNA, 21 nt, Human
ggcagugaugugaagugcauc

SEQ ID NO: 919367 - RNA, 22 nt, Human
auguuuaugcaaacaugugagu

SEQ ID NO: 919368 - RNA, 22 nt, Human
uuaguguaaauugugcuugaga

SEQ ID NO: 919369 - RNA, 22 nt, Human
ggcuuguugaaacacagauugu

SEQ ID NO: 919370 - RNA, 22 nt, Human
cccagaugcagguucaagagua

SEQ ID NO: 919371 - RNA, 22 nt, Human
ugcuuuaaccaucuuguuugga

SEQ ID NO: 919372 - RNA, 22 nt, Human
acacuuuagaaaaaagaauggu

SEQ ID NO: 919373 - RNA, 22 nt, Human
uucaugugucuguagcacauau

SEQ ID NO: 919374 - RNA, 22 nt, Human
cauuguugaacaccugcuggau

SEQ ID NO: 919375 - RNA, 22 nt, Human
uuaaacauuuuugaugaucgau

SEQ ID NO: 919376 - RNA, 22 nt, Human
cccaaggccuucaagccagcuc

SEQ ID NO: 919377 - RNA, 22 nt, Human
gagagacagcacacaguguggg

SEQ ID NO: 919378 - RNA, 22 nt, Human
gaaagacuaacuagaaagugca

SEQ ID NO: 919379 - RNA, 22 nt, Human
acuuacaagcuagggaagcuug

SEQ ID NO: 919380 - RNA, 22 nt, Human
uugacacaauguauauuuucaa

SEQ ID NO: 919381 - RNA, 22 nt, Human
uccacagggauucacccaaaag

SEQ ID NO: 919382 - RNA, 22 nt, Human
uguaaagagaagaaacgugagc

SEQ ID NO: 919383 - RNA, 23 nt, Human
caugugugacaguaucacuguuu

SEQ ID NO: 919384 - RNA, 22 nt, Human
auacacagcuacauugaacaau

SEQ ID NO: 919385 - RNA, 22 nt, Human
ucuaaggacauuggcuuuggag

SEQ ID NO: 919386 - RNA, 22 nt, Human
cuuguuaucuccguguccuugu

SEQ ID NO: 919387 - RNA, 22 nt, Human
aaacucuaguuaugaaguuugu

SEQ ID NO: 919388 - RNA, 22 nt, Human
ccuccugguccagcaucucuuu

SEQ ID NO: 919389 - RNA, 22 nt, Human
cagucccaccaggaucgcucuu

SEQ ID NO: 919390 - RNA, 22 nt, Human
ugcauauucuccuuuauuuugu

SEQ ID NO: 919391 - RNA, 22 nt, Human
uggcugaguuucaugcaucaug

SEQ ID NO: 919392 - RNA, 22 nt, Human
ggugcugaauucuggaggaggc

SEQ ID NO: 919393 - RNA, 22 nt, Human
acuaaagaugucuaaauauauu

SEQ ID NO: 919394 - RNA, 22 nt, Human
uguggcugcaaaggaaggcugc

SEQ ID NO: 919395 - RNA, 22 nt, Human
cagcugcagaaagcaagcaggu

SEQ ID NO: 919396 - RNA, 22 nt, Human
ugcuccagugccugccccacag

SEQ ID NO: 919397 - RNA, 22 nt, Human
aggcuucuugagccccacaggc

SEQ ID NO: 919398 - RNA, 22 nt, Human
ugaaauucaaaacacauuuguc

SEQ ID NO: 919399 - RNA, 22 nt, Human
cagugccagagguacuagugga

SEQ ID NO: 919400 - RNA, 22 nt, Human
ccaggaggcagaaguugcagug

SEQ ID NO: 919401 - RNA, 22 nt, Human
agaacugugccaaaaauuuugu

SEQ ID NO: 919402 - RNA, 22 nt, Human
aaaaguaauugaugcaaucgua

SEQ ID NO: 919403 - RNA, 22 nt, Human
gcagccuucaguuuggcaggag

SEQ ID NO: 919404 - RNA, 22 nt, Human
ucuguguuuuacuccaauuaua

SEQ ID NO: 919405 - RNA, 22 nt, Human
ugagcaguaggucugaauagug

SEQ ID NO: 919406 - RNA, 22 nt, Human
uggcagcaguggagguagaaag

SEQ ID NO: 919407 - RNA, 22 nt, Human
agaucauacuacuuguacuaaa

SEQ ID NO: 919408 - RNA, 22 nt, Human
agcagguggccacgaggaggag

SEQ ID NO: 919409 - RNA, 22 nt, Human
ugcuuagaugaggcagcaggag

SEQ ID NO: 919410 - RNA, 22 nt, Human
aacuaauacauuaauacaugug

SEQ ID NO: 919411 - RNA, 22 nt, Human
ugggagcaagcuggugcuggag

SEQ ID NO: 919412 - RNA, 22 nt, Human
agucuguggggucccuggggca

SEQ ID NO: 919413 - RNA, 22 nt, Human
cagcacacagugacucgcaccu

SEQ ID NO: 919414 - RNA, 22 nt, Human
aguucuggaacucuacagcaac

SEQ ID NO: 919415 - RNA, 22 nt, Human
uguucaaaaauaucuucugcaa

SEQ ID NO: 919416 - RNA, 22 nt, Human
ugcagcauccauauauuauuag

SEQ ID NO: 919417 - RNA, 22 nt, Human
ccacaguuauucauuugugaca

SEQ ID NO: 919418 - RNA, 22 nt, Human
aaauaguaaagugguagccauc

SEQ ID NO: 919419 - RNA, 22 nt, Human
uugcaggguccuguggcucucc

SEQ ID NO: 919420 - RNA, 22 nt, Human
uggccaugaaggaggcagcaga

SEQ ID NO: 919421 - RNA, 22 nt, Human
caaagugcagaaggaacugggu

SEQ ID NO: 919422 - RNA, 22 nt, Human
aaugcaaauucuagggcccuau

SEQ ID NO: 919423 - RNA, 22 nt, Human
uuuucuuacugucugugauccu

SEQ ID NO: 919424 - RNA, 20 nt, Human
ugggauuguuuuuuagcuuc

SEQ ID NO: 919425 - RNA, 22 nt, Human
ggacccugcagccacccgacau

SEQ ID NO: 919426 - RNA, 22 nt, Human
ccaggcuguaaacaccuucaaa

SEQ ID NO: 919427 - RNA, 22 nt, Human
gccaccagugggggccugggca

SEQ ID NO: 919428 - RNA, 22 nt, Human
uuucuccuaacucaaauuuaag

SEQ ID NO: 919429 - RNA, 22 nt, Human
uuccaaaacaauauucugugaa

SEQ ID NO: 919430 - RNA, 22 nt, Human
uucuuuucccaauauuuugcug

SEQ ID NO: 919431 - RNA, 19 nt, Human
agcagccauagacaauaug

SEQ ID NO: 919432 - RNA, 22 nt, Human
guguuuggucagacguccgggg

SEQ ID NO: 919433 - RNA, 17 nt, Human
ggacugggcggggcagg

SEQ ID NO: 919434 - RNA, 22 nt, Human
ggugggcaacauuuggccugag

SEQ ID NO: 919435 - RNA, 22 nt, Human
caggccuccacuccacgcagac

SEQ ID NO: 919436 - RNA, 22 nt, Human
guggcacagugggagagcccca

SEQ ID NO: 919437 - RNA, 22 nt, Human
acuugccccagaauugcugcug

SEQ ID NO: 919438 - RNA, 22 nt, Human
cuuauguaugcuacuuuguggu

SEQ ID NO: 919439 - RNA, 22 nt, Human
ggugcagugcaggguaauuaua

SEQ ID NO: 919440 - RNA, 22 nt, Human
cccuccuuaccaccacagcucc

SEQ ID NO: 919441 - RNA, 23 nt, Human
uccaggcugaaggagcagauuuu

SEQ ID NO: 919442 - RNA, 22 nt, Human
acauauaugugcacaugugcag

SEQ ID NO: 919443 - RNA, 22 nt, Human
gaggccacagugucugggggcc

SEQ ID NO: 919444 - RNA, 22 nt, Human
cuccaggcuggggugcagguug

SEQ ID NO: 919445 - RNA, 22 nt, Human
cccaggcagagagcuggugagc

SEQ ID NO: 919446 - RNA, 22 nt, Human
agcuggcuggccccuuccugcc

SEQ ID NO: 919447 - RNA, 17 nt, Human
cugucacaauaccucgc

SEQ ID NO: 919448 - RNA, 22 nt, Human
gcugaggaggugugguuaggug

SEQ ID NO: 919449 - RNA, 21 nt, Human
auuuuguacauagaauuuguc

SEQ ID NO: 919450 - RNA, 21 nt, Human
ucuggucugcuguggaccugg

SEQ ID NO: 919451 - RNA, 22 nt, Human
gaugcagggcuggcaggagcuu

SEQ ID NO: 919452 - RNA, 22 nt, Human
cacagaaaggcucaaaucccaa

SEQ ID NO: 919453 - RNA, 22 nt, Human
uagaaaugagccaugguagagc

SEQ ID NO: 919454 - RNA, 22 nt, Human
ugggcucugcaucagugcccau

SEQ ID NO: 919455 - RNA, 22 nt, Human
cuguugucuccucucagauuau

SEQ ID NO: 919456 - RNA, 22 nt, Human
aaugaguuagaugagaaaauaa

SEQ ID NO: 919457 - RNA, 21 nt, Human
uucuccuucuugauccaagca

SEQ ID NO: 919458 - RNA, 22 nt, Human
cuguccauggugcuggacgguc

SEQ ID NO: 919459 - RNA, 20 nt, Human
augauagucagaaaacuagc

SEQ ID NO: 919460 - RNA, 22 nt, Human
acacugaguuuuaccaggcaca

SEQ ID NO: 919461 - RNA, 23 nt, Human
ugccucugccucccuagucugca

SEQ ID NO: 919462 - RNA, 22 nt, Human
uauuuccuugagacggagucuc

SEQ ID NO: 919463 - RNA, 22 nt, Human
caguucuacuuggaugucugca

SEQ ID NO: 919464 - RNA, 22 nt, Human
guuauucuacagucauugaagu

SEQ ID NO: 919465 - RNA, 22 nt, Human
uucuuucucuccacaaggcuug

SEQ ID NO: 919466 - RNA, 23 nt, Human
uuuaaaaguuguaauguaggcuu

SEQ ID NO: 919467 - RNA, 22 nt, Human
aggcuuuccugucacucaugcu

SEQ ID NO: 919468 - RNA, 22 nt, Human
guguguguauauauacacacac

SEQ ID NO: 919469 - RNA, 22 nt, Human
uugggagauauuguucuuuaca

SEQ ID NO: 919470 - RNA, 19 nt, Human
ugcaucuugcaugggugag

SEQ ID NO: 919471 - RNA, 23 nt, Human
aguuggcauauucaagcacaguc

SEQ ID NO: 919472 - RNA, 22 nt, Human
ugccaggggaccuagggauguc

SEQ ID NO: 919473 - RNA, 22 nt, Human
ggaggagucaguugggcugcuu

SEQ ID NO: 919474 - RNA, 22 nt, Human
auugcugguagucagugucccu

SEQ ID NO: 919475 - RNA, 22 nt, Human
uaagcaaaguuuauaaggcucu

SEQ ID NO: 919476 - RNA, 22 nt, Human
agaguccaggugggcuggaggc

SEQ ID NO: 919477 - RNA, 22 nt, Human
uccugccugcaaucccagcacu

SEQ ID NO: 919478 - RNA, 22 nt, Human
uuggaagggauauuggcauaug

SEQ ID NO: 919479 - RNA, 22 nt, Human
cauugcaacuucaaacuccugg

SEQ ID NO: 919480 - RNA, 22 nt, Human
caguggaggccuugggaccuuu

SEQ ID NO: 919481 - RNA, 22 nt, Human
aggaggcugguucaggccauau

SEQ ID NO: 919482 - RNA, 22 nt, Human
aagcagaacugggaaguagugg

SEQ ID NO: 919483 - RNA, 22 nt, Human
aauguuacacagguauaaucag

SEQ ID NO: 919484 - RNA, 20 nt, Human
aauaaaagaagccuucaccc

SEQ ID NO: 919485 - RNA, 22 nt, Human
cagaggaaaguauuucuggaag

SEQ ID NO: 919486 - RNA, 22 nt, Human
cagaaagaccugauuggcaguu

SEQ ID NO: 919487 - RNA, 22 nt, Human
aagugucuuuuagccacuuuua

SEQ ID NO: 919488 - RNA, 22 nt, Human
uguacauauucaagcacuucua

SEQ ID NO: 919489 - RNA, 22 nt, Human
gaccauuuuuacagagcauuca

SEQ ID NO: 919490 - RNA, 22 nt, Human
ggaaguguaguccgaaguugcg

SEQ ID NO: 919491 - RNA, 22 nt, Human
ccguauguucagauuugucaau

SEQ ID NO: 919492 - RNA, 22 nt, Human
uuauccaacaugacuuaugucc

SEQ ID NO: 919493 - RNA, 22 nt, Human
agauacaaggcagagaugugca

SEQ ID NO: 919494 - RNA, 22 nt, Human
gaaggcuccuugagggaaggac

SEQ ID NO: 919495 - RNA, 22 nt, Human
gucugagacuuuuucugugugg

SEQ ID NO: 919496 - RNA, 22 nt, Human
uggcagaaugaagacuggggcc

SEQ ID NO: 919497 - RNA, 22 nt, Human
agagugggacacgggcgcuguc

SEQ ID NO: 919498 - RNA, 22 nt, Human
uguguuugggggagaugcauuu

SEQ ID NO: 919499 - RNA, 21 nt, Human
ggaauagcuuaaagugagggg

SEQ ID NO: 919500 - RNA, 22 nt, Human
uuugcuuugggagguugucugg

SEQ ID NO: 919501 - RNA, 22 nt, Human
uuuggaauuggcauucuauucu

SEQ ID NO: 919502 - RNA, 22 nt, Human
cuagugaacgugguacuaugga

SEQ ID NO: 919503 - RNA, 22 nt, Human
uagcuccuccccauccagguuc

SEQ ID NO: 919504 - RNA, 22 nt, Human
aucaaaucauugcauuaauguu

SEQ ID NO: 919505 - RNA, 22 nt, Human
auccacagucuuagccaucaaa

SEQ ID NO: 919506 - RNA, 22 nt, Human
cagggaugaccagagggaugug

SEQ ID NO: 919507 - RNA, 22 nt, Human
agacauccuggggagggcaaug

SEQ ID NO: 919508 - RNA, 22 nt, Human
caggcaggagaggaggauuucu

SEQ ID NO: 919509 - RNA, 22 nt, Human
ggcaggguguggaguugggaca

SEQ ID NO: 919510 - RNA, 22 nt, Human
caggacaucuucuguguuuuua

SEQ ID NO: 919511 - RNA, 20 nt, Human
ggaagcuguggguccccagg

SEQ ID NO: 919512 - RNA, 22 nt, Human
ugcagcucuuacggagggcggg

SEQ ID NO: 919513 - RNA, 22 nt, Human
uggagaggagcaccauggccau

SEQ ID NO: 919514 - RNA, 22 nt, Human
uagaaucugccugcagcaaaga

SEQ ID NO: 919515 - RNA, 22 nt, Human
ccacauuggccucagagguuag

SEQ ID NO: 919516 - RNA, 22 nt, Human
ugcccaggcuccucgcagccuu

SEQ ID NO: 919517 - RNA, 19 nt, Human
caucaaguggaguaucucg

SEQ ID NO: 919518 - RNA, 22 nt, Human
cuucuuggcugcaagucucugu

SEQ ID NO: 919519 - RNA, 22 nt, Human
uagcagcugugaguaaaagcca

SEQ ID NO: 919520 - RNA, 22 nt, Human
aguguguguuugggcgguuuau

SEQ ID NO: 919521 - RNA, 22 nt, Human
uuugucauauagacuauuguga

SEQ ID NO: 919522 - RNA, 22 nt, Human
ggccuagccucuccugagagag

SEQ ID NO: 919523 - RNA, 22 nt, Human
cuuuauguccuugaagaguugu

SEQ ID NO: 919524 - RNA, 22 nt, Human
gggagccacagugaggugcaug

SEQ ID NO: 919525 - RNA, 21 nt, Human
cucuugaaugcuugauaagau

SEQ ID NO: 919526 - RNA, 22 nt, Human
aagaagugguccuuuucuuucu

SEQ ID NO: 919527 - RNA, 22 nt, Human
cccacucuggcucccuucuagu

SEQ ID NO: 919528 - RNA, 22 nt, Human
cagcagcaguggcugcagaaca

SEQ ID NO: 919529 - RNA, 22 nt, Human
caugcaucagaaucaccuagag

SEQ ID NO: 919530 - RNA, 22 nt, Human
aaggcacugaaaaauugugugu

SEQ ID NO: 919531 - RNA, 22 nt, Human
gaggaacugaguaccaugauuc

SEQ ID NO: 919532 - RNA, 22 nt, Human
uuacaacaccaggcaguauccu

SEQ ID NO: 919533 - RNA, 22 nt, Human
gcucacuggccugaagaggacg

SEQ ID NO: 919534 - RNA, 22 nt, Human
cagcaucuucaugugcaucucc

SEQ ID NO: 919535 - RNA, 22 nt, Human
uggcucagucuggguugacuga

SEQ ID NO: 919536 - RNA, 22 nt, Human
uaaagguagugugacauauugu

SEQ ID NO: 919537 - RNA, 22 nt, Human
gucacuuuauuaauuuugguga

SEQ ID NO: 919538 - RNA, 22 nt, Human
uuggaauguuuuaauauaaauu

SEQ ID NO: 919539 - RNA, 22 nt, Human
uagcacugaaucacaugcugcu

SEQ ID NO: 919540 - RNA, 22 nt, Human
ccucacagcuuuucaaagugga

SEQ ID NO: 919541 - RNA, 22 nt, Human
gugucccaaucuacuuuucccu

SEQ ID NO: 919542 - RNA, 22 nt, Human
ucugggugacccugggcaaggc

SEQ ID NO: 919543 - RNA, 22 nt, Human
cuucauuaacuauuggaaugca

SEQ ID NO: 919544 - RNA, 22 nt, Human
gggaaagagagguggacgcagg

SEQ ID NO: 919545 - RNA, 22 nt, Human
ucugggauaagaccacagauuu

SEQ ID NO: 919546 - RNA, 20 nt, Human
acauaucaugguagaguccu

SEQ ID NO: 919547 - RNA, 23 nt, Human
uccagccucuugcucucacaugc

SEQ ID NO: 919548 - RNA, 22 nt, Human
gugucuuuugaggcugaccagu

SEQ ID NO: 919549 - RNA, 22 nt, Human
aagaguuucugggucaaggauu

SEQ ID NO: 919550 - RNA, 22 nt, Human
cacugcaaccuccagcucucag

SEQ ID NO: 919551 - RNA, 22 nt, Human
gcucacugccauucucuagaug

SEQ ID NO: 919552 - RNA, 22 nt, Human
cagcuggacuuuugauagaagu

SEQ ID NO: 919553 - RNA, 22 nt, Human
agaaggcacucacacuggcacg

SEQ ID NO: 919554 - RNA, 22 nt, Human
uuuauguacauauccacaagga

SEQ ID NO: 919555 - RNA, 22 nt, Human
ugucccucauugacgcugugcc

SEQ ID NO: 919556 - RNA, 22 nt, Human
uugaaugaauaaaagaguaagg

SEQ ID NO: 919557 - RNA, 22 nt, Human
uggcagugugugagcuguuauu

SEQ ID NO: 919558 - RNA, 22 nt, Human
ggcuccugcaccugucccucug

SEQ ID NO: 919559 - RNA, 22 nt, Human
agaggucacuccaccuucuucu

SEQ ID NO: 919560 - RNA, 22 nt, Human
gggugggccugucuggccaugu

SEQ ID NO: 919561 - RNA, 22 nt, Human
ucugggaguaaggccuaggcau

SEQ ID NO: 919562 - RNA, 22 nt, Human
gguguccaucaggcugugcuuc

SEQ ID NO: 919563 - RNA, 22 nt, Human
ucucuaacaaaggagcugcugc

SEQ ID NO: 919564 - RNA, 22 nt, Human
uggccaguaauagcuucuggug

SEQ ID NO: 919565 - RNA, 21 nt, Human
uagguauuucuaucaugucuc

SEQ ID NO: 919566 - RNA, 22 nt, Human
acuuagaaauucaguuuuguca

SEQ ID NO: 919567 - RNA, 22 nt, Human
guuucucaagcuugaaugcaca

SEQ ID NO: 919568 - RNA, 22 nt, Human
gcucuguuucuccaugcugugg

SEQ ID NO: 919569 - RNA, 16 nt, Human
uuuauuuacuaguguu

SEQ ID NO: 919570 - RNA, 22 nt, Human
guuuguuuguagggaagccgug

SEQ ID NO: 919571 - RNA, 22 nt, Human
gaccugugcagugacugguggc

SEQ ID NO: 919572 - RNA, 22 nt, Human
ugaagagaagaaaauuaucuuu

SEQ ID NO: 919573 - RNA, 21 nt, Human
augacagaugcugcagaucgu

SEQ ID NO: 919574 - RNA, 22 nt, Human
agggcucuuccuuugccucuca

SEQ ID NO: 919575 - RNA, 22 nt, Human
aauuguacaagccuugugccau

SEQ ID NO: 919576 - RNA, 22 nt, Human
agagaagcagggagucaucugu

SEQ ID NO: 919577 - RNA, 22 nt, Human
ucugagagcaucacugggguac

SEQ ID NO: 919578 - RNA, 22 nt, Human
gcagacauguguucuaacagga

SEQ ID NO: 919579 - RNA, 22 nt, Human
cccuaggcugaggccagggugc

SEQ ID NO: 919580 - RNA, 22 nt, Human
auaguuuuaaaaccucaggaag

SEQ ID NO: 919581 - RNA, 22 nt, Human
aguuucaugagacagauuuuca

SEQ ID NO: 919582 - RNA, 22 nt, Human
gagaggaauaucauuauauuag

SEQ ID NO: 919583 - RNA, 18 nt, Human
gauauauaggaggaaagu

SEQ ID NO: 919584 - RNA, 18 nt, Human
ucauggcuugcagauggu

SEQ ID NO: 919585 - RNA, 22 nt, Human
ugaagaaaggugugggauacuc

SEQ ID NO: 919586 - RNA, 22 nt, Human
ucucugagcccagugucccccu

SEQ ID NO: 919587 - RNA, 22 nt, Human
uuuugugagaugcguaugaaug

SEQ ID NO: 919588 - RNA, 22 nt, Human
agucuuugguuauaagagacag

SEQ ID NO: 919589 - RNA, 22 nt, Human
uucaguguuaaauucaaagagu

SEQ ID NO: 919590 - RNA, 22 nt, Human
gacaguaaaugcagucuagcac

SEQ ID NO: 919591 - RNA, 22 nt, Human
aagcugcuggugacugggcuga

SEQ ID NO: 919592 - RNA, 22 nt, Human
gaggcaaggccgcacgucucag

SEQ ID NO: 919593 - RNA, 22 nt, Human
ggcuuguccuugggcugugcau

SEQ ID NO: 919594 - RNA, 22 nt, Human
ugaggccuggagggaggaguuu

SEQ ID NO: 919595 - RNA, 21 nt, Human
uuuuaugcauaggaaauauau

SEQ ID NO: 919596 - RNA, 22 nt, Human
gccuugcuaauuucuccucaac

SEQ ID NO: 919597 - RNA, 22 nt, Human
guuuaugaauguuacuauagag

SEQ ID NO: 919598 - RNA, 22 nt, Human
ucagaacaggacuggcugccau

SEQ ID NO: 919599 - RNA, 22 nt, Human
cuggaucuugcugcauugagaa

SEQ ID NO: 919600 - RNA, 22 nt, Human
aagagcaggcugcuguggagua

SEQ ID NO: 919601 - RNA, 22 nt, Human
agggagaaaauuggaugcacaa

SEQ ID NO: 919602 - RNA, 18 nt, Human
gccagagguacuacugau

SEQ ID NO: 919603 - RNA, 22 nt, Human
ugguucauaauuugcacuacug

SEQ ID NO: 919604 - RNA, 22 nt, Human
ggcaaaaaccacaauuacuuuu

SEQ ID NO: 919605 - RNA, 22 nt, Human
gugguuuuggaggccacuguuu

SEQ ID NO: 919606 - RNA, 18 nt, Human
gcaggagauggguggggu

SEQ ID NO: 919607 - RNA, 22 nt, Human
ggcucaccauggccucccugcu

SEQ ID NO: 919608 - RNA, 19 nt, Human
ccacaaaauuauuuuaguu

SEQ ID NO: 919609 - RNA, 22 nt, Human
uaagcccacauuuuucugaaga

SEQ ID NO: 919610 - RNA, 23 nt, Human
accuuggacuucccagcuuccag

SEQ ID NO: 919611 - RNA, 22 nt, Human
aacaguuucaguuacugaugag

SEQ ID NO: 919612 - RNA, 22 nt, Human
ccugggcucaggcuugggcagc

SEQ ID NO: 919613 - RNA, 22 nt, Human
uaaauuaugucacaugacucug

SEQ ID NO: 919614 - RNA, 22 nt, Human
uuuaaacaucuuguugccuuaa

SEQ ID NO: 919615 - RNA, 22 nt, Human
gaccugccugagcugccucugc

SEQ ID NO: 919616 - RNA, 22 nt, Human
cguguggucccggcaaggcaag

SEQ ID NO: 919617 - RNA, 22 nt, Human
ucacacaucucagguguuuaau

SEQ ID NO: 919618 - RNA, 22 nt, Human
aaguucaaguaguguuacaugg

SEQ ID NO: 919619 - RNA, 22 nt, Human
aggcucugagucuggugucugc

SEQ ID NO: 919620 - RNA, 22 nt, Human
cugaagaaauaugauugcuuaa

SEQ ID NO: 919621 - RNA, 22 nt, Human
cagacagguagggacagaacau

SEQ ID NO: 919622 - RNA, 22 nt, Human
auacuucuuuagcauauugaac

SEQ ID NO: 919623 - RNA, 22 nt, Human
uaugacauuauaaaggauuauu

SEQ ID NO: 919624 - RNA, 22 nt, Human
cugcugagcccuggcacaggug

SEQ ID NO: 919625 - RNA, 18 nt, Human
uaaaauucaaggcagggu

SEQ ID NO: 919626 - RNA, 22 nt, Human
cagcagagguuuugcuccauga

SEQ ID NO: 919627 - RNA, 22 nt, Human
aacacugagggaaaagagauag

SEQ ID NO: 919628 - RNA, 22 nt, Human
gcaguuuggaaaaugugccucu

SEQ ID NO: 919629 - RNA, 19 nt, Human
aaaugugcacuguuuucca

SEQ ID NO: 919630 - RNA, 22 nt, Human
agccccucuccgcccugagucg

SEQ ID NO: 919631 - RNA, 22 nt, Human
accugccagaaugcuaguccug

SEQ ID NO: 919632 - RNA, 22 nt, Human
uuacccagcccugcccagaugu

SEQ ID NO: 919633 - RNA, 22 nt, Human
cacaauuuguauuuugcaucca

SEQ ID NO: 919634 - RNA, 22 nt, Human
agucaaauaagacugucauaag

SEQ ID NO: 919635 - RNA, 22 nt, Human
agcugagacacuugagagacua

SEQ ID NO: 919636 - RNA, 23 nt, Human
agucuuacugucccagaacaggg

SEQ ID NO: 919637 - RNA, 22 nt, Human
aacaaguuguugaaaauaauua

SEQ ID NO: 919638 - RNA, 21 nt, Human
ugucaguucauguauaggcca

SEQ ID NO: 919639 - RNA, 22 nt, Human
ucugagggcuugaggggaagua

SEQ ID NO: 919640 - RNA, 22 nt, Human
gaugucuuacuaacuagccuuu

SEQ ID NO: 919641 - RNA, 22 nt, Human
uacacaguuuugcucccaugau

SEQ ID NO: 919642 - RNA, 22 nt, Human
gggaaugagagucagcccagga

SEQ ID NO: 919643 - RNA, 22 nt, Human
aaaggcuuguuugaggacuggu

SEQ ID NO: 919644 - RNA, 22 nt, Human
ucagcugccccaguggccccag

SEQ ID NO: 919645 - RNA, 22 nt, Human
gcagccugaugaucuggguugu

SEQ ID NO: 919646 - RNA, 22 nt, Human
gcugucacauuuggagcacugg

SEQ ID NO: 919647 - RNA, 22 nt, Human
ggaggugggauuaggaccuaaa

SEQ ID NO: 919648 - RNA, 22 nt, Human
acaaaagaauaagaugagucau

SEQ ID NO: 919649 - RNA, 19 nt, Human
cucuccagcuccaguagcu

SEQ ID NO: 919650 - RNA, 22 nt, Human
gggcgugaccaucugggagcuc

SEQ ID NO: 919651 - RNA, 22 nt, Human
cccagcauuucugggcugcacu

SEQ ID NO: 919652 - RNA, 22 nt, Human
ucauauaagagcuuuagaguca

SEQ ID NO: 919653 - RNA, 22 nt, Human
cuacagagaauugugugauuuu

SEQ ID NO: 919654 - RNA, 21 nt, Human
uuacaacauuuguguucuaug

SEQ ID NO: 919655 - RNA, 22 nt, Human
gcuguguaucagaugccacggg

SEQ ID NO: 919656 - RNA, 22 nt, Human
ugcagcagacugaguaugagaa

SEQ ID NO: 919657 - RNA, 22 nt, Human
gcagcagccacuauucuggcau

SEQ ID NO: 919658 - RNA, 22 nt, Human
aagauuuucucaacuguauuug

SEQ ID NO: 919659 - RNA, 22 nt, Human
gccaguaaaacaaaggccaugu

SEQ ID NO: 919660 - RNA, 22 nt, Human
aucucaggcccuagugaccuca

SEQ ID NO: 919661 - RNA, 22 nt, Human
uccugugugucagaugcacagu

SEQ ID NO: 919662 - RNA, 22 nt, Human
caaggcaaucucauggcuucuu

SEQ ID NO: 919663 - RNA, 22 nt, Human
uuccauuuggcacuucacugag

SEQ ID NO: 919664 - RNA, 22 nt, Human
aggcaguuguugcugagcagcu

SEQ ID NO: 919665 - RNA, 22 nt, Human
agaagccaauucugugugaguc

SEQ ID NO: 919666 - RNA, 22 nt, Human
agguuauaugacugucaugccu

SEQ ID NO: 919667 - RNA, 22 nt, Human
ugcaggugugggcaggggagca

SEQ ID NO: 919668 - RNA, 22 nt, Human
gacuguggcugcguguaaggaa

SEQ ID NO: 919669 - RNA, 22 nt, Human
ucaaagcagcacauucgcaagc

SEQ ID NO: 919670 - RNA, 22 nt, Human
ugguucuaggcuuugucuuuug

SEQ ID NO: 919671 - RNA, 22 nt, Human
acagcagcugccuucaggcucu

SEQ ID NO: 919672 - RNA, 22 nt, Human
caaguuuaaagugagguuugaa

SEQ ID NO: 919673 - RNA, 22 nt, Human
ugcagggcauaggguccaguuu

SEQ ID NO: 919674 - RNA, 23 nt, Human
auguuugcaguaacccauccugg

SEQ ID NO: 919675 - RNA, 22 nt, Human
ucuggcuucuccuagagcaaug

SEQ ID NO: 919676 - RNA, 22 nt, Human
agagccacugggagacagagca

SEQ ID NO: 919677 - RNA, 22 nt, Human
aacuuaggaaaauaaggcauga

SEQ ID NO: 919678 - RNA, 22 nt, Human
uaggaaauuuuacuggucuggg

SEQ ID NO: 919679 - RNA, 22 nt, Human
auuagaagaggcugacgaaugu

SEQ ID NO: 919680 - RNA, 22 nt, Human
ccugucugcaugagugagcaua

SEQ ID NO: 919681 - RNA, 22 nt, Human
ggagggcaucaaucaggccugg

SEQ ID NO: 919682 - RNA, 22 nt, Human
caggcagauuugcugcccucca

SEQ ID NO: 919683 - RNA, 22 nt, Human
agcugcugccucacuggucugu

SEQ ID NO: 919684 - RNA, 22 nt, Human
ggccccagcuucaaccccgugg

SEQ ID NO: 919685 - RNA, 22 nt, Human
gacugcaagucugggaaaggag

SEQ ID NO: 919686 - RNA, 22 nt, Human
ucugcuguuuacugugugauau

SEQ ID NO: 919687 - RNA, 22 nt, Human
ggugggaucaaagagucauucg

SEQ ID NO: 919688 - RNA, 22 nt, Human
ucugaaauucacaguugaguca

SEQ ID NO: 919689 - RNA, 22 nt, Human
guaaauauaaaugcuagcugcc

SEQ ID NO: 919690 - RNA, 23 nt, Human
agguggagcugugcagccggggc

SEQ ID NO: 919691 - RNA, 22 nt, Human
guagcccaccuggggagggcga

SEQ ID NO: 919692 - RNA, 22 nt, Human
cugucuguuuuaccuucuccag

SEQ ID NO: 919693 - RNA, 22 nt, Human
cuggaggccacuguacagauug

SEQ ID NO: 919694 - RNA, 22 nt, Human
ccacuugugaaauaaucaaaua

SEQ ID NO: 919695 - RNA, 21 nt, Human
uucuccuguuuugcaccacag

SEQ ID NO: 919696 - RNA, 22 nt, Human
uggcuucauucuguaguuaaaa

SEQ ID NO: 919697 - RNA, 22 nt, Human
cccauuuuugugugaguaauga

SEQ ID NO: 919698 - RNA, 22 nt, Human
ccaggcucugcgcuggacaugg

SEQ ID NO: 919699 - RNA, 22 nt, Human
cuagucacucagcacugacaaa

SEQ ID NO: 919700 - RNA, 22 nt, Human
uuacagguggagaaguaaggcu

SEQ ID NO: 919701 - RNA, 22 nt, Human
ucuucaaacccugguuuuguga

SEQ ID NO: 919702 - RNA, 22 nt, Human
caugaacaccaggcaugaacaa

SEQ ID NO: 919703 - RNA, 18 nt, Human
aagaggaggagcagguug

SEQ ID NO: 919704 - RNA, 19 nt, Human
cuggggcuuugguacugcc

SEQ ID NO: 919705 - RNA, 19 nt, Human
ucaguggagaaaggggaag

SEQ ID NO: 919706 - RNA, 22 nt, Human
cugucugucaccaaaacagacu

SEQ ID NO: 919707 - RNA, 22 nt, Human
ucucagagugacaaugagaauu

SEQ ID NO: 919708 - RNA, 22 nt, Human
aaguggcagaauaguggcagga

SEQ ID NO: 919709 - RNA, 22 nt, Human
accacaggaggauggcugcugg

SEQ ID NO: 919710 - RNA, 22 nt, Human
agucaucucugagauagaagcu

SEQ ID NO: 919711 - RNA, 22 nt, Human
uuucuggguuuaugucacagcu

SEQ ID NO: 919712 - RNA, 22 nt, Human
ggaggggagucucccaaagccg

SEQ ID NO: 919713 - RNA, 22 nt, Human
cagaggaagggugcugcgaaag

SEQ ID NO: 919714 - RNA, 22 nt, Human
uuuuuaucuacagauucucagc

SEQ ID NO: 919715 - RNA, 22 nt, Human
uaaacuguagcucucguaauuc

SEQ ID NO: 919716 - RNA, 22 nt, Human
caguagaagcuuguuuuucaga

SEQ ID NO: 919717 - RNA, 22 nt, Human
aaguugauugcuucaaauuucu

SEQ ID NO: 919718 - RNA, 22 nt, Human
acacggcacuuuaggaaggggc

SEQ ID NO: 919719 - RNA, 23 nt, Human
aaaugacauaugguuucugaagg

SEQ ID NO: 919720 - RNA, 22 nt, Human
gaggaggcugaacaaugcccug

SEQ ID NO: 919721 - RNA, 22 nt, Human
acagcaggcaugaaugacacug

SEQ ID NO: 919722 - RNA, 22 nt, Human
cauuacaugguccaggauauau

SEQ ID NO: 919723 - RNA, 22 nt, Human
augccaagcuucagcugaaacu

SEQ ID NO: 919724 - RNA, 22 nt, Human
guucuucaggcugagcagagag

SEQ ID NO: 919725 - RNA, 22 nt, Human
cagagaggaggcuauaugcaaa

SEQ ID NO: 919726 - RNA, 22 nt, Human
cucaggcccacagcagacccac

SEQ ID NO: 919727 - RNA, 22 nt, Human
gcuuuaugugaguagcacuguc

SEQ ID NO: 919728 - RNA, 22 nt, Human
gagcaagacucacugcaucuug

SEQ ID NO: 919729 - RNA, 22 nt, Human
auauguguauggauuucuaucu

SEQ ID NO: 919730 - RNA, 22 nt, Human
ugccuuuaacuuaaagcaugac

SEQ ID NO: 919731 - RNA, 22 nt, Human
aaggccaaaguuuucaggcuaa

SEQ ID NO: 919732 - RNA, 22 nt, Human
uaagaaucaguagauauagauu

SEQ ID NO: 919733 - RNA, 22 nt, Human
cacagaaguuucauagucucga

SEQ ID NO: 919734 - RNA, 22 nt, Human
cuggaagguucuuugugugccu

SEQ ID NO: 919735 - RNA, 22 nt, Human
gucaagucaugacucaaaggaa

SEQ ID NO: 919736 - RNA, 22 nt, Human
cuuaaacugggcauucagagaa

SEQ ID NO: 919737 - RNA, 22 nt, Human
agauuguagaaacuguagcauu

SEQ ID NO: 919738 - RNA, 22 nt, Human
gagacagugguugcagaagcuc

SEQ ID NO: 919739 - RNA, 22 nt, Human
cugccuggaccggcagcccucc

SEQ ID NO: 919740 - RNA, 22 nt, Human
agcccugugugcuuguguuccu

SEQ ID NO: 919741 - RNA, 22 nt, Human
auuagcaacugucuugaaaaca

SEQ ID NO: 919742 - RNA, 21 nt, Human
cucaaagaccaaaaguguaga

SEQ ID NO: 919743 - RNA, 22 nt, Human
gcacaggcuccggaggagagcu

SEQ ID NO: 919744 - RNA, 22 nt, Human
auucuucauuguugauucaugu

SEQ ID NO: 919745 - RNA, 22 nt, Human
agguauuuacccacuuuuguuu

SEQ ID NO: 919746 - RNA, 22 nt, Human
uucaaacuaguuaaaagucaga

SEQ ID NO: 919747 - RNA, 22 nt, Human
gguuagagggcaugcgaucuuu

SEQ ID NO: 919748 - RNA, 22 nt, Human
aaagaaggaccuggaggaggau

SEQ ID NO: 919749 - RNA, 22 nt, Human
agaugugguaguugaagggaag

SEQ ID NO: 919750 - RNA, 22 nt, Human
gccagcagcgagaguuuaaccu

SEQ ID NO: 919751 - RNA, 22 nt, Human
uggcuccagcucaaguauggca

SEQ ID NO: 919752 - RNA, 22 nt, Human
cugggugauuccuguccaggca

SEQ ID NO: 919753 - RNA, 22 nt, Human
agcagggcuuugucucugugaa

SEQ ID NO: 919754 - RNA, 22 nt, Human
auguauuuacugagaaggaaac

SEQ ID NO: 919755 - RNA, 22 nt, Human
cacuucaaccucugaguccugg

SEQ ID NO: 919756 - RNA, 22 nt, Human
cacaauuuggugcuaaagaaag

SEQ ID NO: 919757 - RNA, 21 nt, Human
gagcugcaccuugaccuguuu

SEQ ID NO: 919758 - RNA, 22 nt, Human
aauuucuaauugaaucucucuu

SEQ ID NO: 919759 - RNA, 22 nt, Human
gauuucaaguaucuugggcgag

SEQ ID NO: 919760 - RNA, 22 nt, Human
ucacccagguccaggcucuggc

SEQ ID NO: 919761 - RNA, 22 nt, Human
agugcugucccgacaacugagg

SEQ ID NO: 919762 - RNA, 22 nt, Human
aggcuugauuuguccugcuuaa

SEQ ID NO: 919763 - RNA, 22 nt, Human
cugugccugccuuguucacuga

SEQ ID NO: 919764 - RNA, 22 nt, Human
uguaacaguuauaacaaugugg

SEQ ID NO: 919765 - RNA, 22 nt, Human
uggaaacaaagucauaagcuca

SEQ ID NO: 919766 - RNA, 22 nt, Human
ucugccugaaccacucuuggag

SEQ ID NO: 919767 - RNA, 21 nt, Human
uagcacagcuguagacaguuu

SEQ ID NO: 919768 - RNA, 22 nt, Human
uucaaauacauucuuugccacu

SEQ ID NO: 919769 - RNA, 18 nt, Human
caauuucauccuuaagcc

SEQ ID NO: 919770 - RNA, 22 nt, Human
augcuguggaugccuugcccca

SEQ ID NO: 919771 - RNA, 22 nt, Human
cggcugagcagugcugauggaa

SEQ ID NO: 919772 - RNA, 22 nt, Human
ugcuggccgugagcucucggga

SEQ ID NO: 919773 - RNA, 21 nt, Human
ucuguggcggacucuaggccc

SEQ ID NO: 919774 - RNA, 22 nt, Human
aaucagugcaaaggagagggua

SEQ ID NO: 919775 - RNA, 22 nt, Human
uguggcaggcaagauguacaga

SEQ ID NO: 919776 - RNA, 22 nt, Human
agccagggcugcgagcagacag

SEQ ID NO: 919777 - RNA, 22 nt, Human
cuugccuuugucuucaaaggcu

SEQ ID NO: 919778 - RNA, 22 nt, Human
acauccauuuuguucaaaagca

SEQ ID NO: 919779 - RNA, 22 nt, Human
cuccugaggggacaggacucau

SEQ ID NO: 919780 - RNA, 22 nt, Human
acagugauaaaauuucacaugu

SEQ ID NO: 919781 - RNA, 22 nt, Human
uugcagaacuuaaagacagagu

SEQ ID NO: 919782 - RNA, 22 nt, Human
uacugaaauacuaagaaguuaa

SEQ ID NO: 919783 - RNA, 22 nt, Human
aggcugaggggcgagggacccu

SEQ ID NO: 919784 - RNA, 22 nt, Human
acacugaauguuuaagaacuug

SEQ ID NO: 919785 - RNA, 22 nt, Human
agggggcucagcaggcucugga

SEQ ID NO: 919786 - RNA, 22 nt, Human
gcuuuuccugacuuuccauuag

SEQ ID NO: 919787 - RNA, 22 nt, Human
uuacaaucaucuaggauaaaga

SEQ ID NO: 919788 - RNA, 22 nt, Human
ugggagcaguucagguguggcu

SEQ ID NO: 919789 - RNA, 22 nt, Human
cucugggugggcagcagaugga

SEQ ID NO: 919790 - RNA, 22 nt, Human
gcaaggcagcauccuuuugagg

SEQ ID NO: 919791 - RNA, 22 nt, Human
caacaaguguucguaaagugcc

SEQ ID NO: 919792 - RNA, 15 nt, Human
gaguggcuuucagaa

SEQ ID NO: 919793 - RNA, 22 nt, Human
ugauucaauaggaauugaguag

SEQ ID NO: 919794 - RNA, 22 nt, Human
guuuugcuucucauguuaagug

SEQ ID NO: 919795 - RNA, 20 nt, Human
uuacaaagaggcaucgcuuu

SEQ ID NO: 919796 - RNA, 22 nt, Human
ugcaugcucaaguuaguuguga

SEQ ID NO: 919797 - RNA, 22 nt, Human
aaauccagguaguuugguuuga

SEQ ID NO: 919798 - RNA, 22 nt, Human
auaguuuaccuuccagauggcu

SEQ ID NO: 919799 - RNA, 22 nt, Human
gucuauguaaacgucuacauua

SEQ ID NO: 919800 - RNA, 22 nt, Human
uaacuuuuacuuaccaucugag

SEQ ID NO: 919801 - RNA, 22 nt, Human
ugagcuggcaggggcucaggga

SEQ ID NO: 919802 - RNA, 22 nt, Human
aggccucacacaacagaugcau

SEQ ID NO: 919803 - RNA, 22 nt, Human
aauaaagaauggaugagaucgu

SEQ ID NO: 919804 - RNA, 22 nt, Human
ccaggccagcaggcacaccugc

SEQ ID NO: 919805 - RNA, 22 nt, Human
gucaggaaaaauugauaauuuu

SEQ ID NO: 919806 - RNA, 20 nt, Human
cugagguagggcagaucacc

SEQ ID NO: 919807 - RNA, 22 nt, Human
cuggaauggguuucaggcacug

SEQ ID NO: 919808 - RNA, 22 nt, Human
cauuugaaccuggauguucuua

SEQ ID NO: 919809 - RNA, 20 nt, Human
gaggccucagccucagcucc

SEQ ID NO: 919810 - RNA, 22 nt, Human
gugcuuuaguucuugcaacugg

SEQ ID NO: 919811 - RNA, 22 nt, Human
guauuuuucaguuaggagcuua

SEQ ID NO: 919812 - RNA, 22 nt, Human
auuuagacuucccagcacugug

SEQ ID NO: 919813 - RNA, 18 nt, Human
ucaugagguagaggcugg

SEQ ID NO: 919814 - RNA, 22 nt, Human
cacauacaaggcacacuggagg

SEQ ID NO: 919815 - RNA, 22 nt, Human
gagcagagcuucucaaaguaaa

SEQ ID NO: 919816 - RNA, 22 nt, Human
uacuacauacagaauuuagaga

SEQ ID NO: 919817 - RNA, 17 nt, Human
gagaaguuuugcuaccg

SEQ ID NO: 919818 - RNA, 22 nt, Human
ggauuuccagcuucauugucua

SEQ ID NO: 919819 - RNA, 22 nt, Human
uuuguaaaauuagggaauucaa

SEQ ID NO: 919820 - RNA, 22 nt, Human
ugcagcaucuccuugugccaug

SEQ ID NO: 919821 - RNA, 22 nt, Human
agcagccauccuuagagaaaga

SEQ ID NO: 919822 - RNA, 22 nt, Human
agcccucauggaacagcuccua

SEQ ID NO: 919823 - RNA, 22 nt, Human
aaaguguaaggaauuuaaguaa

SEQ ID NO: 919824 - RNA, 22 nt, Human
ucugaaaugcaaauuugacuga

SEQ ID NO: 919825 - RNA, 22 nt, Human
cauaaaguuuuauaggcucaaa

SEQ ID NO: 919826 - RNA, 22 nt, Human
ccugggcaacauagugagaccu

SEQ ID NO: 919827 - RNA, 22 nt, Human
uaaggaauagugcuaugaaaaa

SEQ ID NO: 919828 - RNA, 22 nt, Human
uccugggagcaugaagagggau

SEQ ID NO: 919829 - RNA, 22 nt, Human
acaguacuguguuaacugaacc

SEQ ID NO: 919830 - RNA, 22 nt, Human
acagccagggucucaggaggcg

SEQ ID NO: 919831 - RNA, 21 nt, Human
ccuggccaaucugauaggguu

SEQ ID NO: 919832 - RNA, 22 nt, Human
cacaguuaagggaugucauguu

SEQ ID NO: 919833 - RNA, 22 nt, Human
acagugaaaauucuauugauuu

SEQ ID NO: 919834 - RNA, 22 nt, Human
acugaaaaaguaugauucacug

SEQ ID NO: 919835 - RNA, 23 nt, Human
ccaguggcguaaacuagaggaua

SEQ ID NO: 919836 - RNA, 22 nt, Human
augucuuugccauaguucauau

SEQ ID NO: 919837 - RNA, 22 nt, Human
ucucuuagucuuauauguaaaa

SEQ ID NO: 919838 - RNA, 22 nt, Human
acugagaacuugccaaggacug

SEQ ID NO: 919839 - RNA, 22 nt, Human
gucuucugaucugguuagccau

SEQ ID NO: 919840 - RNA, 22 nt, Human
acuuccaaauaccaucacauug

SEQ ID NO: 919841 - RNA, 22 nt, Human
auuggcagggccagcaucuccc

SEQ ID NO: 919842 - RNA, 22 nt, Human
agcaggcacgcucccugcgcga

SEQ ID NO: 919843 - RNA, 22 nt, Human
auuagaauuaugcuugcuaaug

SEQ ID NO: 919844 - RNA, 22 nt, Human
cauguaaagaauuucacacaag

SEQ ID NO: 919845 - RNA, 22 nt, Human
caucuuaacaggucucugaggg

SEQ ID NO: 919846 - RNA, 22 nt, Human
gugcaggagccagggguaggaa

SEQ ID NO: 919847 - RNA, 22 nt, Human
cugaggccccucucuugagcuu

SEQ ID NO: 919848 - RNA, 22 nt, Human
uauugucucugcguuguucuau

SEQ ID NO: 919849 - RNA, 22 nt, Human
cuggaggggccauccacagucu

SEQ ID NO: 919850 - RNA, 22 nt, Human
uucuguucuuuauuuaccauau

SEQ ID NO: 919851 - RNA, 22 nt, Human
agugggaggcggcugacgggcg

SEQ ID NO: 919852 - RNA, 22 nt, Human
ucaaguauaucuagucauuagg

SEQ ID NO: 919853 - RNA, 22 nt, Human
caggcccuccugugaucugccu

SEQ ID NO: 919854 - RNA, 22 nt, Human
auguaguuagaagauucaaaca

SEQ ID NO: 919855 - RNA, 21 nt, Human
ugccagcugcugcaucugucu

SEQ ID NO: 919856 - RNA, 22 nt, Human
gcuuuaugcaaaccugguacuu

SEQ ID NO: 919857 - RNA, 23 nt, Human
ugcagcaaccuuggaagcauuuc

SEQ ID NO: 919858 - RNA, 22 nt, Human
gccugagggcuccuagcaggcu

SEQ ID NO: 919859 - RNA, 19 nt, Human
ccagcagacacagcugccc

SEQ ID NO: 919860 - RNA, 22 nt, Human
ucugagaggcaucugcacuucu

SEQ ID NO: 919861 - RNA, 22 nt, Human
agggcgacaauggagagcguuu

SEQ ID NO: 919862 - RNA, 22 nt, Human
ggcuccaggugcaugccaggcu

SEQ ID NO: 919863 - RNA, 22 nt, Human
guuuauaaggcccaauauuucu

SEQ ID NO: 919864 - RNA, 22 nt, Human
cugugugucauuugucaauccu

SEQ ID NO: 919865 - RNA, 22 nt, Human
cccugggucuagguuaugugcu

SEQ ID NO: 919866 - RNA, 22 nt, Human
ccucagcugcugcacagcuuuu

SEQ ID NO: 919867 - RNA, 22 nt, Human
auuagcaugccaagcuuuuaga

SEQ ID NO: 919868 - RNA, 22 nt, Human
cuccucagaagaggguaacaca

SEQ ID NO: 919869 - RNA, 22 nt, Human
aauguauuuugggaguuucuuu

SEQ ID NO: 919870 - RNA, 22 nt, Human
caggcaaggaggcacugaggga

SEQ ID NO: 919871 - RNA, 22 nt, Human
ccuggaaagaggaaggaagccu

SEQ ID NO: 919872 - RNA, 22 nt, Human
ucugccacuuaccuccauguac

SEQ ID NO: 919873 - RNA, 22 nt, Human
ucuuuagaaacuuuucuucaug

SEQ ID NO: 919874 - RNA, 22 nt, Human
cagugaugaucauuguaacauc

SEQ ID NO: 919875 - RNA, 22 nt, Human
gucugagauuagggaagauuuu

SEQ ID NO: 919876 - RNA, 22 nt, Human
aauagcaaaguuaucaaauuaa

SEQ ID NO: 919877 - RNA, 22 nt, Human
uuuucagugguaucuuuguaaa

SEQ ID NO: 919878 - RNA, 22 nt, Human
agaaguuucucugaacguguag

SEQ ID NO: 919879 - RNA, 22 nt, Human
ugugaccauaauuuguaaauaa

SEQ ID NO: 919880 - RNA, 22 nt, Human
ugucuggggguucugaaagcug

SEQ ID NO: 919881 - RNA, 22 nt, Human
uacauucagagaaaguuuccau

SEQ ID NO: 919882 - RNA, 22 nt, Human
acuccagagcucacaugucuaa

SEQ ID NO: 919883 - RNA, 22 nt, Human
ggaggucacaaggugaguaaag

SEQ ID NO: 919884 - RNA, 22 nt, Human
cauguacaaggaugcucagagu

SEQ ID NO: 919885 - RNA, 22 nt, Human
auggacaguacugaguggacua

SEQ ID NO: 919886 - RNA, 20 nt, Human
agaaacauuucuugagaacu

SEQ ID NO: 919887 - RNA, 22 nt, Human
uccuggccuccguucucugcau

SEQ ID NO: 919888 - RNA, 22 nt, Human
agcucccagcagagcuggccac

SEQ ID NO: 919889 - RNA, 22 nt, Human
gcugagcacagcaaagagacaa

SEQ ID NO: 919890 - RNA, 22 nt, Human
aaagucugaaagauaagaguga

SEQ ID NO: 919891 - RNA, 22 nt, Human
uuuacuaacaccauacaugcug

SEQ ID NO: 919892 - RNA, 22 nt, Human
uuaauacagucuccagaaguaa

SEQ ID NO: 919893 - RNA, 22 nt, Human
ggugucugcuucccuccagcug

SEQ ID NO: 919894 - RNA, 22 nt, Human
aggcugagagcaacgugucaga

SEQ ID NO: 919895 - RNA, 22 nt, Human
cacagggaggcggucacuggcu

SEQ ID NO: 919896 - RNA, 22 nt, Human
ccagcuucaugggcaugcacca

SEQ ID NO: 919897 - RNA, 22 nt, Human
acagaguuagcagaaaguugga

SEQ ID NO: 919898 - RNA, 22 nt, Human
ucacauuuguuccucugcacuu

SEQ ID NO: 919899 - RNA, 18 nt, Human
uuguuuuaagacucuguc

SEQ ID NO: 919900 - RNA, 22 nt, Human
uacacauaggucugaauaaaaa

SEQ ID NO: 919901 - RNA, 22 nt, Human
ucacaauuuggauacagcuaug

SEQ ID NO: 919902 - RNA, 22 nt, Human
gcuccugcaggacccaggagac

SEQ ID NO: 919903 - RNA, 22 nt, Human
ggcaagugauccuggagcaccg

SEQ ID NO: 919904 - RNA, 22 nt, Human
caguccucucacucaggccuuu

SEQ ID NO: 919905 - RNA, 22 nt, Human
agauggugauagagcugggauu

SEQ ID NO: 919906 - RNA, 22 nt, Human
caaggaaaagaaguauuucaga

SEQ ID NO: 919907 - RNA, 22 nt, Human
uccucacacuauagaugaggau

SEQ ID NO: 919908 - RNA, 22 nt, Human
ucaggaaguuuugaaucaacug

SEQ ID NO: 919909 - RNA, 22 nt, Human
uaaggaaaauggacaucaaaca

SEQ ID NO: 919910 - RNA, 17 nt, Human
cuaaauacuugcguuuc

SEQ ID NO: 919911 - RNA, 22 nt, Human
uaagaugaccuuauaaagagca

SEQ ID NO: 919912 - RNA, 22 nt, Human
gauacaaaauauaaauggagag

SEQ ID NO: 919913 - RNA, 22 nt, Human
cgcaggaagacaaggguggaaa

SEQ ID NO: 919914 - RNA, 22 nt, Human
aggggcuggcuuaucugagagu

SEQ ID NO: 919915 - RNA, 22 nt, Human
uggaagcgagacagagaucucc

SEQ ID NO: 919916 - RNA, 22 nt, Human
gguagcagggcugugagucaga

SEQ ID NO: 919917 - RNA, 22 nt, Human
ggcucuggcuccuggcuuugug

SEQ ID NO: 919918 - RNA, 20 nt, Human
acgugugugugcacgcgcgc

SEQ ID NO: 919919 - RNA, 22 nt, Human
cagcucuuggagaaaccagagc

SEQ ID NO: 919920 - RNA, 18 nt, Human
gcuccugguuggaaagaa

SEQ ID NO: 919921 - RNA, 23 nt, Human
acacuaaaugugaaggagcaaag

SEQ ID NO: 919922 - RNA, 22 nt, Human
ucuguacauuuguguugugaau

SEQ ID NO: 919923 - RNA, 22 nt, Human
cccuguuuuaaguugauauuga

SEQ ID NO: 919924 - RNA, 22 nt, Human
uccuggggaggguucuggcucc

SEQ ID NO: 919925 - RNA, 22 nt, Human
uggcaacauggacaggucugcc

SEQ ID NO: 919926 - RNA, 21 nt, Human
uacgugugugcauguuuauau

SEQ ID NO: 919927 - RNA, 22 nt, Human
cccaggcuuuuaaguuagacag

SEQ ID NO: 919928 - RNA, 21 nt, Human
augcaucuaucuucuacucca

SEQ ID NO: 919929 - RNA, 22 nt, Human
uucugcauuuaaaauauuacua

SEQ ID NO: 919930 - RNA, 22 nt, Human
uugucucucauuccugcaacuc

SEQ ID NO: 919931 - RNA, 22 nt, Human
ccaagaguaaauucaugaugcc

SEQ ID NO: 919932 - RNA, 22 nt, Human
ugggccugggcuccuguccucu

SEQ ID NO: 919933 - RNA, 21 nt, Human
uagcaaauggagaguaagaga

SEQ ID NO: 919934 - RNA, 22 nt, Human
aaugucuuucucauaacagaua

SEQ ID NO: 919935 - RNA, 22 nt, Human
aaggaaauuagguuauuuugcu

SEQ ID NO: 919936 - RNA, 20 nt, Human
agccagaagaaggcuggaga

SEQ ID NO: 919937 - RNA, 22 nt, Human
gagcuugguguuauuucugugg

SEQ ID NO: 919938 - RNA, 22 nt, Human
cacaaggccuuguagaccacgg

SEQ ID NO: 919939 - RNA, 22 nt, Human
gggucuucauuuauucuacacu

SEQ ID NO: 919940 - RNA, 18 nt, Human
uggcuucugcuagcugga

SEQ ID NO: 919941 - RNA, 22 nt, Human
gcuaggaguaaggagaccuuca

SEQ ID NO: 919942 - RNA, 22 nt, Human
cuggaggcacccuuagagaggc

SEQ ID NO: 919943 - RNA, 22 nt, Human
aucuuauguuguauucaaaauc

SEQ ID NO: 919944 - RNA, 22 nt, Human
auauuuaaacaggguaccaaua

SEQ ID NO: 919945 - RNA, 22 nt, Human
agagacugauggaucaccaaau

SEQ ID NO: 919946 - RNA, 23 nt, Human
caggcaggaugaggacuacacuc

SEQ ID NO: 919947 - RNA, 22 nt, Human
uuuccaaaguugccauaagcuu

SEQ ID NO: 919948 - RNA, 22 nt, Human
uucucucuuacugccaugcugu

SEQ ID NO: 919949 - RNA, 22 nt, Human
acagaacuuccugcuggagugg

SEQ ID NO: 919950 - RNA, 22 nt, Human
agugucugugaggggaauuccu

SEQ ID NO: 919951 - RNA, 17 nt, Human
ucuuugcaaugagacug

SEQ ID NO: 919952 - RNA, 22 nt, Human
gagcauuuuugucugcauuuua

SEQ ID NO: 919953 - RNA, 22 nt, Human
ucuuagcagugcugagaagaau

SEQ ID NO: 919954 - RNA, 22 nt, Human
ugucugaauuuuggaaucaagu

SEQ ID NO: 919955 - RNA, 22 nt, Human
ucagcuguccgcagcccacuuc

SEQ ID NO: 919956 - RNA, 22 nt, Human
uagaggcacccuggaggagacu

SEQ ID NO: 919957 - RNA, 22 nt, Human
auaaucuuguauuuccuaaagu

SEQ ID NO: 919958 - RNA, 22 nt, Human
uucaucuagugugcucguaacg

SEQ ID NO: 919959 - RNA, 22 nt, Human
ugcacaagucagaguaacauuu

SEQ ID NO: 919960 - RNA, 22 nt, Human
uucucucauucaaauuaaagug

SEQ ID NO: 919961 - RNA, 22 nt, Human
auaauggcuucugaguauuagg

SEQ ID NO: 919962 - RNA, 22 nt, Human
acuuguuugaaucucucuagag

SEQ ID NO: 919963 - RNA, 22 nt, Human
uuugagaaaaccagaaagaucu

SEQ ID NO: 919964 - RNA, 17 nt, Human
uuggcucuauugccucu

SEQ ID NO: 919965 - RNA, 22 nt, Human
gaaacuugauaauugaaacaga

SEQ ID NO: 919966 - RNA, 22 nt, Human
uguuuuauauaagcagagcggu

SEQ ID NO: 919967 - RNA, 22 nt, Human
gugccuggcacacagaaggcaa

SEQ ID NO: 919968 - RNA, 22 nt, Human
uuauuguaggccuauuguagaa

SEQ ID NO: 919969 - RNA, 22 nt, Human
cagguucugccauuuacuugua

SEQ ID NO: 919970 - RNA, 22 nt, Human
aagugacuauuugaguacauca

SEQ ID NO: 919971 - RNA, 22 nt, Human
guauucugggccgauuacaaaa

SEQ ID NO: 919972 - RNA, 22 nt, Human
aaugucuuuuaaccucuggacu

SEQ ID NO: 919973 - RNA, 22 nt, Human
uuuuaucagcagggauaacaag

SEQ ID NO: 919974 - RNA, 22 nt, Human
gccucuggguuggugacaggcu

SEQ ID NO: 919975 - RNA, 22 nt, Human
gagggccuagaagcuccauaug

SEQ ID NO: 919976 - RNA, 22 nt, Human
ucaagaacugugaagagucuga

SEQ ID NO: 919977 - RNA, 19 nt, Human
ugucuggaagagcugcagg

SEQ ID NO: 919978 - RNA, 22 nt, Human
auggccagucuguuggacagca

SEQ ID NO: 919979 - RNA, 22 nt, Human
aggcucagcccaagguggagag

SEQ ID NO: 919980 - RNA, 22 nt, Human
ucagcacuuacuaguggccuuu

SEQ ID NO: 919981 - RNA, 20 nt, Human
acaggcuuucugaggcuggc

SEQ ID NO: 919982 - RNA, 22 nt, Human
cacaauguauauguauaucaaa

SEQ ID NO: 919983 - RNA, 22 nt, Human
gcuggacuagaagcagggcuca

SEQ ID NO: 919984 - RNA, 22 nt, Human
aggaaaaugaaacagcaacugu

SEQ ID NO: 919985 - RNA, 22 nt, Human
ggaccgguggcuuccucggguc

SEQ ID NO: 919986 - RNA, 22 nt, Human
ucacagggcauuauggcuccag

SEQ ID NO: 919987 - RNA, 19 nt, Human
uugcagcaaaguuaggacc

SEQ ID NO: 919988 - RNA, 22 nt, Human
ggccaggagauggacaccacau

SEQ ID NO: 919989 - RNA, 22 nt, Human
acuguacauguaaacauuguca

SEQ ID NO: 919990 - RNA, 22 nt, Human
uguacacaugguguacacuccc

SEQ ID NO: 919991 - RNA, 22 nt, Human
ccugggcuuugagggcaggaug

SEQ ID NO: 919992 - RNA, 22 nt, Human
uggcaguguuucuaaggggcuc

SEQ ID NO: 919993 - RNA, 22 nt, Human
aaaucccagauaguaauguauu

SEQ ID NO: 919994 - RNA, 22 nt, Human
gcagaggugaccagcagcaggg

SEQ ID NO: 919995 - RNA, 21 nt, Human
acaggcaauuucauaugguuc

SEQ ID NO: 919996 - RNA, 22 nt, Human
agcugccuuaaauuacuuugug

SEQ ID NO: 919997 - RNA, 22 nt, Human
gagucaacaagucagaucucac

SEQ ID NO: 919998 - RNA, 22 nt, Human
agcuuguuagaaauguagacuc

SEQ ID NO: 919999 - RNA, 22 nt, Human
uacauacaugguggaaugguua

SEQ ID NO: 920000 - RNA, 19 nt, Human
gucuagaccaggcuccuua

SEQ ID NO: 920001 - RNA, 22 nt, Human
cacaauuauuaucucuuucuac

SEQ ID NO: 920002 - RNA, 22 nt, Human
ugagacagcagauuagcaauga

SEQ ID NO: 920003 - RNA, 22 nt, Human
aggcucuauaccgcugggaguu

SEQ ID NO: 920004 - RNA, 22 nt, Human
cgcugcagacgcgcuggcgaaa

SEQ ID NO: 920005 - RNA, 22 nt, Human
gcagggcucugcuguaguccua

SEQ ID NO: 920006 - RNA, 22 nt, Human
agcgcgcucgaugguuuccgcg

SEQ ID NO: 920007 - RNA, 22 nt, Human
uguucauuuugaaguacuucaa

SEQ ID NO: 920008 - RNA, 22 nt, Human
ggugacagugguuaaaauuugu

SEQ ID NO: 920009 - RNA, 22 nt, Human
gaggaggcuuccgggaggcacg

SEQ ID NO: 920010 - RNA, 22 nt, Human
caugaaaauaacauuguuguga

SEQ ID NO: 920011 - RNA, 22 nt, Human
uuacaagcagcuacauaucaca

SEQ ID NO: 920012 - RNA, 22 nt, Human
aagcuggggacucagaccccau

SEQ ID NO: 920013 - RNA, 22 nt, Human
uaacaugagagcuaagacauua

SEQ ID NO: 920014 - RNA, 22 nt, Human
acaggaagaaagugcaguagau

SEQ ID NO: 920015 - RNA, 22 nt, Human
auacuacauacuauguaaacau

SEQ ID NO: 920016 - RNA, 19 nt, Human
uauucuguuaaccuuuguc

SEQ ID NO: 920017 - RNA, 22 nt, Human
auucuaagcacgcugaagucuu

SEQ ID NO: 920018 - RNA, 22 nt, Human
aagagcagaaguccuuggaucc

SEQ ID NO: 920019 - RNA, 18 nt, Human
ucauagaagugaaucaga

SEQ ID NO: 920020 - RNA, 22 nt, Human
cagaaagugauuugcuauucca

SEQ ID NO: 920021 - RNA, 22 nt, Human
gaagaugggaaugaugaguggg

SEQ ID NO: 920022 - RNA, 21 nt, Human
acagaggcauacagcuuaagg

SEQ ID NO: 920023 - RNA, 22 nt, Human
aaguuguaugucuuagaaagua

SEQ ID NO: 920024 - RNA, 22 nt, Human
ccugaguagcuggaauuaaagg

SEQ ID NO: 920025 - RNA, 22 nt, Human
cugucuuugguccugucuguua

SEQ ID NO: 920026 - RNA, 22 nt, Human
aacauagaauaaaugaguuagg

SEQ ID NO: 920027 - RNA, 22 nt, Human
gcugggaguuacugucuccuuu

SEQ ID NO: 920028 - RNA, 22 nt, Human
uugggagaaauaguugauccgc

SEQ ID NO: 920029 - RNA, 22 nt, Human
caccuugagggggaaaauaauc

SEQ ID NO: 920030 - RNA, 22 nt, Human
aggcuucacgaugggugaggug

SEQ ID NO: 920031 - RNA, 22 nt, Human
caggcagccaggggaccugucc

SEQ ID NO: 920032 - RNA, 22 nt, Human
aaugauaccgccaauauuacca

SEQ ID NO: 920033 - RNA, 22 nt, Human
auguaugucugcauacacauac

SEQ ID NO: 920034 - RNA, 22 nt, Human
ugacaggauaguaggaagaucu

SEQ ID NO: 920035 - RNA, 21 nt, Human
uguaugcacgcacaugcacac

SEQ ID NO: 920036 - RNA, 22 nt, Human
guggcuccgcaggcuccauucu

SEQ ID NO: 920037 - RNA, 22 nt, Human
acaggcagcgucauugcugcuc

SEQ ID NO: 920038 - RNA, 22 nt, Human
aacaagaauaagugguuucugg

SEQ ID NO: 920039 - RNA, 22 nt, Human
aacaaacauuaccuggugcugg

SEQ ID NO: 920040 - RNA, 22 nt, Human
ggugagaggcagaggacagcuu

SEQ ID NO: 920041 - RNA, 22 nt, Human
gccaguaagugguagaguugag

SEQ ID NO: 920042 - RNA, 22 nt, Human
cagaaacauguauaaaguugua

SEQ ID NO: 920043 - RNA, 22 nt, Human
acucuggggcgcuacuccaacu

SEQ ID NO: 920044 - RNA, 22 nt, Human
cugcccuguaucuucucccaau

SEQ ID NO: 920045 - RNA, 22 nt, Human
uuuaugauuaauccaauucugu

SEQ ID NO: 920046 - RNA, 22 nt, Human
gcuucaaauuaaggugaauccc

SEQ ID NO: 920047 - RNA, 22 nt, Human
uacacugaaagagaggauugaa

SEQ ID NO: 920048 - RNA, 22 nt, Human
caucugucuccucaucgccugu

SEQ ID NO: 920049 - RNA, 22 nt, Human
aggcuucaguagggagcauguc

SEQ ID NO: 920050 - RNA, 22 nt, Human
uucuuacaaacaagaucauuga

SEQ ID NO: 920051 - RNA, 22 nt, Human
uucauugacugguucguuaagu

SEQ ID NO: 920052 - RNA, 22 nt, Human
cacagaugagcugaauagcuuu

SEQ ID NO: 920053 - RNA, 22 nt, Human
auuacaauaauacaugcucauu

SEQ ID NO: 920054 - RNA, 21 nt, Human
uggcucugaaagagugcugca

SEQ ID NO: 920055 - RNA, 22 nt, Human
acaucuguucuucucuuguccc

SEQ ID NO: 920056 - RNA, 22 nt, Human
accagcuguguccuggcugcag

SEQ ID NO: 920057 - RNA, 19 nt, Human
ucacuucuguuagcaugga

SEQ ID NO: 920058 - RNA, 22 nt, Human
aagcuguguaaguugcuugguu

SEQ ID NO: 920059 - RNA, 22 nt, Human
acucuucaccgcuacugaaaua

SEQ ID NO: 920060 - RNA, 22 nt, Human
cuaauguaaagcauuuguucag

SEQ ID NO: 920061 - RNA, 17 nt, Human
ucugagaacuugaagca

SEQ ID NO: 920062 - RNA, 22 nt, Human
ucagaaguugagauauucaggg

SEQ ID NO: 920063 - RNA, 20 nt, Human
cugcagggugagugggcgau

SEQ ID NO: 920064 - RNA, 20 nt, Human
uuuuggugaauuccagaaua

SEQ ID NO: 920065 - RNA, 22 nt, Human
auggcagaagucaagaugaguu

SEQ ID NO: 920066 - RNA, 22 nt, Human
gcacccagauauugccuugacc

SEQ ID NO: 920067 - RNA, 22 nt, Human
auugcuggaugagcucuuggau

SEQ ID NO: 920068 - RNA, 22 nt, Human
cauggccuugagugacugcacu

SEQ ID NO: 920069 - RNA, 22 nt, Human
gcagguggcagaggugggaucu

SEQ ID NO: 920070 - RNA, 22 nt, Human
cauuugaugacucaacucauaa

SEQ ID NO: 920071 - RNA, 22 nt, Human
cuggaagggggacagccacaca

SEQ ID NO: 920072 - RNA, 22 nt, Human
gccuccugacuuacacugagcu

SEQ ID NO: 920073 - RNA, 22 nt, Human
aaaguaaggguuaaucuacuuu

SEQ ID NO: 920074 - RNA, 22 nt, Human
ugaaggcauugaugaaggaauc

SEQ ID NO: 920075 - RNA, 22 nt, Human
cuggccaggccccuugcagggc

SEQ ID NO: 920076 - RNA, 22 nt, Human
aaacaagucacuuuaucuugaa

SEQ ID NO: 920077 - RNA, 22 nt, Human
augagguagcuguggcuggcug

SEQ ID NO: 920078 - RNA, 22 nt, Human
acuuuauguuugauaucuaugg

SEQ ID NO: 920079 - RNA, 22 nt, Human
gaaauguuguccugucucuuga

SEQ ID NO: 920080 - RNA, 22 nt, Human
aggaagcuaaccagggagugag

SEQ ID NO: 920081 - RNA, 22 nt, Human
uaacuucagcgaguucucuuaa

SEQ ID NO: 920082 - RNA, 22 nt, Human
uuucaaacugggagugagggga

SEQ ID NO: 920083 - RNA, 22 nt, Human
guuuuuccuugcugaggacccg

SEQ ID NO: 920084 - RNA, 22 nt, Human
gcagaggucuagcaccaagaau

SEQ ID NO: 920085 - RNA, 22 nt, Human
agcucacagaaauccugcagga

SEQ ID NO: 920086 - RNA, 22 nt, Human
cacugugggccugucgugggug

SEQ ID NO: 920087 - RNA, 22 nt, Human
cagagugggcugucagccacca

SEQ ID NO: 920088 - RNA, 22 nt, Human
gacaaauaggucaacaggaggg

SEQ ID NO: 920089 - RNA, 22 nt, Human
acacuacaaucucagaacuaua

SEQ ID NO: 920090 - RNA, 22 nt, Human
gcugcuggagagcgagacuguu

SEQ ID NO: 920091 - RNA, 17 nt, Human
gcagccagugcagcagg

SEQ ID NO: 920092 - RNA, 22 nt, Human
cucuuuggugcaccuugcaguc

SEQ ID NO: 920093 - RNA, 22 nt, Human
gaggggcgcugucgggucaccu

SEQ ID NO: 920094 - RNA, 23 nt, Human
ucucugguuaggggagauuggug

SEQ ID NO: 920095 - RNA, 22 nt, Human
cugggagcggcugucacugguu

SEQ ID NO: 920096 - RNA, 22 nt, Human
ugugaugguucacugggcauga

SEQ ID NO: 920097 - RNA, 22 nt, Human
agcuuucucuucuuuagaaagu

SEQ ID NO: 920098 - RNA, 22 nt, Human
uauacagaacugcacgugcacg

SEQ ID NO: 920099 - RNA, 22 nt, Human
gaggaggcacuaguuagugaca

SEQ ID NO: 920100 - RNA, 22 nt, Human
auuugucauguauguaaaguug

SEQ ID NO: 920101 - RNA, 22 nt, Human
gcccaggcuggagugcaguagc

SEQ ID NO: 920102 - RNA, 22 nt, Human
uacauauguaaacauguauaaa

SEQ ID NO: 920103 - RNA, 22 nt, Human
caguaggaaggaugcagaaaaa

SEQ ID NO: 920104 - RNA, 22 nt, Human
ugucagugaguuggguccugag

SEQ ID NO: 920105 - RNA, 22 nt, Human
aguauuuucgccaucacaagaa

SEQ ID NO: 920106 - RNA, 22 nt, Human
aauggucauuggugguuauugg

SEQ ID NO: 920107 - RNA, 22 nt, Human
uuuccaauaaggucaccuuccu

SEQ ID NO: 920108 - RNA, 22 nt, Human
gcuuucccugcccucagaagga

SEQ ID NO: 920109 - RNA, 22 nt, Human
uaugaguacaaggaaucuucca

SEQ ID NO: 920110 - RNA, 22 nt, Human
gccagcagccacagaagucacu

SEQ ID NO: 920111 - RNA, 20 nt, Human
accagagacuggggacaagu

SEQ ID NO: 920112 - RNA, 22 nt, Human
ucucuguggcaacuacuuagcu

SEQ ID NO: 920113 - RNA, 22 nt, Human
cuucugggauuuuugaagacuc

SEQ ID NO: 920114 - RNA, 22 nt, Human
accaugcaucaaagcuaauaua

SEQ ID NO: 920115 - RNA, 22 nt, Human
uugagggaacaugagaaucauc

SEQ ID NO: 920116 - RNA, 22 nt, Human
caggcagcugacugucagauau

SEQ ID NO: 920117 - RNA, 22 nt, Human
uccugagauccuuuuagggauc

SEQ ID NO: 920118 - RNA, 22 nt, Human
ugugcauguaccuuauucugga

SEQ ID NO: 920119 - RNA, 19 nt, Human
uccuggggauguggucacc

SEQ ID NO: 920120 - RNA, 22 nt, Human
ccuggguagacuuugaagcauu

SEQ ID NO: 920121 - RNA, 22 nt, Human
acuguacaaauauugcaaaaua

SEQ ID NO: 920122 - RNA, 22 nt, Human
ucuaaaaugcagaucuacuggu

SEQ ID NO: 920123 - RNA, 22 nt, Human
aagaggcuggaggauacugcgc

SEQ ID NO: 920124 - RNA, 22 nt, Human
aagcaaggccggaaggaaacuc

SEQ ID NO: 920125 - RNA, 22 nt, Human
ccagagcagggcagcagggcuc

SEQ ID NO: 920126 - RNA, 22 nt, Human
uuuuaucugcuucauuaguuga

SEQ ID NO: 920127 - RNA, 22 nt, Human
cugugcacuucucuuuauuugu

SEQ ID NO: 920128 - RNA, 22 nt, Human
agcagcuuuccucuggggucag

SEQ ID NO: 920129 - RNA, 22 nt, Human
acuugaaaagcucagcaguagu

SEQ ID NO: 920130 - RNA, 22 nt, Human
ggguucaucaaaggacagacuc

SEQ ID NO: 920131 - RNA, 22 nt, Human
acugauauuaaacacaauuuaa

SEQ ID NO: 920132 - RNA, 22 nt, Human
ugugaagagaguaauaaaguca

SEQ ID NO: 920133 - RNA, 22 nt, Human
cuugccuacuugucaaccagca

SEQ ID NO: 920134 - RNA, 22 nt, Human
auugaaaauauaauucuaggag

SEQ ID NO: 920135 - RNA, 22 nt, Human
cucaauacccagggacucuaga

SEQ ID NO: 920136 - RNA, 21 nt, Human
auggcuucucaggugcacuga

SEQ ID NO: 920137 - RNA, 22 nt, Human
gcacaauuccaugggacagccc

SEQ ID NO: 920138 - RNA, 22 nt, Human
cuuguuuuuaagagauguuuac

SEQ ID NO: 920139 - RNA, 22 nt, Human
ugagcaggcucccacuucagug

SEQ ID NO: 920140 - RNA, 22 nt, Human
ccagggagccuggugugucagc

SEQ ID NO: 920141 - RNA, 22 nt, Human
uggggaucauaaauugauggag

SEQ ID NO: 920142 - RNA, 22 nt, Human
acuuuuucucagaaggauuggu

SEQ ID NO: 920143 - RNA, 22 nt, Human
ucuuccugaaacccuguuccag

SEQ ID NO: 920144 - RNA, 22 nt, Human
uuucacagaaaggauaacauua

SEQ ID NO: 920145 - RNA, 22 nt, Human
augucagucuuucugucucaga

SEQ ID NO: 920146 - RNA, 22 nt, Human
uugucuuauuuuaucauaagca

SEQ ID NO: 920147 - RNA, 22 nt, Human
agcauucauugcuagaauguaa

SEQ ID NO: 920148 - RNA, 22 nt, Human
uucuuauugggagaccuuuucu

SEQ ID NO: 920149 - RNA, 22 nt, Human
gcucugccucuuugcugcguca

SEQ ID NO: 920150 - RNA, 22 nt, Human
uuucauguuacauuuaaaaugu

SEQ ID NO: 920151 - RNA, 22 nt, Human
agacugaagcuccuugaggaca

SEQ ID NO: 920152 - RNA, 22 nt, Human
accaaagggcagaacaugagca

SEQ ID NO: 920153 - RNA, 22 nt, Human
cuacaaaaguaauugugguuuu

SEQ ID NO: 920154 - RNA, 22 nt, Human
gcuuccaguaaguugcugccau

SEQ ID NO: 920155 - RNA, 22 nt, Human
accuagaacugcaggcuauuuu

SEQ ID NO: 920156 - RNA, 22 nt, Human
aacuguaaggcuuagaacagca

SEQ ID NO: 920157 - RNA, 19 nt, Human
ugagcaugcgagcugagaa

SEQ ID NO: 920158 - RNA, 22 nt, Human
ccagcauggcaccugagaugag

SEQ ID NO: 920159 - RNA, 20 nt, Human
gcucugggagggaugugaug

SEQ ID NO: 920160 - RNA, 22 nt, Human
ugccauggaaucaccuccagcu

SEQ ID NO: 920161 - RNA, 22 nt, Human
ugcugccuccaacuccugggcu

SEQ ID NO: 920162 - RNA, 22 nt, Human
uggcagucccucugguagcacc

SEQ ID NO: 920163 - RNA, 22 nt, Human
cuucaaguaauucugauggcua

SEQ ID NO: 920164 - RNA, 22 nt, Human
uucaauucugaugaaggcaaua

SEQ ID NO: 920165 - RNA, 22 nt, Human
ggcagcugauuagcaucaagga

SEQ ID NO: 920166 - RNA, 22 nt, Human
ucauuucuauugcuacugucug

SEQ ID NO: 920167 - RNA, 22 nt, Human
ggguccccucaucauggagacu

SEQ ID NO: 920168 - RNA, 22 nt, Human
gagcuguucaaggacaggcacg

SEQ ID NO: 920169 - RNA, 22 nt, Human
uuaaagauucugaggcugauua

SEQ ID NO: 920170 - RNA, 22 nt, Human
ugugucuuuggcgaugucugga

SEQ ID NO: 920171 - RNA, 22 nt, Human
aaaguauauaugcacuuuagaa

SEQ ID NO: 920172 - RNA, 22 nt, Human
cugaggcugggcauggggucca

SEQ ID NO: 920173 - RNA, 22 nt, Human
uacagacauucaauuuugaccc

SEQ ID NO: 920174 - RNA, 19 nt, Human
aggacuucugaacccgucc

SEQ ID NO: 920175 - RNA, 22 nt, Human
ucucuagguugauauaaauuau

SEQ ID NO: 920176 - RNA, 22 nt, Human
uaaagcaguguugggucggacg

SEQ ID NO: 920177 - RNA, 22 nt, Human
gcuggggucugugaggagggcu

SEQ ID NO: 920178 - RNA, 22 nt, Human
uauuuaauaaaacuauggcaug

SEQ ID NO: 920179 - RNA, 22 nt, Human
aacccaggguggagguugcagu

SEQ ID NO: 920180 - RNA, 22 nt, Human
gcauuugagcacauuuuaaaga

SEQ ID NO: 920181 - RNA, 22 nt, Human
ugagcagagcaauaggacucuc

SEQ ID NO: 920182 - RNA, 19 nt, Human
uauuauuuguagcaaggcc

SEQ ID NO: 920183 - RNA, 22 nt, Human
aacaugaaguuuucuauaguga

SEQ ID NO: 920184 - RNA, 22 nt, Human
ugggcccugguggccaugccuc

SEQ ID NO: 920185 - RNA, 22 nt, Human
ccagccuggguguuagaagaca

SEQ ID NO: 920186 - RNA, 22 nt, Human
gucacuuuacacuccuacuaaa

SEQ ID NO: 920187 - RNA, 22 nt, Human
ucaaugcacacaggacuuggug

SEQ ID NO: 920188 - RNA, 18 nt, Human
uccagcgugcuccagggc

SEQ ID NO: 920189 - RNA, 22 nt, Human
auguauguucaagcaaugauua

SEQ ID NO: 920190 - RNA, 22 nt, Human
cuguauuuuuuaagaauaucuc

SEQ ID NO: 920191 - RNA, 22 nt, Human
gcuguuauaauauucuguuugu

SEQ ID NO: 920192 - RNA, 22 nt, Human
agaggccaccacugucagggac

SEQ ID NO: 920193 - RNA, 22 nt, Human
acagauguacacucauauauaa

SEQ ID NO: 920194 - RNA, 22 nt, Human
uuucagaagucaacuagguaaa

SEQ ID NO: 920195 - RNA, 22 nt, Human
aaagguuuucuaggguugaggg

SEQ ID NO: 920196 - RNA, 22 nt, Human
cuacagaauucaacaaaugguu

SEQ ID NO: 920197 - RNA, 22 nt, Human
gccaagggggcagugcaugggu

SEQ ID NO: 920198 - RNA, 22 nt, Human
uggggcagcagaccuuucuugg

SEQ ID NO: 920199 - RNA, 22 nt, Human
ggcuguggucugggugcucccc

SEQ ID NO: 920200 - RNA, 22 nt, Human
aacagcaggcaccaaggcuaug

SEQ ID NO: 920201 - RNA, 22 nt, Human
gcacacaggcaguuuccagcca

SEQ ID NO: 920202 - RNA, 22 nt, Human
cugcagagggguugaagggucc

SEQ ID NO: 920203 - RNA, 22 nt, Human
uggagcaggaagucuauggcug

SEQ ID NO: 920204 - RNA, 22 nt, Human
cagagcaguagaaaacagccuu

SEQ ID NO: 920205 - RNA, 22 nt, Human
gacugguaagguauuggaauuc

SEQ ID NO: 920206 - RNA, 22 nt, Human
uuuuuagaguguuaccaguaua

SEQ ID NO: 920207 - RNA, 22 nt, Human
caguaucuugcuuauagacaca

SEQ ID NO: 920208 - RNA, 22 nt, Human
ucuuuuaguaauaaauauuugu

SEQ ID NO: 920209 - RNA, 22 nt, Human
auuugcaauuacucaugucauu

SEQ ID NO: 920210 - RNA, 22 nt, Human
uagcaagacaacuuuucucagu

SEQ ID NO: 920211 - RNA, 20 nt, Human
cuggaauggguguggguuag

SEQ ID NO: 920212 - RNA, 22 nt, Human
cagcugugcugauugcucagua

SEQ ID NO: 920213 - RNA, 22 nt, Human
ggucagcaguuucuuugaauuu

SEQ ID NO: 920214 - RNA, 22 nt, Human
uucuuucugggguccuucggcu

SEQ ID NO: 920215 - RNA, 22 nt, Human
cauaaaguaggcaagcauucca

SEQ ID NO: 920216 - RNA, 22 nt, Human
gauccccagggcaggccucccg

SEQ ID NO: 920217 - RNA, 22 nt, Human
augacagaggagugcaggugau

SEQ ID NO: 920218 - RNA, 22 nt, Human
ggacugaaugccagucuaugga

SEQ ID NO: 920219 - RNA, 22 nt, Human
cagagcccugggcacaugguag

SEQ ID NO: 920220 - RNA, 22 nt, Human
cuggugucugcucccucacagc

SEQ ID NO: 920221 - RNA, 22 nt, Human
guccuuggagcuccccucugua

SEQ ID NO: 920222 - RNA, 22 nt, Human
acaguguggggugagauggaac

SEQ ID NO: 920223 - RNA, 22 nt, Human
caaaguccuagaacagugcuug

SEQ ID NO: 920224 - RNA, 22 nt, Human
cuuggagguggaaguugcagug

SEQ ID NO: 920225 - RNA, 22 nt, Human
ccaagagguugugaggcaggca

SEQ ID NO: 920226 - RNA, 17 nt, Human
uaucuguguuccuggcu

SEQ ID NO: 920227 - RNA, 22 nt, Human
cugcuccaccuccgggucaggc

SEQ ID NO: 920228 - RNA, 22 nt, Human
ggccucagugggccgcugcagg

SEQ ID NO: 920229 - RNA, 22 nt, Human
uggcaauguaaauugaacuaga

SEQ ID NO: 920230 - RNA, 22 nt, Human
cuguuucuuugcugucagagag

SEQ ID NO: 920231 - RNA, 22 nt, Human
uuucagaaagcaucaucaaagu

SEQ ID NO: 920232 - RNA, 22 nt, Human
gcucaaagaauauucagaauga

SEQ ID NO: 920233 - RNA, 23 nt, Human
ccagauuugccacgagagaggcu

SEQ ID NO: 920234 - RNA, 22 nt, Human
ugagacagucaccaggcaggcc

SEQ ID NO: 920235 - RNA, 22 nt, Human
aguggggaagagcaugggcccu

SEQ ID NO: 920236 - RNA, 22 nt, Human
uuacuacauuguaacacaguac

SEQ ID NO: 920237 - RNA, 22 nt, Human
augcaacaccccuauggaugga

SEQ ID NO: 920238 - RNA, 22 nt, Human
uggugccuugggccuacagcgc

SEQ ID NO: 920239 - RNA, 22 nt, Human
ucuccgggugcaugugugugcc

SEQ ID NO: 920240 - RNA, 22 nt, Human
cugccaccaugccccagcagag

SEQ ID NO: 920241 - RNA, 22 nt, Human
cugaggccucucccacuccagc

SEQ ID NO: 920242 - RNA, 22 nt, Human
ucugugcagucagggcucaguc

SEQ ID NO: 920243 - RNA, 22 nt, Human
augugugguuuguaaaugauuu

SEQ ID NO: 920244 - RNA, 22 nt, Human
gaauccgggaggcaaaaguugc

SEQ ID NO: 920245 - RNA, 22 nt, Human
ccagcagagucuaggaaggagg

SEQ ID NO: 920246 - RNA, 22 nt, Human
ucuggcagguucccauguuaug

SEQ ID NO: 920247 - RNA, 22 nt, Human
ggcccagcaucuugugaaguuu

SEQ ID NO: 920248 - RNA, 22 nt, Human
uuucacauuagauaugucauuu

SEQ ID NO: 920249 - RNA, 22 nt, Human
gagcagcuuaugucaagccaga

SEQ ID NO: 920250 - RNA, 20 nt, Human
gcucugucuggccuacuuuu

SEQ ID NO: 920251 - RNA, 22 nt, Human
uucuuuucuuggcaggaguaga

SEQ ID NO: 920252 - RNA, 22 nt, Human
uauuugcaggcuuuugucaugg

SEQ ID NO: 920253 - RNA, 22 nt, Human
gaugaggucauguuuuacauau

SEQ ID NO: 920254 - RNA, 22 nt, Human
cuguggcuggaauaauaaaugu

SEQ ID NO: 920255 - RNA, 22 nt, Human
accccagaggcggaggcugcag

SEQ ID NO: 920256 - RNA, 22 nt, Human
uaugugugcuuuuuccaugcau

SEQ ID NO: 920257 - RNA, 22 nt, Human
auauaguauguccuccagaauu

SEQ ID NO: 920258 - RNA, 22 nt, Human
aucaaauacaaagggcauaagg

SEQ ID NO: 920259 - RNA, 22 nt, Human
cagcggaggacagaugggagcu

SEQ ID NO: 920260 - RNA, 22 nt, Human
agugugucugaucacuugugag

SEQ ID NO: 920261 - RNA, 22 nt, Human
uuccacaaugguuaagcucguu

SEQ ID NO: 920262 - RNA, 22 nt, Human
agcauuccacacugaagucugc

SEQ ID NO: 920263 - RNA, 22 nt, Human
guugcucaaugggaauaagaau

SEQ ID NO: 920264 - RNA, 20 nt, Human
gcuguggcaaagcuuugugu

SEQ ID NO: 920265 - RNA, 22 nt, Human
cugggcugccagguaggcacac

SEQ ID NO: 920266 - RNA, 22 nt, Human
gcugcugcuugaaggcucggag

SEQ ID NO: 920267 - RNA, 22 nt, Human
cacacaugaaguugcugagcua

SEQ ID NO: 920268 - RNA, 22 nt, Human
ugacagaaagaguauuaaagau

SEQ ID NO: 920269 - RNA, 22 nt, Human
cuagguuuaacuuucacagaaa

SEQ ID NO: 920270 - RNA, 22 nt, Human
aaaucaugugcagagaucagga

SEQ ID NO: 920271 - RNA, 22 nt, Human
ugcauuuguuaccuuauugcag

SEQ ID NO: 920272 - RNA, 22 nt, Human
aucuuuggccacuugugcugca

SEQ ID NO: 920273 - RNA, 22 nt, Human
cugcugagguauacuaugugac

SEQ ID NO: 920274 - RNA, 22 nt, Human
uucaacagggcaugaugagacg

SEQ ID NO: 920275 - RNA, 22 nt, Human
accagaaguucuccaaaaagau

SEQ ID NO: 920276 - RNA, 22 nt, Human
aguuucacagaggguuagacgc

SEQ ID NO: 920277 - RNA, 22 nt, Human
cagaggcugagcagucaguuug

SEQ ID NO: 920278 - RNA, 22 nt, Human
ucuucaaaauugauuggagaag

SEQ ID NO: 920279 - RNA, 22 nt, Human
gcucccagggcagcgcagaaga

SEQ ID NO: 920280 - RNA, 22 nt, Human
uggagaguguagacuucagagu

SEQ ID NO: 920281 - RNA, 22 nt, Human
uuaguuacuuauaggugauaga

SEQ ID NO: 920282 - RNA, 22 nt, Human
caucaagauggaagagcaaaua

SEQ ID NO: 920283 - RNA, 22 nt, Human
agccuggagaagauguguauug

SEQ ID NO: 920284 - RNA, 22 nt, Human
cuggccccaucuggagucugag

SEQ ID NO: 920285 - RNA, 22 nt, Human
caguggaaaucagagugagagu

SEQ ID NO: 920286 - RNA, 23 nt, Human
ggaggucagugccugagggugag

SEQ ID NO: 920287 - RNA, 22 nt, Human
uguauaugugauguacauguac

SEQ ID NO: 920288 - RNA, 22 nt, Human
cuccagcuuuuucccaguuggc

SEQ ID NO: 920289 - RNA, 22 nt, Human
gaguuauaaccuaguuuaacug

SEQ ID NO: 920290 - RNA, 22 nt, Human
auguaucaacugcaggcaaguu

SEQ ID NO: 920291 - RNA, 22 nt, Human
caaaaguaccuugugugcuuug

SEQ ID NO: 920292 - RNA, 22 nt, Human
ucugugugauuucagggaaguc

SEQ ID NO: 920293 - RNA, 22 nt, Human
uacccucucccgguccagcuuu

SEQ ID NO: 920294 - RNA, 19 nt, Human
ucaaaggcaaggaggaacu

SEQ ID NO: 920295 - RNA, 22 nt, Human
aagccaguguuuuugagaguug

SEQ ID NO: 920296 - RNA, 22 nt, Human
aagccaagugcuggccaugggc

SEQ ID NO: 920297 - RNA, 22 nt, Human
gcuggugcauuagcugcaguuc

SEQ ID NO: 920298 - RNA, 22 nt, Human
ucagggcugugguuccuuuucu

SEQ ID NO: 920299 - RNA, 22 nt, Human
cugauacauaguagcaugucau

SEQ ID NO: 920300 - RNA, 19 nt, Human
cagaacaggaccaggggcc

SEQ ID NO: 920301 - RNA, 22 nt, Human
uguguacagcaugguccagcag

SEQ ID NO: 920302 - RNA, 20 nt, Human
auacaagaugaguaauuucu

SEQ ID NO: 920303 - RNA, 22 nt, Human
gcaggaugggagcuucacuuug

SEQ ID NO: 920304 - RNA, 22 nt, Human
ugaggaggcccagguuggggcu

SEQ ID NO: 920305 - RNA, 21 nt, Human
aagcuacagaaaauaauuuga

SEQ ID NO: 920306 - RNA, 22 nt, Human
ucagggaaaggggagagucauu

SEQ ID NO: 920307 - RNA, 22 nt, Human
gcacagaacuucucuuaguagg

SEQ ID NO: 920308 - RNA, 22 nt, Human
aauaauagcagaguuuacaauc

SEQ ID NO: 920309 - RNA, 22 nt, Human
ccugugucagccccugccucca

SEQ ID NO: 920310 - RNA, 22 nt, Human
agugucuaaacuggcuuccugg

SEQ ID NO: 920311 - RNA, 22 nt, Human
gcuguccauccacuucccagcg

SEQ ID NO: 920312 - RNA, 22 nt, Human
cugucgccugguccucucugga

SEQ ID NO: 920313 - RNA, 22 nt, Human
agaaucaacugaaaauugguga

SEQ ID NO: 920314 - RNA, 22 nt, Human
ugguuagacacaugcaugucau

SEQ ID NO: 920315 - RNA, 22 nt, Human
uuaacacuaucugucauaauua

SEQ ID NO: 920316 - RNA, 22 nt, Human
uuauuauggcaguuuucuaggu

SEQ ID NO: 920317 - RNA, 20 nt, Human
gcaagcuuauuagugauauu

SEQ ID NO: 920318 - RNA, 22 nt, Human
ugcuccaggagcacuuuccauu

SEQ ID NO: 920319 - RNA, 22 nt, Human
augcugucaguauuaugugcag

SEQ ID NO: 920320 - RNA, 22 nt, Human
ucaguguuugaacccaggguua

SEQ ID NO: 920321 - RNA, 22 nt, Human
guauuuuuaguagagucggggu

SEQ ID NO: 920322 - RNA, 22 nt, Human
gaccacuggcgcugcgagaccc

SEQ ID NO: 920323 - RNA, 22 nt, Human
ggcuagggaucuagaccaggac

SEQ ID NO: 920324 - RNA, 22 nt, Human
gaguaacagcauaaauuuguga

SEQ ID NO: 920325 - RNA, 22 nt, Human
ccagaggugccacagaaagagc

SEQ ID NO: 920326 - RNA, 22 nt, Human
acacaagaaguuaaugggcaaa

SEQ ID NO: 920327 - RNA, 22 nt, Human
gcuguguccucacacagccuuu

SEQ ID NO: 920328 - RNA, 22 nt, Human
aucuuacauucccucaccauuu

SEQ ID NO: 920329 - RNA, 22 nt, Human
gacagcagacagaacuaccugc

SEQ ID NO: 920330 - RNA, 22 nt, Human
gcauuagauauccuugaaguua

SEQ ID NO: 920331 - RNA, 22 nt, Human
auggcagccaguguuggaggaa

SEQ ID NO: 920332 - RNA, 22 nt, Human
uaaguucugcugacggccagcc

SEQ ID NO: 920333 - RNA, 22 nt, Human
ggccucuggucaagacaagcau

SEQ ID NO: 920334 - RNA, 22 nt, Human
gcuccaggcgagcuggaccaga

SEQ ID NO: 920335 - RNA, 22 nt, Human
aggcuucauguagaugguuccc

SEQ ID NO: 920336 - RNA, 22 nt, Human
ucuauuaaugauucaauagugu

SEQ ID NO: 920337 - RNA, 22 nt, Human
aaaagcaauugcaguucuugcc

SEQ ID NO: 920338 - RNA, 22 nt, Human
ggcagcugguucuuuccauuaa

SEQ ID NO: 920339 - RNA, 22 nt, Human
ccugcaagagcggagaagccag

SEQ ID NO: 920340 - RNA, 22 nt, Human
ucugccugagcagagggaggcc

SEQ ID NO: 920341 - RNA, 22 nt, Human
augucauugccaagaugcuaau

SEQ ID NO: 920342 - RNA, 22 nt, Human
acaggcaggcuucggccagagc

SEQ ID NO: 920343 - RNA, 22 nt, Human
aucacaguuuugugccuugugg

SEQ ID NO: 920344 - RNA, 22 nt, Human
aaaugcacaggagaaccaauuc

SEQ ID NO: 920345 - RNA, 22 nt, Human
uucaauaucauuguuuagucuc

SEQ ID NO: 920346 - RNA, 22 nt, Human
agcugccuuuugagaaagcuca

SEQ ID NO: 920347 - RNA, 22 nt, Human
ccucuggggguccucagagucu

SEQ ID NO: 920348 - RNA, 22 nt, Human
aggcucugugcagccugcaucu

SEQ ID NO: 920349 - RNA, 22 nt, Human
cuauugcauuugcaucuucauc

SEQ ID NO: 920350 - RNA, 20 nt, Human
aaauggccucagauaagcag

SEQ ID NO: 920351 - RNA, 23 nt, Human
guuccuucauguggucauugguu

SEQ ID NO: 920352 - RNA, 22 nt, Human
ucucuucuaauuaggguccaug

SEQ ID NO: 920353 - RNA, 22 nt, Human
ucucacucauuuccuaggucuu

SEQ ID NO: 920354 - RNA, 22 nt, Human
cuguacaucucugaggacagua

SEQ ID NO: 920355 - RNA, 22 nt, Human
aggaaugauaguaaaagagaau

SEQ ID NO: 920356 - RNA, 17 nt, Human
acaaugcagucucuagu

SEQ ID NO: 920357 - RNA, 22 nt, Human
ugagaaaaguguggaggucaau

SEQ ID NO: 920358 - RNA, 22 nt, Human
gcuaagaaggccauaucagaga

SEQ ID NO: 920359 - RNA, 22 nt, Human
caggcacuucggcagcguggua

SEQ ID NO: 920360 - RNA, 22 nt, Human
uuaggaaggacuuggauucugg

SEQ ID NO: 920361 - RNA, 22 nt, Human
uugcccugucuuaagcuggcaa

SEQ ID NO: 920362 - RNA, 22 nt, Human
gugccugguuuggggaauguuc

SEQ ID NO: 920363 - RNA, 22 nt, Human
cguuccucuacuccagcuaccc

SEQ ID NO: 920364 - RNA, 22 nt, Human
ggagugagcaaauagagauuug

SEQ ID NO: 920365 - RNA, 22 nt, Human
cagcugggugaucuugggcagg

SEQ ID NO: 920366 - RNA, 22 nt, Human
uggcucaguuccaucaucugga

SEQ ID NO: 920367 - RNA, 22 nt, Human
uugauguagaaccaagaucuuu

SEQ ID NO: 920368 - RNA, 22 nt, Human
agcugcccuggcggagcugcuc

SEQ ID NO: 920369 - RNA, 22 nt, Human
caguaacaugucuguuaagaaa

SEQ ID NO: 920370 - RNA, 22 nt, Human
uuccuccuucccauuccugggg

SEQ ID NO: 920371 - RNA, 22 nt, Human
cauccacuagaaugacagaguu

SEQ ID NO: 920372 - RNA, 22 nt, Human
ugagauggagucuugcucuguu

SEQ ID NO: 920373 - RNA, 22 nt, Human
uugaaaggugaacaugaugcac

SEQ ID NO: 920374 - RNA, 22 nt, Human
uggcucuggauuaaucuaggaa

SEQ ID NO: 920375 - RNA, 22 nt, Human
agggucagagucaggugcagua

SEQ ID NO: 920376 - RNA, 22 nt, Human
gagaugagugggggaucucuca

SEQ ID NO: 920377 - RNA, 22 nt, Human
ucagcuggggcccccucugucc

SEQ ID NO: 920378 - RNA, 22 nt, Human
uccuguguaaauagaucugguu

SEQ ID NO: 920379 - RNA, 22 nt, Human
agaaaucuauguuuugguuaga

SEQ ID NO: 920380 - RNA, 22 nt, Human
aucucagaaggcauuuccaaga

SEQ ID NO: 920381 - RNA, 22 nt, Human
cauuagaagguuuuaaaggaau

SEQ ID NO: 920382 - RNA, 22 nt, Human
caucuuuaauuugugacaacua

SEQ ID NO: 920383 - RNA, 21 nt, Human
uaggggcuggggcuccagcug

SEQ ID NO: 920384 - RNA, 22 nt, Human
gcacagccagcaucugagggau

SEQ ID NO: 920385 - RNA, 22 nt, Human
ccauuguaaauucuguggaagu

SEQ ID NO: 920386 - RNA, 22 nt, Human
cagcaggugucuagcaaggguc

SEQ ID NO: 920387 - RNA, 22 nt, Human
gugcaaagugcauggggaaggg

SEQ ID NO: 920388 - RNA, 22 nt, Human
aaaggucaaaaucgugacauug

SEQ ID NO: 920389 - RNA, 22 nt, Human
accuacagagaucugcauuuuu

SEQ ID NO: 920390 - RNA, 22 nt, Human
uuuguguggauggaaggcagua

SEQ ID NO: 920391 - RNA, 22 nt, Human
uagaaagugaagguuaauuaau

SEQ ID NO: 920392 - RNA, 22 nt, Human
ggagcuggcuacagagaacucc

SEQ ID NO: 920393 - RNA, 22 nt, Human
aaggcagagauuagcagaauga

SEQ ID NO: 920394 - RNA, 21 nt, Human
aguggcugucaagggggccuu

SEQ ID NO: 920395 - RNA, 22 nt, Human
auacccagaguggguagaguua

SEQ ID NO: 920396 - RNA, 22 nt, Human
auccuguuugguugucugccuu

SEQ ID NO: 920397 - RNA, 22 nt, Human
ccagagacgucggucagggcgc

SEQ ID NO: 920398 - RNA, 22 nt, Human
gaguccaggcuguugcucaucu

SEQ ID NO: 920399 - RNA, 22 nt, Human
gagcccuggcagucugggaugg

SEQ ID NO: 920400 - RNA, 22 nt, Human
auguuauuaaaguacagauucu

SEQ ID NO: 920401 - RNA, 22 nt, Human
uuaauuaauuaguuaagcaugu

SEQ ID NO: 920402 - RNA, 22 nt, Human
ugacucacuuaauuuacaaguc

SEQ ID NO: 920403 - RNA, 22 nt, Human
cugaggugcuagggucccugcu

SEQ ID NO: 920404 - RNA, 22 nt, Human
agaaggaaggcugagugcugau

SEQ ID NO: 920405 - RNA, 22 nt, Human
ucuugcugugccccagcagggc

SEQ ID NO: 920406 - RNA, 22 nt, Human
gugggccacaucccagggcucu

SEQ ID NO: 920407 - RNA, 22 nt, Human
cuggagagaccgaaagaggcug

SEQ ID NO: 920408 - RNA, 22 nt, Human
aaaaacugcaauuacuuuuguc

SEQ ID NO: 920409 - RNA, 22 nt, Human
gcuuccuggagggagagagcug

SEQ ID NO: 920410 - RNA, 22 nt, Human
gcuucugcgcacgcuucuuccc

SEQ ID NO: 920411 - RNA, 22 nt, Human
aucuccaggauuuucacacuca

SEQ ID NO: 920412 - RNA, 22 nt, Human
caaggcauuaccauggcuagag

SEQ ID NO: 920413 - RNA, 22 nt, Human
aggcuuugcaaaaaagcucaua

SEQ ID NO: 920414 - RNA, 22 nt, Human
agagaggauuuguuuuucuccu

SEQ ID NO: 920415 - RNA, 22 nt, Human
gagaaucuggguuuuggcuauc

SEQ ID NO: 920416 - RNA, 22 nt, Human
ugguuuuaaaagauguuugaga

SEQ ID NO: 920417 - RNA, 22 nt, Human
ucaagggaggagacacagcccu

SEQ ID NO: 920418 - RNA, 22 nt, Human
agagucugcauuguaacaagau

SEQ ID NO: 920419 - RNA, 22 nt, Human
uacagaacugaaguagugaaaa

SEQ ID NO: 920420 - RNA, 22 nt, Human
ccuggagcaggagcugcagagg

SEQ ID NO: 920421 - RNA, 22 nt, Human
uauggauauaaucagacuggaa

SEQ ID NO: 920422 - RNA, 22 nt, Human
auacaaugggugcaaagaugug

SEQ ID NO: 920423 - RNA, 21 nt, Human
gugauucucugaguuuugggg

SEQ ID NO: 920424 - RNA, 22 nt, Human
uugcucuacccugaucaguuaa

SEQ ID NO: 920425 - RNA, 22 nt, Human
uagcaaggugaaguauggguga

SEQ ID NO: 920426 - RNA, 22 nt, Human
cagggccucauugucaguccug

SEQ ID NO: 920427 - RNA, 22 nt, Human
caaauuuuguguguucucuagu

SEQ ID NO: 920428 - RNA, 22 nt, Human
ucuuuugucgguguaucaugga

SEQ ID NO: 920429 - RNA, 22 nt, Human
auaaagcagguccccagacacu

SEQ ID NO: 920430 - RNA, 22 nt, Human
ccagaacacaguggaagaauau

SEQ ID NO: 920431 - RNA, 22 nt, Human
cuggaggcuggcuuccccuggc

SEQ ID NO: 920432 - RNA, 18 nt, Human
ggaaggaagaaugcauuu

SEQ ID NO: 920433 - RNA, 22 nt, Human
uuaucuugguguuuuaguaauu

SEQ ID NO: 920434 - RNA, 22 nt, Human
uccucaggugacuagguaucuu

SEQ ID NO: 920435 - RNA, 20 nt, Human
agcaagaacguucugaggga

SEQ ID NO: 920436 - RNA, 22 nt, Human
ugcagcaccacaccuggcuaau

SEQ ID NO: 920437 - RNA, 23 nt, Human
acaaugcacuuuaaaugguuccc

SEQ ID NO: 920438 - RNA, 22 nt, Human
aacacaaaaauucucaggggca

SEQ ID NO: 920439 - RNA, 22 nt, Human
uaaauaaguucuucauuguuug

SEQ ID NO: 920440 - RNA, 22 nt, Human
aagagccagugggaaagucuug

SEQ ID NO: 920441 - RNA, 22 nt, Human
uuuuauucuaaguaugauggga

SEQ ID NO: 920442 - RNA, 22 nt, Human
cucuuugucacucauacaguca

SEQ ID NO: 920443 - RNA, 22 nt, Human
aggcaggccccugagaauagac

SEQ ID NO: 920444 - RNA, 22 nt, Human
guccugucccccaaggcugugg

SEQ ID NO: 920445 - RNA, 22 nt, Human
uucaggcccagcacagcgcgug

SEQ ID NO: 920446 - RNA, 22 nt, Human
augcugugucaccuuaggauuu

SEQ ID NO: 920447 - RNA, 22 nt, Human
guuguuuuuguucucuauagcu

SEQ ID NO: 920448 - RNA, 22 nt, Human
aaugucuacagcaaaccccaca

SEQ ID NO: 920449 - RNA, 22 nt, Human
caggugaggcugaacagaugaa

SEQ ID NO: 920450 - RNA, 22 nt, Human
ugcaggugccaucgcugcucau

SEQ ID NO: 920451 - RNA, 20 nt, Human
gucuugaaggggucauggag

SEQ ID NO: 920452 - RNA, 22 nt, Human
agcagcaauggaaagcaacaca

SEQ ID NO: 920453 - RNA, 22 nt, Human
cucuccaucugugugaccuccc

SEQ ID NO: 920454 - RNA, 22 nt, Human
gaggcagcuuaggguacugacu

SEQ ID NO: 920455 - RNA, 22 nt, Human
cccuucucuuucacucacuauu

SEQ ID NO: 920456 - RNA, 18 nt, Human
gacccaggaaagaguccu

SEQ ID NO: 920457 - RNA, 22 nt, Human
aagugaauucauuguguuauau

SEQ ID NO: 920458 - RNA, 22 nt, Human
uacaacacuguucagccucuuc

SEQ ID NO: 920459 - RNA, 22 nt, Human
guggcagagccuugcggcuuug

SEQ ID NO: 920460 - RNA, 22 nt, Human
acaaauguggacauggauaaug

SEQ ID NO: 920461 - RNA, 19 nt, Human
guguacagcucagugaauu

SEQ ID NO: 920462 - RNA, 22 nt, Human
augaggccuaucuuggcagagg

SEQ ID NO: 920463 - RNA, 22 nt, Human
gcaaugaauaaauaauguuuag

SEQ ID NO: 920464 - RNA, 22 nt, Human
uuugaacaggaguaucuauagu

SEQ ID NO: 920465 - RNA, 19 nt, Human
ugucucugaaagaugagcu

SEQ ID NO: 920466 - RNA, 22 nt, Human
cauucucaauaguagaugagua

SEQ ID NO: 920467 - RNA, 22 nt, Human
cagaggccagggggcucacaaa

SEQ ID NO: 920468 - RNA, 22 nt, Human
ucagaggcuacagucugggagu

SEQ ID NO: 920469 - RNA, 17 nt, Human
ccuuccucaucuccuuc

SEQ ID NO: 920470 - RNA, 22 nt, Human
ccuucucccucugagaggaacc

SEQ ID NO: 920471 - RNA, 23 nt, Human
aauuaaauugcuagauccagggc

SEQ ID NO: 920472 - RNA, 22 nt, Human
auuccuaaggaaggcuggcaag

SEQ ID NO: 920473 - RNA, 22 nt, Human
ggauuaacagcuccuggguggu

SEQ ID NO: 920474 - RNA, 22 nt, Human
cugaugauagugauuuauugag

SEQ ID NO: 920475 - RNA, 22 nt, Human
acacauuuacauguuuacguau

SEQ ID NO: 920476 - RNA, 22 nt, Human
auagacacauguuauuauacuu

SEQ ID NO: 920477 - RNA, 22 nt, Human
cugcccacaccugagcugggcc

SEQ ID NO: 920478 - RNA, 22 nt, Human
uaagaugaaggcucaccuagaa

SEQ ID NO: 920479 - RNA, 22 nt, Human
cugggaggcccacguugggaag

SEQ ID NO: 920480 - RNA, 22 nt, Human
cagagggagcccuccaggagca

SEQ ID NO: 920481 - RNA, 22 nt, Human
caggagugaaaugaggcccagg

SEQ ID NO: 920482 - RNA, 22 nt, Human
aguaacaugaguuuuucuaaug

SEQ ID NO: 920483 - RNA, 22 nt, Human
acagguccucaagucagcuggg

SEQ ID NO: 920484 - RNA, 22 nt, Human
caugucuugcccugauuaguag

SEQ ID NO: 920485 - RNA, 22 nt, Human
cugaauaucauuuaucauuggc

SEQ ID NO: 920486 - RNA, 21 nt, Human
ggccccagcccauggguucuc

SEQ ID NO: 920487 - RNA, 22 nt, Human
aaggaagcuguuagacaugcau

SEQ ID NO: 920488 - RNA, 22 nt, Human
ugcaauauuuggcacugagaug

SEQ ID NO: 920489 - RNA, 22 nt, Human
caguguuuaaucauugugaauu

SEQ ID NO: 920490 - RNA, 22 nt, Human
uuuuuugucuugaagaaauggu

SEQ ID NO: 920491 - RNA, 22 nt, Human
caggccucaugguguguccuuc

SEQ ID NO: 920492 - RNA, 18 nt, Human
gacaccagccucugcccc

SEQ ID NO: 920493 - RNA, 22 nt, Human
ucuucacaccgggcagcaggaa

SEQ ID NO: 920494 - RNA, 22 nt, Human
gcccggcagucacacacccagg

SEQ ID NO: 920495 - RNA, 22 nt, Human
aggcuccacggcaggaugcugu

SEQ ID NO: 920496 - RNA, 22 nt, Human
cauccuucucaaagagugcaug

SEQ ID NO: 920497 - RNA, 20 nt, Human
cuucuuggagaugguguuuu

SEQ ID NO: 920498 - RNA, 22 nt, Human
gggaggcuggcucuggccacag

SEQ ID NO: 920499 - RNA, 22 nt, Human
auuuccuugcaacuuaggcaug

SEQ ID NO: 920500 - RNA, 22 nt, Human
uuacagacaaacuguguuaagu

SEQ ID NO: 920501 - RNA, 22 nt, Human
auucaauaaauaugcuacaugg

SEQ ID NO: 920502 - RNA, 22 nt, Human
cagggcuugaucugcauccugc

SEQ ID NO: 920503 - RNA, 22 nt, Human
acacuuggagcaacacuuaugg

SEQ ID NO: 920504 - RNA, 22 nt, Human
uguacacaugcccacuugaagc

SEQ ID NO: 920505 - RNA, 22 nt, Human
acaugcauggagggaaaauguc

SEQ ID NO: 920506 - RNA, 21 nt, Human
gagugcaggucugaugccauc

SEQ ID NO: 920507 - RNA, 22 nt, Human
ucccugggucauucucuggcac

SEQ ID NO: 920508 - RNA, 22 nt, Human
uuccacuuuucucucucaugcc

SEQ ID NO: 920509 - RNA, 22 nt, Human
cugugcuuccaggauggcagcu

SEQ ID NO: 920510 - RNA, 22 nt, Human
accugcagcugagaaaaugacu

SEQ ID NO: 920511 - RNA, 22 nt, Human
aggcugagaaagugggaagaug

SEQ ID NO: 920512 - RNA, 22 nt, Human
uucucuaagagaugcagaaguu

SEQ ID NO: 920513 - RNA, 22 nt, Human
ccacuuuucacuaagaugaauu

SEQ ID NO: 920514 - RNA, 22 nt, Human
gccuucccuggcuaggcaagca

SEQ ID NO: 920515 - RNA, 22 nt, Human
cuguacaaaguagcugcuggga

SEQ ID NO: 920516 - RNA, 22 nt, Human
augagcuuccagacaaaggcau

SEQ ID NO: 920517 - RNA, 22 nt, Human
ggugggcacccgagacuggauc

SEQ ID NO: 920518 - RNA, 19 nt, Human
agcuggcucuucuuugucu

SEQ ID NO: 920519 - RNA, 22 nt, Human
gucagcacuuuuccgaggcaga

SEQ ID NO: 920520 - RNA, 22 nt, Human
ugggccugaaauucccauuuua

SEQ ID NO: 920521 - RNA, 22 nt, Human
ugguuuuugguguucacagagg

SEQ ID NO: 920522 - RNA, 22 nt, Human
gcguuggggaccccgaagcugg

SEQ ID NO: 920523 - RNA, 22 nt, Human
acacaguaaauauugucuccuc

SEQ ID NO: 920524 - RNA, 22 nt, Human
cccagcacaggcaauuccauac

SEQ ID NO: 920525 - RNA, 22 nt, Human
uugagaaauguuuuuuaagcug

SEQ ID NO: 920526 - RNA, 22 nt, Human
aagcaaagagauaaccuuuugg

SEQ ID NO: 920527 - RNA, 22 nt, Human
gauucaaagacagacucauuuc

SEQ ID NO: 920528 - RNA, 22 nt, Human
augaggcaggauuaagcuauca

SEQ ID NO: 920529 - RNA, 22 nt, Human
gauauuuucagucuccuuucaa

SEQ ID NO: 920530 - RNA, 22 nt, Human
uucuagaggggagauacuagua

SEQ ID NO: 920531 - RNA, 22 nt, Human
auaaaaucuuuaugugcucugc

SEQ ID NO: 920532 - RNA, 17 nt, Human
gauguccucuggacuac

SEQ ID NO: 920533 - RNA, 22 nt, Human
caaacauuuuaaauaagggaua

SEQ ID NO: 920534 - RNA, 22 nt, Human
gauacacaaaagucuagugagg

SEQ ID NO: 920535 - RNA, 22 nt, Human
cagagccaaaccucagggcccg

SEQ ID NO: 920536 - RNA, 19 nt, Human
agcagcuguagauagacac

SEQ ID NO: 920537 - RNA, 22 nt, Human
uaaauugcauaaguacaaauga

SEQ ID NO: 920538 - RNA, 22 nt, Human
ccucacaugaauguaagcucca

SEQ ID NO: 920539 - RNA, 21 nt, Human
agaguucuugcugagcaagcc

SEQ ID NO: 920540 - RNA, 22 nt, Human
agugucuuugucaaauuacagg

SEQ ID NO: 920541 - RNA, 22 nt, Human
gguucauucugaagucuucagc

SEQ ID NO: 920542 - RNA, 22 nt, Human
auggucaagauccucuaguuua

SEQ ID NO: 920543 - RNA, 22 nt, Human
ggccagagagccgcuguuagga

SEQ ID NO: 920544 - RNA, 22 nt, Human
ugugugcauuagcauucuaggg

SEQ ID NO: 920545 - RNA, 22 nt, Human
agcaucuggucaugagugagaa

SEQ ID NO: 920546 - RNA, 22 nt, Human
aagguauauguacaauagacau

SEQ ID NO: 920547 - RNA, 22 nt, Human
cgcgguggcggccuccagcgcc

SEQ ID NO: 920548 - RNA, 19 nt, Human
ccaguagagacagcugcag

SEQ ID NO: 920549 - RNA, 22 nt, Human
cuccagagagaaaggaggccgc

SEQ ID NO: 920550 - RNA, 19 nt, Human
gcagacagguccagagagg

SEQ ID NO: 920551 - RNA, 22 nt, Human
uuuaaauguuuauagagaguac

SEQ ID NO: 920552 - RNA, 22 nt, Human
ggugcuggacacguggcacucc

SEQ ID NO: 920553 - RNA, 22 nt, Human
cggcuggugucgggcacagcaa

SEQ ID NO: 920554 - RNA, 22 nt, Human
uuauuaaugaguacaaguuauu

SEQ ID NO: 920555 - RNA, 22 nt, Human
ugaggaugacgauggcaauggc

SEQ ID NO: 920556 - RNA, 22 nt, Human
cauuuguagaguaggaaagagu

SEQ ID NO: 920557 - RNA, 23 nt, Human
uacuuaggguuuagaucugacug

SEQ ID NO: 920558 - RNA, 22 nt, Human
cuggguagaagauuccucagga

SEQ ID NO: 920559 - RNA, 22 nt, Human
agcuuuuaguacguuaaaauug

SEQ ID NO: 920560 - RNA, 22 nt, Human
ggcaggcuccguguuccauucc

SEQ ID NO: 920561 - RNA, 22 nt, Human
cugcaaucuccaugcuugauuu

SEQ ID NO: 920562 - RNA, 22 nt, Human
gcccuggagagggauauggcau

SEQ ID NO: 920563 - RNA, 22 nt, Human
guucauucugaaaagcagcuug

SEQ ID NO: 920564 - RNA, 22 nt, Human
ccaccauucaaggucuucacag

SEQ ID NO: 920565 - RNA, 22 nt, Human
uccagccacucagcagggauug

SEQ ID NO: 920566 - RNA, 22 nt, Human
gcagagucagccuccgagacag

SEQ ID NO: 920567 - RNA, 22 nt, Human
uaguuuauaguuagcgagcacg

SEQ ID NO: 920568 - RNA, 22 nt, Human
cacaauguaagaguuuguucau

SEQ ID NO: 920569 - RNA, 22 nt, Human
aacuccagggucaccauucaca

SEQ ID NO: 920570 - RNA, 22 nt, Human
acagggcccuuagauccuuuua

SEQ ID NO: 920571 - RNA, 22 nt, Human
aggccagacagcuagaaacagg

SEQ ID NO: 920572 - RNA, 16 nt, Human
ggagguggguaaggug

SEQ ID NO: 920573 - RNA, 22 nt, Human
gccuccccaaagugcugacagc

SEQ ID NO: 920574 - RNA, 22 nt, Human
ccaccagcuuugccacccugcu

SEQ ID NO: 920575 - RNA, 22 nt, Human
aagugaaacauguaucucuuua

SEQ ID NO: 920576 - RNA, 22 nt, Human
gugcaagaggacaguaagggug

SEQ ID NO: 920577 - RNA, 21 nt, Human
ccuccaggagcagagcccuga

SEQ ID NO: 920578 - RNA, 22 nt, Human
uagauacauacauuuuaaaaug

SEQ ID NO: 920579 - RNA, 22 nt, Human
cuuucaguuacaguuacacaca

SEQ ID NO: 920580 - RNA, 22 nt, Human
uucucuuuuugcaucucaaccu

SEQ ID NO: 920581 - RNA, 22 nt, Human
gcuuggcacacuuggaccugag

SEQ ID NO: 920582 - RNA, 22 nt, Human
gcugccuccgccggcuccacag

SEQ ID NO: 920583 - RNA, 22 nt, Human
gcugcagggggugggcgucucc

SEQ ID NO: 920584 - RNA, 22 nt, Human
auccugucuaugaguagauaau

SEQ ID NO: 920585 - RNA, 22 nt, Human
ucugcccaguuugugcucaggu

SEQ ID NO: 920586 - RNA, 22 nt, Human
ccaggaaggaagcagggguuuc

SEQ ID NO: 920587 - RNA, 20 nt, Human
uguuccaggaggccagggcu

SEQ ID NO: 920588 - RNA, 22 nt, Human
ucugagcagaugcucgcucucc

SEQ ID NO: 920589 - RNA, 22 nt, Human
ucugagccauaagaguacagga

SEQ ID NO: 920590 - RNA, 22 nt, Human
ucuccugguacccuuccuagca

SEQ ID NO: 920591 - RNA, 22 nt, Human
acacagauaaugcucauauagg

SEQ ID NO: 920592 - RNA, 22 nt, Human
cagggccaggcugauggccugg

SEQ ID NO: 920593 - RNA, 22 nt, Human
ucagaaacagaaacuaagaacc

SEQ ID NO: 920594 - RNA, 22 nt, Human
ggugucagccugggagccuagc

SEQ ID NO: 920595 - RNA, 22 nt, Human
gcucugggauuaccagccuuag

SEQ ID NO: 920596 - RNA, 22 nt, Human
auggcauuugaccgcuuugugg

SEQ ID NO: 920597 - RNA, 22 nt, Human
gccaguggcaugcggcagggac

SEQ ID NO: 920598 - RNA, 22 nt, Human
ucagagcugggugcuucuuccu

SEQ ID NO: 920599 - RNA, 22 nt, Human
uaaagcagugcaaaagcguuuu

SEQ ID NO: 920600 - RNA, 22 nt, Human
ggcuggaaccagagugaggcag

SEQ ID NO: 920601 - RNA, 22 nt, Human
uaugucuuuguccaugugcagu

SEQ ID NO: 920602 - RNA, 22 nt, Human
agaauacuaggcuucagaaagg

SEQ ID NO: 920603 - RNA, 22 nt, Human
ggguaguuuaauuaggaagaaa

SEQ ID NO: 920604 - RNA, 22 nt, Human
agcaacagggggauggccacug

SEQ ID NO: 920605 - RNA, 19 nt, Human
aggcaugggaagagaaguc

SEQ ID NO: 920606 - RNA, 21 nt, Human
cuccucaggaccagccacagg

SEQ ID NO: 920607 - RNA, 22 nt, Human
ugugaaauauuuauauacucaa

SEQ ID NO: 920608 - RNA, 22 nt, Human
ucauugcaguagggagagaccc

SEQ ID NO: 920609 - RNA, 18 nt, Human
ugggagugggaguggaua

SEQ ID NO: 920610 - RNA, 22 nt, Human
acacaguaugaaaagucuaguu

SEQ ID NO: 920611 - RNA, 22 nt, Human
caggggcuuaagugacagaagg

SEQ ID NO: 920612 - RNA, 21 nt, Human
uccucugcucucauaccacaa

SEQ ID NO: 920613 - RNA, 22 nt, Human
cagcuggguggcucuucugcuc

SEQ ID NO: 920614 - RNA, 22 nt, Human
acaggcacaccuuccugcaggc

SEQ ID NO: 920615 - RNA, 22 nt, Human
caguguguggauccucccagga

SEQ ID NO: 920616 - RNA, 22 nt, Human
caguggccugagccaggcuucc

SEQ ID NO: 920617 - RNA, 22 nt, Human
ucagggcccagagcucaggcaa

SEQ ID NO: 920618 - RNA, 22 nt, Human
ucacagagaaaagcuaucacaa

SEQ ID NO: 920619 - RNA, 22 nt, Human
cuguauauaauguaugcauggg

SEQ ID NO: 920620 - RNA, 20 nt, Human
uuucacagucccuguuuccu

SEQ ID NO: 920621 - RNA, 22 nt, Human
aauagaggaagaaaccugauug

SEQ ID NO: 920622 - RNA, 22 nt, Human
guuucccauaucuagggagagg

SEQ ID NO: 920623 - RNA, 22 nt, Human
gaggugagaagggggucagaug

SEQ ID NO: 920624 - RNA, 22 nt, Human
ucaucuguuauuuaugccugag

SEQ ID NO: 920625 - RNA, 22 nt, Human
uugucaccauauuucauuuuga

SEQ ID NO: 920626 - RNA, 22 nt, Human
uguguaaaaucugauuaauacu

SEQ ID NO: 920627 - RNA, 21 nt, Human
aggcagcgugagggccacuca

SEQ ID NO: 920628 - RNA, 22 nt, Human
gugcucaucguggagccugagg

SEQ ID NO: 920629 - RNA, 22 nt, Human
agaauucugacaauagaauugg

SEQ ID NO: 920630 - RNA, 22 nt, Human
aggucccaggcauagcuggucu

SEQ ID NO: 920631 - RNA, 22 nt, Human
aucuugggaauuuuccaggagu

SEQ ID NO: 920632 - RNA, 22 nt, Human
ccuuuagagcaaacgccaccua

SEQ ID NO: 920633 - RNA, 22 nt, Human
uacccagucuggagugcaguga

SEQ ID NO: 920634 - RNA, 22 nt, Human
cagccagcugucccaagugccu

SEQ ID NO: 920635 - RNA, 22 nt, Human
cccaggcugugcaaacuucaaa

SEQ ID NO: 920636 - RNA, 22 nt, Human
uguguuuuacaaauucucuuaa

SEQ ID NO: 920637 - RNA, 22 nt, Human
acuccagggcuccaccccagau

SEQ ID NO: 920638 - RNA, 22 nt, Human
ugccagccagggaagcucaccc

SEQ ID NO: 920639 - RNA, 22 nt, Human
aaagagcugagaccugguggag

SEQ ID NO: 920640 - RNA, 22 nt, Human
aagugcuuccauguuugagugu

SEQ ID NO: 920641 - RNA, 22 nt, Human
guugcacacuggcuauaacaag

SEQ ID NO: 920642 - RNA, 22 nt, Human
auguucugccuccauuuugagu

SEQ ID NO: 920643 - RNA, 22 nt, Human
acaguagauugguaugauguca

SEQ ID NO: 920644 - RNA, 21 nt, Human
uguuaugugcuucaagaagug

SEQ ID NO: 920645 - RNA, 22 nt, Human
cucucucuucuuuguaggggcc

SEQ ID NO: 920646 - RNA, 22 nt, Human
cagcaacggaaaauacacauag

SEQ ID NO: 920647 - RNA, 22 nt, Human
ugggagcacucuuugggaagca

SEQ ID NO: 920648 - RNA, 22 nt, Human
ucuggcaguggaugagggcagc

SEQ ID NO: 920649 - RNA, 22 nt, Human
agagacugcaaugagugguagg

SEQ ID NO: 920650 - RNA, 22 nt, Human
aaggaggaauuucagggugaau

SEQ ID NO: 920651 - RNA, 22 nt, Human
uagagcuggccgggacagcugg

SEQ ID NO: 920652 - RNA, 22 nt, Human
ucucuuggagguucuuccuguu

SEQ ID NO: 920653 - RNA, 22 nt, Human
aaaacugaaccuugagaucuuu

SEQ ID NO: 920654 - RNA, 22 nt, Human
gagggagugccagagggccagc

SEQ ID NO: 920655 - RNA, 22 nt, Human
aagagaauacaagcaggcagga

SEQ ID NO: 920656 - RNA, 22 nt, Human
ccugggcugcaugauggcauuu

SEQ ID NO: 920657 - RNA, 23 nt, Human
ucuguuuugcaacaugugacaag

SEQ ID NO: 920658 - RNA, 22 nt, Human
agggagagacauuuccuucuug

SEQ ID NO: 920659 - RNA, 22 nt, Human
aaugcuuuagaaaaccagcuuu

SEQ ID NO: 920660 - RNA, 22 nt, Human
ugcuggggagugauugaccauc

SEQ ID NO: 920661 - RNA, 22 nt, Human
ugacaaagaccuucaacaagau

SEQ ID NO: 920662 - RNA, 22 nt, Human
ccucuggggugagugggccacu

SEQ ID NO: 920663 - RNA, 22 nt, Human
guguguccaggcgggagucaag

SEQ ID NO: 920664 - RNA, 22 nt, Human
aaguacauggaggauagcugcu

SEQ ID NO: 920665 - RNA, 22 nt, Human
uaacugcacugacagugaguga

SEQ ID NO: 920666 - RNA, 22 nt, Human
agcauauuguaugucuauaugu

SEQ ID NO: 920667 - RNA, 22 nt, Human
gugcauguuaaugguguacaaa

SEQ ID NO: 920668 - RNA, 22 nt, Human
cccaggagauaacguucccaag

SEQ ID NO: 920669 - RNA, 22 nt, Human
gaaagugcaugugcccaccauu

SEQ ID NO: 920670 - RNA, 22 nt, Human
cugggcagcacaucaucguauc

SEQ ID NO: 920671 - RNA, 22 nt, Human
uaaaggcuucugcagggacuga

SEQ ID NO: 920672 - RNA, 22 nt, Human
agaaucucuacucaaguacuug

SEQ ID NO: 920673 - RNA, 22 nt, Human
aucacaguguagaccuuuuaaa

SEQ ID NO: 920674 - RNA, 22 nt, Human
ucucugggauaaacugggccag

SEQ ID NO: 920675 - RNA, 22 nt, Human
auuguacagguuggaggaagug

SEQ ID NO: 920676 - RNA, 22 nt, Human
cgaggcagggaagcugcaaaag

SEQ ID NO: 920677 - RNA, 22 nt, Human
aacuacagaaucauagaaaaua

SEQ ID NO: 920678 - RNA, 22 nt, Human
uuuagaagacagaugcacagcc

SEQ ID NO: 920679 - RNA, 22 nt, Human
gcuucaaagaacaaagggaggc

SEQ ID NO: 920680 - RNA, 22 nt, Human
ccucgcugugugaccuugggug

SEQ ID NO: 920681 - RNA, 22 nt, Human
gucaccagcaccaaugccacau

SEQ ID NO: 920682 - RNA, 18 nt, Human
ugagaaacugacacaugg

SEQ ID NO: 920683 - RNA, 22 nt, Human
uguggccuugcagccuggaggu

SEQ ID NO: 920684 - RNA, 22 nt, Human
aggcagcauccagaggagaaug

SEQ ID NO: 920685 - RNA, 22 nt, Human
auacuuaaugucaguuugaugu

SEQ ID NO: 920686 - RNA, 20 nt, Human
uaugacaacgcagcaaggca

SEQ ID NO: 920687 - RNA, 22 nt, Human
cugggagcaagucaggaaaggu

SEQ ID NO: 920688 - RNA, 22 nt, Human
acccagauaaaugacagggcuu

SEQ ID NO: 920689 - RNA, 22 nt, Human
uugcucuauguuuguaaacaga

SEQ ID NO: 920690 - RNA, 22 nt, Human
ugauucucacagugggaccuca

SEQ ID NO: 920691 - RNA, 22 nt, Human
uuugaaaaaggccuuugguaug

SEQ ID NO: 920692 - RNA, 22 nt, Human
caaugaaaaugaggacuccugu

SEQ ID NO: 920693 - RNA, 22 nt, Human
aagucacacugcugggaacucu

SEQ ID NO: 920694 - RNA, 22 nt, Human
aaaguguuaugagaacuaagug

SEQ ID NO: 920695 - RNA, 22 nt, Human
cugggagagacacuucugauua

SEQ ID NO: 920696 - RNA, 22 nt, Human
aaacauuugcaacucgguuugg

SEQ ID NO: 920697 - RNA, 22 nt, Human
aucauuucccuuuagaucacaa

SEQ ID NO: 920698 - RNA, 22 nt, Human
ccuggccacucagguguggggc

SEQ ID NO: 920699 - RNA, 22 nt, Human
cauacauuuauacacaucuaug

SEQ ID NO: 920700 - RNA, 21 nt, Human
uggcuucagccauuuucucug

SEQ ID NO: 920701 - RNA, 22 nt, Human
cucaggcuugggaggaggccca

SEQ ID NO: 920702 - RNA, 22 nt, Human
aaaguacauguuuggccauuug

SEQ ID NO: 920703 - RNA, 22 nt, Human
cacacauugguuuuacuccuuu

SEQ ID NO: 920704 - RNA, 22 nt, Human
aagaaucuuuccaguuuugaug

SEQ ID NO: 920705 - RNA, 22 nt, Human
gggcugcguguggaggauguaa

SEQ ID NO: 920706 - RNA, 22 nt, Human
gcugagguggcugccuuaguaa

SEQ ID NO: 920707 - RNA, 22 nt, Human
uccaggagauacacugcaccag

SEQ ID NO: 920708 - RNA, 21 nt, Human
aggcagcucaggcccagagag

SEQ ID NO: 920709 - RNA, 22 nt, Human
gcagagcauuggagggacccug

SEQ ID NO: 920710 - RNA, 22 nt, Human
cuggaaaaugaagaagcagagg

SEQ ID NO: 920711 - RNA, 22 nt, Human
cagcucacuuguuucaucuucu

SEQ ID NO: 920712 - RNA, 23 nt, Human
gcugucugucaucucugcgggag

SEQ ID NO: 920713 - RNA, 23 nt, Human
gggggccguccuggggauuauag

SEQ ID NO: 920714 - RNA, 22 nt, Human
gagcuccugcugcauccugccu

SEQ ID NO: 920715 - RNA, 22 nt, Human
uuuacagauucuggguauuagg

SEQ ID NO: 920716 - RNA, 22 nt, Human
gcuccaggagagggaagcagau

SEQ ID NO: 920717 - RNA, 22 nt, Human
ucaucuuuccucaaaagaucca

SEQ ID NO: 920718 - RNA, 22 nt, Human
acaugcaagccccugaacacau

SEQ ID NO: 920719 - RNA, 22 nt, Human
agcuguucccucacugcaguca

SEQ ID NO: 920720 - RNA, 22 nt, Human
aacagauggccaagugcauggg

SEQ ID NO: 920721 - RNA, 22 nt, Human
augaaugaugcaaaagacacug

SEQ ID NO: 920722 - RNA, 22 nt, Human
cuuagaaaucgaacucagguua

SEQ ID NO: 920723 - RNA, 22 nt, Human
cagagcaccugcucauugccag

SEQ ID NO: 920724 - RNA, 22 nt, Human
agucccuucucaaagugugcgg

SEQ ID NO: 920725 - RNA, 22 nt, Human
gaggcucacuuucauccucuuc

SEQ ID NO: 920726 - RNA, 22 nt, Human
uccuggcugaguucccaagucg

SEQ ID NO: 920727 - RNA, 22 nt, Human
uauuuaaaaagaggccagcugg

SEQ ID NO: 920728 - RNA, 22 nt, Human
auuccaaacagugcugcagacu

SEQ ID NO: 920729 - RNA, 22 nt, Human
ugcaagugauucuguuuucuca

SEQ ID NO: 920730 - RNA, 22 nt, Human
gcaguccuuaggagaggaagua

SEQ ID NO: 920731 - RNA, 22 nt, Human
guccuuggcaucaugauuuggu

SEQ ID NO: 920732 - RNA, 22 nt, Human
gugagaagauaaguauugcaaa

SEQ ID NO: 920733 - RNA, 22 nt, Human
agauaucuguauuguuuccaau

SEQ ID NO: 920734 - RNA, 22 nt, Human
uagggaugagccaguggguagu

SEQ ID NO: 920735 - RNA, 22 nt, Human
aauuuuacaaaauaccuccgau

SEQ ID NO: 920736 - RNA, 22 nt, Human
ugcaccuuuaaauucagcagua

SEQ ID NO: 920737 - RNA, 22 nt, Human
uuguuucccuggaucuagagcu

SEQ ID NO: 920738 - RNA, 22 nt, Human
ugggcucuggaauugaguggcc

SEQ ID NO: 920739 - RNA, 23 nt, Human
uggcuuuauucacauaucugacc

SEQ ID NO: 920740 - RNA, 22 nt, Human
uaaguucugaagauaggaaaug

SEQ ID NO: 920741 - RNA, 22 nt, Human
auugucuuuccacugagaaguu

SEQ ID NO: 920742 - RNA, 22 nt, Human
gaagacaucauggagaggauag

SEQ ID NO: 920743 - RNA, 22 nt, Human
gcacaggcuguuggccuucaga

SEQ ID NO: 920744 - RNA, 22 nt, Human
ugggagcucagaaagggagguc

SEQ ID NO: 920745 - RNA, 22 nt, Human
acauggaaaacuaacugcuuuu

SEQ ID NO: 920746 - RNA, 22 nt, Human
aaguuagagauuccaucaugcu

SEQ ID NO: 920747 - RNA, 22 nt, Human
agagucugccuuuuucuccugc

SEQ ID NO: 920748 - RNA, 22 nt, Human
ucucugaaggggagcuguuuaa

SEQ ID NO: 920749 - RNA, 22 nt, Human
ccaggucuggcacuggccaguc

SEQ ID NO: 920750 - RNA, 22 nt, Human
agaacagucguggugagagaaa

SEQ ID NO: 920751 - RNA, 22 nt, Human
caaauucaaugaacauguuuaa

SEQ ID NO: 920752 - RNA, 22 nt, Human
uuuccaacuguaccccaguguu

SEQ ID NO: 920753 - RNA, 22 nt, Human
cuuuguuagcagccaauuuguu

SEQ ID NO: 920754 - RNA, 22 nt, Human
gaauucaagugcaaugguauau

SEQ ID NO: 920755 - RNA, 22 nt, Human
uuagcuuucagccuuucucacc

SEQ ID NO: 920756 - RNA, 22 nt, Human
gaucaaauauauuaugccacag

SEQ ID NO: 920757 - RNA, 20 nt, Human
uuuuuccuucucuacaggca

SEQ ID NO: 920758 - RNA, 22 nt, Human
ugugugauugcaggagaugugg

SEQ ID NO: 920759 - RNA, 22 nt, Human
gagagcugcagccgagaggggg

SEQ ID NO: 920760 - RNA, 22 nt, Human
gugccuccuuaaauucugcacc

SEQ ID NO: 920761 - RNA, 22 nt, Human
agagaggucucaggagaaacca

SEQ ID NO: 920762 - RNA, 21 nt, Human
ucugucucuccacugcccugc

SEQ ID NO: 920763 - RNA, 22 nt, Human
uggagaggaaagugcaguuuug

SEQ ID NO: 920764 - RNA, 23 nt, Human
ucacaguuacuuuugcaucaacc

SEQ ID NO: 920765 - RNA, 22 nt, Human
gggcuacagacaugcucuaagc

SEQ ID NO: 920766 - RNA, 22 nt, Human
uuacaauaguuccuucuuuugu

SEQ ID NO: 920767 - RNA, 22 nt, Human
gcagugguccaguucacaccca

SEQ ID NO: 920768 - RNA, 23 nt, Human
uggcagugaucaaaagcuuacau

SEQ ID NO: 920769 - RNA, 17 nt, Human
agguauuuaaggagcug

SEQ ID NO: 920770 - RNA, 20 nt, Human
uccugguggauacugcuuaa

SEQ ID NO: 920771 - RNA, 22 nt, Human
cggggccucaguuuccccaccu

SEQ ID NO: 920772 - RNA, 22 nt, Human
gaggagggagcuggaagcucuu

SEQ ID NO: 920773 - RNA, 22 nt, Human
ccucacagcaaggauuucagug

SEQ ID NO: 920774 - RNA, 22 nt, Human
cacauuuaagcagauguggacc

SEQ ID NO: 920775 - RNA, 22 nt, Human
guuuccagagaucauuuacaua

SEQ ID NO: 920776 - RNA, 19 nt, Human
ugucuuuaacuggaaccac

SEQ ID NO: 920777 - RNA, 22 nt, Human
ugaggcucacaaaucugcauuu

SEQ ID NO: 920778 - RNA, 22 nt, Human
aaaguacacacagagccaagaa

SEQ ID NO: 920779 - RNA, 22 nt, Human
uuuccuuucugguuuggucaua

SEQ ID NO: 920780 - RNA, 22 nt, Human
cagcuuuggagugugagugcug

SEQ ID NO: 920781 - RNA, 22 nt, Human
cuggcucugaccgcgcuggccu

SEQ ID NO: 920782 - RNA, 22 nt, Human
uuucaaacuaugugucaggcag

SEQ ID NO: 920783 - RNA, 22 nt, Human
caaaacauucucugcagcaggg

SEQ ID NO: 920784 - RNA, 22 nt, Human
aaagggaauguguaggacaugu

SEQ ID NO: 920785 - RNA, 22 nt, Human
caaggacagcgucaggugcaac

SEQ ID NO: 920786 - RNA, 22 nt, Human
ucagggaaauagcagggcugaa

SEQ ID NO: 920787 - RNA, 22 nt, Human
uggagguguccaacucgugggu

SEQ ID NO: 920788 - RNA, 19 nt, Human
cagaguacaccagauagga

SEQ ID NO: 920789 - RNA, 22 nt, Human
uauccaaaguuucucagaaacu

SEQ ID NO: 920790 - RNA, 18 nt, Human
uggcuggcagugggcagc

SEQ ID NO: 920791 - RNA, 22 nt, Human
ugagaaaacucaaagacagauc

SEQ ID NO: 920792 - RNA, 22 nt, Human
caggcgggcaggugcggccccu

SEQ ID NO: 920793 - RNA, 22 nt, Human
aaaugcauucuguuuucacuag

SEQ ID NO: 920794 - RNA, 22 nt, Human
uugcaguuuucugccucauuuc

SEQ ID NO: 920795 - RNA, 22 nt, Human
uucucucccaugaagcuucuau

SEQ ID NO: 920796 - RNA, 16 nt, Human
ugcuggggcgccgucc

SEQ ID NO: 920797 - RNA, 22 nt, Human
gcugagguuucaggaguggcag

SEQ ID NO: 920798 - RNA, 22 nt, Human
uaguaacagcagcuucccugug

SEQ ID NO: 920799 - RNA, 22 nt, Human
gggcugggauugcuugcuguga

SEQ ID NO: 920800 - RNA, 22 nt, Human
uucucagauccaucagaagucc

SEQ ID NO: 920801 - RNA, 22 nt, Human
uuugaagggcacgacaauaguu

SEQ ID NO: 920802 - RNA, 22 nt, Human
guucugggagaucuugagcuuc

SEQ ID NO: 920803 - RNA, 22 nt, Human
ggcccagcuuucauuccuugcu

SEQ ID NO: 920804 - RNA, 22 nt, Human
cacagcaaaggcuucggcugau

SEQ ID NO: 920805 - RNA, 22 nt, Human
aacuuauugaacauucucgaau

SEQ ID NO: 920806 - RNA, 22 nt, Human
ucagaaaauaacuguuaguuug

SEQ ID NO: 920807 - RNA, 16 nt, Human
uccuggggauacugga

SEQ ID NO: 920808 - RNA, 22 nt, Human
gagcugcuucugugugccgggu

SEQ ID NO: 920809 - RNA, 22 nt, Human
cccagagagcauuuggacaaag

SEQ ID NO: 920810 - RNA, 22 nt, Human
uacauguauguuuaucuugaga

SEQ ID NO: 920811 - RNA, 22 nt, Human
aaagaggcaaucaauguagcaa

SEQ ID NO: 920812 - RNA, 22 nt, Human
ugccugggugcuggcuggucac

SEQ ID NO: 920813 - RNA, 21 nt, Human
ggcugguguuuagcugugaua

SEQ ID NO: 920814 - RNA, 22 nt, Human
cuggagggaguuaggacccgga

SEQ ID NO: 920815 - RNA, 22 nt, Human
gcagaggagaugaagauacuuu

SEQ ID NO: 920816 - RNA, 22 nt, Human
uaaauuaaagauuggagaagga

SEQ ID NO: 920817 - RNA, 22 nt, Human
ucauugaaaacucagcaucuac

SEQ ID NO: 920818 - RNA, 22 nt, Human
uuguaagacuguagaaugcaaa

SEQ ID NO: 920819 - RNA, 22 nt, Human
aucagcuuggaccaauaagaug

SEQ ID NO: 920820 - RNA, 22 nt, Human
agcacagggacaaugccaggug

SEQ ID NO: 920821 - RNA, 22 nt, Human
uccaggaguccugggagugauu

SEQ ID NO: 920822 - RNA, 19 nt, Human
aauguuuaagagaaaaagg

SEQ ID NO: 920823 - RNA, 21 nt, Human
auaaauucugagaggcucugc

SEQ ID NO: 920824 - RNA, 22 nt, Human
uuugcaaacacuuaagaagaga

SEQ ID NO: 920825 - RNA, 22 nt, Human
aaggcaagguucaccgugcuau

SEQ ID NO: 920826 - RNA, 22 nt, Human
gaagauuucuuuaugaaagaug

SEQ ID NO: 920827 - RNA, 22 nt, Human
aaugcuuccuccucaccucagg

SEQ ID NO: 920828 - RNA, 22 nt, Human
aggcuucauauuuaggcauaug

SEQ ID NO: 920829 - RNA, 22 nt, Human
ccugucagaugaaguaauugug

SEQ ID NO: 920830 - RNA, 20 nt, Human
aaaguguaaggcaaaguugu

SEQ ID NO: 920831 - RNA, 22 nt, Human
ucaguguguaguaaauuguagg

SEQ ID NO: 920832 - RNA, 22 nt, Human
aggcuggccagugcugcagugg

SEQ ID NO: 920833 - RNA, 22 nt, Human
ugacagggcuagaggcaaugca

SEQ ID NO: 920834 - RNA, 22 nt, Human
agcagugggugacagagcugag

SEQ ID NO: 920835 - RNA, 22 nt, Human
auugccaggaggguugagaaua

SEQ ID NO: 920836 - RNA, 22 nt, Human
aaguggcaguucaggaagcaga

SEQ ID NO: 920837 - RNA, 22 nt, Human
ucaggcaggaagggaggacuug

SEQ ID NO: 920838 - RNA, 20 nt, Human
uccaggccuuguucucagau

SEQ ID NO: 920839 - RNA, 22 nt, Human
aggcucugaagcaacccuuuga

SEQ ID NO: 920840 - RNA, 22 nt, Human
agaaauucaauucuaauuagcu

SEQ ID NO: 920841 - RNA, 23 nt, Human
uacauucauuugcacagccagua

SEQ ID NO: 920842 - RNA, 22 nt, Human
aaaauagauucuaggaugucuu

SEQ ID NO: 920843 - RNA, 22 nt, Human
augcguguaggaacagugucua

SEQ ID NO: 920844 - RNA, 22 nt, Human
agcccagggacagggcggaugu

SEQ ID NO: 920845 - RNA, 20 nt, Human
aggguggggacguucugacu

SEQ ID NO: 920846 - RNA, 22 nt, Human
ccauuauccauuuugagucuua

SEQ ID NO: 920847 - RNA, 22 nt, Human
gugcaggagguaacauagcaaa

SEQ ID NO: 920848 - RNA, 20 nt, Human
guguggccaggagcugcgcu

SEQ ID NO: 920849 - RNA, 22 nt, Human
ggcuagggaaaaugauuggaua

SEQ ID NO: 920850 - RNA, 22 nt, Human
uccaccagagccuucccaugcu

SEQ ID NO: 920851 - RNA, 22 nt, Human
aggccagaugucgggcuagaag

SEQ ID NO: 920852 - RNA, 22 nt, Human
acaguacugaguacugaguugg

SEQ ID NO: 920853 - RNA, 22 nt, Human
gacgcacugaaggcugguuacc

SEQ ID NO: 920854 - RNA, 22 nt, Human
uuauuuccaguccagaaauuua

SEQ ID NO: 920855 - RNA, 22 nt, Human
ggucucaggagacuggagagca

SEQ ID NO: 920856 - RNA, 22 nt, Human
ggcuuuggggugugcagagaug

SEQ ID NO: 920857 - RNA, 22 nt, Human
aguccagggagcccaggcuuug

SEQ ID NO: 920858 - RNA, 22 nt, Human
gaagcuggagaaugggucuagg

SEQ ID NO: 920859 - RNA, 22 nt, Human
uugaauuuagauuguauguuga

SEQ ID NO: 920860 - RNA, 22 nt, Human
uccaugugcuuccucaggggaa

SEQ ID NO: 920861 - RNA, 22 nt, Human
gcaaagaaagccaaggucuaac

SEQ ID NO: 920862 - RNA, 22 nt, Human
uuuucuuaugugcagcuauaug

SEQ ID NO: 920863 - RNA, 18 nt, Human
aagcugggaaggagacag

SEQ ID NO: 920864 - RNA, 22 nt, Human
agcagccaaccuuacauucauc

SEQ ID NO: 920865 - RNA, 22 nt, Human
ccugccugcaccuucucugggg

SEQ ID NO: 920866 - RNA, 18 nt, Human
acauuucuccuucugacc

SEQ ID NO: 920867 - RNA, 22 nt, Human
uuacuacagagagagcuccagu

SEQ ID NO: 920868 - RNA, 22 nt, Human
gaagagagaacauuacauaaac

SEQ ID NO: 920869 - RNA, 22 nt, Human
uggcuccucuucuggguguccc

SEQ ID NO: 920870 - RNA, 22 nt, Human
uacaguaacuggaauucuucuu

SEQ ID NO: 920871 - RNA, 22 nt, Human
acaugauuuuaguaucauaaua

SEQ ID NO: 920872 - RNA, 22 nt, Human
aggcagacuuccugcuuggauc

SEQ ID NO: 920873 - RNA, 22 nt, Human
agugucugaagccucagcccga

SEQ ID NO: 920874 - RNA, 22 nt, Human
aacuaaaggcuguugcagggaa

SEQ ID NO: 920875 - RNA, 22 nt, Human
agaaaaaucuuggcgcuugucu

SEQ ID NO: 920876 - RNA, 22 nt, Human
caucaucaaaacaaauggaguc

SEQ ID NO: 920877 - RNA, 22 nt, Human
uucugggcucucuuucugugug

SEQ ID NO: 920878 - RNA, 22 nt, Human
agcugucagugcugugccugua

SEQ ID NO: 920879 - RNA, 22 nt, Human
gggaccugccauugcucacagg

SEQ ID NO: 920880 - RNA, 22 nt, Human
caaaguauauuggauugaaugg

SEQ ID NO: 920881 - RNA, 22 nt, Human
ccaauguuuuauacagaaguac

SEQ ID NO: 920882 - RNA, 19 nt, Human
agacucugugugagacuuu

SEQ ID NO: 920883 - RNA, 23 nt, Human
gugagcagcaccaugaggcuaga

SEQ ID NO: 920884 - RNA, 19 nt, Human
aggcacaauucugagaagc

SEQ ID NO: 920885 - RNA, 22 nt, Human
gugggccucuugaggguggcua

SEQ ID NO: 920886 - RNA, 22 nt, Human
aaaaaugucauuauggaacuga

SEQ ID NO: 920887 - RNA, 22 nt, Human
cagagccugcucacgucucugu

SEQ ID NO: 920888 - RNA, 22 nt, Human
aagaggaaaugauugacuauau

SEQ ID NO: 920889 - RNA, 22 nt, Human
uauuagguagauuuuacugauu

SEQ ID NO: 920890 - RNA, 22 nt, Human
augcauauaauggccagaacaa

SEQ ID NO: 920891 - RNA, 22 nt, Human
uuccuggggggauagauuucac

SEQ ID NO: 920892 - RNA, 22 nt, Human
ugaagccucaccugcucaguau

SEQ ID NO: 920893 - RNA, 22 nt, Human
uacugucuaauaagauugaugg

SEQ ID NO: 920894 - RNA, 20 nt, Human
gugugugcuccaugcaugcu

SEQ ID NO: 920895 - RNA, 21 nt, Human
ccauucuuagucaagugucuc

SEQ ID NO: 920896 - RNA, 22 nt, Human
uuaccacagugcaugacuucug

SEQ ID NO: 920897 - RNA, 22 nt, Human
agcccagaggcugggcgugcau

SEQ ID NO: 920898 - RNA, 22 nt, Human
gacaguguuacaauuuaaugga

SEQ ID NO: 920899 - RNA, 22 nt, Human
uauauuaacuugugauccugga

SEQ ID NO: 920900 - RNA, 22 nt, Human
aaguacauccuagucucuuuca

SEQ ID NO: 920901 - RNA, 20 nt, Human
aaaguucauguuugcacuuu

SEQ ID NO: 920902 - RNA, 22 nt, Human
ucuccaggagcaagucacccag

SEQ ID NO: 920903 - RNA, 22 nt, Human
auugucuuaaacaaauguguuu

SEQ ID NO: 920904 - RNA, 22 nt, Human
gcaaggcugggagaugaggccu

SEQ ID NO: 920905 - RNA, 22 nt, Human
auauaucaugaguaaaacuuga

SEQ ID NO: 920906 - RNA, 19 nt, Human
cacagccacagccaaccuc

SEQ ID NO: 920907 - RNA, 22 nt, Human
cagguacaaagcuacugccuga

SEQ ID NO: 920908 - RNA, 22 nt, Human
auugugcagcucugcucuuauu

SEQ ID NO: 920909 - RNA, 22 nt, Human
gaagauuucaguuaaguaucua

SEQ ID NO: 920910 - RNA, 22 nt, Human
aguaaacauguaauuguucauu

SEQ ID NO: 920911 - RNA, 22 nt, Human
acccagucuggagugcagugac

SEQ ID NO: 920912 - RNA, 21 nt, Human
uucaaagacuugaugcugacc

SEQ ID NO: 920913 - RNA, 22 nt, Human
cccagcucuaggagugguggca

SEQ ID NO: 920914 - RNA, 19 nt, Human
uccaggaggcugccauuga

SEQ ID NO: 920915 - RNA, 22 nt, Human
gauacaaauucaugucugaauu

SEQ ID NO: 920916 - RNA, 22 nt, Human
cauucaaaggcauguccuauuu

SEQ ID NO: 920917 - RNA, 20 nt, Human
ucccugccuuuuacugcugg

SEQ ID NO: 920918 - RNA, 22 nt, Human
augccuccaagauucuuacguu

SEQ ID NO: 920919 - RNA, 22 nt, Human
agagacaccgcgcaucauggcu

SEQ ID NO: 920920 - RNA, 22 nt, Human
uccagggcuugacagggugccu

SEQ ID NO: 920921 - RNA, 22 nt, Human
ugaagaaacgcagagagguagg

SEQ ID NO: 920922 - RNA, 22 nt, Human
acaguauacauugauuaggacc

SEQ ID NO: 920923 - RNA, 22 nt, Human
ucucacauuucauugacagcug

SEQ ID NO: 920924 - RNA, 22 nt, Human
gggcccuggauuuaagcaugga

SEQ ID NO: 920925 - RNA, 22 nt, Human
auugcugaacuuauaaaugaau

SEQ ID NO: 920926 - RNA, 22 nt, Human
auugcacaaagagggaaacuga

SEQ ID NO: 920927 - RNA, 22 nt, Human
cccugcagaucagugagaacuu

SEQ ID NO: 920928 - RNA, 22 nt, Human
uagucccggaacuccuucaggu

SEQ ID NO: 920929 - RNA, 22 nt, Human
ggcuccagauguccccuggcaa

SEQ ID NO: 920930 - RNA, 22 nt, Human
aacuccagggggucaauauuua

SEQ ID NO: 920931 - RNA, 22 nt, Human
cucuaggcugcccaggagcuga

SEQ ID NO: 920932 - RNA, 19 nt, Human
aaaugugaugguacaauuc

SEQ ID NO: 920933 - RNA, 22 nt, Human
ccaggaggcucugcccauccca

SEQ ID NO: 920934 - RNA, 22 nt, Human
cccaggagauggugcguggucu

SEQ ID NO: 920935 - RNA, 20 nt, Human
ugagaaaguagagacucagg

SEQ ID NO: 920936 - RNA, 22 nt, Human
caaaaggccaguacuuuguuug

SEQ ID NO: 920937 - RNA, 22 nt, Human
gcugcuggggccuucccucggg

SEQ ID NO: 920938 - RNA, 22 nt, Human
uaagaacaguguuucaucucua

SEQ ID NO: 920939 - RNA, 22 nt, Human
uggcuucaucacucgggcugcc

SEQ ID NO: 920940 - RNA, 22 nt, Human
cucugaccauucccuugauuuu

SEQ ID NO: 920941 - RNA, 22 nt, Human
gcuguccaggagugcagagauu

SEQ ID NO: 920942 - RNA, 22 nt, Human
ggcugcagaggcccccaguggg

SEQ ID NO: 920943 - RNA, 22 nt, Human
auaguacuccaccaguacaugu

SEQ ID NO: 920944 - RNA, 20 nt, Human
accucccucuguggguggga

SEQ ID NO: 920945 - RNA, 22 nt, Human
cuguuuuucagaagguaaggga

SEQ ID NO: 920946 - RNA, 22 nt, Human
cugaggcauguuacaggacaua

SEQ ID NO: 920947 - RNA, 22 nt, Human
ggccaugcaggucagagguggg

SEQ ID NO: 920948 - RNA, 22 nt, Human
uuucuucuaggacuaauaagag

SEQ ID NO: 920949 - RNA, 22 nt, Human
aggacugaaaaugaguucuucu

SEQ ID NO: 920950 - RNA, 22 nt, Human
auucuggguuugcuguacaaag

SEQ ID NO: 920951 - RNA, 22 nt, Human
acaguguccuuguggucccugu

SEQ ID NO: 920952 - RNA, 21 nt, Human
cacuccacuuagaacaggguu

SEQ ID NO: 920953 - RNA, 22 nt, Human
aaagaguugaggcaguuaucca

SEQ ID NO: 920954 - RNA, 22 nt, Human
gaagagaaaggcaaggaguuuu

SEQ ID NO: 920955 - RNA, 22 nt, Human
cggcccugaccagaccuuaguu

SEQ ID NO: 920956 - RNA, 22 nt, Human
gagagagaagugggugucaccu

SEQ ID NO: 920957 - RNA, 22 nt, Human
cugagacccagacaccugagga

SEQ ID NO: 920958 - RNA, 22 nt, Human
aacaauaacuagacaugccaug

SEQ ID NO: 920959 - RNA, 22 nt, Human
uauaguuaguuucauaaucaug

SEQ ID NO: 920960 - RNA, 22 nt, Human
uccccaaagcuuuguggucagg

SEQ ID NO: 920961 - RNA, 20 nt, Human
aauaaacuacugagagaugu

SEQ ID NO: 920962 - RNA, 22 nt, Human
augaaacacacacgcgcauacu

SEQ ID NO: 920963 - RNA, 20 nt, Human
agggugugggccuuagccau

SEQ ID NO: 920964 - RNA, 22 nt, Human
acaggcagggaccucuugaguu

SEQ ID NO: 920965 - RNA, 22 nt, Human
ugucaauaacauuuacuucuau

SEQ ID NO: 920966 - RNA, 22 nt, Human
aguuuagaaaaucuguuucuuc

SEQ ID NO: 920967 - RNA, 22 nt, Human
ucacaguacuccccaaaguuuc

SEQ ID NO: 920968 - RNA, 20 nt, Human
uggcaggaauagggccagag

SEQ ID NO: 920969 - RNA, 20 nt, Human
aggcaguuucaauuuuguua

SEQ ID NO: 920970 - RNA, 22 nt, Human
cuuugauauaaguauacauagu

SEQ ID NO: 920971 - RNA, 22 nt, Human
gucuuauugcguauguauacaa

SEQ ID NO: 920972 - RNA, 22 nt, Human
uccagcucaggguuggcucaag

SEQ ID NO: 920973 - RNA, 22 nt, Human
agacaaaggauuaaugaugaug

SEQ ID NO: 920974 - RNA, 19 nt, Human
uguguucauucaucagagg

SEQ ID NO: 920975 - RNA, 22 nt, Human
auggcuucucgcuggcaccugu

SEQ ID NO: 920976 - RNA, 22 nt, Human
uccugggcuuuguuucucuccu

SEQ ID NO: 920977 - RNA, 22 nt, Human
auucuagcaguuacaggcugau

SEQ ID NO: 920978 - RNA, 22 nt, Human
uccaggcccugggaugggagca

SEQ ID NO: 920979 - RNA, 22 nt, Human
aaugacaauaaucauuaacuuu

SEQ ID NO: 920980 - RNA, 22 nt, Human
ggccugcucuggcuguggucag

SEQ ID NO: 920981 - RNA, 23 nt, Human
gacagggcugacuuggcagcugc

SEQ ID NO: 920982 - RNA, 22 nt, Human
ggcuggcagaggggagucugug

SEQ ID NO: 920983 - RNA, 22 nt, Human
cagacauggaaauuuaguguua

SEQ ID NO: 920984 - RNA, 22 nt, Human
auauacagggagaaacagcuua

SEQ ID NO: 920985 - RNA, 22 nt, Human
gugcuggggguuucuguagguc

SEQ ID NO: 920986 - RNA, 22 nt, Human
ugaggcaggaugcuugcacagg

SEQ ID NO: 920987 - RNA, 22 nt, Human
uguggagaagaaggccacugca

SEQ ID NO: 920988 - RNA, 22 nt, Human
aacaaagaagacugguuauuuu

SEQ ID NO: 920989 - RNA, 22 nt, Human
ccagaagaccggggagucaggg

SEQ ID NO: 920990 - RNA, 23 nt, Human
uacagcugcagaaucaggcuaag

SEQ ID NO: 920991 - RNA, 22 nt, Human
uagaaacagauguuuuugaaga

SEQ ID NO: 920992 - RNA, 22 nt, Human
caggccucgaggagacagcuac

SEQ ID NO: 920993 - RNA, 22 nt, Human
uuguuugaggucacugauauuu

SEQ ID NO: 920994 - RNA, 22 nt, Human
uuucucauggaacauagcuccu

SEQ ID NO: 920995 - RNA, 22 nt, Human
gcaugcaggaagggcuugggga

SEQ ID NO: 920996 - RNA, 19 nt, Human
auggcucugggaucacugc

SEQ ID NO: 920997 - RNA, 22 nt, Human
agguaaggagucccaaccaucc

SEQ ID NO: 920998 - RNA, 19 nt, Human
ucuugaugagguuucucca

SEQ ID NO: 920999 - RNA, 22 nt, Human
cuuguucaguugccucuccugc

SEQ ID NO: 921000 - RNA, 22 nt, Human
agaauucuccuucagggcagga

SEQ ID NO: 921001 - RNA, 22 nt, Human
ucuggaaguuagaggaggaaag

SEQ ID NO: 921002 - RNA, 22 nt, Human
gccaggcauucuagaaguagug

SEQ ID NO: 921003 - RNA, 22 nt, Human
aaacucagauguggugaagacc

SEQ ID NO: 921004 - RNA, 17 nt, Human
cucagcagggcucacuu

SEQ ID NO: 921005 - RNA, 22 nt, Human
uucagagacauguucuagauca

SEQ ID NO: 921006 - RNA, 22 nt, Human
aagguauuuucuaauguauacu

SEQ ID NO: 921007 - RNA, 22 nt, Human
ugccauggugacugcaggaggu

SEQ ID NO: 921008 - RNA, 22 nt, Human
aagcugauucuaaaauuuauua

SEQ ID NO: 921009 - RNA, 22 nt, Human
aaaauuaagugucugggaagcc

SEQ ID NO: 921010 - RNA, 22 nt, Human
ugacacuuccgguaaaaaaugc

SEQ ID NO: 921011 - RNA, 22 nt, Human
gggcuaagugaagauugcucca

SEQ ID NO: 921012 - RNA, 22 nt, Human
guccaaacaggucaaaauauua

SEQ ID NO: 921013 - RNA, 21 nt, Human
gcugcucgagauccagugcuu

SEQ ID NO: 921014 - RNA, 22 nt, Human
ggcagggguccugguguugacu

SEQ ID NO: 921015 - RNA, 21 nt, Human
aguaguuuagcacaggguuug

SEQ ID NO: 921016 - RNA, 22 nt, Human
ucugaggauagaggcaauagga

SEQ ID NO: 921017 - RNA, 22 nt, Human
gauguuuauaucuaacuuaagu

SEQ ID NO: 921018 - RNA, 22 nt, Human
agaauuucuggaagauugcaag

SEQ ID NO: 921019 - RNA, 17 nt, Human
ugggguguugaaggguu

SEQ ID NO: 921020 - RNA, 23 nt, Human
ccugugucuguugcugaauaaug

SEQ ID NO: 921021 - RNA, 22 nt, Human
auuuaugagcugaaccaugaaa

SEQ ID NO: 921022 - RNA, 22 nt, Human
caggccaaagaucccauugaca

SEQ ID NO: 921023 - RNA, 22 nt, Human
ccaggugggaggaaagcagaga

SEQ ID NO: 921024 - RNA, 22 nt, Human
uaauaagcguagaagguauauc

SEQ ID NO: 921025 - RNA, 20 nt, Human
cucuuaguacuguuccuggu

SEQ ID NO: 921026 - RNA, 20 nt, Human
uccaauguaggauaaaugug

SEQ ID NO: 921027 - RNA, 22 nt, Human
acauacauggauucauggauuc

SEQ ID NO: 921028 - RNA, 22 nt, Human
gcugggaugcgucuucccaggc

SEQ ID NO: 921029 - RNA, 18 nt, Human
acauuucucucugcguga

SEQ ID NO: 921030 - RNA, 22 nt, Human
aucuuucuccauauacaucuuu

SEQ ID NO: 921031 - RNA, 22 nt, Human
ugacaguucaggucagauuuau

SEQ ID NO: 921032 - RNA, 23 nt, Human
acagugugguggacaaggagcag

SEQ ID NO: 921033 - RNA, 22 nt, Human
uccugggguuuagagggaagug

SEQ ID NO: 921034 - RNA, 22 nt, Human
uggccagcacuuagcccuuacc

SEQ ID NO: 921035 - RNA, 21 nt, Human
accaggccaggaggcuggcac

SEQ ID NO: 921036 - RNA, 22 nt, Human
ucuuuguuggaguccaaggaua

SEQ ID NO: 921037 - RNA, 22 nt, Human
agcagugaguaacacagaccag

SEQ ID NO: 921038 - RNA, 22 nt, Human
uccuuggaagagcauucccagg

SEQ ID NO: 921039 - RNA, 22 nt, Human
aaaaggcuaauuaaguuuugga

SEQ ID NO: 921040 - RNA, 22 nt, Human
ucugagaggugaauucagcaaa

SEQ ID NO: 921041 - RNA, 22 nt, Human
ggugacagcgggucaagaggag

SEQ ID NO: 921042 - RNA, 22 nt, Human
uuuguaagcaguguuuuuacag

SEQ ID NO: 921043 - RNA, 22 nt, Human
agcucuuaucucuaagcacagc

SEQ ID NO: 921044 - RNA, 22 nt, Human
uaugcaaaguccuaagaaagaa

SEQ ID NO: 921045 - RNA, 22 nt, Human
ugaauaugugacuuugauuuca

SEQ ID NO: 921046 - RNA, 22 nt, Human
cagaaacuucuggugucaaaua

SEQ ID NO: 921047 - RNA, 22 nt, Human
aagguguucagguuuucccauu

SEQ ID NO: 921048 - RNA, 22 nt, Human
gguccuuugccaucucuccacc

SEQ ID NO: 921049 - RNA, 22 nt, Human
ggcauuuaucuaauauaguuua

SEQ ID NO: 921050 - RNA, 22 nt, Human
cucagagcacaguuuaugacag

SEQ ID NO: 921051 - RNA, 22 nt, Human
uucuagaagcucuaggggagaa

SEQ ID NO: 921052 - RNA, 21 nt, Human
agcagcugcaguuucuaucug

SEQ ID NO: 921053 - RNA, 23 nt, Human
aggcaaaccuauaaaauaggaau

SEQ ID NO: 921054 - RNA, 22 nt, Human
cuaggcugagcugggcugagcu

SEQ ID NO: 921055 - RNA, 22 nt, Human
cuggugcaaaaguaauuguggu

SEQ ID NO: 921056 - RNA, 22 nt, Human
aaguuucucaauggcaacuggg

SEQ ID NO: 921057 - RNA, 20 nt, Human
acuuuggggucuuucucaga

SEQ ID NO: 921058 - RNA, 22 nt, Human
cauaacaucugugaagcaggaa

SEQ ID NO: 921059 - RNA, 22 nt, Human
caguguggugugcacagcuuag

SEQ ID NO: 921060 - RNA, 22 nt, Human
guccuggggauacagaagugaa

SEQ ID NO: 921061 - RNA, 22 nt, Human
ggcuacuagacuuugauacuag

SEQ ID NO: 921062 - RNA, 22 nt, Human
aggcaccaguaagaguagaacu

SEQ ID NO: 921063 - RNA, 22 nt, Human
agagguauguucacuucccuuu

SEQ ID NO: 921064 - RNA, 22 nt, Human
acugggcuucacuuggcacauc

SEQ ID NO: 921065 - RNA, 20 nt, Human
aaagucucaacagcugagaa

SEQ ID NO: 921066 - RNA, 22 nt, Human
cagggcacaguuauggaggugg

SEQ ID NO: 921067 - RNA, 22 nt, Human
aggccagcugccacccgguccg

SEQ ID NO: 921068 - RNA, 22 nt, Human
aguuuaauuggaggcguggcuc

SEQ ID NO: 921069 - RNA, 22 nt, Human
ugacaagaagaccugguaauga

SEQ ID NO: 921070 - RNA, 22 nt, Human
ucuguggaagauuccaggcguu

SEQ ID NO: 921071 - RNA, 22 nt, Human
ucuuuagacauccaguuucucu

SEQ ID NO: 921072 - RNA, 22 nt, Human
aagccaggugugcccaggaucc

SEQ ID NO: 921073 - RNA, 22 nt, Human
guggccaggagagggugggaca

SEQ ID NO: 921074 - RNA, 22 nt, Human
agcacagagcuaggaguggagg

SEQ ID NO: 921075 - RNA, 22 nt, Human
cucugcuguuuuguauacaggc

SEQ ID NO: 921076 - RNA, 22 nt, Human
aguuuccuugggcauuuguuua

SEQ ID NO: 921077 - RNA, 22 nt, Human
uacagggaccaauaauaacuau

SEQ ID NO: 921078 - RNA, 22 nt, Human
ugagguaugugaugucuuuuag

SEQ ID NO: 921079 - RNA, 22 nt, Human
aguaggaggcgggagcaugaag

SEQ ID NO: 921080 - RNA, 22 nt, Human
aaugucuuuuaaauguugaggu

SEQ ID NO: 921081 - RNA, 22 nt, Human
gccaguggagcacauggugaag

SEQ ID NO: 921082 - RNA, 22 nt, Human
ugucuuuuuacuauguucaauc

SEQ ID NO: 921083 - RNA, 22 nt, Human
cccugagagguugagugucugc

SEQ ID NO: 921084 - RNA, 22 nt, Human
aagagaauaucgauagcacucu

SEQ ID NO: 921085 - RNA, 22 nt, Human
ggagguggagguugcaaugagc

SEQ ID NO: 921086 - RNA, 22 nt, Human
auagccaggucacagagcuagc

SEQ ID NO: 921087 - RNA, 22 nt, Human
uggcccagagcacugcugggca

SEQ ID NO: 921088 - RNA, 22 nt, Human
ccugcaggggagagacuucuag

SEQ ID NO: 921089 - RNA, 22 nt, Human
ggcagcugagaucaugcuguug

SEQ ID NO: 921090 - RNA, 22 nt, Human
cuggcaugaaauggcaucucau

SEQ ID NO: 921091 - RNA, 22 nt, Human
acaacaguccaguauagacugu

SEQ ID NO: 921092 - RNA, 22 nt, Human
ccagggcagaaaaagagggaau

SEQ ID NO: 921093 - RNA, 22 nt, Human
aauauucauuugcagaagaagu

SEQ ID NO: 921094 - RNA, 22 nt, Human
caggaaauguauaauuuuauaa

SEQ ID NO: 921095 - RNA, 19 nt, Human
auggcagcagcagcucucc

SEQ ID NO: 921096 - RNA, 23 nt, Human
gccuggagaaaagcugcaguuca

SEQ ID NO: 921097 - RNA, 22 nt, Human
ggcugccucuuucuuagugucu

SEQ ID NO: 921098 - RNA, 23 nt, Human
ugcuggcuguguuauugccaaca

SEQ ID NO: 921099 - RNA, 22 nt, Human
caauuucaaugaggccacaggg

SEQ ID NO: 921100 - RNA, 22 nt, Human
ucauuuugcagagcugaggaac

SEQ ID NO: 921101 - RNA, 22 nt, Human
ucuuagcaugcauguauaaaua

SEQ ID NO: 921102 - RNA, 19 nt, Human
uucuaggcuaugaagcagu

SEQ ID NO: 921103 - RNA, 22 nt, Human
gcacccaguuugucucaggguu

SEQ ID NO: 921104 - RNA, 22 nt, Human
agggccagucguguauuacugu

SEQ ID NO: 921105 - RNA, 22 nt, Human
auguagauguucacuugauuuu

SEQ ID NO: 921106 - RNA, 22 nt, Human
gacugaaauuauaccaaguggu

SEQ ID NO: 921107 - RNA, 22 nt, Human
agugacuuaaaggaacuuacug

SEQ ID NO: 921108 - RNA, 22 nt, Human
gcugccuguguggccacucacu

SEQ ID NO: 921109 - RNA, 20 nt, Human
aagcuggguaggagaggagc

SEQ ID NO: 921110 - RNA, 22 nt, Human
agcagccaaaugaagauuuuac

SEQ ID NO: 921111 - RNA, 22 nt, Human
ggugucacaggaggccgugugg

SEQ ID NO: 921112 - RNA, 21 nt, Human
ugcaggagucugugagucagg

SEQ ID NO: 921113 - RNA, 22 nt, Human
auagcacaucacuccagugagu

SEQ ID NO: 921114 - RNA, 19 nt, Human
ugggccucacaaugcuccc

SEQ ID NO: 921115 - RNA, 22 nt, Human
aggugcuagguguguaguggag

SEQ ID NO: 921116 - RNA, 22 nt, Human
ugcucccaggcucuguggucug

SEQ ID NO: 921117 - RNA, 22 nt, Human
agaauacaucuagugcugcaug

SEQ ID NO: 921118 - RNA, 22 nt, Human
cagcaagacaggauucccgugg

SEQ ID NO: 921119 - RNA, 22 nt, Human
auuugauuagcuguguaauuuu

SEQ ID NO: 921120 - RNA, 22 nt, Human
aaugguuuugcuuuaguauucu

SEQ ID NO: 921121 - RNA, 22 nt, Human
uuucagaaagcugaacauauga

SEQ ID NO: 921122 - RNA, 22 nt, Human
auggcauuuauguugacaaugg

SEQ ID NO: 921123 - RNA, 21 nt, Human
aaagaugagaacuggauggcu

SEQ ID NO: 921124 - RNA, 22 nt, Human
uccaggcugugcgcaccgugug

SEQ ID NO: 921125 - RNA, 22 nt, Human
uaaagugcuuccuaacccagag

SEQ ID NO: 921126 - RNA, 17 nt, Human
aauagcugcucagagag

SEQ ID NO: 921127 - RNA, 22 nt, Human
ucuauaaauuaugcagucucag

SEQ ID NO: 921128 - RNA, 22 nt, Human
acaugguauuucuauuauaauu

SEQ ID NO: 921129 - RNA, 22 nt, Human
ucagaucuggugaaguuauagu

SEQ ID NO: 921130 - RNA, 22 nt, Human
ccagguggacggcgaguacagg

SEQ ID NO: 921131 - RNA, 22 nt, Human
uuuuuacacuuagcauugagcg

SEQ ID NO: 921132 - RNA, 22 nt, Human
cucaccccuguaauuccagcac

SEQ ID NO: 921133 - RNA, 22 nt, Human
ggccugcuccgggggcugagcu

SEQ ID NO: 921134 - RNA, 22 nt, Human
agagcagcuggggcagagacca

SEQ ID NO: 921135 - RNA, 22 nt, Human
auuagaaugacagaaaugaggc

SEQ ID NO: 921136 - RNA, 22 nt, Human
aaguauuucuggccugugaaag

SEQ ID NO: 921137 - RNA, 22 nt, Human
uagcccaggcuggagggcagug

SEQ ID NO: 921138 - RNA, 22 nt, Human
aggcacagauuuggggaaagca

SEQ ID NO: 921139 - RNA, 22 nt, Human
uaacaguauugaagauaaacua

SEQ ID NO: 921140 - RNA, 22 nt, Human
ugcccacuucaaaaucuucauu

SEQ ID NO: 921141 - RNA, 22 nt, Human
cuguggcaggugucuggggcag

SEQ ID NO: 921142 - RNA, 22 nt, Human
acuacagucccucauauguugg

SEQ ID NO: 921143 - RNA, 22 nt, Human
gacacagguagaauaaaguacu

SEQ ID NO: 921144 - RNA, 22 nt, Human
gguguagcucugugucccacug

SEQ ID NO: 921145 - RNA, 22 nt, Human
uguuugcuuggucaguaaguag

SEQ ID NO: 921146 - RNA, 22 nt, Human
ucuuuguguucaggagccacgu

SEQ ID NO: 921147 - RNA, 22 nt, Human
uguggaagaacacuggccaggc

SEQ ID NO: 921148 - RNA, 22 nt, Human
ucuugcauuucagaguucagag

SEQ ID NO: 921149 - RNA, 22 nt, Human
ugcccugcugugccuggagcca

SEQ ID NO: 921150 - RNA, 22 nt, Human
uacacagagacucaaaagggca

SEQ ID NO: 921151 - RNA, 22 nt, Human
aauggcaauucagugaaauuau

SEQ ID NO: 921152 - RNA, 22 nt, Human
cuguauucugggcagggaagga

SEQ ID NO: 921153 - RNA, 22 nt, Human
gaagaggcaauugaauaagcua

SEQ ID NO: 921154 - RNA, 22 nt, Human
ggcaagagugaggagugucucu

SEQ ID NO: 921155 - RNA, 22 nt, Human
uuauacacguuuauggagcuac

SEQ ID NO: 921156 - RNA, 22 nt, Human
aagcagcauccugggcagaccu

SEQ ID NO: 921157 - RNA, 22 nt, Human
gugcugaauaacaguagaaauu

SEQ ID NO: 921158 - RNA, 22 nt, Human
caguuuuacccaagcuuauuuu

SEQ ID NO: 921159 - RNA, 22 nt, Human
agccuggauucgugcauccaca

SEQ ID NO: 921160 - RNA, 22 nt, Human
agagggugcuggagagacauug

SEQ ID NO: 921161 - RNA, 22 nt, Human
uaacuacauuucacugcaauua

SEQ ID NO: 921162 - RNA, 22 nt, Human
gaucaaccacgccggguugcca

SEQ ID NO: 921163 - RNA, 22 nt, Human
ggcuagggacacagcucugcuc

SEQ ID NO: 921164 - RNA, 22 nt, Human
gagcugcacuggggguggaaug

SEQ ID NO: 921165 - RNA, 22 nt, Human
agaccaugaccugccacuaagc

SEQ ID NO: 921166 - RNA, 22 nt, Human
cauauuagccuccacugggaca

SEQ ID NO: 921167 - RNA, 22 nt, Human
uaguuucuggguuggcuucuac

SEQ ID NO: 921168 - RNA, 22 nt, Human
cagagcugcagauugaaggcau

SEQ ID NO: 921169 - RNA, 22 nt, Human
agccaucucugaaaucaaagcu

SEQ ID NO: 921170 - RNA, 22 nt, Human
ucccuuguccugugggaagagc

SEQ ID NO: 921171 - RNA, 22 nt, Human
uggcaguugugagguucauauu

SEQ ID NO: 921172 - RNA, 22 nt, Human
ggagacacccacauugcugggu

SEQ ID NO: 921173 - RNA, 22 nt, Human
ugccagcuuguggucagaggcu

SEQ ID NO: 921174 - RNA, 22 nt, Human
ugcuaaggacugggaggcaggg

SEQ ID NO: 921175 - RNA, 22 nt, Human
aaaagaaccuagcuccucaguc

SEQ ID NO: 921176 - RNA, 22 nt, Human
ugacccuuguuuaucauuucug

SEQ ID NO: 921177 - RNA, 22 nt, Human
ucagcaaguauuuucugaaugc

SEQ ID NO: 921178 - RNA, 18 nt, Human
cugaauuaucucaucauu

SEQ ID NO: 921179 - RNA, 22 nt, Human
uuuauuuauaagccacuugcug

SEQ ID NO: 921180 - RNA, 22 nt, Human
augggaggaagagaagaugucu

SEQ ID NO: 921181 - RNA, 22 nt, Human
aggaagcgugggucuggcugga

SEQ ID NO: 921182 - RNA, 21 nt, Human
aggaauguguauauauacaau

SEQ ID NO: 921183 - RNA, 22 nt, Human
guaaaaucuuuccuauuugccu

SEQ ID NO: 921184 - RNA, 22 nt, Human
aaguuuuauuggcuauagcacu

SEQ ID NO: 921185 - RNA, 22 nt, Human
ggcuacuagguaccauuuagaa

SEQ ID NO: 921186 - RNA, 22 nt, Human
uucuagaaacuggagcaaacag

SEQ ID NO: 921187 - RNA, 20 nt, Human
uugcaagcuuucaagauagc

SEQ ID NO: 921188 - RNA, 21 nt, Human
ugggcagauggcaguguggcu

SEQ ID NO: 921189 - RNA, 22 nt, Human
gccacagcccgagcaccaugag

SEQ ID NO: 921190 - RNA, 22 nt, Human
uaacagaaaggggacagaaaua

SEQ ID NO: 921191 - RNA, 22 nt, Human
gcugaguugaaagcagaggaua

SEQ ID NO: 921192 - RNA, 21 nt, Human
aggaggggucuuucccacuga

SEQ ID NO: 921193 - RNA, 22 nt, Human
uccccacugggccuccucuuuc

SEQ ID NO: 921194 - RNA, 22 nt, Human
ugggagagaauaaucaauaggu

SEQ ID NO: 921195 - RNA, 22 nt, Human
uguacaaucugaugauguaugg

SEQ ID NO: 921196 - RNA, 22 nt, Human
ugcauggagauauacuauuuga

SEQ ID NO: 921197 - RNA, 22 nt, Human
aucuuguucucccuuguucuua

SEQ ID NO: 921198 - RNA, 22 nt, Human
aaggugucggcagagccgcuuc

SEQ ID NO: 921199 - RNA, 21 nt, Human
uuuccugcccuuugucaucac

SEQ ID NO: 921200 - RNA, 22 nt, Human
gacacagaauuccccuccaagu

SEQ ID NO: 921201 - RNA, 22 nt, Human
ccuguggguacaacagggucac

SEQ ID NO: 921202 - RNA, 22 nt, Human
uucugcaggcuguacaagaagc

SEQ ID NO: 921203 - RNA, 22 nt, Human
uauuucaagaacuucuauccau

SEQ ID NO: 921204 - RNA, 22 nt, Human
cucucccucauuggguuccauu

SEQ ID NO: 921205 - RNA, 22 nt, Human
gaguggggucugggcaucaguc

SEQ ID NO: 921206 - RNA, 21 nt, Human
aagcagggacugcccaggucc

SEQ ID NO: 921207 - RNA, 22 nt, Human
ugucucugaggugagggucagc

SEQ ID NO: 921208 - RNA, 22 nt, Human
ugagccuggagucguggagggg

SEQ ID NO: 921209 - RNA, 22 nt, Human
ugcuucauuuccuuauauugua

SEQ ID NO: 921210 - RNA, 23 nt, Human
aagaaguuaccuaaaguuguacu

SEQ ID NO: 921211 - RNA, 22 nt, Human
gaaugucuauguaaccgagggg

SEQ ID NO: 921212 - RNA, 20 nt, Human
cuucuucauuaacccuacug

SEQ ID NO: 921213 - RNA, 22 nt, Human
aggcucugaguagagcugccag

SEQ ID NO: 921214 - RNA, 22 nt, Human
uggcagaaguucacuaguagcu

SEQ ID NO: 921215 - RNA, 22 nt, Human
gugugccaggaacuggcugcug

SEQ ID NO: 921216 - RNA, 22 nt, Human
augugucuuucaagguauagaa

SEQ ID NO: 921217 - RNA, 22 nt, Human
aaguacaccuuuggaguccacg

SEQ ID NO: 921218 - RNA, 22 nt, Human
uucuggagauugagaaggcauu

SEQ ID NO: 921219 - RNA, 22 nt, Human
gaaguguuuaagucuucuuugu

SEQ ID NO: 921220 - RNA, 23 nt, Human
uggcuggcagaaacugaagcaug

SEQ ID NO: 921221 - RNA, 22 nt, Human
agggggugcuacuuccagaguu

SEQ ID NO: 921222 - RNA, 22 nt, Human
ucugcagacuugccuaagugug

SEQ ID NO: 921223 - RNA, 22 nt, Human
gaagacagaaaccuguuuggcu

SEQ ID NO: 921224 - RNA, 22 nt, Human
ggcuccagcccuggcucuucac

SEQ ID NO: 921225 - RNA, 22 nt, Human
agccagcaggugcagaauucca

SEQ ID NO: 921226 - RNA, 22 nt, Human
ccagaggggcugagcaggucac

SEQ ID NO: 921227 - RNA, 22 nt, Human
uucauggcaggagucagaagcu

SEQ ID NO: 921228 - RNA, 22 nt, Human
gcugagcugggacaguccuggg

SEQ ID NO: 921229 - RNA, 22 nt, Human
agcgagcacauugagugaagaa

SEQ ID NO: 921230 - RNA, 22 nt, Human
cugugucuaaucaggucaguca

SEQ ID NO: 921231 - RNA, 22 nt, Human
gggcagcagaggaucccuuaau

SEQ ID NO: 921232 - RNA, 22 nt, Human
gacccuuucagacccuuuagua

SEQ ID NO: 921233 - RNA, 22 nt, Human
uaaaggcagccacugagcucaa

SEQ ID NO: 921234 - RNA, 22 nt, Human
aaugagaaccuugaaaggaacu

SEQ ID NO: 921235 - RNA, 22 nt, Human
ucugucaccauucagcuugaau

SEQ ID NO: 921236 - RNA, 22 nt, Human
agaggggcaaguaaagagucuu

SEQ ID NO: 921237 - RNA, 22 nt, Human
ucuuugaugugguuaauuauga

SEQ ID NO: 921238 - RNA, 17 nt, Human
uggccaggccccgccag

SEQ ID NO: 921239 - RNA, 22 nt, Human
aaagccugucuggucauagcua

SEQ ID NO: 921240 - RNA, 22 nt, Human
gucucuggguuaagcagugcau

SEQ ID NO: 921241 - RNA, 22 nt, Human
uugaaguugguguggaaaguag

SEQ ID NO: 921242 - RNA, 21 nt, Human
gggcagcacgucauuccugug

SEQ ID NO: 921243 - RNA, 22 nt, Human
cugagacauuaugacaagugga

SEQ ID NO: 921244 - RNA, 22 nt, Human
guaccaaaucuguauuaggaaa

SEQ ID NO: 921245 - RNA, 19 nt, Human
cuggcagccugucuguguc

SEQ ID NO: 921246 - RNA, 22 nt, Human
uggagcugucacucagaaccaa

SEQ ID NO: 921247 - RNA, 22 nt, Human
ccaggcccuugcaagucccacc

SEQ ID NO: 921248 - RNA, 22 nt, Human
ucacauuucucagcacugauga

SEQ ID NO: 921249 - RNA, 22 nt, Human
ucucagcucauggcagccuuga

SEQ ID NO: 921250 - RNA, 22 nt, Human
aucagugcugagagacuaucaa

SEQ ID NO: 921251 - RNA, 22 nt, Human
ccugcagggaaucgaggcagaa

SEQ ID NO: 921252 - RNA, 22 nt, Human
gugagcagcucaggguggucuc

SEQ ID NO: 921253 - RNA, 22 nt, Human
aaagccacugcauguguaguau

SEQ ID NO: 921254 - RNA, 22 nt, Human
aaggcugggaaacaugcaggcc

SEQ ID NO: 921255 - RNA, 23 nt, Human
agcuccugaggccagccucuccu

SEQ ID NO: 921256 - RNA, 22 nt, Human
agcagcaggcuagggaacugcu

SEQ ID NO: 921257 - RNA, 22 nt, Human
gcuuccagggcucagucacugc

SEQ ID NO: 921258 - RNA, 22 nt, Human
ucaccauacauaaauuacauug

SEQ ID NO: 921259 - RNA, 22 nt, Human
gauauucuaccugcugaccaag

SEQ ID NO: 921260 - RNA, 22 nt, Human
agggccagcagcuuggccaacc

SEQ ID NO: 921261 - RNA, 22 nt, Human
auuaaaguugaaauugaacuga

SEQ ID NO: 921262 - RNA, 21 nt, Human
gacucucuagugcuguccagu

SEQ ID NO: 921263 - RNA, 22 nt, Human
auauacacaucuuuuuaaauau

SEQ ID NO: 921264 - RNA, 22 nt, Human
cacaggcuccggccuugcagcc

SEQ ID NO: 921265 - RNA, 22 nt, Human
uaacaauucucaaaagagggga

SEQ ID NO: 921266 - RNA, 22 nt, Human
augcuuugauuugguuucucua

SEQ ID NO: 921267 - RNA, 22 nt, Human
aacccauguuggaagcuuauca

SEQ ID NO: 921268 - RNA, 20 nt, Human
agggugagacaugagccucc

SEQ ID NO: 921269 - RNA, 22 nt, Human
uuauuagaucuguuagggaucc

SEQ ID NO: 921270 - RNA, 22 nt, Human
agccagugucgugugacaugag

SEQ ID NO: 921271 - RNA, 22 nt, Human
uaaggagagaauuuagagguuu

SEQ ID NO: 921272 - RNA, 20 nt, Human
gcaauggcgugcuaguucug

SEQ ID NO: 921273 - RNA, 22 nt, Human
auggaugcuucuuucuaguuuu

SEQ ID NO: 921274 - RNA, 22 nt, Human
ugucauguggcaauuaaagcag

SEQ ID NO: 921275 - RNA, 22 nt, Human
uagcaggaauaugagguuaaua

SEQ ID NO: 921276 - RNA, 22 nt, Human
uuucaacagcucucaaaugauc

SEQ ID NO: 921277 - RNA, 22 nt, Human
uguguacacaaugauugcagag

SEQ ID NO: 921278 - RNA, 22 nt, Human
agagcaaagggacauggaagag

SEQ ID NO: 921279 - RNA, 22 nt, Human
ccuuuuauaaaguuguauugaa

SEQ ID NO: 921280 - RNA, 22 nt, Human
caaaaagcuuagguaacaagcc

SEQ ID NO: 921281 - RNA, 22 nt, Human
cagguagcuuuugauauuaggg

SEQ ID NO: 921282 - RNA, 21 nt, Human
uacacucauccucucccaagg

SEQ ID NO: 921283 - RNA, 22 nt, Human
agcaauuuucccuuagucuuug

SEQ ID NO: 921284 - RNA, 22 nt, Human
gcacaggaaaugacucauguua

SEQ ID NO: 921285 - RNA, 22 nt, Human
cagaguggugcaagggcagugu

SEQ ID NO: 921286 - RNA, 22 nt, Human
gggccccacuggggcugccugc

SEQ ID NO: 921287 - RNA, 22 nt, Human
ucaauuacagcacaguacucca

SEQ ID NO: 921288 - RNA, 22 nt, Human
ccugacaggagaagcgcagcau

SEQ ID NO: 921289 - RNA, 22 nt, Human
ccugagcacacaucagaaucac

SEQ ID NO: 921290 - RNA, 22 nt, Human
cugggagguggagguugcauug

SEQ ID NO: 921291 - RNA, 23 nt, Human
caguacaauguggaaaaggagug

SEQ ID NO: 921292 - RNA, 22 nt, Human
ccagagguggucauagaaagca

SEQ ID NO: 921293 - RNA, 22 nt, Human
ucaggcugcccguucagggcuc

SEQ ID NO: 921294 - RNA, 22 nt, Human
uacaggcauguagcauggugau

SEQ ID NO: 921295 - RNA, 21 nt, Human
cauacucaguguauaacuucu

SEQ ID NO: 921296 - RNA, 22 nt, Human
gucaucuucucucagcccaggc

SEQ ID NO: 921297 - RNA, 22 nt, Human
ugcaucagaguuugcugcugcu

SEQ ID NO: 921298 - RNA, 22 nt, Human
cacacagguaagccucuuucaa

SEQ ID NO: 921299 - RNA, 22 nt, Human
uccaggcugugcaugaguuuag

SEQ ID NO: 921300 - RNA, 22 nt, Human
ugccagccuggccugagucuuu

SEQ ID NO: 921301 - RNA, 22 nt, Human
cccugggcaccaggccugguaa

SEQ ID NO: 921302 - RNA, 22 nt, Human
ugagcaccuacuguauuccagg

SEQ ID NO: 921303 - RNA, 22 nt, Human
cuuugcagaagaaaccuacaaa

SEQ ID NO: 921304 - RNA, 22 nt, Human
ugaggcuuuauguaagggugca

SEQ ID NO: 921305 - RNA, 22 nt, Human
gugggcagaauugaaucuuuaa

SEQ ID NO: 921306 - RNA, 22 nt, Human
uccagugccucacugaggauuc

SEQ ID NO: 921307 - RNA, 22 nt, Human
gacagcugcucccguuucugcu

SEQ ID NO: 921308 - RNA, 17 nt, Human
ugcccugugccuggugu

SEQ ID NO: 921309 - RNA, 22 nt, Human
guuuccuauaacucaggcacca

SEQ ID NO: 921310 - RNA, 18 nt, Human
cugucaccgccaccacac

SEQ ID NO: 921311 - RNA, 22 nt, Human
auucucugugcagauuuaagac

SEQ ID NO: 921312 - RNA, 22 nt, Human
ugggucagaaucagagaguugc

SEQ ID NO: 921313 - RNA, 22 nt, Human
cagcaggguauacagggaauuu

SEQ ID NO: 921314 - RNA, 22 nt, Human
aauauuaucaaaagcuuuuuca

SEQ ID NO: 921315 - RNA, 22 nt, Human
agucacugguucuguaauuaau

SEQ ID NO: 921316 - RNA, 22 nt, Human
aguuacaaacacuaucaguucu

SEQ ID NO: 921317 - RNA, 22 nt, Human
agaaagacgugaugaagaagua

SEQ ID NO: 921318 - RNA, 22 nt, Human
auggcaguauuuguaucacaga

SEQ ID NO: 921319 - RNA, 18 nt, Human
uccccugcucuggugcuc

SEQ ID NO: 921320 - RNA, 22 nt, Human
uggcuggagucuggugcuagcc

SEQ ID NO: 921321 - RNA, 22 nt, Human
ugcagggcacggugcgcguggg

SEQ ID NO: 921322 - RNA, 20 nt, Human
uuggaagguggagaagagga

SEQ ID NO: 921323 - RNA, 22 nt, Human
uucuccagaguuucucucacug

SEQ ID NO: 921324 - RNA, 22 nt, Human
caagauuuaagagucagccuug

SEQ ID NO: 921325 - RNA, 22 nt, Human
aaccucaaacucuugggcuuaa

SEQ ID NO: 921326 - RNA, 19 nt, Human
ucccucagucugccaggcc

SEQ ID NO: 921327 - RNA, 22 nt, Human
guccugaggaugcagagauaaa

SEQ ID NO: 921328 - RNA, 22 nt, Human
acaaucacacaugcaauuauac

SEQ ID NO: 921329 - RNA, 21 nt, Human
uuacaaagcaagugcuguguc

SEQ ID NO: 921330 - RNA, 22 nt, Human
cacugcaguaacucuaggacug

SEQ ID NO: 921331 - RNA, 22 nt, Human
uuggaaggguuucaguuagucu

SEQ ID NO: 921332 - RNA, 22 nt, Human
aaaaaguuucaacugccaacuc

SEQ ID NO: 921333 - RNA, 22 nt, Human
auucagcagccauggcuucuga

SEQ ID NO: 921334 - RNA, 22 nt, Human
ucccacccccuccaaggaggaa

SEQ ID NO: 921335 - RNA, 22 nt, Human
cuugguaaaacugucuuaaauu

SEQ ID NO: 921336 - RNA, 22 nt, Human
guguccauucacugcaacacuu

SEQ ID NO: 921337 - RNA, 22 nt, Human
cagggccacuguagaugaggag

SEQ ID NO: 921338 - RNA, 22 nt, Human
caagugacuucuuugagcccgu

SEQ ID NO: 921339 - RNA, 22 nt, Human
acaggcagguaauuuacauauu

SEQ ID NO: 921340 - RNA, 22 nt, Human
uaugucuugaaaugagaagcca

SEQ ID NO: 921341 - RNA, 22 nt, Human
auuacagauagacuuugaagcu

SEQ ID NO: 921342 - RNA, 22 nt, Human
ugaggugguuuguaucacuggg

SEQ ID NO: 921343 - RNA, 22 nt, Human
ggacaggugcaaagggcacaug

SEQ ID NO: 921344 - RNA, 22 nt, Human
gauggaaugaauggcagauaca

SEQ ID NO: 921345 - RNA, 22 nt, Human
caggcucuuccauccugcugag

SEQ ID NO: 921346 - RNA, 22 nt, Human
uuugaaacucaugaucaucacu

SEQ ID NO: 921347 - RNA, 22 nt, Human
auagaaucaucugugcacuagu

SEQ ID NO: 921348 - RNA, 19 nt, Human
agacacacuugauaugugu

SEQ ID NO: 921349 - RNA, 22 nt, Human
agauuuaaauuugcuacaauuc

SEQ ID NO: 921350 - RNA, 22 nt, Human
aggagcugagggagcgcccuug

SEQ ID NO: 921351 - RNA, 22 nt, Human
cuuucuaauucucccauagucu

SEQ ID NO: 921352 - RNA, 22 nt, Human
uccugggaccgagggaagagcu

SEQ ID NO: 921353 - RNA, 22 nt, Human
ugcccagggauaagccuagaga

SEQ ID NO: 921354 - RNA, 18 nt, Human
gggcccuggcguccgccc

SEQ ID NO: 921355 - RNA, 21 nt, Human
cgcagcugagaaauauacaga

SEQ ID NO: 921356 - RNA, 22 nt, Human
uaaagcauaaugaauaucuaga

SEQ ID NO: 921357 - RNA, 22 nt, Human
cuggaaugauugaaaaggaaug

SEQ ID NO: 921358 - RNA, 22 nt, Human
guugcuucucuuaaguccagcu

SEQ ID NO: 921359 - RNA, 22 nt, Human
ccaggaagcugugagauuccaa

SEQ ID NO: 921360 - RNA, 22 nt, Human
gcacauccaaugauuguuuuga

SEQ ID NO: 921361 - RNA, 23 nt, Human
ggcucccuccuagcuuucccaau

SEQ ID NO: 921362 - RNA, 22 nt, Human
aaaaguaauugugguuuuggcc

SEQ ID NO: 921363 - RNA, 22 nt, Human
uugcaaagacuggcuuaacagu

SEQ ID NO: 921364 - RNA, 22 nt, Human
uacauucacaguuguucaucuc

SEQ ID NO: 921365 - RNA, 22 nt, Human
auauuaaaacuaugguuuucag

SEQ ID NO: 921366 - RNA, 22 nt, Human
guucacagcaaaccuaugaacu

SEQ ID NO: 921367 - RNA, 22 nt, Human
cuucuaugaggagagacaugca

SEQ ID NO: 921368 - RNA, 22 nt, Human
acaguaacaccuacucuguccc

SEQ ID NO: 921369 - RNA, 22 nt, Human
gagaacaggcucuggagucaga

SEQ ID NO: 921370 - RNA, 22 nt, Human
acaaugaacacacaaggaauuc

SEQ ID NO: 921371 - RNA, 22 nt, Human
auauuucuggggguguguuucu

SEQ ID NO: 921372 - RNA, 22 nt, Human
aaacaugcuggauuuagaauau

SEQ ID NO: 921373 - RNA, 22 nt, Human
ccuuggcauccucugaagaaau

SEQ ID NO: 921374 - RNA, 22 nt, Human
uucauuccugagcccauauuua

SEQ ID NO: 921375 - RNA, 22 nt, Human
aggcaggaaaaucgcuugaacc

SEQ ID NO: 921376 - RNA, 22 nt, Human
ccaggaggaaauucuaaaggua

SEQ ID NO: 921377 - RNA, 22 nt, Human
cugcccaccccgaggcaggaag

SEQ ID NO: 921378 - RNA, 22 nt, Human
uucuaugugcuggagaauauuu

SEQ ID NO: 921379 - RNA, 22 nt, Human
ggagauaguccaggugaaggga

SEQ ID NO: 921380 - RNA, 22 nt, Human
guauacuagauagacaguauca

SEQ ID NO: 921381 - RNA, 22 nt, Human
ccagcugggauuaagggaaaau

SEQ ID NO: 921382 - RNA, 22 nt, Human
uauucugugugauauguaaaug

SEQ ID NO: 921383 - RNA, 22 nt, Human
caggcagcucgaugccuuguug

SEQ ID NO: 921384 - RNA, 22 nt, Human
acagugaucaguuacugucugu

SEQ ID NO: 921385 - RNA, 22 nt, Human
aggcuccugauccuggggucug

SEQ ID NO: 921386 - RNA, 22 nt, Human
acauugaaagcauauuaucucc

SEQ ID NO: 921387 - RNA, 22 nt, Human
aucuuugaagaggacuugaagu

SEQ ID NO: 921388 - RNA, 22 nt, Human
aacaggcuggccuugaagcagu

SEQ ID NO: 921389 - RNA, 22 nt, Human
gagggccagcagccucagcaug

SEQ ID NO: 921390 - RNA, 22 nt, Human
aguggcuguuuauaggugggua

SEQ ID NO: 921391 - RNA, 22 nt, Human
gacagaggcaagaccagaagcc

SEQ ID NO: 921392 - RNA, 22 nt, Human
uucugggaggcuggcugucaua

SEQ ID NO: 921393 - RNA, 22 nt, Human
gggcacagcccagugggguccc

SEQ ID NO: 921394 - RNA, 22 nt, Human
agcugugguguuuucaagcccu

SEQ ID NO: 921395 - RNA, 22 nt, Human
caacauguguuagacaauagac

SEQ ID NO: 921396 - RNA, 22 nt, Human
uccuguccugaggcuccaggcc

SEQ ID NO: 921397 - RNA, 22 nt, Human
uccugggagacccagcugugga

SEQ ID NO: 921398 - RNA, 22 nt, Human
gaggagcugagccacguccugg

SEQ ID NO: 921399 - RNA, 22 nt, Human
augaggcagauguugcaugagg

SEQ ID NO: 921400 - RNA, 22 nt, Human
cagcaagacaguuuccuaagug

SEQ ID NO: 921401 - RNA, 22 nt, Human
gggggaaaguggagguucguga

SEQ ID NO: 921402 - RNA, 22 nt, Human
ucagaggugagcaugugaccaa

SEQ ID NO: 921403 - RNA, 22 nt, Human
ccuuccuggagcccaugcagau

SEQ ID NO: 921404 - RNA, 22 nt, Human
cucaggaggccauucucaaggu

SEQ ID NO: 921405 - RNA, 20 nt, Human
ugcuggggacauacagggug

SEQ ID NO: 921406 - RNA, 22 nt, Human
ucuucaugucuugccugauaua

SEQ ID NO: 921407 - RNA, 21 nt, Human
acagugagaaauaaauggaaa

SEQ ID NO: 921408 - RNA, 22 nt, Human
ugacagauuuuuucugagcuaa

SEQ ID NO: 921409 - RNA, 22 nt, Human
caaggcaguuccccagagggcu

SEQ ID NO: 921410 - RNA, 20 nt, Human
uguguguguacuucuaaaua

SEQ ID NO: 921411 - RNA, 22 nt, Human
uuggcuuucucuguaucugaau

SEQ ID NO: 921412 - RNA, 22 nt, Human
aggccagugguucucugugucc

SEQ ID NO: 921413 - RNA, 22 nt, Human
cugugcguaaguagccaaaaua

SEQ ID NO: 921414 - RNA, 22 nt, Human
auuccuaaaguaauacacuaga

SEQ ID NO: 921415 - RNA, 22 nt, Human
ccuguguccuaauccaucaggc

SEQ ID NO: 921416 - RNA, 22 nt, Human
auagaguacagucuuugauuau

SEQ ID NO: 921417 - RNA, 19 nt, Human
gccaggucuuggguccagg

SEQ ID NO: 921418 - RNA, 22 nt, Human
aaugguuuaguuaagacugagu

SEQ ID NO: 921419 - RNA, 22 nt, Human
ucagugucuucucuuuccuacc

SEQ ID NO: 921420 - RNA, 22 nt, Human
acuucagaguuaguuauagacc

SEQ ID NO: 921421 - RNA, 22 nt, Human
ucuauagacuuggacauauagu

SEQ ID NO: 921422 - RNA, 22 nt, Human
acugucacuacuauguguuugu

SEQ ID NO: 921423 - RNA, 22 nt, Human
guuuggauguguagugagggga

SEQ ID NO: 921424 - RNA, 22 nt, Human
auucaagauuaauucuauguca

SEQ ID NO: 921425 - RNA, 22 nt, Human
uucucauaggagcgcaaacccu

SEQ ID NO: 921426 - RNA, 22 nt, Human
ugccaaauauucucuacgugcu

SEQ ID NO: 921427 - RNA, 22 nt, Human
auacaguaauugcccugcaaug

SEQ ID NO: 921428 - RNA, 22 nt, Human
uagucaacuagugagcauaugg

SEQ ID NO: 921429 - RNA, 22 nt, Human
aauacaaucaaauucacuagca

SEQ ID NO: 921430 - RNA, 22 nt, Human
aagguuuauuaaauguugcaug

SEQ ID NO: 921431 - RNA, 22 nt, Human
uauaagaaauugccaaccuguu

SEQ ID NO: 921432 - RNA, 22 nt, Human
ugcuguagggagaaagaguuga

SEQ ID NO: 921433 - RNA, 22 nt, Human
cugcugugucagaguccagggg

SEQ ID NO: 921434 - RNA, 22 nt, Human
aaaugcagcagcuaauugaaaa

SEQ ID NO: 921435 - RNA, 22 nt, Human
guuuuguuuugagucaacucca

SEQ ID NO: 921436 - RNA, 22 nt, Human
aaaauaugaaguugucaguaug

SEQ ID NO: 921437 - RNA, 22 nt, Human
agacucugauucccucauguca

SEQ ID NO: 921438 - RNA, 22 nt, Human
ggagccuuacuagaaugugagc

SEQ ID NO: 921439 - RNA, 22 nt, Human
ccccaaaacuuagugacuuaaa

SEQ ID NO: 921440 - RNA, 22 nt, Human
cuaggaaucaccaagauucuag

SEQ ID NO: 921441 - RNA, 22 nt, Human
gaggcagcagggcugguuccuu

SEQ ID NO: 921442 - RNA, 22 nt, Human
uggaagacacuauuuaccaggu

SEQ ID NO: 921443 - RNA, 22 nt, Human
ccugagcugcggggcagugcuc

SEQ ID NO: 921444 - RNA, 22 nt, Human
aggcuggagugcuggagugcug

SEQ ID NO: 921445 - RNA, 22 nt, Human
cuacaaauccacaaggcacuuu

SEQ ID NO: 921446 - RNA, 21 nt, Human
caaauacuuagaaacuuaaga

SEQ ID NO: 921447 - RNA, 22 nt, Human
caggacaggaguggggucaaag

SEQ ID NO: 921448 - RNA, 22 nt, Human
uuugugcaagacaugcuaagag

SEQ ID NO: 921449 - RNA, 22 nt, Human
agagacuaagccagcauagugc

SEQ ID NO: 921450 - RNA, 22 nt, Human
aucuuucuaugguacuuucucc

SEQ ID NO: 921451 - RNA, 22 nt, Human
uaaaauagccagugccccucug

SEQ ID NO: 921452 - RNA, 22 nt, Human
uggugcugauaauggcaggauu

SEQ ID NO: 921453 - RNA, 22 nt, Human
uuucacugggcuugcagaaauc

SEQ ID NO: 921454 - RNA, 22 nt, Human
caggacccaaccucccugcucu

SEQ ID NO: 921455 - RNA, 22 nt, Human
auacaugugggucuaaacauau

SEQ ID NO: 921456 - RNA, 22 nt, Human
aagcuguuugcaguggauggag

SEQ ID NO: 921457 - RNA, 22 nt, Human
ugcuuuauucccuucugaugug

SEQ ID NO: 921458 - RNA, 22 nt, Human
uuguguccugauuugacacaau

SEQ ID NO: 921459 - RNA, 22 nt, Human
aggagaaguaaggcuagaugau

SEQ ID NO: 921460 - RNA, 22 nt, Human
cacagcagucuuucacuaaaua

SEQ ID NO: 921461 - RNA, 22 nt, Human
gggcuccaguuuggccaggaag

SEQ ID NO: 921462 - RNA, 22 nt, Human
uaugugcauuauuaccagugga

SEQ ID NO: 921463 - RNA, 22 nt, Human
uaaaggaggaguuaaugagacu

SEQ ID NO: 921464 - RNA, 22 nt, Human
uuccagagguucucagcccugu

SEQ ID NO: 921465 - RNA, 22 nt, Human
gcagcuggggaggucgugggga

SEQ ID NO: 921466 - RNA, 22 nt, Human
uccuuggcaugccgucuucucc

SEQ ID NO: 921467 - RNA, 22 nt, Human
ccugcugugaccggggagcagg

SEQ ID NO: 921468 - RNA, 22 nt, Human
uuaugcaugagauaaaaauugg

SEQ ID NO: 921469 - RNA, 22 nt, Human
acuguacaugcaucuugucuau

SEQ ID NO: 921470 - RNA, 22 nt, Human
uauuuguccagguaaauuucag

SEQ ID NO: 921471 - RNA, 22 nt, Human
ucuguguauuugugaccuguau

SEQ ID NO: 921472 - RNA, 23 nt, Human
aaguaacagggauaauagcaguu

SEQ ID NO: 921473 - RNA, 17 nt, Human
acagaggcaggagugga

SEQ ID NO: 921474 - RNA, 22 nt, Human
ugggcuagauauuuuugggcug

SEQ ID NO: 921475 - RNA, 22 nt, Human
acagcugcaaauuguuagagga

SEQ ID NO: 921476 - RNA, 22 nt, Human
uggaaugucagcuacaagaggg

SEQ ID NO: 921477 - RNA, 22 nt, Human
gucuggacaggacuauuucuaa

SEQ ID NO: 921478 - RNA, 23 nt, Human
auuuuacaggucaguuccuugaa

SEQ ID NO: 921479 - RNA, 22 nt, Human
aggcugggaagguaaaguugua

SEQ ID NO: 921480 - RNA, 22 nt, Human
ucaaaucaccaaacucacuggc

SEQ ID NO: 921481 - RNA, 22 nt, Human
uaauuucuggagggagaaagag

SEQ ID NO: 921482 - RNA, 19 nt, Human
gccaggaaagaaucaggcg

SEQ ID NO: 921483 - RNA, 22 nt, Human
aaaucacagggucucuaaguau

SEQ ID NO: 921484 - RNA, 22 nt, Human
acaggugggcuuaagagucggc

SEQ ID NO: 921485 - RNA, 18 nt, Human
agcucuggcauacuugaa

SEQ ID NO: 921486 - RNA, 22 nt, Human
uugcuauguggguugugcacuc

SEQ ID NO: 921487 - RNA, 21 nt, Human
auaaaguuuuacaggaaugca

SEQ ID NO: 921488 - RNA, 22 nt, Human
gauggcaccuugaacgcugcgu

SEQ ID NO: 921489 - RNA, 22 nt, Human
ucuuugcuccacacucuagaga

SEQ ID NO: 921490 - RNA, 22 nt, Human
aaaguacaugagauucaagggg

SEQ ID NO: 921491 - RNA, 23 nt, Human
gcucugaggaaguugggcacggg

SEQ ID NO: 921492 - RNA, 22 nt, Human
aacuagagcuuccagcuucuug

SEQ ID NO: 921493 - RNA, 22 nt, Human
caauuucaauacaaaauacauu

SEQ ID NO: 921494 - RNA, 22 nt, Human
aagaugcaugcugaagcuggcu

SEQ ID NO: 921495 - RNA, 21 nt, Human
aggcuuggaucuagacaggcc

SEQ ID NO: 921496 - RNA, 23 nt, Human
ucauaaauauuagcacaguagga

SEQ ID NO: 921497 - RNA, 22 nt, Human
ucagggucagauuccagagccu

SEQ ID NO: 921498 - RNA, 22 nt, Human
aggugcagcugguggagucugg

SEQ ID NO: 921499 - RNA, 22 nt, Human
gaauuauaaacuagugacuuca

SEQ ID NO: 921500 - RNA, 22 nt, Human
aaaguguacuaugucaugaaca

SEQ ID NO: 921501 - RNA, 17 nt, Human
ugcaaacaaucacauau

SEQ ID NO: 921502 - RNA, 22 nt, Human
ccuugguucugccuggccugga

SEQ ID NO: 921503 - RNA, 22 nt, Human
uuccuacauuuguacaauaaga

SEQ ID NO: 921504 - RNA, 22 nt, Human
auaaaaacugacccauccuuug

SEQ ID NO: 921505 - RNA, 22 nt, Human
cacagguacauccuuaucccca

SEQ ID NO: 921506 - RNA, 22 nt, Human
cagugccaugaugcagagcaau

SEQ ID NO: 921507 - RNA, 22 nt, Human
guguaaguaucuuuguaucuuu

SEQ ID NO: 921508 - RNA, 22 nt, Human
cuggacagaaaccaguccuggg

SEQ ID NO: 921509 - RNA, 22 nt, Human
aaaguucuucauuuuuauugga

SEQ ID NO: 921510 - RNA, 22 nt, Human
uaaaucacuccuaauaaucagu

SEQ ID NO: 921511 - RNA, 22 nt, Human
agcaaugaaaugaaaucagucu

SEQ ID NO: 921512 - RNA, 22 nt, Human
caggcucccugggcaguggcag

SEQ ID NO: 921513 - RNA, 22 nt, Human
cagaguccugcaccagcuccag

SEQ ID NO: 921514 - RNA, 22 nt, Human
aaacaacaauccaaugggagcu

SEQ ID NO: 921515 - RNA, 22 nt, Human
guuuccugaaauagaguacugg

SEQ ID NO: 921516 - RNA, 22 nt, Human
gcuuuaguuugucacuggcauu

SEQ ID NO: 921517 - RNA, 22 nt, Human
uauguacauaacaugaaaugca

SEQ ID NO: 921518 - RNA, 22 nt, Human
uacauugaguauuauuuagcca

SEQ ID NO: 921519 - RNA, 22 nt, Human
uugauuuguaggaauggagacc

SEQ ID NO: 921520 - RNA, 22 nt, Human
ccagggcucaggcucccagugg

SEQ ID NO: 921521 - RNA, 22 nt, Human
uuggacaguaaauugugcuuaa

SEQ ID NO: 921522 - RNA, 22 nt, Human
aacaaagucguugccuagaaga

SEQ ID NO: 921523 - RNA, 22 nt, Human
auccauuuguuuacugauggac

SEQ ID NO: 921524 - RNA, 20 nt, Human
caauaauuuacuucccuauu

SEQ ID NO: 921525 - RNA, 20 nt, Human
guuuuucucucuugccacua

SEQ ID NO: 921526 - RNA, 22 nt, Human
ucucagagauguuagggaagag

SEQ ID NO: 921527 - RNA, 22 nt, Human
aggcugaggcuggcagcuccag

SEQ ID NO: 921528 - RNA, 22 nt, Human
gugaagcacaugggcguugggu

SEQ ID NO: 921529 - RNA, 22 nt, Human
aggggcggccugccugaagcag

SEQ ID NO: 921530 - RNA, 22 nt, Human
acagggagccccagcauuucca

SEQ ID NO: 921531 - RNA, 22 nt, Human
uauaucuaaguguauguaagag

SEQ ID NO: 921532 - RNA, 22 nt, Human
cugggccacaucagaugaagac

SEQ ID NO: 921533 - RNA, 22 nt, Human
gacaagcucuuguuucaugguu

SEQ ID NO: 921534 - RNA, 22 nt, Human
acccaggagacggaggugcagu

SEQ ID NO: 921535 - RNA, 22 nt, Human
uuguauucuuccuuagcaguac

SEQ ID NO: 921536 - RNA, 22 nt, Human
auuuguaucuucuaauauuauc

SEQ ID NO: 921537 - RNA, 22 nt, Human
gcagucuauaaaucagcuuugc

SEQ ID NO: 921538 - RNA, 22 nt, Human
ugaauugagauaggaucagucu

SEQ ID NO: 921539 - RNA, 22 nt, Human
uaggcagcuuagguuagaagug

SEQ ID NO: 921540 - RNA, 22 nt, Human
acuuucucccacccacccgucu

SEQ ID NO: 921541 - RNA, 22 nt, Human
uguaagaugcugggauagauga

SEQ ID NO: 921542 - RNA, 22 nt, Human
gaaggcugucagagaggagggc

SEQ ID NO: 921543 - RNA, 22 nt, Human
aggguaggaacugaguggaagg

SEQ ID NO: 921544 - RNA, 22 nt, Human
aauuuuaaucaguggugcugag

SEQ ID NO: 921545 - RNA, 22 nt, Human
uuagaaagaguauaccagaaac

SEQ ID NO: 921546 - RNA, 22 nt, Human
ucugccagugccagaguacaua

SEQ ID NO: 921547 - RNA, 22 nt, Human
aaaagguaguugccaaauaagg

SEQ ID NO: 921548 - RNA, 22 nt, Human
ggaacugagaagcagcuaugcc

SEQ ID NO: 921549 - RNA, 22 nt, Human
ucagggagaggugagagccugu

SEQ ID NO: 921550 - RNA, 22 nt, Human
uacaaagcuuguacugugugac

SEQ ID NO: 921551 - RNA, 22 nt, Human
gaucuggaaucugaaggcugag

SEQ ID NO: 921552 - RNA, 22 nt, Human
auucuaagugcuuguggugguu

SEQ ID NO: 921553 - RNA, 22 nt, Human
ugcagacaagugcaucuaaccc

SEQ ID NO: 921554 - RNA, 22 nt, Human
aaauccuguccauuuaccagau

SEQ ID NO: 921555 - RNA, 22 nt, Human
cugacccuggaggcauuucucu

SEQ ID NO: 921556 - RNA, 22 nt, Human
aauagcauagaguuaaaaugca

SEQ ID NO: 921557 - RNA, 22 nt, Human
ucuugaggucaucaucugaaac

SEQ ID NO: 921558 - RNA, 23 nt, Human
uuugacagcgugguuucuguggg

SEQ ID NO: 921559 - RNA, 22 nt, Human
uucauacuguguuuccaaguuu

SEQ ID NO: 921560 - RNA, 22 nt, Human
aggcagcagccacaaggccuga

SEQ ID NO: 921561 - RNA, 22 nt, Human
uuaauuuaagaaacggcaggcc

SEQ ID NO: 921562 - RNA, 23 nt, Human
ugccagaggcagucacaguggug

SEQ ID NO: 921563 - RNA, 22 nt, Human
gggcccugcguccggaagucug

SEQ ID NO: 921564 - RNA, 22 nt, Human
ucugccagguggggagaggcca

SEQ ID NO: 921565 - RNA, 22 nt, Human
uauucugcuaagugauuucuac

SEQ ID NO: 921566 - RNA, 22 nt, Human
ucugucugccuugugagggcac

SEQ ID NO: 921567 - RNA, 22 nt, Human
cauucauucagcaacuguuauu

SEQ ID NO: 921568 - RNA, 22 nt, Human
guggguggaucaugaggucagg

SEQ ID NO: 921569 - RNA, 22 nt, Human
acugaucacauagauauauucc

SEQ ID NO: 921570 - RNA, 22 nt, Human
aagugggaauagaaaugaaggu

SEQ ID NO: 921571 - RNA, 22 nt, Human
ugcagugugaccuguagcgagc

SEQ ID NO: 921572 - RNA, 22 nt, Human
aggcgugguugaggcgagcaua

SEQ ID NO: 921573 - RNA, 22 nt, Human
guggagcaggacuagcugagaa

SEQ ID NO: 921574 - RNA, 22 nt, Human
auucauaucauagaguuauuga

SEQ ID NO: 921575 - RNA, 22 nt, Human
ugaggccuggacucugcaugga

SEQ ID NO: 921576 - RNA, 22 nt, Human
cauucauucacauuuugucuau

SEQ ID NO: 921577 - RNA, 22 nt, Human
cagcaucucuuuuugcauuccu

SEQ ID NO: 921578 - RNA, 22 nt, Human
ucagcucuguuuugaguggaac

SEQ ID NO: 921579 - RNA, 22 nt, Human
cccagccaaggugcugguguug

SEQ ID NO: 921580 - RNA, 22 nt, Human
auccugggcagugugucacucu

SEQ ID NO: 921581 - RNA, 22 nt, Human
cugggccucaugcacagagaug

SEQ ID NO: 921582 - RNA, 22 nt, Human
aauuuucacagugcugugagau

SEQ ID NO: 921583 - RNA, 22 nt, Human
agggggcuggagacaccuccuc

SEQ ID NO: 921584 - RNA, 22 nt, Human
gauuuucuugggaaacaaugag

SEQ ID NO: 921585 - RNA, 22 nt, Human
gagguauuugauccucugcagu

SEQ ID NO: 921586 - RNA, 20 nt, Human
uuucuauggggccagcacau

SEQ ID NO: 921587 - RNA, 23 nt, Human
ggcagccucugacucugcuuugc

SEQ ID NO: 921588 - RNA, 23 nt, Human
uuuuccagaaucgacucuguaga

SEQ ID NO: 921589 - RNA, 22 nt, Human
uuuggccucaugaauuucuugc

SEQ ID NO: 921590 - RNA, 22 nt, Human
ugcugccuuuguggggucacug

SEQ ID NO: 921591 - RNA, 22 nt, Human
ggcuuugggauucagcaugaga

SEQ ID NO: 921592 - RNA, 22 nt, Human
cuggcccauggugagcucuggg

SEQ ID NO: 921593 - RNA, 22 nt, Human
aaaguguuaacacuggcuacuu

SEQ ID NO: 921594 - RNA, 22 nt, Human
acaguagaguaaaagggagccu

SEQ ID NO: 921595 - RNA, 23 nt, Human
ggcugcucuuuucaugcuguuuc

SEQ ID NO: 921596 - RNA, 22 nt, Human
cugaggcucugggugucacugu

SEQ ID NO: 921597 - RNA, 22 nt, Human
gcagcagcucagccgggcacug

SEQ ID NO: 921598 - RNA, 22 nt, Human
gguuuccacauccauggaaugg

SEQ ID NO: 921599 - RNA, 22 nt, Human
ugggcagagucauacaggagac

SEQ ID NO: 921600 - RNA, 22 nt, Human
acugguaacaauggaagcuucu

SEQ ID NO: 921601 - RNA, 22 nt, Human
cagcacauuuacucagcccuca

SEQ ID NO: 921602 - RNA, 22 nt, Human
acacacagaguuuauacaggca

SEQ ID NO: 921603 - RNA, 22 nt, Human
cagggcucccucuggcucccag

SEQ ID NO: 921604 - RNA, 22 nt, Human
cuucauaaacucagaaggcagc

SEQ ID NO: 921605 - RNA, 22 nt, Human
acaauuacccuggcuugauaaa

SEQ ID NO: 921606 - RNA, 22 nt, Human
aaaugcugucaguguuauugga

SEQ ID NO: 921607 - RNA, 22 nt, Human
cauuuaagagaaauauuuaguu

SEQ ID NO: 921608 - RNA, 22 nt, Human
acucuuuuauaaagcaucuuga

SEQ ID NO: 921609 - RNA, 22 nt, Human
agacucugguccucuugaauuu

SEQ ID NO: 921610 - RNA, 22 nt, Human
ccacagugccuggaauucugca

SEQ ID NO: 921611 - RNA, 22 nt, Human
ugucacauugaauaugauuuau

SEQ ID NO: 921612 - RNA, 22 nt, Human
ugucacauguguggcauuuuuc

SEQ ID NO: 921613 - RNA, 22 nt, Human
caccagggcagcagccuagucu

SEQ ID NO: 921614 - RNA, 22 nt, Human
uggugagcucuuuagacuggga

SEQ ID NO: 921615 - RNA, 22 nt, Human
cacaugcaaguccucaguucua

SEQ ID NO: 921616 - RNA, 22 nt, Human
gcugcagcaagcccuccagggg

SEQ ID NO: 921617 - RNA, 22 nt, Human
uguggcaugguugcaaggacaa

SEQ ID NO: 921618 - RNA, 22 nt, Human
agaagggccagcuggacaccug

SEQ ID NO: 921619 - RNA, 22 nt, Human
uguucucuuuuccugcugagcc

SEQ ID NO: 921620 - RNA, 22 nt, Human
ucacaagauauuucaguccuuu

SEQ ID NO: 921621 - RNA, 22 nt, Human
ccuggcccuggaauagggcagg

SEQ ID NO: 921622 - RNA, 22 nt, Human
aagcugugugacuauuucugag

SEQ ID NO: 921623 - RNA, 22 nt, Human
ggcuuuauuaacucauccguaa

SEQ ID NO: 921624 - RNA, 22 nt, Human
gacacagaaugggugcucagua

SEQ ID NO: 921625 - RNA, 22 nt, Human
ugucauuuauucucuuauucua

SEQ ID NO: 921626 - RNA, 22 nt, Human
gccaggggacgcggagcgacga

SEQ ID NO: 921627 - RNA, 22 nt, Human
aacaucuccaaccuacauccac

SEQ ID NO: 921628 - RNA, 22 nt, Human
augaaguuccaguauaugcagu

SEQ ID NO: 921629 - RNA, 22 nt, Human
ugccugaguuuaacccucagag

SEQ ID NO: 921630 - RNA, 22 nt, Human
uggaauguauuaaguauugagu

SEQ ID NO: 921631 - RNA, 18 nt, Human
auuuaaugaacugaaagc

SEQ ID NO: 921632 - RNA, 22 nt, Human
ccagggaaacagcccaguguga

SEQ ID NO: 921633 - RNA, 22 nt, Human
caggagcucucaucgucagggc

SEQ ID NO: 921634 - RNA, 22 nt, Human
gccagguggucuggcuccagag

SEQ ID NO: 921635 - RNA, 22 nt, Human
cuuauguauaauguuccacaua

SEQ ID NO: 921636 - RNA, 22 nt, Human
aagccucuggggccucaucugu

SEQ ID NO: 921637 - RNA, 22 nt, Human
ugucugucuuuagugagauugc

SEQ ID NO: 921638 - RNA, 22 nt, Human
ugcagcuucuuguccugugauu

SEQ ID NO: 921639 - RNA, 22 nt, Human
uccuggcugucacucggguuga

SEQ ID NO: 921640 - RNA, 22 nt, Human
cuguccugcccacccugcaggg

SEQ ID NO: 921641 - RNA, 23 nt, Human
uuucucauccagagagucagucc

SEQ ID NO: 921642 - RNA, 19 nt, Human
ccacagagacuagaagaca

SEQ ID NO: 921643 - RNA, 22 nt, Human
caaaugcaggucagcagguguc

SEQ ID NO: 921644 - RNA, 22 nt, Human
ugucccagggaaggcccagcac

SEQ ID NO: 921645 - RNA, 22 nt, Human
cugggcugcaguuccugguccu

SEQ ID NO: 921646 - RNA, 22 nt, Human
acagggccauuggaggauuaua

SEQ ID NO: 921647 - RNA, 22 nt, Human
acaggaaagagcuaggcauagg

SEQ ID NO: 921648 - RNA, 22 nt, Human
cugucuccagggcaggugcagg

SEQ ID NO: 921649 - RNA, 22 nt, Human
aaguauuauuuaacaaauuugu

SEQ ID NO: 921650 - RNA, 22 nt, Human
cagaagaguagcugaacaaguu

SEQ ID NO: 921651 - RNA, 22 nt, Human
gugcagugacccuggagagcug

SEQ ID NO: 921652 - RNA, 22 nt, Human
uuccacagaugaaaauuaaguu

SEQ ID NO: 921653 - RNA, 22 nt, Human
augcgagugaugcagaguggcu

SEQ ID NO: 921654 - RNA, 19 nt, Human
aacagugaggcccagccug

SEQ ID NO: 921655 - RNA, 22 nt, Human
gagcugaaguuuccauuuguac

SEQ ID NO: 921656 - RNA, 22 nt, Human
cauccuucaaaggcuacaauua

SEQ ID NO: 921657 - RNA, 22 nt, Human
uccagggagauggcagaggcug

SEQ ID NO: 921658 - RNA, 17 nt, Human
gaacuuguucacuguga

SEQ ID NO: 921659 - RNA, 22 nt, Human
gcagugggccugaggaagggug

SEQ ID NO: 921660 - RNA, 22 nt, Human
uggacaguuacugagcuugagu

SEQ ID NO: 921661 - RNA, 22 nt, Human
gcacuggagaauggcuguauuc

SEQ ID NO: 921662 - RNA, 22 nt, Human
uucugugucuucuuguucugug

SEQ ID NO: 921663 - RNA, 22 nt, Human
gcugugcagaggugagaaucca

SEQ ID NO: 921664 - RNA, 18 nt, Human
acacaggcugacagcacc

SEQ ID NO: 921665 - RNA, 22 nt, Human
uggccagaagguuuaaaagagg

SEQ ID NO: 921666 - RNA, 22 nt, Human
cuuuaagacuaaauuagaguuu

SEQ ID NO: 921667 - RNA, 22 nt, Human
gccagccauaggccagcacugg

SEQ ID NO: 921668 - RNA, 22 nt, Human
ucuacaaauaaauuacuaugua

SEQ ID NO: 921669 - RNA, 22 nt, Human
uggcucaagugauccuccugcc

SEQ ID NO: 921670 - RNA, 22 nt, Human
ucucaggcucuuggaaccuguu

SEQ ID NO: 921671 - RNA, 22 nt, Human
cacaggaaaaauggguccuuua

SEQ ID NO: 921672 - RNA, 22 nt, Human
gaaggaagauucuguuggaauc

SEQ ID NO: 921673 - RNA, 22 nt, Human
ucucugaacuuccuggaaaggc

SEQ ID NO: 921674 - RNA, 22 nt, Human
gcucuccugugcagaugcugcu

SEQ ID NO: 921675 - RNA, 22 nt, Human
gcagugugacgcuguucuccgu

SEQ ID NO: 921676 - RNA, 22 nt, Human
caguuaaagcugcaugugucag

SEQ ID NO: 921677 - RNA, 22 nt, Human
acaggcugccuaccaaguauca

SEQ ID NO: 921678 - RNA, 22 nt, Human
uaacaacugaggaagaggcaga

SEQ ID NO: 921679 - RNA, 22 nt, Human
acccuggcucucuggccaccgc

SEQ ID NO: 921680 - RNA, 22 nt, Human
cucccucucaccggagcccugg

SEQ ID NO: 921681 - RNA, 22 nt, Human
cagauuuauuuuacauccuuca

SEQ ID NO: 921682 - RNA, 16 nt, Human
cacauauauuuauaug

SEQ ID NO: 921683 - RNA, 22 nt, Human
cuuuuuauagcuauguccuaug

SEQ ID NO: 921684 - RNA, 22 nt, Human
gaaagauauuuauuggcaacag

SEQ ID NO: 921685 - RNA, 22 nt, Human
acaggcagagucagguuggguu

SEQ ID NO: 921686 - RNA, 22 nt, Human
aacuguaaugaauuguucauga

SEQ ID NO: 921687 - RNA, 22 nt, Human
auuucaugugaagaagagauaa

SEQ ID NO: 921688 - RNA, 22 nt, Human
auugaacagcccagguuuaccu

SEQ ID NO: 921689 - RNA, 22 nt, Human
acaagagagacacuaggaaugu

SEQ ID NO: 921690 - RNA, 22 nt, Human
uacaguuucuguccuuguggag

SEQ ID NO: 921691 - RNA, 22 nt, Human
ccagcagaagcucccgcugggu

SEQ ID NO: 921692 - RNA, 22 nt, Human
gugccuggcagggucagcugcu

SEQ ID NO: 921693 - RNA, 22 nt, Human
uggaauguugggauuuaagugu

SEQ ID NO: 921694 - RNA, 17 nt, Human
uuaaaccauaaagaagg

SEQ ID NO: 921695 - RNA, 19 nt, Human
ugcuagaaauucugugacu

SEQ ID NO: 921696 - RNA, 22 nt, Human
aaggaauucccuuucugacaga

SEQ ID NO: 921697 - RNA, 22 nt, Human
acaugaaaacugguuccuucag

SEQ ID NO: 921698 - RNA, 22 nt, Human
aagccaggguuuguggaucuau

SEQ ID NO: 921699 - RNA, 22 nt, Human
gugugaaaguuccuaagacuau

SEQ ID NO: 921700 - RNA, 22 nt, Human
auguucccaagggauagaaaga

SEQ ID NO: 921701 - RNA, 22 nt, Human
acugaggcagaaggguaagugg

SEQ ID NO: 921702 - RNA, 22 nt, Human
uacccacagccucucuucaaaa

SEQ ID NO: 921703 - RNA, 22 nt, Human
ccagccagccuugaucugagua

SEQ ID NO: 921704 - RNA, 22 nt, Human
gaugagaaauggacaggagugg

SEQ ID NO: 921705 - RNA, 22 nt, Human
cucaggaaggaagcagggagcc

SEQ ID NO: 921706 - RNA, 22 nt, Human
gcuuaaauuguuuguggauagu

SEQ ID NO: 921707 - RNA, 22 nt, Human
aagagcaaguggguagugaagc

SEQ ID NO: 921708 - RNA, 22 nt, Human
uuacacagugcacaagcagagu

SEQ ID NO: 921709 - RNA, 22 nt, Human
aaaacucugcaguuaguuucua

SEQ ID NO: 921710 - RNA, 22 nt, Human
uucagaggcuguaugacuagau

SEQ ID NO: 921711 - RNA, 22 nt, Human
gugggcaguggggucuucugcc

SEQ ID NO: 921712 - RNA, 22 nt, Human
uugcugugucugauggcugaga

SEQ ID NO: 921713 - RNA, 22 nt, Human
cugggccuucauugcucuccca

SEQ ID NO: 921714 - RNA, 22 nt, Human
agaaaucaugucuuauuucuau

SEQ ID NO: 921715 - RNA, 22 nt, Human
auucuuguuuaauuugcauccc

SEQ ID NO: 921716 - RNA, 22 nt, Human
uuacaacauaugauaggagucu

SEQ ID NO: 921717 - RNA, 22 nt, Human
aaacagcuccuuaguuuccauc

SEQ ID NO: 921718 - RNA, 22 nt, Human
ggaagagaaaugagucaagacu

SEQ ID NO: 921719 - RNA, 22 nt, Human
aguggcugaagcaucaaaggca

SEQ ID NO: 921720 - RNA, 22 nt, Human
uauguucaucuggugcaucagu

SEQ ID NO: 921721 - RNA, 22 nt, Human
gcagauggagauaaauggaacu

SEQ ID NO: 921722 - RNA, 23 nt, Human
cauggggagcagugcuccugacc

SEQ ID NO: 921723 - RNA, 19 nt, Human
uucuuuccacaucuucucu

SEQ ID NO: 921724 - RNA, 22 nt, Human
aacaaaugauuguugguuggag

SEQ ID NO: 921725 - RNA, 22 nt, Human
gcccagggcgauggucggggcc

SEQ ID NO: 921726 - RNA, 22 nt, Human
gucaauaauugauagauauugg

SEQ ID NO: 921727 - RNA, 22 nt, Human
agugaaaucagguuuugacugc

SEQ ID NO: 921728 - RNA, 22 nt, Human
cccaggcugggaacgauucuag

SEQ ID NO: 921729 - RNA, 22 nt, Human
gugccagcaguuauggugauuu

SEQ ID NO: 921730 - RNA, 22 nt, Human
uggggccuggucagagcugcac

SEQ ID NO: 921731 - RNA, 22 nt, Human
cccaggaggaggaaaaagcucg

SEQ ID NO: 921732 - RNA, 23 nt, Human
uguaacaauucccagccuuugcc

SEQ ID NO: 921733 - RNA, 22 nt, Human
augauguacuaguuaaauauua

SEQ ID NO: 921734 - RNA, 22 nt, Human
ugcguggcgcagcgugugggau

SEQ ID NO: 921735 - RNA, 22 nt, Human
uuauuuugguaaauguuugccu

SEQ ID NO: 921736 - RNA, 22 nt, Human
uauccacguaugauaaaacucu

SEQ ID NO: 921737 - RNA, 22 nt, Human
acacuuugggcuggauaauuau

SEQ ID NO: 921738 - RNA, 22 nt, Human
ccaaggcuccucagcuggucuu

SEQ ID NO: 921739 - RNA, 22 nt, Human
gauuugacaccuggggcauaua

SEQ ID NO: 921740 - RNA, 22 nt, Human
aggcuugaaaugaaaucuguaa

SEQ ID NO: 921741 - RNA, 19 nt, Human
agggcuaggcacauagggc

SEQ ID NO: 921742 - RNA, 22 nt, Human
uauuuuguaauuggucauagcu

SEQ ID NO: 921743 - RNA, 22 nt, Human
ggucaucuguauguccucagcu

SEQ ID NO: 921744 - RNA, 19 nt, Human
uccaaggcauggcccagug

SEQ ID NO: 921745 - RNA, 18 nt, Human
cgggcgggcgccuggccc

SEQ ID NO: 921746 - RNA, 22 nt, Human
agacccuggagaaugaaagugc

SEQ ID NO: 921747 - RNA, 23 nt, Human
uguaucuguacuauuccugccuc

SEQ ID NO: 921748 - RNA, 21 nt, Human
augcauggauuucagugagag

SEQ ID NO: 921749 - RNA, 22 nt, Human
uaguuuacuguucacuuugccc

SEQ ID NO: 921750 - RNA, 22 nt, Human
cugucuuuucauacuuucccuc

SEQ ID NO: 921751 - RNA, 22 nt, Human
gagccuggauugaagugggugg

SEQ ID NO: 921752 - RNA, 22 nt, Human
gcugcccauuccacuggauggu

SEQ ID NO: 921753 - RNA, 22 nt, Human
aaauacacguacauguguaaaa

SEQ ID NO: 921754 - RNA, 22 nt, Human
aauguuaaaaccuucagugcuu

SEQ ID NO: 921755 - RNA, 22 nt, Human
cagcugcccaggccaccuggag

SEQ ID NO: 921756 - RNA, 22 nt, Human
ucauaaguaauuuaaacauucc

SEQ ID NO: 921757 - RNA, 22 nt, Human
aagcugucaauguaucuagucu

SEQ ID NO: 921758 - RNA, 22 nt, Human
aaaugcuacacaggaauucuca

SEQ ID NO: 921759 - RNA, 22 nt, Human
aaacaagagucuugcuccaccu

SEQ ID NO: 921760 - RNA, 22 nt, Human
ucuggaauucucaaguccugga

SEQ ID NO: 921761 - RNA, 22 nt, Human
gcagcuuuaaacauuggaaaua

SEQ ID NO: 921762 - RNA, 22 nt, Human
aacaguacaacuccacaagacu

SEQ ID NO: 921763 - RNA, 19 nt, Human
gugggccaggcagaaggcu

SEQ ID NO: 921764 - RNA, 19 nt, Human
aaaaggaauauucuuuggg

SEQ ID NO: 921765 - RNA, 22 nt, Human
agugcuggauuacaggcgugag

SEQ ID NO: 921766 - RNA, 22 nt, Human
cgagugucccuaccauuuccua

SEQ ID NO: 921767 - RNA, 18 nt, Human
gagcccugggagaucucu

SEQ ID NO: 921768 - RNA, 22 nt, Human
uguguugugacauucuuggaug

SEQ ID NO: 921769 - RNA, 22 nt, Human
ucaauagcaaucaagccuucca

SEQ ID NO: 921770 - RNA, 22 nt, Human
ugcuggcuaauggaaaccagau

SEQ ID NO: 921771 - RNA, 22 nt, Human
uuuacacauaccucuuuaaagu

SEQ ID NO: 921772 - RNA, 22 nt, Human
cagaagccugccucagaugcac

SEQ ID NO: 921773 - RNA, 22 nt, Human
gccugcuggacauuggccggcc

SEQ ID NO: 921774 - RNA, 22 nt, Human
aagagugacuuuucagcuguga

SEQ ID NO: 921775 - RNA, 22 nt, Human
auggaauaggcugcucuuuaaa

SEQ ID NO: 921776 - RNA, 22 nt, Human
ucugaggccuugggacagaagu

SEQ ID NO: 921777 - RNA, 22 nt, Human
ggaggugguggcagugacaauu

SEQ ID NO: 921778 - RNA, 22 nt, Human
guggucccuucuggcccugguc

SEQ ID NO: 921779 - RNA, 22 nt, Human
cuggggggcuacugacagagga

SEQ ID NO: 921780 - RNA, 23 nt, Human
uucuaagguaugguuuauaccug

SEQ ID NO: 921781 - RNA, 22 nt, Human
caaaauucugcauuucuaauaa

SEQ ID NO: 921782 - RNA, 22 nt, Human
gcugggcagccuggccgcugcc

SEQ ID NO: 921783 - RNA, 22 nt, Human
agcucagaaaugccaguaggua

SEQ ID NO: 921784 - RNA, 19 nt, Human
cugauguuccagagaagcu

SEQ ID NO: 921785 - RNA, 22 nt, Human
gcagcugcgcugguguggggca

SEQ ID NO: 921786 - RNA, 22 nt, Human
uuuucauaguaauggugcaugu

SEQ ID NO: 921787 - RNA, 22 nt, Human
cuggaagggucuacuuagcaga

SEQ ID NO: 921788 - RNA, 22 nt, Human
aggcaguucucguguguguccc

SEQ ID NO: 921789 - RNA, 22 nt, Human
uuuccucuccaccaggaggucu

SEQ ID NO: 921790 - RNA, 22 nt, Human
gcaguguguagaguuuaggaaa

SEQ ID NO: 921791 - RNA, 22 nt, Human
caugaagcccucaucagucuga

SEQ ID NO: 921792 - RNA, 22 nt, Human
ccacugagaagggguugggguc

SEQ ID NO: 921793 - RNA, 22 nt, Human
gugcugugucuaucaggaauaa

SEQ ID NO: 921794 - RNA, 22 nt, Human
cuucagaagaaaagcagugugu

SEQ ID NO: 921795 - RNA, 22 nt, Human
uuucugaacuugguacuggagc

SEQ ID NO: 921796 - RNA, 22 nt, Human
gcacuuccaucugucaccaggu

SEQ ID NO: 921797 - RNA, 22 nt, Human
gacagugucccucuggggugga

SEQ ID NO: 921798 - RNA, 19 nt, Human
aaaagucuauucaauuaca

SEQ ID NO: 921799 - RNA, 21 nt, Human
agggccagaucaccaaggagc

SEQ ID NO: 921800 - RNA, 22 nt, Human
ccucagagacugcaucuucccu

SEQ ID NO: 921801 - RNA, 22 nt, Human
uguauauguuuguauguacaca

SEQ ID NO: 921802 - RNA, 22 nt, Human
aguuauaugugaaaacacguau

SEQ ID NO: 921803 - RNA, 22 nt, Human
cccuggaacuccuaggcaagca

SEQ ID NO: 921804 - RNA, 22 nt, Human
ugagacaauaaggcugagaagc

SEQ ID NO: 921805 - RNA, 22 nt, Human
ccuuggcaggcacguccugcgg

SEQ ID NO: 921806 - RNA, 21 nt, Human
guuuuucagcccugaggugag

SEQ ID NO: 921807 - RNA, 22 nt, Human
uucucaagaacauauguagggu

SEQ ID NO: 921808 - RNA, 22 nt, Human
ccugagugcuuccagagucaug

SEQ ID NO: 921809 - RNA, 22 nt, Human
cagagcugcucaugguggccag

SEQ ID NO: 921810 - RNA, 22 nt, Human
cugcagaaauauggaugugaua

SEQ ID NO: 921811 - RNA, 22 nt, Human
ggucccaggaagugcggcggcg

SEQ ID NO: 921812 - RNA, 22 nt, Human
aguuuaaaucauguuuuguaac

SEQ ID NO: 921813 - RNA, 22 nt, Human
uuccuucuuuuacaccauaaau

SEQ ID NO: 921814 - RNA, 18 nt, Human
gagggaguagcugagguu

SEQ ID NO: 921815 - RNA, 22 nt, Human
gcucuguuuaucccugacaauu

SEQ ID NO: 921816 - RNA, 19 nt, Human
agcuccugauugugccucg

SEQ ID NO: 921817 - RNA, 22 nt, Human
uggcagagaaccugggcuuugu

SEQ ID NO: 921818 - RNA, 20 nt, Human
cuaaacucugcagauuuagu

SEQ ID NO: 921819 - RNA, 22 nt, Human
auucaguguggacccauuuaaa

SEQ ID NO: 921820 - RNA, 19 nt, Human
gcugcagcagagaaacugg

SEQ ID NO: 921821 - RNA, 22 nt, Human
ccagggcucugcuucugccaug

SEQ ID NO: 921822 - RNA, 22 nt, Human
agaguccacccuggggucaggc

SEQ ID NO: 921823 - RNA, 22 nt, Human
gucuaaagcccuuagaauagua

SEQ ID NO: 921824 - RNA, 22 nt, Human
agcugcccugggucuugcugcu

SEQ ID NO: 921825 - RNA, 22 nt, Human
aaaguuggauuucauccucaug

SEQ ID NO: 921826 - RNA, 22 nt, Human
ggaagcugcuuagcuaauguag

SEQ ID NO: 921827 - RNA, 22 nt, Human
caacauauaauauuugaguucu

SEQ ID NO: 921828 - RNA, 22 nt, Human
cuugcuuuccaaaugacucacu

SEQ ID NO: 921829 - RNA, 19 nt, Human
auagaguagaguaucuguu

SEQ ID NO: 921830 - RNA, 22 nt, Human
auuguacauaaaauguaugucu

SEQ ID NO: 921831 - RNA, 22 nt, Human
agcagggcuggauuuggcaaga

SEQ ID NO: 921832 - RNA, 22 nt, Human
auauuugucaauucacuguuca

SEQ ID NO: 921833 - RNA, 22 nt, Human
ugucuuauuuugaaguguucac

SEQ ID NO: 921834 - RNA, 22 nt, Human
ugcggaaggcagcgcagggugg

SEQ ID NO: 921835 - RNA, 22 nt, Human
uagaaagaucuguaggcaagag

SEQ ID NO: 921836 - RNA, 22 nt, Human
uacacaguaaaugguaaauaca

SEQ ID NO: 921837 - RNA, 22 nt, Human
ggcagugacuguucagacgucc

SEQ ID NO: 921838 - RNA, 22 nt, Human
augucaaagcagacugagagcg

SEQ ID NO: 921839 - RNA, 22 nt, Human
gcucagcuacuuacagguggcu

SEQ ID NO: 921840 - RNA, 22 nt, Human
augccuuuaagagauacugagg

SEQ ID NO: 921841 - RNA, 22 nt, Human
uggaggaaguugcuggaaguca

SEQ ID NO: 921842 - RNA, 22 nt, Human
ccaggcugugcuuuucauaaau

SEQ ID NO: 921843 - RNA, 22 nt, Human
cagaggcugcucuggguggcau

SEQ ID NO: 921844 - RNA, 22 nt, Human
caguugcagaggcagagugcua

SEQ ID NO: 921845 - RNA, 17 nt, Human
caagagagaugacugga

SEQ ID NO: 921846 - RNA, 22 nt, Human
uuauuuacaacucuucucuucc

SEQ ID NO: 921847 - RNA, 19 nt, Human
ccuggcugugaagccugca

SEQ ID NO: 921848 - RNA, 22 nt, Human
uuggaagauucugugucuggug

SEQ ID NO: 921849 - RNA, 20 nt, Human
ugcguguguauuuauuuucu

SEQ ID NO: 921850 - RNA, 22 nt, Human
accugccuaucagcugccugcu

SEQ ID NO: 921851 - RNA, 22 nt, Human
gagaagaacuugggcaaaguca

SEQ ID NO: 921852 - RNA, 22 nt, Human
uggagaauucuauguugagggg

SEQ ID NO: 921853 - RNA, 22 nt, Human
gugaggagcugacacuggggug

SEQ ID NO: 921854 - RNA, 22 nt, Human
auuucucacucacaguccaugu

SEQ ID NO: 921855 - RNA, 22 nt, Human
aucucaacuaagccuaacuuuu

SEQ ID NO: 921856 - RNA, 22 nt, Human
cugggucuggccacaggaagua

SEQ ID NO: 921857 - RNA, 22 nt, Human
uucauugaguauagggguauac

SEQ ID NO: 921858 - RNA, 22 nt, Human
gcaaggcagcgcggaguagcua

SEQ ID NO: 921859 - RNA, 22 nt, Human
ccucuggcagccagccaguugu

SEQ ID NO: 921860 - RNA, 22 nt, Human
gggcuccaccuagggacacugg

SEQ ID NO: 921861 - RNA, 22 nt, Human
gugcucuaauaaagccugacau

SEQ ID NO: 921862 - RNA, 22 nt, Human
uggcugaguucuccaggaguag

SEQ ID NO: 921863 - RNA, 22 nt, Human
auuucaugagcuaauggaucuc

SEQ ID NO: 921864 - RNA, 22 nt, Human
ucuggauggucagcucuuccug

SEQ ID NO: 921865 - RNA, 22 nt, Human
gagcacaggcugcugugaacug

SEQ ID NO: 921866 - RNA, 22 nt, Human
gaccccaagggaugcgugugcu

SEQ ID NO: 921867 - RNA, 22 nt, Human
uuaaauguuuaaucuaacuuga

SEQ ID NO: 921868 - RNA, 20 nt, Human
uggcccaguggggcagggug

SEQ ID NO: 921869 - RNA, 22 nt, Human
agcugcucuucauuucccccca

SEQ ID NO: 921870 - RNA, 22 nt, Human
gugucuggaacgggugguacuc

SEQ ID NO: 921871 - RNA, 22 nt, Human
augacaugaggcaucuuuggag

SEQ ID NO: 921872 - RNA, 21 nt, Human
gcucaggcucuugacagagca

SEQ ID NO: 921873 - RNA, 22 nt, Human
uuguacaaguuuugagcuuaag

SEQ ID NO: 921874 - RNA, 22 nt, Human
cccaggcucccaggugggacaa

SEQ ID NO: 921875 - RNA, 22 nt, Human
uuaaaguauagaggacaaaaac

SEQ ID NO: 921876 - RNA, 22 nt, Human
acccugggcacaccauuucccc

SEQ ID NO: 921877 - RNA, 22 nt, Human
ucgcugaggcugcacggcugcc

SEQ ID NO: 921878 - RNA, 17 nt, Human
acacagggagagggagc

SEQ ID NO: 921879 - RNA, 22 nt, Human
cagcgucucguugugggccucg

SEQ ID NO: 921880 - RNA, 22 nt, Human
auaauuuaauuuucacaguggu

SEQ ID NO: 921881 - RNA, 22 nt, Human
auguuuuuggaaaugggaacau

SEQ ID NO: 921882 - RNA, 22 nt, Human
uauuaaauauaucuguuaguug

SEQ ID NO: 921883 - RNA, 20 nt, Human
agcuggccaauucuauuacu

SEQ ID NO: 921884 - RNA, 22 nt, Human
ucagaaucuaaauaggcuccag

SEQ ID NO: 921885 - RNA, 22 nt, Human
agagacauggagaggcaaaguu

SEQ ID NO: 921886 - RNA, 22 nt, Human
cccugccuacaggguuuucuuu

SEQ ID NO: 921887 - RNA, 22 nt, Human
augcuuguacuaaaaaaauauu

SEQ ID NO: 921888 - RNA, 18 nt, Human
cugaggcuggcaggagcc

SEQ ID NO: 921889 - RNA, 22 nt, Human
auugucuaauugacuuggugug

SEQ ID NO: 921890 - RNA, 22 nt, Human
ugagaacggauacuaagggcug

SEQ ID NO: 921891 - RNA, 22 nt, Human
ugagaccuguagcuucacagag

SEQ ID NO: 921892 - RNA, 22 nt, Human
ucaucuguggcugcuuuugugc

SEQ ID NO: 921893 - RNA, 22 nt, Human
uaaagugcugggauuauaggcc

SEQ ID NO: 921894 - RNA, 22 nt, Human
cauuaucucuucuauaugcuag

SEQ ID NO: 921895 - RNA, 23 nt, Human
uucaugaguuggacaagacuggg

SEQ ID NO: 921896 - RNA, 22 nt, Human
ggacaggggcguggggauuguu

SEQ ID NO: 921897 - RNA, 22 nt, Human
cugcuggagggagcugauagug

SEQ ID NO: 921898 - RNA, 22 nt, Human
cucaaaaugguuaauuuuaaua

SEQ ID NO: 921899 - RNA, 22 nt, Human
uagggcugccauuugcuuuucu

SEQ ID NO: 921900 - RNA, 22 nt, Human
ugcuugcauccaacauuaaggg

SEQ ID NO: 921901 - RNA, 22 nt, Human
gcugcugucagugguggcaguu

SEQ ID NO: 921902 - RNA, 22 nt, Human
augacaaauucagaccauagca

SEQ ID NO: 921903 - RNA, 22 nt, Human
uuccuugggagaaaaaauauau

SEQ ID NO: 921904 - RNA, 22 nt, Human
agaaaauaaauugaugguggaa

SEQ ID NO: 921905 - RNA, 21 nt, Human
aggaaaggccagcacguaggg

SEQ ID NO: 921906 - RNA, 22 nt, Human
ccaggagcauuaagagaacaua

SEQ ID NO: 921907 - RNA, 22 nt, Human
uagaaaugcaguguacuguguc

SEQ ID NO: 921908 - RNA, 22 nt, Human
agcaggugagcacagccaggcu

SEQ ID NO: 921909 - RNA, 22 nt, Human
aaagccuucugucuagcagaua

SEQ ID NO: 921910 - RNA, 22 nt, Human
auuucagcagcccauguuugga

SEQ ID NO: 921911 - RNA, 22 nt, Human
acaguguuuucuuaaggagaaa

SEQ ID NO: 921912 - RNA, 22 nt, Human
gcccaggaagccaccgggaagu

SEQ ID NO: 921913 - RNA, 22 nt, Human
gcauuuuucaucccucuugggu

SEQ ID NO: 921914 - RNA, 22 nt, Human
aaaguuuuagcuguccaguucc

SEQ ID NO: 921915 - RNA, 22 nt, Human
uuuccuccuagccuccagccgc

SEQ ID NO: 921916 - RNA, 22 nt, Human
ccacauuucuucacuuguccca

SEQ ID NO: 921917 - RNA, 22 nt, Human
gagaagcaauuuccaacugugc

SEQ ID NO: 921918 - RNA, 22 nt, Human
caugcuguugaauaugacauug

SEQ ID NO: 921919 - RNA, 22 nt, Human
agaaccucaauuauuuuugcac

SEQ ID NO: 921920 - RNA, 22 nt, Human
ucacaggguaucugggauggau

SEQ ID NO: 921921 - RNA, 22 nt, Human
cuggcuggaaguuagagaacuu

SEQ ID NO: 921922 - RNA, 22 nt, Human
uccauuaaugauuauuucugug

SEQ ID NO: 921923 - RNA, 22 nt, Human
uacaguacacagguaccaagcu

SEQ ID NO: 921924 - RNA, 17 nt, Human
acauggcaguucacgcu

SEQ ID NO: 921925 - RNA, 22 nt, Human
ggaagguuuuucuccugguggg

SEQ ID NO: 921926 - RNA, 20 nt, Human
cugaaagacguaacagugca

SEQ ID NO: 921927 - RNA, 22 nt, Human
cagaggcacaagaaagcaaggc

SEQ ID NO: 921928 - RNA, 22 nt, Human
agacacagcugcaggagguggg

SEQ ID NO: 921929 - RNA, 22 nt, Human
uggcagugucuugcuggggcag

SEQ ID NO: 921930 - RNA, 22 nt, Human
acaugaaugcagccauaacacu

SEQ ID NO: 921931 - RNA, 22 nt, Human
acagagucaugguagucaaagg

SEQ ID NO: 921932 - RNA, 22 nt, Human
gggaguggguuuggccuaggcc

SEQ ID NO: 921933 - RNA, 22 nt, Human
uuccuuacauucauauggcuuc

SEQ ID NO: 921934 - RNA, 22 nt, Human
ucuucaaaaaauauccaucagu

SEQ ID NO: 921935 - RNA, 22 nt, Human
uuguucaucguccuugcucugu

SEQ ID NO: 921936 - RNA, 18 nt, Human
cuaagaggucguuucuca

SEQ ID NO: 921937 - RNA, 22 nt, Human
gagcuuggaagcagauccucac

SEQ ID NO: 921938 - RNA, 22 nt, Human
guauauaugugugaacauguau

SEQ ID NO: 921939 - RNA, 20 nt, Human
gccugagcuauugccaggau

SEQ ID NO: 921940 - RNA, 19 nt, Human
gcugugggacagcagggug

SEQ ID NO: 921941 - RNA, 22 nt, Human
cuggggcugcggacgggagccc

SEQ ID NO: 921942 - RNA, 22 nt, Human
ccuggcucuucgggaguuuguu

SEQ ID NO: 921943 - RNA, 22 nt, Human
cuguccugaguucuuggagguc

SEQ ID NO: 921944 - RNA, 22 nt, Human
ucugccuggcucauggcaguga

SEQ ID NO: 921945 - RNA, 18 nt, Human
gucuuuucucccuuccuc

SEQ ID NO: 921946 - RNA, 22 nt, Human
uggaaaauuaguagugaaaggc

SEQ ID NO: 921947 - RNA, 20 nt, Human
augccaagcuaucuagaauc

SEQ ID NO: 921948 - RNA, 19 nt, Human
acagacauuugcaauuagc

SEQ ID NO: 921949 - RNA, 22 nt, Human
gcaggaagcauagaagaaugcc

SEQ ID NO: 921950 - RNA, 22 nt, Human
uguaaaaggaaaucaaagcacu

SEQ ID NO: 921951 - RNA, 22 nt, Human
uaugaauauaccacaauuuagg

SEQ ID NO: 921952 - RNA, 22 nt, Human
acccuggcagccuucuguccug

SEQ ID NO: 921953 - RNA, 22 nt, Human
augcauauguacccauguucug

SEQ ID NO: 921954 - RNA, 22 nt, Human
aaacuagauuaccacugcuaga

SEQ ID NO: 921955 - RNA, 22 nt, Human
aagaguuugaccugugccaucc

SEQ ID NO: 921956 - RNA, 22 nt, Human
cugaggccuggugaggugguga

SEQ ID NO: 921957 - RNA, 22 nt, Human
ugcacuuggcugugaucucuag

SEQ ID NO: 921958 - RNA, 22 nt, Human
ugcugcuguauccuuaguguca

SEQ ID NO: 921959 - RNA, 22 nt, Human
auuggucuaaaguuaagaagau

SEQ ID NO: 921960 - RNA, 22 nt, Human
uagaaagcguuaaaucuacaga

SEQ ID NO: 921961 - RNA, 23 nt, Human
cucccuggaguuucuggaagaug

SEQ ID NO: 921962 - RNA, 22 nt, Human
gacaaaugaaugaugaacacca

SEQ ID NO: 921963 - RNA, 22 nt, Human
agggggcugccaaggaauguaa

SEQ ID NO: 921964 - RNA, 22 nt, Human
agaggucagaacaggaaagugu

SEQ ID NO: 921965 - RNA, 22 nt, Human
agggccagaaucccucagucua

SEQ ID NO: 921966 - RNA, 22 nt, Human
uauuuaaccaguuaaauuucca

SEQ ID NO: 921967 - RNA, 22 nt, Human
agcucucccaccuucuucuuac

SEQ ID NO: 921968 - RNA, 22 nt, Human
agcaucugcauaaugccuuccc

SEQ ID NO: 921969 - RNA, 22 nt, Human
uuuggagagaguuaaauauguu

SEQ ID NO: 921970 - RNA, 22 nt, Human
uaaagcacauaucuuacaauaa

SEQ ID NO: 921971 - RNA, 22 nt, Human
aguauauugguguuauuccuca

SEQ ID NO: 921972 - RNA, 22 nt, Human
ggagagcagggaggcugcucug

SEQ ID NO: 921973 - RNA, 22 nt, Human
gacauuuaugaaggagauaugc

SEQ ID NO: 921974 - RNA, 22 nt, Human
uugcauuugagaaaguucuccu

SEQ ID NO: 921975 - RNA, 22 nt, Human
agcugagguuaguauaaaugug

SEQ ID NO: 921976 - RNA, 22 nt, Human
aggcaauagguuccucaucuuu

SEQ ID NO: 921977 - RNA, 23 nt, Human
ucuguacacaucagcaucuccca

SEQ ID NO: 921978 - RNA, 22 nt, Human
uucaaaugguuagacuguuagc

SEQ ID NO: 921979 - RNA, 22 nt, Human
ucaugcaaacucuaguccuuua

SEQ ID NO: 921980 - RNA, 22 nt, Human
uaaacuacuaggaugaauuuuu

SEQ ID NO: 921981 - RNA, 19 nt, Human
guuuuguuugcagaacuua

SEQ ID NO: 921982 - RNA, 22 nt, Human
uguaaggugcucauguauuucu

SEQ ID NO: 921983 - RNA, 22 nt, Human
ugucaacagauacuagagagcu

SEQ ID NO: 921984 - RNA, 22 nt, Human
ggucccagaauugguuagcaca

SEQ ID NO: 921985 - RNA, 22 nt, Human
gacacaguaauguguuucaucu

SEQ ID NO: 921986 - RNA, 22 nt, Human
cagauaaaggcuuacuaguagu

SEQ ID NO: 921987 - RNA, 22 nt, Human
ggacccugggcagcuggcugcu

SEQ ID NO: 921988 - RNA, 22 nt, Human
aaggguggauuucugagcucua

SEQ ID NO: 921989 - RNA, 22 nt, Human
uacuucaaacaaugguacaaac

SEQ ID NO: 921990 - RNA, 22 nt, Human
uugcuuuccgucaugugcuaau

SEQ ID NO: 921991 - RNA, 22 nt, Human
agugcagggggaaagggugucu

SEQ ID NO: 921992 - RNA, 22 nt, Human
ucuuuggaucccaacuggcugg

SEQ ID NO: 921993 - RNA, 22 nt, Human
cagcacaguuucccccaugagc

SEQ ID NO: 921994 - RNA, 22 nt, Human
uguuugacaccucaguguuucu

SEQ ID NO: 921995 - RNA, 20 nt, Human
agucccuuuggucagguauu

SEQ ID NO: 921996 - RNA, 22 nt, Human
aaaggagaguagguuacuccau

SEQ ID NO: 921997 - RNA, 22 nt, Human
ccacaaaguugcugaguuucug

SEQ ID NO: 921998 - RNA, 22 nt, Human
cgaggcagaggcugaaacggcu

SEQ ID NO: 921999 - RNA, 22 nt, Human
acacuuuaucucaucucagaca

SEQ ID NO: 922000 - RNA, 22 nt, Human
cauauuaaggucuguaaggggu

SEQ ID NO: 922001 - RNA, 22 nt, Human
acuuagaagaugcaguaaagca

SEQ ID NO: 922002 - RNA, 22 nt, Human
uagaaacaagggagaggauucu

SEQ ID NO: 922003 - RNA, 22 nt, Human
aggguugccucugagugcuccg

SEQ ID NO: 922004 - RNA, 22 nt, Human
guggggcaugcacgcugcuccu

SEQ ID NO: 922005 - RNA, 22 nt, Human
aggcugagcugguagugaguac

SEQ ID NO: 922006 - RNA, 22 nt, Human
gcuguggccuaguuuguuauau

SEQ ID NO: 922007 - RNA, 22 nt, Human
gcccagaaguugaggcugcagu

SEQ ID NO: 922008 - RNA, 19 nt, Human
aacaucuuuccaguagagg

SEQ ID NO: 922009 - RNA, 22 nt, Human
ugggaaggacgugucaguggca

SEQ ID NO: 922010 - RNA, 22 nt, Human
ggaugcaggaggucggggagca

SEQ ID NO: 922011 - RNA, 22 nt, Human
acugcagccuugaacucugggc

SEQ ID NO: 922012 - RNA, 22 nt, Human
gcagccuuccguggaccuggac

SEQ ID NO: 922013 - RNA, 22 nt, Human
aggagagaauguuccaggcuug

SEQ ID NO: 922014 - RNA, 22 nt, Human
acugagggagagucuuagguug

SEQ ID NO: 922015 - RNA, 22 nt, Human
aaucuaaggacuuagcauugcu

SEQ ID NO: 922016 - RNA, 22 nt, Human
uuagcagcuuagacugccuggg

SEQ ID NO: 922017 - RNA, 22 nt, Human
aguggcuucauuucugccagaa

SEQ ID NO: 922018 - RNA, 22 nt, Human
uauguguauugagcauuguuac

SEQ ID NO: 922019 - RNA, 16 nt, Human
auuuccuugugaguuu

SEQ ID NO: 922020 - RNA, 22 nt, Human
ggaaaggggccuggaucuuuug

SEQ ID NO: 922021 - RNA, 22 nt, Human
aauccuggaauacaagagugaa

SEQ ID NO: 922022 - RNA, 22 nt, Human
uggcccaggcgaggugggcaga

SEQ ID NO: 922023 - RNA, 22 nt, Human
ugucacaguuuguacuuuauag

SEQ ID NO: 922024 - RNA, 22 nt, Human
ccagggcaggggcuggaguuca

SEQ ID NO: 922025 - RNA, 22 nt, Human
ucacuuugacggccaacuucua

SEQ ID NO: 922026 - RNA, 22 nt, Human
agagucaccuuuuccucaggau

SEQ ID NO: 922027 - RNA, 22 nt, Human
uauuccaagucacuguguccug

SEQ ID NO: 922028 - RNA, 22 nt, Human
ugcagaccucccauggcugccu

SEQ ID NO: 922029 - RNA, 22 nt, Human
cugaggccucuccuuggcuugu

SEQ ID NO: 922030 - RNA, 22 nt, Human
cccagggacagaugggcagcua

SEQ ID NO: 922031 - RNA, 22 nt, Human
uuauaggaaauaguucaugcga

SEQ ID NO: 922032 - RNA, 22 nt, Human
ccagugggagggagcuaggcca

SEQ ID NO: 922033 - RNA, 22 nt, Human
agcugcagauucucuacuucau

SEQ ID NO: 922034 - RNA, 22 nt, Human
gcguggugcugcccugcacaca

SEQ ID NO: 922035 - RNA, 20 nt, Human
gccuggaggcaaugggaaga

SEQ ID NO: 922036 - RNA, 22 nt, Human
uacagcaaugccugaaauagua

SEQ ID NO: 922037 - RNA, 22 nt, Human
agauaauguucugauccauuuc

SEQ ID NO: 922038 - RNA, 22 nt, Human
cagugcaguuucccagaugcug

SEQ ID NO: 922039 - RNA, 22 nt, Human
ugcaggcagggccagcgugagg

SEQ ID NO: 922040 - RNA, 22 nt, Human
augacacauaaaacaaggacug

SEQ ID NO: 922041 - RNA, 22 nt, Human
aaaaccugauugaauucuauuu

SEQ ID NO: 922042 - RNA, 22 nt, Human
ucaggaagugcugaggcugcuu

SEQ ID NO: 922043 - RNA, 22 nt, Human
gagguccacugaggcaacaggg

SEQ ID NO: 922044 - RNA, 22 nt, Human
caccccaaguucuguccacugc

SEQ ID NO: 922045 - RNA, 22 nt, Human
gaaauauacaugaagucggcug

SEQ ID NO: 922046 - RNA, 23 nt, Human
agcagcaggagguauugauaagg

SEQ ID NO: 922047 - RNA, 22 nt, Human
caguucaaaguuaagcagcagu

SEQ ID NO: 922048 - RNA, 22 nt, Human
acagcuguauucaaguugcaag

SEQ ID NO: 922049 - RNA, 22 nt, Human
uggcuggagccccucaagagca

SEQ ID NO: 922050 - RNA, 22 nt, Human
agcacauuuaaguaugaaauau

SEQ ID NO: 922051 - RNA, 19 nt, Human
uccugcagaccagaccugu

SEQ ID NO: 922052 - RNA, 22 nt, Human
guucacaagcuggguuucugca

SEQ ID NO: 922053 - RNA, 22 nt, Human
agccagauccaggagacagcuc

SEQ ID NO: 922054 - RNA, 22 nt, Human
aacaguuugccugaaauguauu

SEQ ID NO: 922055 - RNA, 22 nt, Human
uggaagcggacguuguggggug

SEQ ID NO: 922056 - RNA, 22 nt, Human
gagugucuauguuuagucuuuc

SEQ ID NO: 922057 - RNA, 21 nt, Human
aucacauuggcuguuauuauu

SEQ ID NO: 922058 - RNA, 23 nt, Human
ucccagggaaggugagcgaggcu

SEQ ID NO: 922059 - RNA, 22 nt, Human
ggagacaguauggcuuguagcu

SEQ ID NO: 922060 - RNA, 22 nt, Human
gggcucugguacuuccuggcuc

SEQ ID NO: 922061 - RNA, 22 nt, Human
gcuuuaugcuacgauuucuagu

SEQ ID NO: 922062 - RNA, 22 nt, Human
cagugcagguuuagggcugggg

SEQ ID NO: 922063 - RNA, 22 nt, Human
uagcaaagaagauauuauugca

SEQ ID NO: 922064 - RNA, 22 nt, Human
ucuucauguugcuguagggaga

SEQ ID NO: 922065 - RNA, 22 nt, Human
uagcugucaccagaaauggcca

SEQ ID NO: 922066 - RNA, 22 nt, Human
agucagagugugcaggccggcu

SEQ ID NO: 922067 - RNA, 22 nt, Human
uccucagaugcucuuggacgcc

SEQ ID NO: 922068 - RNA, 22 nt, Human
cuuuaguucuagaaagugaaac

SEQ ID NO: 922069 - RNA, 22 nt, Human
aaaugcauguauguaauaugcu

SEQ ID NO: 922070 - RNA, 22 nt, Human
uagauucuggagagacagcagu

SEQ ID NO: 922071 - RNA, 22 nt, Human
gaaaugacaaggacauuccugu

SEQ ID NO: 922072 - RNA, 22 nt, Human
ucccaggguuacagccagggca

SEQ ID NO: 922073 - RNA, 22 nt, Human
ggggaagucggagccugagcac

SEQ ID NO: 922074 - RNA, 22 nt, Human
auuugaaguaaguaaugaguau

SEQ ID NO: 922075 - RNA, 22 nt, Human
aaucaggaugacugucauuuca

SEQ ID NO: 922076 - RNA, 22 nt, Human
cacuucucugauaaucucaguu

SEQ ID NO: 922077 - RNA, 22 nt, Human
uacuuuuaaaauucacagguau

SEQ ID NO: 922078 - RNA, 22 nt, Human
cacagaaauuauuaggaugcuu

SEQ ID NO: 922079 - RNA, 22 nt, Human
uuccacagucauccugggaauu

SEQ ID NO: 922080 - RNA, 22 nt, Human
gaaggugucuggcccagagucu

SEQ ID NO: 922081 - RNA, 22 nt, Human
caaauuuaagugaggucuuugu

SEQ ID NO: 922082 - RNA, 22 nt, Human
uagcagcaagaaugggaugugu

SEQ ID NO: 922083 - RNA, 19 nt, Human
ucuccaggcaggugagcga

SEQ ID NO: 922084 - RNA, 22 nt, Human
uucugugaaucuuuuuucccac

SEQ ID NO: 922085 - RNA, 22 nt, Human
aucauuagcaauuuucaauaag

SEQ ID NO: 922086 - RNA, 22 nt, Human
uggaauguaguguccauggaau

SEQ ID NO: 922087 - RNA, 22 nt, Human
acaugguaaauugguaaaggac

SEQ ID NO: 922088 - RNA, 23 nt, Human
aaaaucuucugccuaugaagaaa

SEQ ID NO: 922089 - RNA, 22 nt, Human
ggcagcuucucccaggcuguuu

SEQ ID NO: 922090 - RNA, 22 nt, Human
agcugcaacuguccuugccuug

SEQ ID NO: 922091 - RNA, 22 nt, Human
ggcagugaaaaaguauguuucc

SEQ ID NO: 922092 - RNA, 22 nt, Human
caauagcuaggcugguaaagga

SEQ ID NO: 922093 - RNA, 22 nt, Human
aggcacugacucaagggagcca

SEQ ID NO: 922094 - RNA, 22 nt, Human
gcugcaggcgccugcggucucu

SEQ ID NO: 922095 - RNA, 18 nt, Human
ccuggcuuccaucuuggu

SEQ ID NO: 922096 - RNA, 22 nt, Human
uggcucaucuaucagaaagucc

SEQ ID NO: 922097 - RNA, 17 nt, Human
cuuuuaauuuacuuccc

SEQ ID NO: 922098 - RNA, 20 nt, Human
ggagcuggcauccagccucu

SEQ ID NO: 922099 - RNA, 22 nt, Human
aggguagggccguagggccaug

SEQ ID NO: 922100 - RNA, 22 nt, Human
uucaggaagccuuucuuggucu

SEQ ID NO: 922101 - RNA, 22 nt, Human
uaaguucaguuggucgaaguag

SEQ ID NO: 922102 - RNA, 22 nt, Human
uucagugcagucggaacuacug

SEQ ID NO: 922103 - RNA, 22 nt, Human
ucugugucugguugggccagua

SEQ ID NO: 922104 - RNA, 23 nt, Human
agggccucaggagggcugcaugg

SEQ ID NO: 922105 - RNA, 22 nt, Human
ucaggugggaguagaaugcuag

SEQ ID NO: 922106 - RNA, 22 nt, Human
gaacacagguggcccggcaggg

SEQ ID NO: 922107 - RNA, 22 nt, Human
ggggccagcacugugccuuugu

SEQ ID NO: 922108 - RNA, 22 nt, Human
uguguauagaugcaugcauaua

SEQ ID NO: 922109 - RNA, 21 nt, Human
gccugccugcgugacccucuu

SEQ ID NO: 922110 - RNA, 23 nt, Human
cuuuccuuucuuugacacccagc

SEQ ID NO: 922111 - RNA, 22 nt, Human
aguuuagacaaagucuugcauu

SEQ ID NO: 922112 - RNA, 22 nt, Human
gcugggccgaccugggcugcag

SEQ ID NO: 922113 - RNA, 20 nt, Human
cagcagccauucuaguagua

SEQ ID NO: 922114 - RNA, 22 nt, Human
uacaguagcuacucaauaacua

SEQ ID NO: 922115 - RNA, 22 nt, Human
agaauuagaggccauguacuug

SEQ ID NO: 922116 - RNA, 23 nt, Human
ucauuucauccagccuugagagu

SEQ ID NO: 922117 - RNA, 22 nt, Human
agaggcuggguacgggccaccu

SEQ ID NO: 922118 - RNA, 22 nt, Human
gaacaucugccuuguggcugcc

SEQ ID NO: 922119 - RNA, 22 nt, Human
gcugagguggagauugcaguga

SEQ ID NO: 922120 - RNA, 19 nt, Human
ccucacccugcagaggagg

SEQ ID NO: 922121 - RNA, 22 nt, Human
agucuguggauggacuggcaga

SEQ ID NO: 922122 - RNA, 22 nt, Human
aaauugcauucaggaugcagga

SEQ ID NO: 922123 - RNA, 22 nt, Human
gcuuuuguuccacaguuuugaa

SEQ ID NO: 922124 - RNA, 22 nt, Human
uugugaauagugcugcaauaaa

SEQ ID NO: 922125 - RNA, 19 nt, Human
uuuuccacagaaauauguu

SEQ ID NO: 922126 - RNA, 22 nt, Human
ugcugcacaauuggaaaguauc

SEQ ID NO: 922127 - RNA, 17 nt, Human
uaucucugcuucauggu

SEQ ID NO: 922128 - RNA, 17 nt, Human
gccuucucugcccucac

SEQ ID NO: 922129 - RNA, 22 nt, Human
aucugcauguccccauggaucc

SEQ ID NO: 922130 - RNA, 22 nt, Human
gaauuucauuuguuuccuacca

SEQ ID NO: 922131 - RNA, 22 nt, Human
auggcacagauguucugauuau

SEQ ID NO: 922132 - RNA, 22 nt, Human
auaugacagcggauucacauau

SEQ ID NO: 922133 - RNA, 22 nt, Human
uuccuuggaaauucugacuuca

SEQ ID NO: 922134 - RNA, 22 nt, Human
cuggaagaggggaaaugccaug

SEQ ID NO: 922135 - RNA, 19 nt, Human
acacagggaucagaggguu

SEQ ID NO: 922136 - RNA, 22 nt, Human
caggauaaauaguaaauguaag

SEQ ID NO: 922137 - RNA, 22 nt, Human
gauauaguuggaauuauaaagg

SEQ ID NO: 922138 - RNA, 19 nt, Human
agugucaucagcuacucag

SEQ ID NO: 922139 - RNA, 22 nt, Human
cuugcuggcagucacuguugcg

SEQ ID NO: 922140 - RNA, 21 nt, Human
ucuguacaucauugagucccc

SEQ ID NO: 922141 - RNA, 22 nt, Human
aguucagaaaugucuuugcaaa

SEQ ID NO: 922142 - RNA, 19 nt, Human
agcuccaggccuggaugcu

SEQ ID NO: 922143 - RNA, 21 nt, Human
uauuaauaugucuaagcugau

SEQ ID NO: 922144 - RNA, 22 nt, Human
aucaguuuauacuuauaaaucu

SEQ ID NO: 922145 - RNA, 22 nt, Human
acauuuaaauaccuauguuucu

SEQ ID NO: 922146 - RNA, 22 nt, Human
cuggucaccagguagcauugua

SEQ ID NO: 922147 - RNA, 22 nt, Human
ucagaaucugcauuuaacaaaa

SEQ ID NO: 922148 - RNA, 22 nt, Human
ggccaggcugcugggaccccgc

SEQ ID NO: 922149 - RNA, 22 nt, Human
ccagcagaguugguuucuggua

SEQ ID NO: 922150 - RNA, 22 nt, Human
cuugacagucccaggaaaauag

SEQ ID NO: 922151 - RNA, 22 nt, Human
aucacaguuacucaaauaauga

SEQ ID NO: 922152 - RNA, 20 nt, Human
uucaaguugggucucuggcu

SEQ ID NO: 922153 - RNA, 22 nt, Human
aagucaggaagugcaaaaguug

SEQ ID NO: 922154 - RNA, 22 nt, Human
uucugccagugaaaauaaugau

SEQ ID NO: 922155 - RNA, 22 nt, Human
auguguauuaguuaguuuaaug

SEQ ID NO: 922156 - RNA, 22 nt, Human
ucuccugguuuguuaaauaauu

SEQ ID NO: 922157 - RNA, 22 nt, Human
uuggugugacuaaggcagugug

SEQ ID NO: 922158 - RNA, 22 nt, Human
uucacaaucuggcuuagcauug

SEQ ID NO: 922159 - RNA, 22 nt, Human
uggaagagcaggcagacaaugc

SEQ ID NO: 922160 - RNA, 19 nt, Human
uaguggagugacaaguucu

SEQ ID NO: 922161 - RNA, 22 nt, Human
auucuuuuaagccccagggauu

SEQ ID NO: 922162 - RNA, 22 nt, Human
acaguuaccacuuagcaguuac

SEQ ID NO: 922163 - RNA, 22 nt, Human
auuccaguuaguggcagcuuau

SEQ ID NO: 922164 - RNA, 20 nt, Human
ucugaggcugagcccagcgu

SEQ ID NO: 922165 - RNA, 22 nt, Human
cugcagagcaaguucucuguug

SEQ ID NO: 922166 - RNA, 22 nt, Human
uugauguaaacuuugauuucau

SEQ ID NO: 922167 - RNA, 22 nt, Human
uaugacaaugugggccuaaggg

SEQ ID NO: 922168 - RNA, 22 nt, Human
accaggcccuccagcugcgugg

SEQ ID NO: 922169 - RNA, 22 nt, Human
ugaguucugacugugaugccag

SEQ ID NO: 922170 - RNA, 22 nt, Human
acucacucuuaaucagacuccc

SEQ ID NO: 922171 - RNA, 22 nt, Human
accucuggacacugcauccuuc

SEQ ID NO: 922172 - RNA, 22 nt, Human
uaagaacaguagaacaguaggu

SEQ ID NO: 922173 - RNA, 22 nt, Human
ucuaacuauacaaagaaaacau

SEQ ID NO: 922174 - RNA, 22 nt, Human
uuuccuucaucaucugagagcu

SEQ ID NO: 922175 - RNA, 22 nt, Human
aguuagaauggauguugagagc

SEQ ID NO: 922176 - RNA, 22 nt, Human
aauccuggcaugugccuuggga

SEQ ID NO: 922177 - RNA, 19 nt, Human
gcugugccucucuccugcu

SEQ ID NO: 922178 - RNA, 22 nt, Human
gcugggagccguaccugucacg

SEQ ID NO: 922179 - RNA, 20 nt, Human
cauuggacuuggcuucaugg

SEQ ID NO: 922180 - RNA, 22 nt, Human
uguuuagaggaacuggaaucag

SEQ ID NO: 922181 - RNA, 22 nt, Human
uagaagauaagacaagugcugc

SEQ ID NO: 922182 - RNA, 22 nt, Human
cagcaacaugugguaguguagg

SEQ ID NO: 922183 - RNA, 22 nt, Human
ccagggcuucccacgugcccug

SEQ ID NO: 922184 - RNA, 22 nt, Human
uugcauuuuuacaaguagccag

SEQ ID NO: 922185 - RNA, 22 nt, Human
acauugaacuacuuguaaugag

SEQ ID NO: 922186 - RNA, 22 nt, Human
uuacacuaagcuacuucuauau

SEQ ID NO: 922187 - RNA, 22 nt, Human
aucuuuuuugucuuggucacug

SEQ ID NO: 922188 - RNA, 22 nt, Human
ggcuucacaguuguagcagcuc

SEQ ID NO: 922189 - RNA, 22 nt, Human
cuggcuggccggagcgaggcgg

SEQ ID NO: 922190 - RNA, 22 nt, Human
guggcagggugcucaucaugca

SEQ ID NO: 922191 - RNA, 22 nt, Human
uggagaguucuguagauaucua

SEQ ID NO: 922192 - RNA, 18 nt, Human
ccucagaggcaaauuguu

SEQ ID NO: 922193 - RNA, 22 nt, Human
ucuggagaggaggauguggaca

SEQ ID NO: 922194 - RNA, 18 nt, Human
uccagagguguuggagcc

SEQ ID NO: 922195 - RNA, 22 nt, Human
cuguuuucccuggaguucagca

SEQ ID NO: 922196 - RNA, 22 nt, Human
uggcagaguucgcugugccuuu

SEQ ID NO: 922197 - RNA, 22 nt, Human
ucacacauguaagggcuuugga

SEQ ID NO: 922198 - RNA, 22 nt, Human
ucacuuagauggggaucaucac

SEQ ID NO: 922199 - RNA, 22 nt, Human
cagcccaggacugcagguguuu

SEQ ID NO: 922200 - RNA, 22 nt, Human
guuagagggcugccuuuuguuu

SEQ ID NO: 922201 - RNA, 22 nt, Human
gccuuauuaccugcacuuugaa

SEQ ID NO: 922202 - RNA, 22 nt, Human
uucagaacaaccaugguuagau

SEQ ID NO: 922203 - RNA, 22 nt, Human
agacauccuucaagugauaugu

SEQ ID NO: 922204 - RNA, 21 nt, Human
ugcauaaagaaauacaaauac

SEQ ID NO: 922205 - RNA, 22 nt, Human
caaaugcuggcccugcuacuua

SEQ ID NO: 922206 - RNA, 22 nt, Human
ccagaaucaucaucugaagccu

SEQ ID NO: 922207 - RNA, 22 nt, Human
aggcacugugcagucccaagca

SEQ ID NO: 922208 - RNA, 22 nt, Human
aacaagauguuuugauauaugu

SEQ ID NO: 922209 - RNA, 22 nt, Human
ugcugggcuaggguggagcucu

SEQ ID NO: 922210 - RNA, 22 nt, Human
cagacucugaugcagccuugug

SEQ ID NO: 922211 - RNA, 22 nt, Human
gcugggagaggcccugaaguga

SEQ ID NO: 922212 - RNA, 22 nt, Human
gcaugcaggauagguugagcuc

SEQ ID NO: 922213 - RNA, 19 nt, Human
uaccaaucccuugguuuac

SEQ ID NO: 922214 - RNA, 23 nt, Human
gucagcuugaccaguggagaguc

SEQ ID NO: 922215 - RNA, 22 nt, Human
acagagacuuggagcaggcuga

SEQ ID NO: 922216 - RNA, 22 nt, Human
ucauucacuuugaaauaaacga

SEQ ID NO: 922217 - RNA, 22 nt, Human
aaccuguucccugguccuugac

SEQ ID NO: 922218 - RNA, 22 nt, Human
aaaaguauuggccaccauuucu

SEQ ID NO: 922219 - RNA, 22 nt, Human
uccuuuguugagauaaauuggg

SEQ ID NO: 922220 - RNA, 22 nt, Human
aagagguucuaauuuaacuauc

SEQ ID NO: 922221 - RNA, 22 nt, Human
caauuuuuaaacuaugaaguug

SEQ ID NO: 922222 - RNA, 23 nt, Human
uuucaaagacuuucccuuagagu

SEQ ID NO: 922223 - RNA, 22 nt, Human
cagcauggggcuuggagucagc

SEQ ID NO: 922224 - RNA, 22 nt, Human
cagaaauggaauuuuccaucac

SEQ ID NO: 922225 - RNA, 22 nt, Human
acuagugaagaagauuugacug

SEQ ID NO: 922226 - RNA, 22 nt, Human
ccaggaggcuucguccguggag

SEQ ID NO: 922227 - RNA, 22 nt, Human
gcaaaggccacuggggcgaugg

SEQ ID NO: 922228 - RNA, 18 nt, Human
uccucucuuuccccaggg

SEQ ID NO: 922229 - RNA, 22 nt, Human
cuguggcucauucuugguggca

SEQ ID NO: 922230 - RNA, 22 nt, Human
acauucaaggcagcacugagug

SEQ ID NO: 922231 - RNA, 22 nt, Human
uucuuaagcguaugauaaugaa

SEQ ID NO: 922232 - RNA, 22 nt, Human
aaugacugaagcaauugcagug

SEQ ID NO: 922233 - RNA, 22 nt, Human
aauugucaaaaauugcaauugu

SEQ ID NO: 922234 - RNA, 22 nt, Human
cagcaggggugucauuguaguu

SEQ ID NO: 922235 - RNA, 22 nt, Human
cacuuuaugggaagcaaaaauu

SEQ ID NO: 922236 - RNA, 22 nt, Human
uaggacaggcuaaaagggauaa

SEQ ID NO: 922237 - RNA, 22 nt, Human
aggcagcagaaaacaaaugguu

SEQ ID NO: 922238 - RNA, 22 nt, Human
gcuucuguggugaggucaccuu

SEQ ID NO: 922239 - RNA, 22 nt, Human
agggaggucuuugaggggcuua

SEQ ID NO: 922240 - RNA, 22 nt, Human
ggugggcaggcgaggcccaggu

SEQ ID NO: 922241 - RNA, 22 nt, Human
uauacaagaggugagaugagca

SEQ ID NO: 922242 - RNA, 22 nt, Human
ggcucuggaaaguguccuugau

SEQ ID NO: 922243 - RNA, 22 nt, Human
gacagacacagggccaugauug

SEQ ID NO: 922244 - RNA, 22 nt, Human
agaaaguuuggggcugggcacg

SEQ ID NO: 922245 - RNA, 22 nt, Human
auccauuucaguguuccacuug

SEQ ID NO: 922246 - RNA, 22 nt, Human
cugacaguguacacugacagcu

SEQ ID NO: 922247 - RNA, 22 nt, Human
acuuuguuccuuucacaaagaa

SEQ ID NO: 922248 - RNA, 22 nt, Human
auuuucugaguccagaauuuac

SEQ ID NO: 922249 - RNA, 22 nt, Human
gagugcaguaucuucugugucc

SEQ ID NO: 922250 - RNA, 22 nt, Human
guccguaguggcugaugcuuug

SEQ ID NO: 922251 - RNA, 22 nt, Human
ggagaaagaagacgaacauugu

SEQ ID NO: 922252 - RNA, 22 nt, Human
ggcagcuucuuaauauggagac

SEQ ID NO: 922253 - RNA, 22 nt, Human
agauauuaggaggauucauaau

SEQ ID NO: 922254 - RNA, 22 nt, Human
ugucugaaacuugguccuaugc

SEQ ID NO: 922255 - RNA, 22 nt, Human
aggggccuccucauuggagugu

SEQ ID NO: 922256 - RNA, 22 nt, Human
agcaucuggccugguuacuuuu

SEQ ID NO: 922257 - RNA, 22 nt, Human
acaucagauuaugcuuugcuua

SEQ ID NO: 922258 - RNA, 22 nt, Human
agagaaaagaguucaggcuuug

SEQ ID NO: 922259 - RNA, 20 nt, Human
ccagacagcaccugccuggu

SEQ ID NO: 922260 - RNA, 22 nt, Human
aaaaggaucagauuuugagcag

SEQ ID NO: 922261 - RNA, 22 nt, Human
uuuauucugugcuacaugaaga

SEQ ID NO: 922262 - RNA, 22 nt, Human
cagcaaggguuauaucaaagau

SEQ ID NO: 922263 - RNA, 22 nt, Human
uccccucuggaggcugcagggg

SEQ ID NO: 922264 - RNA, 22 nt, Human
auaaaauuugcuacuguuaaau

SEQ ID NO: 922265 - RNA, 22 nt, Human
uguucuuucaguuagacacagu

SEQ ID NO: 922266 - RNA, 18 nt, Human
gccagcugcacggcccuc

SEQ ID NO: 922267 - RNA, 22 nt, Human
aaaggucuuuuuucuaacacca

SEQ ID NO: 922268 - RNA, 22 nt, Human
uuacacaaaguuagcucuugca

SEQ ID NO: 922269 - RNA, 22 nt, Human
uucaugcacuauuucuucuagc

SEQ ID NO: 922270 - RNA, 22 nt, Human
gcacagagguggaggacaaaua

SEQ ID NO: 922271 - RNA, 22 nt, Human
guaaagcuggagaggucuuuua

SEQ ID NO: 922272 - RNA, 22 nt, Human
gcugucugcugugcacugagca

SEQ ID NO: 922273 - RNA, 22 nt, Human
ugugaaggcagagccagugaaa

SEQ ID NO: 922274 - RNA, 22 nt, Human
uuucagagucuggcugcagccu

SEQ ID NO: 922275 - RNA, 22 nt, Human
ucaaacagcaggucuuucauag

SEQ ID NO: 922276 - RNA, 22 nt, Human
agcuuuauauguuguuucucca

SEQ ID NO: 922277 - RNA, 20 nt, Human
auucucugacaccgcccccg

SEQ ID NO: 922278 - RNA, 22 nt, Human
ucagaaguacugugcuacaaua

SEQ ID NO: 922279 - RNA, 22 nt, Human
aaacagcuggucucaaauguuc

SEQ ID NO: 922280 - RNA, 20 nt, Human
uuucauugucagaaucuuau

SEQ ID NO: 922281 - RNA, 18 nt, Human
cagugcuguuaacaguga

SEQ ID NO: 922282 - RNA, 22 nt, Human
gacaaugugcaauugcagcuag

SEQ ID NO: 922283 - RNA, 23 nt, Human
agcaaucuguguuucagcaagcc

SEQ ID NO: 922284 - RNA, 19 nt, Human
cugcacugagaaaaggagg

SEQ ID NO: 922285 - RNA, 22 nt, Human
aaagagcauggaaaguucagga

SEQ ID NO: 922286 - RNA, 22 nt, Human
acaugaucuuauguagaagauc

SEQ ID NO: 922287 - RNA, 22 nt, Human
gucugugcaguuacuagcuggu

SEQ ID NO: 922288 - RNA, 21 nt, Human
uccagaaaagaggucauuagc

SEQ ID NO: 922289 - RNA, 22 nt, Human
ugagcagaagcccuccuggacu

SEQ ID NO: 922290 - RNA, 22 nt, Human
cuauuagacacaauuagugauu

SEQ ID NO: 922291 - RNA, 22 nt, Human
augagcugggccauccagugau

SEQ ID NO: 922292 - RNA, 19 nt, Human
uaccauguugacuuuccug

SEQ ID NO: 922293 - RNA, 22 nt, Human
gcucccagaaccaaggcugggg

SEQ ID NO: 922294 - RNA, 22 nt, Human
ucugugugggauaguuugagga

SEQ ID NO: 922295 - RNA, 22 nt, Human
cuagaaacuccaucucacuaca

SEQ ID NO: 922296 - RNA, 22 nt, Human
aggaagagcuggaccagaggac

SEQ ID NO: 922297 - RNA, 22 nt, Human
gucacaggccuggaugaggggc

SEQ ID NO: 922298 - RNA, 17 nt, Human
cucuuuugucuucuucc

SEQ ID NO: 922299 - RNA, 22 nt, Human
aggcccagagcaggaaaggguu

SEQ ID NO: 922300 - RNA, 22 nt, Human
uagcaauguguguguauaaauu

SEQ ID NO: 922301 - RNA, 22 nt, Human
ucaggagaaaauaucaggaagu

SEQ ID NO: 922302 - RNA, 22 nt, Human
agcaggagauggggcgugaugu

SEQ ID NO: 922303 - RNA, 22 nt, Human
cagcagcugauggggaagugau

SEQ ID NO: 922304 - RNA, 22 nt, Human
aaguccauaguuugcauuaggg

SEQ ID NO: 922305 - RNA, 22 nt, Human
cagccacugaacuccuggcuau

SEQ ID NO: 922306 - RNA, 22 nt, Human
gcuggccccgagugcuacgcuc

SEQ ID NO: 922307 - RNA, 22 nt, Human
cagcaggguagguuguaucagu

SEQ ID NO: 922308 - RNA, 22 nt, Human
ucugacccuacucagcacuuug

SEQ ID NO: 922309 - RNA, 22 nt, Human
ucaaagaugauaggaaaucaua

SEQ ID NO: 922310 - RNA, 22 nt, Human
gugccugguauguagguagcgg

SEQ ID NO: 922311 - RNA, 22 nt, Human
gggcugugagaguggggcugcu

SEQ ID NO: 922312 - RNA, 22 nt, Human
gcaggccacaguggagucucug

SEQ ID NO: 922313 - RNA, 22 nt, Human
acccuggacuggggcugaggcu

SEQ ID NO: 922314 - RNA, 22 nt, Human
cagagcugguaagugguagagg

SEQ ID NO: 922315 - RNA, 19 nt, Human
ccagagucaugucuccccc

SEQ ID NO: 922316 - RNA, 22 nt, Human
acuguucugcaugcugugaggg

SEQ ID NO: 922317 - RNA, 22 nt, Human
ccugggugacagagugagaccu

SEQ ID NO: 922318 - RNA, 22 nt, Human
uuguaacaaucugucauaaaug

SEQ ID NO: 922319 - RNA, 19 nt, Human
uacaagcuuuuuuggcagg

SEQ ID NO: 922320 - RNA, 22 nt, Human
cucuuuaagcuccuaacagcca

SEQ ID NO: 922321 - RNA, 22 nt, Human
ucuagaaagccaaauuaggaau

SEQ ID NO: 922322 - RNA, 22 nt, Human
agaggccaagccagacugugca

SEQ ID NO: 922323 - RNA, 22 nt, Human
uuuuuggcagcucagaaacuuc

SEQ ID NO: 922324 - RNA, 20 nt, Human
ggucaucuuccaaucccagg

SEQ ID NO: 922325 - RNA, 19 nt, Human
ugcccugcccgcagccuug

SEQ ID NO: 922326 - RNA, 22 nt, Human
ucaacccuggugggaauauuug

SEQ ID NO: 922327 - RNA, 22 nt, Human
uugaauaaaugagcagugaauu

SEQ ID NO: 922328 - RNA, 22 nt, Human
cuagagcuguucugugcacuca

SEQ ID NO: 922329 - RNA, 22 nt, Human
aacaggagucauugucauuauu

SEQ ID NO: 922330 - RNA, 22 nt, Human
ccugagcugaacuaagcaguuu

SEQ ID NO: 922331 - RNA, 22 nt, Human
uagauacaugaaauggcagaua

SEQ ID NO: 922332 - RNA, 22 nt, Human
ccuuuuauacucuguccucugg

SEQ ID NO: 922333 - RNA, 22 nt, Human
uggggcugaggagccucacucu

SEQ ID NO: 922334 - RNA, 18 nt, Human
ucacagacagcugucuuu

SEQ ID NO: 922335 - RNA, 22 nt, Human
acaaaguuucuucuaacaucug

SEQ ID NO: 922336 - RNA, 22 nt, Human
aauuauacauugaacaaucuag

SEQ ID NO: 922337 - RNA, 23 nt, Human
uguaaaaugggguaguguuacca

SEQ ID NO: 922338 - RNA, 22 nt, Human
cagcagaagugcauuugugauu

SEQ ID NO: 922339 - RNA, 22 nt, Human
aacauauucagaugccaagucc

SEQ ID NO: 922340 - RNA, 22 nt, Human
uuccugggguacuggagaaaau

SEQ ID NO: 922341 - RNA, 22 nt, Human
cagcaagagacuguucucuaag

SEQ ID NO: 922342 - RNA, 22 nt, Human
ugaauaguaagagaauauuugc

SEQ ID NO: 922343 - RNA, 22 nt, Human
agugucugaugcacaguugucc

SEQ ID NO: 922344 - RNA, 22 nt, Human
ucuuuagauguuuagaggaaga

SEQ ID NO: 922345 - RNA, 22 nt, Human
gggucuucugauauagguccag

SEQ ID NO: 922346 - RNA, 22 nt, Human
ccaguggacaauuucugaggaa

SEQ ID NO: 922347 - RNA, 22 nt, Human
gacauucaaguuugcaguuagg

SEQ ID NO: 922348 - RNA, 22 nt, Human
aagagcugcccaaggugaacag

SEQ ID NO: 922349 - RNA, 22 nt, Human
agucauaugacccuucacaaac

SEQ ID NO: 922350 - RNA, 22 nt, Human
aguacacaagacacauuuaaaa

SEQ ID NO: 922351 - RNA, 22 nt, Human
uaccugggaagugggaccugag

SEQ ID NO: 922352 - RNA, 22 nt, Human
uggaaauuaaaauuccucuuaa

SEQ ID NO: 922353 - RNA, 22 nt, Human
auaagcauguuagaauauuuga

SEQ ID NO: 922354 - RNA, 22 nt, Human
cuagcaagccuaccacgaaacu

SEQ ID NO: 922355 - RNA, 18 nt, Human
cacauuuaccuggcuccc

SEQ ID NO: 922356 - RNA, 22 nt, Human
uuucuugaccacuauguugaua

SEQ ID NO: 922357 - RNA, 22 nt, Human
uccugccuucauacugcuguau

SEQ ID NO: 922358 - RNA, 22 nt, Human
gaggccugaggcugccuggagc

SEQ ID NO: 922359 - RNA, 22 nt, Human
gugguuuguuuuauuccuggaa

SEQ ID NO: 922360 - RNA, 22 nt, Human
aauguuaugugguucaacuuaa

SEQ ID NO: 922361 - RNA, 22 nt, Human
cagcaucaccaacuugagcaau

SEQ ID NO: 922362 - RNA, 22 nt, Human
aacaggcaaacugugggauccc

SEQ ID NO: 922363 - RNA, 22 nt, Human
gugugucugaaguugaguagac

SEQ ID NO: 922364 - RNA, 22 nt, Human
uaaacagagagugcaguuauag

SEQ ID NO: 922365 - RNA, 19 nt, Human
aacuacagcgcacuguccu

SEQ ID NO: 922366 - RNA, 22 nt, Human
gcacaagaaaucauggacugaa

SEQ ID NO: 922367 - RNA, 22 nt, Human
cagcauggccauuucucgcugc

SEQ ID NO: 922368 - RNA, 22 nt, Human
aaggcaguucacucacgcagcc

SEQ ID NO: 922369 - RNA, 22 nt, Human
uggcuggcaguuaucuuuggau

SEQ ID NO: 922370 - RNA, 17 nt, Human
acaacagaaauguauuc

SEQ ID NO: 922371 - RNA, 22 nt, Human
cacuuuuaaauggguccguguu

SEQ ID NO: 922372 - RNA, 22 nt, Human
gcacagaacagagaaauagcca

SEQ ID NO: 922373 - RNA, 22 nt, Human
ucuuuuguugccuacuuauuaa

SEQ ID NO: 922374 - RNA, 22 nt, Human
gcugccugucugcugacccagg

SEQ ID NO: 922375 - RNA, 22 nt, Human
agcuucucggcugggaguauuu

SEQ ID NO: 922376 - RNA, 20 nt, Human
gcagccucaacaggcacagc

SEQ ID NO: 922377 - RNA, 22 nt, Human
cuguggcucagcacggggucag

SEQ ID NO: 922378 - RNA, 22 nt, Human
uucauacauuuuuacuaacagc

SEQ ID NO: 922379 - RNA, 22 nt, Human
uaugaguuuaaggcuaaaauag

SEQ ID NO: 922380 - RNA, 23 nt, Human
ggaauguuuaccugugaauguca

SEQ ID NO: 922381 - RNA, 22 nt, Human
auuaggcacuagaaugucaauu

SEQ ID NO: 922382 - RNA, 20 nt, Human
uggacagaauuagacacuuu

SEQ ID NO: 922383 - RNA, 22 nt, Human
aacaguuuaugauaaauucuua

SEQ ID NO: 922384 - RNA, 22 nt, Human
aauuuaagaacauuucaggacu

SEQ ID NO: 922385 - RNA, 22 nt, Human
gcugucacacaugggaucucag

SEQ ID NO: 922386 - RNA, 22 nt, Human
gcaagauuccgcucuagagccu

SEQ ID NO: 922387 - RNA, 22 nt, Human
aagccagaguuuuugagaacuu

SEQ ID NO: 922388 - RNA, 22 nt, Human
uuuaccaguguuaaacaccagc

SEQ ID NO: 922389 - RNA, 22 nt, Human
cugguucugauguucuuggcuu

SEQ ID NO: 922390 - RNA, 21 nt, Human
cauuacaugguuuuagugaac

SEQ ID NO: 922391 - RNA, 22 nt, Human
uuuuagauuauaagucuaauuc

SEQ ID NO: 922392 - RNA, 22 nt, Human
agacagacuugaaaauguucuu

SEQ ID NO: 922393 - RNA, 22 nt, Human
uuucuauaaaaagugcuaggau

SEQ ID NO: 922394 - RNA, 22 nt, Human
ccuccaggauaagucagggccu

SEQ ID NO: 922395 - RNA, 22 nt, Human
gcuuccuccuggaggucacuca

SEQ ID NO: 922396 - RNA, 22 nt, Human
uucaagguaaguaugagaaagc

SEQ ID NO: 922397 - RNA, 22 nt, Human
cgcagacacugaggguccgggg

SEQ ID NO: 922398 - RNA, 23 nt, Human
ucaucaaacagcugcucaagaaa

SEQ ID NO: 922399 - RNA, 22 nt, Human
uuacacacucugcccugcuguu

SEQ ID NO: 922400 - RNA, 22 nt, Human
acauuaaaaaauguugcaugaa

SEQ ID NO: 922401 - RNA, 19 nt, Human
uuagguauuauugcuuucc

SEQ ID NO: 922402 - RNA, 21 nt, Human
guggcccugccgcagugucca

SEQ ID NO: 922403 - RNA, 22 nt, Human
uucuuuggggucuccagcauag

SEQ ID NO: 922404 - RNA, 22 nt, Human
uagcagagaggggacaguggca

SEQ ID NO: 922405 - RNA, 22 nt, Human
uggcagccuucucugagaaggu

SEQ ID NO: 922406 - RNA, 22 nt, Human
uuugacagugcugcuaaaaugc

SEQ ID NO: 922407 - RNA, 22 nt, Human
ggcaugcaaaacaacucagaga

SEQ ID NO: 922408 - RNA, 22 nt, Human
acccugagaugccacagcauga

SEQ ID NO: 922409 - RNA, 22 nt, Human
agguucucacacgucuacaccc

SEQ ID NO: 922410 - RNA, 22 nt, Human
uguccucacaggaaugaacuuu

SEQ ID NO: 922411 - RNA, 22 nt, Human
aggaggcugaacuagggucugg

SEQ ID NO: 922412 - RNA, 22 nt, Human
aguuuucauuaccaugcugcaa

SEQ ID NO: 922413 - RNA, 23 nt, Human
ugucuggcucauggugggucuca

SEQ ID NO: 922414 - RNA, 22 nt, Human
uagcuguuuaucaaguucuuga

SEQ ID NO: 922415 - RNA, 21 nt, Human
agcugcagucaagccagaggu

SEQ ID NO: 922416 - RNA, 19 nt, Human
uuugccuugcagcugugug

SEQ ID NO: 922417 - RNA, 22 nt, Human
ggaagggccucgggcgugggac

SEQ ID NO: 922418 - RNA, 22 nt, Human
ugccagugucugcuaucugaga

SEQ ID NO: 922419 - RNA, 22 nt, Human
gaucuuugcaaacuuugucacu

SEQ ID NO: 922420 - RNA, 22 nt, Human
ucccaucagucauugguugagg

SEQ ID NO: 922421 - RNA, 22 nt, Human
cugggcagugguggcaucuuug

SEQ ID NO: 922422 - RNA, 22 nt, Human
augcacaauguuuugauuugag

SEQ ID NO: 922423 - RNA, 22 nt, Human
ggagagcuuggagugcgauuuu

SEQ ID NO: 922424 - RNA, 22 nt, Human
aguuaagagugugaaaauguua

SEQ ID NO: 922425 - RNA, 23 nt, Human
uggcagagacccagaaucuacau

SEQ ID NO: 922426 - RNA, 22 nt, Human
ucaguaacuggguugaagcuag

SEQ ID NO: 922427 - RNA, 22 nt, Human
uaaagugcuggauuugaguaaa

SEQ ID NO: 922428 - RNA, 22 nt, Human
gaggaaaaugcaacaggaaugc

SEQ ID NO: 922429 - RNA, 22 nt, Human
cuauuugucaguuuggcuuuaa

SEQ ID NO: 922430 - RNA, 22 nt, Human
ugggaaugugagcauucauuca

SEQ ID NO: 922431 - RNA, 22 nt, Human
acaguggaggccauaugguccu

SEQ ID NO: 922432 - RNA, 22 nt, Human
uccccacaucucugcaucaggc

SEQ ID NO: 922433 - RNA, 22 nt, Human
ccaugcccuaaaggacuggcag

SEQ ID NO: 922434 - RNA, 22 nt, Human
ggacacagauaaucacacagau

SEQ ID NO: 922435 - RNA, 22 nt, Human
gugcuccaggucgcucagagag

SEQ ID NO: 922436 - RNA, 21 nt, Human
augaaggcagugccaagggcu

SEQ ID NO: 922437 - RNA, 22 nt, Human
uuagaggggcugcugaauggga

SEQ ID NO: 922438 - RNA, 22 nt, Human
aaacacaagauggccucuucug

SEQ ID NO: 922439 - RNA, 19 nt, Human
ccuguucuuggcugaggcu

SEQ ID NO: 922440 - RNA, 22 nt, Human
agacacagcagugccugccuca

SEQ ID NO: 922441 - RNA, 22 nt, Human
uauuuuacuuuaaagcgagaga

SEQ ID NO: 922442 - RNA, 22 nt, Human
uagcaagaagggagaugggguu

SEQ ID NO: 922443 - RNA, 22 nt, Human
aagaagcaggucacagacaggg

SEQ ID NO: 922444 - RNA, 22 nt, Human
aagaaagagaucacuccuccau

SEQ ID NO: 922445 - RNA, 21 nt, Human
uuuaucaucacgagcuugagc

SEQ ID NO: 922446 - RNA, 22 nt, Human
aacuauaaugggguuaggaaau

SEQ ID NO: 922447 - RNA, 22 nt, Human
aggccagccuuguaaaugccuc

SEQ ID NO: 922448 - RNA, 22 nt, Human
ggagccuggcaaugcugcgucc

SEQ ID NO: 922449 - RNA, 22 nt, Human
ucuggacuugaaucagaguaga

SEQ ID NO: 922450 - RNA, 22 nt, Human
uguguuugaggcauguugcaga

SEQ ID NO: 922451 - RNA, 22 nt, Human
augaagcagccucuucccucug

SEQ ID NO: 922452 - RNA, 22 nt, Human
uccugugucucagcgugaagca

SEQ ID NO: 922453 - RNA, 22 nt, Human
caacauuuucauggccagggag

SEQ ID NO: 922454 - RNA, 22 nt, Human
uuaaggaauuuauaguuguacu

SEQ ID NO: 922455 - RNA, 22 nt, Human
uuuucuguauuauugugcuuca

SEQ ID NO: 922456 - RNA, 22 nt, Human
uaguuuuuucaacaaauggugc

SEQ ID NO: 922457 - RNA, 22 nt, Human
gcugugauccuugagagaaggu

SEQ ID NO: 922458 - RNA, 22 nt, Human
uuuaccaagaguugucacuguu

SEQ ID NO: 922459 - RNA, 22 nt, Human
cuucuucugguuuauguggcaa

SEQ ID NO: 922460 - RNA, 22 nt, Human
auaaaagaucccuucugagcuc

SEQ ID NO: 922461 - RNA, 18 nt, Human
cugucagcagcuucacga

SEQ ID NO: 922462 - RNA, 22 nt, Human
ggagggcugagacuggggucug

SEQ ID NO: 922463 - RNA, 22 nt, Human
ugggccaggauuucaagacccu

SEQ ID NO: 922464 - RNA, 22 nt, Human
auagaaauggcagcuggugcua

SEQ ID NO: 922465 - RNA, 22 nt, Human
gcugcagguuugucuagucugg

SEQ ID NO: 922466 - RNA, 22 nt, Human
uuuccacaauguuuuugcagga

SEQ ID NO: 922467 - RNA, 22 nt, Human
ucugucacuuuuauuuacugaa

SEQ ID NO: 922468 - RNA, 22 nt, Human
acaaguuuuugauagacuagaa

SEQ ID NO: 922469 - RNA, 22 nt, Human
uuggaaggugagucccuggguu

SEQ ID NO: 922470 - RNA, 22 nt, Human
aucauuccacauguaccacuag

SEQ ID NO: 922471 - RNA, 22 nt, Human
ugcaggugccucuugagcuugu

SEQ ID NO: 922472 - RNA, 22 nt, Human
auaaauuuauaauuguuuccug

SEQ ID NO: 922473 - RNA, 22 nt, Human
acaauggcaugcuagcaaaugg

SEQ ID NO: 922474 - RNA, 22 nt, Human
gcagcuccuuuaggcugcaaag

SEQ ID NO: 922475 - RNA, 22 nt, Human
uuucauucauguguuaaaggug

SEQ ID NO: 922476 - RNA, 22 nt, Human
caugucaagacugaagauccag

SEQ ID NO: 922477 - RNA, 22 nt, Human
uccagagagauaguggcuaaua

SEQ ID NO: 922478 - RNA, 22 nt, Human
agcucugguauuucuuuaaucc

SEQ ID NO: 922479 - RNA, 22 nt, Human
agcagggcuuuggcuggcuuuc

SEQ ID NO: 922480 - RNA, 17 nt, Human
uuucuagcugugaaccc

SEQ ID NO: 922481 - RNA, 22 nt, Human
ggggcuccagucuucacauuuu

SEQ ID NO: 922482 - RNA, 22 nt, Human
ggugaaggucagagcaggaaaa

SEQ ID NO: 922483 - RNA, 22 nt, Human
gacagggccaaaccggcugauc

SEQ ID NO: 922484 - RNA, 22 nt, Human
aagcagcaugauuguaauacua

SEQ ID NO: 922485 - RNA, 22 nt, Human
ccugauuauuguaaauauauuu

SEQ ID NO: 922486 - RNA, 22 nt, Human
gagacugcauuguccaaggguu

SEQ ID NO: 922487 - RNA, 22 nt, Human
aauguauucucuuuauaagaua

SEQ ID NO: 922488 - RNA, 22 nt, Human
ucugggcugugguuccacuccg

SEQ ID NO: 922489 - RNA, 22 nt, Human
agcuggcauugcagggagcugc

SEQ ID NO: 922490 - RNA, 22 nt, Human
auggaauaauuguuucacagaa

SEQ ID NO: 922491 - RNA, 22 nt, Human
aauauuguuucaagaucacaga

SEQ ID NO: 922492 - RNA, 22 nt, Human
auuggugcauuuuacaaaacuc

SEQ ID NO: 922493 - RNA, 22 nt, Human
gcugcagcuuuaggauccagug

SEQ ID NO: 922494 - RNA, 20 nt, Human
uucaauaugacccuggggag

SEQ ID NO: 922495 - RNA, 22 nt, Human
acugucuucaaaugaauauauu

SEQ ID NO: 922496 - RNA, 22 nt, Human
cuguggcugugaaacuucucag

SEQ ID NO: 922497 - RNA, 22 nt, Human
auaaacacuucuagggcacaca

SEQ ID NO: 922498 - RNA, 22 nt, Human
ucuucacaggagccugccugcc

SEQ ID NO: 922499 - RNA, 21 nt, Human
gguugguguguccaguggcca

SEQ ID NO: 922500 - RNA, 22 nt, Human
gcuucagaaguugggcucugac

SEQ ID NO: 922501 - RNA, 22 nt, Human
uagaaguucaugcgaauuauuu

SEQ ID NO: 922502 - RNA, 22 nt, Human
aggcugucucaccucaggaggg

SEQ ID NO: 922503 - RNA, 22 nt, Human
cugccugccuggagacagaugg

SEQ ID NO: 922504 - RNA, 22 nt, Human
aggcucugaucagguggcugug

SEQ ID NO: 922505 - RNA, 20 nt, Human
ugcagcugguuucacaggga

SEQ ID NO: 922506 - RNA, 19 nt, Human
acugucacauaaaggaagg

SEQ ID NO: 922507 - RNA, 22 nt, Human
uccugggaagacugugaggaca

SEQ ID NO: 922508 - RNA, 22 nt, Human
ucuguguuuuaaacaguagaaa

SEQ ID NO: 922509 - RNA, 22 nt, Human
ucagcugcucuguugagcugaa

SEQ ID NO: 922510 - RNA, 21 nt, Human
uguuuauggaaaagagacaaa

SEQ ID NO: 922511 - RNA, 22 nt, Human
aggguggccaugagggagagau

SEQ ID NO: 922512 - RNA, 22 nt, Human
auuuuaguuuuagcauccaugc

SEQ ID NO: 922513 - RNA, 22 nt, Human
ucacccaggcuggugcgcagug

SEQ ID NO: 922514 - RNA, 22 nt, Human
acugagaagcucgcagugaugc

SEQ ID NO: 922515 - RNA, 22 nt, Human
acaauguucuacauauacauaa

SEQ ID NO: 922516 - RNA, 20 nt, Human
guucucacugaucugcaggg

SEQ ID NO: 922517 - RNA, 22 nt, Human
uucacauuguuuuaaugugaau

SEQ ID NO: 922518 - RNA, 22 nt, Human
gaaggcauaaaaccaauuuugu

SEQ ID NO: 922519 - RNA, 22 nt, Human
ugggccaggcaugugaucagca

SEQ ID NO: 922520 - RNA, 22 nt, Human
uacaaagaggcagcuccauuuu

SEQ ID NO: 922521 - RNA, 22 nt, Human
accuccuggugcccaaguguuu

SEQ ID NO: 922522 - RNA, 22 nt, Human
auugaacugucuuugaagaaau

SEQ ID NO: 922523 - RNA, 22 nt, Human
ucuagaaauuuugccuuguauu

SEQ ID NO: 922524 - RNA, 22 nt, Human
gagaggcuaugagguucugugu

SEQ ID NO: 922525 - RNA, 22 nt, Human
aagacaauuuugaguaugcaca

SEQ ID NO: 922526 - RNA, 22 nt, Human
aaacuguuucccuccauaaccu

SEQ ID NO: 922527 - RNA, 22 nt, Human
caaauacuacgauucuugcagu

SEQ ID NO: 922528 - RNA, 22 nt, Human
gucccugggucuaaggcaguaa

SEQ ID NO: 922529 - RNA, 22 nt, Human
cagcagcucagucucucaguag

SEQ ID NO: 922530 - RNA, 21 nt, Human
ugagcaccagcugcaugcccc

SEQ ID NO: 922531 - RNA, 22 nt, Human
ugucucuuacuuugauucuugg

SEQ ID NO: 922532 - RNA, 22 nt, Human
uccuccagggggaucuucagcc

SEQ ID NO: 922533 - RNA, 22 nt, Human
uacaagagacaccagggaggcu

SEQ ID NO: 922534 - RNA, 22 nt, Human
gguuccuucugaggucccugua

SEQ ID NO: 922535 - RNA, 22 nt, Human
aaaguuugucacuuggcuagaa

SEQ ID NO: 922536 - RNA, 22 nt, Human
uuagcacaggcaacuccacaua

SEQ ID NO: 922537 - RNA, 22 nt, Human
uucccagugauugaacaucccu

SEQ ID NO: 922538 - RNA, 22 nt, Human
gccaggagaaaaggcgaaugau

SEQ ID NO: 922539 - RNA, 22 nt, Human
gcucccugacucaguuccugag

SEQ ID NO: 922540 - RNA, 22 nt, Human
gcugggagugggcaagaugaga

SEQ ID NO: 922541 - RNA, 22 nt, Human
cuggggcuggugaggcaggcuc

SEQ ID NO: 922542 - RNA, 22 nt, Human
gucuuucuuaauucaagugcuu

SEQ ID NO: 922543 - RNA, 22 nt, Human
cuugagguuuugacucagcuuu

SEQ ID NO: 922544 - RNA, 22 nt, Human
ccaaggagcaaggcucaacaag

SEQ ID NO: 922545 - RNA, 22 nt, Human
ggguaaaggucgcccucaaggu

SEQ ID NO: 922546 - RNA, 22 nt, Human
ugaauguuugaugagaaauaga

SEQ ID NO: 922547 - RNA, 22 nt, Human
gccaauuuaucuuacucgugcu

SEQ ID NO: 922548 - RNA, 22 nt, Human
uuucacagcuuccacuuaagga

SEQ ID NO: 922549 - RNA, 23 nt, Human
uacuugguuuugauagaaaucca

SEQ ID NO: 922550 - RNA, 22 nt, Human
agaggccagaaggcgcaccccg

SEQ ID NO: 922551 - RNA, 19 nt, Human
caauucugcaacacugucc

SEQ ID NO: 922552 - RNA, 22 nt, Human
aggggaauggguagacuguuga

SEQ ID NO: 922553 - RNA, 22 nt, Human
gacccugacucuaaugcuuggc

SEQ ID NO: 922554 - RNA, 22 nt, Human
uucccagagaaggaugaaaaag

SEQ ID NO: 922555 - RNA, 22 nt, Human
ccuuuagaauucugccccuccu

SEQ ID NO: 922556 - RNA, 22 nt, Human
ucagacagcuugggauaacuga

SEQ ID NO: 922557 - RNA, 22 nt, Human
ucagugcuuuugucacaugguc

SEQ ID NO: 922558 - RNA, 22 nt, Human
agguauucagagagaugcuuuu

SEQ ID NO: 922559 - RNA, 22 nt, Human
gugggcagugguuugcgcgguc

SEQ ID NO: 922560 - RNA, 22 nt, Human
uuaggaaggccuugaaugccag

SEQ ID NO: 922561 - RNA, 22 nt, Human
gcuuugugugaaguccauggcg

SEQ ID NO: 922562 - RNA, 22 nt, Human
ucaagucuggagaucuggaacu

SEQ ID NO: 922563 - RNA, 22 nt, Human
gaucugggagccucauggagac

SEQ ID NO: 922564 - RNA, 22 nt, Human
uuuagcuauggauaacaaccac

SEQ ID NO: 922565 - RNA, 16 nt, Human
cucuuugggcuuccag

SEQ ID NO: 922566 - RNA, 22 nt, Human
ucacacacauuugcugucugau

SEQ ID NO: 922567 - RNA, 22 nt, Human
uugaaagacauuauuuauauau

SEQ ID NO: 922568 - RNA, 22 nt, Human
cugggagcugaggcugacgcug

SEQ ID NO: 922569 - RNA, 19 nt, Human
uggugcuggccucccaugg

SEQ ID NO: 922570 - RNA, 22 nt, Human
auaggcagacucuuuuuggagg

SEQ ID NO: 922571 - RNA, 22 nt, Human
acacuucagcuccacaaacauu

SEQ ID NO: 922572 - RNA, 22 nt, Human
gucugcugacagagcauggacc

SEQ ID NO: 922573 - RNA, 22 nt, Human
auugaaagguuuugagcagaua

SEQ ID NO: 922574 - RNA, 22 nt, Human
ucugugcugcccaacuucucaa

SEQ ID NO: 922575 - RNA, 22 nt, Human
gcagccaagaccccaagaacug

SEQ ID NO: 922576 - RNA, 22 nt, Human
cauuuagaaacuguuuuuaaca

SEQ ID NO: 922577 - RNA, 22 nt, Human
cugggcuuaggaccuggugcgg

SEQ ID NO: 922578 - RNA, 22 nt, Human
caggccagcguccagaacaagc

SEQ ID NO: 922579 - RNA, 22 nt, Human
gaacagcagcucguucucgaug

SEQ ID NO: 922580 - RNA, 21 nt, Human
agagacagagaaaguaacauu

SEQ ID NO: 922581 - RNA, 21 nt, Human
aacauuucugggagaacucac

SEQ ID NO: 922582 - RNA, 22 nt, Human
ugcagcaguuuaaugcaggguu

SEQ ID NO: 922583 - RNA, 22 nt, Human
ugguaagguuccagaucuagaa

SEQ ID NO: 922584 - RNA, 22 nt, Human
caucacaaauguaauaaugucu

SEQ ID NO: 922585 - RNA, 22 nt, Human
ucugaaauuccuuccagacuuu

SEQ ID NO: 922586 - RNA, 22 nt, Human
auguuacaauccaacaaaauua

SEQ ID NO: 922587 - RNA, 22 nt, Human
cacagaggcucaaagccaggug

SEQ ID NO: 922588 - RNA, 22 nt, Human
aaaagaggaacucuuauauacu

SEQ ID NO: 922589 - RNA, 22 nt, Human
uaagguuugcuuaucuucgccu

SEQ ID NO: 922590 - RNA, 22 nt, Human
uuucaaggugcaggaggguuuu

SEQ ID NO: 922591 - RNA, 22 nt, Human
uuuguuuagagaauugaagcag

SEQ ID NO: 922592 - RNA, 22 nt, Human
cuuugauucagagagaauuagc

SEQ ID NO: 922593 - RNA, 22 nt, Human
aaugucaaaauaauugauuugu

SEQ ID NO: 922594 - RNA, 20 nt, Human
ugggccugagccugugggcu

SEQ ID NO: 922595 - RNA, 17 nt, Human
cagacagauauccuggg

SEQ ID NO: 922596 - RNA, 22 nt, Human
cagugucucccccagguucugu

SEQ ID NO: 922597 - RNA, 22 nt, Human
aaagagcacccucaaugucuga

SEQ ID NO: 922598 - RNA, 22 nt, Human
uuugggaaucuuugugcaugac

SEQ ID NO: 922599 - RNA, 22 nt, Human
cuuauuguguguauuuucuagu

SEQ ID NO: 922600 - RNA, 22 nt, Human
cucuuugggaugggcucugcug

SEQ ID NO: 922601 - RNA, 22 nt, Human
gguuauauaauucagugcuuuc

SEQ ID NO: 922602 - RNA, 22 nt, Human
gaagagcuaaaggcacaggcuu

SEQ ID NO: 922603 - RNA, 20 nt, Human
gcuggaagggcuagagggcu

SEQ ID NO: 922604 - RNA, 22 nt, Human
aaguuuauguugguaagauauc

SEQ ID NO: 922605 - RNA, 22 nt, Human
guguggcaaggugagaaguggg

SEQ ID NO: 922606 - RNA, 22 nt, Human
ucaaugcaacuuccaccuccca

SEQ ID NO: 922607 - RNA, 22 nt, Human
aguaaaugaaagcaauuuuaga

SEQ ID NO: 922608 - RNA, 22 nt, Human
agccaggccuuuucucaagguu

SEQ ID NO: 922609 - RNA, 22 nt, Human
gaacauuugaugaugacauugg

SEQ ID NO: 922610 - RNA, 22 nt, Human
gggucccaggaaggagcagugu

SEQ ID NO: 922611 - RNA, 22 nt, Human
ucauaaaguuguuuuaauggga

SEQ ID NO: 922612 - RNA, 22 nt, Human
augcuauguuugguguuggaga

SEQ ID NO: 922613 - RNA, 22 nt, Human
ucucuucugaaaccugucuuua

SEQ ID NO: 922614 - RNA, 22 nt, Human
guuccuugggaacaacgcugaa

SEQ ID NO: 922615 - RNA, 22 nt, Human
acagagguguguguaggacagu

SEQ ID NO: 922616 - RNA, 22 nt, Human
cugagggcuuccuugucccggg

SEQ ID NO: 922617 - RNA, 22 nt, Human
uguauacauuuggugcauauuu

SEQ ID NO: 922618 - RNA, 22 nt, Human
agagacaugcaguuguugugaa

SEQ ID NO: 922619 - RNA, 22 nt, Human
auacacuacuaagcacagauug

SEQ ID NO: 922620 - RNA, 19 nt, Human
caguggagauuggaggagg

SEQ ID NO: 922621 - RNA, 22 nt, Human
uucuguaagggauuuauucuga

SEQ ID NO: 922622 - RNA, 22 nt, Human
agaggccaccuucucuugagaa

SEQ ID NO: 922623 - RNA, 22 nt, Human
aaugaucccauuuagaaacaga

SEQ ID NO: 922624 - RNA, 22 nt, Human
cugacaggguagacagagggca

SEQ ID NO: 922625 - RNA, 22 nt, Human
agauuugucagcucagucuuua

SEQ ID NO: 922626 - RNA, 22 nt, Human
ucauugaaugagaugcaauaga

SEQ ID NO: 922627 - RNA, 20 nt, Human
auagaaucacaaguccugaa

SEQ ID NO: 922628 - RNA, 22 nt, Human
gcccugcugucuucagaguaua

SEQ ID NO: 922629 - RNA, 22 nt, Human
ccugggagaacugcuggguugg

SEQ ID NO: 922630 - RNA, 22 nt, Human
ucuuuagagcucagaaauacag

SEQ ID NO: 922631 - RNA, 22 nt, Human
gaaacccuuccuagagggcaag

SEQ ID NO: 922632 - RNA, 22 nt, Human
aucuccuuggaucacguuuagu

SEQ ID NO: 922633 - RNA, 22 nt, Human
uuccacaguggcuguaguucug

SEQ ID NO: 922634 - RNA, 22 nt, Human
uauuuauaaucugccaaagaga

SEQ ID NO: 922635 - RNA, 22 nt, Human
ggacugguggcuccuugggcag

SEQ ID NO: 922636 - RNA, 22 nt, Human
ugguccugaucaccgcugggca

SEQ ID NO: 922637 - RNA, 22 nt, Human
uuucaaagguuuugucaugucu

SEQ ID NO: 922638 - RNA, 22 nt, Human
uacaaggaggcuaaugaugaca

SEQ ID NO: 922639 - RNA, 22 nt, Human
uugcaggguugacacugccugc

SEQ ID NO: 922640 - RNA, 22 nt, Human
ugcugcaguucacccugccguc

SEQ ID NO: 922641 - RNA, 19 nt, Human
agcacaguuuccacaugca

SEQ ID NO: 922642 - RNA, 17 nt, Human
aaaauucuguaaagagg

SEQ ID NO: 922643 - RNA, 22 nt, Human
caaauagugucacauugugagg

SEQ ID NO: 922644 - RNA, 22 nt, Human
aggcugccuguuccaaucuccu

SEQ ID NO: 922645 - RNA, 22 nt, Human
aauaauuagugggacagagaac

SEQ ID NO: 922646 - RNA, 22 nt, Human
agaggucagaggucgccagguc

SEQ ID NO: 922647 - RNA, 22 nt, Human
ucucaaacuguguauuauaauu

SEQ ID NO: 922648 - RNA, 22 nt, Human
uagguuuaggagugaaggugaa

SEQ ID NO: 922649 - RNA, 22 nt, Human
cucccuggugacucccaaagcu

SEQ ID NO: 922650 - RNA, 22 nt, Human
ugaauacaggaaaauauacuga

SEQ ID NO: 922651 - RNA, 23 nt, Human
aggcuuccuaucuuagagcuggg

SEQ ID NO: 922652 - RNA, 22 nt, Human
cuuaucuguaaaauggauacaa

SEQ ID NO: 922653 - RNA, 22 nt, Human
cugcucuucccacucacuccca

SEQ ID NO: 922654 - RNA, 22 nt, Human
auuuacagacccucccacuaag

SEQ ID NO: 922655 - RNA, 22 nt, Human
ccugagugaccugaggucuagu

SEQ ID NO: 922656 - RNA, 22 nt, Human
ugacaguaguguuagaacugau

SEQ ID NO: 922657 - RNA, 22 nt, Human
uaaccugacugcucuuuagaau

SEQ ID NO: 922658 - RNA, 22 nt, Human
uaacuaggauuacaagcgugcg

SEQ ID NO: 922659 - RNA, 19 nt, Human
cugugcaggccgggcugag

SEQ ID NO: 922660 - RNA, 22 nt, Human
gauggggaugagaagugagcag

SEQ ID NO: 922661 - RNA, 22 nt, Human
aagaguggagcuggaaaguggg

SEQ ID NO: 922662 - RNA, 22 nt, Human
auuagcaauugcccugugcaau

SEQ ID NO: 922663 - RNA, 22 nt, Human
acacauaagaaacuacaaagag

SEQ ID NO: 922664 - RNA, 21 nt, Human
ugaggcuguuguaccagggag

SEQ ID NO: 922665 - RNA, 22 nt, Human
aaugacaaccacaauggugcug

SEQ ID NO: 922666 - RNA, 22 nt, Human
aggggagcgacauuccgugccg

SEQ ID NO: 922667 - RNA, 22 nt, Human
agagauggagagcacuggggcu

SEQ ID NO: 922668 - RNA, 22 nt, Human
auagauaauguguagcagugau

SEQ ID NO: 922669 - RNA, 19 nt, Human
uccaggcugagagucagcu

SEQ ID NO: 922670 - RNA, 22 nt, Human
aaugcaaauuaucaggcuucuc

SEQ ID NO: 922671 - RNA, 20 nt, Human
ucacacaugguaagcuauga

SEQ ID NO: 922672 - RNA, 16 nt, Human
aucuuccaaaguuauu

SEQ ID NO: 922673 - RNA, 22 nt, Human
ccucuggccauucuuugaugga

SEQ ID NO: 922674 - RNA, 22 nt, Human
guuuaaagucuuggaaggagga

SEQ ID NO: 922675 - RNA, 22 nt, Human
agcuucuugacggauguucugg

SEQ ID NO: 922676 - RNA, 22 nt, Human
uacugcaugaaggcaccuauuu

SEQ ID NO: 922677 - RNA, 22 nt, Human
ugccagcugacagcagagacaa

SEQ ID NO: 922678 - RNA, 22 nt, Human
gucuccacuaaaaacuuucacg

SEQ ID NO: 922679 - RNA, 22 nt, Human
aagcagcacaguaauauuggug

SEQ ID NO: 922680 - RNA, 22 nt, Human
agccugggcccugccucuucuc

SEQ ID NO: 922681 - RNA, 21 nt, Human
ugucugauguauuuuuugccu

SEQ ID NO: 922682 - RNA, 22 nt, Human
aucuuugacugccauucuugac

SEQ ID NO: 922683 - RNA, 22 nt, Human
gcagugaagcaguccuuguuga

SEQ ID NO: 922684 - RNA, 20 nt, Human
ggccggggagcucuccaggg

SEQ ID NO: 922685 - RNA, 22 nt, Human
uuagaauccaugguugcagugg

SEQ ID NO: 922686 - RNA, 22 nt, Human
ucucugggccucaguuuucuca

SEQ ID NO: 922687 - RNA, 22 nt, Human
aucucuaaucaccagcucuagc

SEQ ID NO: 922688 - RNA, 19 nt, Human
uuacaagcauugaaagaaa

SEQ ID NO: 922689 - RNA, 22 nt, Human
agccuuguugcuaccagaugcc

SEQ ID NO: 922690 - RNA, 23 nt, Human
aaggggauacuuccacuuucuuu

SEQ ID NO: 922691 - RNA, 18 nt, Human
gccagagggaagcaggug

SEQ ID NO: 922692 - RNA, 22 nt, Human
aaggguguugaucagagaggau

SEQ ID NO: 922693 - RNA, 22 nt, Human
augaaauauuucagagcagagu

SEQ ID NO: 922694 - RNA, 22 nt, Human
uucuugaugaaugcuaagaacu

SEQ ID NO: 922695 - RNA, 22 nt, Human
ggcaggugccaguuggcuuggg

SEQ ID NO: 922696 - RNA, 22 nt, Human
cucugugugguagauuccauua

SEQ ID NO: 922697 - RNA, 22 nt, Human
ccaaauuaaaucauacagacag

SEQ ID NO: 922698 - RNA, 22 nt, Human
ggcugagcccccucugcguagg

SEQ ID NO: 922699 - RNA, 22 nt, Human
uacagagacccacaagagacug

SEQ ID NO: 922700 - RNA, 22 nt, Human
uuccuuuucuuaaacauaugug

SEQ ID NO: 922701 - RNA, 22 nt, Human
ccccagcacuaccagaagccag

SEQ ID NO: 922702 - RNA, 22 nt, Human
aucaagugaagggcucuugaag

SEQ ID NO: 922703 - RNA, 22 nt, Human
ugugaggagggucaaacugagu

SEQ ID NO: 922704 - RNA, 22 nt, Human
agaauccuggccaggucagagc

SEQ ID NO: 922705 - RNA, 22 nt, Human
aaauggcauagaggugaaggua

SEQ ID NO: 922706 - RNA, 22 nt, Human
aggcaggugggucacuugaguc

SEQ ID NO: 922707 - RNA, 22 nt, Human
cuggacagaaguggcugggcag

SEQ ID NO: 922708 - RNA, 22 nt, Human
gugcccuggcucacagugucuc

SEQ ID NO: 922709 - RNA, 22 nt, Human
cccagcaggcauguugggagga

SEQ ID NO: 922710 - RNA, 22 nt, Human
auggaaauacagccagagcaga

SEQ ID NO: 922711 - RNA, 18 nt, Human
uggcagagugucuguucu

SEQ ID NO: 922712 - RNA, 22 nt, Human
aucaagcuggcauauguaguuc

SEQ ID NO: 922713 - RNA, 22 nt, Human
acacagaggaaagugugaaggg

SEQ ID NO: 922714 - RNA, 17 nt, Human
ccucccacaccgcccug

SEQ ID NO: 922715 - RNA, 19 nt, Human
uccugggcguugacuuugg

SEQ ID NO: 922716 - RNA, 22 nt, Human
agucucuuuguggacucugccu

SEQ ID NO: 922717 - RNA, 21 nt, Human
agcgccugcaacaaggcagau

SEQ ID NO: 922718 - RNA, 22 nt, Human
uuaugcuaaccucaucuucucc

SEQ ID NO: 922719 - RNA, 23 nt, Human
agcaggcaucuguggcacaaggc

SEQ ID NO: 922720 - RNA, 22 nt, Human
acaguuacauuccagcaacauc

SEQ ID NO: 922721 - RNA, 22 nt, Human
cuggugguucaggagaauggcu

SEQ ID NO: 922722 - RNA, 22 nt, Human
cccugcugucccucaguccugc

SEQ ID NO: 922723 - RNA, 22 nt, Human
ugacuuuaagcuaucugauucu

SEQ ID NO: 922724 - RNA, 22 nt, Human
ugcuauuuuguuuucaguccau

SEQ ID NO: 922725 - RNA, 22 nt, Human
gcagacaugaccaccaaccagg

SEQ ID NO: 922726 - RNA, 22 nt, Human
gcaaauguucuauauuugcugu

SEQ ID NO: 922727 - RNA, 22 nt, Human
gaaaacugugauuagaaugccu

SEQ ID NO: 922728 - RNA, 22 nt, Human
cccugagaagaucauugccacg

SEQ ID NO: 922729 - RNA, 22 nt, Human
ugcuccuauccuccugcugaca

SEQ ID NO: 922730 - RNA, 22 nt, Human
ggcaggguuuacaauagcaaua

SEQ ID NO: 922731 - RNA, 22 nt, Human
gagcagcuggaggccuuguugg

SEQ ID NO: 922732 - RNA, 22 nt, Human
uuuuauuaucuuugaaugggac

SEQ ID NO: 922733 - RNA, 22 nt, Human
ucagaguuugaaauaauuuuua

SEQ ID NO: 922734 - RNA, 22 nt, Human
gacagcugccucuguguagauc

SEQ ID NO: 922735 - RNA, 22 nt, Human
ggcuaggccucaggccugccug

SEQ ID NO: 922736 - RNA, 22 nt, Human
augcaaauuaacauauaguaga

SEQ ID NO: 922737 - RNA, 22 nt, Human
cugggauccacgggcucccaag

SEQ ID NO: 922738 - RNA, 22 nt, Human
cugagggcaugaacauuccaua

SEQ ID NO: 922739 - RNA, 22 nt, Human
ugauucuuuggagagcuauaua

SEQ ID NO: 922740 - RNA, 22 nt, Human
acacagugugugcagucggacg

SEQ ID NO: 922741 - RNA, 22 nt, Human
gcauucuuuuugacuccugguu

SEQ ID NO: 922742 - RNA, 22 nt, Human
caggagguggagcucaaguggu

SEQ ID NO: 922743 - RNA, 18 nt, Human
ugagagccugcuuguccc

SEQ ID NO: 922744 - RNA, 22 nt, Human
acagauacagggacuugguauu

SEQ ID NO: 922745 - RNA, 22 nt, Human
cacagggcaccaguuggccauc

SEQ ID NO: 922746 - RNA, 22 nt, Human
uguuuaaccaccauucuauucu

SEQ ID NO: 922747 - RNA, 22 nt, Human
auguauguuucuauauaugaca

SEQ ID NO: 922748 - RNA, 22 nt, Human
uuucuucuugaguaaccagauu

SEQ ID NO: 922749 - RNA, 22 nt, Human
ugcucaggccagccggacagag

SEQ ID NO: 922750 - RNA, 22 nt, Human
aggugcagaaaaaaguccuuua

SEQ ID NO: 922751 - RNA, 22 nt, Human
aucuuuggguacaaacuugccu

SEQ ID NO: 922752 - RNA, 22 nt, Human
agccaagaggagccuaaagcga

SEQ ID NO: 922753 - RNA, 19 nt, Human
ugucugaguaugcugacaa

SEQ ID NO: 922754 - RNA, 22 nt, Human
ugcuuuauaaccauuucugugg

SEQ ID NO: 922755 - RNA, 22 nt, Human
aaaguauguuguggcuuuuaaa

SEQ ID NO: 922756 - RNA, 22 nt, Human
uguggaugagggagugaacaaa

SEQ ID NO: 922757 - RNA, 22 nt, Human
ucccugcuuucuugugagggga

SEQ ID NO: 922758 - RNA, 22 nt, Human
uuucaacagaucugucuucagg

SEQ ID NO: 922759 - RNA, 23 nt, Human
aaauugucguaagguggagaugu

SEQ ID NO: 922760 - RNA, 22 nt, Human
gagcccuuuuccuagauacugu

SEQ ID NO: 922761 - RNA, 22 nt, Human
gaaggagacccugaagaugcug

SEQ ID NO: 922762 - RNA, 22 nt, Human
cacaagaaauaagcugccuuuc

SEQ ID NO: 922763 - RNA, 22 nt, Human
ugguauuuaagacuucacuccu

SEQ ID NO: 922764 - RNA, 22 nt, Human
aggucaggaggccucugccauu

SEQ ID NO: 922765 - RNA, 21 nt, Human
uggaauguaccucccucucuu

SEQ ID NO: 922766 - RNA, 22 nt, Human
acagcagagaacuuuagagggu

SEQ ID NO: 922767 - RNA, 20 nt, Human
cugggcucaagugauccucc

SEQ ID NO: 922768 - RNA, 22 nt, Human
gagagaagggggauaugagccu

SEQ ID NO: 922769 - RNA, 22 nt, Human
cucacauaugcugggauuuccg

SEQ ID NO: 922770 - RNA, 22 nt, Human
auucaaagucuagauguagugu

SEQ ID NO: 922771 - RNA, 22 nt, Human
uauacagauuucugggcaaucu

SEQ ID NO: 922772 - RNA, 22 nt, Human
ccuggcucugagguaugccugg

SEQ ID NO: 922773 - RNA, 22 nt, Human
cucagagcccaggguacacccg

SEQ ID NO: 922774 - RNA, 21 nt, Human
acagcagagaucaagacuaag

SEQ ID NO: 922775 - RNA, 22 nt, Human
gggagacacgcugcaggcauaa

SEQ ID NO: 922776 - RNA, 20 nt, Human
cagcaggaaaagugccucag

SEQ ID NO: 922777 - RNA, 22 nt, Human
auuugucuaaugaguguguacu

SEQ ID NO: 922778 - RNA, 22 nt, Human
ucauuuuugaccauggguagga

SEQ ID NO: 922779 - RNA, 22 nt, Human
ugcaggcauuggugagagaagc

SEQ ID NO: 922780 - RNA, 22 nt, Human
gggaaauuaaugacugguugga

SEQ ID NO: 922781 - RNA, 22 nt, Human
aucaacuuaaagaaaagauacu

SEQ ID NO: 922782 - RNA, 22 nt, Human
uagauaacuugcaccuacagga

SEQ ID NO: 922783 - RNA, 22 nt, Human
gcugcuaagcguuucuguucca

SEQ ID NO: 922784 - RNA, 22 nt, Human
aggacagaaucuauauucaguu

SEQ ID NO: 922785 - RNA, 22 nt, Human
ggggugggagugccauccuuga

SEQ ID NO: 922786 - RNA, 22 nt, Human
uuauaguuaguaggucauuaaa

SEQ ID NO: 922787 - RNA, 22 nt, Human
gccuucaguagugucagcugua

SEQ ID NO: 922788 - RNA, 22 nt, Human
cagguggcuucucccuaggcca

SEQ ID NO: 922789 - RNA, 22 nt, Human
cccacccacucugaccagaagc

SEQ ID NO: 922790 - RNA, 22 nt, Human
aaagaaguguugaauuugcaag

SEQ ID NO: 922791 - RNA, 23 nt, Human
uccuuugucuuugcauagauggu

SEQ ID NO: 922792 - RNA, 23 nt, Human
ugagagccuggcagccuggguuc

SEQ ID NO: 922793 - RNA, 22 nt, Human
aagggcagaaagggacgcuuug

SEQ ID NO: 922794 - RNA, 22 nt, Human
uaaauaagucacugaccauuua

SEQ ID NO: 922795 - RNA, 22 nt, Human
uagucacaaccuucaaguuguc

SEQ ID NO: 922796 - RNA, 22 nt, Human
caggaggaacaagagguucugg

SEQ ID NO: 922797 - RNA, 22 nt, Human
gggaagggagcuggguauuuag

SEQ ID NO: 922798 - RNA, 22 nt, Human
ugcagcugcaggagggugggag

SEQ ID NO: 922799 - RNA, 22 nt, Human
acugagggacucccaccuggca

SEQ ID NO: 922800 - RNA, 21 nt, Human
uccucagggccccagagcacu

SEQ ID NO: 922801 - RNA, 22 nt, Human
augcuucuugagauagaaacac

SEQ ID NO: 922802 - RNA, 22 nt, Human
agacauuuuggaaaguauuacu

SEQ ID NO: 922803 - RNA, 20 nt, Human
gggaggcgagggcugagcag

SEQ ID NO: 922804 - RNA, 22 nt, Human
gagagggcucuguguggguacu

SEQ ID NO: 922805 - RNA, 22 nt, Human
gagugugucggucagcguggcg

SEQ ID NO: 922806 - RNA, 22 nt, Human
uuggaagcccucugcaagaucc

SEQ ID NO: 922807 - RNA, 22 nt, Human
aacaugauuggaaaaugcuguc

SEQ ID NO: 922808 - RNA, 22 nt, Human
auacaguaaccacauucuauag

SEQ ID NO: 922809 - RNA, 22 nt, Human
uaggaagguccaugucuuaucu

SEQ ID NO: 922810 - RNA, 22 nt, Human
ugguggcaugauagugugaaug

SEQ ID NO: 922811 - RNA, 19 nt, Human
gcugucugaugcugagguc

SEQ ID NO: 922812 - RNA, 22 nt, Human
auggccagagaggccagccugg

SEQ ID NO: 922813 - RNA, 23 nt, Human
uggucucagccugugagagcuga

SEQ ID NO: 922814 - RNA, 22 nt, Human
auagccagcauauagcagggag

SEQ ID NO: 922815 - RNA, 22 nt, Human
augaaucuguuuuuugucaaua

SEQ ID NO: 922816 - RNA, 22 nt, Human
agaaguaugugagaaauuaucc

SEQ ID NO: 922817 - RNA, 20 nt, Human
gaaggaagggggcaagguga

SEQ ID NO: 922818 - RNA, 22 nt, Human
cauuugaaauucuuagaacaaa

SEQ ID NO: 922819 - RNA, 22 nt, Human
agcaagacucagcaggauacca

SEQ ID NO: 922820 - RNA, 22 nt, Human
aaggcuuggaccagcuacagug

SEQ ID NO: 922821 - RNA, 22 nt, Human
ggccugcuauuggugggcagac

SEQ ID NO: 922822 - RNA, 22 nt, Human
cagcugugagcagccaguugcc

SEQ ID NO: 922823 - RNA, 22 nt, Human
agaggaggcucugggaucgucc

SEQ ID NO: 922824 - RNA, 22 nt, Human
agcaggaacucagggaguucuc

SEQ ID NO: 922825 - RNA, 22 nt, Human
uuugagaaacagacgaaagaca

SEQ ID NO: 922826 - RNA, 22 nt, Human
agacuauuaccuaaaagauaca

SEQ ID NO: 922827 - RNA, 21 nt, Human
gugcagaggaauguagggggc

SEQ ID NO: 922828 - RNA, 22 nt, Human
auucagcauaaucaguagcuug

SEQ ID NO: 922829 - RNA, 22 nt, Human
uucauguuguaguauguaucag

SEQ ID NO: 922830 - RNA, 22 nt, Human
uaagacagguaguaagaacauu

SEQ ID NO: 922831 - RNA, 22 nt, Human
ucaguggaguauggaugaaguc

SEQ ID NO: 922832 - RNA, 20 nt, Human
aauugcccauccuccuagcc

SEQ ID NO: 922833 - RNA, 22 nt, Human
ucauauuuauauguuggcacag

SEQ ID NO: 922834 - RNA, 21 nt, Human
uuggaaucuuaggaguguggg

SEQ ID NO: 922835 - RNA, 22 nt, Human
cuaggcugcaccuaggauggcu

SEQ ID NO: 922836 - RNA, 22 nt, Human
gccagccagggaagggagagac

SEQ ID NO: 922837 - RNA, 22 nt, Human
aaggaagcagccagagacccuc

SEQ ID NO: 922838 - RNA, 22 nt, Human
agguaaauauaaaucuuacucu

SEQ ID NO: 922839 - RNA, 22 nt, Human
gucuuauuuaaggacaagaaga

SEQ ID NO: 922840 - RNA, 22 nt, Human
aaguugaagcaugaaccaaggu

SEQ ID NO: 922841 - RNA, 21 nt, Human
aagcagcuuaauaaaguaugu

SEQ ID NO: 922842 - RNA, 20 nt, Human
ugcagagcugacauuaccug

SEQ ID NO: 922843 - RNA, 22 nt, Human
cagugcaguggcugagcuggag

SEQ ID NO: 922844 - RNA, 22 nt, Human
gagggaagucauaauguucuag

SEQ ID NO: 922845 - RNA, 21 nt, Human
aggacaggaacuggcugaaua

SEQ ID NO: 922846 - RNA, 22 nt, Human
ugacaaacagggaguuugcuca

SEQ ID NO: 922847 - RNA, 22 nt, Human
auuuacagccuugaaaacagca

SEQ ID NO: 922848 - RNA, 20 nt, Human
aaagcauuuacuugugauug

SEQ ID NO: 922849 - RNA, 21 nt, Human
guugaauauccauguaugugu

SEQ ID NO: 922850 - RNA, 20 nt, Human
cuuagaaauuuuuacccugg

SEQ ID NO: 922851 - RNA, 22 nt, Human
uggcucagaagaaaagguaaac

SEQ ID NO: 922852 - RNA, 20 nt, Human
uggcagaguugucccaccca

SEQ ID NO: 922853 - RNA, 22 nt, Human
agaugcagaguuugcuguggac

SEQ ID NO: 922854 - RNA, 22 nt, Human
aggagggugauccgggcugguc

SEQ ID NO: 922855 - RNA, 22 nt, Human
aagccuuaaauguuucuaauau

SEQ ID NO: 922856 - RNA, 23 nt, Human
uuucuucucgaagagggagcuua

SEQ ID NO: 922857 - RNA, 22 nt, Human
gagcaggcauucuaguggcuga

SEQ ID NO: 922858 - RNA, 17 nt, Human
augugucugaguguccu

SEQ ID NO: 922859 - RNA, 22 nt, Human
caauuucagucucagagaguuc

SEQ ID NO: 922860 - RNA, 22 nt, Human
aaggcugugucagaagcucccu

SEQ ID NO: 922861 - RNA, 22 nt, Human
gcuggaguccaguggcaugauc

SEQ ID NO: 922862 - RNA, 22 nt, Human
auaaagucucauggguaaaugu

SEQ ID NO: 922863 - RNA, 22 nt, Human
gguuuccaaugacaaacacugu

SEQ ID NO: 922864 - RNA, 22 nt, Human
ugucauuaaaaugcuucucaaa

SEQ ID NO: 922865 - RNA, 22 nt, Human
gagggagggacuagcauucucu

SEQ ID NO: 922866 - RNA, 22 nt, Human
agcuguuuccauucuugaguag

SEQ ID NO: 922867 - RNA, 22 nt, Human
cucagacauuuguagaaagugc

SEQ ID NO: 922868 - RNA, 22 nt, Human
gccuguuggugacuuucuguug

SEQ ID NO: 922869 - RNA, 22 nt, Human
cuaagacaugcccugcaugaua

SEQ ID NO: 922870 - RNA, 22 nt, Human
aaaugcaggauuaacagcuuug

SEQ ID NO: 922871 - RNA, 22 nt, Human
aaagcuggcuuuuacaggggcu

SEQ ID NO: 922872 - RNA, 22 nt, Human
ucuucacauucacguaacauag

SEQ ID NO: 922873 - RNA, 22 nt, Human
augggucccuggccgcccucgg

SEQ ID NO: 922874 - RNA, 22 nt, Human
auuuguuccaugaguaaggcua

SEQ ID NO: 922875 - RNA, 22 nt, Human
acagauuuaggacuguagcgau

SEQ ID NO: 922876 - RNA, 22 nt, Human
auguguucacgugcacaugugc

SEQ ID NO: 922877 - RNA, 22 nt, Human
agaaauguugaauacacaaaau

SEQ ID NO: 922878 - RNA, 22 nt, Human
acauucuaugaagauaauuuua

SEQ ID NO: 922879 - RNA, 22 nt, Human
cauacucacuguuguaucuucg

SEQ ID NO: 922880 - RNA, 22 nt, Human
uaugcuuugcaauuggaaaagg

SEQ ID NO: 922881 - RNA, 22 nt, Human
gccagagcagaauagaguggcc

SEQ ID NO: 922882 - RNA, 22 nt, Human
ccuggccagaggcgugccugug

SEQ ID NO: 922883 - RNA, 22 nt, Human
cccucaccaggcuccaggcaug

SEQ ID NO: 922884 - RNA, 22 nt, Human
uugacaaguaauacuuaaauua

SEQ ID NO: 922885 - RNA, 22 nt, Human
ccccauucuggccagcccagcu

SEQ ID NO: 922886 - RNA, 22 nt, Human
acagccugagaguggagcuggc

SEQ ID NO: 922887 - RNA, 22 nt, Human
ccuggccucgugcucacggcuc

SEQ ID NO: 922888 - RNA, 18 nt, Human
auuuugaacaaugcugua

SEQ ID NO: 922889 - RNA, 22 nt, Human
auguacauuauucgagugaugg

SEQ ID NO: 922890 - RNA, 22 nt, Human
acaguuacauuaaacaaaagga

SEQ ID NO: 922891 - RNA, 22 nt, Human
uuuuaugauugagcuggcuaca

SEQ ID NO: 922892 - RNA, 22 nt, Human
cagaagacagagcacuucucuu

SEQ ID NO: 922893 - RNA, 22 nt, Human
ugaaggugaaugucuaugggga

SEQ ID NO: 922894 - RNA, 22 nt, Human
ucucccaggcuggagugcagug

SEQ ID NO: 922895 - RNA, 20 nt, Human
ugaagagugcgcacauugcc

SEQ ID NO: 922896 - RNA, 22 nt, Human
aggcugcugccuuggagagugu

SEQ ID NO: 922897 - RNA, 22 nt, Human
ggcauuugacucagugacuggg

SEQ ID NO: 922898 - RNA, 22 nt, Human
gcuuucugcucuguaaaauggg

SEQ ID NO: 922899 - RNA, 22 nt, Human
ugucagagcaaugagguucagc

SEQ ID NO: 922900 - RNA, 22 nt, Human
gauauuuuuaguauuucugccu

SEQ ID NO: 922901 - RNA, 22 nt, Human
ggccauggucaugggugagcuu

SEQ ID NO: 922902 - RNA, 20 nt, Human
aggcucaggguguuuaggaa

SEQ ID NO: 922903 - RNA, 22 nt, Human
cuggggagacgaucgauguucu

SEQ ID NO: 922904 - RNA, 22 nt, Human
augcauaucagugauuguuugc

SEQ ID NO: 922905 - RNA, 22 nt, Human
aagugguguguuggaagaaauc

SEQ ID NO: 922906 - RNA, 22 nt, Human
uaggaagggcucagggcucggu

SEQ ID NO: 922907 - RNA, 22 nt, Human
agcaggugucggcgagggucuu

SEQ ID NO: 922908 - RNA, 22 nt, Human
ucugcacaggcguagguugacu

SEQ ID NO: 922909 - RNA, 22 nt, Human
caaauguuucuugaacaccaac

SEQ ID NO: 922910 - RNA, 22 nt, Human
ucugagcccucuuuugcagccc

SEQ ID NO: 922911 - RNA, 22 nt, Human
aaaacaggugucagcaaacuau

SEQ ID NO: 922912 - RNA, 22 nt, Human
uuaaaucaguaggcuacuccuu

SEQ ID NO: 922913 - RNA, 22 nt, Human
uauggaugaguuccugaggagu

SEQ ID NO: 922914 - RNA, 22 nt, Human
accaggcccgcugcuauggugg

SEQ ID NO: 922915 - RNA, 22 nt, Human
guaaagcucucauuuaauauca

SEQ ID NO: 922916 - RNA, 22 nt, Human
caguggguaggaaaggcucuuc

SEQ ID NO: 922917 - RNA, 22 nt, Human
ucucacagcaggggccaggucu

SEQ ID NO: 922918 - RNA, 22 nt, Human
auucugaggacagagucuagca

SEQ ID NO: 922919 - RNA, 21 nt, Human
uaguucuacuucagucucaug

SEQ ID NO: 922920 - RNA, 22 nt, Human
uagauuugaaugauguaaagag

SEQ ID NO: 922921 - RNA, 22 nt, Human
ggaggccaugaggcucuaggug

SEQ ID NO: 922922 - RNA, 22 nt, Human
aaagaucagucugaagcaacau

SEQ ID NO: 922923 - RNA, 22 nt, Human
gucugucucucuccagagugca

SEQ ID NO: 922924 - RNA, 21 nt, Human
agcuuguuauuaauucagaac

SEQ ID NO: 922925 - RNA, 22 nt, Human
uggagaauuaggccaaaucucc

SEQ ID NO: 922926 - RNA, 22 nt, Human
ccugcugucaguggggcaggca

SEQ ID NO: 922927 - RNA, 22 nt, Human
cauuuccugucuggaggucaaa

SEQ ID NO: 922928 - RNA, 22 nt, Human
auucucuucugaugucuugcca

SEQ ID NO: 922929 - RNA, 22 nt, Human
auguuucaccagcaaauuaccu

SEQ ID NO: 922930 - RNA, 22 nt, Human
guuuuuauuguguaaauguggg

SEQ ID NO: 922931 - RNA, 22 nt, Human
uacaaccagauccucuaaguca

SEQ ID NO: 922932 - RNA, 22 nt, Human
uaggcuggggguaggaauugag

SEQ ID NO: 922933 - RNA, 22 nt, Human
cuuuccuccacucccuaggcuu

SEQ ID NO: 922934 - RNA, 22 nt, Human
cuacaggucaagcaguagcucu

SEQ ID NO: 922935 - RNA, 22 nt, Human
ugaaggagcugauguaaggggu

SEQ ID NO: 922936 - RNA, 22 nt, Human
uuucugggacuggggagauucu

SEQ ID NO: 922937 - RNA, 20 nt, Human
cagggccacgcuccaaggca

SEQ ID NO: 922938 - RNA, 22 nt, Human
cacagguucaccucagguaggu

SEQ ID NO: 922939 - RNA, 22 nt, Human
aaacagauugaaauucguagua

SEQ ID NO: 922940 - RNA, 19 nt, Human
acaaauaguuacauauccu

SEQ ID NO: 922941 - RNA, 22 nt, Human
aguaagauucuucugaaaaauu

SEQ ID NO: 922942 - RNA, 22 nt, Human
ucuuuauguugauuuccucagg

SEQ ID NO: 922943 - RNA, 22 nt, Human
caaaugauagagccgauuauca

SEQ ID NO: 922944 - RNA, 22 nt, Human
uaaaggcaguucugauuagguc

SEQ ID NO: 922945 - RNA, 22 nt, Human
aaacaaguuuagaauaaugaau

SEQ ID NO: 922946 - RNA, 22 nt, Human
uaacacauaucuacaacaugug

SEQ ID NO: 922947 - RNA, 22 nt, Human
uaguuucuagacaguaagaauu

SEQ ID NO: 922948 - RNA, 22 nt, Human
uagaaacauauaggauggcagg

SEQ ID NO: 922949 - RNA, 22 nt, Human
ugcaggagcccuugggcucugg

SEQ ID NO: 922950 - RNA, 22 nt, Human
aaauccuaauaaugcacuagug

SEQ ID NO: 922951 - RNA, 22 nt, Human
cuuucucuucagcacccagccc

SEQ ID NO: 922952 - RNA, 22 nt, Human
gcaauaaaauguaaugauuggg

SEQ ID NO: 922953 - RNA, 22 nt, Human
ggaggccaugggcagaaucuuu

SEQ ID NO: 922954 - RNA, 22 nt, Human
agaaauuaugcaguaguuuuau

SEQ ID NO: 922955 - RNA, 22 nt, Human
aguaaacacuaaaaugacugcg

SEQ ID NO: 922956 - RNA, 22 nt, Human
caguguuuguauagaauaugca

SEQ ID NO: 922957 - RNA, 22 nt, Human
gggcuugcugauuugggcagga

SEQ ID NO: 922958 - RNA, 19 nt, Human
ccagcagcuuugauucucu

SEQ ID NO: 922959 - RNA, 22 nt, Human
gcuuucuguagguaguuacugu

SEQ ID NO: 922960 - RNA, 22 nt, Human
gcaaagcacacuggagaugucg

SEQ ID NO: 922961 - RNA, 22 nt, Human
ggcugccucaaagcucaagcuc

SEQ ID NO: 922962 - RNA, 22 nt, Human
gagcucccaggccccagcaagg

SEQ ID NO: 922963 - RNA, 22 nt, Human
agugaacaaguuaagaacacua

SEQ ID NO: 922964 - RNA, 22 nt, Human
cugcccugcuggagaucacagu

SEQ ID NO: 922965 - RNA, 22 nt, Human
ugcucaguagcagugugcugcu

SEQ ID NO: 922966 - RNA, 22 nt, Human
uauuaaauguuauuuggguugu

SEQ ID NO: 922967 - RNA, 22 nt, Human
agaagugcuccagugaguuggg

SEQ ID NO: 922968 - RNA, 22 nt, Human
agcagcagggacaaaggaacag

SEQ ID NO: 922969 - RNA, 22 nt, Human
ucuccaggccuuucccaucuua

SEQ ID NO: 922970 - RNA, 22 nt, Human
cugucugcuagaacaucuauac

SEQ ID NO: 922971 - RNA, 22 nt, Human
caaggagaguaauugaaugaga

SEQ ID NO: 922972 - RNA, 22 nt, Human
cuggcccugguaaggacaccca

SEQ ID NO: 922973 - RNA, 18 nt, Human
gagaaaguuugggcagaa

SEQ ID NO: 922974 - RNA, 22 nt, Human
agggggcuccuuggugugcaga

SEQ ID NO: 922975 - RNA, 23 nt, Human
ugcuaaaggcagaauauucaccu

SEQ ID NO: 922976 - RNA, 22 nt, Human
uguauuuauucaggauguaacu

SEQ ID NO: 922977 - RNA, 21 nt, Human
agcugcaggccucccagggau

SEQ ID NO: 922978 - RNA, 22 nt, Human
aaacagcugucauuguuuuaaa

SEQ ID NO: 922979 - RNA, 22 nt, Human
uuuacugaacugcuaguacagg

SEQ ID NO: 922980 - RNA, 22 nt, Human
gagcugcauagcugggauccuc

SEQ ID NO: 922981 - RNA, 23 nt, Human
ucuauacauacugcagccucugg

SEQ ID NO: 922982 - RNA, 22 nt, Human
cuggagagggagcccuggcagu

SEQ ID NO: 922983 - RNA, 22 nt, Human
gccagcuuuggcacaggguggu

SEQ ID NO: 922984 - RNA, 22 nt, Human
aaaaauguuaucuacuguccga

SEQ ID NO: 922985 - RNA, 22 nt, Human
gcaguggcccagcuugcaggcu

SEQ ID NO: 922986 - RNA, 22 nt, Human
guuuuucuaggaccaugugauu

SEQ ID NO: 922987 - RNA, 22 nt, Human
agcugcagcguucauuuuucca

SEQ ID NO: 922988 - RNA, 20 nt, Human
acaauagauuugagcaaagu

SEQ ID NO: 922989 - RNA, 22 nt, Human
ugaggcucacgaacagaagacu

SEQ ID NO: 922990 - RNA, 22 nt, Human
gcuggcagggugguugagagag

SEQ ID NO: 922991 - RNA, 22 nt, Human
cauucuugaaccaggcacugug

SEQ ID NO: 922992 - RNA, 22 nt, Human
aaugcauaccaugucaucuuug

SEQ ID NO: 922993 - RNA, 22 nt, Human
gggggaaagcucaggagccugu

SEQ ID NO: 922994 - RNA, 22 nt, Human
ugcccuguggguaucugauggc

SEQ ID NO: 922995 - RNA, 22 nt, Human
agccccugggaguagcugcugc

SEQ ID NO: 922996 - RNA, 22 nt, Human
cauuccuuaacguggggagucu

SEQ ID NO: 922997 - RNA, 22 nt, Human
gucaggcauuuaggaugaguuc

SEQ ID NO: 922998 - RNA, 22 nt, Human
agcagccagugggagugauaca

SEQ ID NO: 922999 - RNA, 22 nt, Human
accagagagagacaggguugug

SEQ ID NO: 923000 - RNA, 22 nt, Human
uuucuguaauuaaaagggcagg

SEQ ID NO: 923001 - RNA, 22 nt, Human
auuccacaguguguggugagga

SEQ ID NO: 923002 - RNA, 22 nt, Human
gugagcaguuguauaaagacuu

SEQ ID NO: 923003 - RNA, 22 nt, Human
uggcaggaggaugaggcggcua

SEQ ID NO: 923004 - RNA, 22 nt, Human
caguuuaagacaagggggugua

SEQ ID NO: 923005 - RNA, 22 nt, Human
gaaaucuuuucaucucauuuga

SEQ ID NO: 923006 - RNA, 22 nt, Human
gccuggagacagcagaggcggc

SEQ ID NO: 923007 - RNA, 22 nt, Human
ugacaaacucuuugagaacaag

SEQ ID NO: 923008 - RNA, 20 nt, Human
agcaccagugggggcagccc

SEQ ID NO: 923009 - RNA, 22 nt, Human
ccuggcagcauugguagagauu

SEQ ID NO: 923010 - RNA, 22 nt, Human
cauaacuugguguuggaaacug

SEQ ID NO: 923011 - RNA, 22 nt, Human
auuuucagguuuugccauugua

SEQ ID NO: 923012 - RNA, 22 nt, Human
aaauuauuaaacagugggaugc

SEQ ID NO: 923013 - RNA, 22 nt, Human
uggucuuagcuggaaggaggga

SEQ ID NO: 923014 - RNA, 22 nt, Human
auuagaaugcaggguucauugu

SEQ ID NO: 923015 - RNA, 22 nt, Human
agcagcauggcugacuaaagac

SEQ ID NO: 923016 - RNA, 22 nt, Human
ggagggcgacagggcgaccgcg

SEQ ID NO: 923017 - RNA, 22 nt, Human
cccaggagacagaaacagaggu

SEQ ID NO: 923018 - RNA, 22 nt, Human
ggaggggaugguuugacccugg

SEQ ID NO: 923019 - RNA, 22 nt, Human
augaaacucuagcuuucagcac

SEQ ID NO: 923020 - RNA, 22 nt, Human
ggggcugagucagugggaagag

SEQ ID NO: 923021 - RNA, 22 nt, Human
uggaauggaaacaaacugagga

SEQ ID NO: 923022 - RNA, 21 nt, Human
acacaguaacugggcgcaggg

SEQ ID NO: 923023 - RNA, 22 nt, Human
gagcgggaggaacggcucgggc

SEQ ID NO: 923024 - RNA, 22 nt, Human
cccucaggaugcaguggaagug

SEQ ID NO: 923025 - RNA, 22 nt, Human
agcagcaguccuuuguguaauu

SEQ ID NO: 923026 - RNA, 22 nt, Human
ugaaaagucuuauauugucuga

SEQ ID NO: 923027 - RNA, 22 nt, Human
ucugggagcagcucagcagauu

SEQ ID NO: 923028 - RNA, 22 nt, Human
gggagguucuguucgcacuuga

SEQ ID NO: 923029 - RNA, 22 nt, Human
gcaccugguuuauauaaucaua

SEQ ID NO: 923030 - RNA, 22 nt, Human
gagaccccagcucagccuccag

SEQ ID NO: 923031 - RNA, 22 nt, Human
gcagaggagcaaguugcuacag

SEQ ID NO: 923032 - RNA, 20 nt, Human
ugcccagcaagagugcaguu

SEQ ID NO: 923033 - RNA, 19 nt, Human
ugcagcacuaaaaacuuuc

SEQ ID NO: 923034 - RNA, 20 nt, Human
accuccuggaagcaggugcc

SEQ ID NO: 923035 - RNA, 22 nt, Human
uuaauacacuauaugaucacau

SEQ ID NO: 923036 - RNA, 22 nt, Human
aguucacauaucuguuuuauuu

SEQ ID NO: 923037 - RNA, 23 nt, Human
auuuccuacuauaaaagagguaa

SEQ ID NO: 923038 - RNA, 22 nt, Human
aggaaacuaauuaguagaauaa

SEQ ID NO: 923039 - RNA, 22 nt, Human
cuucugaccccuggucuacagc

SEQ ID NO: 923040 - RNA, 22 nt, Human
aacuagcagcuaagacauaauu

SEQ ID NO: 923041 - RNA, 22 nt, Human
cuggcagcuggaggcuagaggc

SEQ ID NO: 923042 - RNA, 22 nt, Human
aaugucuauuugcuacaaagcc

SEQ ID NO: 923043 - RNA, 22 nt, Human
aggcacugggaauaugcugagg

SEQ ID NO: 923044 - RNA, 18 nt, Human
cagcugugcccuguuugg

SEQ ID NO: 923045 - RNA, 22 nt, Human
uugcaaaagccgaggcacucca

SEQ ID NO: 923046 - RNA, 22 nt, Human
auccacccugugguggcuuucu

SEQ ID NO: 923047 - RNA, 22 nt, Human
caggccugaguguggaagucuu

SEQ ID NO: 923048 - RNA, 22 nt, Human
aagccauucaucuaauguccug

SEQ ID NO: 923049 - RNA, 22 nt, Human
agagacaaacacugcaacuucu

SEQ ID NO: 923050 - RNA, 20 nt, Human
ucucccugcccaucucagau

SEQ ID NO: 923051 - RNA, 22 nt, Human
cucaggaugaaagucaugguga

SEQ ID NO: 923052 - RNA, 22 nt, Human
ugcagaggugaaagacuagcaa

SEQ ID NO: 923053 - RNA, 22 nt, Human
ucuucaaaaauacagguuuuca

SEQ ID NO: 923054 - RNA, 22 nt, Human
uuaacucucccuccuuacaucc

SEQ ID NO: 923055 - RNA, 22 nt, Human
ugggugguccaggcucagcaga

SEQ ID NO: 923056 - RNA, 22 nt, Human
uauucauuaugaccaaaucuag

SEQ ID NO: 923057 - RNA, 22 nt, Human
cgcugggggaacuucagccaau

SEQ ID NO: 923058 - RNA, 22 nt, Human
uuuccagaugcuagguugaaag

SEQ ID NO: 923059 - RNA, 22 nt, Human
gggcagugacaaaggggaugaa

SEQ ID NO: 923060 - RNA, 22 nt, Human
aauuccacagcugcacagaggu

SEQ ID NO: 923061 - RNA, 22 nt, Human
cauuugaucuccugaauaaaca

SEQ ID NO: 923062 - RNA, 20 nt, Human
ucuggcaggugaacgagcug

SEQ ID NO: 923063 - RNA, 22 nt, Human
ccugucugcaagggguggaucc

SEQ ID NO: 923064 - RNA, 22 nt, Human
agacagcagcagaggggcuccc

SEQ ID NO: 923065 - RNA, 22 nt, Human
agggcuaggaauggaacuggag

SEQ ID NO: 923066 - RNA, 22 nt, Human
ugcauggauuugacauguguac

SEQ ID NO: 923067 - RNA, 22 nt, Human
uaccccaagagugucugccaug

SEQ ID NO: 923068 - RNA, 22 nt, Human
uauguacacacacaugcaugua

SEQ ID NO: 923069 - RNA, 22 nt, Human
uccccuuuguaagauggaaacg

SEQ ID NO: 923070 - RNA, 22 nt, Human
accagaagcuggagcacaagga

SEQ ID NO: 923071 - RNA, 22 nt, Human
cucaggauagauuguccucuca

SEQ ID NO: 923072 - RNA, 22 nt, Human
gacauaaaauucaauaauuugu

SEQ ID NO: 923073 - RNA, 20 nt, Human
aagauagaauccuaacuuug

SEQ ID NO: 923074 - RNA, 22 nt, Human
agggcuuguuuccuguuucaua

SEQ ID NO: 923075 - RNA, 18 nt, Human
caggucagccuggccuca

SEQ ID NO: 923076 - RNA, 22 nt, Human
ugcagcagguauggcaagcucc

SEQ ID NO: 923077 - RNA, 22 nt, Human
gcccaaagagcuuugaucucag

SEQ ID NO: 923078 - RNA, 20 nt, Human
auccuuggcagaauccagga

SEQ ID NO: 923079 - RNA, 22 nt, Human
aucacaauguacguuaaaaugu

SEQ ID NO: 923080 - RNA, 22 nt, Human
gugacagauuauagggagcguu

SEQ ID NO: 923081 - RNA, 22 nt, Human
cugcccaggggagugcugucgg

SEQ ID NO: 923082 - RNA, 22 nt, Human
uggcagguuaacuuacaacugu

SEQ ID NO: 923083 - RNA, 22 nt, Human
ucagugcuaaaagagcuggugu

SEQ ID NO: 923084 - RNA, 22 nt, Human
cugcaucucugcuagucaguca

SEQ ID NO: 923085 - RNA, 22 nt, Human
aucuagaagucauggcuuucuu

SEQ ID NO: 923086 - RNA, 17 nt, Human
ucagcaguaaugguggg

SEQ ID NO: 923087 - RNA, 22 nt, Human
gcaaagacggacucaggagugc

SEQ ID NO: 923088 - RNA, 22 nt, Human
cuggcuggcugugccccugccg

SEQ ID NO: 923089 - RNA, 22 nt, Human
uuaugaaagacauuucuguugg

SEQ ID NO: 923090 - RNA, 22 nt, Human
cccagggcuguagaauguccaa

SEQ ID NO: 923091 - RNA, 22 nt, Human
ggcugguguuacagucggcagc

SEQ ID NO: 923092 - RNA, 22 nt, Human
aaaugcuuagagguguucaaau

SEQ ID NO: 923093 - RNA, 22 nt, Human
uugauauuagaguauuuguuug

SEQ ID NO: 923094 - RNA, 22 nt, Human
cuuuaguuguaucagucaaguu

SEQ ID NO: 923095 - RNA, 22 nt, Human
aggaggagcagcuuuuugucuc

SEQ ID NO: 923096 - RNA, 22 nt, Human
augaagcaggcacagcuucagg

SEQ ID NO: 923097 - RNA, 22 nt, Human
uguagaaggcuauagacuagga

SEQ ID NO: 923098 - RNA, 22 nt, Human
aagggugggcccuggcagccau

SEQ ID NO: 923099 - RNA, 20 nt, Human
uucuagaaguuugcuaccca

SEQ ID NO: 923100 - RNA, 22 nt, Human
aggcacaggaaugucauccagu

SEQ ID NO: 923101 - RNA, 20 nt, Human
ucucagcauaagaacccuuc

SEQ ID NO: 923102 - RNA, 22 nt, Human
uggcugccuuucaccucaucuc

SEQ ID NO: 923103 - RNA, 22 nt, Human
aacugaaaguuucaccugaggu

SEQ ID NO: 923104 - RNA, 22 nt, Human
cagggcagggccacacccccug

SEQ ID NO: 923105 - RNA, 22 nt, Human
aacaaugaggaucuguucugag

SEQ ID NO: 923106 - RNA, 22 nt, Human
uucacaaagcuggagcauuucc

SEQ ID NO: 923107 - RNA, 22 nt, Human
aaaguagaguuguggaauuacu

SEQ ID NO: 923108 - RNA, 22 nt, Human
gcauuuuucucuccuauaggag

SEQ ID NO: 923109 - RNA, 22 nt, Human
gugcugaggccaaugucagggu

SEQ ID NO: 923110 - RNA, 22 nt, Human
ucagagagguuggugauaagaa

SEQ ID NO: 923111 - RNA, 22 nt, Human
agugcuggcccauagcugcugg

SEQ ID NO: 923112 - RNA, 22 nt, Human
ugaaaucauugccaaguauuga

SEQ ID NO: 923113 - RNA, 22 nt, Human
caggucugagucacauguucau

SEQ ID NO: 923114 - RNA, 21 nt, Human
ugugugugcaggcacacacac

SEQ ID NO: 923115 - RNA, 22 nt, Human
gugugccucccauuagggugua

SEQ ID NO: 923116 - RNA, 22 nt, Human
uggcccuguggcuucagaacag

SEQ ID NO: 923117 - RNA, 22 nt, Human
uccugagagccuuggcuucaga

SEQ ID NO: 923118 - RNA, 19 nt, Human
ccccuuguguaacuagccu

SEQ ID NO: 923119 - RNA, 22 nt, Human
ugcuauuuuuaucuugaucaaa

SEQ ID NO: 923120 - RNA, 22 nt, Human
ggaugggcccgggacggcgcug

SEQ ID NO: 923121 - RNA, 21 nt, Human
uuccacagugagaacugcaag

SEQ ID NO: 923122 - RNA, 22 nt, Human
cugagggagcugcuggccuugg

SEQ ID NO: 923123 - RNA, 22 nt, Human
cccaaggacacgggcagggaca

SEQ ID NO: 923124 - RNA, 22 nt, Human
gaggaacuuaugauauucuacu

SEQ ID NO: 923125 - RNA, 22 nt, Human
acguuaaacauuuagcauagua

SEQ ID NO: 923126 - RNA, 22 nt, Human
aguaucaaucacccuuugaagu

SEQ ID NO: 923127 - RNA, 22 nt, Human
uuucagagccuuuaucucucua

SEQ ID NO: 923128 - RNA, 22 nt, Human
cagugccaaggauggccuggga

SEQ ID NO: 923129 - RNA, 22 nt, Human
aggcccugcccagugccacaag

SEQ ID NO: 923130 - RNA, 22 nt, Human
uacaacauaacgggcauucagu

SEQ ID NO: 923131 - RNA, 22 nt, Human
uguaaacaguaggacuaaagag

SEQ ID NO: 923132 - RNA, 22 nt, Human
uaguuacagagaaaugauuuga

SEQ ID NO: 923133 - RNA, 22 nt, Human
agaagauuaugaauuagagcag

SEQ ID NO: 923134 - RNA, 22 nt, Human
ugucaguuuccugugcccugcu

SEQ ID NO: 923135 - RNA, 22 nt, Human
aaggccuugccugacagcacca

SEQ ID NO: 923136 - RNA, 22 nt, Human
agucccagugagaugaaccagg

SEQ ID NO: 923137 - RNA, 22 nt, Human
acagaauugaagcugaguaaau

SEQ ID NO: 923138 - RNA, 22 nt, Human
ugagagcuguccaccuguggga

SEQ ID NO: 923139 - RNA, 22 nt, Human
aggaaacagugaacuuggcagg

SEQ ID NO: 923140 - RNA, 22 nt, Human
uuucaucauguuggcagauugg

SEQ ID NO: 923141 - RNA, 22 nt, Human
aggcauuuggcugucauuugua

SEQ ID NO: 923142 - RNA, 22 nt, Human
ccaaggacguacaggagauaau

SEQ ID NO: 923143 - RNA, 22 nt, Human
gucucugagcucugagcuggcu

SEQ ID NO: 923144 - RNA, 22 nt, Human
ugccaggcauuugacagacacu

SEQ ID NO: 923145 - RNA, 22 nt, Human
gggcugagccacagcuuuuguu

SEQ ID NO: 923146 - RNA, 22 nt, Human
gaguggcugaguaagaggggag

SEQ ID NO: 923147 - RNA, 22 nt, Human
cuguguccuuuuaguugcugug

SEQ ID NO: 923148 - RNA, 22 nt, Human
ggcaccugucugcucacaguga

SEQ ID NO: 923149 - RNA, 22 nt, Human
auacagcaguuugugauccuag

SEQ ID NO: 923150 - RNA, 22 nt, Human
uucuggaaguuggaaauagcag

SEQ ID NO: 923151 - RNA, 22 nt, Human
cagugcagaggccagggaggau

SEQ ID NO: 923152 - RNA, 22 nt, Human
agaaucugcauuucuaauaagc

SEQ ID NO: 923153 - RNA, 22 nt, Human
ugcagggccuuguugaugugcu

SEQ ID NO: 923154 - RNA, 22 nt, Human
aggcacgagcaauggccgagga

SEQ ID NO: 923155 - RNA, 22 nt, Human
ccgggggcgggacgagcuugac

SEQ ID NO: 923156 - RNA, 22 nt, Human
cucccaggggagucaucugcuu

SEQ ID NO: 923157 - RNA, 22 nt, Human
uucagggcagacagaagagaug

SEQ ID NO: 923158 - RNA, 19 nt, Human
agacacacuuacguggaau

SEQ ID NO: 923159 - RNA, 22 nt, Human
uguuauaacaucgguugacuaa

SEQ ID NO: 923160 - RNA, 22 nt, Human
ucagagguggagauaguuggga

SEQ ID NO: 923161 - RNA, 22 nt, Human
cacaggcuugucagcaugaggc

SEQ ID NO: 923162 - RNA, 22 nt, Human
uagucucuaggaggggaaaaga

SEQ ID NO: 923163 - RNA, 22 nt, Human
ggaagcugggaucucucucccg

SEQ ID NO: 923164 - RNA, 22 nt, Human
auaagcagggucaaaugccuac

SEQ ID NO: 923165 - RNA, 22 nt, Human
aauucauagcaacaaagaccca

SEQ ID NO: 923166 - RNA, 22 nt, Human
gcuguuucucuugagucaaaau

SEQ ID NO: 923167 - RNA, 22 nt, Human
cuccucaguugucccauggaga

SEQ ID NO: 923168 - RNA, 22 nt, Human
ucuugacauucaaucauguaua

SEQ ID NO: 923169 - RNA, 22 nt, Human
uagcagcaaagcaggaucugcu

SEQ ID NO: 923170 - RNA, 22 nt, Human
uguacaaauucaguucuagggu

SEQ ID NO: 923171 - RNA, 22 nt, Human
cugagcuuaacccuguuagcaa

SEQ ID NO: 923172 - RNA, 22 nt, Human
gggacuggaacuacuggugcag

SEQ ID NO: 923173 - RNA, 22 nt, Human
agucuaguaggaucucugggcu

SEQ ID NO: 923174 - RNA, 20 nt, Human
uucucuuuggguccagagaa

SEQ ID NO: 923175 - RNA, 22 nt, Human
cugcagcuuauuugcuguguga

SEQ ID NO: 923176 - RNA, 22 nt, Human
ccucuauagaugugugcaucua

SEQ ID NO: 923177 - RNA, 22 nt, Human
aaaucacuaaguuauagugugg

SEQ ID NO: 923178 - RNA, 22 nt, Human
gcaugcagagaauaccugugau

SEQ ID NO: 923179 - RNA, 22 nt, Human
cugcucuguucccccaucaucu

SEQ ID NO: 923180 - RNA, 22 nt, Human
ucugcacauagguaggcuggaa

SEQ ID NO: 923181 - RNA, 19 nt, Human
ggugugaagugaggaguua

SEQ ID NO: 923182 - RNA, 22 nt, Human
agggcugaccuaagcuccacuu

SEQ ID NO: 923183 - RNA, 20 nt, Human
agaggcuuccuugggaggag

SEQ ID NO: 923184 - RNA, 22 nt, Human
aagaacagguucuagaaccauu

SEQ ID NO: 923185 - RNA, 22 nt, Human
cuaggccaguuaggaagagaag

SEQ ID NO: 923186 - RNA, 22 nt, Human
aggcaggggagcuggaagggua

SEQ ID NO: 923187 - RNA, 22 nt, Human
aguuuuauaucuuccauugguu

SEQ ID NO: 923188 - RNA, 22 nt, Human
ucugacagugugaauauugacu

SEQ ID NO: 923189 - RNA, 22 nt, Human
gcagagguggcaucugggcucu

SEQ ID NO: 923190 - RNA, 22 nt, Human
guagcagcucugagcaugcugc

SEQ ID NO: 923191 - RNA, 22 nt, Human
aggagagucuugagucacuggu

SEQ ID NO: 923192 - RNA, 22 nt, Human
ugugugacccccagugaagccu

SEQ ID NO: 923193 - RNA, 22 nt, Human
uugaggagguaguacagaguau

SEQ ID NO: 923194 - RNA, 22 nt, Human
uuucagagucagcuccucucua

SEQ ID NO: 923195 - RNA, 22 nt, Human
aucaauuuugaggauacaagaa

SEQ ID NO: 923196 - RNA, 22 nt, Human
aguggacauucugcacuuggag

SEQ ID NO: 923197 - RNA, 22 nt, Human
gggcagagaaauggacaguugg

SEQ ID NO: 923198 - RNA, 22 nt, Human
uacagaauauuucugcccugag

SEQ ID NO: 923199 - RNA, 22 nt, Human
aucagugcauccugccacaaag

SEQ ID NO: 923200 - RNA, 22 nt, Human
caggaugcacuaggaaccaggg

SEQ ID NO: 923201 - RNA, 22 nt, Human
ucugaaaugcaggcaauuugcu

SEQ ID NO: 923202 - RNA, 22 nt, Human
acugaauaaggugaaugcucug

SEQ ID NO: 923203 - RNA, 22 nt, Human
acacagagcaaaucaugacaga

SEQ ID NO: 923204 - RNA, 22 nt, Human
gcccucagcuccuggacacaug

SEQ ID NO: 923205 - RNA, 22 nt, Human
cuccucacacccacugcaacca

SEQ ID NO: 923206 - RNA, 22 nt, Human
cucccuggaggcccagaccugg

SEQ ID NO: 923207 - RNA, 20 nt, Human
caccagcagcagcugccacc

SEQ ID NO: 923208 - RNA, 22 nt, Human
ucaggaguacuggugucuacag

SEQ ID NO: 923209 - RNA, 22 nt, Human
cccuuagagggcucuccuuacu

SEQ ID NO: 923210 - RNA, 22 nt, Human
ugagggaggccuccaucugcca

SEQ ID NO: 923211 - RNA, 22 nt, Human
gcuuauuagguuauuucaagga

SEQ ID NO: 923212 - RNA, 22 nt, Human
caggaaauaaaaaguaucuucu

SEQ ID NO: 923213 - RNA, 22 nt, Human
cgggcagaucacacagggcuug

SEQ ID NO: 923214 - RNA, 22 nt, Human
uuucaauaacaaagcucauuuu

SEQ ID NO: 923215 - RNA, 22 nt, Human
ccagugcacagccaggcaggug

SEQ ID NO: 923216 - RNA, 22 nt, Human
cugcaggguuucgccaguugug

SEQ ID NO: 923217 - RNA, 22 nt, Human
gcagcuguggugcugagauagg

SEQ ID NO: 923218 - RNA, 22 nt, Human
uggcccugccacucacugcuga

SEQ ID NO: 923219 - RNA, 22 nt, Human
auucugggacuccuuccucccc

SEQ ID NO: 923220 - RNA, 22 nt, Human
aucuaaacuguuuacucucugc

SEQ ID NO: 923221 - RNA, 22 nt, Human
accaggcuguugggcccagugu

SEQ ID NO: 923222 - RNA, 22 nt, Human
ucugccaguuuauagacaagcc

SEQ ID NO: 923223 - RNA, 22 nt, Human
gcucccagacugaccagaggug

SEQ ID NO: 923224 - RNA, 22 nt, Human
uccaccauguaacaagcucugu

SEQ ID NO: 923225 - RNA, 22 nt, Human
aaaaaugaaacggcugguuggc

SEQ ID NO: 923226 - RNA, 22 nt, Human
guguguauuauugcauacacau

SEQ ID NO: 923227 - RNA, 22 nt, Human
cuggcucacaggugagaugcau

SEQ ID NO: 923228 - RNA, 22 nt, Human
uaucuagagccuggaagucuug

SEQ ID NO: 923229 - RNA, 22 nt, Human
aucuuucaaucaggaaaaaucu

SEQ ID NO: 923230 - RNA, 22 nt, Human
uacaguuuacaugagaggaagc

SEQ ID NO: 923231 - RNA, 22 nt, Human
ugaggccugcauugaacuagaa

SEQ ID NO: 923232 - RNA, 22 nt, Human
ugugaggcuggcaggggccagg

SEQ ID NO: 923233 - RNA, 22 nt, Human
agccaacuaggagauuaaggua

SEQ ID NO: 923234 - RNA, 22 nt, Human
uggugcuggugccacgccccuu

SEQ ID NO: 923235 - RNA, 18 nt, Human
ggccagcuccugaggcag

SEQ ID NO: 923236 - RNA, 22 nt, Human
aaacugucaccuaauguauuuu

SEQ ID NO: 923237 - RNA, 20 nt, Human
ugcagguguuggagaaggua

SEQ ID NO: 923238 - RNA, 22 nt, Human
aaguucaaaaauguaaucagug

SEQ ID NO: 923239 - RNA, 22 nt, Human
acacaacagaagagcaauugca

SEQ ID NO: 923240 - RNA, 22 nt, Human
uuagcagcuuuuaaaugguucu

SEQ ID NO: 923241 - RNA, 22 nt, Human
guugcucaggcaggaguacagu

SEQ ID NO: 923242 - RNA, 22 nt, Human
ucuuucccgccagagcaugagu

SEQ ID NO: 923243 - RNA, 22 nt, Human
uuuuccuaguaggccuauuaga

SEQ ID NO: 923244 - RNA, 22 nt, Human
uuguggcucgugagauguuagg

SEQ ID NO: 923245 - RNA, 20 nt, Human
ucaaguuuugcuugacaaga

SEQ ID NO: 923246 - RNA, 22 nt, Human
gccagcagggaagccuugggcu

SEQ ID NO: 923247 - RNA, 22 nt, Human
uaagccaaaaucaggacacaga

SEQ ID NO: 923248 - RNA, 22 nt, Human
ugaggcuuggcaaaagaguggu

SEQ ID NO: 923249 - RNA, 22 nt, Human
gagccagguuugaaucucaguc

SEQ ID NO: 923250 - RNA, 22 nt, Human
cuccucugucuaccacgagggu

SEQ ID NO: 923251 - RNA, 22 nt, Human
aggacuuccauggauggauugg

SEQ ID NO: 923252 - RNA, 22 nt, Human
ccaagaggcagaaugcagagaa

SEQ ID NO: 923253 - RNA, 21 nt, Human
agcugccugcucuggaccugg

SEQ ID NO: 923254 - RNA, 22 nt, Human
uagcuacaaaucugauaagugg

SEQ ID NO: 923255 - RNA, 23 nt, Human
uggcuucugccccauucucucca

SEQ ID NO: 923256 - RNA, 22 nt, Human
guauauuuugaucacccucuau

SEQ ID NO: 923257 - RNA, 22 nt, Human
augggcagcugcagcaguggug

SEQ ID NO: 923258 - RNA, 22 nt, Human
gccuuggcuguuggagcuugau

SEQ ID NO: 923259 - RNA, 22 nt, Human
ccuccuggugacaaggcaaagc

SEQ ID NO: 923260 - RNA, 23 nt, Human
acucagcuuugggagaugacuca

SEQ ID NO: 923261 - RNA, 22 nt, Human
uguaacaauuucuuacuauugu

SEQ ID NO: 923262 - RNA, 23 nt, Human
gcagacagagcagacuaagacaa

SEQ ID NO: 923263 - RNA, 22 nt, Human
uuuaguguagcauucagaguca

SEQ ID NO: 923264 - RNA, 22 nt, Human
aaggcugguggauuaugagguc

SEQ ID NO: 923265 - RNA, 22 nt, Human
gcaaacauuuggucuagugugu

SEQ ID NO: 923266 - RNA, 22 nt, Human
caagaaugaauucaaugugugg

SEQ ID NO: 923267 - RNA, 22 nt, Human
ucuccaggaagcccucccugac

SEQ ID NO: 923268 - RNA, 22 nt, Human
ccuugagaugagcuaauuuuuu

SEQ ID NO: 923269 - RNA, 22 nt, Human
gggguggccuguaggcagcaug

SEQ ID NO: 923270 - RNA, 22 nt, Human
gaggagugccagccguggaguc

SEQ ID NO: 923271 - RNA, 21 nt, Human
uaucagaagagaaagaaugau

SEQ ID NO: 923272 - RNA, 22 nt, Human
gguguccgcgcuguagaagguc

SEQ ID NO: 923273 - RNA, 22 nt, Human
uucauacauguguacuguucca

SEQ ID NO: 923274 - RNA, 22 nt, Human
uggcuggcuagaauggaaaugu

SEQ ID NO: 923275 - RNA, 22 nt, Human
uaguguguaugguaaugaugaa

SEQ ID NO: 923276 - RNA, 22 nt, Human
aggaugggccugggauaugcuu

SEQ ID NO: 923277 - RNA, 22 nt, Human
ucucuuuaaguauaaucuuaua

SEQ ID NO: 923278 - RNA, 22 nt, Human
agguuucuucuuaggaauaugu

SEQ ID NO: 923279 - RNA, 22 nt, Human
uucauugauaguuuuauguaug

SEQ ID NO: 923280 - RNA, 22 nt, Human
ggacagacagugugagugaggc

SEQ ID NO: 923281 - RNA, 22 nt, Human
uacacacuuacuggagaugaag

SEQ ID NO: 923282 - RNA, 22 nt, Human
gcugagccccccugcguggguc

SEQ ID NO: 923283 - RNA, 22 nt, Human
cugugggccuagucuggccuag

SEQ ID NO: 923284 - RNA, 22 nt, Human
ggagaugcaauguagaaucugg

SEQ ID NO: 923285 - RNA, 22 nt, Human
caaagauaugacauggaaaaug

SEQ ID NO: 923286 - RNA, 22 nt, Human
ccuccuggaaaaauucccuggc

SEQ ID NO: 923287 - RNA, 22 nt, Human
aaauaggaaugugguccuggga

SEQ ID NO: 923288 - RNA, 22 nt, Human
uaauaguuaugguugguucuca

SEQ ID NO: 923289 - RNA, 22 nt, Human
aggcuucagaaagaguaauugg

SEQ ID NO: 923290 - RNA, 22 nt, Human
gcuggagaugcuaugcagaggg

SEQ ID NO: 923291 - RNA, 19 nt, Human
augcaucugcauugacagg

SEQ ID NO: 923292 - RNA, 22 nt, Human
agcugggaggugggcagugaga

SEQ ID NO: 923293 - RNA, 22 nt, Human
caggaaagggaugggcugccac

SEQ ID NO: 923294 - RNA, 22 nt, Human
aggggcuccucucugagaguag

SEQ ID NO: 923295 - RNA, 22 nt, Human
gacugagguauuaagauggcuu

SEQ ID NO: 923296 - RNA, 20 nt, Human
accauaauguuaauuacaaa

SEQ ID NO: 923297 - RNA, 22 nt, Human
uacaguuucucauuaugcucuc

SEQ ID NO: 923298 - RNA, 22 nt, Human
agccccaguucccuggaagucu

SEQ ID NO: 923299 - RNA, 22 nt, Human
guuugccugugauguacauuuc

SEQ ID NO: 923300 - RNA, 22 nt, Human
caggcccuggcagggcugaguc

SEQ ID NO: 923301 - RNA, 22 nt, Human
aauuaguaaccuaauuccaucu

SEQ ID NO: 923302 - RNA, 22 nt, Human
ccccucuggucaaccagucaca

SEQ ID NO: 923303 - RNA, 22 nt, Human
acacugugacaagaaagagcug

SEQ ID NO: 923304 - RNA, 22 nt, Human
augucuucucuguagguaaauu

SEQ ID NO: 923305 - RNA, 22 nt, Human
uggggcuggggaucuugagccu

SEQ ID NO: 923306 - RNA, 22 nt, Human
cugcugucuuuauuucacugcu

SEQ ID NO: 923307 - RNA, 22 nt, Human
cucuucaguuguugcauauucu

SEQ ID NO: 923308 - RNA, 22 nt, Human
uaaaauagcuuaugucuuuuga

SEQ ID NO: 923309 - RNA, 22 nt, Human
cuucuggagcucaccaacuucc

SEQ ID NO: 923310 - RNA, 23 nt, Human
cuccccaguguccucaugcaucu

SEQ ID NO: 923311 - RNA, 22 nt, Human
aaaugaugcuacaguuuuccca

SEQ ID NO: 923312 - RNA, 22 nt, Human
cugcccugggaguaccuguccu

SEQ ID NO: 923313 - RNA, 22 nt, Human
aggacagcaguuggugagguuc

SEQ ID NO: 923314 - RNA, 20 nt, Human
cagagccaagagcagcaucu

SEQ ID NO: 923315 - RNA, 22 nt, Human
aacuuucuuggaugucucaaca

SEQ ID NO: 923316 - RNA, 22 nt, Human
cuggauaaaugcuuuaguugga

SEQ ID NO: 923317 - RNA, 22 nt, Human
ugucugugacagaccuuugcua

SEQ ID NO: 923318 - RNA, 19 nt, Human
gccagcacccagcuguguc

SEQ ID NO: 923319 - RNA, 22 nt, Human
cugaaauucugccucugcacaa

SEQ ID NO: 923320 - RNA, 22 nt, Human
ucucaagcuuguugguauguuu

SEQ ID NO: 923321 - RNA, 22 nt, Human
cagcagcagcuuaguggucccc

SEQ ID NO: 923322 - RNA, 22 nt, Human
agcuuuauauuuaaugaauucu

SEQ ID NO: 923323 - RNA, 22 nt, Human
ucucugggcccagaccuuccuu

SEQ ID NO: 923324 - RNA, 18 nt, Human
uccagagagggagaagug

SEQ ID NO: 923325 - RNA, 22 nt, Human
ccaaugaauauauuucauauga

SEQ ID NO: 923326 - RNA, 22 nt, Human
gggccagacccuuggcgaucug

SEQ ID NO: 923327 - RNA, 22 nt, Human
ugcugggcaucguaggagguac

SEQ ID NO: 923328 - RNA, 22 nt, Human
aaagguuuugguaaggcuuuaa

SEQ ID NO: 923329 - RNA, 22 nt, Human
aaaucucugcaggcaaauguga

SEQ ID NO: 923330 - RNA, 22 nt, Human
caguuuaaggcaggacauggga

SEQ ID NO: 923331 - RNA, 22 nt, Human
ccuuugugguggcccagugugg

SEQ ID NO: 923332 - RNA, 22 nt, Human
cuuuaguuuaagaacaugauga

SEQ ID NO: 923333 - RNA, 22 nt, Human
cugaggagaaagaugguccaag

SEQ ID NO: 923334 - RNA, 22 nt, Human
uguggcagcuggagguggagaa

SEQ ID NO: 923335 - RNA, 22 nt, Human
cugucugugaccucugcauguc

SEQ ID NO: 923336 - RNA, 22 nt, Human
cauuagcauuacuucaaagagu

SEQ ID NO: 923337 - RNA, 22 nt, Human
ugcaacaguggggcaugcugaa

SEQ ID NO: 923338 - RNA, 21 nt, Human
gcugccaccgcgugcuccagg

SEQ ID NO: 923339 - RNA, 22 nt, Human
agagcagcugugacauggacag

SEQ ID NO: 923340 - RNA, 22 nt, Human
acaguucacuuuuuauaucaaa

SEQ ID NO: 923341 - RNA, 22 nt, Human
cucagcagaggcaguauucagu

SEQ ID NO: 923342 - RNA, 22 nt, Human
uucacaggugagcauuaggccg

SEQ ID NO: 923343 - RNA, 22 nt, Human
ugccaaauugaauuacauaauu

SEQ ID NO: 923344 - RNA, 22 nt, Human
ugaggaagugguuguaugguuu

SEQ ID NO: 923345 - RNA, 22 nt, Human
gggauggaucuuggcugaggcu

SEQ ID NO: 923346 - RNA, 22 nt, Human
cagcaguucaauccagugcacg

SEQ ID NO: 923347 - RNA, 22 nt, Human
uucucuuuugugaugugagaug

SEQ ID NO: 923348 - RNA, 22 nt, Human
auuucauguaaauggaaugaua

SEQ ID NO: 923349 - RNA, 22 nt, Human
agagccugggcagcuccucugg

SEQ ID NO: 923350 - RNA, 22 nt, Human
acagagcuuaauucaggagcuu

SEQ ID NO: 923351 - RNA, 22 nt, Human
uuucagaaccaagagagacauc

SEQ ID NO: 923352 - RNA, 22 nt, Human
uuacacagacauggcaucauga

SEQ ID NO: 923353 - RNA, 22 nt, Human
aucagagggugagauggagaaa

SEQ ID NO: 923354 - RNA, 23 nt, Human
gggaagcuccauggaggugcugg

SEQ ID NO: 923355 - RNA, 22 nt, Human
cuguccucaacccauccuucuc

SEQ ID NO: 923356 - RNA, 22 nt, Human
ugcuguggcaguuuauguauag

SEQ ID NO: 923357 - RNA, 22 nt, Human
uggcaguguccuacugguuggu

SEQ ID NO: 923358 - RNA, 22 nt, Human
auucucugaagucuuucagggc

SEQ ID NO: 923359 - RNA, 22 nt, Human
ugccaggcccugugcuggaugc

SEQ ID NO: 923360 - RNA, 22 nt, Human
auuuucaagggagaggccucug

SEQ ID NO: 923361 - RNA, 22 nt, Human
uagagcugauaaugaggccaag

SEQ ID NO: 923362 - RNA, 22 nt, Human
aagaucuauuaugagucagguc

SEQ ID NO: 923363 - RNA, 22 nt, Human
auuagccuccuugucucaugcg

SEQ ID NO: 923364 - RNA, 22 nt, Human
agcaacagaagauagagugaau

SEQ ID NO: 923365 - RNA, 22 nt, Human
ugugugacacauugauaugugc

SEQ ID NO: 923366 - RNA, 22 nt, Human
uagcacaagaaguacacauaga

SEQ ID NO: 923367 - RNA, 23 nt, Human
ggggacaguucccacuggggucu

SEQ ID NO: 923368 - RNA, 22 nt, Human
uucaucaauguguuuaauaaug

SEQ ID NO: 923369 - RNA, 22 nt, Human
ggaagauucagcauauaugagu

SEQ ID NO: 923370 - RNA, 22 nt, Human
auucacaaagaagggaaguaca

SEQ ID NO: 923371 - RNA, 22 nt, Human
auuuccuaggugcucgagugcu

SEQ ID NO: 923372 - RNA, 22 nt, Human
ggcagauggggugacaagagag

SEQ ID NO: 923373 - RNA, 22 nt, Human
accaggaguugggggugggacc

SEQ ID NO: 923374 - RNA, 22 nt, Human
uuucuucucuaaucucaaugau

SEQ ID NO: 923375 - RNA, 22 nt, Human
aggccugagguuccugugcuca

SEQ ID NO: 923376 - RNA, 22 nt, Human
aagagcuuggacuuucaaguca

SEQ ID NO: 923377 - RNA, 22 nt, Human
cugguggcaucuugagacgguu

SEQ ID NO: 923378 - RNA, 22 nt, Human
aaaugcaaguucauauuuuguu

SEQ ID NO: 923379 - RNA, 22 nt, Human
cucagcccagcucaggucuuuc

SEQ ID NO: 923380 - RNA, 22 nt, Human
aggaaccagacagaacugaaug

SEQ ID NO: 923381 - RNA, 22 nt, Human
ggcagcaaacuggcuucaggcu

SEQ ID NO: 923382 - RNA, 20 nt, Human
ggggaagaaaaggaugugau

SEQ ID NO: 923383 - RNA, 22 nt, Human
ugugagaguugagauauuuugc

SEQ ID NO: 923384 - RNA, 17 nt, Human
ugauaguucauuuuaag

SEQ ID NO: 923385 - RNA, 22 nt, Human
uguaugcaucuuugauaaauag

SEQ ID NO: 923386 - RNA, 22 nt, Human
ucaggaagcauccugagguguc

SEQ ID NO: 923387 - RNA, 21 nt, Human
gagugucuaauccaggcuguc

SEQ ID NO: 923388 - RNA, 22 nt, Human
cagaaacacuguauuuagggaa

SEQ ID NO: 923389 - RNA, 22 nt, Human
uuccaacaauguguuauuguuc

SEQ ID NO: 923390 - RNA, 22 nt, Human
ccugcccuaugaccagcuucac

SEQ ID NO: 923391 - RNA, 22 nt, Human
aaagucuuaauguaaguuuagu

SEQ ID NO: 923392 - RNA, 22 nt, Human
agauauaauaauuuacaagugu

SEQ ID NO: 923393 - RNA, 22 nt, Human
cucuggccugcuuccucaggua

SEQ ID NO: 923394 - RNA, 22 nt, Human
gcuguccagagcaugggagcaa

SEQ ID NO: 923395 - RNA, 22 nt, Human
uccaguggcaggcggugagguc

SEQ ID NO: 923396 - RNA, 22 nt, Human
agccagcuggagaccacuguuu

SEQ ID NO: 923397 - RNA, 22 nt, Human
cugcaguuugcuaagagacaaa

SEQ ID NO: 923398 - RNA, 22 nt, Human
uauguguguuucaguggaaaug

SEQ ID NO: 923399 - RNA, 22 nt, Human
gaguggcuccaauuugguccua

SEQ ID NO: 923400 - RNA, 22 nt, Human
ucuccagggacugaggcuggag

SEQ ID NO: 923401 - RNA, 22 nt, Human
agagcuggggccagagucaagg

SEQ ID NO: 923402 - RNA, 22 nt, Human
cagugccacuuaaugaggcugc

SEQ ID NO: 923403 - RNA, 22 nt, Human
cauucaaaagcuccauguuugu

SEQ ID NO: 923404 - RNA, 22 nt, Human
uguggcagaaccagaauucaaa

SEQ ID NO: 923405 - RNA, 22 nt, Human
aaaucucaaaggcuuagcaucu

SEQ ID NO: 923406 - RNA, 22 nt, Human
aggcuguccucucuugcucagu

SEQ ID NO: 923407 - RNA, 22 nt, Human
ugagcuggagucgugagcaaag

SEQ ID NO: 923408 - RNA, 22 nt, Human
uggcagcacuagguacugagcu

SEQ ID NO: 923409 - RNA, 22 nt, Human
gggcuucugcucuuuuggugcu

SEQ ID NO: 923410 - RNA, 22 nt, Human
ucaacccuugugcaacagugau

SEQ ID NO: 923411 - RNA, 20 nt, Human
gccagcacagggagcaguuc

SEQ ID NO: 923412 - RNA, 22 nt, Human
cuaggaaaugaauacaguacac

SEQ ID NO: 923413 - RNA, 22 nt, Human
gaggccagaguuccccgaguca

SEQ ID NO: 923414 - RNA, 22 nt, Human
cagcugugucuaauuauggcug

SEQ ID NO: 923415 - RNA, 22 nt, Human
uggcagaaguacacaagcaugc

SEQ ID NO: 923416 - RNA, 22 nt, Human
gggcucuuuucugagcuucacu

SEQ ID NO: 923417 - RNA, 22 nt, Human
uucuggagacccagcaacaggg

SEQ ID NO: 923418 - RNA, 17 nt, Human
gcuccaggcgugaguga

SEQ ID NO: 923419 - RNA, 22 nt, Human
aaaccuagaaggaagggucucu

SEQ ID NO: 923420 - RNA, 22 nt, Human
agguggcucugacagcucuggu

SEQ ID NO: 923421 - RNA, 22 nt, Human
cugaggccuggccccaccacag

SEQ ID NO: 923422 - RNA, 22 nt, Human
aaaauacuguggaguguugaaa

SEQ ID NO: 923423 - RNA, 22 nt, Human
gucauuuuuuucguaauagugg

SEQ ID NO: 923424 - RNA, 22 nt, Human
ccuuuuauagaucaguguguua

SEQ ID NO: 923425 - RNA, 22 nt, Human
gugcaugaagcaggcagcuccu

SEQ ID NO: 923426 - RNA, 22 nt, Human
ugucugggucaccccuccuggc

SEQ ID NO: 923427 - RNA, 22 nt, Human
uggcucaguuucugcccagcug

SEQ ID NO: 923428 - RNA, 22 nt, Human
ggagccuggucagguuggcucc

SEQ ID NO: 923429 - RNA, 22 nt, Human
gcugccccccggacucggcggg

SEQ ID NO: 923430 - RNA, 22 nt, Human
cacacaggcaggaucccuuccc

SEQ ID NO: 923431 - RNA, 22 nt, Human
ucuuuguuuguacuguuagaau

SEQ ID NO: 923432 - RNA, 22 nt, Human
cauguuaaguguuugauaacca

SEQ ID NO: 923433 - RNA, 22 nt, Human
ucuucacaaagcuguuguuaaa

SEQ ID NO: 923434 - RNA, 22 nt, Human
cagcuccagccugacaccaaga

SEQ ID NO: 923435 - RNA, 22 nt, Human
gagccagugaucagacagggag

SEQ ID NO: 923436 - RNA, 22 nt, Human
acagcuguggccacuugcaucc

SEQ ID NO: 923437 - RNA, 22 nt, Human
acagaaaugauguuuggcaaua

SEQ ID NO: 923438 - RNA, 22 nt, Human
gugggcaaggucccugccagcu

SEQ ID NO: 923439 - RNA, 22 nt, Human
uuauguucagcaucugcuuuau

SEQ ID NO: 923440 - RNA, 22 nt, Human
agcacaaaagcagccacagaug

SEQ ID NO: 923441 - RNA, 22 nt, Human
aucugcaucagacuuugcauga

SEQ ID NO: 923442 - RNA, 22 nt, Human
uaguacaguuuuggcacaugga

SEQ ID NO: 923443 - RNA, 22 nt, Human
ggccaccucugcccuacugagu

SEQ ID NO: 923444 - RNA, 22 nt, Human
uggcauuuccucagugcucaga

SEQ ID NO: 923445 - RNA, 22 nt, Human
uguggccagggggccauguccc

SEQ ID NO: 923446 - RNA, 22 nt, Human
ggccuuagagaccaccuagucu

SEQ ID NO: 923447 - RNA, 17 nt, Human
uucugacccuagagcuc

SEQ ID NO: 923448 - RNA, 20 nt, Human
cuggggagccucgcgguggc

SEQ ID NO: 923449 - RNA, 22 nt, Human
uguggggaagaguaugacuugg

SEQ ID NO: 923450 - RNA, 22 nt, Human
aauagacuccagggucuauuuu

SEQ ID NO: 923451 - RNA, 22 nt, Human
gaggaaacauuguagaagcagu

SEQ ID NO: 923452 - RNA, 22 nt, Human
acuggcuggaguugccaaggcu

SEQ ID NO: 923453 - RNA, 22 nt, Human
auauacacuccacugauacagg

SEQ ID NO: 923454 - RNA, 22 nt, Human
uuuauuuauccuucuggauugc

SEQ ID NO: 923455 - RNA, 22 nt, Human
cugagcagcagggagacuggug

SEQ ID NO: 923456 - RNA, 22 nt, Human
auuuaagacugacuucaccagu

SEQ ID NO: 923457 - RNA, 22 nt, Human
agagaaggguguagccugggcc

SEQ ID NO: 923458 - RNA, 22 nt, Human
ggaagcuguugugagugcagca

SEQ ID NO: 923459 - RNA, 22 nt, Human
guacaaaugagaguucuguuuu

SEQ ID NO: 923460 - RNA, 22 nt, Human
agggucugaccaccaguaggga

SEQ ID NO: 923461 - RNA, 22 nt, Human
uguauuuuuagaccuuuagacc

SEQ ID NO: 923462 - RNA, 22 nt, Human
auuccucauuuguugagaacca

SEQ ID NO: 923463 - RNA, 17 nt, Human
ccaggagcgugggucuc

SEQ ID NO: 923464 - RNA, 22 nt, Human
ggaauguuuuucauugcucucu

SEQ ID NO: 923465 - RNA, 19 nt, Human
aagccagcugccagcucgg

SEQ ID NO: 923466 - RNA, 22 nt, Human
aguguugucaaacggcucagca

SEQ ID NO: 923467 - RNA, 22 nt, Human
cauuuuacugacucuugaauua

SEQ ID NO: 923468 - RNA, 22 nt, Human
ccaaggcacacucugcaagguu

SEQ ID NO: 923469 - RNA, 20 nt, Human
caauagaauguggagauaag

SEQ ID NO: 923470 - RNA, 19 nt, Human
agcagggagugguuguggg

SEQ ID NO: 923471 - RNA, 22 nt, Human
gcaagggugugaaccaaugaga

SEQ ID NO: 923472 - RNA, 22 nt, Human
ucaggagguccgcccgggaggg

SEQ ID NO: 923473 - RNA, 22 nt, Human
uguuuucugaugguuaaugagu

SEQ ID NO: 923474 - RNA, 22 nt, Human
gaggcagagguuguugcaguga

SEQ ID NO: 923475 - RNA, 23 nt, Human
uccagcucccuucaauggcacug

SEQ ID NO: 923476 - RNA, 22 nt, Human
uggccaggccggggacagaacu

SEQ ID NO: 923477 - RNA, 22 nt, Human
cugugagagugguggccuaggc

SEQ ID NO: 923478 - RNA, 20 nt, Human
gauggauuucaacaccuuuc

SEQ ID NO: 923479 - RNA, 22 nt, Human
uguuccagaggcagagauagga

SEQ ID NO: 923480 - RNA, 22 nt, Human
aagacuugaccagguugaaggc

SEQ ID NO: 923481 - RNA, 22 nt, Human
uucugcacaaauuuuagguuau

SEQ ID NO: 923482 - RNA, 23 nt, Human
uuauaaauauuuucagguguguu

SEQ ID NO: 923483 - RNA, 22 nt, Human
ugaacaaauggaaauaaccagu

SEQ ID NO: 923484 - RNA, 22 nt, Human
gggccacaggccuugcccgcag

SEQ ID NO: 923485 - RNA, 20 nt, Human
uacaguguauguauuuaggc

SEQ ID NO: 923486 - RNA, 22 nt, Human
caggcuggaguuaccuuuaggg

SEQ ID NO: 923487 - RNA, 22 nt, Human
ggugggaaggggccagugugcg

SEQ ID NO: 923488 - RNA, 22 nt, Human
ggugucugugauggcauauaac

SEQ ID NO: 923489 - RNA, 22 nt, Human
cacagcccugcgccccaguuug

SEQ ID NO: 923490 - RNA, 22 nt, Human
uuaaagagguaguuagguuuaa

SEQ ID NO: 923491 - RNA, 22 nt, Human
cucagcaggcacugugccuuac

SEQ ID NO: 923492 - RNA, 19 nt, Human
ggugcugacaucaugcuuu

SEQ ID NO: 923493 - RNA, 22 nt, Human
acauccucggggaaaggcacug

SEQ ID NO: 923494 - RNA, 22 nt, Human
uaaacaggccccagggagguug

SEQ ID NO: 923495 - RNA, 22 nt, Human
auggaauauagucuuauaucuc

SEQ ID NO: 923496 - RNA, 22 nt, Human
aauugucuugaaagcaacacuu

SEQ ID NO: 923497 - RNA, 21 nt, Human
cagagccuguguugacaguug

SEQ ID NO: 923498 - RNA, 22 nt, Human
aagcaugggaaucccacagggu

SEQ ID NO: 923499 - RNA, 22 nt, Human
gacaauaagaaaagaggaggca

SEQ ID NO: 923500 - RNA, 22 nt, Human
agcuuaaaguauuuaaauuuca

SEQ ID NO: 923501 - RNA, 22 nt, Human
acauggcucagucucaugacag

SEQ ID NO: 923502 - RNA, 22 nt, Human
ugacauuuaucaaagaaauggu

SEQ ID NO: 923503 - RNA, 22 nt, Human
gaacaauagugguaacaaagcc

SEQ ID NO: 923504 - RNA, 22 nt, Human
cggagggguuugaacagaggag

SEQ ID NO: 923505 - RNA, 22 nt, Human
ugagcuggucuugaguguagcu

SEQ ID NO: 923506 - RNA, 22 nt, Human
gcacugggggcagcagugaggg

SEQ ID NO: 923507 - RNA, 22 nt, Human
uacuuuuaugugaugaaaucug

SEQ ID NO: 923508 - RNA, 19 nt, Human
gcacacccugcaccaccau

SEQ ID NO: 923509 - RNA, 22 nt, Human
uuccuggcacauaguuagugcu

SEQ ID NO: 923510 - RNA, 22 nt, Human
caucauuuguuugcaugcagga

SEQ ID NO: 923511 - RNA, 22 nt, Human
guguccauguuguucaggguga

SEQ ID NO: 923512 - RNA, 22 nt, Human
auagcauggccaggaagcuggg

SEQ ID NO: 923513 - RNA, 22 nt, Human
aggggagaggugagcaacuucu

SEQ ID NO: 923514 - RNA, 22 nt, Human
agaucacagucaauugcaaguu

SEQ ID NO: 923515 - RNA, 22 nt, Human
gcagcaggagaguuuguccugc

SEQ ID NO: 923516 - RNA, 22 nt, Human
cugguccccagacugggcuuag

SEQ ID NO: 923517 - RNA, 22 nt, Human
agcugagggcaggaugggguga

SEQ ID NO: 923518 - RNA, 22 nt, Human
aaguuuaagguggaaguggugg

SEQ ID NO: 923519 - RNA, 22 nt, Human
uugaaaggcacaggcaccuggg

SEQ ID NO: 923520 - RNA, 22 nt, Human
gucacuuucacacuuuauugcu

SEQ ID NO: 923521 - RNA, 22 nt, Human
cccacucccugcacgccugccg

SEQ ID NO: 923522 - RNA, 22 nt, Human
uuacauuuuaguuaaccuguga

SEQ ID NO: 923523 - RNA, 22 nt, Human
gggaugagaguagggugugaaa

SEQ ID NO: 923524 - RNA, 22 nt, Human
gccaggagcccugggcaaguuc

SEQ ID NO: 923525 - RNA, 22 nt, Human
agaggcugucucauauuuugua

SEQ ID NO: 923526 - RNA, 22 nt, Human
ugagcagcaacuguccauggca

SEQ ID NO: 923527 - RNA, 22 nt, Human
aucauuuaugccccaauuagau

SEQ ID NO: 923528 - RNA, 22 nt, Human
aaagacauuagauuaacguaca

SEQ ID NO: 923529 - RNA, 22 nt, Human
augagaaggacauaaauuauag

SEQ ID NO: 923530 - RNA, 22 nt, Human
uagauaaauuagaaaguuuacu

SEQ ID NO: 923531 - RNA, 22 nt, Human
uagcagcuaccuggcuaagagu

SEQ ID NO: 923532 - RNA, 22 nt, Human
cuuauuguucagauagagauga

SEQ ID NO: 923533 - RNA, 22 nt, Human
uguagcauuuuauguaauaagu

SEQ ID NO: 923534 - RNA, 22 nt, Human
ugcucagacaagcugaacagua

SEQ ID NO: 923535 - RNA, 22 nt, Human
uauacaauggcugaaucaucca

SEQ ID NO: 923536 - RNA, 22 nt, Human
gaagaagggagugacaaaugca

SEQ ID NO: 923537 - RNA, 18 nt, Human
uggaggcagaguucuggc

SEQ ID NO: 923538 - RNA, 22 nt, Human
cucucugggcccaguuggcacc

SEQ ID NO: 923539 - RNA, 22 nt, Human
gagagaccucagaaacaaucua

SEQ ID NO: 923540 - RNA, 22 nt, Human
aagucuugaugaucuccuccuu

SEQ ID NO: 923541 - RNA, 17 nt, Human
ucuguucaugcauaccu

SEQ ID NO: 923542 - RNA, 22 nt, Human
ggcugagcaauuuugaugacau

SEQ ID NO: 923543 - RNA, 22 nt, Human
ggacagcauucuacuguaggca

SEQ ID NO: 923544 - RNA, 22 nt, Human
auagccuugacucacagcucuu

SEQ ID NO: 923545 - RNA, 22 nt, Human
cuaauguaaugauauguugaau

SEQ ID NO: 923546 - RNA, 22 nt, Human
gccucuggucccucaugcugug

SEQ ID NO: 923547 - RNA, 22 nt, Human
uuauuuguggcauaugagacga

SEQ ID NO: 923548 - RNA, 22 nt, Human
aaugcauuagcuacauaugucu

SEQ ID NO: 923549 - RNA, 22 nt, Human
ccucaaagcgguaugcagacgg

SEQ ID NO: 923550 - RNA, 22 nt, Human
gugacgugaggggcuccuguug

SEQ ID NO: 923551 - RNA, 22 nt, Human
gcagugaguuaugaucaugcca

SEQ ID NO: 923552 - RNA, 22 nt, Human
gcaggugguccccguggagugg

SEQ ID NO: 923553 - RNA, 22 nt, Human
gagagagaaccccgugcccuuc

SEQ ID NO: 923554 - RNA, 22 nt, Human
uugggccugaucggaauaagga

SEQ ID NO: 923555 - RNA, 22 nt, Human
auggcccagacucagacuggug

SEQ ID NO: 923556 - RNA, 22 nt, Human
uugggcugaucuguggaagaag

SEQ ID NO: 923557 - RNA, 22 nt, Human
acauuucucaucuaguagagua

SEQ ID NO: 923558 - RNA, 22 nt, Human
cacagaggauuuuuagggcagu

SEQ ID NO: 923559 - RNA, 22 nt, Human
gccacagcggggccgcuagagc

SEQ ID NO: 923560 - RNA, 22 nt, Human
aaugaugucgaaaaguaagcuc

SEQ ID NO: 923561 - RNA, 17 nt, Human
aucucucuaaggcaggc

SEQ ID NO: 923562 - RNA, 18 nt, Human
ucauuuugucugccuuug

SEQ ID NO: 923563 - RNA, 22 nt, Human
ucagugcucugagguccagggu

SEQ ID NO: 923564 - RNA, 22 nt, Human
cgugaaaugaguugaauuauug

SEQ ID NO: 923565 - RNA, 22 nt, Human
uccaggccacugcagaggcucu

SEQ ID NO: 923566 - RNA, 22 nt, Human
uaacagaauuugcuaaacuccg

SEQ ID NO: 923567 - RNA, 22 nt, Human
gcagggcugggugggagacaga

SEQ ID NO: 923568 - RNA, 22 nt, Human
ccagccuugacugccccagcac

SEQ ID NO: 923569 - RNA, 22 nt, Human
ccaggugggcgugucuucaccu

SEQ ID NO: 923570 - RNA, 22 nt, Human
caugcaagaagauagauuaaau

SEQ ID NO: 923571 - RNA, 22 nt, Human
ugaacaugcuguugauggccug

SEQ ID NO: 923572 - RNA, 20 nt, Human
ugaaauaaggaguuguccuu

SEQ ID NO: 923573 - RNA, 22 nt, Human
guuagugugacugaggaaugca

SEQ ID NO: 923574 - RNA, 22 nt, Human
uaaaggccagggccugagugcu

SEQ ID NO: 923575 - RNA, 20 nt, Human
gacacaggcaguccucagag

SEQ ID NO: 923576 - RNA, 22 nt, Human
cggcagagugugugcgugcaug

SEQ ID NO: 923577 - RNA, 22 nt, Human
agucaggauuuaaacucagaca

SEQ ID NO: 923578 - RNA, 22 nt, Human
cagaacugggcucgcucugguu

SEQ ID NO: 923579 - RNA, 21 nt, Human
agcagcagggaagccucaucc

SEQ ID NO: 923580 - RNA, 17 nt, Human
agcagaagucagaggga

SEQ ID NO: 923581 - RNA, 22 nt, Human
ggcccagccuggcaacaaugac

SEQ ID NO: 923582 - RNA, 22 nt, Human
auuuagguagcugucuaagugu

SEQ ID NO: 923583 - RNA, 22 nt, Human
aacucuagugcuccuuggagga

SEQ ID NO: 923584 - RNA, 23 nt, Human
ugcaacaaugaggaaagcuacug

SEQ ID NO: 923585 - RNA, 22 nt, Human
caguaaaaauguugucaaggca

SEQ ID NO: 923586 - RNA, 22 nt, Human
uguuuccauggugacagcagcu

SEQ ID NO: 923587 - RNA, 22 nt, Human
acacuuuaucaauauucaaaaa

SEQ ID NO: 923588 - RNA, 22 nt, Human
caugcaggucuggagcuugggg

SEQ ID NO: 923589 - RNA, 22 nt, Human
gcagcuggcucugggaaaaacu

SEQ ID NO: 923590 - RNA, 22 nt, Human
ccaggagggaccgcggcauccc

SEQ ID NO: 923591 - RNA, 22 nt, Human
uucaguagggcccucacacagu

SEQ ID NO: 923592 - RNA, 22 nt, Human
uggcuccacucuccaggaguuu

SEQ ID NO: 923593 - RNA, 22 nt, Human
cugugcuuucaaaagaaggguu

SEQ ID NO: 923594 - RNA, 22 nt, Human
uaacaaaguaccauagauuggg

SEQ ID NO: 923595 - RNA, 22 nt, Human
uugaaaggugacauuguuagag

SEQ ID NO: 923596 - RNA, 22 nt, Human
cagcucccgccaucgggaggca

SEQ ID NO: 923597 - RNA, 22 nt, Human
agggaaucuaggcucagagugc

SEQ ID NO: 923598 - RNA, 22 nt, Human
augcuuagguuaaauuuguaau

SEQ ID NO: 923599 - RNA, 22 nt, Human
gcaaaugcucuccagccugggu

SEQ ID NO: 923600 - RNA, 22 nt, Human
guucucucagccuuuguuauua

SEQ ID NO: 923601 - RNA, 21 nt, Human
auaagcaugcugauuacauuu

SEQ ID NO: 923602 - RNA, 22 nt, Human
uuuacaagaaaucaugaugcua

SEQ ID NO: 923603 - RNA, 21 nt, Human
uggaaaacauuuaaauagcaa

SEQ ID NO: 923604 - RNA, 22 nt, Human
agcuuucuaguuuagccaucuu

SEQ ID NO: 923605 - RNA, 22 nt, Human
ggcagucaagagggagucugaa

SEQ ID NO: 923606 - RNA, 22 nt, Human
ucuuuucauugagaacacacug

SEQ ID NO: 923607 - RNA, 22 nt, Human
aaucucuuguauuuccuuugac

SEQ ID NO: 923608 - RNA, 22 nt, Human
aucaagaguuauauuucauagu

SEQ ID NO: 923609 - RNA, 22 nt, Human
ugccucagucuaaagucucuca

SEQ ID NO: 923610 - RNA, 22 nt, Human
gccagcugaggccgugcaggcu

SEQ ID NO: 923611 - RNA, 19 nt, Human
gcaggucauuaggcuaggu

SEQ ID NO: 923612 - RNA, 22 nt, Human
ucauuuuugucuccgguuugug

SEQ ID NO: 923613 - RNA, 22 nt, Human
cauaagaagguaacauccuuaa

SEQ ID NO: 923614 - RNA, 19 nt, Human
ggucagcugggcuagaggc

SEQ ID NO: 923615 - RNA, 22 nt, Human
ugaacauugucacauuccuagc

SEQ ID NO: 923616 - RNA, 22 nt, Human
auuuuuuagccaagacucugca

SEQ ID NO: 923617 - RNA, 22 nt, Human
aauucaaagccgcuugggaauc

SEQ ID NO: 923618 - RNA, 22 nt, Human
uccgggcaacugaagggagguu

SEQ ID NO: 923619 - RNA, 22 nt, Human
cagcagaaauggauuuugagau

SEQ ID NO: 923620 - RNA, 22 nt, Human
ggcccugggacacaacaccgaa

SEQ ID NO: 923621 - RNA, 22 nt, Human
ggaggccaagucacugaccugg

SEQ ID NO: 923622 - RNA, 22 nt, Human
aaauacuguugaaugaaguaag

SEQ ID NO: 923623 - RNA, 16 nt, Human
gcugggagggagaggu

SEQ ID NO: 923624 - RNA, 22 nt, Human
ccaauacacuuuauagaagaaa

SEQ ID NO: 923625 - RNA, 19 nt, Human
ccagcccugucacuucuug

SEQ ID NO: 923626 - RNA, 22 nt, Human
agggaaggaaaagcugucgcuu

SEQ ID NO: 923627 - RNA, 22 nt, Human
cugagagguaagcagcgcagug

SEQ ID NO: 923628 - RNA, 22 nt, Human
aucagcucauuuugauggaaau

SEQ ID NO: 923629 - RNA, 22 nt, Human
ggccugagucacaucaggagag

SEQ ID NO: 923630 - RNA, 22 nt, Human
acacaugugauucuaagacagc

SEQ ID NO: 923631 - RNA, 22 nt, Human
agcgagguuuugcagauacagc

SEQ ID NO: 923632 - RNA, 22 nt, Human
gaaucuuuuuucuugccaggca

SEQ ID NO: 923633 - RNA, 22 nt, Human
cccagagcugggugggcagcgg

SEQ ID NO: 923634 - RNA, 22 nt, Human
ggcauuugagccauuggccugu

SEQ ID NO: 923635 - RNA, 20 nt, Human
acagauacccugugcuggug

SEQ ID NO: 923636 - RNA, 22 nt, Human
cagaggcuuugcccuggaaacc

SEQ ID NO: 923637 - RNA, 22 nt, Human
cagggugcauacccaugcauac

SEQ ID NO: 923638 - RNA, 22 nt, Human
ugugcuuuucucugcuccugga

SEQ ID NO: 923639 - RNA, 22 nt, Human
uggcagguuuccuccucauagu

SEQ ID NO: 923640 - RNA, 22 nt, Human
gacccuccacucacugcugugu

SEQ ID NO: 923641 - RNA, 22 nt, Human
uuccugguuuauaccuguauca

SEQ ID NO: 923642 - RNA, 22 nt, Human
gugaaacacccuccaaugcaca

SEQ ID NO: 923643 - RNA, 22 nt, Human
aggaggugcuguuuguccugga

SEQ ID NO: 923644 - RNA, 20 nt, Human
aucugcuugccuguccucgg

SEQ ID NO: 923645 - RNA, 22 nt, Human
gacugcaaccuuagacuagaaa

SEQ ID NO: 923646 - RNA, 22 nt, Human
ucuaaggucaggggaaaguuug

SEQ ID NO: 923647 - RNA, 22 nt, Human
ugggcaggauaauaucucaugu

SEQ ID NO: 923648 - RNA, 22 nt, Human
agguauuucaaagcccacuucc

SEQ ID NO: 923649 - RNA, 22 nt, Human
cagucuggaucugugcugcugu

SEQ ID NO: 923650 - RNA, 22 nt, Human
ugcugggcuggagcugccaggg

SEQ ID NO: 923651 - RNA, 21 nt, Human
uccuggcuuuaugcuaccucu

SEQ ID NO: 923652 - RNA, 22 nt, Human
ccugugcccuacaccuuuccag

SEQ ID NO: 923653 - RNA, 22 nt, Human
ccaggugugccagcagggacug

SEQ ID NO: 923654 - RNA, 22 nt, Human
aguuuucagaaauugcgaccca

SEQ ID NO: 923655 - RNA, 22 nt, Human
uuaaagcuggcguuacaguuug

SEQ ID NO: 923656 - RNA, 22 nt, Human
cugcugucgccgagcugcaugc

SEQ ID NO: 923657 - RNA, 22 nt, Human
ucugaagaaauacagcuggggu

SEQ ID NO: 923658 - RNA, 22 nt, Human
ucauacaagaucacuuuggcca

SEQ ID NO: 923659 - RNA, 22 nt, Human
ucauugaguucaaauccuucau

SEQ ID NO: 923660 - RNA, 21 nt, Human
gggugggaggacacagcaggc

SEQ ID NO: 923661 - RNA, 22 nt, Human
uacuguucaugccuucauaaag

SEQ ID NO: 923662 - RNA, 22 nt, Human
ucucaggcacugggugccaacu

SEQ ID NO: 923663 - RNA, 22 nt, Human
caugcauaugucaaaaaagcua

SEQ ID NO: 923664 - RNA, 22 nt, Human
acuggcagagguuggacaccau

SEQ ID NO: 923665 - RNA, 21 nt, Human
gccugggaagagaaagguaag

SEQ ID NO: 923666 - RNA, 22 nt, Human
acugccuucuuggccuucaaaa

SEQ ID NO: 923667 - RNA, 22 nt, Human
gaauuucaagcagugcaauguu

SEQ ID NO: 923668 - RNA, 22 nt, Human
uggcucaggugugagcugaaga

SEQ ID NO: 923669 - RNA, 22 nt, Human
ugcuuaaaggauaguuuaaacu

SEQ ID NO: 923670 - RNA, 22 nt, Human
aaacaguuucuaaucauggaga

SEQ ID NO: 923671 - RNA, 22 nt, Human
ggaugaggaagauuacugagaa

SEQ ID NO: 923672 - RNA, 22 nt, Human
ccugggcugggcgucucauggg

SEQ ID NO: 923673 - RNA, 22 nt, Human
accccucaucaguugcuuccua

SEQ ID NO: 923674 - RNA, 22 nt, Human
cuggcagguggauggggacucc

SEQ ID NO: 923675 - RNA, 22 nt, Human
agcagggcuucugugccugugc

SEQ ID NO: 923676 - RNA, 22 nt, Human
ugcccagcgcccacauucuguc

SEQ ID NO: 923677 - RNA, 22 nt, Human
cacagagacagaagcacuuaug

SEQ ID NO: 923678 - RNA, 22 nt, Human
acacagugguguuuacaaaauu

SEQ ID NO: 923679 - RNA, 22 nt, Human
caugcuuuuuucuaguauaaau

SEQ ID NO: 923680 - RNA, 22 nt, Human
uucagagcaucucuaaagccag

SEQ ID NO: 923681 - RNA, 20 nt, Human
ugggugccugccacggggcc

SEQ ID NO: 923682 - RNA, 22 nt, Human
ucaggcagaguggaagcugcaa

SEQ ID NO: 923683 - RNA, 22 nt, Human
aaaauuuuacugguguuuccuu

SEQ ID NO: 923684 - RNA, 22 nt, Human
uuucuauugaucuaauaaacau

SEQ ID NO: 923685 - RNA, 20 nt, Human
uccccagggcaucaggagca

SEQ ID NO: 923686 - RNA, 22 nt, Human
uugauucugcugaucucggacg

SEQ ID NO: 923687 - RNA, 22 nt, Human
gacaaggcaaccagggaggcuu

SEQ ID NO: 923688 - RNA, 22 nt, Human
gagcaccaaggcucugccaugg

SEQ ID NO: 923689 - RNA, 22 nt, Human
cucaccauggaucuuccauuuc

SEQ ID NO: 923690 - RNA, 22 nt, Human
agaggccaccagagguggugcc

SEQ ID NO: 923691 - RNA, 22 nt, Human
ggcagggaagcuggcaucacgg

SEQ ID NO: 923692 - RNA, 18 nt, Human
aagugacuggcaggccaa

SEQ ID NO: 923693 - RNA, 22 nt, Human
uccuggaggcaaaugaagacuc

SEQ ID NO: 923694 - RNA, 22 nt, Human
acauuuaaccaaacuguuuaau

SEQ ID NO: 923695 - RNA, 22 nt, Human
ugccacagacaggacagaacag

SEQ ID NO: 923696 - RNA, 22 nt, Human
uuaacauuucuuuuccacucau

SEQ ID NO: 923697 - RNA, 18 nt, Human
uuuuggugaggaagugag

SEQ ID NO: 923698 - RNA, 22 nt, Human
uagucucugcuuugcccuuggc

SEQ ID NO: 923699 - RNA, 22 nt, Human
gggcaugguggugcacaccugu

SEQ ID NO: 923700 - RNA, 22 nt, Human
cagcauucuacuuugugaacug

SEQ ID NO: 923701 - RNA, 21 nt, Human
agauggcucccaggucucugg

SEQ ID NO: 923702 - RNA, 19 nt, Human
gucucugcuccagggucuc

SEQ ID NO: 923703 - RNA, 22 nt, Human
ucccuugugagaacauguguug

SEQ ID NO: 923704 - RNA, 22 nt, Human
augagguaugaagugugggaua

SEQ ID NO: 923705 - RNA, 22 nt, Human
gacuuuauaaaugagaggcgga

SEQ ID NO: 923706 - RNA, 22 nt, Human
uagaagagacauagccuguggu

SEQ ID NO: 923707 - RNA, 22 nt, Human
gcaggggcuaaggacacagaga

SEQ ID NO: 923708 - RNA, 23 nt, Human
agaucacaugcugauggaaaaug

SEQ ID NO: 923709 - RNA, 22 nt, Human
aaacaguuuugccaaaaggaca

SEQ ID NO: 923710 - RNA, 22 nt, Human
ugcuggcccuggcucagggaac

SEQ ID NO: 923711 - RNA, 22 nt, Human
caguaacugaugugaucaaacg

SEQ ID NO: 923712 - RNA, 22 nt, Human
uuuccucugcugccauugcccc

SEQ ID NO: 923713 - RNA, 22 nt, Human
aacuacagugggcagaggcaau

SEQ ID NO: 923714 - RNA, 22 nt, Human
caucagaauagcucuguggaua

SEQ ID NO: 923715 - RNA, 22 nt, Human
caagagcucaccggagagcauu

SEQ ID NO: 923716 - RNA, 22 nt, Human
agugucugcggcggggaggcgg

SEQ ID NO: 923717 - RNA, 22 nt, Human
uuacaaaguguuaugauaaaca

SEQ ID NO: 923718 - RNA, 22 nt, Human
guucugaguggcccaagcccug

SEQ ID NO: 923719 - RNA, 22 nt, Human
gaaguucucagcuaggugaugu

SEQ ID NO: 923720 - RNA, 22 nt, Human
uugcaccaaaugaguuaaaauu

SEQ ID NO: 923721 - RNA, 22 nt, Human
cucuggagaacgcuauggaucu

SEQ ID NO: 923722 - RNA, 22 nt, Human
caggagguuguaagagcaggcc

SEQ ID NO: 923723 - RNA, 22 nt, Human
ugucacaauaucccaaucugcc

SEQ ID NO: 923724 - RNA, 22 nt, Human
aagggcugccagggggugccag

SEQ ID NO: 923725 - RNA, 22 nt, Human
auaguaugagcucauacacuug

SEQ ID NO: 923726 - RNA, 22 nt, Human
cuggcccuauuccaggccuucc

SEQ ID NO: 923727 - RNA, 22 nt, Human
ugggaacugcagguguuacaua

SEQ ID NO: 923728 - RNA, 22 nt, Human
uguccugugccaccuuccugag

SEQ ID NO: 923729 - RNA, 22 nt, Human
uucagagaauuggauaauucgu

SEQ ID NO: 923730 - RNA, 22 nt, Human
auuucacauuaauuugaugcuc

SEQ ID NO: 923731 - RNA, 22 nt, Human
uagacauuucugguuauugaca

SEQ ID NO: 923732 - RNA, 20 nt, Human
gcucagggccugggucugga

SEQ ID NO: 923733 - RNA, 22 nt, Human
gucuuuuuuacaccuuacauca

SEQ ID NO: 923734 - RNA, 22 nt, Human
cagauggauuuuguaggcugau

SEQ ID NO: 923735 - RNA, 22 nt, Human
gauucagcuucugagcaguaau

SEQ ID NO: 923736 - RNA, 22 nt, Human
cugggcugucccaaccccaucc

SEQ ID NO: 923737 - RNA, 18 nt, Human
acaaaugugucacaggaa

SEQ ID NO: 923738 - RNA, 22 nt, Human
agaagccacugcucccagugag

SEQ ID NO: 923739 - RNA, 22 nt, Human
ccugugcccugccaggcuggug

SEQ ID NO: 923740 - RNA, 22 nt, Human
ccccagcugagauuugaggaga

SEQ ID NO: 923741 - RNA, 22 nt, Human
caacacauugaagcuaugauga

SEQ ID NO: 923742 - RNA, 22 nt, Human
aggaaggguucuuugugaaaga

SEQ ID NO: 923743 - RNA, 22 nt, Human
cugggccacaagccugugugau

SEQ ID NO: 923744 - RNA, 22 nt, Human
agacaacaccaaaugcuagugu

SEQ ID NO: 923745 - RNA, 22 nt, Human
ggaagcacugaggcagagaggg

SEQ ID NO: 923746 - RNA, 22 nt, Human
cuuuaugaaggaacaaugcucc

SEQ ID NO: 923747 - RNA, 22 nt, Human
acucugugccaggcacuuuggg

SEQ ID NO: 923748 - RNA, 20 nt, Human
cugggcugcccagcuauggg

SEQ ID NO: 923749 - RNA, 20 nt, Human
aguguuucucaacauggggc

SEQ ID NO: 923750 - RNA, 22 nt, Human
cuggaaagugcugagacaauug

SEQ ID NO: 923751 - RNA, 22 nt, Human
ccagagagcuacaaggcauaaa

SEQ ID NO: 923752 - RNA, 22 nt, Human
cauaaaguauagaucugugggu

SEQ ID NO: 923753 - RNA, 22 nt, Human
gaggauggugagcaggacccag

SEQ ID NO: 923754 - RNA, 18 nt, Human
ggagggcuuuggggacug

SEQ ID NO: 923755 - RNA, 22 nt, Human
aguuccaccauuuaggaucugu

SEQ ID NO: 923756 - RNA, 22 nt, Human
uuugaaaggagcuuuauccaga

SEQ ID NO: 923757 - RNA, 22 nt, Human
cccauuuaugacuacacaggug

SEQ ID NO: 923758 - RNA, 22 nt, Human
cuagaaauguagauucuuagug

SEQ ID NO: 923759 - RNA, 22 nt, Human
uucuaaugaaaucuguacagua

SEQ ID NO: 923760 - RNA, 22 nt, Human
cagacaggaauucuggcguggu

SEQ ID NO: 923761 - RNA, 22 nt, Human
ucauuucaguuguucccugguu

SEQ ID NO: 923762 - RNA, 22 nt, Human
gaugugugcugcauaguauauu

SEQ ID NO: 923763 - RNA, 22 nt, Human
ugccugugucacagugauguuu

SEQ ID NO: 923764 - RNA, 22 nt, Human
aggcugugcauuuuggagggcc

SEQ ID NO: 923765 - RNA, 22 nt, Human
ucagaaucuuucuagagucuag

SEQ ID NO: 923766 - RNA, 22 nt, Human
aaugucauugugaguuaggcuu

SEQ ID NO: 923767 - RNA, 22 nt, Human
gugcacuuugggagucucagug

SEQ ID NO: 923768 - RNA, 22 nt, Human
aucagagguuauguggagggga

SEQ ID NO: 923769 - RNA, 22 nt, Human
caacaguuuauaguguuaucuu

SEQ ID NO: 923770 - RNA, 20 nt, Human
cgcccaggagggcccaugug

SEQ ID NO: 923771 - RNA, 22 nt, Human
aguccaaaucuuguuucauauc

SEQ ID NO: 923772 - RNA, 22 nt, Human
cuaucuuuuguucauuuugagu

SEQ ID NO: 923773 - RNA, 22 nt, Human
caaagcagagaacugucucauu

SEQ ID NO: 923774 - RNA, 22 nt, Human
ucuggaguuccugcaggcugug

SEQ ID NO: 923775 - RNA, 22 nt, Human
ucuagaaaguacuagagcuggu

SEQ ID NO: 923776 - RNA, 22 nt, Human
agggucagcuggcugucagggg

SEQ ID NO: 923777 - RNA, 22 nt, Human
cagugucugggacagaaaguca

SEQ ID NO: 923778 - RNA, 20 nt, Human
cagggcacacugcagccucg

SEQ ID NO: 923779 - RNA, 22 nt, Human
uccaaauagcuggaugauggug

SEQ ID NO: 923780 - RNA, 22 nt, Human
acacucugugaggcauguaaug

SEQ ID NO: 923781 - RNA, 22 nt, Human
aggccagugccuuuccagggcu

SEQ ID NO: 923782 - RNA, 22 nt, Human
acuguaaagagguguaucuuua

SEQ ID NO: 923783 - RNA, 22 nt, Human
auucaacuauguauagucuucu

SEQ ID NO: 923784 - RNA, 22 nt, Human
ucucauaaacucaguuuucuca

SEQ ID NO: 923785 - RNA, 22 nt, Human
cuuguucugugcuucuuacauu

SEQ ID NO: 923786 - RNA, 22 nt, Human
uuacaauguaaggcaugguucu

SEQ ID NO: 923787 - RNA, 22 nt, Human
uauuuccaaaagccuauuauga

SEQ ID NO: 923788 - RNA, 22 nt, Human
cagugcuguguuugcugccugg

SEQ ID NO: 923789 - RNA, 22 nt, Human
ucccuggacagccuugccuggg

SEQ ID NO: 923790 - RNA, 22 nt, Human
aucuucaacucagagagugcug

SEQ ID NO: 923791 - RNA, 21 nt, Human
gggagcuggaaacugggugac

SEQ ID NO: 923792 - RNA, 22 nt, Human
uagcaagaggaaacaaggggcc

SEQ ID NO: 923793 - RNA, 22 nt, Human
cugugugccuagaggguggccg

SEQ ID NO: 923794 - RNA, 22 nt, Human
cauucaagaguggacauaaugc

SEQ ID NO: 923795 - RNA, 22 nt, Human
aauauaaauuccugggcccagc

SEQ ID NO: 923796 - RNA, 22 nt, Human
aaugagaaaacacagaggaggu

SEQ ID NO: 923797 - RNA, 22 nt, Human
gugggguagaucuuucucagga

SEQ ID NO: 923798 - RNA, 22 nt, Human
ugagcagagcaggcugcgcccu

SEQ ID NO: 923799 - RNA, 22 nt, Human
uaucuagauuucuuucucugug

SEQ ID NO: 923800 - RNA, 22 nt, Human
ggcagugaaucugagagccugg

SEQ ID NO: 923801 - RNA, 22 nt, Human
gagguggguguaucacagguca

SEQ ID NO: 923802 - RNA, 22 nt, Human
cacagaguggaggcuuggccug

SEQ ID NO: 923803 - RNA, 22 nt, Human
acucugggauuguuucugguau

SEQ ID NO: 923804 - RNA, 22 nt, Human
gcugccccagcugggggcugga

SEQ ID NO: 923805 - RNA, 22 nt, Human
ugcagaagaaugagcuuggagu

SEQ ID NO: 923806 - RNA, 22 nt, Human
ggugcugauucacugacuucug

SEQ ID NO: 923807 - RNA, 22 nt, Human
uccuccagugguacuggccaau

SEQ ID NO: 923808 - RNA, 22 nt, Human
cucagugugagugagaagugca

SEQ ID NO: 923809 - RNA, 22 nt, Human
uggcuccuaucaaggagugggu

SEQ ID NO: 923810 - RNA, 22 nt, Human
caggcagauauguucgcuuuaa

SEQ ID NO: 923811 - RNA, 22 nt, Human
uuccuuaaugaaucaggccauu

SEQ ID NO: 923812 - RNA, 22 nt, Human
aauggacaggagagcauaguca

SEQ ID NO: 923813 - RNA, 22 nt, Human
uaacauguuuguacacugaaac

SEQ ID NO: 923814 - RNA, 22 nt, Human
uggcagaggagaauuaagauua

SEQ ID NO: 923815 - RNA, 22 nt, Human
gcagcgaggugaugaaauagcu

SEQ ID NO: 923816 - RNA, 22 nt, Human
gucccuaguggaaagacaugau

SEQ ID NO: 923817 - RNA, 22 nt, Human
caccacuguaucccuagcacuu

SEQ ID NO: 923818 - RNA, 20 nt, Human
gagggugggacuuccuaggc

SEQ ID NO: 923819 - RNA, 22 nt, Human
auaaaggauaauccauuagacu

SEQ ID NO: 923820 - RNA, 22 nt, Human
uaaucucuuuaugagaagaagg

SEQ ID NO: 923821 - RNA, 15 nt, Human
aagcagcaauauaua

SEQ ID NO: 923822 - RNA, 22 nt, Human
gggugggcccagcccagagaag

SEQ ID NO: 923823 - RNA, 22 nt, Human
aaacuucaagauucaagccugg

SEQ ID NO: 923824 - RNA, 22 nt, Human
cagugcagccaaggacaggcac

SEQ ID NO: 923825 - RNA, 22 nt, Human
ccugugcuucagcuggaggagg

SEQ ID NO: 923826 - RNA, 22 nt, Human
ggcuggagguagaagaacacuu

SEQ ID NO: 923827 - RNA, 18 nt, Human
ucuuuggacaacuacugg

SEQ ID NO: 923828 - RNA, 22 nt, Human
ucaacaauugcauguugauguu

SEQ ID NO: 923829 - RNA, 21 nt, Human
ugggggugaggccuaggaauc

SEQ ID NO: 923830 - RNA, 22 nt, Human
uuuaucugauauucagcgauuu

SEQ ID NO: 923831 - RNA, 22 nt, Human
gucuucugucugucuggcaugu

SEQ ID NO: 923832 - RNA, 22 nt, Human
aguguccccuacagaggcauuc

SEQ ID NO: 923833 - RNA, 22 nt, Human
uccagcuuauagguagauuuaa

SEQ ID NO: 923834 - RNA, 22 nt, Human
aggaagugucagggauaacgau

SEQ ID NO: 923835 - RNA, 22 nt, Human
caggacccaucagccaggcacu

SEQ ID NO: 923836 - RNA, 22 nt, Human
aacaguuuaugagauaugcuau

SEQ ID NO: 923837 - RNA, 20 nt, Human
ggcagagcuaugucuguugc

SEQ ID NO: 923838 - RNA, 22 nt, Human
aaggcaaggccaagccaucagu

SEQ ID NO: 923839 - RNA, 19 nt, Human
aucauacauguuacacucu

SEQ ID NO: 923840 - RNA, 22 nt, Human
ggagcaagagguggugaaaaau

SEQ ID NO: 923841 - RNA, 22 nt, Human
agcuccagaagccugcaaggua

SEQ ID NO: 923842 - RNA, 22 nt, Human
acagaaauuagcagugaguuua

SEQ ID NO: 923843 - RNA, 22 nt, Human
ggacccuguaaagucgugucca

SEQ ID NO: 923844 - RNA, 22 nt, Human
gcagacgucaccgagucgaugg

SEQ ID NO: 923845 - RNA, 22 nt, Human
gggcaggaggcuaauucugcau

SEQ ID NO: 923846 - RNA, 22 nt, Human
ugucaguuaaaugagguacaag

SEQ ID NO: 923847 - RNA, 22 nt, Human
cucugggagaggacacuuggag

SEQ ID NO: 923848 - RNA, 22 nt, Human
ccuugcauuuaaaggcguaggg

SEQ ID NO: 923849 - RNA, 22 nt, Human
ugaggccaaugacccugggcag

SEQ ID NO: 923850 - RNA, 22 nt, Human
uuucuagucagccauaucuagu

SEQ ID NO: 923851 - RNA, 22 nt, Human
ucugucuuagcaucuuugcuca

SEQ ID NO: 923852 - RNA, 18 nt, Human
uguugaaacuucagguaa

SEQ ID NO: 923853 - RNA, 22 nt, Human
caggccuggcccccggcacacc

SEQ ID NO: 923854 - RNA, 22 nt, Human
uacagcauauacagaaugaaca

SEQ ID NO: 923855 - RNA, 22 nt, Human
cugguggcaucuugagaugguu

SEQ ID NO: 923856 - RNA, 22 nt, Human
cugcucuggcguacucggcauc

SEQ ID NO: 923857 - RNA, 22 nt, Human
cuguucuguaagcugcuguugu

SEQ ID NO: 923858 - RNA, 22 nt, Human
aaggccaggccagaugacaguc

SEQ ID NO: 923859 - RNA, 22 nt, Human
gagcagcagcugggccagguuc

SEQ ID NO: 923860 - RNA, 22 nt, Human
ggacauuucauaagaccauucu

SEQ ID NO: 923861 - RNA, 22 nt, Human
ccaggauggggagcagauagaa

SEQ ID NO: 923862 - RNA, 22 nt, Human
agacagcaauaugggagacgga

SEQ ID NO: 923863 - RNA, 17 nt, Human
agcacuaaggauaauac

SEQ ID NO: 923864 - RNA, 22 nt, Human
cagagacauucuccccauugga

SEQ ID NO: 923865 - RNA, 22 nt, Human
acagaagaaagggagguuuugc

SEQ ID NO: 923866 - RNA, 22 nt, Human
cuguggcucauaucuguaaucu

SEQ ID NO: 923867 - RNA, 20 nt, Human
auguauauuacuggcuguga

SEQ ID NO: 923868 - RNA, 22 nt, Human
aggcuggauuuauggggacuuc

SEQ ID NO: 923869 - RNA, 22 nt, Human
ucaaacauaggcacacauucag

SEQ ID NO: 923870 - RNA, 22 nt, Human
aggucacacaacugucagaggc

SEQ ID NO: 923871 - RNA, 22 nt, Human
gcuuacaaggguaggaagucua

SEQ ID NO: 923872 - RNA, 20 nt, Human
uucaugguguauuucuuucu

SEQ ID NO: 923873 - RNA, 22 nt, Human
gcuguuauuuuacaagacuuau

SEQ ID NO: 923874 - RNA, 17 nt, Human
uaaguuauagcagaaga

SEQ ID NO: 923875 - RNA, 22 nt, Human
gugguuuuauucguuccucugu

SEQ ID NO: 923876 - RNA, 22 nt, Human
ggagggcucgucauccaccacu

SEQ ID NO: 923877 - RNA, 22 nt, Human
cccucuccuggcugcauggagc

SEQ ID NO: 923878 - RNA, 22 nt, Human
auacagaauuugcccuuuucau

SEQ ID NO: 923879 - RNA, 23 nt, Human
agcugcugggccugccguggccu

SEQ ID NO: 923880 - RNA, 22 nt, Human
aggcccugggcaguucuguagc

SEQ ID NO: 923881 - RNA, 22 nt, Human
cuggccuggagccucugggugg

SEQ ID NO: 923882 - RNA, 21 nt, Human
uagaauccuggacugggacuc

SEQ ID NO: 923883 - RNA, 22 nt, Human
cuuuggaagugauagauaugau

SEQ ID NO: 923884 - RNA, 22 nt, Human
uggcuggagugggagaaguuua

SEQ ID NO: 923885 - RNA, 22 nt, Human
ucucauugguauauacaugugu

SEQ ID NO: 923886 - RNA, 22 nt, Human
ucacagacucuugauugucuaa

SEQ ID NO: 923887 - RNA, 22 nt, Human
ucccaggcugggggccugaagu

SEQ ID NO: 923888 - RNA, 22 nt, Human
accaggaggccuugguucugag

SEQ ID NO: 923889 - RNA, 22 nt, Human
ccugaggucaugguccaguguu

SEQ ID NO: 923890 - RNA, 22 nt, Human
aagacucuaucuuuagagauca

SEQ ID NO: 923891 - RNA, 21 nt, Human
ugugucagucuuuggaagcaa

SEQ ID NO: 923892 - RNA, 22 nt, Human
ugcagggcacacgcacgggugu

SEQ ID NO: 923893 - RNA, 17 nt, Human
gaggacagggaaguagg

SEQ ID NO: 923894 - RNA, 22 nt, Human
aggcaaaauuacaaaguuauua

SEQ ID NO: 923895 - RNA, 22 nt, Human
accuuggaacugaaguguuuuu

SEQ ID NO: 923896 - RNA, 22 nt, Human
uugggcugaaguagagggcaga

SEQ ID NO: 923897 - RNA, 22 nt, Human
gcuggcagcuggaaguugggcu

SEQ ID NO: 923898 - RNA, 22 nt, Human
gcaggcccuccucuagcaaggc

SEQ ID NO: 923899 - RNA, 22 nt, Human
gaagcacauggcugugagcaac

SEQ ID NO: 923900 - RNA, 22 nt, Human
ccagagcuaaacacacaggcug

SEQ ID NO: 923901 - RNA, 23 nt, Human
aucuuacauauuuagcaccugaa

SEQ ID NO: 923902 - RNA, 22 nt, Human
cacaguaagaaaugaagaggua

SEQ ID NO: 923903 - RNA, 22 nt, Human
cagcuauuuugccuaucauggu

SEQ ID NO: 923904 - RNA, 22 nt, Human
ugucuguguccaaauuuccucu

SEQ ID NO: 923905 - RNA, 22 nt, Human
accaggccuagcaaguacauua

SEQ ID NO: 923906 - RNA, 22 nt, Human
aggaaugucauagaauaaucau

SEQ ID NO: 923907 - RNA, 20 nt, Human
guagaaccaugugugcuggg

SEQ ID NO: 923908 - RNA, 22 nt, Human
gggagaagaaugugucaauugu

SEQ ID NO: 923909 - RNA, 22 nt, Human
aaucuguauugcucauacuuga

SEQ ID NO: 923910 - RNA, 22 nt, Human
agauucagaaaugaggagggcc

SEQ ID NO: 923911 - RNA, 22 nt, Human
ggguggugagauguagcugaug

SEQ ID NO: 923912 - RNA, 22 nt, Human
gcugucugggugcccaaaagaa

SEQ ID NO: 923913 - RNA, 22 nt, Human
caggagcucuuaaggaugugau

SEQ ID NO: 923914 - RNA, 22 nt, Human
gaggccaggggagucagcgucc

SEQ ID NO: 923915 - RNA, 22 nt, Human
auacacacgugcacgugggaaa

SEQ ID NO: 923916 - RNA, 22 nt, Human
gugcaaauuccacuggaaagcu

SEQ ID NO: 923917 - RNA, 22 nt, Human
cagggcccagucccugcuguca

SEQ ID NO: 923918 - RNA, 20 nt, Human
ucagcucuuagaggucgcuu

SEQ ID NO: 923919 - RNA, 22 nt, Human
aagaguuugggcaagucauaaa

SEQ ID NO: 923920 - RNA, 22 nt, Human
ccaggcaaaacagauuuguaug

SEQ ID NO: 923921 - RNA, 22 nt, Human
uuucuugacugcuuaggaaugc

SEQ ID NO: 923922 - RNA, 22 nt, Human
agugcaggcucgcuugugaggc

SEQ ID NO: 923923 - RNA, 17 nt, Human
ugcuuucuuccugcccu

SEQ ID NO: 923924 - RNA, 22 nt, Human
ucucucucagccauuacagaac

SEQ ID NO: 923925 - RNA, 22 nt, Human
gggcugccuuucuucugggagc

SEQ ID NO: 923926 - RNA, 22 nt, Human
aggaggccgauuucagaggucg

SEQ ID NO: 923927 - RNA, 22 nt, Human
cagcuaaggcuccuucuaggua

SEQ ID NO: 923928 - RNA, 22 nt, Human
caagccuuggaaauccauucug

SEQ ID NO: 923929 - RNA, 22 nt, Human
aaucuagagacaauuugaauau

SEQ ID NO: 923930 - RNA, 22 nt, Human
gaggcuccucauucaguaugcu

SEQ ID NO: 923931 - RNA, 22 nt, Human
agcuuguuauaaaugcagaaug

SEQ ID NO: 923932 - RNA, 22 nt, Human
guuauuuauaagguguaacucc

SEQ ID NO: 923933 - RNA, 22 nt, Human
cuggaggcugaguugggucucc

SEQ ID NO: 923934 - RNA, 19 nt, Human
uauguguauauguaucugu

SEQ ID NO: 923935 - RNA, 22 nt, Human
ugggccuuguccccucagcugu

SEQ ID NO: 923936 - RNA, 22 nt, Human
cuuccuguugucacagucugcg

SEQ ID NO: 923937 - RNA, 22 nt, Human
guucacaagaugugguggggag

SEQ ID NO: 923938 - RNA, 22 nt, Human
cugcucugagaggcucuuccua

SEQ ID NO: 923939 - RNA, 22 nt, Human
uggcugaguuccuggcacacgg

SEQ ID NO: 923940 - RNA, 22 nt, Human
acauauauguaaaguacuuugu

SEQ ID NO: 923941 - RNA, 21 nt, Human
gccacugugcacacuaaccca

SEQ ID NO: 923942 - RNA, 20 nt, Human
gcugaggucccugugguuuu

SEQ ID NO: 923943 - RNA, 22 nt, Human
ugccuuccuaauggugggguuu

SEQ ID NO: 923944 - RNA, 22 nt, Human
gaggacacaugacuccagcagg

SEQ ID NO: 923945 - RNA, 19 nt, Human
cagcaagaaugaaggcaua

SEQ ID NO: 923946 - RNA, 22 nt, Human
cccugcagcauucucuaacugg

SEQ ID NO: 923947 - RNA, 22 nt, Human
ccucugaguccuuugggcucuc

SEQ ID NO: 923948 - RNA, 22 nt, Human
aacuuuuucugggauggagggu

SEQ ID NO: 923949 - RNA, 22 nt, Human
gaauuacaaagugagacaagcu

SEQ ID NO: 923950 - RNA, 22 nt, Human
gucucucugacugguccacacc

SEQ ID NO: 923951 - RNA, 22 nt, Human
ugccaggcuccggaacgacagu

SEQ ID NO: 923952 - RNA, 22 nt, Human
acucuacagaaugaauaccugu

SEQ ID NO: 923953 - RNA, 22 nt, Human
ggcagccaguagggccagccug

SEQ ID NO: 923954 - RNA, 22 nt, Human
agcagggcaugaauaaggguuu

SEQ ID NO: 923955 - RNA, 22 nt, Human
acaugucuuuuaaagucuaaua

SEQ ID NO: 923956 - RNA, 22 nt, Human
acaugcacaccuauauacaugu

SEQ ID NO: 923957 - RNA, 22 nt, Human
uccaugugacgguggcaguuuu

SEQ ID NO: 923958 - RNA, 21 nt, Human
cucuuuguggcaauguauuuu

SEQ ID NO: 923959 - RNA, 22 nt, Human
acuguggccuuguggguucagg

SEQ ID NO: 923960 - RNA, 22 nt, Human
gcaugcugcaccagagccucuc

SEQ ID NO: 923961 - RNA, 23 nt, Human
ccaucaggccuccguguccagcc

SEQ ID NO: 923962 - RNA, 22 nt, Human
agcuuuaucagaggagucucua

SEQ ID NO: 923963 - RNA, 22 nt, Human
uacacauaggaggguaauaaaa

SEQ ID NO: 923964 - RNA, 22 nt, Human
cugcuucuaagaaccugcagcu

SEQ ID NO: 923965 - RNA, 22 nt, Human
uacacaugacaguggacugaga

SEQ ID NO: 923966 - RNA, 22 nt, Human
gccugccuggagcuugagguga

SEQ ID NO: 923967 - RNA, 21 nt, Human
uuuuuucuugcgugaggccug

SEQ ID NO: 923968 - RNA, 22 nt, Human
uuacauuaggucaagcugccaa

SEQ ID NO: 923969 - RNA, 22 nt, Human
guuuccaggaaggguugggagg

SEQ ID NO: 923970 - RNA, 22 nt, Human
cugucugggucuacauccucug

SEQ ID NO: 923971 - RNA, 22 nt, Human
cucuuuggcuuugacucccauu

SEQ ID NO: 923972 - RNA, 22 nt, Human
uagcagcuaugccauuuugaca

SEQ ID NO: 923973 - RNA, 22 nt, Human
ugaguccaucgcagggaagugg

SEQ ID NO: 923974 - RNA, 22 nt, Human
cugaggcugggcuugccuucuu

SEQ ID NO: 923975 - RNA, 22 nt, Human
ggcccagugucccggucguggc

SEQ ID NO: 923976 - RNA, 22 nt, Human
uuuuacagucagucaaacucag

SEQ ID NO: 923977 - RNA, 22 nt, Human
augucuguggcaauuguugaug

SEQ ID NO: 923978 - RNA, 22 nt, Human
aucuuggauuggagaaagaagu

SEQ ID NO: 923979 - RNA, 22 nt, Human
acuacuaguggcuacaauaaug

SEQ ID NO: 923980 - RNA, 22 nt, Human
aaauuguugaucuacaguaagg

SEQ ID NO: 923981 - RNA, 22 nt, Human
cagccucuuuccacaucaggca

SEQ ID NO: 923982 - RNA, 21 nt, Human
aagaggcaucacuauuugugu

SEQ ID NO: 923983 - RNA, 22 nt, Human
uuguuuuuaaacaugugacuga

SEQ ID NO: 923984 - RNA, 22 nt, Human
uucccaaagcuuugucugugaa

SEQ ID NO: 923985 - RNA, 22 nt, Human
ccguaugucuggguuucuuaau

SEQ ID NO: 923986 - RNA, 22 nt, Human
uggaauguguucuauuuuacag

SEQ ID NO: 923987 - RNA, 22 nt, Human
ucuagaauacugugacaugcca

SEQ ID NO: 923988 - RNA, 22 nt, Human
cugugucucccaaggaggguca

SEQ ID NO: 923989 - RNA, 22 nt, Human
uugauuuuuuucuacuaugcgc

SEQ ID NO: 923990 - RNA, 22 nt, Human
uuggggcaccuccccagcauuu

SEQ ID NO: 923991 - RNA, 22 nt, Human
aggagcaaggaagcuacaguuu

SEQ ID NO: 923992 - RNA, 22 nt, Human
uuuguucaauauguguuugucc

SEQ ID NO: 923993 - RNA, 22 nt, Human
ugggccugagcucaccaggggc

SEQ ID NO: 923994 - RNA, 22 nt, Human
ucugccacuagugguuaccuua

SEQ ID NO: 923995 - RNA, 22 nt, Human
gucagcagaaacgccacaugca

SEQ ID NO: 923996 - RNA, 22 nt, Human
gaaagcaguauuuaguucuguu

SEQ ID NO: 923997 - RNA, 22 nt, Human
aauguagaugagauauuuuuug

SEQ ID NO: 923998 - RNA, 22 nt, Human
uauuucuuuucgugacuuauug

SEQ ID NO: 923999 - RNA, 22 nt, Human
ugggcugcuuccucagcugaga

SEQ ID NO: 924000 - RNA, 22 nt, Human
ggagaggagcuauugggggcuc

SEQ ID NO: 924001 - RNA, 22 nt, Human
acagggccagccugggaccugg

SEQ ID NO: 924002 - RNA, 22 nt, Human
cuagaaucccaaauggacuggg

SEQ ID NO: 924003 - RNA, 22 nt, Human
guacauaauuuucagccaguuu

SEQ ID NO: 924004 - RNA, 22 nt, Human
ccaggaguggcuggugaccuuc

SEQ ID NO: 924005 - RNA, 22 nt, Human
ugauuucccuguagccucugaa

SEQ ID NO: 924006 - RNA, 22 nt, Human
ucuggcuccguguccgcuccca

SEQ ID NO: 924007 - RNA, 22 nt, Human
ggcuuguccuucugguugucuu

SEQ ID NO: 924008 - RNA, 22 nt, Human
gucucuguuauuuccaggguca

SEQ ID NO: 924009 - RNA, 23 nt, Human
guuaacaugguccauggaagagc

SEQ ID NO: 924010 - RNA, 22 nt, Human
ggcggguguaaguaggacagcg

SEQ ID NO: 924011 - RNA, 22 nt, Human
uccaggagaggccugaccaggu

SEQ ID NO: 924012 - RNA, 22 nt, Human
ccucucucagcuugcugcaacu

SEQ ID NO: 924013 - RNA, 22 nt, Human
uggcucagagccuugagagcug

SEQ ID NO: 924014 - RNA, 22 nt, Human
acaguuuagagcaugaugacca

SEQ ID NO: 924015 - RNA, 22 nt, Human
aauuuguauacauguuacauuu

SEQ ID NO: 924016 - RNA, 22 nt, Human
uuggaagacauuaaagagagug

SEQ ID NO: 924017 - RNA, 22 nt, Human
cuacaguagagguugucaggga

SEQ ID NO: 924018 - RNA, 22 nt, Human
cuggcccucggaguccagcugc

SEQ ID NO: 924019 - RNA, 22 nt, Human
agaggaggauuuguaaaggucu

SEQ ID NO: 924020 - RNA, 20 nt, Human
aguucucuuccuugggccug

SEQ ID NO: 924021 - RNA, 22 nt, Human
uaugcacauuaucuaauccauu

SEQ ID NO: 924022 - RNA, 22 nt, Human
gcuggcugccaauuucagagcu

SEQ ID NO: 924023 - RNA, 22 nt, Human
acauuugucuggcuagaaaguu

SEQ ID NO: 924024 - RNA, 22 nt, Human
aaggcaauggcaagagaaagca

SEQ ID NO: 924025 - RNA, 22 nt, Human
gugagucuuaagcaccaccuuu

SEQ ID NO: 924026 - RNA, 18 nt, Human
gagugcgguggugcacac

SEQ ID NO: 924027 - RNA, 22 nt, Human
aggaguguugcuucagggaagc

SEQ ID NO: 924028 - RNA, 22 nt, Human
agcagccuugcaggggucgcac

SEQ ID NO: 924029 - RNA, 22 nt, Human
cuugcaugcauuugaagaucau

SEQ ID NO: 924030 - RNA, 22 nt, Human
ugucaccucuuuggcugcagcu

SEQ ID NO: 924031 - RNA, 22 nt, Human
uuccuagggcagagccgcuggg

SEQ ID NO: 924032 - RNA, 20 nt, Human
ucaaaauaggugugggcgga

SEQ ID NO: 924033 - RNA, 23 nt, Human
gccuggcuuccaagguaggggag

SEQ ID NO: 924034 - RNA, 22 nt, Human
cagaaagcucuuucaaucuugc

SEQ ID NO: 924035 - RNA, 22 nt, Human
uagaaucauugagaauaacagg

SEQ ID NO: 924036 - RNA, 22 nt, Human
aguaaauaacagagaaaauggg

SEQ ID NO: 924037 - RNA, 22 nt, Human
auugcugaaaugaaaggauaug

SEQ ID NO: 924038 - RNA, 22 nt, Human
uucccucuccaggagcccugag

SEQ ID NO: 924039 - RNA, 22 nt, Human
uguaucaaggguuuauguaagc

SEQ ID NO: 924040 - RNA, 22 nt, Human
uccagcuuugccugaucauaua

SEQ ID NO: 924041 - RNA, 22 nt, Human
uucaugugaucacagauuguaa

SEQ ID NO: 924042 - RNA, 22 nt, Human
agcagguggacagaggaagaaa

SEQ ID NO: 924043 - RNA, 22 nt, Human
gacaauguguugaaagggaaaa

SEQ ID NO: 924044 - RNA, 22 nt, Human
uaacaagaaauacauugguucu

SEQ ID NO: 924045 - RNA, 22 nt, Human
gcuugcaugauauggcaucugg

SEQ ID NO: 924046 - RNA, 22 nt, Human
uauaggaaauuuaucuccuggg

SEQ ID NO: 924047 - RNA, 22 nt, Human
agccacagugcaagagagaaaa

SEQ ID NO: 924048 - RNA, 22 nt, Human
ggccaguuuccaugcacuauuu

SEQ ID NO: 924049 - RNA, 22 nt, Human
cuaaaaauccacacuaggugaa

SEQ ID NO: 924050 - RNA, 22 nt, Human
aaguuugugagguuaaucccuu

SEQ ID NO: 924051 - RNA, 22 nt, Human
ugcacacaguggacaagucuug

SEQ ID NO: 924052 - RNA, 22 nt, Human
agaggccagaucaucauagaug

SEQ ID NO: 924053 - RNA, 20 nt, Human
uuuacauuuugaaacaguga

SEQ ID NO: 924054 - RNA, 22 nt, Human
ucugcugucugauucccacuuc

SEQ ID NO: 924055 - RNA, 22 nt, Human
uggagacaugggcgaaucuaag

SEQ ID NO: 924056 - RNA, 17 nt, Human
ugguucuuuucauuccc

SEQ ID NO: 924057 - RNA, 22 nt, Human
uuucaaagcaacugaaaaggaa

SEQ ID NO: 924058 - RNA, 22 nt, Human
uuccuaggauggugaagcagga

SEQ ID NO: 924059 - RNA, 23 nt, Human
aaagugacuuuuauaccacuaac

SEQ ID NO: 924060 - RNA, 22 nt, Human
cacaugcccagaacuucucauu

SEQ ID NO: 924061 - RNA, 22 nt, Human
uccugggaagcgccggccugcg

SEQ ID NO: 924062 - RNA, 22 nt, Human
aaagccaguucuuagagaaagc

SEQ ID NO: 924063 - RNA, 22 nt, Human
ugcuggcuuugcgagaugcauu

SEQ ID NO: 924064 - RNA, 22 nt, Human
agaaaacuggagccugggguug

SEQ ID NO: 924065 - RNA, 22 nt, Human
aaggcuccagugaaugcuggca

SEQ ID NO: 924066 - RNA, 22 nt, Human
cacagggcaggccccaggccuc

SEQ ID NO: 924067 - RNA, 22 nt, Human
uguucucaguaauucuauuuua

SEQ ID NO: 924068 - RNA, 22 nt, Human
ugcaggguggagcggaagcgga

SEQ ID NO: 924069 - RNA, 22 nt, Human
ccaggccugcauucccucucag

SEQ ID NO: 924070 - RNA, 22 nt, Human
ugccucagagugggcuugcuau

SEQ ID NO: 924071 - RNA, 22 nt, Human
acaguggagaaggcaugaggcu

SEQ ID NO: 924072 - RNA, 22 nt, Human
ucuguucuugcuuuucuccaac

SEQ ID NO: 924073 - RNA, 22 nt, Human
acagcagguuuuaacuuugaag

SEQ ID NO: 924074 - RNA, 22 nt, Human
caucacaggcauuuugaguguc

SEQ ID NO: 924075 - RNA, 22 nt, Human
cuccagaggaaagcacauagug

SEQ ID NO: 924076 - RNA, 22 nt, Human
cagcucucuaaggucuugcuuu

SEQ ID NO: 924077 - RNA, 22 nt, Human
gugugcuguuguucagguagaa

SEQ ID NO: 924078 - RNA, 22 nt, Human
auacugugugcagaguccuaau

SEQ ID NO: 924079 - RNA, 22 nt, Human
uguguuucagaaccuucuuuca

SEQ ID NO: 924080 - RNA, 21 nt, Human
ugcucagucugucuccagcuu

SEQ ID NO: 924081 - RNA, 22 nt, Human
gcugugcuauaucucugagugu

SEQ ID NO: 924082 - RNA, 22 nt, Human
ccuccugcaccuccaggaacuc

SEQ ID NO: 924083 - RNA, 22 nt, Human
guuuaagaaaauucauguuguu

SEQ ID NO: 924084 - RNA, 21 nt, Human
aguuuccucaacugcagaagg

SEQ ID NO: 924085 - RNA, 22 nt, Human
uaggcuuuguguuuugggaaca

SEQ ID NO: 924086 - RNA, 22 nt, Human
caccugggcuuucucugggacu

SEQ ID NO: 924087 - RNA, 22 nt, Human
gcaaagaaaguuuuaaugaggu

SEQ ID NO: 924088 - RNA, 22 nt, Human
guuuuccauggaggucugaccu

SEQ ID NO: 924089 - RNA, 22 nt, Human
uccaggaguggggcagaggucu

SEQ ID NO: 924090 - RNA, 22 nt, Human
ucaggaguaaagaagacuugac

SEQ ID NO: 924091 - RNA, 22 nt, Human
aucuaagauuuugcuaagauca

SEQ ID NO: 924092 - RNA, 22 nt, Human
ggcaguuccagaauuucaguac

SEQ ID NO: 924093 - RNA, 22 nt, Human
ugagcuuacgugggaacagacu

SEQ ID NO: 924094 - RNA, 20 nt, Human
agaguuuggggucauuuugg

SEQ ID NO: 924095 - RNA, 22 nt, Human
auuucaacguuagauguaauag

SEQ ID NO: 924096 - RNA, 20 nt, Human
acguggccaccaguggcuua

SEQ ID NO: 924097 - RNA, 22 nt, Human
uggagcugauacagcuggcuuu

SEQ ID NO: 924098 - RNA, 22 nt, Human
ucauacaacuaagaguuucaga

SEQ ID NO: 924099 - RNA, 22 nt, Human
cuccagggaggucugcaggacu

SEQ ID NO: 924100 - RNA, 22 nt, Human
gcaaaaaaugcuuguugcuuag

SEQ ID NO: 924101 - RNA, 22 nt, Human
acuuucuuaggcuguauaaaug

SEQ ID NO: 924102 - RNA, 21 nt, Human
agcagccauggaugguaugua

SEQ ID NO: 924103 - RNA, 22 nt, Human
auaauuacauuauacuguuaga

SEQ ID NO: 924104 - RNA, 22 nt, Human
gggcugagucugcugccuguca

SEQ ID NO: 924105 - RNA, 22 nt, Human
aauaaguacuuggggauaacuu

SEQ ID NO: 924106 - RNA, 22 nt, Human
auguguuaaugagcaaugaccu

SEQ ID NO: 924107 - RNA, 22 nt, Human
uauacuaugcuucugauccaau

SEQ ID NO: 924108 - RNA, 22 nt, Human
uauguauauguauacacacaca

SEQ ID NO: 924109 - RNA, 22 nt, Human
ucauggcacaugcccuccaggg

SEQ ID NO: 924110 - RNA, 21 nt, Human
caugauaaugaagguguuauu

SEQ ID NO: 924111 - RNA, 23 nt, Human
aaauuauugcucuucaauugccu

SEQ ID NO: 924112 - RNA, 23 nt, Human
accaggagccaagaucucccugg

SEQ ID NO: 924113 - RNA, 22 nt, Human
auuugucuucaguagguucuuc

SEQ ID NO: 924114 - RNA, 22 nt, Human
gaaaucuuuauggaaauaacaa

SEQ ID NO: 924115 - RNA, 18 nt, Human
uaauuugcacaguugcaa

SEQ ID NO: 924116 - RNA, 19 nt, Human
uaagguuuaccagcaaaau

SEQ ID NO: 924117 - RNA, 22 nt, Human
acagacauauuuggcccauagc

SEQ ID NO: 924118 - RNA, 22 nt, Human
caaauguuucuuaucuauuguu

SEQ ID NO: 924119 - RNA, 22 nt, Human
uuuggaauuacuuacucaagcc

SEQ ID NO: 924120 - RNA, 22 nt, Human
uauauacuaugcgauuccugcc

SEQ ID NO: 924121 - RNA, 22 nt, Human
acagugcuaaacacuucuugaa

SEQ ID NO: 924122 - RNA, 22 nt, Human
gggaaggcaccaugguguucca

SEQ ID NO: 924123 - RNA, 22 nt, Human
uucuugcaucacucugcuguuc

SEQ ID NO: 924124 - RNA, 22 nt, Human
caggagguugguagcaguagau

SEQ ID NO: 924125 - RNA, 22 nt, Human
caugggcugaaaaucugcaaac

SEQ ID NO: 924126 - RNA, 20 nt, Human
aggaagcugagauguagagg

SEQ ID NO: 924127 - RNA, 22 nt, Human
auacauauaugguacuuccugg

SEQ ID NO: 924128 - RNA, 22 nt, Human
augcugaaggugaauugacaau

SEQ ID NO: 924129 - RNA, 22 nt, Human
acugaacagccugaggagucac

SEQ ID NO: 924130 - RNA, 22 nt, Human
gacaagacugguuuauuuaagg

SEQ ID NO: 924131 - RNA, 22 nt, Human
uucaaaagcgguccaggaagau

SEQ ID NO: 924132 - RNA, 20 nt, Human
agaaauacuuugguauaaug

SEQ ID NO: 924133 - RNA, 21 nt, Human
uuuaaagaauaggaagggagg

SEQ ID NO: 924134 - RNA, 22 nt, Human
caacuacauccacacuuuguua

SEQ ID NO: 924135 - RNA, 22 nt, Human
gggaggcucugcucagcccccg

SEQ ID NO: 924136 - RNA, 22 nt, Human
uguaaagcaucucugucauaua

SEQ ID NO: 924137 - RNA, 20 nt, Human
ucggcuggacacugugcacu

SEQ ID NO: 924138 - RNA, 22 nt, Human
cuucaguguccucucuaguaga

SEQ ID NO: 924139 - RNA, 22 nt, Human
aauaguaaaagauacagcuaau

SEQ ID NO: 924140 - RNA, 22 nt, Human
cccaggcucuuaugugacuugc

SEQ ID NO: 924141 - RNA, 22 nt, Human
auagacacagaucuauauaugu

SEQ ID NO: 924142 - RNA, 22 nt, Human
ugauuugagguacauaaaucca

SEQ ID NO: 924143 - RNA, 22 nt, Human
gaaaugcuacacuuguuaauga

SEQ ID NO: 924144 - RNA, 22 nt, Human
uggaaaacaaagcucucauuau

SEQ ID NO: 924145 - RNA, 22 nt, Human
gaaacacaugcagcuccauaga

SEQ ID NO: 924146 - RNA, 22 nt, Human
uucaacacugaucguuuacaca

SEQ ID NO: 924147 - RNA, 22 nt, Human
cagcaucuguauccuaggcuga

SEQ ID NO: 924148 - RNA, 22 nt, Human
uguuuauuacaguucuuggaau

SEQ ID NO: 924149 - RNA, 22 nt, Human
aaagagcuuuagaaaucucaga

SEQ ID NO: 924150 - RNA, 22 nt, Human
uccugagguggauugagcagag

SEQ ID NO: 924151 - RNA, 22 nt, Human
aaaaguaauugcaguuuuguca

SEQ ID NO: 924152 - RNA, 17 nt, Human
cucuuuauaaagaguua

SEQ ID NO: 924153 - RNA, 22 nt, Human
ggagccugugggaugagaugug

SEQ ID NO: 924154 - RNA, 22 nt, Human
agaaucaaggugaagcccacag

SEQ ID NO: 924155 - RNA, 22 nt, Human
auucuggguucaugagugagcu

SEQ ID NO: 924156 - RNA, 22 nt, Human
gagcaggccuggggugaggccu

SEQ ID NO: 924157 - RNA, 22 nt, Human
augaauaaacaggugccucuuc

SEQ ID NO: 924158 - RNA, 22 nt, Human
agaguucugaauuuuauucucu

SEQ ID NO: 924159 - RNA, 19 nt, Human
gcauaaaaugucaaugugu

SEQ ID NO: 924160 - RNA, 22 nt, Human
ccagagucuuuauauuccugaa

SEQ ID NO: 924161 - RNA, 22 nt, Human
cucaggauuaaggaaucuaaau

SEQ ID NO: 924162 - RNA, 22 nt, Human
auuaagugacuaaaguaaugcu

SEQ ID NO: 924163 - RNA, 22 nt, Human
cagggccagagagggcuggcug

SEQ ID NO: 924164 - RNA, 22 nt, Human
guucccaggcccugggcucucc

SEQ ID NO: 924165 - RNA, 20 nt, Human
cucuauuauuaauuucuuaa

SEQ ID NO: 924166 - RNA, 22 nt, Human
cauuuugugcuagacacuaugg

SEQ ID NO: 924167 - RNA, 22 nt, Human
aauguuauuguccuuuccaaaa

SEQ ID NO: 924168 - RNA, 22 nt, Human
aaccaauuuaaauauaaagacu

SEQ ID NO: 924169 - RNA, 21 nt, Human
agcugccacccuagcuucuga

SEQ ID NO: 924170 - RNA, 22 nt, Human
uaaucuagucccacauggaauu

SEQ ID NO: 924171 - RNA, 20 nt, Human
caucuccugccuccauguuc

SEQ ID NO: 924172 - RNA, 16 nt, Human
cuuccucuucacuggc

SEQ ID NO: 924173 - RNA, 22 nt, Human
cucugccaguuucuggccucag

SEQ ID NO: 924174 - RNA, 22 nt, Human
gcuggguuuucuuccgggccua

SEQ ID NO: 924175 - RNA, 20 nt, Human
gcugaagauucccaugcaag

SEQ ID NO: 924176 - RNA, 22 nt, Human
caagagcugaggcuggagaggu

SEQ ID NO: 924177 - RNA, 22 nt, Human
ccugugguuuacucuguggcua

SEQ ID NO: 924178 - RNA, 22 nt, Human
gucuuauuggguccaagguggc

SEQ ID NO: 924179 - RNA, 22 nt, Human
agggccagggaagcuguauuuu

SEQ ID NO: 924180 - RNA, 20 nt, Human
agcuucauuauagcccacag

SEQ ID NO: 924181 - RNA, 22 nt, Human
cagguggggagaguguggagca

SEQ ID NO: 924182 - RNA, 22 nt, Human
ugagcagaaguuauaaauaaga

SEQ ID NO: 924183 - RNA, 22 nt, Human
agggagcuaggauccugaaggu

SEQ ID NO: 924184 - RNA, 22 nt, Human
uuauaugaguaucauaucacuu

SEQ ID NO: 924185 - RNA, 21 nt, Human
uccugagugugcccaggcucu

SEQ ID NO: 924186 - RNA, 22 nt, Human
uuucuaagugaacauucaaguu

SEQ ID NO: 924187 - RNA, 22 nt, Human
agcccagcuuugaaccauauca

SEQ ID NO: 924188 - RNA, 22 nt, Human
uacaguuaaaaaguucaauggu

SEQ ID NO: 924189 - RNA, 22 nt, Human
guuuacaaauauuuuaaauggu

SEQ ID NO: 924190 - RNA, 22 nt, Human
uaaagcugcaggcucagaaaac

SEQ ID NO: 924191 - RNA, 22 nt, Human
gcccuccaccagagcccuucuc

SEQ ID NO: 924192 - RNA, 22 nt, Human
ccucuccagcggccucagggcc

SEQ ID NO: 924193 - RNA, 22 nt, Human
gcucccacugcagcccugagcc

SEQ ID NO: 924194 - RNA, 22 nt, Human
uuccuggccucucucugagcag

SEQ ID NO: 924195 - RNA, 22 nt, Human
aggcucagggacucccucccuc

SEQ ID NO: 924196 - RNA, 22 nt, Human
aagccaggccauucucugguuc

SEQ ID NO: 924197 - RNA, 22 nt, Human
cagagccaggguugcaccccug

SEQ ID NO: 924198 - RNA, 22 nt, Human
aguguuucuggcaaaugaaagu

SEQ ID NO: 924199 - RNA, 22 nt, Human
accaggcucugccaguguuuac

SEQ ID NO: 924200 - RNA, 22 nt, Human
aggcuccaccagucaggugcau

SEQ ID NO: 924201 - RNA, 22 nt, Human
cugggcugcagcgggagcgacg

SEQ ID NO: 924202 - RNA, 22 nt, Human
ccagacuguggaguuccuggug

SEQ ID NO: 924203 - RNA, 22 nt, Human
gcuguucuccgaugaccccgug

SEQ ID NO: 924204 - RNA, 22 nt, Human
ucagaggaugcuguucuuuaau

SEQ ID NO: 924205 - RNA, 22 nt, Human
gugcucuauagagaucuaaucg

SEQ ID NO: 924206 - RNA, 22 nt, Human
ggcagucacaggggagacuggg

SEQ ID NO: 924207 - RNA, 22 nt, Human
gcaagcaaaaugggagauuccc

SEQ ID NO: 924208 - RNA, 22 nt, Human
uucuaaauggggauccuuucug

SEQ ID NO: 924209 - RNA, 22 nt, Human
gcugcccaaugguagugucuuu

SEQ ID NO: 924210 - RNA, 22 nt, Human
ugguguguuagagcucagggca

SEQ ID NO: 924211 - RNA, 22 nt, Human
gcggggggaggaacaucuugca

SEQ ID NO: 924212 - RNA, 22 nt, Human
guccaaauuccacagauuucuc

SEQ ID NO: 924213 - RNA, 22 nt, Human
cugcagggcccaaggucaacgg

SEQ ID NO: 924214 - RNA, 22 nt, Human
gcagguggaucaccacgucagg

SEQ ID NO: 924215 - RNA, 20 nt, Human
ucuguaaagacuccagaagc

SEQ ID NO: 924216 - RNA, 22 nt, Human
cucucuggaagggggagcugau

SEQ ID NO: 924217 - RNA, 22 nt, Human
uggggaugaaacccaggcaucu

SEQ ID NO: 924218 - RNA, 22 nt, Human
agucaucucuucuacaauaugg

SEQ ID NO: 924219 - RNA, 22 nt, Human
aaaagagagcugaggagcucca

SEQ ID NO: 924220 - RNA, 22 nt, Human
cccuggagcuagucugagcaga

SEQ ID NO: 924221 - RNA, 22 nt, Human
ucugcaagcucaguucugacuu

SEQ ID NO: 924222 - RNA, 22 nt, Human
ugcuggcuccaaccuggcaucu

SEQ ID NO: 924223 - RNA, 19 nt, Human
ccagucccauacaggagau

SEQ ID NO: 924224 - RNA, 22 nt, Human
uuccuuccauagcaaaacaugc

SEQ ID NO: 924225 - RNA, 22 nt, Human
auaggcuuggcuuauucuuggg

SEQ ID NO: 924226 - RNA, 22 nt, Human
acuguaaaacagguuucaucau

SEQ ID NO: 924227 - RNA, 22 nt, Human
cagcugaguuacucugaggucu

SEQ ID NO: 924228 - RNA, 22 nt, Human
uguuugcuauauccuacuucau

SEQ ID NO: 924229 - RNA, 22 nt, Human
cagacacugcagcagucuccca

SEQ ID NO: 924230 - RNA, 22 nt, Human
ucagcaagaagucauuuguagc

SEQ ID NO: 924231 - RNA, 22 nt, Human
cagcucuguucauagauggugc

SEQ ID NO: 924232 - RNA, 22 nt, Human
acauccauuugcuuuauuugcu

SEQ ID NO: 924233 - RNA, 22 nt, Human
aauguucagcuuucuuacuuaa

SEQ ID NO: 924234 - RNA, 22 nt, Human
aggcucaguauagcuggcaagu

SEQ ID NO: 924235 - RNA, 22 nt, Human
agcugccagcaucccggaaggg

SEQ ID NO: 924236 - RNA, 22 nt, Human
gcuggccauggggagugaggag

SEQ ID NO: 924237 - RNA, 22 nt, Human
aaaugcaaggccaugugaagga

SEQ ID NO: 924238 - RNA, 22 nt, Human
cauguaaaaaauuaggucaucu

SEQ ID NO: 924239 - RNA, 22 nt, Human
uacugcauagacacugggauau

SEQ ID NO: 924240 - RNA, 22 nt, Human
ccagagaggcaaaacuccuucc

SEQ ID NO: 924241 - RNA, 22 nt, Human
ucagcaguccuccaggaucaag

SEQ ID NO: 924242 - RNA, 22 nt, Human
ccccaaaauucuuaaguugaau

SEQ ID NO: 924243 - RNA, 22 nt, Human
gacuccucucuaacccacugga

SEQ ID NO: 924244 - RNA, 22 nt, Human
gaaauguacuuuaaagccaucc

SEQ ID NO: 924245 - RNA, 22 nt, Human
ucuaggaggcacacaaguaguu

SEQ ID NO: 924246 - RNA, 22 nt, Human
ggcugcagguugguuggcagcu

SEQ ID NO: 924247 - RNA, 22 nt, Human
aauugagaugacagaggaauag

SEQ ID NO: 924248 - RNA, 22 nt, Human
ugugacagcacgguucaacugc

SEQ ID NO: 924249 - RNA, 22 nt, Human
cauacugugaagcuuacuauuu

SEQ ID NO: 924250 - RNA, 22 nt, Human
ggcuggcuaucugugguugccu

SEQ ID NO: 924251 - RNA, 22 nt, Human
ucacccagauagugagcauagu

SEQ ID NO: 924252 - RNA, 22 nt, Human
gagggcugauaaaugcgcaugg

SEQ ID NO: 924253 - RNA, 22 nt, Human
cuguccugaaguuuucaugaga

SEQ ID NO: 924254 - RNA, 22 nt, Human
ucuuaaagccaagcauaaacca

SEQ ID NO: 924255 - RNA, 22 nt, Human
ccuuuucuggccaccaagcgcu

SEQ ID NO: 924256 - RNA, 22 nt, Human
ugaggacaugagugggacagag

SEQ ID NO: 924257 - RNA, 21 nt, Human
acccugcuuuaugccguccuc

SEQ ID NO: 924258 - RNA, 22 nt, Human
aguuugaucugacagauuuuaa

SEQ ID NO: 924259 - RNA, 19 nt, Human
uuacuucaggagugaaauu

SEQ ID NO: 924260 - RNA, 22 nt, Human
auguucaguuagcacugaaguc

SEQ ID NO: 924261 - RNA, 18 nt, Human
aaggcuucaaagaguaga

SEQ ID NO: 924262 - RNA, 22 nt, Human
aauuauauguuaaucuucaauu

SEQ ID NO: 924263 - RNA, 22 nt, Human
uguauggcuuggaaauaguuua

SEQ ID NO: 924264 - RNA, 22 nt, Human
ucuuauuuuguuagaugcugua

SEQ ID NO: 924265 - RNA, 22 nt, Human
ugcugccaccccucaccagagc

SEQ ID NO: 924266 - RNA, 22 nt, Human
guccaagagaacugaaauagga

SEQ ID NO: 924267 - RNA, 22 nt, Human
gcucuaugcaugggagcaggag

SEQ ID NO: 924268 - RNA, 22 nt, Human
uuacacaaacacauuccagaua

SEQ ID NO: 924269 - RNA, 22 nt, Human
agcuuuguauuugagcauacga

SEQ ID NO: 924270 - RNA, 22 nt, Human
uuacacucugguugugggccuu

SEQ ID NO: 924271 - RNA, 22 nt, Human
ucacuccauagcuuaacucuuu

SEQ ID NO: 924272 - RNA, 22 nt, Human
gccaaggagacacgguguugua

SEQ ID NO: 924273 - RNA, 20 nt, Human
cuuugguggggguagcccag

SEQ ID NO: 924274 - RNA, 22 nt, Human
aguuagaagugugucaucugug

SEQ ID NO: 924275 - RNA, 17 nt, Human
gcagaaaagucaaggga

SEQ ID NO: 924276 - RNA, 22 nt, Human
cuggcugggagcucgccugcgg

SEQ ID NO: 924277 - RNA, 22 nt, Human
agcacagccucugguuucugac

SEQ ID NO: 924278 - RNA, 22 nt, Human
guacacacuguuugaucauuuc

SEQ ID NO: 924279 - RNA, 22 nt, Human
uguaaaaagcccagccgcugag

SEQ ID NO: 924280 - RNA, 16 nt, Human
cagagaggacagaggc

SEQ ID NO: 924281 - RNA, 22 nt, Human
auugggaugccggcugauaaga

SEQ ID NO: 924282 - RNA, 22 nt, Human
gaggggcuguggagcucucugg

SEQ ID NO: 924283 - RNA, 22 nt, Human
uuacauuguccagaaauuauug

SEQ ID NO: 924284 - RNA, 22 nt, Human
ugggugugaagucuguuggccu

SEQ ID NO: 924285 - RNA, 22 nt, Human
ggcaucuuguugcucaaaucua

SEQ ID NO: 924286 - RNA, 22 nt, Human
uuucauuauguuccuggaagag

SEQ ID NO: 924287 - RNA, 22 nt, Human
ucugucugcaccuaagcacagu

SEQ ID NO: 924288 - RNA, 22 nt, Human
aguggcuguucauuuuacacaa

SEQ ID NO: 924289 - RNA, 22 nt, Human
ucugugccaagcuuauaucugu

SEQ ID NO: 924290 - RNA, 22 nt, Human
gccugagcuacuagggagucug

SEQ ID NO: 924291 - RNA, 22 nt, Human
gaggucaggcuugcagcagggu

SEQ ID NO: 924292 - RNA, 22 nt, Human
uucccagucaaacgaaggacuu

SEQ ID NO: 924293 - RNA, 22 nt, Human
cuggaauguauguaucuuaaga

SEQ ID NO: 924294 - RNA, 22 nt, Human
cgaugggggcaguguuacauug

SEQ ID NO: 924295 - RNA, 22 nt, Human
auguuuaaauuuauagacagug

SEQ ID NO: 924296 - RNA, 22 nt, Human
gugccugcuaccugacuuguuu

SEQ ID NO: 924297 - RNA, 22 nt, Human
uuggaaaugcaaauauauugaa

SEQ ID NO: 924298 - RNA, 22 nt, Human
auucuucagcaggggacacuau

SEQ ID NO: 924299 - RNA, 22 nt, Human
gggaagggagggaccucagucu

SEQ ID NO: 924300 - RNA, 22 nt, Human
cuccagugagugagcaggcgac

SEQ ID NO: 924301 - RNA, 22 nt, Human
gcucagagaguuucacaaguuu

SEQ ID NO: 924302 - RNA, 21 nt, Human
aacauuucaggauccaaauug

SEQ ID NO: 924303 - RNA, 22 nt, Human
aaccuugaauacuuaaauacau

SEQ ID NO: 924304 - RNA, 22 nt, Human
gcucucucgugaacaggugguu

SEQ ID NO: 924305 - RNA, 22 nt, Human
agaaaagugcucuagugagagc

SEQ ID NO: 924306 - RNA, 18 nt, Human
aggcuucccaggcaggcc

SEQ ID NO: 924307 - RNA, 22 nt, Human
uuugggcaauucagugggaccu

SEQ ID NO: 924308 - RNA, 22 nt, Human
agggccugucuguagaacugaa

SEQ ID NO: 924309 - RNA, 22 nt, Human
aguuauagaaccagguccucac

SEQ ID NO: 924310 - RNA, 22 nt, Human
cccaggucuaugccagcucuga

SEQ ID NO: 924311 - RNA, 22 nt, Human
aaacugugagcuaguaaauagg

SEQ ID NO: 924312 - RNA, 22 nt, Human
ucaaggaaugacuauaugagga

SEQ ID NO: 924313 - RNA, 22 nt, Human
cucacaggguucuaucgaagag

SEQ ID NO: 924314 - RNA, 22 nt, Human
ugggcagggucucuguuaucag

SEQ ID NO: 924315 - RNA, 22 nt, Human
agcagggcugcggccccaccac

SEQ ID NO: 924316 - RNA, 23 nt, Human
gugcucugcggucugcuagucug

SEQ ID NO: 924317 - RNA, 22 nt, Human
uuagacauagaauauugucuag

SEQ ID NO: 924318 - RNA, 22 nt, Human
guuaacauaggcuuagggguuu

SEQ ID NO: 924319 - RNA, 17 nt, Human
uuuucucucuuggauuc

SEQ ID NO: 924320 - RNA, 22 nt, Human
uucaaagauuuucccaaagcuc

SEQ ID NO: 924321 - RNA, 22 nt, Human
ugccuuuagggaaaagcaagcu

SEQ ID NO: 924322 - RNA, 22 nt, Human
ugcccugcagugagugcgucug

SEQ ID NO: 924323 - RNA, 22 nt, Human
aagcccuguccggggggaagaa

SEQ ID NO: 924324 - RNA, 22 nt, Human
acagggcagagaggcaggcuug

SEQ ID NO: 924325 - RNA, 22 nt, Human
caccugggcuaaacuaugcagg

SEQ ID NO: 924326 - RNA, 23 nt, Human
uggacagcagcagcagugucacc

SEQ ID NO: 924327 - RNA, 22 nt, Human
cucuguccuccaccugcuuuca

SEQ ID NO: 924328 - RNA, 22 nt, Human
auggcccaggcaggcugguacu

SEQ ID NO: 924329 - RNA, 22 nt, Human
accugccuauggagccacaugg

SEQ ID NO: 924330 - RNA, 22 nt, Human
ucugagccagccaccuccuuca

SEQ ID NO: 924331 - RNA, 22 nt, Human
gaggcugggaaguccaagauca

SEQ ID NO: 924332 - RNA, 22 nt, Human
ccagggccucguguucugagug

SEQ ID NO: 924333 - RNA, 22 nt, Human
gcucugagagagcaaagucacc

SEQ ID NO: 924334 - RNA, 19 nt, Human
aacagucugggaagcacag

SEQ ID NO: 924335 - RNA, 22 nt, Human
agcagccagagaaugaugcagu

SEQ ID NO: 924336 - RNA, 22 nt, Human
agagggagaaaagaaucaguug

SEQ ID NO: 924337 - RNA, 22 nt, Human
gccacaugucaugugcucagua

SEQ ID NO: 924338 - RNA, 23 nt, Human
cucagaggccuguccaggguggu

SEQ ID NO: 924339 - RNA, 22 nt, Human
gcaggaugaaggcagaggcuga

SEQ ID NO: 924340 - RNA, 22 nt, Human
caaguuuacuacuaccugugug

SEQ ID NO: 924341 - RNA, 22 nt, Human
uagaggugagacuucagugaca

SEQ ID NO: 924342 - RNA, 22 nt, Human
gccaccaggagcccaguccaaa

SEQ ID NO: 924343 - RNA, 22 nt, Human
uuucuaauaguugagucagcua

SEQ ID NO: 924344 - RNA, 22 nt, Human
ucagaggacgcacuaggguugu

SEQ ID NO: 924345 - RNA, 22 nt, Human
ugccugggacuguacuaaauuu

SEQ ID NO: 924346 - RNA, 22 nt, Human
gcaggcaggcuuccuugaacug

SEQ ID NO: 924347 - RNA, 22 nt, Human
acugcaaaaaugggugcauuca

SEQ ID NO: 924348 - RNA, 17 nt, Human
cucugggcagccugggg

SEQ ID NO: 924349 - RNA, 22 nt, Human
cugcagagcaugaggaggucug

SEQ ID NO: 924350 - RNA, 22 nt, Human
aaacaagcaagcacauaauuuu

SEQ ID NO: 924351 - RNA, 22 nt, Human
ggcacacagauggagcacuagc

SEQ ID NO: 924352 - RNA, 22 nt, Human
ugggagcaaaugacugggagau

SEQ ID NO: 924353 - RNA, 22 nt, Human
auuccuuggcauucuggacuug

SEQ ID NO: 924354 - RNA, 22 nt, Human
ccaggcagucaggguugugugu

SEQ ID NO: 924355 - RNA, 22 nt, Human
auucaucuguacuucaauaucu

SEQ ID NO: 924356 - RNA, 22 nt, Human
uuacaaguauuuaagaugcugu

SEQ ID NO: 924357 - RNA, 22 nt, Human
cagaaggcuuuguggaguagac

SEQ ID NO: 924358 - RNA, 22 nt, Human
uaaaaguggauaagcuguagga

SEQ ID NO: 924359 - RNA, 22 nt, Human
gcagccagcaggaagcgggaga

SEQ ID NO: 924360 - RNA, 22 nt, Human
uucaggaucauuuguuuuaucu

SEQ ID NO: 924361 - RNA, 22 nt, Human
gaaggaagggcuggcugucuug

SEQ ID NO: 924362 - RNA, 22 nt, Human
uauuucugauugcucaugaggc

SEQ ID NO: 924363 - RNA, 22 nt, Human
aagagcuggaugaagaaaucaa

SEQ ID NO: 924364 - RNA, 23 nt, Human
cuggcccaggugagagguuggug

SEQ ID NO: 924365 - RNA, 22 nt, Human
agcucccagaguccucugccca

SEQ ID NO: 924366 - RNA, 22 nt, Human
cauagaauaugugugauuguua

SEQ ID NO: 924367 - RNA, 22 nt, Human
agcauuuagucuuuauugcagc

SEQ ID NO: 924368 - RNA, 22 nt, Human
uuugaacaagagcuucacauua

SEQ ID NO: 924369 - RNA, 22 nt, Human
agcugccaaguuucucaguuua

SEQ ID NO: 924370 - RNA, 20 nt, Human
agaaauauugaguucagagg

SEQ ID NO: 924371 - RNA, 22 nt, Human
aucacaucucaccacugcaacc

SEQ ID NO: 924372 - RNA, 22 nt, Human
cuguccuguacuuugaggcccu

SEQ ID NO: 924373 - RNA, 22 nt, Human
uggcagagguauauugggagga

SEQ ID NO: 924374 - RNA, 22 nt, Human
cuuucuuuguccaccaacaaug

SEQ ID NO: 924375 - RNA, 22 nt, Human
caagccaggugaacauaacaag

SEQ ID NO: 924376 - RNA, 22 nt, Human
cugugucuugaguaauucggug

SEQ ID NO: 924377 - RNA, 22 nt, Human
ccuguuguuuagcacuuagaac

SEQ ID NO: 924378 - RNA, 22 nt, Human
ucacacauuugaaggccuguca

SEQ ID NO: 924379 - RNA, 22 nt, Human
ugucacagucucgugagcaucu

SEQ ID NO: 924380 - RNA, 22 nt, Human
cugagcugagccaaaucugucu

SEQ ID NO: 924381 - RNA, 22 nt, Human
aggcaggaggaucauggaugca

SEQ ID NO: 924382 - RNA, 22 nt, Human
ggcugccugggagcccuccucu

SEQ ID NO: 924383 - RNA, 22 nt, Human
auguguauuuccaucgaucagc

SEQ ID NO: 924384 - RNA, 22 nt, Human
gcugcuggaugcgcuugauggu

SEQ ID NO: 924385 - RNA, 22 nt, Human
uuaggcaaagcuggaauccagg

SEQ ID NO: 924386 - RNA, 22 nt, Human
ucugcaggaaaaaagugccugg

SEQ ID NO: 924387 - RNA, 22 nt, Human
ccagagaguaucauggagagua

SEQ ID NO: 924388 - RNA, 22 nt, Human
gguguggguccuugugcuugcu

SEQ ID NO: 924389 - RNA, 22 nt, Human
gaccugagauuuugaggcucau

SEQ ID NO: 924390 - RNA, 22 nt, Human
uccuggauggccugcaggcggu

SEQ ID NO: 924391 - RNA, 22 nt, Human
uccacaggcugaggcccuucug

SEQ ID NO: 924392 - RNA, 22 nt, Human
ugcuccagaaaaacuugagacu

SEQ ID NO: 924393 - RNA, 19 nt, Human
ucuaacagcuuucauucua

SEQ ID NO: 924394 - RNA, 22 nt, Human
uuacaacugaagcuaaugugcu

SEQ ID NO: 924395 - RNA, 22 nt, Human
cauggccucaaaggacugcaga

SEQ ID NO: 924396 - RNA, 22 nt, Human
auggcagcauaguggcaaguua

SEQ ID NO: 924397 - RNA, 19 nt, Human
caguuuaugcuuuggggac

SEQ ID NO: 924398 - RNA, 22 nt, Human
ucugcagguguuggaaggguca

SEQ ID NO: 924399 - RNA, 22 nt, Human
ugcucaucaacaugaugaucau

SEQ ID NO: 924400 - RNA, 23 nt, Human
cagggaggagauacuguguaucu

SEQ ID NO: 924401 - RNA, 23 nt, Human
auuuuaaccuugacuaacaugca

SEQ ID NO: 924402 - RNA, 22 nt, Human
ugaaaugcuucucugaaaauac

SEQ ID NO: 924403 - RNA, 22 nt, Human
gcuagaauauuggguaggcaag

SEQ ID NO: 924404 - RNA, 22 nt, Human
cuguggcugucucuuucccaug

SEQ ID NO: 924405 - RNA, 22 nt, Human
aucuuauuuaacacagcaaaac

SEQ ID NO: 924406 - RNA, 22 nt, Human
auguguguguuuaauccucaaa

SEQ ID NO: 924407 - RNA, 22 nt, Human
agccaagcacucaacuccugga

SEQ ID NO: 924408 - RNA, 22 nt, Human
cuggcagggcugguauucaaaa

SEQ ID NO: 924409 - RNA, 22 nt, Human
ggugcugauuaagaacuguaua

SEQ ID NO: 924410 - RNA, 22 nt, Human
aaggucuauggagaagacugag

SEQ ID NO: 924411 - RNA, 22 nt, Human
ggacuugcaggggagacugcgu

SEQ ID NO: 924412 - RNA, 19 nt, Human
caucuggaugauucuccug

SEQ ID NO: 924413 - RNA, 22 nt, Human
ugucccagucaaggcugucauc

SEQ ID NO: 924414 - RNA, 22 nt, Human
aaagaguucacggaggccaaag

SEQ ID NO: 924415 - RNA, 22 nt, Human
guucuuaagaccacaauaaaaa

SEQ ID NO: 924416 - RNA, 22 nt, Human
cugaagacugcugagaaguuac

SEQ ID NO: 924417 - RNA, 22 nt, Human
uucuaacuuucaagguccuuuc

SEQ ID NO: 924418 - RNA, 23 nt, Human
aggcacucgacagaaauauugga

SEQ ID NO: 924419 - RNA, 22 nt, Human
ucugaaauaggagccauguaga

SEQ ID NO: 924420 - RNA, 19 nt, Human
aauauuuuagccucuuccu

SEQ ID NO: 924421 - RNA, 22 nt, Human
ggauguugauugaauggccauu

SEQ ID NO: 924422 - RNA, 20 nt, Human
agaacugaaucauuuugggu

SEQ ID NO: 924423 - RNA, 22 nt, Human
uaaaugacaacaccugcuuuug

SEQ ID NO: 924424 - RNA, 22 nt, Human
cccucgcucuaggcagcccugu

SEQ ID NO: 924425 - RNA, 19 nt, Human
ggcugucuacgaaccaguc

SEQ ID NO: 924426 - RNA, 22 nt, Human
agccagcuguucuggggcagca

SEQ ID NO: 924427 - RNA, 22 nt, Human
ggcagcugcaaaucugcucugu

SEQ ID NO: 924428 - RNA, 20 nt, Human
acugcuucuuucucugaccu

SEQ ID NO: 924429 - RNA, 22 nt, Human
aauaacuggcacauaucacaua

SEQ ID NO: 924430 - RNA, 22 nt, Human
uagcuguuacccauaaaagcca

SEQ ID NO: 924431 - RNA, 22 nt, Human
gacaucaggccugcagucuggg

SEQ ID NO: 924432 - RNA, 22 nt, Human
gcuggaguuggcaaggcaugua

SEQ ID NO: 924433 - RNA, 22 nt, Human
uugcagggcuuggggauuacag

SEQ ID NO: 924434 - RNA, 22 nt, Human
caucuuuucagaagccauucug

SEQ ID NO: 924435 - RNA, 22 nt, Human
gugagcagagaucgcgugauug

SEQ ID NO: 924436 - RNA, 22 nt, Human
gaaugauuaacuaguugauaca

SEQ ID NO: 924437 - RNA, 22 nt, Human
uccaggggugauuuuugacuug

SEQ ID NO: 924438 - RNA, 22 nt, Human
aaugaacaaaauaugcuuugca

SEQ ID NO: 924439 - RNA, 22 nt, Human
aguguguaagggaucaaagagu

SEQ ID NO: 924440 - RNA, 22 nt, Human
guuucuuagacauaugccauga

SEQ ID NO: 924441 - RNA, 22 nt, Human
gggauggcucaaaggagucagg

SEQ ID NO: 924442 - RNA, 21 nt, Human
acaucagaguugugaagguag

SEQ ID NO: 924443 - RNA, 22 nt, Human
uguuaacagguaacugaggcug

SEQ ID NO: 924444 - RNA, 22 nt, Human
ccucucuguaagggucccuccc

SEQ ID NO: 924445 - RNA, 22 nt, Human
uagaaucuggaucugggcgcau

SEQ ID NO: 924446 - RNA, 22 nt, Human
aaagaucauucucugguccaga

SEQ ID NO: 924447 - RNA, 22 nt, Human
aacaucugaaaaggcuucacuc

SEQ ID NO: 924448 - RNA, 23 nt, Human
gaauucuuaaggucacuaaaguc

SEQ ID NO: 924449 - RNA, 22 nt, Human
auguuuaaggaacugguuugcu

SEQ ID NO: 924450 - RNA, 22 nt, Human
cagaaauacccagcauuuggag

SEQ ID NO: 924451 - RNA, 22 nt, Human
acuguggaugccaaaggggagg

SEQ ID NO: 924452 - RNA, 22 nt, Human
ugagguccugcauguugagguc

SEQ ID NO: 924453 - RNA, 22 nt, Human
ugaggcagccugcauuaaagag

SEQ ID NO: 924454 - RNA, 22 nt, Human
uuccugugcuuaauucucacug

SEQ ID NO: 924455 - RNA, 22 nt, Human
cuuggcccaguugccaaggaaa

SEQ ID NO: 924456 - RNA, 22 nt, Human
auuacacaggcuggcucuuuga

SEQ ID NO: 924457 - RNA, 22 nt, Human
uagggagcucuggcagaaggaa

SEQ ID NO: 924458 - RNA, 22 nt, Human
guggcugggcuccgagcggcuu

SEQ ID NO: 924459 - RNA, 22 nt, Human
ggccugagcucuggggaggcaa

SEQ ID NO: 924460 - RNA, 22 nt, Human
uacuacaagggcccuaaaaggu

SEQ ID NO: 924461 - RNA, 22 nt, Human
ugcaggcuggaggagggacuaa

SEQ ID NO: 924462 - RNA, 22 nt, Human
aagcccugcagucucugccaca

SEQ ID NO: 924463 - RNA, 22 nt, Human
ugaagccaucccucagauggcc

SEQ ID NO: 924464 - RNA, 22 nt, Human
ccagccuccauguagauagcug

SEQ ID NO: 924465 - RNA, 22 nt, Human
aggcucagagaugaguaagcac

SEQ ID NO: 924466 - RNA, 22 nt, Human
aaggcuauugggaagaaaaaug

SEQ ID NO: 924467 - RNA, 22 nt, Human
cagcaggcccagaguuucaugg

SEQ ID NO: 924468 - RNA, 22 nt, Human
uuguggggcaacagcaggugaa

SEQ ID NO: 924469 - RNA, 22 nt, Human
guggcagagccaaggcuggagc

SEQ ID NO: 924470 - RNA, 22 nt, Human
cauggcaggaaaaugaacaggc

SEQ ID NO: 924471 - RNA, 22 nt, Human
agagggagaagcuaaaauaacu

SEQ ID NO: 924472 - RNA, 22 nt, Human
acaacauuauacauagaaagcu

SEQ ID NO: 924473 - RNA, 17 nt, Human
ggaaagguagaguaauc

SEQ ID NO: 924474 - RNA, 22 nt, Human
cauuuccagcuccugcaucaug

SEQ ID NO: 924475 - RNA, 22 nt, Human
acccaggagcucugggguccuc

SEQ ID NO: 924476 - RNA, 22 nt, Human
cagggcugugcccaucuucccc

SEQ ID NO: 924477 - RNA, 19 nt, Human
ucucacaucagcuccuagc

SEQ ID NO: 924478 - RNA, 22 nt, Human
augggcaggcacuggcucucag

SEQ ID NO: 924479 - RNA, 22 nt, Human
aucccauuuccuguuuugucaa

SEQ ID NO: 924480 - RNA, 22 nt, Human
cccugcuuagcacccuugcacc

SEQ ID NO: 924481 - RNA, 22 nt, Human
acccggagucggagguugcagu

SEQ ID NO: 924482 - RNA, 22 nt, Human
caaggcuagaaguccaacauca

SEQ ID NO: 924483 - RNA, 21 nt, Human
ugcagcagaagucucuguguc

SEQ ID NO: 924484 - RNA, 22 nt, Human
auggcaguggaaugggaugagu

SEQ ID NO: 924485 - RNA, 23 nt, Human
aggcacugaaugugucagugagu

SEQ ID NO: 924486 - RNA, 22 nt, Human
cauagagugauguaagguaugu

SEQ ID NO: 924487 - RNA, 22 nt, Human
cauuuacauuuaagguuaauau

SEQ ID NO: 924488 - RNA, 22 nt, Human
acaaagugcugacauuacaggc

SEQ ID NO: 924489 - RNA, 22 nt, Human
ccaaaauauuagugcuuaagua

SEQ ID NO: 924490 - RNA, 22 nt, Human
ggcagcaaguggugggagacuu

SEQ ID NO: 924491 - RNA, 22 nt, Human
ugugaggacauuggaggacuca

SEQ ID NO: 924492 - RNA, 21 nt, Human
uaaagcuagaaccuuagcuuu

SEQ ID NO: 924493 - RNA, 22 nt, Human
uagacuagaggaucagcaaggg

SEQ ID NO: 924494 - RNA, 22 nt, Human
cugggagcugucaggagcgugu

SEQ ID NO: 924495 - RNA, 22 nt, Human
caacuuuaaauggcuaugucug

SEQ ID NO: 924496 - RNA, 22 nt, Human
auucucuuuguauaacaucuug

SEQ ID NO: 924497 - RNA, 22 nt, Human
gggcagugguuacacagcugag

SEQ ID NO: 924498 - RNA, 22 nt, Human
auugcagggaggcagguagaug

SEQ ID NO: 924499 - RNA, 22 nt, Human
cuggacagaaaaggccacugga

SEQ ID NO: 924500 - RNA, 19 nt, Human
ggcuccuguggcugcagcc

SEQ ID NO: 924501 - RNA, 22 nt, Human
ugccaucacugaacuucugaaa

SEQ ID NO: 924502 - RNA, 22 nt, Human
acagcuggaggggcugcagagg

SEQ ID NO: 924503 - RNA, 22 nt, Human
ucuuuguuugccuuuaucaaga

SEQ ID NO: 924504 - RNA, 18 nt, Human
ugaggccagagugggcau

SEQ ID NO: 924505 - RNA, 22 nt, Human
aacucuuugaacagugaggcua

SEQ ID NO: 924506 - RNA, 22 nt, Human
augugcaacuucagcagaaagg

SEQ ID NO: 924507 - RNA, 22 nt, Human
ugugcccagacugccucaguga

SEQ ID NO: 924508 - RNA, 22 nt, Human
augggcugggaauacacagggg

SEQ ID NO: 924509 - RNA, 22 nt, Human
aauccagaugagcaaucauacu

SEQ ID NO: 924510 - RNA, 22 nt, Human
auagcuuucuuaaauauauaaa

SEQ ID NO: 924511 - RNA, 22 nt, Human
guguuaaaugcaaucacaugca

SEQ ID NO: 924512 - RNA, 22 nt, Human
agucugaagauauucuugcagg

SEQ ID NO: 924513 - RNA, 22 nt, Human
ggagcuguuggcagcuaucuug

SEQ ID NO: 924514 - RNA, 22 nt, Human
gcaaggcaguccuggggcccug

SEQ ID NO: 924515 - RNA, 23 nt, Human
acagagguccaaacaguauaagc

SEQ ID NO: 924516 - RNA, 22 nt, Human
cccauugugguuguugaggaua

SEQ ID NO: 924517 - RNA, 22 nt, Human
cugcaucuuagucaaaaucugu

SEQ ID NO: 924518 - RNA, 22 nt, Human
guguaaacaacagugguuugaa

SEQ ID NO: 924519 - RNA, 22 nt, Human
cauuuacaauguacagguugug

SEQ ID NO: 924520 - RNA, 22 nt, Human
gccacaggcuccagcaucagua

SEQ ID NO: 924521 - RNA, 22 nt, Human
ugcuuuuagcuaguaacuagua

SEQ ID NO: 924522 - RNA, 22 nt, Human
ggggcugauggaacucaggccu

SEQ ID NO: 924523 - RNA, 22 nt, Human
gucaucuugcuguuuuagaucu

SEQ ID NO: 924524 - RNA, 22 nt, Human
ugcuggccucggcgcugggccu

SEQ ID NO: 924525 - RNA, 22 nt, Human
uuucacaacguuguggugagag

SEQ ID NO: 924526 - RNA, 22 nt, Human
gccagggaggcuguaggguccu

SEQ ID NO: 924527 - RNA, 22 nt, Human
ggccuguccagccugccuggcu

SEQ ID NO: 924528 - RNA, 18 nt, Human
aagauucugcuucucucu

SEQ ID NO: 924529 - RNA, 22 nt, Human
ucagaaauacuaucagcuuuug

SEQ ID NO: 924530 - RNA, 22 nt, Human
ccuggcagacugugagggcagg

SEQ ID NO: 924531 - RNA, 22 nt, Human
aucaaagguaucuaugcugucu

SEQ ID NO: 924532 - RNA, 20 nt, Human
aauacuaaacacaaagcagu

SEQ ID NO: 924533 - RNA, 22 nt, Human
gcucugagacacaaagggugca

SEQ ID NO: 924534 - RNA, 22 nt, Human
aguggagcuuuuccuaucagag

SEQ ID NO: 924535 - RNA, 22 nt, Human
uaauuauuugaagacauuagag

SEQ ID NO: 924536 - RNA, 20 nt, Human
ggcaggcaggagguuuccag

SEQ ID NO: 924537 - RNA, 22 nt, Human
gcaaacugcauucuauagcuug

SEQ ID NO: 924538 - RNA, 19 nt, Human
cugugcuuuaaacuccuau

SEQ ID NO: 924539 - RNA, 22 nt, Human
gcugcugagaauugcaggcaag

SEQ ID NO: 924540 - RNA, 22 nt, Human
uuucaggauuuuaugagauagu

SEQ ID NO: 924541 - RNA, 19 nt, Human
uaucuuuaugcaguggugg

SEQ ID NO: 924542 - RNA, 22 nt, Human
guggcuucaccccaguugucuc

SEQ ID NO: 924543 - RNA, 22 nt, Human
cccaggaaugagcaggcagggg

SEQ ID NO: 924544 - RNA, 22 nt, Human
aagcuguguauuacagaauauu

SEQ ID NO: 924545 - RNA, 23 nt, Human
uaggaagacagcaaaagaaugga

SEQ ID NO: 924546 - RNA, 22 nt, Human
gccucuccgagccacugccucu

SEQ ID NO: 924547 - RNA, 22 nt, Human
uuguuuuggaagaacuuacucu

SEQ ID NO: 924548 - RNA, 22 nt, Human
cagaggggcugacacccuuggc

SEQ ID NO: 924549 - RNA, 22 nt, Human
agcugcucaggagagccagguc

SEQ ID NO: 924550 - RNA, 22 nt, Human
uucauccauaugcagagagcuu

SEQ ID NO: 924551 - RNA, 22 nt, Human
agagucugaggcagcugcagcc

SEQ ID NO: 924552 - RNA, 22 nt, Human
uucauguauuuaucauguaaau

SEQ ID NO: 924553 - RNA, 22 nt, Human
agaaaacauuacauaggugugu

SEQ ID NO: 924554 - RNA, 22 nt, Human
uuugacuccugccuucuccugu

SEQ ID NO: 924555 - RNA, 22 nt, Human
augcucuagacauacuggcuau

SEQ ID NO: 924556 - RNA, 20 nt, Human
ugagugaguuuguggcagga

SEQ ID NO: 924557 - RNA, 22 nt, Human
aguauuucuucauaugauuacu

SEQ ID NO: 924558 - RNA, 22 nt, Human
gggccaaggggagcuggaaggg

SEQ ID NO: 924559 - RNA, 22 nt, Human
gugauguagcccuaauucugca

SEQ ID NO: 924560 - RNA, 22 nt, Human
aauaucacaggaggagaccaag

SEQ ID NO: 924561 - RNA, 22 nt, Human
cuuuacugaagugaagaccugg

SEQ ID NO: 924562 - RNA, 22 nt, Human
uugcauauccuccaacacaugg

SEQ ID NO: 924563 - RNA, 22 nt, Human
uucuaugucagugugcucugug

SEQ ID NO: 924564 - RNA, 22 nt, Human
acagagacaauauuuguaaagu

SEQ ID NO: 924565 - RNA, 22 nt, Human
gagaggaaagauauauacuucu

SEQ ID NO: 924566 - RNA, 22 nt, Human
uacaaagauaaaaucucaccau

SEQ ID NO: 924567 - RNA, 22 nt, Human
cauaaaagccaccuauuuaaag

SEQ ID NO: 924568 - RNA, 22 nt, Human
gggugggagaaaugaguaucua

SEQ ID NO: 924569 - RNA, 22 nt, Human
ucaucuccauacggucucgcag

SEQ ID NO: 924570 - RNA, 22 nt, Human
ggaagcuguuccuguguggcca

SEQ ID NO: 924571 - RNA, 22 nt, Human
caccucaggcagcaaagucuca

SEQ ID NO: 924572 - RNA, 22 nt, Human
ccucaggcugcucacacuuguc

SEQ ID NO: 924573 - RNA, 22 nt, Human
aaaggcccacagucagucuacc

SEQ ID NO: 924574 - RNA, 22 nt, Human
cgcugcagcuggcugcagggaa

SEQ ID NO: 924575 - RNA, 22 nt, Human
ucuugggaucaccuccuggcuu

SEQ ID NO: 924576 - RNA, 22 nt, Human
gaaaguucugcucugauuggcu

SEQ ID NO: 924577 - RNA, 22 nt, Human
cauucccaugacuccugcucag

SEQ ID NO: 924578 - RNA, 22 nt, Human
cuguccauuuugaauuuucagu

SEQ ID NO: 924579 - RNA, 22 nt, Human
agcagagucuucaagggcaggc

SEQ ID NO: 924580 - RNA, 22 nt, Human
caucagcaggcaacacucuugg

SEQ ID NO: 924581 - RNA, 19 nt, Human
aggcucugagcuccuggag

SEQ ID NO: 924582 - RNA, 22 nt, Human
gaggggccuggcacugagcugg

SEQ ID NO: 924583 - RNA, 22 nt, Human
cuggccacugauuccuccccug

SEQ ID NO: 924584 - RNA, 22 nt, Human
agauggaguuguagcagugacu

SEQ ID NO: 924585 - RNA, 22 nt, Human
cuccuggagcagcaggcgcagg

SEQ ID NO: 924586 - RNA, 22 nt, Human
ccucacagcccuuggcccagga

SEQ ID NO: 924587 - RNA, 23 nt, Human
gcugggcuuacucuuucagugag

SEQ ID NO: 924588 - RNA, 22 nt, Human
augauguaauggaaagaacaga

SEQ ID NO: 924589 - RNA, 22 nt, Human
acaaaugugucuaauugugccu

SEQ ID NO: 924590 - RNA, 22 nt, Human
acacuguuccacacuaagaagg

SEQ ID NO: 924591 - RNA, 22 nt, Human
ucagauuuacugcagagcagau

SEQ ID NO: 924592 - RNA, 22 nt, Human
caaggcauuucgcuuagagaga

SEQ ID NO: 924593 - RNA, 22 nt, Human
gcagagcagcaaauggaaagga

SEQ ID NO: 924594 - RNA, 22 nt, Human
gaggcugguucccuugaucuuu

SEQ ID NO: 924595 - RNA, 22 nt, Human
uggucgaccaguuggaaaguaa

SEQ ID NO: 924596 - RNA, 22 nt, Human
ugccugugggugaugauuugau

SEQ ID NO: 924597 - RNA, 22 nt, Human
ugcaugcuucaggcuggcucug

SEQ ID NO: 924598 - RNA, 22 nt, Human
aggcuguggugggcuuugagcc

SEQ ID NO: 924599 - RNA, 22 nt, Human
uggcacagccacugaaucggga

SEQ ID NO: 924600 - RNA, 22 nt, Human
uccugagaugagacagugcugc

SEQ ID NO: 924601 - RNA, 22 nt, Human
caaaugaauuucccugcaaaug

SEQ ID NO: 924602 - RNA, 22 nt, Human
uggcaguuuucaagaguucugu

SEQ ID NO: 924603 - RNA, 22 nt, Human
auuucaugaaacauuccccuug

SEQ ID NO: 924604 - RNA, 22 nt, Human
acuuaaaguaguuuuacugugg

SEQ ID NO: 924605 - RNA, 22 nt, Human
aaaaaugcugugguagcugugu

SEQ ID NO: 924606 - RNA, 22 nt, Human
uaaaaaucuuaugaauggcaag

SEQ ID NO: 924607 - RNA, 21 nt, Human
uauagucacuugagcauuauc

SEQ ID NO: 924608 - RNA, 22 nt, Human
aggaggguggggucugccuguc

SEQ ID NO: 924609 - RNA, 22 nt, Human
acugccugcuccuggcuccaca

SEQ ID NO: 924610 - RNA, 22 nt, Human
ugaaaacuccaaguuucaucag

SEQ ID NO: 924611 - RNA, 22 nt, Human
caaggcaggcaguucacuugag

SEQ ID NO: 924612 - RNA, 22 nt, Human
cauguuuaauugcgauguuuga

SEQ ID NO: 924613 - RNA, 22 nt, Human
aaaacuacauuugacauuuugu

SEQ ID NO: 924614 - RNA, 22 nt, Human
acagaggguguggaggaagacg

SEQ ID NO: 924615 - RNA, 22 nt, Human
gggcagguguugucaaucuaau

SEQ ID NO: 924616 - RNA, 22 nt, Human
aagugcaauuugaaauucugca

SEQ ID NO: 924617 - RNA, 22 nt, Human
cugucacacugauaucaggcuu

SEQ ID NO: 924618 - RNA, 22 nt, Human
cuuguuaaaaugccgauucuga

SEQ ID NO: 924619 - RNA, 17 nt, Human
uccuggcucugccacug

SEQ ID NO: 924620 - RNA, 22 nt, Human
ucuaggguggagcugggaaucc

SEQ ID NO: 924621 - RNA, 19 nt, Human
aucuacaauuauucucagu

SEQ ID NO: 924622 - RNA, 22 nt, Human
uuucaauguaacauuuccaggc

SEQ ID NO: 924623 - RNA, 22 nt, Human
ugggccugggagggcagacgcu

SEQ ID NO: 924624 - RNA, 22 nt, Human
aauuauccaccuuugcaugauu

SEQ ID NO: 924625 - RNA, 22 nt, Human
cuucucuugguaguucuuguug

SEQ ID NO: 924626 - RNA, 22 nt, Human
gugcucugggcugccugacaug

SEQ ID NO: 924627 - RNA, 22 nt, Human
gcugagucuugagcacugagca

SEQ ID NO: 924628 - RNA, 22 nt, Human
uucuuuaugcuucuguuuaggc

SEQ ID NO: 924629 - RNA, 22 nt, Human
acauagaguaucauacuggaug

SEQ ID NO: 924630 - RNA, 22 nt, Human
cuggguggcuguccagccagcc

SEQ ID NO: 924631 - RNA, 22 nt, Human
aggccucauugcccaccugugg

SEQ ID NO: 924632 - RNA, 22 nt, Human
ggcuuccccacaaagcacacaa

SEQ ID NO: 924633 - RNA, 22 nt, Human
aguaaaguaccaaagugugagu

SEQ ID NO: 924634 - RNA, 22 nt, Human
acccagcaugacaccugcacau

SEQ ID NO: 924635 - RNA, 18 nt, Human
cauaauuuucuuucuuua

SEQ ID NO: 924636 - RNA, 21 nt, Human
acauucacaggauauuaucau

SEQ ID NO: 924637 - RNA, 21 nt, Human
ucauuuuuauugcuaccuugc

SEQ ID NO: 924638 - RNA, 22 nt, Human
cuggaggagaacuugaggaagg

SEQ ID NO: 924639 - RNA, 22 nt, Human
ugguauauuaacuaguuucuuc

SEQ ID NO: 924640 - RNA, 22 nt, Human
uaauccugaucaauuuuagcuu

SEQ ID NO: 924641 - RNA, 22 nt, Human
uucccaaaauauaacaguuaac

SEQ ID NO: 924642 - RNA, 23 nt, Human
ggagccuggcauaugagacgcau

SEQ ID NO: 924643 - RNA, 22 nt, Human
cugugucccccucagccaggug

SEQ ID NO: 924644 - RNA, 22 nt, Human
agacagugauguaagcaggagu

SEQ ID NO: 924645 - RNA, 22 nt, Human
guggggaaaggaguggggcuca

SEQ ID NO: 924646 - RNA, 22 nt, Human
uuauguacccacucauauuccc

SEQ ID NO: 924647 - RNA, 22 nt, Human
uauccaaaguggcauauuauag

SEQ ID NO: 924648 - RNA, 22 nt, Human
auuuucucucaaaccuuaaaau

SEQ ID NO: 924649 - RNA, 22 nt, Human
gacccuggaguuaguccugugu

SEQ ID NO: 924650 - RNA, 22 nt, Human
gauguauauucugugccaggau

SEQ ID NO: 924651 - RNA, 22 nt, Human
uuucuugccagagaaaaagagu

SEQ ID NO: 924652 - RNA, 19 nt, Human
uuuacaaguucuuuguaug

SEQ ID NO: 924653 - RNA, 22 nt, Human
ugugugucugcacauguauaau

SEQ ID NO: 924654 - RNA, 22 nt, Human
caugaacaauuugcucacugau

SEQ ID NO: 924655 - RNA, 22 nt, Human
agagggaacggaucccagcgcg

SEQ ID NO: 924656 - RNA, 22 nt, Human
ugaguucuucacauuaccuacg

SEQ ID NO: 924657 - RNA, 19 nt, Human
agcagggacauggaacuuu

SEQ ID NO: 924658 - RNA, 22 nt, Human
uuccagggcagcaagugaaugg

SEQ ID NO: 924659 - RNA, 22 nt, Human
ugucuagaggccaacaggaaag

SEQ ID NO: 924660 - RNA, 22 nt, Human
gcuggcucugcacccaggccuc

SEQ ID NO: 924661 - RNA, 22 nt, Human
acuuucuccagaaaaccaagga

SEQ ID NO: 924662 - RNA, 22 nt, Human
auguuucaaauauauagaguug

SEQ ID NO: 924663 - RNA, 22 nt, Human
cuagaaauacaggcacgugcca

SEQ ID NO: 924664 - RNA, 22 nt, Human
aacaaguuacucuuaaaguaua

SEQ ID NO: 924665 - RNA, 22 nt, Human
gcuggagauacugcucaguauc

SEQ ID NO: 924666 - RNA, 22 nt, Human
aaggaugugacucagucagcua

SEQ ID NO: 924667 - RNA, 23 nt, Human
ugcccucccaaugcuucggucac

SEQ ID NO: 924668 - RNA, 21 nt, Human
agaaccuuggaugccauugca

SEQ ID NO: 924669 - RNA, 22 nt, Human
gugcaaacaucauagaguguac

SEQ ID NO: 924670 - RNA, 21 nt, Human
ucuuuccaauauucaugucuc

SEQ ID NO: 924671 - RNA, 22 nt, Human
ucuccaggcacuaccuggguaa

SEQ ID NO: 924672 - RNA, 22 nt, Human
gcugcucuccauggccgugagu

SEQ ID NO: 924673 - RNA, 22 nt, Human
ggcucauaaacucaguucaguu

SEQ ID NO: 924674 - RNA, 23 nt, Human
uaagacacccgacuccagagaug

SEQ ID NO: 924675 - RNA, 22 nt, Human
aaaaaagauugaugguggaugc

SEQ ID NO: 924676 - RNA, 22 nt, Human
guuucaugccauuuccagauug

SEQ ID NO: 924677 - RNA, 22 nt, Human
agucaggauuuuggauuauucg

SEQ ID NO: 924678 - RNA, 22 nt, Human
gcauuuguugaguugccagcua

SEQ ID NO: 924679 - RNA, 22 nt, Human
agagugggcaggagccucgacu

SEQ ID NO: 924680 - RNA, 22 nt, Human
cgucccaguuccagccgcgcug

SEQ ID NO: 924681 - RNA, 19 nt, Human
aggggcacugucucuagag

SEQ ID NO: 924682 - RNA, 22 nt, Human
uguaaagcauuuccuaaaucca

SEQ ID NO: 924683 - RNA, 19 nt, Human
cuguggccuccaggaggga

SEQ ID NO: 924684 - RNA, 22 nt, Human
aaacuacuggauuaguaacuua

SEQ ID NO: 924685 - RNA, 22 nt, Human
aguguuuaguuaagauuucaaa

SEQ ID NO: 924686 - RNA, 22 nt, Human
cuaaacaucuugcaaugcacag

SEQ ID NO: 924687 - RNA, 22 nt, Human
aguacagucaggaagcugcugu

SEQ ID NO: 924688 - RNA, 22 nt, Human
cucaggccauucuuccagcugc

SEQ ID NO: 924689 - RNA, 22 nt, Human
ugcugaaagaccguauuuaucu

SEQ ID NO: 924690 - RNA, 22 nt, Human
cugggcauuuuucucuguuaca

SEQ ID NO: 924691 - RNA, 22 nt, Human
gccaggcugguuauuuaaugag

SEQ ID NO: 924692 - RNA, 22 nt, Human
ccugccaggcgagucuaggcca

SEQ ID NO: 924693 - RNA, 22 nt, Human
cuucccagacgggguggcagcc

SEQ ID NO: 924694 - RNA, 22 nt, Human
aguuccagugugagagaacaug

SEQ ID NO: 924695 - RNA, 22 nt, Human
aaagaguuaagagucuuaagcu

SEQ ID NO: 924696 - RNA, 22 nt, Human
uauuucucagcauuuuacaucc

SEQ ID NO: 924697 - RNA, 19 nt, Human
gacuucugauguccagaug

SEQ ID NO: 924698 - RNA, 21 nt, Human
ugcauauucuucugguggcug

SEQ ID NO: 924699 - RNA, 22 nt, Human
cugcuguagagaaggguuguca

SEQ ID NO: 924700 - RNA, 22 nt, Human
ugguagggacacuaugcagaaa

SEQ ID NO: 924701 - RNA, 22 nt, Human
aagaguuuuuggagugugaguu

SEQ ID NO: 924702 - RNA, 17 nt, Human
uuuggaaagugaucauu

SEQ ID NO: 924703 - RNA, 22 nt, Human
caugcucuccauuggacacaga

SEQ ID NO: 924704 - RNA, 22 nt, Human
gugugcgcgcgcgucccgggug

SEQ ID NO: 924705 - RNA, 22 nt, Human
uaggccaaaugacuugauguuu

SEQ ID NO: 924706 - RNA, 22 nt, Human
uuuuucuagaccuuaaaggcca

SEQ ID NO: 924707 - RNA, 22 nt, Human
guggguguggaacugugagacc

SEQ ID NO: 924708 - RNA, 22 nt, Human
accagccuccuagcugcuccug

SEQ ID NO: 924709 - RNA, 22 nt, Human
ccuggcuguuuauuucggggcu

SEQ ID NO: 924710 - RNA, 22 nt, Human
aagaucagaacuuuauacagga

SEQ ID NO: 924711 - RNA, 22 nt, Human
ggacagugucugcuucaggccc

SEQ ID NO: 924712 - RNA, 22 nt, Human
ccacaaagaaugggggaagcau

SEQ ID NO: 924713 - RNA, 22 nt, Human
uggaggcagucaaaugacugac

SEQ ID NO: 924714 - RNA, 22 nt, Human
cugcagagaauuguggggcuuc

SEQ ID NO: 924715 - RNA, 22 nt, Human
ugaggcaggaggauugcaggau

SEQ ID NO: 924716 - RNA, 22 nt, Human
ucagaaagguugagucaugugc

SEQ ID NO: 924717 - RNA, 21 nt, Human
gacacaguaaucuuggggcuu

SEQ ID NO: 924718 - RNA, 22 nt, Human
aagagcauuuggugagauuuga

SEQ ID NO: 924719 - RNA, 23 nt, Human
ucuuuccucagcacacaccaaga

SEQ ID NO: 924720 - RNA, 22 nt, Human
uuaugccuccgaaaccuggagu

SEQ ID NO: 924721 - RNA, 22 nt, Human
uggcacugcacuuuaagauuua

SEQ ID NO: 924722 - RNA, 22 nt, Human
caggaagcuagauuuuguugcu

SEQ ID NO: 924723 - RNA, 22 nt, Human
gaguugaaagcaaaaguugaua

SEQ ID NO: 924724 - RNA, 18 nt, Human
uugcuuuguaagcuugca

SEQ ID NO: 924725 - RNA, 22 nt, Human
cagagccaaaugcugugguuau

SEQ ID NO: 924726 - RNA, 22 nt, Human
cugggcagcuaccaccacugcu

SEQ ID NO: 924727 - RNA, 22 nt, Human
cgcagcuguccauguguggggg

SEQ ID NO: 924728 - RNA, 22 nt, Human
uuuguguuuguacaaugcacua

SEQ ID NO: 924729 - RNA, 22 nt, Human
gaaaacuauuggccuagaacaa

SEQ ID NO: 924730 - RNA, 22 nt, Human
ucucugugugugugacagcauu

SEQ ID NO: 924731 - RNA, 22 nt, Human
uaagaaucgauguuuauuuaga

SEQ ID NO: 924732 - RNA, 22 nt, Human
gaugcuaaaauaauuauuuuga

SEQ ID NO: 924733 - RNA, 22 nt, Human
acuaacauguuaaucaaaagaa

SEQ ID NO: 924734 - RNA, 22 nt, Human
agaggucaaugggacuuggauc

SEQ ID NO: 924735 - RNA, 22 nt, Human
uagagcuuagagaaugaguuug

SEQ ID NO: 924736 - RNA, 22 nt, Human
agcuguuuccauaaaugagaca

SEQ ID NO: 924737 - RNA, 22 nt, Human
acuccagguuuuuucacugaag

SEQ ID NO: 924738 - RNA, 22 nt, Human
aggcagcaugcucugcuucuac

SEQ ID NO: 924739 - RNA, 22 nt, Human
gauuucucacuguggauuuccu

SEQ ID NO: 924740 - RNA, 22 nt, Human
agggaagugaaugacagauauc

SEQ ID NO: 924741 - RNA, 22 nt, Human
uauccauuuauuuucuaggcaa

SEQ ID NO: 924742 - RNA, 22 nt, Human
ugugugugcacaugcauauaca

SEQ ID NO: 924743 - RNA, 22 nt, Human
uggcaaauuuuggcaagcugaa

SEQ ID NO: 924744 - RNA, 22 nt, Human
aauaagcaagccugugugcaag

SEQ ID NO: 924745 - RNA, 22 nt, Human
cuguuugugauuagcagugggu

SEQ ID NO: 924746 - RNA, 22 nt, Human
auuagccuguugcauuuucacu

SEQ ID NO: 924747 - RNA, 22 nt, Human
cacagggaguuacagaagcacu

SEQ ID NO: 924748 - RNA, 22 nt, Human
gaaugucuaaacauagcuuuua

SEQ ID NO: 924749 - RNA, 22 nt, Human
aagagacuauggugucuaugaa

SEQ ID NO: 924750 - RNA, 22 nt, Human
ucaaucuguguaugcugggagu

SEQ ID NO: 924751 - RNA, 19 nt, Human
ccagagcccgccagauggg

SEQ ID NO: 924752 - RNA, 22 nt, Human
uccuuagagugguugugcuaug

SEQ ID NO: 924753 - RNA, 19 nt, Human
agccaggguccagacaugu

SEQ ID NO: 924754 - RNA, 22 nt, Human
uagcugucagcaaucaaguggu

SEQ ID NO: 924755 - RNA, 22 nt, Human
agagagggaauauuugggguau

SEQ ID NO: 924756 - RNA, 22 nt, Human
uauuuuaaagacugccagccua

SEQ ID NO: 924757 - RNA, 18 nt, Human
uaaaugcauguuaauaac

SEQ ID NO: 924758 - RNA, 22 nt, Human
guuaacauaggaguuuguugua

SEQ ID NO: 924759 - RNA, 22 nt, Human
augcucagggcacacucuggac

SEQ ID NO: 924760 - RNA, 22 nt, Human
acagggccuuugauggauuaua

SEQ ID NO: 924761 - RNA, 18 nt, Human
ggcuggaagcuguugcug

SEQ ID NO: 924762 - RNA, 22 nt, Human
uuucuaaggcuaggucuuaagg

SEQ ID NO: 924763 - RNA, 22 nt, Human
agaggacagagugcuggauuua

SEQ ID NO: 924764 - RNA, 22 nt, Human
ugaaauguguucuaguguuuug

SEQ ID NO: 924765 - RNA, 22 nt, Human
aggcauggggcugcagucaggu

SEQ ID NO: 924766 - RNA, 22 nt, Human
uuaggaagaaggaggcaguauu

SEQ ID NO: 924767 - RNA, 22 nt, Human
aggacuucaaauggaaacaaaa

SEQ ID NO: 924768 - RNA, 22 nt, Human
acauucugggugauguucuuca

SEQ ID NO: 924769 - RNA, 22 nt, Human
ugggaagguacacgggaaagag

SEQ ID NO: 924770 - RNA, 22 nt, Human
auccuuaauuuacuugcaucuu

SEQ ID NO: 924771 - RNA, 22 nt, Human
agacuucaccuacagcagucuc

SEQ ID NO: 924772 - RNA, 22 nt, Human
cuccuccagugggucccucagg

SEQ ID NO: 924773 - RNA, 21 nt, Human
gccugggauaguggccuccgg

SEQ ID NO: 924774 - RNA, 22 nt, Human
guggacuugcuguccuggacuu

SEQ ID NO: 924775 - RNA, 22 nt, Human
ugucucugaagcccccuccuuu

SEQ ID NO: 924776 - RNA, 22 nt, Human
ggagaggacauggcucccacag

SEQ ID NO: 924777 - RNA, 22 nt, Human
cuucuucuuuuaauaaaugucu

SEQ ID NO: 924778 - RNA, 22 nt, Human
ugggcucuuggaccccaacgcu

SEQ ID NO: 924779 - RNA, 22 nt, Human
uggacacaaagaucaaauauug

SEQ ID NO: 924780 - RNA, 22 nt, Human
aggcuucagguuugcuuugcag

SEQ ID NO: 924781 - RNA, 22 nt, Human
ggcaccuggagguuuacuggau

SEQ ID NO: 924782 - RNA, 22 nt, Human
gugggccaguuccucacaggua

SEQ ID NO: 924783 - RNA, 22 nt, Human
aacaaucuguucgauagaaaau

SEQ ID NO: 924784 - RNA, 22 nt, Human
aguggcuaugcaugacuggaau

SEQ ID NO: 924785 - RNA, 22 nt, Human
aggcccugcggaaaugaucauu

SEQ ID NO: 924786 - RNA, 22 nt, Human
uuuuagaaggaaugcuauggug

SEQ ID NO: 924787 - RNA, 22 nt, Human
uacauuuccugucagagauaua

SEQ ID NO: 924788 - RNA, 22 nt, Human
gcuuacaagccagcuguaccac

SEQ ID NO: 924789 - RNA, 22 nt, Human
caaagguuggaaauguuuacca

SEQ ID NO: 924790 - RNA, 22 nt, Human
uggaaccuggugauguacaagu

SEQ ID NO: 924791 - RNA, 22 nt, Human
gggaggaaggcuugggugagua

SEQ ID NO: 924792 - RNA, 22 nt, Human
cugggaaguagaaucagaugag

SEQ ID NO: 924793 - RNA, 22 nt, Human
agcgcaggaacacgucugccuu

SEQ ID NO: 924794 - RNA, 22 nt, Human
gagagaaaggcuugcaggcugu

SEQ ID NO: 924795 - RNA, 22 nt, Human
ccaggcucugugugggcuagag

SEQ ID NO: 924796 - RNA, 22 nt, Human
acagaagaccaagaaagcuucc

SEQ ID NO: 924797 - RNA, 22 nt, Human
aacugaauuuuaaauacaggcc

SEQ ID NO: 924798 - RNA, 22 nt, Human
aggcuggagguuuguugcggcu

SEQ ID NO: 924799 - RNA, 22 nt, Human
uugucucuaagugugaucuuca

SEQ ID NO: 924800 - RNA, 23 nt, Human
cuucagugugggacugcagcgug

SEQ ID NO: 924801 - RNA, 22 nt, Human
ugacugccccuuccauuccugc

SEQ ID NO: 924802 - RNA, 22 nt, Human
agagccaggcucccauggggca

SEQ ID NO: 924803 - RNA, 22 nt, Human
gaagacuuuaagccgagauuag

SEQ ID NO: 924804 - RNA, 22 nt, Human
uggcagagcuggcugcggauga

SEQ ID NO: 924805 - RNA, 22 nt, Human
gcacagguugcaaaaguucaca

SEQ ID NO: 924806 - RNA, 22 nt, Human
cauaauguuguaacacauagag

SEQ ID NO: 924807 - RNA, 22 nt, Human
gacagaguuguugauguaugcu

SEQ ID NO: 924808 - RNA, 22 nt, Human
gcugcagcuguaggacacaauu

SEQ ID NO: 924809 - RNA, 22 nt, Human
uggugcuguggaggggcagaag

SEQ ID NO: 924810 - RNA, 22 nt, Human
ucccagagcugauaagccuuua

SEQ ID NO: 924811 - RNA, 22 nt, Human
gccacauuagcccucaccaucu

SEQ ID NO: 924812 - RNA, 22 nt, Human
caggcagcugcgacaagagagc

SEQ ID NO: 924813 - RNA, 22 nt, Human
ggaaguuuauugaguucaagua

SEQ ID NO: 924814 - RNA, 22 nt, Human
cagcucucacacccuccuccca

SEQ ID NO: 924815 - RNA, 22 nt, Human
ugccugaauucaauuccuggcu

SEQ ID NO: 924816 - RNA, 22 nt, Human
ugugugaguaaggcugagagag

SEQ ID NO: 924817 - RNA, 22 nt, Human
uccaggagaccagauguaggcc

SEQ ID NO: 924818 - RNA, 22 nt, Human
caguugccuuauuuccuugcug

SEQ ID NO: 924819 - RNA, 22 nt, Human
aagggggcacagucacuguaau

SEQ ID NO: 924820 - RNA, 22 nt, Human
aauuagaaccagaagccauauu

SEQ ID NO: 924821 - RNA, 22 nt, Human
acaugacaaaaugcacaggauu

SEQ ID NO: 924822 - RNA, 22 nt, Human
gcucugggcugcccucuggaca

SEQ ID NO: 924823 - RNA, 22 nt, Human
auguaaacucacauuuucuuca

SEQ ID NO: 924824 - RNA, 22 nt, Human
uuugaaacccgucacuuugagu

SEQ ID NO: 924825 - RNA, 22 nt, Human
gugcugacaggagccuggcggu

SEQ ID NO: 924826 - RNA, 22 nt, Human
uuuguucacaggguuguuguag

SEQ ID NO: 924827 - RNA, 22 nt, Human
aucaacuuguccuugauguuaa

SEQ ID NO: 924828 - RNA, 22 nt, Human
uacagggacauggaacaggcuc

SEQ ID NO: 924829 - RNA, 22 nt, Human
aagcgcagacacagagagugga

SEQ ID NO: 924830 - RNA, 22 nt, Human
gcaaacauaauaugaagacacu

SEQ ID NO: 924831 - RNA, 22 nt, Human
gggggcuggaauauccaucaac

SEQ ID NO: 924832 - RNA, 20 nt, Human
uccagggcuagggagcucau

SEQ ID NO: 924833 - RNA, 22 nt, Human
gugcaguugagacaauaggcug

SEQ ID NO: 924834 - RNA, 17 nt, Human
ggaaaaggaugauacag

SEQ ID NO: 924835 - RNA, 22 nt, Human
uauugcauuucccacguucacu

SEQ ID NO: 924836 - RNA, 20 nt, Human
aagcuuccuugggcgcccgg

SEQ ID NO: 924837 - RNA, 21 nt, Human
ugcucaugcaaugcaugucca

SEQ ID NO: 924838 - RNA, 22 nt, Human
cugcaucugcauaaucaacuuc

SEQ ID NO: 924839 - RNA, 22 nt, Human
gagaaagaaagggaaguuuguu

SEQ ID NO: 924840 - RNA, 22 nt, Human
guuuuuuggguguauaucuucu

SEQ ID NO: 924841 - RNA, 22 nt, Human
gggagcugucaucaguguuguc

SEQ ID NO: 924842 - RNA, 22 nt, Human
aagcccugucacccugacuuca

SEQ ID NO: 924843 - RNA, 22 nt, Human
cuggaaugggccauuugaggcc

SEQ ID NO: 924844 - RNA, 22 nt, Human
aaaaauacuucacuucugggug

SEQ ID NO: 924845 - RNA, 22 nt, Human
ucuagggagcucuagcaguggu

SEQ ID NO: 924846 - RNA, 22 nt, Human
caucaagagucuuacuaucagu

SEQ ID NO: 924847 - RNA, 21 nt, Human
ugagauaaauuuccuuacuac

SEQ ID NO: 924848 - RNA, 22 nt, Human
aggugggcgcugcucccgcugg

SEQ ID NO: 924849 - RNA, 22 nt, Human
uucauugauuccaggcucuucu

SEQ ID NO: 924850 - RNA, 22 nt, Human
gugggggacccaggugcugucc

SEQ ID NO: 924851 - RNA, 22 nt, Human
acagaaauaacuuuuuauguuu

SEQ ID NO: 924852 - RNA, 23 nt, Human
uguguauguaucuaugcauaggu

SEQ ID NO: 924853 - RNA, 22 nt, Human
auaauagcauuagguuuaugca

SEQ ID NO: 924854 - RNA, 21 nt, Human
aacugcaaaugaugcuggaga

SEQ ID NO: 924855 - RNA, 22 nt, Human
ggcagccagcggguggacgcgc

SEQ ID NO: 924856 - RNA, 22 nt, Human
uuauuucccugaggguugcagg

SEQ ID NO: 924857 - RNA, 22 nt, Human
ugucaccacauuugucaauauc

SEQ ID NO: 924858 - RNA, 22 nt, Human
cugggaggacaacuuggagcuc

SEQ ID NO: 924859 - RNA, 19 nt, Human
aucuuuggguccugaaggg

SEQ ID NO: 924860 - RNA, 20 nt, Human
auauaccaucccacaacagg

SEQ ID NO: 924861 - RNA, 22 nt, Human
aaucuucauguccucucuaauu

SEQ ID NO: 924862 - RNA, 22 nt, Human
uauauucugauuccaucugugu

SEQ ID NO: 924863 - RNA, 22 nt, Human
auauauuuugcggucacguggc

SEQ ID NO: 924864 - RNA, 22 nt, Human
ucacauaaauuuaccagaugau

SEQ ID NO: 924865 - RNA, 22 nt, Human
aaccaguauguuuaggagguga

SEQ ID NO: 924866 - RNA, 22 nt, Human
caggagccagcugucccaacca

SEQ ID NO: 924867 - RNA, 20 nt, Human
cucaggauugucuagccccu

SEQ ID NO: 924868 - RNA, 22 nt, Human
gcagggcugcagagggcacugu

SEQ ID NO: 924869 - RNA, 22 nt, Human
uucauguauugcauuguguccu

SEQ ID NO: 924870 - RNA, 22 nt, Human
ugcacacagccagugaguggca

SEQ ID NO: 924871 - RNA, 17 nt, Human
ugaauucaaucugcacu

SEQ ID NO: 924872 - RNA, 22 nt, Human
cuccuuccccuacucagcaucc

SEQ ID NO: 924873 - RNA, 22 nt, Human
uagagacaccaguaccauucug

SEQ ID NO: 924874 - RNA, 22 nt, Human
uaugcuuuaacccucuuauauu

SEQ ID NO: 924875 - RNA, 22 nt, Human
uuugguuuauuaaauuguaggc

SEQ ID NO: 924876 - RNA, 22 nt, Human
uguggccucuaagcucacgaag

SEQ ID NO: 924877 - RNA, 22 nt, Human
ugaggcagcaauuguauuguau

SEQ ID NO: 924878 - RNA, 22 nt, Human
uucucugccucacaggucuaag

SEQ ID NO: 924879 - RNA, 22 nt, Human
guugaauacuugagaaauccau

SEQ ID NO: 924880 - RNA, 22 nt, Human
gccugagagucugcauuucuaa

SEQ ID NO: 924881 - RNA, 18 nt, Human
gcauacagaggggaagua

SEQ ID NO: 924882 - RNA, 22 nt, Human
uugugugauaagucucuugugc

SEQ ID NO: 924883 - RNA, 22 nt, Human
uaucuuucuguccuagauucug

SEQ ID NO: 924884 - RNA, 22 nt, Human
gccucugucauagcucauguga

SEQ ID NO: 924885 - RNA, 22 nt, Human
auuccuugggcugccuuauuau

SEQ ID NO: 924886 - RNA, 22 nt, Human
aaaguuuggauuagcaguuaga

SEQ ID NO: 924887 - RNA, 22 nt, Human
uauguuuuaggaauuaauuguu

SEQ ID NO: 924888 - RNA, 22 nt, Human
agggccugagcucuccuccagu

SEQ ID NO: 924889 - RNA, 22 nt, Human
ggaggccuugaggccaggagcu

SEQ ID NO: 924890 - RNA, 22 nt, Human
ugggccacgucaucucccacaa

SEQ ID NO: 924891 - RNA, 22 nt, Human
aggaggaauacaauccagcagc

SEQ ID NO: 924892 - RNA, 17 nt, Human
agccagguacaagucca

SEQ ID NO: 924893 - RNA, 22 nt, Human
ugcuucaggagaugucaccaug

SEQ ID NO: 924894 - RNA, 22 nt, Human
uggugccaagcaugaggacucu

SEQ ID NO: 924895 - RNA, 22 nt, Human
uucagagcuuagaauggacuac

SEQ ID NO: 924896 - RNA, 22 nt, Human
ccaguuuuuccagugcuuucug

SEQ ID NO: 924897 - RNA, 22 nt, Human
cugggcuuagcagcuccugguc

SEQ ID NO: 924898 - RNA, 22 nt, Human
cagaggcagaauggagauuugg

SEQ ID NO: 924899 - RNA, 22 nt, Human
aaauaaguaguuuaguguugug

SEQ ID NO: 924900 - RNA, 23 nt, Human
auacauacagucuuacugacuuu

SEQ ID NO: 924901 - RNA, 22 nt, Human
uuacaaacaagaucuuauucuu

SEQ ID NO: 924902 - RNA, 22 nt, Human
ccagcuggugggucuuucucug

SEQ ID NO: 924903 - RNA, 19 nt, Human
gggacuggaggauguggag

SEQ ID NO: 924904 - RNA, 22 nt, Human
aauacauaauaaguuuugucug

SEQ ID NO: 924905 - RNA, 22 nt, Human
gcccaagaguuaagucucugcu

SEQ ID NO: 924906 - RNA, 22 nt, Human
aaguccagggaucaaaguaggc

SEQ ID NO: 924907 - RNA, 22 nt, Human
cuccugggcucaagugauccuc

SEQ ID NO: 924908 - RNA, 22 nt, Human
ugaggccacuuccccacagccc

SEQ ID NO: 924909 - RNA, 22 nt, Human
guauguguugaauucagggguc

SEQ ID NO: 924910 - RNA, 22 nt, Human
agaacauaauuaucauaaacug

SEQ ID NO: 924911 - RNA, 22 nt, Human
uuaggaaugagauuucuaguga

SEQ ID NO: 924912 - RNA, 17 nt, Human
gcagccucuugguagug

SEQ ID NO: 924913 - RNA, 22 nt, Human
uggauaaaacguucugaaaaac

SEQ ID NO: 924914 - RNA, 21 nt, Human
ccugagccuguuuauccagaa

SEQ ID NO: 924915 - RNA, 22 nt, Human
guccauggcagagcccuucugc

SEQ ID NO: 924916 - RNA, 22 nt, Human
aguuauagccauauucuaagau

SEQ ID NO: 924917 - RNA, 22 nt, Human
aacuacauagaaauuaguauuu

SEQ ID NO: 924918 - RNA, 22 nt, Human
aggaagacaaucugugugcugu

SEQ ID NO: 924919 - RNA, 22 nt, Human
caucacaucagugugaacaguu

SEQ ID NO: 924920 - RNA, 22 nt, Human
aguaucagaugugauuaaaggg

SEQ ID NO: 924921 - RNA, 22 nt, Human
cgguaaggucugagacaacacc

SEQ ID NO: 924922 - RNA, 22 nt, Human
gcugucacuggcauguuccggg

SEQ ID NO: 924923 - RNA, 22 nt, Human
uagaaaauguuccacugccauu

SEQ ID NO: 924924 - RNA, 22 nt, Human
caccuuuugugucugcguuugu

SEQ ID NO: 924925 - RNA, 22 nt, Human
uauacacauuuuuaccuauagu

SEQ ID NO: 924926 - RNA, 22 nt, Human
uagcaauccguugaucccuugc

SEQ ID NO: 924927 - RNA, 22 nt, Human
acacaguugguggcucagucug

SEQ ID NO: 924928 - RNA, 19 nt, Human
uucugggaggggcugacug

SEQ ID NO: 924929 - RNA, 22 nt, Human
agagacuggcuucuaaaauggc

SEQ ID NO: 924930 - RNA, 22 nt, Human
gccugaggaaugcuccugacuu

SEQ ID NO: 924931 - RNA, 22 nt, Human
gaggaggaggaaguggaaccca

SEQ ID NO: 924932 - RNA, 22 nt, Human
gcagcaggcuuuucauaccuug

SEQ ID NO: 924933 - RNA, 22 nt, Human
cuugcuguuuucuacccucaag

SEQ ID NO: 924934 - RNA, 22 nt, Human
uucauuuaauuuguguauuaac

SEQ ID NO: 924935 - RNA, 22 nt, Human
uuuaguaccaucauuugccucu

SEQ ID NO: 924936 - RNA, 22 nt, Human
cucucuggcuuggcacggagau

SEQ ID NO: 924937 - RNA, 22 nt, Human
ugagcccaggaguuggagaccg

SEQ ID NO: 924938 - RNA, 22 nt, Human
ccagaagaggacacagugugga

SEQ ID NO: 924939 - RNA, 18 nt, Human
ucagcuggggcugcagcc

SEQ ID NO: 924940 - RNA, 22 nt, Human
aggcagugcucaagacagcagc

SEQ ID NO: 924941 - RNA, 20 nt, Human
uuucaccaucuuggccaggc

SEQ ID NO: 924942 - RNA, 22 nt, Human
auguuugucaggauuguaauua

SEQ ID NO: 924943 - RNA, 22 nt, Human
cugcugagguccuugcucagac

SEQ ID NO: 924944 - RNA, 22 nt, Human
augccuuaaggcgagauacuua

SEQ ID NO: 924945 - RNA, 22 nt, Human
caggucagaggcgcagccccca

SEQ ID NO: 924946 - RNA, 23 nt, Human
uccuggugacaugccugagcauc

SEQ ID NO: 924947 - RNA, 22 nt, Human
gcagacuguaccuggaagaggg

SEQ ID NO: 924948 - RNA, 22 nt, Human
ccagcugcccaagaggcauccu

SEQ ID NO: 924949 - RNA, 22 nt, Human
uucugcugaaaacagccaugua

SEQ ID NO: 924950 - RNA, 22 nt, Human
aguugucagucaaagacauuug

SEQ ID NO: 924951 - RNA, 22 nt, Human
guggcagugaggcaggagcagu

SEQ ID NO: 924952 - RNA, 22 nt, Human
gggcucuguuuagaucagagau

SEQ ID NO: 924953 - RNA, 22 nt, Human
gugggagcuucaucaagcaguu

SEQ ID NO: 924954 - RNA, 22 nt, Human
acagacauucagcuaagucuau

SEQ ID NO: 924955 - RNA, 20 nt, Human
uaucugcucuaguagcaguu

SEQ ID NO: 924956 - RNA, 22 nt, Human
aaacucuaguaaaauguauuca

SEQ ID NO: 924957 - RNA, 22 nt, Human
uaguucuagggcaucaucccag

SEQ ID NO: 924958 - RNA, 19 nt, Human
ggagaagcaucuagaaaua

SEQ ID NO: 924959 - RNA, 22 nt, Human
ggugcugaugaguuaggagagg

SEQ ID NO: 924960 - RNA, 19 nt, Human
aaugcugcuucuuuuugca

SEQ ID NO: 924961 - RNA, 22 nt, Human
ucauguuugcccuaagaaaaag

SEQ ID NO: 924962 - RNA, 22 nt, Human
gagcugggcuggcuuccucccu

SEQ ID NO: 924963 - RNA, 22 nt, Human
acugcaaucuggauccuagaag

SEQ ID NO: 924964 - RNA, 21 nt, Human
aaguaaugugucucuucuacc

SEQ ID NO: 924965 - RNA, 22 nt, Human
uuacauaguuaaauaguacagc

SEQ ID NO: 924966 - RNA, 22 nt, Human
aggaagcuccuggagagccagu

SEQ ID NO: 924967 - RNA, 22 nt, Human
guucauuuuucccuaaugagua

SEQ ID NO: 924968 - RNA, 17 nt, Human
gcuucuggagcuucugu

SEQ ID NO: 924969 - RNA, 23 nt, Human
ucagagaggcccccugcagagau

SEQ ID NO: 924970 - RNA, 22 nt, Human
caaauacuaaacauaagauuuu

SEQ ID NO: 924971 - RNA, 23 nt, Human
ggagaggggugugggcaucuuua

SEQ ID NO: 924972 - RNA, 22 nt, Human
cuugcucacaguaccuggcuug

SEQ ID NO: 924973 - RNA, 22 nt, Human
gcuuggcccugccgccuggguc

SEQ ID NO: 924974 - RNA, 22 nt, Human
aagaggagacuucagcaacuug

SEQ ID NO: 924975 - RNA, 22 nt, Human
acacaugaguucucaucuugug

SEQ ID NO: 924976 - RNA, 22 nt, Human
gugggguguccagcagcgagcu

SEQ ID NO: 924977 - RNA, 22 nt, Human
uucauugaaauguuucuagcug

SEQ ID NO: 924978 - RNA, 22 nt, Human
ucuguuuagaugcuuuaucugu

SEQ ID NO: 924979 - RNA, 22 nt, Human
ccagcugucugguuccagagcc

SEQ ID NO: 924980 - RNA, 22 nt, Human
caguguggcugagacagaggcu

SEQ ID NO: 924981 - RNA, 22 nt, Human
aauucugaugagucagagaaag

SEQ ID NO: 924982 - RNA, 17 nt, Human
ugcaggcuguuauagcc

SEQ ID NO: 924983 - RNA, 22 nt, Human
ucuguggcccaagugauggcug

SEQ ID NO: 924984 - RNA, 22 nt, Human
ggguggcacaggugcagagggu

SEQ ID NO: 924985 - RNA, 22 nt, Human
auguguuuauaauuacucaauc

SEQ ID NO: 924986 - RNA, 22 nt, Human
agugguaagggcauaggcacug

SEQ ID NO: 924987 - RNA, 22 nt, Human
gugaaguugauuguuaucguca

SEQ ID NO: 924988 - RNA, 22 nt, Human
agcuggugcucaggggcaugga

SEQ ID NO: 924989 - RNA, 22 nt, Human
uuuacagaugaggaaacugaga

SEQ ID NO: 924990 - RNA, 22 nt, Human
ggcaggacauugacuacaguga

SEQ ID NO: 924991 - RNA, 22 nt, Human
cuaaggcaccgaggcaggagcg

SEQ ID NO: 924992 - RNA, 22 nt, Human
agagagcugacuuuggagucag

SEQ ID NO: 924993 - RNA, 22 nt, Human
ucugccuccugcuugucccgac

SEQ ID NO: 924994 - RNA, 22 nt, Human
ccugucuggaacauggccuguu

SEQ ID NO: 924995 - RNA, 22 nt, Human
acagcauggauaacaaggcacu

SEQ ID NO: 924996 - RNA, 22 nt, Human
acagggccuuauauccagaagg

SEQ ID NO: 924997 - RNA, 22 nt, Human
agaaucuugggcaaauucaucu

SEQ ID NO: 924998 - RNA, 22 nt, Human
agucccagugagaugagccacg

SEQ ID NO: 924999 - RNA, 20 nt, Human
guuuuaugccaguucugugu

SEQ ID NO: 925000 - RNA, 22 nt, Human
auugcaaauaacuguacugaau

SEQ ID NO: 925001 - RNA, 22 nt, Human
gaucacaauuuagacuuuuuaa

SEQ ID NO: 925002 - RNA, 17 nt, Human
aggcagguaagaguuau

SEQ ID NO: 925003 - RNA, 20 nt, Human
uccaggagguuaguguggcu

SEQ ID NO: 925004 - RNA, 22 nt, Human
gacauaaaauggaauucuguug

SEQ ID NO: 925005 - RNA, 22 nt, Human
aggaaugacagauguccgcacc

SEQ ID NO: 925006 - RNA, 22 nt, Human
ugcuggcccaugaagacgcagu

SEQ ID NO: 925007 - RNA, 22 nt, Human
cauggcugcgagaagagugggu

SEQ ID NO: 925008 - RNA, 22 nt, Human
uuauagugggcccaacauggcg

SEQ ID NO: 925009 - RNA, 22 nt, Human
guggcagccgcaggcccugugu

SEQ ID NO: 925010 - RNA, 22 nt, Human
agcaagaagcuuugcugugaua

SEQ ID NO: 925011 - RNA, 22 nt, Human
aaaaguaauugcaauuuuguag

SEQ ID NO: 925012 - RNA, 19 nt, Human
ccuggcccugcugcgcggg

SEQ ID NO: 925013 - RNA, 22 nt, Human
aagaacaguugggaggugagcc

SEQ ID NO: 925014 - RNA, 22 nt, Human
gacagaggagaagaugcugugg

SEQ ID NO: 925015 - RNA, 22 nt, Human
uagcacuuguguuaugccuugu

SEQ ID NO: 925016 - RNA, 22 nt, Human
cggagaggaccugcaacucgcu

SEQ ID NO: 925017 - RNA, 22 nt, Human
ucacagacuguguugcuacuca

SEQ ID NO: 925018 - RNA, 22 nt, Human
agguucaaauuguugcaguuuc

SEQ ID NO: 925019 - RNA, 22 nt, Human
aacaggcuucuucugggcuccu

SEQ ID NO: 925020 - RNA, 22 nt, Human
uccucccugaguggggacagcu

SEQ ID NO: 925021 - RNA, 22 nt, Human
ccauuucacuggguaguugugg

SEQ ID NO: 925022 - RNA, 22 nt, Human
ccagaaaaggagcugcaggaug

SEQ ID NO: 925023 - RNA, 22 nt, Human
uaaggcagccgcucagagaggu

SEQ ID NO: 925024 - RNA, 22 nt, Human
gagccaccuucaacucaggaau

SEQ ID NO: 925025 - RNA, 22 nt, Human
uuuagagagaauuuucaaagug

SEQ ID NO: 925026 - RNA, 22 nt, Human
auguaaaccgugcacucccagg

SEQ ID NO: 925027 - RNA, 22 nt, Human
ccuuuaugagauccugggguga

SEQ ID NO: 925028 - RNA, 22 nt, Human
uucuaguguccuuggacuugcu

SEQ ID NO: 925029 - RNA, 22 nt, Human
aagauacacguuguauugaaua

SEQ ID NO: 925030 - RNA, 20 nt, Human
cucauguggcaccaggcacu

SEQ ID NO: 925031 - RNA, 22 nt, Human
cuuggucucuuuaccggagugu

SEQ ID NO: 925032 - RNA, 22 nt, Human
cacuuucuguguaucuuccauu

SEQ ID NO: 925033 - RNA, 22 nt, Human
gaaagcaauuuguguaaucugu

SEQ ID NO: 925034 - RNA, 22 nt, Human
gaaggagagagacaucgucccu

SEQ ID NO: 925035 - RNA, 22 nt, Human
gcagagcucaagguguucagcu

SEQ ID NO: 925036 - RNA, 22 nt, Human
uccugggcccuccggaucaggu

SEQ ID NO: 925037 - RNA, 22 nt, Human
aggccacaaccacccugugccc

SEQ ID NO: 925038 - RNA, 22 nt, Human
ugcagcaauuugcaguaauuua

SEQ ID NO: 925039 - RNA, 22 nt, Human
gagcagugggaaggaacagggu

SEQ ID NO: 925040 - RNA, 22 nt, Human
ccucucucugcaucuggagggc

SEQ ID NO: 925041 - RNA, 22 nt, Human
ggcuucauuuuaucuuaucaug

SEQ ID NO: 925042 - RNA, 22 nt, Human
agcugagccagcagcaacagga

SEQ ID NO: 925043 - RNA, 22 nt, Human
ugcuuaaauagcuggaggcuac

SEQ ID NO: 925044 - RNA, 22 nt, Human
auucuucucccuuagggcccag

SEQ ID NO: 925045 - RNA, 22 nt, Human
uucuggaauauuugacacaauu

SEQ ID NO: 925046 - RNA, 22 nt, Human
auggugaagcuucauggguguu

SEQ ID NO: 925047 - RNA, 22 nt, Human
ucaggcugcuguacugugaaug

SEQ ID NO: 925048 - RNA, 22 nt, Human
cugggaagaaauugugggaggc

SEQ ID NO: 925049 - RNA, 22 nt, Human
agcaaauacuuuucacugagcc

SEQ ID NO: 925050 - RNA, 22 nt, Human
aguaaacauagaauguucuucc

SEQ ID NO: 925051 - RNA, 22 nt, Human
cuggccaacuugcuuguuggca

SEQ ID NO: 925052 - RNA, 19 nt, Human
ucagggccgcagaggguac

SEQ ID NO: 925053 - RNA, 22 nt, Human
cuguaugucuugugaauuguag

SEQ ID NO: 925054 - RNA, 22 nt, Human
aguucuggcggcugucggcacu

SEQ ID NO: 925055 - RNA, 22 nt, Human
gcugcaagcaugucauccucac

SEQ ID NO: 925056 - RNA, 22 nt, Human
uugcagaaucucaggaaggaga

SEQ ID NO: 925057 - RNA, 22 nt, Human
ggcuggaaaagacaaagcuauu

SEQ ID NO: 925058 - RNA, 22 nt, Human
acauuugauaauuauaaagaca

SEQ ID NO: 925059 - RNA, 22 nt, Human
gggucaaggcuacauggagacc

SEQ ID NO: 925060 - RNA, 22 nt, Human
aggggagagaacauaaggaagu

SEQ ID NO: 925061 - RNA, 22 nt, Human
auaaguucagguaaagaaauca

SEQ ID NO: 925062 - RNA, 22 nt, Human
cucaggcagugcccucuggccg

SEQ ID NO: 925063 - RNA, 22 nt, Human
cagaaggagggggcaagcccug

SEQ ID NO: 925064 - RNA, 22 nt, Human
ccagaggcggagguuugcagug

SEQ ID NO: 925065 - RNA, 22 nt, Human
agagauaguguauuaguugggc

SEQ ID NO: 925066 - RNA, 22 nt, Human
guccacauaggaacccagcuuc

SEQ ID NO: 925067 - RNA, 22 nt, Human
acuaaauacacacauuuguuca

SEQ ID NO: 925068 - RNA, 22 nt, Human
uuuuauguugcuauaauaggua

SEQ ID NO: 925069 - RNA, 22 nt, Human
ucauuuucacacauaaauagca

SEQ ID NO: 925070 - RNA, 22 nt, Human
uguuugaaacuuugaucacuaa

SEQ ID NO: 925071 - RNA, 22 nt, Human
ggucuccugaggcugccacacc

SEQ ID NO: 925072 - RNA, 22 nt, Human
cccugcagccuugcaugccuuc

SEQ ID NO: 925073 - RNA, 22 nt, Human
cucaagaaggaugagcuauugc

SEQ ID NO: 925074 - RNA, 22 nt, Human
uuuucuuaggugcuccaaguag

SEQ ID NO: 925075 - RNA, 22 nt, Human
auacauuagugaacaaaagaga

SEQ ID NO: 925076 - RNA, 22 nt, Human
uucucucuggaccugggaugcg

SEQ ID NO: 925077 - RNA, 22 nt, Human
caaguucacaugcauccuugcu

SEQ ID NO: 925078 - RNA, 22 nt, Human
uuugacaacugugcaguuugua

SEQ ID NO: 925079 - RNA, 20 nt, Human
caacaugagcaagugaacug

SEQ ID NO: 925080 - RNA, 22 nt, Human
gucccagggcaaggcuguuucu

SEQ ID NO: 925081 - RNA, 22 nt, Human
uguucucuaagaaaagaagcau

SEQ ID NO: 925082 - RNA, 22 nt, Human
gggcuccagcagaggcagccgg

SEQ ID NO: 925083 - RNA, 20 nt, Human
gauggcuuuagaagcuggua

SEQ ID NO: 925084 - RNA, 22 nt, Human
cccugccuuguuggagccuaug

SEQ ID NO: 925085 - RNA, 22 nt, Human
cucucccuagguuagcggucag

SEQ ID NO: 925086 - RNA, 22 nt, Human
uauguguauaccuauacaugug

SEQ ID NO: 925087 - RNA, 22 nt, Human
uccacauuauguuucuccuuuc

SEQ ID NO: 925088 - RNA, 22 nt, Human
acagccaggagccaugggcagg

SEQ ID NO: 925089 - RNA, 22 nt, Human
gagccagcugagcugcacuguc

SEQ ID NO: 925090 - RNA, 22 nt, Human
cagcuggcugcggugaggggac

SEQ ID NO: 925091 - RNA, 23 nt, Human
gccugggacugguagugugaccu

SEQ ID NO: 925092 - RNA, 17 nt, Human
agccugggaaggaguga

SEQ ID NO: 925093 - RNA, 22 nt, Human
ggcagcaaauauugucagcugu

SEQ ID NO: 925094 - RNA, 22 nt, Human
uggcuucuauugcuguggcauu

SEQ ID NO: 925095 - RNA, 22 nt, Human
gggccacacagaaccuccuggu

SEQ ID NO: 925096 - RNA, 22 nt, Human
ugucuagacauuagcuucagcu

SEQ ID NO: 925097 - RNA, 22 nt, Human
ucagugaaguaauggugagaga

SEQ ID NO: 925098 - RNA, 22 nt, Human
ugacagcaauaauuuuaucuuc

SEQ ID NO: 925099 - RNA, 22 nt, Human
uucuuuggggaauauucugguu

SEQ ID NO: 925100 - RNA, 22 nt, Human
guucaguguuuacaugauuguu

SEQ ID NO: 925101 - RNA, 20 nt, Human
uuuauucagccuacccucuu

SEQ ID NO: 925102 - RNA, 17 nt, Human
aggcagcucagaacauc

SEQ ID NO: 925103 - RNA, 23 nt, Human
acauacauaagcaccacauuuug

SEQ ID NO: 925104 - RNA, 18 nt, Human
gacagcuguccugagccc

SEQ ID NO: 925105 - RNA, 22 nt, Human
acagcaguuuagaggacagcca

SEQ ID NO: 925106 - RNA, 22 nt, Human
acauuuauuuuggcacggcaca

SEQ ID NO: 925107 - RNA, 22 nt, Human
aagaaaugcacacaacugcugg

SEQ ID NO: 925108 - RNA, 22 nt, Human
uguguaaauuuauuuacauaaa

SEQ ID NO: 925109 - RNA, 19 nt, Human
ugcuccaggccuugccgca

SEQ ID NO: 925110 - RNA, 22 nt, Human
ggcuuuauaggguagaggauca

SEQ ID NO: 925111 - RNA, 22 nt, Human
cccagcuccuuguuugcaucuc

SEQ ID NO: 925112 - RNA, 22 nt, Human
aaugcugucuuuucuacuucau

SEQ ID NO: 925113 - RNA, 22 nt, Human
uugugucuggaaugcguggagc

SEQ ID NO: 925114 - RNA, 22 nt, Human
aauugcuucauuaacauuuagg

SEQ ID NO: 925115 - RNA, 22 nt, Human
ugcugcagagaauguuuuggcc

SEQ ID NO: 925116 - RNA, 22 nt, Human
acaacacagcuuuccucaaguu

SEQ ID NO: 925117 - RNA, 22 nt, Human
gagcacaguccuuuuguuaaaa

SEQ ID NO: 925118 - RNA, 22 nt, Human
uugacagagaaaagugugacuu

SEQ ID NO: 925119 - RNA, 22 nt, Human
uucacaaaaaugcugaacaguu

SEQ ID NO: 925120 - RNA, 22 nt, Human
agcagggcagugcuucagcucu

SEQ ID NO: 925121 - RNA, 22 nt, Human
aaucuacaugcaauauuuuuag

SEQ ID NO: 925122 - RNA, 22 nt, Human
caacuuuagcaauguuaguaua

SEQ ID NO: 925123 - RNA, 22 nt, Human
augggcuaaacuuagaggauau

SEQ ID NO: 925124 - RNA, 22 nt, Human
agggaugggucuaacccagaac

SEQ ID NO: 925125 - RNA, 22 nt, Human
uuucucugugccauuuccauaa

SEQ ID NO: 925126 - RNA, 22 nt, Human
agcuggccuguuagagcugagu

SEQ ID NO: 925127 - RNA, 22 nt, Human
ccagaggaucaguacuggcugg

SEQ ID NO: 925128 - RNA, 22 nt, Human
uaaaugagggcugacaugauug

SEQ ID NO: 925129 - RNA, 22 nt, Human
agggcagacuaggauggaagug

SEQ ID NO: 925130 - RNA, 22 nt, Human
ucugagaaaauaggaaacuuga

SEQ ID NO: 925131 - RNA, 22 nt, Human
ggccuuccaucugccucuguuu

SEQ ID NO: 925132 - RNA, 23 nt, Human
uggcucuguggaucccucaggag

SEQ ID NO: 925133 - RNA, 22 nt, Human
gaguuuuuccaaggucacauga

SEQ ID NO: 925134 - RNA, 22 nt, Human
aguuauuuggcuauagauggua

SEQ ID NO: 925135 - RNA, 22 nt, Human
cauuagaauuagguuguuuacc

SEQ ID NO: 925136 - RNA, 22 nt, Human
uugaguguacuuuagucaucug

SEQ ID NO: 925137 - RNA, 22 nt, Human
uucauuugugguuauuuacaau

SEQ ID NO: 925138 - RNA, 22 nt, Human
uuguguguguaacuuuaugaga

SEQ ID NO: 925139 - RNA, 22 nt, Human
auugaagaguugauuauuaucu

SEQ ID NO: 925140 - RNA, 22 nt, Human
agaaagcagcauuuaugaucuc

SEQ ID NO: 925141 - RNA, 22 nt, Human
cuggguguagauggaaguuugg

SEQ ID NO: 925142 - RNA, 22 nt, Human
caccagaacaagacaggagaau

SEQ ID NO: 925143 - RNA, 19 nt, Human
ggcagccugcacgggcugc

SEQ ID NO: 925144 - RNA, 22 nt, Human
uggcaguuauuaaucaagucuu

SEQ ID NO: 925145 - RNA, 22 nt, Human
uuccugugguguuucccagaca

SEQ ID NO: 925146 - RNA, 22 nt, Human
ugugugggagcacgggcuguug

SEQ ID NO: 925147 - RNA, 22 nt, Human
cugcaggggccucgagcacagg

SEQ ID NO: 925148 - RNA, 22 nt, Human
gaagauuuaagcacaauagucu

SEQ ID NO: 925149 - RNA, 22 nt, Human
caaguaacuugauuaagguaag

SEQ ID NO: 925150 - RNA, 22 nt, Human
agggaauguagcaagaugccaa

SEQ ID NO: 925151 - RNA, 22 nt, Human
uuaggcaauuuugucauugugu

SEQ ID NO: 925152 - RNA, 22 nt, Human
gaaugcuaagcaugugggaguu

SEQ ID NO: 925153 - RNA, 22 nt, Human
aaguccauaguuugcauuacag

SEQ ID NO: 925154 - RNA, 22 nt, Human
uggccagaaccugcaguaggcc

SEQ ID NO: 925155 - RNA, 22 nt, Human
cagcagacuggaguaggcagug

SEQ ID NO: 925156 - RNA, 22 nt, Human
uaacaggguaggagggcaugaa

SEQ ID NO: 925157 - RNA, 22 nt, Human
uaugauuuguagacauuugauu

SEQ ID NO: 925158 - RNA, 22 nt, Human
uccauauuaacuaaaacuagaa

SEQ ID NO: 925159 - RNA, 22 nt, Human
uaacaagaugucacuccugucc

SEQ ID NO: 925160 - RNA, 22 nt, Human
acacuguucuuugcacugagaa

SEQ ID NO: 925161 - RNA, 22 nt, Human
uggagcagccaugaugacagag

SEQ ID NO: 925162 - RNA, 22 nt, Human
uaauaauagcaguagcugccac

SEQ ID NO: 925163 - RNA, 22 nt, Human
gacauugaaguauuuuugucga

SEQ ID NO: 925164 - RNA, 21 nt, Human
ccagagagagggaaguggguu

SEQ ID NO: 925165 - RNA, 22 nt, Human
uucaaacaacucauuuaugcaa

SEQ ID NO: 925166 - RNA, 22 nt, Human
ccaggacuucgaggcuacagug

SEQ ID NO: 925167 - RNA, 21 nt, Human
cagccugcugcuccagggcca

SEQ ID NO: 925168 - RNA, 18 nt, Human
ucuuggcagcaucuggca

SEQ ID NO: 925169 - RNA, 22 nt, Human
ggacugaagugcugucuagugu

SEQ ID NO: 925170 - RNA, 22 nt, Human
auuagcaaggcagcaucaggca

SEQ ID NO: 925171 - RNA, 22 nt, Human
uacaucaaaucaauguuccagu

SEQ ID NO: 925172 - RNA, 22 nt, Human
agccugugacucugugaaacca

SEQ ID NO: 925173 - RNA, 22 nt, Human
accugccucuaagcagcaggug

SEQ ID NO: 925174 - RNA, 22 nt, Human
cucaggaugcaggucacaggac

SEQ ID NO: 925175 - RNA, 22 nt, Human
gugagcagaauaaggguugaga

SEQ ID NO: 925176 - RNA, 22 nt, Human
agcacccuccaacuucccugua

SEQ ID NO: 925177 - RNA, 22 nt, Human
uucucuuagcuguaaagucaau

SEQ ID NO: 925178 - RNA, 22 nt, Human
gcagaggcacagccccagauga

SEQ ID NO: 925179 - RNA, 22 nt, Human
uguccuuuacugauugcuucug

SEQ ID NO: 925180 - RNA, 22 nt, Human
augagaaauuuauuacaagcua

SEQ ID NO: 925181 - RNA, 22 nt, Human
ggaagccaggcugggggaucug

SEQ ID NO: 925182 - RNA, 22 nt, Human
agagacaggguuuugccauguu

SEQ ID NO: 925183 - RNA, 22 nt, Human
ucuucccccgugcuccagugca

SEQ ID NO: 925184 - RNA, 20 nt, Human
uuuuccuucugaguauguug

SEQ ID NO: 925185 - RNA, 22 nt, Human
uagguacauuauuagaugcaug

SEQ ID NO: 925186 - RNA, 22 nt, Human
cagggagaggcaucauagggaa

SEQ ID NO: 925187 - RNA, 22 nt, Human
aaacugcugguugcuggccagc

SEQ ID NO: 925188 - RNA, 22 nt, Human
gcaguccuagggugcucugcag

SEQ ID NO: 925189 - RNA, 22 nt, Human
caagacaugcaauugccacuuu

SEQ ID NO: 925190 - RNA, 22 nt, Human
uauuauuuuagcacugaggauu

SEQ ID NO: 925191 - RNA, 22 nt, Human
ucuuuccaaggacucuguagca

SEQ ID NO: 925192 - RNA, 22 nt, Human
gaagauuuggauuccaugucac

SEQ ID NO: 925193 - RNA, 22 nt, Human
agcugcuguccuaggcacugua

SEQ ID NO: 925194 - RNA, 22 nt, Human
gagguagcgaguggacagugca

SEQ ID NO: 925195 - RNA, 22 nt, Human
gauaauuugauaccucaaucag

SEQ ID NO: 925196 - RNA, 22 nt, Human
ccaggacuuuaaguccagcacu

SEQ ID NO: 925197 - RNA, 20 nt, Human
gacuucccauaucuucuuca

SEQ ID NO: 925198 - RNA, 22 nt, Human
agaagccagaauauucauggau

SEQ ID NO: 925199 - RNA, 22 nt, Human
uccugggacuuucaaggcuagg

SEQ ID NO: 925200 - RNA, 22 nt, Human
ugcagcaccgucccacuggcua

SEQ ID NO: 925201 - RNA, 22 nt, Human
aagcauuuauagauaagaauuu

SEQ ID NO: 925202 - RNA, 22 nt, Human
ccugcagagccacgugccagcg

SEQ ID NO: 925203 - RNA, 22 nt, Human
uauuuguagaauggauuaaggg

SEQ ID NO: 925204 - RNA, 22 nt, Human
uacagaaggaaguuuagcuaaa

SEQ ID NO: 925205 - RNA, 22 nt, Human
aaacuguuauagcagaaaggac

SEQ ID NO: 925206 - RNA, 22 nt, Human
uaucauuuaacagaaucauugc

SEQ ID NO: 925207 - RNA, 17 nt, Human
ugaacuuuagguggagc

SEQ ID NO: 925208 - RNA, 22 nt, Human
ggagaagccacacauugggugu

SEQ ID NO: 925209 - RNA, 22 nt, Human
aggaaauguaguccucaucucc

SEQ ID NO: 925210 - RNA, 22 nt, Human
caauugucagugcuguuuaaau

SEQ ID NO: 925211 - RNA, 19 nt, Human
uuucuuuuccccucagcac

SEQ ID NO: 925212 - RNA, 22 nt, Human
cagggcagggauguugcggcag

SEQ ID NO: 925213 - RNA, 22 nt, Human
uuauguuuuauggcuauaucau

SEQ ID NO: 925214 - RNA, 18 nt, Human
uccugggaaaggcauaca

SEQ ID NO: 925215 - RNA, 22 nt, Human
agaagcacagguaaagugauuu

SEQ ID NO: 925216 - RNA, 22 nt, Human
uggcucugagacacaggcucuc

SEQ ID NO: 925217 - RNA, 22 nt, Human
uauuuucaccauguaucccugu

SEQ ID NO: 925218 - RNA, 22 nt, Human
caggggcucccugggugccagu

SEQ ID NO: 925219 - RNA, 22 nt, Human
gcucucugaggugcuggcagag

SEQ ID NO: 925220 - RNA, 22 nt, Human
gaaaucuuuuccaauuguuuag

SEQ ID NO: 925221 - RNA, 19 nt, Human
ccuuccuccccagggccau

SEQ ID NO: 925222 - RNA, 18 nt, Human
agaccagacaagaauggu

SEQ ID NO: 925223 - RNA, 22 nt, Human
augugugcaucaaugauagauc

SEQ ID NO: 925224 - RNA, 22 nt, Human
uucaacuauuaugaauaaaauu

SEQ ID NO: 925225 - RNA, 22 nt, Human
cuggcagggcucuuugggugcu

SEQ ID NO: 925226 - RNA, 18 nt, Human
uccuuucaccccuucucu

SEQ ID NO: 925227 - RNA, 22 nt, Human
uucugaauccucgaaacauagc

SEQ ID NO: 925228 - RNA, 22 nt, Human
ucagggcaaugucccucagaag

SEQ ID NO: 925229 - RNA, 23 nt, Human
acuacagauacuccugcuguuug

SEQ ID NO: 925230 - RNA, 19 nt, Human
uuagaacauccucuaggga

SEQ ID NO: 925231 - RNA, 20 nt, Human
gaagauggguagaggcacag

SEQ ID NO: 925232 - RNA, 19 nt, Human
gugaacaaggagaauggga

SEQ ID NO: 925233 - RNA, 22 nt, Human
ugauuuuuggaucugagcugca

SEQ ID NO: 925234 - RNA, 22 nt, Human
agcaguggcugaagauguuccu

SEQ ID NO: 925235 - RNA, 22 nt, Human
agacaagagcugaggacauauu

SEQ ID NO: 925236 - RNA, 22 nt, Human
auucuacacaacaugaugaugg

SEQ ID NO: 925237 - RNA, 22 nt, Human
uccugaguguuuggccaggcca

SEQ ID NO: 925238 - RNA, 22 nt, Human
uugcaaaggggaauaaagcaau

SEQ ID NO: 925239 - RNA, 22 nt, Human
aacacaggcauacuggcuccag

SEQ ID NO: 925240 - RNA, 22 nt, Human
cuggcuccaaauucugauguuc

SEQ ID NO: 925241 - RNA, 22 nt, Human
caggggaaggagccuugaaacu

SEQ ID NO: 925242 - RNA, 22 nt, Human
auagccaggagaugauggggga

SEQ ID NO: 925243 - RNA, 22 nt, Human
agguaagggcugcgacuauaag

SEQ ID NO: 925244 - RNA, 22 nt, Human
acauguuaaacaucauggaaug

SEQ ID NO: 925245 - RNA, 22 nt, Human
uucuguuacuguuggucauaac

SEQ ID NO: 925246 - RNA, 20 nt, Human
accagagaccugaaucaguu

SEQ ID NO: 925247 - RNA, 22 nt, Human
gacacagucaagaguggaggaa

SEQ ID NO: 925248 - RNA, 22 nt, Human
acagggcuccuagguggugugc

SEQ ID NO: 925249 - RNA, 22 nt, Human
uucugcaugaacaguuuauucc

SEQ ID NO: 925250 - RNA, 22 nt, Human
ccagagaggccuuggcaagaca

SEQ ID NO: 925251 - RNA, 22 nt, Human
cuaauucuuuggagacaaucug

SEQ ID NO: 925252 - RNA, 22 nt, Human
auggccuggccagagcucugcu

SEQ ID NO: 925253 - RNA, 19 nt, Human
gguuccucacgcuaagggc

SEQ ID NO: 925254 - RNA, 22 nt, Human
aggcugaugcuggcugaggcug

SEQ ID NO: 925255 - RNA, 22 nt, Human
agcuggauuccagugcagucac

SEQ ID NO: 925256 - RNA, 19 nt, Human
aggcugcaagguggugggc

SEQ ID NO: 925257 - RNA, 22 nt, Human
acaggagugaaucuggcacuua

SEQ ID NO: 925258 - RNA, 22 nt, Human
ucuauaauggaaaguggaugug

SEQ ID NO: 925259 - RNA, 18 nt, Human
gagguggcugggccaucu

SEQ ID NO: 925260 - RNA, 22 nt, Human
cccugcagaucuaggguccuuc

SEQ ID NO: 925261 - RNA, 22 nt, Human
aaauucugcaauuugacaagau

SEQ ID NO: 925262 - RNA, 22 nt, Human
agaguccaugaagacagcugag

SEQ ID NO: 925263 - RNA, 22 nt, Human
aguggcagccgagcaggagaug

SEQ ID NO: 925264 - RNA, 22 nt, Human
gcaccuuagccugaauuugugu

SEQ ID NO: 925265 - RNA, 22 nt, Human
gguauucacaauauuuaaagag

SEQ ID NO: 925266 - RNA, 22 nt, Human
uucaaauccuagcccuguggcc

SEQ ID NO: 925267 - RNA, 22 nt, Human
gcugucuggaggcucugaggga

SEQ ID NO: 925268 - RNA, 22 nt, Human
acagcagccuuguugguuucga

SEQ ID NO: 925269 - RNA, 22 nt, Human
ggggaggaguguacagguuuau

SEQ ID NO: 925270 - RNA, 22 nt, Human
cgcaggcaaugcuccgcggggg

SEQ ID NO: 925271 - RNA, 22 nt, Human
ccucugugacuucuaccuucac

SEQ ID NO: 925272 - RNA, 22 nt, Human
uuuuuaugccuacgcugaaaag

SEQ ID NO: 925273 - RNA, 22 nt, Human
cacauucauggaguuugccugu

SEQ ID NO: 925274 - RNA, 23 nt, Human
gcuacagcugacugucauucccu

SEQ ID NO: 925275 - RNA, 22 nt, Human
aucauguucaucguauuuaggc

SEQ ID NO: 925276 - RNA, 22 nt, Human
cagagcuggguuugggaaaccu

SEQ ID NO: 925277 - RNA, 22 nt, Human
auguggaaugaacaaaggaggc

SEQ ID NO: 925278 - RNA, 22 nt, Human
cugggugcugugggcucagagg

SEQ ID NO: 925279 - RNA, 22 nt, Human
uaggacagagauuuguuuuaug

SEQ ID NO: 925280 - RNA, 22 nt, Human
caggcagaaauuuuguuucauu

SEQ ID NO: 925281 - RNA, 22 nt, Human
ucacccaggcuggacugcagug

SEQ ID NO: 925282 - RNA, 22 nt, Human
uucccugcaaccuuucccuggg

SEQ ID NO: 925283 - RNA, 22 nt, Human
ugcagaugccugggcugcacca

SEQ ID NO: 925284 - RNA, 22 nt, Human
cuuguggccaauguuuguuaua

SEQ ID NO: 925285 - RNA, 22 nt, Human
uucaaagaauuuugagaccuga

SEQ ID NO: 925286 - RNA, 20 nt, Human
gguccuguacucucauugaa

SEQ ID NO: 925287 - RNA, 22 nt, Human
uuuauuaugauggacaccuucg

SEQ ID NO: 925288 - RNA, 19 nt, Human
uccagggcuuuauggcuuu

SEQ ID NO: 925289 - RNA, 22 nt, Human
uuuguucuugcaacaguuauua

SEQ ID NO: 925290 - RNA, 22 nt, Human
aaggcaaguuuuaguuuucugg

SEQ ID NO: 925291 - RNA, 22 nt, Human
acccacagccgcugugcguccc

SEQ ID NO: 925292 - RNA, 22 nt, Human
uuuauguuccucuugagcuuuc

SEQ ID NO: 925293 - RNA, 17 nt, Human
ucagcaggggccaagcu

SEQ ID NO: 925294 - RNA, 18 nt, Human
uuugcaugguaacauuga

SEQ ID NO: 925295 - RNA, 22 nt, Human
ugucaguucaauuauaguaauu

SEQ ID NO: 925296 - RNA, 22 nt, Human
accugcugucuugggggaaugc

SEQ ID NO: 925297 - RNA, 21 nt, Human
caucuuaauugaaagcagaga

SEQ ID NO: 925298 - RNA, 22 nt, Human
cucagagggaggacugggcugg

SEQ ID NO: 925299 - RNA, 22 nt, Human
ugagcaggcgcagcaggagguc

SEQ ID NO: 925300 - RNA, 22 nt, Human
gcaguucuccagaauaaagggu

SEQ ID NO: 925301 - RNA, 22 nt, Human
uaacauguucagacuaccugug

SEQ ID NO: 925302 - RNA, 22 nt, Human
augcagcaguuuacaaagcaau

SEQ ID NO: 925303 - RNA, 22 nt, Human
uugugagagaaaauguguauau

SEQ ID NO: 925304 - RNA, 22 nt, Human
guccacagcuggccagggccuc

SEQ ID NO: 925305 - RNA, 22 nt, Human
guuuauaugaacuucauaccca

SEQ ID NO: 925306 - RNA, 20 nt, Human
agucacaguaucagucuuag

SEQ ID NO: 925307 - RNA, 22 nt, Human
gugaggauacuuaagagaacac

SEQ ID NO: 925308 - RNA, 22 nt, Human
uguucauuaguggaaguaaguu

SEQ ID NO: 925309 - RNA, 20 nt, Human
agauggugaaggccagggag

SEQ ID NO: 925310 - RNA, 22 nt, Human
cucuugcuugcaaguggggaua

SEQ ID NO: 925311 - RNA, 22 nt, Human
agcgagggaggucugaggacag

SEQ ID NO: 925312 - RNA, 22 nt, Human
ugcuucugaaaugcaggucuuc

SEQ ID NO: 925313 - RNA, 22 nt, Human
cugggccugugacucccauccu

SEQ ID NO: 925314 - RNA, 22 nt, Human
agcccagcaaagggagguucag

SEQ ID NO: 925315 - RNA, 22 nt, Human
ucccagcaggaguccaguuccc

SEQ ID NO: 925316 - RNA, 16 nt, Human
ccaccugcagcucuca

SEQ ID NO: 925317 - RNA, 22 nt, Human
uaugauguguaccuaagucacc

SEQ ID NO: 925318 - RNA, 22 nt, Human
uaugucuuguguuugcuaaucu

SEQ ID NO: 925319 - RNA, 22 nt, Human
cuuacagagaagaaaauguagu

SEQ ID NO: 925320 - RNA, 22 nt, Human
aagaggaacugggggcugaguc

SEQ ID NO: 925321 - RNA, 22 nt, Human
uuagaacaguguuugccucgcu

SEQ ID NO: 925322 - RNA, 22 nt, Human
uggccagcuguagguugugcag

SEQ ID NO: 925323 - RNA, 22 nt, Human
gcaaucaaugauuuauauuugu

SEQ ID NO: 925324 - RNA, 22 nt, Human
uggcagugaugcggcaggacau

SEQ ID NO: 925325 - RNA, 22 nt, Human
cacugcccaggaccugccaccc

SEQ ID NO: 925326 - RNA, 19 nt, Human
uggaggccucaggaaaaga

SEQ ID NO: 925327 - RNA, 22 nt, Human
uggaagggagcuggaauuugga

SEQ ID NO: 925328 - RNA, 22 nt, Human
agagggcauaaaauagagcacg

SEQ ID NO: 925329 - RNA, 22 nt, Human
guacauuucucccaacacuaaa

SEQ ID NO: 925330 - RNA, 22 nt, Human
gaccaacagaauuuccuguuuu

SEQ ID NO: 925331 - RNA, 22 nt, Human
ugaggcuggaugggaugccucc

SEQ ID NO: 925332 - RNA, 22 nt, Human
aaugcagugagccauuaaaugg

SEQ ID NO: 925333 - RNA, 22 nt, Human
cuuggcagcuacacagguaaga

SEQ ID NO: 925334 - RNA, 22 nt, Human
ugcugaggucacggcggccaga

SEQ ID NO: 925335 - RNA, 22 nt, Human
gcuggucccaauguguuuccuu

SEQ ID NO: 925336 - RNA, 22 nt, Human
ugcuuuauagacaaggaaguag

SEQ ID NO: 925337 - RNA, 22 nt, Human
acagucuuuaauuucuuugugg

SEQ ID NO: 925338 - RNA, 23 nt, Human
guaaaauacgcagugcaguguga

SEQ ID NO: 925339 - RNA, 22 nt, Human
uccuggccgccgcguggggccg

SEQ ID NO: 925340 - RNA, 22 nt, Human
ggcuuugacaugcugaauuaaa

SEQ ID NO: 925341 - RNA, 22 nt, Human
acccgggaggcaggagucauag

SEQ ID NO: 925342 - RNA, 19 nt, Human
aagguggcagcagguauua

SEQ ID NO: 925343 - RNA, 22 nt, Human
gggcggggggagcuggaaugaa

SEQ ID NO: 925344 - RNA, 22 nt, Human
caguuuauauauaagcacauug

SEQ ID NO: 925345 - RNA, 22 nt, Human
ucuucauuuugaagaggcagaa

SEQ ID NO: 925346 - RNA, 22 nt, Human
caaguucacguugcuuuuugag

SEQ ID NO: 925347 - RNA, 23 nt, Human
aguagcacauacaguacuuguuc

SEQ ID NO: 925348 - RNA, 22 nt, Human
cugcuucaaggaaaugaaucgg

SEQ ID NO: 925349 - RNA, 22 nt, Human
auuucaugcagaaggaaguugg

SEQ ID NO: 925350 - RNA, 22 nt, Human
ggugcucaagagggcauccucu

SEQ ID NO: 925351 - RNA, 22 nt, Human
cagugcuauaauccagugucgu

SEQ ID NO: 925352 - RNA, 22 nt, Human
acacugacugggacagaagacc

SEQ ID NO: 925353 - RNA, 22 nt, Human
agguauuuuauagauaaguaaa

SEQ ID NO: 925354 - RNA, 22 nt, Human
cagguagcugcagagacuauuu

SEQ ID NO: 925355 - RNA, 22 nt, Human
guuuuauuggaacacagccaug

SEQ ID NO: 925356 - RNA, 22 nt, Human
cggcagcaaaggaagccagguc

SEQ ID NO: 925357 - RNA, 22 nt, Human
ccauuuuugacagaaggccuaa

SEQ ID NO: 925358 - RNA, 21 nt, Human
gcuggcugucucuuacacggu

SEQ ID NO: 925359 - RNA, 22 nt, Human
aguuuacaugacguguauuuca

SEQ ID NO: 925360 - RNA, 22 nt, Human
cagugcuggagauggguggaac

SEQ ID NO: 925361 - RNA, 22 nt, Human
acccaggagguggaggcugcag

SEQ ID NO: 925362 - RNA, 19 nt, Human
ccagaugagcagcugagau

SEQ ID NO: 925363 - RNA, 22 nt, Human
gggaaggguguugucuuaucuu

SEQ ID NO: 925364 - RNA, 22 nt, Human
aguggcacaauuuugacucccc

SEQ ID NO: 925365 - RNA, 22 nt, Human
ccuuuauguuucugcagccccc

SEQ ID NO: 925366 - RNA, 22 nt, Human
auggcccaggccaggauccagc

SEQ ID NO: 925367 - RNA, 22 nt, Human
augucacaggcaacaagauugc

SEQ ID NO: 925368 - RNA, 22 nt, Human
ccaccacauuugccuagacuuu

SEQ ID NO: 925369 - RNA, 22 nt, Human
agcccugguagccugcugccau

SEQ ID NO: 925370 - RNA, 22 nt, Human
gccaaugacagucucaguucug

SEQ ID NO: 925371 - RNA, 22 nt, Human
guauuagacugagaaauggagu

SEQ ID NO: 925372 - RNA, 22 nt, Human
augcaaacauguuuccucuaag

SEQ ID NO: 925373 - RNA, 20 nt, Human
cccugcagccaugggagugg

SEQ ID NO: 925374 - RNA, 23 nt, Human
gccaggcacaugguggacacgca

SEQ ID NO: 925375 - RNA, 22 nt, Human
acaugaagcaagaaagaugcua

SEQ ID NO: 925376 - RNA, 22 nt, Human
gaagucuucaucugaugcucug

SEQ ID NO: 925377 - RNA, 22 nt, Human
ccugugaauccaucauuauuuc

SEQ ID NO: 925378 - RNA, 22 nt, Human
cuggaauguagagacagcuuag

SEQ ID NO: 925379 - RNA, 22 nt, Human
agaagcagcuuucaaggugauu

SEQ ID NO: 925380 - RNA, 22 nt, Human
uauuuguagcuucccaaagcuu

SEQ ID NO: 925381 - RNA, 22 nt, Human
agccaagaaucaugagcuaaua

SEQ ID NO: 925382 - RNA, 22 nt, Human
aucaggccagcaaucccugggc

SEQ ID NO: 925383 - RNA, 22 nt, Human
cugggcuccuaaccauccaggu

SEQ ID NO: 925384 - RNA, 22 nt, Human
acuguucuccuuuggcuauauc

SEQ ID NO: 925385 - RNA, 22 nt, Human
ucugcaucuguguugagugccc

SEQ ID NO: 925386 - RNA, 22 nt, Human
augaagcaacagcccuccuauu

SEQ ID NO: 925387 - RNA, 22 nt, Human
uacaaagucccauugccaugga

SEQ ID NO: 925388 - RNA, 22 nt, Human
cagcugaagaaagagugguuag

SEQ ID NO: 925389 - RNA, 22 nt, Human
uccaagaagcucagcaaacauc

SEQ ID NO: 925390 - RNA, 21 nt, Human
agaaaaacacgauauaagccc

SEQ ID NO: 925391 - RNA, 22 nt, Human
cacauguguauaugugaggggg

SEQ ID NO: 925392 - RNA, 22 nt, Human
ggaagagagaucccauagaugu

SEQ ID NO: 925393 - RNA, 22 nt, Human
ccuucccuaaagcgucgcuuag

SEQ ID NO: 925394 - RNA, 22 nt, Human
aaguugguguaugagacagaag

SEQ ID NO: 925395 - RNA, 22 nt, Human
aggaagcuuuaugaccagcuaa

SEQ ID NO: 925396 - RNA, 22 nt, Human
uuccaaaaugccuugauaugau

SEQ ID NO: 925397 - RNA, 22 nt, Human
ggcagcuuugagucuuagagua

SEQ ID NO: 925398 - RNA, 22 nt, Human
cucaccacagagccuguccagc

SEQ ID NO: 925399 - RNA, 22 nt, Human
ucaaggagcccacagucuaaug

SEQ ID NO: 925400 - RNA, 22 nt, Human
cagguucuuaacuuguucuucc

SEQ ID NO: 925401 - RNA, 22 nt, Human
acagccugacuuuuguugucac

SEQ ID NO: 925402 - RNA, 22 nt, Human
uccaggccccagcaccuuggga

SEQ ID NO: 925403 - RNA, 22 nt, Human
aaugcauacguguuuguggcaa

SEQ ID NO: 925404 - RNA, 22 nt, Human
aaaugaguagcgaugcacauua

SEQ ID NO: 925405 - RNA, 22 nt, Human
uuuggaaugaaacagcagagcc

SEQ ID NO: 925406 - RNA, 22 nt, Human
agccagagacugugucuguaau

SEQ ID NO: 925407 - RNA, 22 nt, Human
cacauucagggaacauuggagg

SEQ ID NO: 925408 - RNA, 22 nt, Human
gcagccacccucaaggcugaau

SEQ ID NO: 925409 - RNA, 22 nt, Human
ucuuggcaaauuuuugaggcuc

SEQ ID NO: 925410 - RNA, 22 nt, Human
aaauacgugcacauacauacau

SEQ ID NO: 925411 - RNA, 22 nt, Human
uuacaaagcguugagacaagua

SEQ ID NO: 925412 - RNA, 20 nt, Human
gcacagagaugagcaaagua

SEQ ID NO: 925413 - RNA, 23 nt, Human
ggccacugaauuuucugcaucuu

SEQ ID NO: 925414 - RNA, 22 nt, Human
uuaggaagaugcuuuuucuggg

SEQ ID NO: 925415 - RNA, 22 nt, Human
aauauuuuugaggcccuguuau

SEQ ID NO: 925416 - RNA, 20 nt, Human
uuagaguuagcuguuaugca

SEQ ID NO: 925417 - RNA, 22 nt, Human
gccacagguaggaaccuaccuc

SEQ ID NO: 925418 - RNA, 19 nt, Human
uccagggcaggaacaugua

SEQ ID NO: 925419 - RNA, 22 nt, Human
ugcugucagacagcagugguaa

SEQ ID NO: 925420 - RNA, 21 nt, Human
aucugaaaugucaaagcagau

SEQ ID NO: 925421 - RNA, 22 nt, Human
uuuguacugaccaauuauuuga

SEQ ID NO: 925422 - RNA, 22 nt, Human
gggagucaggcucccucagaga

SEQ ID NO: 925423 - RNA, 18 nt, Human
agagaaagaccaaagcau

SEQ ID NO: 925424 - RNA, 22 nt, Human
aaagaugucagucagauaggau

SEQ ID NO: 925425 - RNA, 22 nt, Human
gagaccucuugguaucgcuagg

SEQ ID NO: 925426 - RNA, 22 nt, Human
aacccaggucuuuggcuuccag

SEQ ID NO: 925427 - RNA, 22 nt, Human
ccagggaaucucugaguguguu

SEQ ID NO: 925428 - RNA, 22 nt, Human
uugacuuuacaguuuucuuagg

SEQ ID NO: 925429 - RNA, 22 nt, Human
ucaggaagaaauucuguaucuu

SEQ ID NO: 925430 - RNA, 22 nt, Human
cuggcccaggaagacguguccc

SEQ ID NO: 925431 - RNA, 22 nt, Human
uuacauuuggcuauguccucua

SEQ ID NO: 925432 - RNA, 22 nt, Human
cccugaggcaguaggagcuuuu

SEQ ID NO: 925433 - RNA, 22 nt, Human
ucugccuggccuggagggcaca

SEQ ID NO: 925434 - RNA, 22 nt, Human
cuggagcuccagggucuccucu

SEQ ID NO: 925435 - RNA, 22 nt, Human
uacuuuggguuuagaauaaacu

SEQ ID NO: 925436 - RNA, 22 nt, Human
cagaggcagugggguugcuccu

SEQ ID NO: 925437 - RNA, 20 nt, Human
ugcuucauuaugugagauag

SEQ ID NO: 925438 - RNA, 20 nt, Human
cagcacagagcuuggcucua

SEQ ID NO: 925439 - RNA, 22 nt, Human
aagggcugcuguagaagcagag

SEQ ID NO: 925440 - RNA, 22 nt, Human
ucuuccaagguugcacacuauc

SEQ ID NO: 925441 - RNA, 22 nt, Human
uacacaggcugccucuuugcau

SEQ ID NO: 925442 - RNA, 22 nt, Human
ucacagaaaagcugagcaucag

SEQ ID NO: 925443 - RNA, 22 nt, Human
acuuagcaauuugauuaaaaga

SEQ ID NO: 925444 - RNA, 22 nt, Human
agaaagauccuucuggcugccu

SEQ ID NO: 925445 - RNA, 21 nt, Human
uccagggcgggcgcacggaga

SEQ ID NO: 925446 - RNA, 22 nt, Human
cagaggcuaagaugagugggug

SEQ ID NO: 925447 - RNA, 22 nt, Human
agagacuguacguggcaaguau

SEQ ID NO: 925448 - RNA, 22 nt, Human
accccagcccugcuucugggag

SEQ ID NO: 925449 - RNA, 20 nt, Human
cuguccugaucuuuucagaa

SEQ ID NO: 925450 - RNA, 22 nt, Human
gcagggagggccuuucaugaca

SEQ ID NO: 925451 - RNA, 22 nt, Human
cacugcuuuucagacaguuauu

SEQ ID NO: 925452 - RNA, 22 nt, Human
cucuugguggguggccuguuga

SEQ ID NO: 925453 - RNA, 22 nt, Human
aucuggaacaaagcuuaggaau

SEQ ID NO: 925454 - RNA, 22 nt, Human
aaaccacaugccuucaaaugcu

SEQ ID NO: 925455 - RNA, 22 nt, Human
ugagcuggucacuccuucugaa

SEQ ID NO: 925456 - RNA, 22 nt, Human
aggagggacaccaauauauguu

SEQ ID NO: 925457 - RNA, 22 nt, Human
ccuugacugccuucaggcuggg

SEQ ID NO: 925458 - RNA, 22 nt, Human
cagcugccaagaaucuuuucua

SEQ ID NO: 925459 - RNA, 22 nt, Human
cagagcagguaucuuuggugaa

SEQ ID NO: 925460 - RNA, 22 nt, Human
aggagcagaccguaguccugca

SEQ ID NO: 925461 - RNA, 20 nt, Human
auaaaauaacugccacaaga

SEQ ID NO: 925462 - RNA, 22 nt, Human
cacagguuagcagcuugaaacu

SEQ ID NO: 925463 - RNA, 22 nt, Human
aaggcagagggcuggaucagag

SEQ ID NO: 925464 - RNA, 22 nt, Human
uccaggccgcauaguuacucug

SEQ ID NO: 925465 - RNA, 22 nt, Human
ucacaggguguacaucaccuau

SEQ ID NO: 925466 - RNA, 22 nt, Human
guggugaguucaggcuggggug

SEQ ID NO: 925467 - RNA, 22 nt, Human
uaucuuuagaggaagagaaucu

SEQ ID NO: 925468 - RNA, 22 nt, Human
uuuguuuauuaggggagaguug

SEQ ID NO: 925469 - RNA, 19 nt, Human
agcagcagcaccagggauu

SEQ ID NO: 925470 - RNA, 22 nt, Human
gaggcagagugcaccccaggag

SEQ ID NO: 925471 - RNA, 22 nt, Human
cugaggggaaaagucaggauga

SEQ ID NO: 925472 - RNA, 22 nt, Human
uagcagcucuuuacuaaccagu

SEQ ID NO: 925473 - RNA, 22 nt, Human
ccugccuggcccaccuugccac

SEQ ID NO: 925474 - RNA, 22 nt, Human
agcagccucuguagaggucucc

SEQ ID NO: 925475 - RNA, 22 nt, Human
uaggaacauaugcagugcuuuu

SEQ ID NO: 925476 - RNA, 22 nt, Human
ggagaccagaaggaagcuucga

SEQ ID NO: 925477 - RNA, 22 nt, Human
aggcugggaaauguagucuucc

SEQ ID NO: 925478 - RNA, 22 nt, Human
ggccacagagggcgggaugcug

SEQ ID NO: 925479 - RNA, 22 nt, Human
caucuuugcacccucaaaaccu

SEQ ID NO: 925480 - RNA, 22 nt, Human
uuuagcauguuccuuucauaga

SEQ ID NO: 925481 - RNA, 22 nt, Human
ggagugguggucaggccauggc

SEQ ID NO: 925482 - RNA, 22 nt, Human
caagggcuucaaguggccaaga

SEQ ID NO: 925483 - RNA, 22 nt, Human
gcuucucaauucucacccucca

SEQ ID NO: 925484 - RNA, 17 nt, Human
cagugaagagacauuaa

SEQ ID NO: 925485 - RNA, 22 nt, Human
aacacagacauagugauuacag

SEQ ID NO: 925486 - RNA, 22 nt, Human
uugcucuguaauaaucuggggu

SEQ ID NO: 925487 - RNA, 22 nt, Human
caauggcacugcccaaagagaa

SEQ ID NO: 925488 - RNA, 18 nt, Human
ugucucaguucugcuaug

SEQ ID NO: 925489 - RNA, 22 nt, Human
ucugugcauuucaggaccugaa

SEQ ID NO: 925490 - RNA, 22 nt, Human
gcucugggugaauggcagauug

SEQ ID NO: 925491 - RNA, 22 nt, Human
ucacauguuaggucgggcaagg

SEQ ID NO: 925492 - RNA, 22 nt, Human
cugggaugcggagguugcggug

SEQ ID NO: 925493 - RNA, 22 nt, Human
acauuuagaguucuuuacucca

SEQ ID NO: 925494 - RNA, 22 nt, Human
ggcagccaugcacgcugccugg

SEQ ID NO: 925495 - RNA, 19 nt, Human
guacagugguaagcuauga

SEQ ID NO: 925496 - RNA, 22 nt, Human
aagaugguuucuguagguuuau

SEQ ID NO: 925497 - RNA, 20 nt, Human
agagagcacaggcaggaaag

SEQ ID NO: 925498 - RNA, 19 nt, Human
aaugguaauuagagaaaug

SEQ ID NO: 925499 - RNA, 22 nt, Human
cagugcagacguggagggggca

SEQ ID NO: 925500 - RNA, 22 nt, Human
ugccaggcuguccugggccugg

SEQ ID NO: 925501 - RNA, 22 nt, Human
ugcaugugcccacucuggcuua

SEQ ID NO: 925502 - RNA, 22 nt, Human
guguuucuugcacuccccggac

SEQ ID NO: 925503 - RNA, 22 nt, Human
gcagcauugugagguccugccc

SEQ ID NO: 925504 - RNA, 22 nt, Human
cuguguccuccccaucacuucu

SEQ ID NO: 925505 - RNA, 23 nt, Human
agcauggaauaggaaagaggcag

SEQ ID NO: 925506 - RNA, 22 nt, Human
aaaucuaguaccuuuuugauua

SEQ ID NO: 925507 - RNA, 22 nt, Human
agagcugcaggguggacccagg

SEQ ID NO: 925508 - RNA, 22 nt, Human
acuuuagaccaucuuccacagu

SEQ ID NO: 925509 - RNA, 22 nt, Human
ccaggcaaaucccucuggcaga

SEQ ID NO: 925510 - RNA, 17 nt, Human
ggagagugggaauggcc

SEQ ID NO: 925511 - RNA, 22 nt, Human
aauccauuuacucuuuacaaga

SEQ ID NO: 925512 - RNA, 22 nt, Human
uucuuuggcauuuccuguaugu

SEQ ID NO: 925513 - RNA, 22 nt, Human
cuuaagaagcaagucucagcaa

SEQ ID NO: 925514 - RNA, 22 nt, Human
agaaaaacuaagaguggguggu

SEQ ID NO: 925515 - RNA, 22 nt, Human
cccaggaggucgaagcugcagu

SEQ ID NO: 925516 - RNA, 22 nt, Human
cccagaaggucgaggcugcagu

SEQ ID NO: 925517 - RNA, 22 nt, Human
cagcagagcauuugguaggagg

SEQ ID NO: 925518 - RNA, 22 nt, Human
gucccaggggagcucucugauu

SEQ ID NO: 925519 - RNA, 22 nt, Human
aagugcuagaaccccagcaaca

SEQ ID NO: 925520 - RNA, 22 nt, Human
cugaggcugagacaggugaaau

SEQ ID NO: 925521 - RNA, 22 nt, Human
uucuucucggcugucagauagu

SEQ ID NO: 925522 - RNA, 22 nt, Human
ugggaugaauacaaugggauca

SEQ ID NO: 925523 - RNA, 22 nt, Human
ggagcagagcugggcuuggcug

SEQ ID NO: 925524 - RNA, 22 nt, Human
ugagcccagucugucugacaug

SEQ ID NO: 925525 - RNA, 22 nt, Human
uuguguguuuguagaaaaucca

SEQ ID NO: 925526 - RNA, 22 nt, Human
gaggaagccccauugaagccag

SEQ ID NO: 925527 - RNA, 22 nt, Human
aagaacuuuuggcaaguguuau

SEQ ID NO: 925528 - RNA, 22 nt, Human
uggcccagaucucugaccuuga

SEQ ID NO: 925529 - RNA, 22 nt, Human
guccccagagcugguggugguu

SEQ ID NO: 925530 - RNA, 22 nt, Human
ggaggguggcagcguccugggc

SEQ ID NO: 925531 - RNA, 22 nt, Human
agaacagaggccuuauguuuca

SEQ ID NO: 925532 - RNA, 22 nt, Human
gugaagcagggaaggaaaggau

SEQ ID NO: 925533 - RNA, 22 nt, Human
cagaggugcuggagugaguccu

SEQ ID NO: 925534 - RNA, 22 nt, Human
uaaagcuaugcuuaauuuauca

SEQ ID NO: 925535 - RNA, 22 nt, Human
auuucuuccuucuccuagaaga

SEQ ID NO: 925536 - RNA, 22 nt, Human
cagcagggggcagcgcagauca

SEQ ID NO: 925537 - RNA, 23 nt, Human
ugucccagagggagggauaggcu

SEQ ID NO: 925538 - RNA, 22 nt, Human
auuagauacacagauuuccacu

SEQ ID NO: 925539 - RNA, 18 nt, Human
cuguccaguagacucugc

SEQ ID NO: 925540 - RNA, 23 nt, Human
uugcugagauaaagaaugcaggg

SEQ ID NO: 925541 - RNA, 22 nt, Human
gaggaaaauaacaacuaagggc

SEQ ID NO: 925542 - RNA, 22 nt, Human
aagacacaauguagcccagcac

SEQ ID NO: 925543 - RNA, 22 nt, Human
uagaauaugugguaggaucugg

SEQ ID NO: 925544 - RNA, 22 nt, Human
uauauguaaauaagucuaaugu

SEQ ID NO: 925545 - RNA, 18 nt, Human
cagggcuguggggucacu

SEQ ID NO: 925546 - RNA, 22 nt, Human
guggugaagccccaucucugcu

SEQ ID NO: 925547 - RNA, 22 nt, Human
ucuguguccugcuagcugucuu

SEQ ID NO: 925548 - RNA, 22 nt, Human
uggcuuggcuaagaucuaagcu

SEQ ID NO: 925549 - RNA, 22 nt, Human
uggccuggaagagaggucgagg

SEQ ID NO: 925550 - RNA, 22 nt, Human
acgaaucauucacggacaacac

SEQ ID NO: 925551 - RNA, 20 nt, Human
caguggcuucuguggaauau

SEQ ID NO: 925552 - RNA, 22 nt, Human
aaaagucugcucucauuucaga

SEQ ID NO: 925553 - RNA, 22 nt, Human
ugccaugcccaccucccuucug

SEQ ID NO: 925554 - RNA, 21 nt, Human
aaggcagaagcauggaaugag

SEQ ID NO: 925555 - RNA, 22 nt, Human
aguggcuguccuggcucuaacu

SEQ ID NO: 925556 - RNA, 22 nt, Human
aacaacagcugcuaaagaguug

SEQ ID NO: 925557 - RNA, 22 nt, Human
gagcaaggcggcaucucucuga

SEQ ID NO: 925558 - RNA, 22 nt, Human
agaguaaaguacuuggaauacc

SEQ ID NO: 925559 - RNA, 22 nt, Human
aggcaagcccccagugaggcuc

SEQ ID NO: 925560 - RNA, 22 nt, Human
cucacagguaccagcacccucc

SEQ ID NO: 925561 - RNA, 22 nt, Human
gugcugagauuggagugagcag

SEQ ID NO: 925562 - RNA, 22 nt, Human
guuuuauuuccaugagagaccg

SEQ ID NO: 925563 - RNA, 22 nt, Human
ggagaaaggauaggaaugugcu

SEQ ID NO: 925564 - RNA, 22 nt, Human
agcaggaaggggccuagccugg

SEQ ID NO: 925565 - RNA, 22 nt, Human
caggaagcaucuggcuagcuaa

SEQ ID NO: 925566 - RNA, 22 nt, Human
ggcacaagguuuaaauaacauc

SEQ ID NO: 925567 - RNA, 22 nt, Human
uauuggaaggcauuagugaaua

SEQ ID NO: 925568 - RNA, 22 nt, Human
auuggucucugcuaaagggagg

SEQ ID NO: 925569 - RNA, 22 nt, Human
agucuagaugauccuaggaaua

SEQ ID NO: 925570 - RNA, 22 nt, Human
gaaguacaaaggacauggaaac

SEQ ID NO: 925571 - RNA, 22 nt, Human
aagucacaagcauauaugcauu

SEQ ID NO: 925572 - RNA, 21 nt, Human
acagcauguuuguguguuugc

SEQ ID NO: 925573 - RNA, 22 nt, Human
agcccaggaguccuuaaggacc

SEQ ID NO: 925574 - RNA, 19 nt, Human
aauucuguuucagcagauc

SEQ ID NO: 925575 - RNA, 22 nt, Human
gaaguucugguguaugugauaa

SEQ ID NO: 925576 - RNA, 22 nt, Human
auaacagguugaauccgaaugu

SEQ ID NO: 925577 - RNA, 22 nt, Human
acugcacugauuuaucauccca

SEQ ID NO: 925578 - RNA, 22 nt, Human
cucuggagaugguucucaauug

SEQ ID NO: 925579 - RNA, 22 nt, Human
ccugucugaaggcagggggaug

SEQ ID NO: 925580 - RNA, 22 nt, Human
ucuucauacucaucacauaggu

SEQ ID NO: 925581 - RNA, 22 nt, Human
agggcucagggcacgucaucca

SEQ ID NO: 925582 - RNA, 22 nt, Human
guggggagggagaugcugaagu

SEQ ID NO: 925583 - RNA, 21 nt, Human
ucauuuauugagaaaugacug

SEQ ID NO: 925584 - RNA, 22 nt, Human
ccagcaggcagucauauccuuu

SEQ ID NO: 925585 - RNA, 22 nt, Human
guggccugggguuuguucugag

SEQ ID NO: 925586 - RNA, 22 nt, Human
aucugaaguggagaaaaauaua

SEQ ID NO: 925587 - RNA, 22 nt, Human
ugguaaggauuguagaaacgaa

SEQ ID NO: 925588 - RNA, 22 nt, Human
ggccuggcauggggacuaaggg

SEQ ID NO: 925589 - RNA, 22 nt, Human
aagguauuauuugcaaucauuu

SEQ ID NO: 925590 - RNA, 22 nt, Human
ccagccuucugggacucucauc

SEQ ID NO: 925591 - RNA, 22 nt, Human
aaguuuugaaauacugaagugu

SEQ ID NO: 925592 - RNA, 22 nt, Human
ggcuggguuugacuccuggcuu

SEQ ID NO: 925593 - RNA, 22 nt, Human
gugcaaaaguaauggcaguuuu

SEQ ID NO: 925594 - RNA, 22 nt, Human
cugagccuuauucaccagcccu

SEQ ID NO: 925595 - RNA, 22 nt, Human
aaggcaauugagaagaaacaga

SEQ ID NO: 925596 - RNA, 23 nt, Human
ugagaagccauuagagcaggugg

SEQ ID NO: 925597 - RNA, 22 nt, Human
cugugucucauccgccucuggc

SEQ ID NO: 925598 - RNA, 22 nt, Human
agcuuccucaccucagaggucu

SEQ ID NO: 925599 - RNA, 22 nt, Human
ccugccaggcuuucagguuugg

SEQ ID NO: 925600 - RNA, 22 nt, Human
aaacauuagacaccauaugcuc

SEQ ID NO: 925601 - RNA, 22 nt, Human
ucagugaucuaaggguauggcc

SEQ ID NO: 925602 - RNA, 22 nt, Human
uugacaaguggagauauuuaag

SEQ ID NO: 925603 - RNA, 22 nt, Human
ucaucauccuuuuuugaagagu

SEQ ID NO: 925604 - RNA, 22 nt, Human
aagaguuuccaguuguggcuca

SEQ ID NO: 925605 - RNA, 22 nt, Human
cucugaggucagggcccggcaa

SEQ ID NO: 925606 - RNA, 22 nt, Human
gugauucuuugaucuaugaaag

SEQ ID NO: 925607 - RNA, 22 nt, Human
aaguuuuauuggaacauagcca

SEQ ID NO: 925608 - RNA, 22 nt, Human
ggucgagucacuuguugccuuu

SEQ ID NO: 925609 - RNA, 22 nt, Human
gcagggcuaauggggcaaguag

SEQ ID NO: 925610 - RNA, 22 nt, Human
acucaaauuugucaacugaagc

SEQ ID NO: 925611 - RNA, 22 nt, Human
aguggcagagccaagauaugau

SEQ ID NO: 925612 - RNA, 22 nt, Human
cacugagaggucucauuuccaa

SEQ ID NO: 925613 - RNA, 22 nt, Human
ccccaggagauuugggagcaca

SEQ ID NO: 925614 - RNA, 23 nt, Human
cagaugugcaacucuaggcaaug

SEQ ID NO: 925615 - RNA, 22 nt, Human
ugcgcgcuggcgucacuuagca

SEQ ID NO: 925616 - RNA, 22 nt, Human
caugaaggaauuaagguaagga

SEQ ID NO: 925617 - RNA, 22 nt, Human
uucugagcuacauaguacuggg

SEQ ID NO: 925618 - RNA, 22 nt, Human
ugggccaggucugugucagcug

SEQ ID NO: 925619 - RNA, 22 nt, Human
uggccugguuauauugcuauca

SEQ ID NO: 925620 - RNA, 22 nt, Human
agugggggcagagccucucucg

SEQ ID NO: 925621 - RNA, 22 nt, Human
cagcuucugcuaucgaacaucu

SEQ ID NO: 925622 - RNA, 22 nt, Human
cccagaguucaaacccugcguc

SEQ ID NO: 925623 - RNA, 22 nt, Human
uugugugugagccuucaccaca

SEQ ID NO: 925624 - RNA, 22 nt, Human
uuacagaagagaaagaauucag

SEQ ID NO: 925625 - RNA, 22 nt, Human
agagguaugggcauggugcugu

SEQ ID NO: 925626 - RNA, 22 nt, Human
cugcccuggcagccuaccaugg

SEQ ID NO: 925627 - RNA, 22 nt, Human
agcacagauaacauggagugga

SEQ ID NO: 925628 - RNA, 22 nt, Human
guggcagaagaguaggaugggc

SEQ ID NO: 925629 - RNA, 22 nt, Human
guauucuuaaggauugagcaaa

SEQ ID NO: 925630 - RNA, 22 nt, Human
uacaacuuccagcuuucagccc

SEQ ID NO: 925631 - RNA, 22 nt, Human
uaugugcauuaucuaguucauu

SEQ ID NO: 925632 - RNA, 22 nt, Human
acaaaauuguguuaaacuuuau

SEQ ID NO: 925633 - RNA, 22 nt, Human
cgagaguuagcuaggagucaca

SEQ ID NO: 925634 - RNA, 20 nt, Human
uguugauuggugucaucuca

SEQ ID NO: 925635 - RNA, 22 nt, Human
accugccuaguugguucugccc

SEQ ID NO: 925636 - RNA, 22 nt, Human
acauuucugcaucucagagcua

SEQ ID NO: 925637 - RNA, 22 nt, Human
gcacccagggcaggaagugagg

SEQ ID NO: 925638 - RNA, 19 nt, Human
ucagaggauuuggcuauga

SEQ ID NO: 925639 - RNA, 22 nt, Human
augcccccaucucuguuggcuc

SEQ ID NO: 925640 - RNA, 22 nt, Human
cuuuuuccagcuucaggguggg

SEQ ID NO: 925641 - RNA, 22 nt, Human
ucugugucacugaggccugugu

SEQ ID NO: 925642 - RNA, 22 nt, Human
gagcagcugugggguugaccau

SEQ ID NO: 925643 - RNA, 22 nt, Human
auggauaaucaugaacuuugag

SEQ ID NO: 925644 - RNA, 19 nt, Human
acagugcaugggaccuggu

SEQ ID NO: 925645 - RNA, 22 nt, Human
gccaggcccugggcacuucgug

SEQ ID NO: 925646 - RNA, 20 nt, Human
aguuacuaagugcuggaacc

SEQ ID NO: 925647 - RNA, 22 nt, Human
aagggcagcuauuaucgucauc

SEQ ID NO: 925648 - RNA, 22 nt, Human
uacauuucagagcuccucucug

SEQ ID NO: 925649 - RNA, 22 nt, Human
caggaaauaucuccuggcagag

SEQ ID NO: 925650 - RNA, 22 nt, Human
ugugggcaggcccgggucugag

SEQ ID NO: 925651 - RNA, 22 nt, Human
cuauuucauugugcugagucug

SEQ ID NO: 925652 - RNA, 22 nt, Human
gcuguggccgucagggaaaugg

SEQ ID NO: 925653 - RNA, 21 nt, Human
ucuggcccucacagucacacc

SEQ ID NO: 925654 - RNA, 21 nt, Human
acaaauuguuuauauaggaag

SEQ ID NO: 925655 - RNA, 22 nt, Human
gagggaggggagcuccacccuc

SEQ ID NO: 925656 - RNA, 22 nt, Human
cuggagcuaauaauccaucuga

SEQ ID NO: 925657 - RNA, 22 nt, Human
uuguuaaaaauagauuuccagg

SEQ ID NO: 925658 - RNA, 22 nt, Human
cagcaucccagagcccagagcu

SEQ ID NO: 925659 - RNA, 22 nt, Human
ggccaccaaaguccuguggcuu

SEQ ID NO: 925660 - RNA, 22 nt, Human
gggcugaggcuaccacuggucu

SEQ ID NO: 925661 - RNA, 22 nt, Human
caauguuuguuagagcucuaga

SEQ ID NO: 925662 - RNA, 22 nt, Human
uaucaucugcaaagcacaucua

SEQ ID NO: 925663 - RNA, 22 nt, Human
auucacaaagucacccuuacac

SEQ ID NO: 925664 - RNA, 22 nt, Human
gacaggcaauuaccagcgccca

SEQ ID NO: 925665 - RNA, 22 nt, Human
acaaggaggucuggggggcccu

SEQ ID NO: 925666 - RNA, 22 nt, Human
aagaggagggcagauucaaggc

SEQ ID NO: 925667 - RNA, 22 nt, Human
aucuuuaauuuggaucagggcc

SEQ ID NO: 925668 - RNA, 22 nt, Human
cuggaaaucacuacuagucaau

SEQ ID NO: 925669 - RNA, 22 nt, Human
cucuggguucacugaggcucug

SEQ ID NO: 925670 - RNA, 22 nt, Human
gcaaaggcuagagacacaggga

SEQ ID NO: 925671 - RNA, 22 nt, Human
uaaguucucaauacauuguagc

SEQ ID NO: 925672 - RNA, 22 nt, Human
ucuuuugucaucccuuguacau

SEQ ID NO: 925673 - RNA, 22 nt, Human
uaauacagacaacuugccaaau

SEQ ID NO: 925674 - RNA, 23 nt, Human
caggcucccggaccaggauccgc

SEQ ID NO: 925675 - RNA, 20 nt, Human
uggagggauuguuggcaaau

SEQ ID NO: 925676 - RNA, 19 nt, Human
cacauuuugagucugagau

SEQ ID NO: 925677 - RNA, 22 nt, Human
uaagauuacagugagaaauaaa

SEQ ID NO: 925678 - RNA, 22 nt, Human
ugugugcagacagauauuacuu

SEQ ID NO: 925679 - RNA, 19 nt, Human
ucugugcugggaggcagca

SEQ ID NO: 925680 - RNA, 22 nt, Human
uaacuuuaugacaugucuugcu

SEQ ID NO: 925681 - RNA, 22 nt, Human
auaagguuggucuuaacuaccu

SEQ ID NO: 925682 - RNA, 22 nt, Human
uuggaagggaaccgaguuugcu

SEQ ID NO: 925683 - RNA, 22 nt, Human
ucagaaggaaguuagaguaugg

SEQ ID NO: 925684 - RNA, 23 nt, Human
uccucccugacuucuacagcaca

SEQ ID NO: 925685 - RNA, 22 nt, Human
ccucucuuggccgcagucuucu

SEQ ID NO: 925686 - RNA, 22 nt, Human
uggccuggcagagcaaggccug

SEQ ID NO: 925687 - RNA, 20 nt, Human
ugcugggcaugcaguggaaa

SEQ ID NO: 925688 - RNA, 23 nt, Human
caacacugccuucaggugaagaa

SEQ ID NO: 925689 - RNA, 22 nt, Human
ugaggccaaaaugacucaaaug

SEQ ID NO: 925690 - RNA, 22 nt, Human
cuccaggacacuaacccaggcu

SEQ ID NO: 925691 - RNA, 22 nt, Human
guuucuuauuucaacuggaaca

SEQ ID NO: 925692 - RNA, 20 nt, Human
agcaaacaggcuccaccaga

SEQ ID NO: 925693 - RNA, 22 nt, Human
cugucuguccugaguucaacca

SEQ ID NO: 925694 - RNA, 22 nt, Human
guccugacggcugauuggccug

SEQ ID NO: 925695 - RNA, 22 nt, Human
uaacuucugaauagcaauagua

SEQ ID NO: 925696 - RNA, 22 nt, Human
cuggccaggcauccccugaucc

SEQ ID NO: 925697 - RNA, 22 nt, Human
uagaggcauugcuuaauuucag

SEQ ID NO: 925698 - RNA, 22 nt, Human
ccuggcucaaggcgaggacucc

SEQ ID NO: 925699 - RNA, 22 nt, Human
agaauccuauugucagauucuu

SEQ ID NO: 925700 - RNA, 22 nt, Human
auccagagacccaaggacagaa

SEQ ID NO: 925701 - RNA, 22 nt, Human
uucagggacuuagugucaguuu

SEQ ID NO: 925702 - RNA, 22 nt, Human
aggucuggugagagcaggugcu

SEQ ID NO: 925703 - RNA, 22 nt, Human
cccccugcgcccggcacgucau

SEQ ID NO: 925704 - RNA, 19 nt, Human
gccuaugucuucaaaucau

SEQ ID NO: 925705 - RNA, 22 nt, Human
cagugccaggagacaagaucag

SEQ ID NO: 925706 - RNA, 22 nt, Human
aucgcauuugagcaaucuuuuc

SEQ ID NO: 925707 - RNA, 22 nt, Human
uuuguucauuaguacaguugua

SEQ ID NO: 925708 - RNA, 22 nt, Human
aaugaaacuaguagaaucuuug

SEQ ID NO: 925709 - RNA, 22 nt, Human
cugcugugccuuaaaaugcaag

SEQ ID NO: 925710 - RNA, 22 nt, Human
ccuuaaucugauauggcuggug

SEQ ID NO: 925711 - RNA, 22 nt, Human
acaugcauacacguacauaccu

SEQ ID NO: 925712 - RNA, 22 nt, Human
ugauuuucuccauuguaaauuc

SEQ ID NO: 925713 - RNA, 20 nt, Human
gcaugaggaaucauugcagc

SEQ ID NO: 925714 - RNA, 22 nt, Human
cacugcuugauugacaugcacg

SEQ ID NO: 925715 - RNA, 22 nt, Human
agcugccucucuugagguuacg

SEQ ID NO: 925716 - RNA, 19 nt, Human
ugcuucauuucuuuuaugu

SEQ ID NO: 925717 - RNA, 17 nt, Human
gagacagcaggagcccc

SEQ ID NO: 925718 - RNA, 22 nt, Human
gcacccagugggaugcuuagca

SEQ ID NO: 925719 - RNA, 19 nt, Human
caucagagggcauaggaug

SEQ ID NO: 925720 - RNA, 22 nt, Human
acuauacaccaaaauauuaagg

SEQ ID NO: 925721 - RNA, 22 nt, Human
ugcugugagguugagaaggaag

SEQ ID NO: 925722 - RNA, 18 nt, Human
gcagcugcaguuguagcu

SEQ ID NO: 925723 - RNA, 22 nt, Human
auuucucugccucagcuucugc

SEQ ID NO: 925724 - RNA, 22 nt, Human
ugccauggccuagaccugugau

SEQ ID NO: 925725 - RNA, 22 nt, Human
guauuuucaugauuucagacca

SEQ ID NO: 925726 - RNA, 22 nt, Human
guggaauguccuugaucauaag

SEQ ID NO: 925727 - RNA, 22 nt, Human
aagcugugccuuugccuagaau

SEQ ID NO: 925728 - RNA, 22 nt, Human
ucccacaggagccugaguccca

SEQ ID NO: 925729 - RNA, 22 nt, Human
aacuauuuuuggagcuaacucu

SEQ ID NO: 925730 - RNA, 22 nt, Human
ucacaguuaauuguuggaaugu

SEQ ID NO: 925731 - RNA, 16 nt, Human
cagauggaucuaacuc

SEQ ID NO: 925732 - RNA, 23 nt, Human
aggcagcagguuguccaggguga

SEQ ID NO: 925733 - RNA, 18 nt, Human
gccugagggucaagugug

SEQ ID NO: 925734 - RNA, 22 nt, Human
guguccuggagcccccaguuca

SEQ ID NO: 925735 - RNA, 22 nt, Human
uucacucuucggcaucucugua

SEQ ID NO: 925736 - RNA, 22 nt, Human
acauuuaacccucagguuucug

SEQ ID NO: 925737 - RNA, 22 nt, Human
aagcucaugggugcuguacuuu

SEQ ID NO: 925738 - RNA, 22 nt, Human
uucuaaugaaaguggaccaugg

SEQ ID NO: 925739 - RNA, 22 nt, Human
gagaaauagauucaugguagau

SEQ ID NO: 925740 - RNA, 22 nt, Human
ggcagcucgaugacuucugcau

SEQ ID NO: 925741 - RNA, 22 nt, Human
uaacaguguguccagucaguuu

SEQ ID NO: 925742 - RNA, 22 nt, Human
uguauauacacacucccauguu

SEQ ID NO: 925743 - RNA, 22 nt, Human
cauaguuauaaggcaacacugu

SEQ ID NO: 925744 - RNA, 22 nt, Human
ccagaauccaaaacguuuugag

SEQ ID NO: 925745 - RNA, 17 nt, Human
aguuuauuuagccuucu

SEQ ID NO: 925746 - RNA, 22 nt, Human
gccugcuggauguggccaggcc

SEQ ID NO: 925747 - RNA, 22 nt, Human
ugcacuuuaaaaaauggugaug

SEQ ID NO: 925748 - RNA, 22 nt, Human
cccauuuagauaacaguucaaa

SEQ ID NO: 925749 - RNA, 22 nt, Human
uggagucagaaugcgacaggcc

SEQ ID NO: 925750 - RNA, 22 nt, Human
aggcccaguagucgacggcgcu

SEQ ID NO: 925751 - RNA, 22 nt, Human
gcaaggagccuggaggugagug

SEQ ID NO: 925752 - RNA, 22 nt, Human
aaugaaaugaagauaugaucag

SEQ ID NO: 925753 - RNA, 22 nt, Human
uacagcaauaaugacaccgcuc

SEQ ID NO: 925754 - RNA, 22 nt, Human
ucugggccugauggcuaaagcc

SEQ ID NO: 925755 - RNA, 22 nt, Human
aggcugaaaacgagauggcaau

SEQ ID NO: 925756 - RNA, 22 nt, Human
uucuuuccaaccagauauuggu

SEQ ID NO: 925757 - RNA, 22 nt, Human
gaaggcuggaaggcaaguagga

SEQ ID NO: 925758 - RNA, 22 nt, Human
cccauggggacaccaugaagga

SEQ ID NO: 925759 - RNA, 22 nt, Human
gcccuggagcuagacuaggaca

SEQ ID NO: 925760 - RNA, 22 nt, Human
uggacucuaagcagaggaucua

SEQ ID NO: 925761 - RNA, 22 nt, Human
aauguuuuaaaagagauugaga

SEQ ID NO: 925762 - RNA, 20 nt, Human
gcacuuggcugcugcuucuc

SEQ ID NO: 925763 - RNA, 22 nt, Human
cuuuagguuuugccugagaucu

SEQ ID NO: 925764 - RNA, 22 nt, Human
acuuaugaaugucauuauaaug

SEQ ID NO: 925765 - RNA, 22 nt, Human
ccagugugggcugguggaggac

SEQ ID NO: 925766 - RNA, 19 nt, Human
ugggaguggggaagguccu

SEQ ID NO: 925767 - RNA, 22 nt, Human
cuccugaggacuucuauugggu

SEQ ID NO: 925768 - RNA, 22 nt, Human
ggaggcucccacgcagcucaca

SEQ ID NO: 925769 - RNA, 20 nt, Human
uacagagagcuagcucucug

SEQ ID NO: 925770 - RNA, 22 nt, Human
ccuggaguuuuuugguugacuc

SEQ ID NO: 925771 - RNA, 22 nt, Human
ugggcagauguccucugaagug

SEQ ID NO: 925772 - RNA, 22 nt, Human
cauggcagcaauuuuccugacu

SEQ ID NO: 925773 - RNA, 22 nt, Human
uagaaaacuaauacaugcuuga

SEQ ID NO: 925774 - RNA, 21 nt, Human
ugacacccagagccuccuccc

SEQ ID NO: 925775 - RNA, 22 nt, Human
auguguauuaccucgauuguga

SEQ ID NO: 925776 - RNA, 22 nt, Human
auguuagaaucucugaaugugg

SEQ ID NO: 925777 - RNA, 22 nt, Human
auguuuuccccaaaugaucuuc

SEQ ID NO: 925778 - RNA, 19 nt, Human
ggcagagcuccugcuuucu

SEQ ID NO: 925779 - RNA, 22 nt, Human
aucaaaauggaagaauuuggcu

SEQ ID NO: 925780 - RNA, 22 nt, Human
gauuugucacgguugagagcca

SEQ ID NO: 925781 - RNA, 22 nt, Human
uguuagaauauuguaauauucg

SEQ ID NO: 925782 - RNA, 22 nt, Human
acaggcuggugguccuggccau

SEQ ID NO: 925783 - RNA, 22 nt, Human
uacuaaguagcagaacuaagaa

SEQ ID NO: 925784 - RNA, 22 nt, Human
gccaauuuccugagguaaagcu

SEQ ID NO: 925785 - RNA, 22 nt, Human
uuuaaagagaaugugaaggagu

SEQ ID NO: 925786 - RNA, 22 nt, Human
agcucuggaauaaugaugugau

SEQ ID NO: 925787 - RNA, 22 nt, Human
guggcagcaaaauccugcauuc

SEQ ID NO: 925788 - RNA, 22 nt, Human
guuuccugacuguggaauuaua

SEQ ID NO: 925789 - RNA, 22 nt, Human
uacagaaauugccaccagcucu

SEQ ID NO: 925790 - RNA, 22 nt, Human
uuugagcuuguagcauugcuau

SEQ ID NO: 925791 - RNA, 22 nt, Human
acagagccuccaggagugcugg

SEQ ID NO: 925792 - RNA, 22 nt, Human
aacacuuuuuauauauuguauc

SEQ ID NO: 925793 - RNA, 22 nt, Human
cugccuguggacacccuggagg

SEQ ID NO: 925794 - RNA, 22 nt, Human
agaguuucuugugagcacugac

SEQ ID NO: 925795 - RNA, 22 nt, Human
uuuacugaauuugguauauucc

SEQ ID NO: 925796 - RNA, 22 nt, Human
caggaggaggguacaccaucag

SEQ ID NO: 925797 - RNA, 22 nt, Human
gcuucagauuccucuucuguaa

SEQ ID NO: 925798 - RNA, 22 nt, Human
gccuggagcucggcugagggcg

SEQ ID NO: 925799 - RNA, 22 nt, Human
ccucagagacaguaacuggaau

SEQ ID NO: 925800 - RNA, 20 nt, Human
gcaggcccucucucuagucu

SEQ ID NO: 925801 - RNA, 22 nt, Human
agcauuuaucuuuuguuugagu

SEQ ID NO: 925802 - RNA, 22 nt, Human
gggcagccugcuuucugaucca

SEQ ID NO: 925803 - RNA, 22 nt, Human
agguuaucaucaguugagcacu

SEQ ID NO: 925804 - RNA, 22 nt, Human
acuguuauguuauuacccaugu

SEQ ID NO: 925805 - RNA, 22 nt, Human
augcuauguaacuggcagauag

SEQ ID NO: 925806 - RNA, 22 nt, Human
ucuggagaaucugucagugugg

SEQ ID NO: 925807 - RNA, 22 nt, Human
cagcagcuacuuggagcagcag

SEQ ID NO: 925808 - RNA, 22 nt, Human
agcucugaugacuuuacaacuu

SEQ ID NO: 925809 - RNA, 22 nt, Human
cugauggagagugugauuuggg

SEQ ID NO: 925810 - RNA, 22 nt, Human
uaaacucucaacagagaaccac

SEQ ID NO: 925811 - RNA, 19 nt, Human
cagagccuucagugacucc

SEQ ID NO: 925812 - RNA, 22 nt, Human
caugcagugacucagacacagg

SEQ ID NO: 925813 - RNA, 20 nt, Human
aggcugagggugauuguguc

SEQ ID NO: 925814 - RNA, 22 nt, Human
gagcagcaggccagguugcagg

SEQ ID NO: 925815 - RNA, 23 nt, Human
cugcagccgcguggggacgugga

SEQ ID NO: 925816 - RNA, 22 nt, Human
cuuggacuuuagucucucucca

SEQ ID NO: 925817 - RNA, 19 nt, Human
ugccauuugacugaaugua

SEQ ID NO: 925818 - RNA, 22 nt, Human
agugauggggcccugcacugau

SEQ ID NO: 925819 - RNA, 22 nt, Human
ucucagggcucagagcucaggc

SEQ ID NO: 925820 - RNA, 22 nt, Human
uuuauuaauuagugacccaaug

SEQ ID NO: 925821 - RNA, 22 nt, Human
uuuagcaaauuagcaccucuaa

SEQ ID NO: 925822 - RNA, 22 nt, Human
cuggccuggcaggggaccucua

SEQ ID NO: 925823 - RNA, 22 nt, Human
ucagauuuccuugcaguuugga

SEQ ID NO: 925824 - RNA, 22 nt, Human
aggcuagggccauggcugguga

SEQ ID NO: 925825 - RNA, 22 nt, Human
aauaccuuuucagugcacaaaa

SEQ ID NO: 925826 - RNA, 20 nt, Human
acaugaacagggcuacagca

SEQ ID NO: 925827 - RNA, 22 nt, Human
acauuacagcaaguuuacguua

SEQ ID NO: 925828 - RNA, 22 nt, Human
ccugaguggugcuaagcagaua

SEQ ID NO: 925829 - RNA, 22 nt, Human
ucucucuauuuauuugucuugu

SEQ ID NO: 925830 - RNA, 19 nt, Human
uucuuugaguucuucugag

SEQ ID NO: 925831 - RNA, 22 nt, Human
ggagaugggggauuuuacagcg

SEQ ID NO: 925832 - RNA, 22 nt, Human
uggggacagggcucagcaauuu

SEQ ID NO: 925833 - RNA, 22 nt, Human
agaaaacacugcccccucucuc

SEQ ID NO: 925834 - RNA, 22 nt, Human
aucauuaaauauaagcuucaca

SEQ ID NO: 925835 - RNA, 22 nt, Human
ucugggcuuuacacugugcuua

SEQ ID NO: 925836 - RNA, 22 nt, Human
uacaggcaugaaugaaaucugu

SEQ ID NO: 925837 - RNA, 22 nt, Human
ugacuuccugcacucaggugau

SEQ ID NO: 925838 - RNA, 22 nt, Human
uggcccugcccucuucaucuuu

SEQ ID NO: 925839 - RNA, 22 nt, Human
ucaguccauaggugggccugag

SEQ ID NO: 925840 - RNA, 22 nt, Human
auugaaaaauucacaauucugg

SEQ ID NO: 925841 - RNA, 22 nt, Human
ugagaaggccugugugacaggg

SEQ ID NO: 925842 - RNA, 19 nt, Human
guguacacuuggccauggu

SEQ ID NO: 925843 - RNA, 22 nt, Human
acaaauaugguacucggagaaa

SEQ ID NO: 925844 - RNA, 22 nt, Human
ucuuggauuuuaauggaucaaa

SEQ ID NO: 925845 - RNA, 22 nt, Human
gaauacauggcagggagucauc

SEQ ID NO: 925846 - RNA, 22 nt, Human
ggugugccuggggcuuagcugc

SEQ ID NO: 925847 - RNA, 22 nt, Human
uucacaauaauguccauccucu

SEQ ID NO: 925848 - RNA, 22 nt, Human
aagacauaaaacagucagcgaa

SEQ ID NO: 925849 - RNA, 22 nt, Human
gugccuccaggcucgacuaguc

SEQ ID NO: 925850 - RNA, 22 nt, Human
ugagcaccuggaccagauucug

SEQ ID NO: 925851 - RNA, 22 nt, Human
gcagugcugaucccauggcaga

SEQ ID NO: 925852 - RNA, 22 nt, Human
uccuggcucuaaguccugagug

SEQ ID NO: 925853 - RNA, 22 nt, Human
caaauacuuuauauacuucaaa

SEQ ID NO: 925854 - RNA, 22 nt, Human
ucagaaaagagaaaaucuuaua

SEQ ID NO: 925855 - RNA, 22 nt, Human
auccuguuuuagauaagcuuau

SEQ ID NO: 925856 - RNA, 22 nt, Human
ggggcaggagcccuucuucagc

SEQ ID NO: 925857 - RNA, 23 nt, Human
aagcuggcugggagcagaaggga

SEQ ID NO: 925858 - RNA, 22 nt, Human
aaagccagagcaagcugucaca

SEQ ID NO: 925859 - RNA, 19 nt, Human
ccugggaggcggagguugc

SEQ ID NO: 925860 - RNA, 22 nt, Human
ccucuggcuguaccacuggcac

SEQ ID NO: 925861 - RNA, 22 nt, Human
ugggcacuauggcucugugcac

SEQ ID NO: 925862 - RNA, 22 nt, Human
uggcuccaucauccaugcaaga

SEQ ID NO: 925863 - RNA, 22 nt, Human
ccugugaggucuugcaugugaa

SEQ ID NO: 925864 - RNA, 22 nt, Human
cuguacaggagacgucugugca

SEQ ID NO: 925865 - RNA, 20 nt, Human
uuguuuccuggcuguucugc

SEQ ID NO: 925866 - RNA, 22 nt, Human
uaugaacaugcugugguuauaa

SEQ ID NO: 925867 - RNA, 20 nt, Human
gccacugggcaccagcaggg

SEQ ID NO: 925868 - RNA, 22 nt, Human
aggcacugggggaugagcaagg

SEQ ID NO: 925869 - RNA, 22 nt, Human
gcucccagggacacuggccacu

SEQ ID NO: 925870 - RNA, 22 nt, Human
acaugcaaaugugcaugcaugu

SEQ ID NO: 925871 - RNA, 22 nt, Human
cgaggcaggcaggcggaggaua

SEQ ID NO: 925872 - RNA, 17 nt, Human
uaguaaaugaguagagc

SEQ ID NO: 925873 - RNA, 22 nt, Human
ucucugcaacuacaucuuaggg

SEQ ID NO: 925874 - RNA, 22 nt, Human
cuggcugaagcugggcucuccu

SEQ ID NO: 925875 - RNA, 22 nt, Human
ccauuucauugccuguaaagug

SEQ ID NO: 925876 - RNA, 22 nt, Human
auuucacaggccaguggugggg

SEQ ID NO: 925877 - RNA, 22 nt, Human
aacacuaaugggagaacaaccc

SEQ ID NO: 925878 - RNA, 22 nt, Human
gaggcucagggaguauaugaau

SEQ ID NO: 925879 - RNA, 22 nt, Human
ccaggcugcagucaaggggcau

SEQ ID NO: 925880 - RNA, 22 nt, Human
uuaggauuugaaaaggggcaga

SEQ ID NO: 925881 - RNA, 19 nt, Human
uucauaaguuuagugaggg

SEQ ID NO: 925882 - RNA, 22 nt, Human
agugcauacccuucuaaaaagu

SEQ ID NO: 925883 - RNA, 22 nt, Human
aaagguaaaguaucugcccaag

SEQ ID NO: 925884 - RNA, 22 nt, Human
aaacuagaugaaacgaguaaag

SEQ ID NO: 925885 - RNA, 22 nt, Human
uccucacagggcaggaaggagg

SEQ ID NO: 925886 - RNA, 22 nt, Human
ucaaaagaaacaccauguuccu

SEQ ID NO: 925887 - RNA, 16 nt, Human
cgccucccucccucgc

SEQ ID NO: 925888 - RNA, 22 nt, Human
uacuuguuaucaucuuuuccuu

SEQ ID NO: 925889 - RNA, 22 nt, Human
guucagcccacagagggggccg

SEQ ID NO: 925890 - RNA, 22 nt, Human
augcaucaccgaguugcccacc

SEQ ID NO: 925891 - RNA, 23 nt, Human
cugcaauugccugaucucauugg

SEQ ID NO: 925892 - RNA, 22 nt, Human
aaauagcuuuucauaauucuca

SEQ ID NO: 925893 - RNA, 22 nt, Human
uucuacacucacccagcuguaa

SEQ ID NO: 925894 - RNA, 22 nt, Human
aguuucuuuagauagaaaguuc

SEQ ID NO: 925895 - RNA, 21 nt, Human
uggguggaagcgggaggccgc

SEQ ID NO: 925896 - RNA, 23 nt, Human
aaaguguagccagguuaagaacc

SEQ ID NO: 925897 - RNA, 20 nt, Human
uggcuggcuuguauuuccuu

SEQ ID NO: 925898 - RNA, 22 nt, Human
uuguucuuacuuaagagugaau

SEQ ID NO: 925899 - RNA, 22 nt, Human
agccaguuuaagcaggaggggu

SEQ ID NO: 925900 - RNA, 22 nt, Human
guacaauuauuuaaauggugaa

SEQ ID NO: 925901 - RNA, 22 nt, Human
aacaguugauguagcuuuggag

SEQ ID NO: 925902 - RNA, 22 nt, Human
aguuuaugucuuuacuucagcu

SEQ ID NO: 925903 - RNA, 22 nt, Human
ggucacaaggcagauaauaagg

SEQ ID NO: 925904 - RNA, 22 nt, Human
agccccacguugucuagcaccu

SEQ ID NO: 925905 - RNA, 22 nt, Human
guuuuccugaaacugauggugu

SEQ ID NO: 925906 - RNA, 22 nt, Human
aaacaguggccaauucuggaga

SEQ ID NO: 925907 - RNA, 22 nt, Human
agccacagugggcuaccagcuc

SEQ ID NO: 925908 - RNA, 22 nt, Human
uucugacacauuacuacaugga

SEQ ID NO: 925909 - RNA, 22 nt, Human
gcagcagaaggccaaggggagc

SEQ ID NO: 925910 - RNA, 22 nt, Human
guacauaaaauacugccaugua

SEQ ID NO: 925911 - RNA, 22 nt, Human
gaggcugagaguuuguucuacu

SEQ ID NO: 925912 - RNA, 22 nt, Human
aagccuugccuauuugaugaca

SEQ ID NO: 925913 - RNA, 22 nt, Human
acaaaaagcuccauuacugucc

SEQ ID NO: 925914 - RNA, 18 nt, Human
ugcccaccagaagaggga

SEQ ID NO: 925915 - RNA, 22 nt, Human
ugaaauguaaauaggacuagaa

SEQ ID NO: 925916 - RNA, 22 nt, Human
acagaggcugcgcuugggaacg

SEQ ID NO: 925917 - RNA, 22 nt, Human
ugaacagugugagggugugacc

SEQ ID NO: 925918 - RNA, 22 nt, Human
ucuggagggggaugccucaucc

SEQ ID NO: 925919 - RNA, 22 nt, Human
aggauaaguuugauucuugcca

SEQ ID NO: 925920 - RNA, 22 nt, Human
cugaucuguccuccucagagcc

SEQ ID NO: 925921 - RNA, 22 nt, Human
acugggcaauaaauucagagaa

SEQ ID NO: 925922 - RNA, 22 nt, Human
uggcucugagucugcccuuggc

SEQ ID NO: 925923 - RNA, 22 nt, Human
ugugugucacugaaagaaaucu

SEQ ID NO: 925924 - RNA, 22 nt, Human
augaaacagaguacuuaauaua

SEQ ID NO: 925925 - RNA, 22 nt, Human
ugaaguuuuacuaggugaauuu

SEQ ID NO: 925926 - RNA, 22 nt, Human
uugauguagguuuaucuauugu

SEQ ID NO: 925927 - RNA, 22 nt, Human
gcugggagacagacuuggaacc

SEQ ID NO: 925928 - RNA, 22 nt, Human
ccucauuaacacaaugucauuu

SEQ ID NO: 925929 - RNA, 21 nt, Human
cagugcucaggaauagagaga

SEQ ID NO: 925930 - RNA, 22 nt, Human
agcagggcuguguagguaauga

SEQ ID NO: 925931 - RNA, 17 nt, Human
uuccaguuuaguauugu

SEQ ID NO: 925932 - RNA, 22 nt, Human
guccuuggcagcaguccacccc

SEQ ID NO: 925933 - RNA, 22 nt, Human
gccagaggcccaaggacagcug

SEQ ID NO: 925934 - RNA, 22 nt, Human
agcuccagcggauggucuuaua

SEQ ID NO: 925935 - RNA, 22 nt, Human
gaucugguacaggccugcagcc

SEQ ID NO: 925936 - RNA, 22 nt, Human
ugagcugguucuugaggcauga

SEQ ID NO: 925937 - RNA, 19 nt, Human
guguccauggagcauggag

SEQ ID NO: 925938 - RNA, 23 nt, Human
aaguucuuagguugauacuaaug

SEQ ID NO: 925939 - RNA, 22 nt, Human
cagcugcaugucuguggugguc

SEQ ID NO: 925940 - RNA, 22 nt, Human
ucaggcugguggucagauggcu

SEQ ID NO: 925941 - RNA, 22 nt, Human
gcauuuacauggagcuaucuaa

SEQ ID NO: 925942 - RNA, 22 nt, Human
ucucugacagugaaagaguuca

SEQ ID NO: 925943 - RNA, 21 nt, Human
cugcucugacagugaggccag

SEQ ID NO: 925944 - RNA, 22 nt, Human
uauuuccaggccccacucuaga

SEQ ID NO: 925945 - RNA, 22 nt, Human
uuuguucuuaguaucugugugc

SEQ ID NO: 925946 - RNA, 22 nt, Human
uccccaguaagccugcacugug

SEQ ID NO: 925947 - RNA, 20 nt, Human
gucugaggagcagugggaaa

SEQ ID NO: 925948 - RNA, 22 nt, Human
guuuuucuagaaaucuccuccu

SEQ ID NO: 925949 - RNA, 22 nt, Human
ugucugaguggugcaaggcuga

SEQ ID NO: 925950 - RNA, 22 nt, Human
ccagaggugggagugaucuggu

SEQ ID NO: 925951 - RNA, 22 nt, Human
gagcuggaggcagugcugaggu

SEQ ID NO: 925952 - RNA, 22 nt, Human
uuucuucugagaucagggagaa

SEQ ID NO: 925953 - RNA, 22 nt, Human
gccuggcuaagcagaaggaccc

SEQ ID NO: 925954 - RNA, 22 nt, Human
acaaugugcuuaugaaggcagu

SEQ ID NO: 925955 - RNA, 22 nt, Human
ugugucauauuaguauugagag

SEQ ID NO: 925956 - RNA, 22 nt, Human
ugaggcaggagaaucaccggaa

SEQ ID NO: 925957 - RNA, 22 nt, Human
ucagaaugaaauuucuuucaga

SEQ ID NO: 925958 - RNA, 22 nt, Human
cacuuuacuaucuauaaaauaa

SEQ ID NO: 925959 - RNA, 22 nt, Human
uggcucugccaccuuucccuaa

SEQ ID NO: 925960 - RNA, 22 nt, Human
uucucaggguuggccucaaauc

SEQ ID NO: 925961 - RNA, 22 nt, Human
ucuugauuugaauugcaguugu

SEQ ID NO: 925962 - RNA, 22 nt, Human
cuauuagaaagcaucuucuaua

SEQ ID NO: 925963 - RNA, 22 nt, Human
ugacagauuuugauggcuaaua

SEQ ID NO: 925964 - RNA, 22 nt, Human
uucuuuaccagugaaauguuau

SEQ ID NO: 925965 - RNA, 21 nt, Human
uuugaaagcuacaucuauagc

SEQ ID NO: 925966 - RNA, 22 nt, Human
uugaagcacaaugucuuuuauc

SEQ ID NO: 925967 - RNA, 22 nt, Human
caaauaauuacuauccucacuu

SEQ ID NO: 925968 - RNA, 22 nt, Human
auacaguagggaccaugucuga

SEQ ID NO: 925969 - RNA, 22 nt, Human
cauuucaaguaacagauugcuu

SEQ ID NO: 925970 - RNA, 22 nt, Human
ucuucaauuagauuuaccaauu

SEQ ID NO: 925971 - RNA, 22 nt, Human
ugccuccuucaggagggcccgg

SEQ ID NO: 925972 - RNA, 22 nt, Human
cucagaggaggcagggugugcc

SEQ ID NO: 925973 - RNA, 19 nt, Human
ucuggcuccgccucuuagu

SEQ ID NO: 925974 - RNA, 22 nt, Human
gccaggaaagcaaaaucaccca

SEQ ID NO: 925975 - RNA, 23 nt, Human
uagggcagcugggagggacaugc

SEQ ID NO: 925976 - RNA, 22 nt, Human
cugugucuucacauuugugugc

SEQ ID NO: 925977 - RNA, 22 nt, Human
ggccugugggaggacagcuggg

SEQ ID NO: 925978 - RNA, 22 nt, Human
ucaguaguuuugaucugagcag

SEQ ID NO: 925979 - RNA, 22 nt, Human
aagaaacaaccacugcucuccu

SEQ ID NO: 925980 - RNA, 22 nt, Human
gagcagcuugcgcugucuucac

SEQ ID NO: 925981 - RNA, 22 nt, Human
ugaauggugauuggugcuucuc

SEQ ID NO: 925982 - RNA, 22 nt, Human
uagaaacagaaaacuguaauag

SEQ ID NO: 925983 - RNA, 22 nt, Human
aaaccacuuauaucgugauuug

SEQ ID NO: 925984 - RNA, 22 nt, Human
cuuugaaagcucccaggacuua

SEQ ID NO: 925985 - RNA, 22 nt, Human
cagagcuggcucugcauguaca

SEQ ID NO: 925986 - RNA, 22 nt, Human
ggaccaggccagccucccugcg

SEQ ID NO: 925987 - RNA, 22 nt, Human
uccagggcaugcucagacucag

SEQ ID NO: 925988 - RNA, 22 nt, Human
ugcuccagggccuccagugggg

SEQ ID NO: 925989 - RNA, 22 nt, Human
agacagacguagugugagagua

SEQ ID NO: 925990 - RNA, 22 nt, Human
aaguacuucuagauggauaauc

SEQ ID NO: 925991 - RNA, 22 nt, Human
uguguucuaugguucagggugg

SEQ ID NO: 925992 - RNA, 22 nt, Human
uauacacaaggugugcauuugu

SEQ ID NO: 925993 - RNA, 22 nt, Human
acaguuaacuggagagcgaguu

SEQ ID NO: 925994 - RNA, 22 nt, Human
guuucauuaccugacccaugag

SEQ ID NO: 925995 - RNA, 22 nt, Human
cucugggucucccugaggcuaa

SEQ ID NO: 925996 - RNA, 22 nt, Human
uaugaagucucugauguugagu

SEQ ID NO: 925997 - RNA, 22 nt, Human
ugggcacagggguaggaaugag

SEQ ID NO: 925998 - RNA, 22 nt, Human
uuauuguggacuacuguucugg

SEQ ID NO: 925999 - RNA, 22 nt, Human
ugccaaguagccugcagugacu

SEQ ID NO: 926000 - RNA, 22 nt, Human
acaaagcuagagaagagaauug

SEQ ID NO: 926001 - RNA, 22 nt, Human
ccugaggaugccagcaugggug

SEQ ID NO: 926002 - RNA, 22 nt, Human
agacugaauaacaagcaaauaa

SEQ ID NO: 926003 - RNA, 22 nt, Human
uuccagaggcucuaggggagaa

SEQ ID NO: 926004 - RNA, 22 nt, Human
uucaucaggcaucaugcucaag

SEQ ID NO: 926005 - RNA, 22 nt, Human
agauggcugauggcaggagcca

SEQ ID NO: 926006 - RNA, 22 nt, Human
cugugugcucggauggacucgu

SEQ ID NO: 926007 - RNA, 22 nt, Human
aacagcaucaccccauaacauu

SEQ ID NO: 926008 - RNA, 22 nt, Human
uguaggaguccaaucaggagac

SEQ ID NO: 926009 - RNA, 22 nt, Human
ggcagggcccugauuccugggg

SEQ ID NO: 926010 - RNA, 22 nt, Human
gcugacucagaugcagcuggau

SEQ ID NO: 926011 - RNA, 21 nt, Human
ucuauguacgcaucuaugccu

SEQ ID NO: 926012 - RNA, 18 nt, Human
cucuuucuuuggcacaaa

SEQ ID NO: 926013 - RNA, 22 nt, Human
gaguuuaugucuuucauuguuc

SEQ ID NO: 926014 - RNA, 22 nt, Human
ugggccugauuuaucaucuuca

SEQ ID NO: 926015 - RNA, 22 nt, Human
uuucacaacugcuuauuugaga

SEQ ID NO: 926016 - RNA, 22 nt, Human
cugccagguuggcgcucgcucu

SEQ ID NO: 926017 - RNA, 22 nt, Human
aagcagagaaaagcuuagguuc

SEQ ID NO: 926018 - RNA, 20 nt, Human
auauugcaaggaagcuggau

SEQ ID NO: 926019 - RNA, 22 nt, Human
aauaguauuuauuuggaaaaag

SEQ ID NO: 926020 - RNA, 22 nt, Human
gaacaucagucauaauuuaacg

SEQ ID NO: 926021 - RNA, 22 nt, Human
ggcugugcgucauccggcugca

SEQ ID NO: 926022 - RNA, 17 nt, Human
gcacucccccaccuccu

SEQ ID NO: 926023 - RNA, 22 nt, Human
aacacaguuucucuaugagagu

SEQ ID NO: 926024 - RNA, 22 nt, Human
acuuagcacgaacauuuacuuu

SEQ ID NO: 926025 - RNA, 22 nt, Human
gacaauugcuuuugccgaauaa

SEQ ID NO: 926026 - RNA, 22 nt, Human
uuccuucucuguggggaaggca

SEQ ID NO: 926027 - RNA, 22 nt, Human
gcugccugggcuggcauuccca

SEQ ID NO: 926028 - RNA, 22 nt, Human
gaggggccuggcgaggacaugu

SEQ ID NO: 926029 - RNA, 22 nt, Human
acacugucucauaugaggggac

SEQ ID NO: 926030 - RNA, 22 nt, Human
agagaucaaagcuugccaagua

SEQ ID NO: 926031 - RNA, 22 nt, Human
agggcuugcugauuuaaagagc

SEQ ID NO: 926032 - RNA, 22 nt, Human
ggcucauguuucagaaagugga

SEQ ID NO: 926033 - RNA, 22 nt, Human
aaugucauuuuuaaaugugaga

SEQ ID NO: 926034 - RNA, 22 nt, Human
acagacauuuaauaaaugcuga

SEQ ID NO: 926035 - RNA, 22 nt, Human
gugcugaagaagucuguucgcc

SEQ ID NO: 926036 - RNA, 20 nt, Human
cuccaguguucaggggagug

SEQ ID NO: 926037 - RNA, 22 nt, Human
agguuauuguagauuauaggca

SEQ ID NO: 926038 - RNA, 22 nt, Human
caccacuggaggucuuggcuuu

SEQ ID NO: 926039 - RNA, 22 nt, Human
uauaugaugccaaauaaccugu

SEQ ID NO: 926040 - RNA, 22 nt, Human
ugucagugauuuguagggaauu

SEQ ID NO: 926041 - RNA, 21 nt, Human
aggagcauuguugugguggag

SEQ ID NO: 926042 - RNA, 22 nt, Human
aggcgcugcaugugaaggaguu

SEQ ID NO: 926043 - RNA, 22 nt, Human
agacuuuaaugugcaaaugaaa

SEQ ID NO: 926044 - RNA, 22 nt, Human
ucuggagcgaggucccugucug

SEQ ID NO: 926045 - RNA, 22 nt, Human
guggaggagaggcgccuugcgg

SEQ ID NO: 926046 - RNA, 22 nt, Human
ucacauuuuuuacuggacuuaa

SEQ ID NO: 926047 - RNA, 22 nt, Human
ggcccagccggcgagucucgcg

SEQ ID NO: 926048 - RNA, 22 nt, Human
cagaggaguucaguacacagcc

SEQ ID NO: 926049 - RNA, 19 nt, Human
uugugugucagucagaguu

SEQ ID NO: 926050 - RNA, 22 nt, Human
caagauuuagcucccuuaucuc

SEQ ID NO: 926051 - RNA, 18 nt, Human
acccaguuugaaggaaag

SEQ ID NO: 926052 - RNA, 22 nt, Human
aggcagcaaagaaaugaugcug

SEQ ID NO: 926053 - RNA, 22 nt, Human
aaugugauuuucucacucccuu

SEQ ID NO: 926054 - RNA, 22 nt, Human
aaugugaucgcuuuagaagcuu

SEQ ID NO: 926055 - RNA, 22 nt, Human
uuccuuggguucugauguguuu

SEQ ID NO: 926056 - RNA, 22 nt, Human
cuggccagacuacacaugugug

SEQ ID NO: 926057 - RNA, 22 nt, Human
gcccaggaaguugaggcugccg

SEQ ID NO: 926058 - RNA, 22 nt, Human
uucagcaaauggcuugagauaa

SEQ ID NO: 926059 - RNA, 22 nt, Human
ugggccugauucuugaauccug

SEQ ID NO: 926060 - RNA, 22 nt, Human
aucucaggagguuccucugucc

SEQ ID NO: 926061 - RNA, 22 nt, Human
cucuggaguuagugaucugggc

SEQ ID NO: 926062 - RNA, 22 nt, Human
agcaagcuaacauaggagauug

SEQ ID NO: 926063 - RNA, 22 nt, Human
uuucauagccuucuaaugaguu

SEQ ID NO: 926064 - RNA, 22 nt, Human
ugagccagccucagaagucacg

SEQ ID NO: 926065 - RNA, 22 nt, Human
aaacauuguacauucuguagcu

SEQ ID NO: 926066 - RNA, 22 nt, Human
agcugcagagaaaagaggcugg

SEQ ID NO: 926067 - RNA, 22 nt, Human
ccauuaaaauggaauguaguga

SEQ ID NO: 926068 - RNA, 22 nt, Human
gaacaguagaugagaugcuaga

SEQ ID NO: 926069 - RNA, 22 nt, Human
guucagcacaggugcucagaca

SEQ ID NO: 926070 - RNA, 22 nt, Human
aggccaaguagccgcuguccua

SEQ ID NO: 926071 - RNA, 22 nt, Human
gggaauuauagcugucacaggc

SEQ ID NO: 926072 - RNA, 22 nt, Human
ucucuacagacacuguugacuu

SEQ ID NO: 926073 - RNA, 22 nt, Human
ucugagacuucugaagcuagaa

SEQ ID NO: 926074 - RNA, 23 nt, Human
agagggagauguuuuucucaaga

SEQ ID NO: 926075 - RNA, 21 nt, Human
ccuggcagaagccugauaugc

SEQ ID NO: 926076 - RNA, 22 nt, Human
aagcagggagaaauuuuucuuc

SEQ ID NO: 926077 - RNA, 22 nt, Human
aggggcgaggggagccgugcca

SEQ ID NO: 926078 - RNA, 23 nt, Human
aaagacugaggaaagucucuguc

SEQ ID NO: 926079 - RNA, 22 nt, Human
guaaacaucagccacucuauuu

SEQ ID NO: 926080 - RNA, 19 nt, Human
acaauguuguuggacacuc

SEQ ID NO: 926081 - RNA, 22 nt, Human
gcugcucuuuucagagaugaga

SEQ ID NO: 926082 - RNA, 22 nt, Human
auuguaaaaguauucuaagauu

SEQ ID NO: 926083 - RNA, 23 nt, Human
gccagaggaacgcagagcuuucu

SEQ ID NO: 926084 - RNA, 22 nt, Human
ucaggaguugaaggggauccug

SEQ ID NO: 926085 - RNA, 22 nt, Human
aagaacaugguaggauaacaaa

SEQ ID NO: 926086 - RNA, 22 nt, Human
gaacacaagcguaugucuuugu

SEQ ID NO: 926087 - RNA, 22 nt, Human
gcacacauauauaugagcaugu

SEQ ID NO: 926088 - RNA, 22 nt, Human
cagagccacugcauuuuacagc

SEQ ID NO: 926089 - RNA, 21 nt, Human
acauguaagagaguuucaaga

SEQ ID NO: 926090 - RNA, 22 nt, Human
gcagaggugagaagggccuccc

SEQ ID NO: 926091 - RNA, 22 nt, Human
auugagaaaauaaguauggaua

SEQ ID NO: 926092 - RNA, 22 nt, Human
uggaaacugggaguuaaaugua

SEQ ID NO: 926093 - RNA, 22 nt, Human
cauggcaggugcagauucugug

SEQ ID NO: 926094 - RNA, 23 nt, Human
uucugucuugcugucagcuuucu

SEQ ID NO: 926095 - RNA, 22 nt, Human
gaaugcugagucuuaucucuua

SEQ ID NO: 926096 - RNA, 22 nt, Human
cuguggcauugccgaggcuggc

SEQ ID NO: 926097 - RNA, 22 nt, Human
agaggacagguuuuccaugggc

SEQ ID NO: 926098 - RNA, 22 nt, Human
agcuggcccucgagagccaauu

SEQ ID NO: 926099 - RNA, 22 nt, Human
uguccuagagacaucagauguu

SEQ ID NO: 926100 - RNA, 21 nt, Human
acucaaguggagaugccaggu

SEQ ID NO: 926101 - RNA, 22 nt, Human
ucagcagggcugugguguggcu

SEQ ID NO: 926102 - RNA, 22 nt, Human
uuacacuuguaauuauauaacg

SEQ ID NO: 926103 - RNA, 22 nt, Human
auauguauguacgcacauauuc

SEQ ID NO: 926104 - RNA, 20 nt, Human
aaccaacagaaucaugucuc

SEQ ID NO: 926105 - RNA, 22 nt, Human
uuucucuguucucuaacuguaa

SEQ ID NO: 926106 - RNA, 22 nt, Human
auugauaaauugcaauggggcu

SEQ ID NO: 926107 - RNA, 22 nt, Human
ucauugccauggcauuugcaga

SEQ ID NO: 926108 - RNA, 22 nt, Human
uauguagucaaguggauauaug

SEQ ID NO: 926109 - RNA, 22 nt, Human
ugagagaggggacugccugcuu

SEQ ID NO: 926110 - RNA, 22 nt, Human
gggcuggaggccugccugguua

SEQ ID NO: 926111 - RNA, 22 nt, Human
ucagggcaggacaguguaggcc

SEQ ID NO: 926112 - RNA, 22 nt, Human
ugaacuuuguaguaauggagau

SEQ ID NO: 926113 - RNA, 22 nt, Human
gcugcugguccucagagcucau

SEQ ID NO: 926114 - RNA, 22 nt, Human
auugagaaugcaaucuacuaug

SEQ ID NO: 926115 - RNA, 22 nt, Human
ccuuuguaagaugugaagacug

SEQ ID NO: 926116 - RNA, 22 nt, Human
gaaauguuaugagauauguacu

SEQ ID NO: 926117 - RNA, 22 nt, Human
ucacuuugaauuccuugauuuu

SEQ ID NO: 926118 - RNA, 22 nt, Human
cuuuacagaaagagaacucugg

SEQ ID NO: 926119 - RNA, 20 nt, Human
cucuugggcccaaagggccu

SEQ ID NO: 926120 - RNA, 22 nt, Human
uauucacauucucaggccuggu

SEQ ID NO: 926121 - RNA, 22 nt, Human
uucuuacauauuuucauauggu

SEQ ID NO: 926122 - RNA, 22 nt, Human
gcaggccuuuaucccugccuca

SEQ ID NO: 926123 - RNA, 22 nt, Human
ugcugggauauagcuucuaggg

SEQ ID NO: 926124 - RNA, 22 nt, Human
ugcugucuucucugaggucccu

SEQ ID NO: 926125 - RNA, 22 nt, Human
uuauuuugagagaaugugugcu

SEQ ID NO: 926126 - RNA, 22 nt, Human
aggcugugaguuuugucucaga

SEQ ID NO: 926127 - RNA, 21 nt, Human
ccagagguucugggccucccu

SEQ ID NO: 926128 - RNA, 22 nt, Human
gacaguuuaagcaccuaauauu

SEQ ID NO: 926129 - RNA, 19 nt, Human
aucacaugucaagagcagg

SEQ ID NO: 926130 - RNA, 22 nt, Human
aucuacacuauaacagaaugcu

SEQ ID NO: 926131 - RNA, 22 nt, Human
uuaauagauaugccucuagagu

SEQ ID NO: 926132 - RNA, 22 nt, Human
cagaaaaccugacucuagaacu

SEQ ID NO: 926133 - RNA, 22 nt, Human
ggaaggggagcuaaaucuacug

SEQ ID NO: 926134 - RNA, 22 nt, Human
uuuacaacguuccuggugcuaa

SEQ ID NO: 926135 - RNA, 22 nt, Human
aggcuguguggucaugguggcu

SEQ ID NO: 926136 - RNA, 22 nt, Human
ggcugcccucggggucgcaggc

SEQ ID NO: 926137 - RNA, 22 nt, Human
cugcucuaauaucagauagacu

SEQ ID NO: 926138 - RNA, 19 nt, Human
cugccuguuauggagagaa

SEQ ID NO: 926139 - RNA, 22 nt, Human
cagcaggcucugaguggcugcc

SEQ ID NO: 926140 - RNA, 22 nt, Human
ucuauuuacagaaagcagaauu

SEQ ID NO: 926141 - RNA, 22 nt, Human
cucuguguuaaauuggguuuuu

SEQ ID NO: 926142 - RNA, 22 nt, Human
gcuggagauaguaggauccaua

SEQ ID NO: 926143 - RNA, 22 nt, Human
aggugaaguugaggaggcagaa

SEQ ID NO: 926144 - RNA, 23 nt, Human
uucuucauuuucagaguugagca

SEQ ID NO: 926145 - RNA, 22 nt, Human
cuucacauugggcuugauauga

SEQ ID NO: 926146 - RNA, 22 nt, Human
guauaucagacacucauaugua

SEQ ID NO: 926147 - RNA, 22 nt, Human
gcccugaauuccucaggcugug

SEQ ID NO: 926148 - RNA, 22 nt, Human
ucuaagccaggacugagagacg

SEQ ID NO: 926149 - RNA, 22 nt, Human
agguaucaacagcagagucuga

SEQ ID NO: 926150 - RNA, 22 nt, Human
gggcuccaaaguaagcuuuagu

SEQ ID NO: 926151 - RNA, 22 nt, Human
ugggaauguagaauguaaacca

SEQ ID NO: 926152 - RNA, 22 nt, Human
uggggcagccacauagacaaca

SEQ ID NO: 926153 - RNA, 22 nt, Human
acacagaguauuuagaaggggu

SEQ ID NO: 926154 - RNA, 22 nt, Human
uagaaaguacuaaauuuaacug

SEQ ID NO: 926155 - RNA, 22 nt, Human
ccacuggcuuuuccuaggucuc

SEQ ID NO: 926156 - RNA, 22 nt, Human
uuugauaucuugguauacagau

SEQ ID NO: 926157 - RNA, 22 nt, Human
auuucugugcaguaaaugguga

SEQ ID NO: 926158 - RNA, 22 nt, Human
agcagggaauagcggaaagaau

SEQ ID NO: 926159 - RNA, 22 nt, Human
agaggcagccguauuucaaagg

SEQ ID NO: 926160 - RNA, 22 nt, Human
aaucaaccauauauuugauggg

SEQ ID NO: 926161 - RNA, 22 nt, Human
ccagauucauagaaacucauag

SEQ ID NO: 926162 - RNA, 22 nt, Human
caaauguaaauucuuuugaagc

SEQ ID NO: 926163 - RNA, 18 nt, Human
agggagcaucugguugcc

SEQ ID NO: 926164 - RNA, 22 nt, Human
gcauguguggaggagaugugcu

SEQ ID NO: 926165 - RNA, 22 nt, Human
uagaaaauccaguguggggaga

SEQ ID NO: 926166 - RNA, 22 nt, Human
gcaccagggagggugugcuuca

SEQ ID NO: 926167 - RNA, 22 nt, Human
agggagccuuccuggcuguggu

SEQ ID NO: 926168 - RNA, 22 nt, Human
uucaacaaguauuuauugagca

SEQ ID NO: 926169 - RNA, 22 nt, Human
ugcuucuggcuuaucucgugcc

SEQ ID NO: 926170 - RNA, 21 nt, Human
ccugucuuggacugaggcacc

SEQ ID NO: 926171 - RNA, 23 nt, Human
agggaacaagcaagcugcuaguc

SEQ ID NO: 926172 - RNA, 22 nt, Human
ugucuccauagaguagcuugau

SEQ ID NO: 926173 - RNA, 22 nt, Human
cuagcacaguaugguaucagau

SEQ ID NO: 926174 - RNA, 22 nt, Human
gucucucugcuaggccuccagu

SEQ ID NO: 926175 - RNA, 22 nt, Human
agacaucaaugaucagagguag

SEQ ID NO: 926176 - RNA, 22 nt, Human
aaaaccagguagcaaaggagac

SEQ ID NO: 926177 - RNA, 22 nt, Human
ugcugugcaaaggugaugugag

SEQ ID NO: 926178 - RNA, 22 nt, Human
cuuuggaacauacugcugagcu

SEQ ID NO: 926179 - RNA, 22 nt, Human
cuugagguaugaaaccugcauu

SEQ ID NO: 926180 - RNA, 22 nt, Human
uggggucccacucagcuccccu

SEQ ID NO: 926181 - RNA, 22 nt, Human
ugucagcaggacauuaaaagcu

SEQ ID NO: 926182 - RNA, 22 nt, Human
ccagcagcuuugcauacacuaa

SEQ ID NO: 926183 - RNA, 22 nt, Human
acugggagggucuugaagaggg

SEQ ID NO: 926184 - RNA, 22 nt, Human
cauaauuugauaugcuugaugg

SEQ ID NO: 926185 - RNA, 22 nt, Human
agaugcugcuccacaggccagg

SEQ ID NO: 926186 - RNA, 22 nt, Human
aucuagaggagggcugcuggau

SEQ ID NO: 926187 - RNA, 22 nt, Human
uugaacaaucaaaagaauucau

SEQ ID NO: 926188 - RNA, 22 nt, Human
aaguucaagucuccugaguaua

SEQ ID NO: 926189 - RNA, 22 nt, Human
uggcugagcucccuguguguug

SEQ ID NO: 926190 - RNA, 22 nt, Human
uccuggcucgauugcuaccaau

SEQ ID NO: 926191 - RNA, 22 nt, Human
agggcagaccacgugcaaggau

SEQ ID NO: 926192 - RNA, 20 nt, Human
agugucugggccucaggccc

SEQ ID NO: 926193 - RNA, 22 nt, Human
acacagccaggguaguaaggcu

SEQ ID NO: 926194 - RNA, 22 nt, Human
ucagaaaagacucaggggcuga

SEQ ID NO: 926195 - RNA, 22 nt, Human
cugggacuggguccucaggaca

SEQ ID NO: 926196 - RNA, 21 nt, Human
uuagcaguuguugauuuccag

SEQ ID NO: 926197 - RNA, 22 nt, Human
auguuucaugacugagcaaaau

SEQ ID NO: 926198 - RNA, 22 nt, Human
acuuuguuuucaugaaacagcu

SEQ ID NO: 926199 - RNA, 22 nt, Human
auauugcaauagaugcaucauu

SEQ ID NO: 926200 - RNA, 22 nt, Human
guggaagcugaugggagacagg

SEQ ID NO: 926201 - RNA, 22 nt, Human
gaagagguagcauuggcaggug

SEQ ID NO: 926202 - RNA, 23 nt, Human
aaacuugcuauggcugaaaucau

SEQ ID NO: 926203 - RNA, 21 nt, Human
aagcucuucucagggucaccu

SEQ ID NO: 926204 - RNA, 22 nt, Human
auuaaauuggaucugcauaguu

SEQ ID NO: 926205 - RNA, 22 nt, Human
acucagcuugcacacaucaaug

SEQ ID NO: 926206 - RNA, 22 nt, Human
gagugugggggugcugaggaca

SEQ ID NO: 926207 - RNA, 22 nt, Human
agagcugagaauguggcuuccu

SEQ ID NO: 926208 - RNA, 22 nt, Human
ucaggagggugacaggcccugg

SEQ ID NO: 926209 - RNA, 22 nt, Human
ugcucccacacuacucggaggc

SEQ ID NO: 926210 - RNA, 22 nt, Human
uucuguggaauaugaacuagca

SEQ ID NO: 926211 - RNA, 22 nt, Human
acaaaaucaaaggagugauuca

SEQ ID NO: 926212 - RNA, 22 nt, Human
caguugccuguuuccuugugug

SEQ ID NO: 926213 - RNA, 22 nt, Human
ccaggaagcauaauguaguggg

SEQ ID NO: 926214 - RNA, 22 nt, Human
uuacaacauauuuagcuugauu

SEQ ID NO: 926215 - RNA, 22 nt, Human
gccaggcagcugggagggugcc

SEQ ID NO: 926216 - RNA, 22 nt, Human
ucuuggagacucuuguauauuu

SEQ ID NO: 926217 - RNA, 22 nt, Human
aacauguugcuuuaauaauauu

SEQ ID NO: 926218 - RNA, 22 nt, Human
aauggcugccagggcaggaggu

SEQ ID NO: 926219 - RNA, 19 nt, Human
uauguguguguauuuacau

SEQ ID NO: 926220 - RNA, 22 nt, Human
uucagcagguggugaguucugc

SEQ ID NO: 926221 - RNA, 23 nt, Human
caggagggaaugaaguuagacaa

SEQ ID NO: 926222 - RNA, 22 nt, Human
cuguaugugaaaaugucaagug

SEQ ID NO: 926223 - RNA, 22 nt, Human
acacaugaggaugaggggauca

SEQ ID NO: 926224 - RNA, 22 nt, Human
ccaggcacaggugggccucaga

SEQ ID NO: 926225 - RNA, 23 nt, Human
uagccaggcccagcauggacacc

SEQ ID NO: 926226 - RNA, 22 nt, Human
auggaaugggaagcagagccau

SEQ ID NO: 926227 - RNA, 22 nt, Human
ccugugaugguguuacacuguu

SEQ ID NO: 926228 - RNA, 22 nt, Human
gaggccaggacaugaaagcuga

SEQ ID NO: 926229 - RNA, 21 nt, Human
aggaagcugcccagauaguag

SEQ ID NO: 926230 - RNA, 22 nt, Human
gggcacuguguucagagugcag

SEQ ID NO: 926231 - RNA, 22 nt, Human
ucuguuccuggucucuggagcu

SEQ ID NO: 926232 - RNA, 22 nt, Human
ugcucucucaggccuggcccac

SEQ ID NO: 926233 - RNA, 22 nt, Human
uuuacaguaagguggaugguac

SEQ ID NO: 926234 - RNA, 22 nt, Human
gcuuuacacagaugaauauuuc

SEQ ID NO: 926235 - RNA, 20 nt, Human
gcugcucuccacggucugca

SEQ ID NO: 926236 - RNA, 22 nt, Human
ggcugggucccagcugggagga

SEQ ID NO: 926237 - RNA, 22 nt, Human
aucagugcuaagagagggccug

SEQ ID NO: 926238 - RNA, 22 nt, Human
uugcagagagguuaggaacuca

SEQ ID NO: 926239 - RNA, 22 nt, Human
agucaucugguuuugcauggca

SEQ ID NO: 926240 - RNA, 22 nt, Human
cagcugugggccugacguggca

SEQ ID NO: 926241 - RNA, 22 nt, Human
gcccacagcucguuccucuccu

SEQ ID NO: 926242 - RNA, 22 nt, Human
aaugaauggguuuaauauuuua

SEQ ID NO: 926243 - RNA, 20 nt, Human
ucucugaguuuccuaauuug

SEQ ID NO: 926244 - RNA, 23 nt, Human
aaauagagauaggccagcuuugc

SEQ ID NO: 926245 - RNA, 22 nt, Human
cugcugugacagcugccguguu

SEQ ID NO: 926246 - RNA, 22 nt, Human
gccagagcacaggcugguagua

SEQ ID NO: 926247 - RNA, 22 nt, Human
gaaucucaaauuaagaauuuua

SEQ ID NO: 926248 - RNA, 22 nt, Human
agguaggguuaauggagauaua

SEQ ID NO: 926249 - RNA, 19 nt, Human
agucugcauuucuagcaag

SEQ ID NO: 926250 - RNA, 22 nt, Human
uuccaaagucauguugcugaua

SEQ ID NO: 926251 - RNA, 22 nt, Human
ugcaguggaaucuggagagcag

SEQ ID NO: 926252 - RNA, 22 nt, Human
aggagccuccuucucaugugca

SEQ ID NO: 926253 - RNA, 22 nt, Human
cgcugcaguuuauguguuccug

SEQ ID NO: 926254 - RNA, 22 nt, Human
agcuuugucuucucacauaucc

SEQ ID NO: 926255 - RNA, 22 nt, Human
aggccaagggcaaagcggagag

SEQ ID NO: 926256 - RNA, 22 nt, Human
aguuaguauacaaaguaacagc

SEQ ID NO: 926257 - RNA, 22 nt, Human
guaguuuucugaaaauuacuuu

SEQ ID NO: 926258 - RNA, 22 nt, Human
ugacacagaaauuaagcuguca

SEQ ID NO: 926259 - RNA, 22 nt, Human
aaaaggauguuuucaugaaaca

SEQ ID NO: 926260 - RNA, 22 nt, Human
ugggaagaugaggugccauggg

SEQ ID NO: 926261 - RNA, 22 nt, Human
uacaagaaaguccaguggguuu

SEQ ID NO: 926262 - RNA, 22 nt, Human
caucagaguuaacaucaugacu

SEQ ID NO: 926263 - RNA, 18 nt, Human
cgauguguaugugauuug

SEQ ID NO: 926264 - RNA, 22 nt, Human
guauuccuucagaagacguuua

SEQ ID NO: 926265 - RNA, 22 nt, Human
uugagguaggcggacuccucca

SEQ ID NO: 926266 - RNA, 20 nt, Human
gaaauucucguauuaguuua

SEQ ID NO: 926267 - RNA, 22 nt, Human
uggagguccuggcuggguuuua

SEQ ID NO: 926268 - RNA, 22 nt, Human
uguacaaagaguauagcuuuga

SEQ ID NO: 926269 - RNA, 22 nt, Human
ugucaaagaugucuuugaaaau

SEQ ID NO: 926270 - RNA, 20 nt, Human
gcuggcagaugucuugagau

SEQ ID NO: 926271 - RNA, 22 nt, Human
ugugucucauuuccuccugcug

SEQ ID NO: 926272 - RNA, 22 nt, Human
aacaaguucuaagugucuacuu

SEQ ID NO: 926273 - RNA, 22 nt, Human
caggcaggagccagggauucca

SEQ ID NO: 926274 - RNA, 22 nt, Human
agccaaagaucagugugcaagu

SEQ ID NO: 926275 - RNA, 22 nt, Human
cugggcucagcccaugcugucc

SEQ ID NO: 926276 - RNA, 22 nt, Human
uagaaguugcucaauaaauguu

SEQ ID NO: 926277 - RNA, 22 nt, Human
uggggcaguuaauaaacauucu

SEQ ID NO: 926278 - RNA, 22 nt, Human
cccagccucugggcucacccaa

SEQ ID NO: 926279 - RNA, 22 nt, Human
ccugucugggcuugaguauuua

SEQ ID NO: 926280 - RNA, 22 nt, Human
uucuugaaucacuuuagagaua

SEQ ID NO: 926281 - RNA, 22 nt, Human
ccaggaagcugucugauaugaa

SEQ ID NO: 926282 - RNA, 22 nt, Human
aggcaaaagaaugucauaaaug

SEQ ID NO: 926283 - RNA, 22 nt, Human
uaugaaaugauggggaaaauag

SEQ ID NO: 926284 - RNA, 22 nt, Human
aaauguaagucuuuguuucuua

SEQ ID NO: 926285 - RNA, 22 nt, Human
ccaggcucugcaaaaucaggcu

SEQ ID NO: 926286 - RNA, 22 nt, Human
ugccuaagucugcagucacuug

SEQ ID NO: 926287 - RNA, 22 nt, Human
aagcagaggccacagagugggc

SEQ ID NO: 926288 - RNA, 22 nt, Human
gggcugggcaugguguucccuc

SEQ ID NO: 926289 - RNA, 20 nt, Human
ccugugugguuugcacuaca

SEQ ID NO: 926290 - RNA, 22 nt, Human
gccaggcugccuuaucucuagc

SEQ ID NO: 926291 - RNA, 22 nt, Human
agauuuuaguguagaggacuug

SEQ ID NO: 926292 - RNA, 22 nt, Human
ucuuucuucagcccuguaagau

SEQ ID NO: 926293 - RNA, 22 nt, Human
cagagcucagagcagggcacuc

SEQ ID NO: 926294 - RNA, 22 nt, Human
agcagagcaugcuaagugacuc

SEQ ID NO: 926295 - RNA, 22 nt, Human
guccagcccgggcuccgccagc

SEQ ID NO: 926296 - RNA, 21 nt, Human
auuuucauuuccaggggagga

SEQ ID NO: 926297 - RNA, 22 nt, Human
gccugcagccccucugcaguag

SEQ ID NO: 926298 - RNA, 22 nt, Human
uuucuguuguuggugucuggcu

SEQ ID NO: 926299 - RNA, 22 nt, Human
cagggcauccgugcuccaugcu

SEQ ID NO: 926300 - RNA, 22 nt, Human
agacuguaaagggccagaaagu

SEQ ID NO: 926301 - RNA, 22 nt, Human
uguggcagauacagaagaucaa

SEQ ID NO: 926302 - RNA, 22 nt, Human
gugcugaggugggugggcagcc

SEQ ID NO: 926303 - RNA, 22 nt, Human
ucugucugccuguguccccacc

SEQ ID NO: 926304 - RNA, 22 nt, Human
ugguggcaauguccuggagaag

SEQ ID NO: 926305 - RNA, 22 nt, Human
ggagaaagcuaugugggggagu

SEQ ID NO: 926306 - RNA, 21 nt, Human
uuucuccaagugacugauucc

SEQ ID NO: 926307 - RNA, 21 nt, Human
acagauuagcacaaugcaggc

SEQ ID NO: 926308 - RNA, 22 nt, Human
gguucacuccgaucucugccuc

SEQ ID NO: 926309 - RNA, 19 nt, Human
ugaguguguguuucucuaa

SEQ ID NO: 926310 - RNA, 22 nt, Human
gggagggaaggaccuuaugaau

SEQ ID NO: 926311 - RNA, 23 nt, Human
augcaagaguuucucaaacugga

SEQ ID NO: 926312 - RNA, 17 nt, Human
acacagacaggcagaca

SEQ ID NO: 926313 - RNA, 22 nt, Human
auccugucuuuguuuuaaauau

SEQ ID NO: 926314 - RNA, 22 nt, Human
ugcaaaugggugaggguuagga

SEQ ID NO: 926315 - RNA, 22 nt, Human
ugggccugacacuuacuaggga

SEQ ID NO: 926316 - RNA, 22 nt, Human
aaugugcuucuggcugugguca

SEQ ID NO: 926317 - RNA, 21 nt, Human
uaaaugugagcagggcugggc

SEQ ID NO: 926318 - RNA, 22 nt, Human
cugaggagagguggccuguguu

SEQ ID NO: 926319 - RNA, 22 nt, Human
gauucucuuggauguaggcaua

SEQ ID NO: 926320 - RNA, 22 nt, Human
aggagagaauuacuggguguca

SEQ ID NO: 926321 - RNA, 22 nt, Human
aaaggaaugagcuucuguuagg

SEQ ID NO: 926322 - RNA, 22 nt, Human
caagaaacaccaaugacugcug

SEQ ID NO: 926323 - RNA, 22 nt, Human
cucagaggggaugcuuggagaa

SEQ ID NO: 926324 - RNA, 22 nt, Human
augaagacaggucucaucacca

SEQ ID NO: 926325 - RNA, 18 nt, Human
cacaggcaggugauaggu

SEQ ID NO: 926326 - RNA, 22 nt, Human
cuaacuuuuacagucauguugc

SEQ ID NO: 926327 - RNA, 22 nt, Human
aauuaccaucgucaaaucauau

SEQ ID NO: 926328 - RNA, 22 nt, Human
ggcagcucugcuccacaugagu

SEQ ID NO: 926329 - RNA, 21 nt, Human
ucuaucaccuaaauuaaacag

SEQ ID NO: 926330 - RNA, 22 nt, Human
gacucagauuuagaggguaaga

SEQ ID NO: 926331 - RNA, 22 nt, Human
ccugaagcaaggguaggcaggu

SEQ ID NO: 926332 - RNA, 17 nt, Human
gcagacacuucuauuga

SEQ ID NO: 926333 - RNA, 22 nt, Human
ggcccagcgaggccaccuacag

SEQ ID NO: 926334 - RNA, 22 nt, Human
ggacuguagacaucagccugua

SEQ ID NO: 926335 - RNA, 22 nt, Human
gaaacaacuacuauugauuucu

SEQ ID NO: 926336 - RNA, 22 nt, Human
cugugcugcagacgcaguagcu

SEQ ID NO: 926337 - RNA, 22 nt, Human
acacuuuaguaugaagagguag

SEQ ID NO: 926338 - RNA, 22 nt, Human
cuuguauucugccuaaccuuca

SEQ ID NO: 926339 - RNA, 20 nt, Human
ucucuauucccacgaggaaa

SEQ ID NO: 926340 - RNA, 22 nt, Human
uacaaaucagaucaugaguuua

SEQ ID NO: 926341 - RNA, 22 nt, Human
aggucaagaauugaugugguuu

SEQ ID NO: 926342 - RNA, 22 nt, Human
cauuaauaaacauuucagaaga

SEQ ID NO: 926343 - RNA, 22 nt, Human
gcacacaguagggauucaauga

SEQ ID NO: 926344 - RNA, 22 nt, Human
gcagcugucgcuaggagcugug

SEQ ID NO: 926345 - RNA, 22 nt, Human
gcuuagaacauguggauugcaa

SEQ ID NO: 926346 - RNA, 22 nt, Human
gccuggcacauugcaguggauu

SEQ ID NO: 926347 - RNA, 22 nt, Human
aguucuuuguaaaaggucucua

SEQ ID NO: 926348 - RNA, 22 nt, Human
auuagccuugguaagucuuuca

SEQ ID NO: 926349 - RNA, 22 nt, Human
cugcaggguucggagaguuccc

SEQ ID NO: 926350 - RNA, 19 nt, Human
uggcucugucgaaggcaca

SEQ ID NO: 926351 - RNA, 22 nt, Human
cgucacuucuuagucuauuuuc

SEQ ID NO: 926352 - RNA, 22 nt, Human
agccaugcuccuuccccucugg

SEQ ID NO: 926353 - RNA, 22 nt, Human
acagagcauauaaagugcuuug

SEQ ID NO: 926354 - RNA, 22 nt, Human
gacuccucagucacccucagcu

SEQ ID NO: 926355 - RNA, 22 nt, Human
aggcagaggagaaugaucuucc

SEQ ID NO: 926356 - RNA, 22 nt, Human
aagcuguuagggagugguaggu

SEQ ID NO: 926357 - RNA, 22 nt, Human
aggcagugcaugcaaaggucgg

SEQ ID NO: 926358 - RNA, 22 nt, Human
uguuucuaggucaauaauuuuu

SEQ ID NO: 926359 - RNA, 22 nt, Human
ggucccaguugcccaggucagg

SEQ ID NO: 926360 - RNA, 22 nt, Human
acaugcuacagugaaggaggaa

SEQ ID NO: 926361 - RNA, 22 nt, Human
gugggccaggccggagugcaga

SEQ ID NO: 926362 - RNA, 22 nt, Human
acaacuuuagucuggagggaaa

SEQ ID NO: 926363 - RNA, 22 nt, Human
aucugagacugaguuuggauuu

SEQ ID NO: 926364 - RNA, 22 nt, Human
uuggaaggaauuaaggucauga

SEQ ID NO: 926365 - RNA, 22 nt, Human
uauauguugauacuaauucugg

SEQ ID NO: 926366 - RNA, 22 nt, Human
uuugggcauauagcuguucccu

SEQ ID NO: 926367 - RNA, 22 nt, Human
aggaagcugggguguucuucau

SEQ ID NO: 926368 - RNA, 20 nt, Human
ggagggcagcugagaguugg

SEQ ID NO: 926369 - RNA, 22 nt, Human
uggguagggccugcgccugugc

SEQ ID NO: 926370 - RNA, 22 nt, Human
gacaggcaggccagggcugugg

SEQ ID NO: 926371 - RNA, 23 nt, Human
uuggaacacaguaaaugcacaau

SEQ ID NO: 926372 - RNA, 22 nt, Human
uccugggcuuaguggcuagguc

SEQ ID NO: 926373 - RNA, 22 nt, Human
agcccugcccugccauguggca

SEQ ID NO: 926374 - RNA, 22 nt, Human
gggcacuguacacugugcaugg

SEQ ID NO: 926375 - RNA, 22 nt, Human
cugagaggaugcugcaguggag

SEQ ID NO: 926376 - RNA, 22 nt, Human
uacaaaugguugaauggaugaa

SEQ ID NO: 926377 - RNA, 22 nt, Human
agaggccaauaguagguggcau

SEQ ID NO: 926378 - RNA, 22 nt, Human
uggcuccacaggccagggugug

SEQ ID NO: 926379 - RNA, 22 nt, Human
agaaggggagaagcuaccagga

SEQ ID NO: 926380 - RNA, 22 nt, Human
aggaggucagagccccaugcug

SEQ ID NO: 926381 - RNA, 22 nt, Human
uagacagauuuaaaggaaugga

SEQ ID NO: 926382 - RNA, 22 nt, Human
caugccagggcuugcugccugg

SEQ ID NO: 926383 - RNA, 22 nt, Human
uaaagcuauugcuguuuauugu

SEQ ID NO: 926384 - RNA, 22 nt, Human
gcuggccugaccagccacaggc

SEQ ID NO: 926385 - RNA, 22 nt, Human
ggagggacccacugcggugacc

SEQ ID NO: 926386 - RNA, 22 nt, Human
cagcacagggacaauagcagau

SEQ ID NO: 926387 - RNA, 22 nt, Human
caguggguggcuaaguggcuga

SEQ ID NO: 926388 - RNA, 22 nt, Human
uuaguuuucccaucuuuauggu

SEQ ID NO: 926389 - RNA, 22 nt, Human
acccaggguagaaccucagagc

SEQ ID NO: 926390 - RNA, 22 nt, Human
cugccuguuagucuagcaguua

SEQ ID NO: 926391 - RNA, 22 nt, Human
acucaguacaucuggaguuggc

SEQ ID NO: 926392 - RNA, 22 nt, Human
agacaacaucuaguuuggugga

SEQ ID NO: 926393 - RNA, 22 nt, Human
agucuuaggcuccauuaguaga

SEQ ID NO: 926394 - RNA, 22 nt, Human
gccaggucuaagcaucagccac

SEQ ID NO: 926395 - RNA, 22 nt, Human
gaaagugcucucucuauacaca

SEQ ID NO: 926396 - RNA, 22 nt, Human
uaaagugcagauugugauucag

SEQ ID NO: 926397 - RNA, 22 nt, Human
caggguggcaggcaccauggcc

SEQ ID NO: 926398 - RNA, 22 nt, Human
caggcagagucagauuagacuu

SEQ ID NO: 926399 - RNA, 22 nt, Human
caggguagacaguaggugucug

SEQ ID NO: 926400 - RNA, 22 nt, Human
cccaguccuaaagcagacgcca

SEQ ID NO: 926401 - RNA, 22 nt, Human
ucacugaaaaccauacuucuuu

SEQ ID NO: 926402 - RNA, 22 nt, Human
uucaacaucuuggagcuggaac

SEQ ID NO: 926403 - RNA, 22 nt, Human
ccucucuguguggccucuccau

SEQ ID NO: 926404 - RNA, 22 nt, Human
uucugagggagguucucuggga

SEQ ID NO: 926405 - RNA, 20 nt, Human
agcaguguuucuugacucua

SEQ ID NO: 926406 - RNA, 22 nt, Human
uguaggaacucacagauauucu

SEQ ID NO: 926407 - RNA, 22 nt, Human
uuaacaauagaguuucuucagg

SEQ ID NO: 926408 - RNA, 21 nt, Human
uccccacauuucuaaacagac

SEQ ID NO: 926409 - RNA, 19 nt, Human
aggugcuggugaggguguu

SEQ ID NO: 926410 - RNA, 22 nt, Human
uggcaauuuucuagcagauggc

SEQ ID NO: 926411 - RNA, 20 nt, Human
caggugagcagaucugggug

SEQ ID NO: 926412 - RNA, 22 nt, Human
aaaggucuuuauuggucagcca

SEQ ID NO: 926413 - RNA, 22 nt, Human
gggcuucauucaggcagaauuu

SEQ ID NO: 926414 - RNA, 22 nt, Human
caggaagagguggggcuaaagu

SEQ ID NO: 926415 - RNA, 22 nt, Human
gcacacagacuaaccauauuuc

SEQ ID NO: 926416 - RNA, 22 nt, Human
aggaagcuuggggcagggcuac

SEQ ID NO: 926417 - RNA, 22 nt, Human
ggugccugauggugaugagguc

SEQ ID NO: 926418 - RNA, 22 nt, Human
gcugucaggccaugugggccuu

SEQ ID NO: 926419 - RNA, 22 nt, Human
ugcuaaagcaaacugugcuacu

SEQ ID NO: 926420 - RNA, 22 nt, Human
aauaccaugcagaaauaacaua

SEQ ID NO: 926421 - RNA, 22 nt, Human
ucugagagucucugaggcagau

SEQ ID NO: 926422 - RNA, 22 nt, Human
acugcucucuuugcaggggcua

SEQ ID NO: 926423 - RNA, 20 nt, Human
cacugcccuccagccugagc

SEQ ID NO: 926424 - RNA, 22 nt, Human
gauuuccaugauugggccagaa

SEQ ID NO: 926425 - RNA, 22 nt, Human
cugagcugcaguccuggcucug

SEQ ID NO: 926426 - RNA, 22 nt, Human
guguuaaaaugcuuuauaguag

SEQ ID NO: 926427 - RNA, 22 nt, Human
aagcccuggcucagcucaccag

SEQ ID NO: 926428 - RNA, 22 nt, Human
uuuaucugagcugauagauagu

SEQ ID NO: 926429 - RNA, 22 nt, Human
gccucaggccgcccugcugcuc

SEQ ID NO: 926430 - RNA, 22 nt, Human
agucuuuaaugaucauguauuu

SEQ ID NO: 926431 - RNA, 19 nt, Human
caacaguacugguuugucc

SEQ ID NO: 926432 - RNA, 22 nt, Human
gcagucaguaaggcagccagaa

SEQ ID NO: 926433 - RNA, 22 nt, Human
uagagcuggaaaacugcaggua

SEQ ID NO: 926434 - RNA, 22 nt, Human
cuggguguucaggagcugggcu

SEQ ID NO: 926435 - RNA, 22 nt, Human
cuguugaucucaguuagcuaga

SEQ ID NO: 926436 - RNA, 23 nt, Human
ccguguguauacucuguaauaga

SEQ ID NO: 926437 - RNA, 22 nt, Human
cccaggaaaguggaggcggcug

SEQ ID NO: 926438 - RNA, 22 nt, Human
agauauuaaucguacauaaggu

SEQ ID NO: 926439 - RNA, 22 nt, Human
gcagagccugugucugagcaaa

SEQ ID NO: 926440 - RNA, 22 nt, Human
agugucugaacugggugcugac

SEQ ID NO: 926441 - RNA, 22 nt, Human
agagucagucacuggcacuuug

SEQ ID NO: 926442 - RNA, 22 nt, Human
agagggcuaagguuugggagau

SEQ ID NO: 926443 - RNA, 22 nt, Human
agagcccaucaguggcagugga

SEQ ID NO: 926444 - RNA, 22 nt, Human
augaucagggcagaagcagaag

SEQ ID NO: 926445 - RNA, 22 nt, Human
cccugcagagagugcuuuugug

SEQ ID NO: 926446 - RNA, 22 nt, Human
acuccagguguguuggacucua

SEQ ID NO: 926447 - RNA, 22 nt, Human
uccuagaacuccaggacagucc

SEQ ID NO: 926448 - RNA, 22 nt, Human
aaacaucucaaagagguauuug

SEQ ID NO: 926449 - RNA, 22 nt, Human
cagcacagcacagcggugacuc

SEQ ID NO: 926450 - RNA, 21 nt, Human
acaggccuuaggggccauuca

SEQ ID NO: 926451 - RNA, 22 nt, Human
ucucagaugcccuugcaucacc

SEQ ID NO: 926452 - RNA, 22 nt, Human
agaggcucugccgccucaggua

SEQ ID NO: 926453 - RNA, 22 nt, Human
ugcuuaaaaaguaacugcugau

SEQ ID NO: 926454 - RNA, 22 nt, Human
uggucaguugcaucagagaagu

SEQ ID NO: 926455 - RNA, 22 nt, Human
ggcacugcuguaggcagugagg

SEQ ID NO: 926456 - RNA, 22 nt, Human
uagacuuuucaaaaucuagacc

SEQ ID NO: 926457 - RNA, 22 nt, Human
uuucaagucauucuauaauauc

SEQ ID NO: 926458 - RNA, 22 nt, Human
aacuuuaaggcuauaaauuaug

SEQ ID NO: 926459 - RNA, 22 nt, Human
gccuggcuugccagcccuggcg

SEQ ID NO: 926460 - RNA, 22 nt, Human
uguggcuguguccaccugcugc

SEQ ID NO: 926461 - RNA, 22 nt, Human
ugguggggcuuuccuucugcuu

SEQ ID NO: 926462 - RNA, 22 nt, Human
gcagcagggugccagcuuugca

SEQ ID NO: 926463 - RNA, 22 nt, Human
ugaaagguuaaaaguaguauug

SEQ ID NO: 926464 - RNA, 22 nt, Human
gauccagauauuugggcuggua

SEQ ID NO: 926465 - RNA, 22 nt, Human
acagcagaguaguuuuccaacu

SEQ ID NO: 926466 - RNA, 22 nt, Human
ucugucugagugguguuagagu

SEQ ID NO: 926467 - RNA, 22 nt, Human
gcagccauugagcgaaaaaauc

SEQ ID NO: 926468 - RNA, 17 nt, Human
uccaggcagcaacugag

SEQ ID NO: 926469 - RNA, 22 nt, Human
ucuuuacaagucacauuuucug

SEQ ID NO: 926470 - RNA, 22 nt, Human
aauuauacaauugucaaguucu

SEQ ID NO: 926471 - RNA, 22 nt, Human
gucauaaagcuuguugcauuua

SEQ ID NO: 926472 - RNA, 22 nt, Human
accaggaggaaguguuaaugau

SEQ ID NO: 926473 - RNA, 22 nt, Human
agugucagcuaauuauucauga

SEQ ID NO: 926474 - RNA, 22 nt, Human
caccauuuaagaaagccaaauu

SEQ ID NO: 926475 - RNA, 22 nt, Human
cauuacaaccccaaauuacaaa

SEQ ID NO: 926476 - RNA, 22 nt, Human
aacagugaguugaugacugaau

SEQ ID NO: 926477 - RNA, 22 nt, Human
cuuugaaaacuuaaauaacagc

SEQ ID NO: 926478 - RNA, 22 nt, Human
cacaaauggccguguucaaaga

SEQ ID NO: 926479 - RNA, 22 nt, Human
uguggucccaaggcaacuggaa

SEQ ID NO: 926480 - RNA, 22 nt, Human
uucuacagguacugaaguacau

SEQ ID NO: 926481 - RNA, 22 nt, Human
cugggugacagagugagauggu

SEQ ID NO: 926482 - RNA, 23 nt, Human
gccauggcugccccacaggccuc

SEQ ID NO: 926483 - RNA, 22 nt, Human
uuuggcaaagauggcuagcugu

SEQ ID NO: 926484 - RNA, 22 nt, Human
aagcugaauuuucuaaaagaau

SEQ ID NO: 926485 - RNA, 22 nt, Human
agugcccugcuggggcaggaga

SEQ ID NO: 926486 - RNA, 22 nt, Human
acagacuggaggagaauaguuu

SEQ ID NO: 926487 - RNA, 22 nt, Human
acauuccugccauaaauuuuuu

SEQ ID NO: 926488 - RNA, 22 nt, Human
aaagaugucaguuugaaauaac

SEQ ID NO: 926489 - RNA, 22 nt, Human
cagagcugagucuucaagguug

SEQ ID NO: 926490 - RNA, 22 nt, Human
uaaggcagccucaggguagggu

SEQ ID NO: 926491 - RNA, 22 nt, Human
cagcugucuggggagugcucgc

SEQ ID NO: 926492 - RNA, 22 nt, Human
cucuagaaagauuguugaccaa

SEQ ID NO: 926493 - RNA, 22 nt, Human
agaaauacuuuguaaaucucac

SEQ ID NO: 926494 - RNA, 22 nt, Human
uagaacaaugaauuucuggagg

SEQ ID NO: 926495 - RNA, 22 nt, Human
aaccugaaaguaguaaaagcug

SEQ ID NO: 926496 - RNA, 22 nt, Human
aggaaggagggcagauauuaag

SEQ ID NO: 926497 - RNA, 22 nt, Human
ccuggcuuuuguuuauaaauuc

SEQ ID NO: 926498 - RNA, 22 nt, Human
aaguauauacuaaauguuaauc

SEQ ID NO: 926499 - RNA, 22 nt, Human
accuucugaccaguuaucuuga

SEQ ID NO: 926500 - RNA, 22 nt, Human
gcuccucuucucccacugaaug

SEQ ID NO: 926501 - RNA, 22 nt, Human
gacuucugaauuccuaucaggu

SEQ ID NO: 926502 - RNA, 22 nt, Human
aggaaauguacaaaugaagaug

SEQ ID NO: 926503 - RNA, 22 nt, Human
ucagggcagaauccaaagaauu

SEQ ID NO: 926504 - RNA, 19 nt, Human
cugucugugcagagaugug

SEQ ID NO: 926505 - RNA, 22 nt, Human
augagacuaccuguaauguggc

SEQ ID NO: 926506 - RNA, 22 nt, Human
acuuagcaccuauggcauuuuu

SEQ ID NO: 926507 - RNA, 18 nt, Human
cugugggaagaguuuggg

SEQ ID NO: 926508 - RNA, 22 nt, Human
gcagaauguaggccuucagugu

SEQ ID NO: 926509 - RNA, 22 nt, Human
auucacaacugauccuugcuca

SEQ ID NO: 926510 - RNA, 22 nt, Human
aaaagcuuugccagaugaguug

SEQ ID NO: 926511 - RNA, 22 nt, Human
ggacaggcugcaucugagcaug

SEQ ID NO: 926512 - RNA, 22 nt, Human
gaugaggaauuugagguuagaa

SEQ ID NO: 926513 - RNA, 22 nt, Human
uaaaugcaguuaguacuugcca

SEQ ID NO: 926514 - RNA, 22 nt, Human
aaaauagcagggaugugggaaa

SEQ ID NO: 926515 - RNA, 19 nt, Human
ccccuuagggguuaagccu

SEQ ID NO: 926516 - RNA, 22 nt, Human
gggcuaagcagagugggaacag

SEQ ID NO: 926517 - RNA, 22 nt, Human
uaggucagaacaagcaguaucg

SEQ ID NO: 926518 - RNA, 22 nt, Human
ucucuuuucuuucuggauaaaa

SEQ ID NO: 926519 - RNA, 19 nt, Human
cugggccagagcuguccuc

SEQ ID NO: 926520 - RNA, 22 nt, Human
uuuuucagccaugaauuacacu

SEQ ID NO: 926521 - RNA, 22 nt, Human
gucagcaauaguuaguuuacaa

SEQ ID NO: 926522 - RNA, 19 nt, Human
aagggcugggcaccucacu

SEQ ID NO: 926523 - RNA, 22 nt, Human
uaauuuauagaauuucuuggau

SEQ ID NO: 926524 - RNA, 22 nt, Human
aaugacagcccucuagucuggg

SEQ ID NO: 926525 - RNA, 22 nt, Human
uagcacagcuucuugaugucac

SEQ ID NO: 926526 - RNA, 22 nt, Human
cucuggaguucucaugaggaac

SEQ ID NO: 926527 - RNA, 22 nt, Human
agcuccugcagacuccugcuca

SEQ ID NO: 926528 - RNA, 22 nt, Human
ccugggagagccaucuguggcc

SEQ ID NO: 926529 - RNA, 22 nt, Human
ucuaaacacgucucuuugaaua

SEQ ID NO: 926530 - RNA, 22 nt, Human
ugagcuaaguacucucaucaag

SEQ ID NO: 926531 - RNA, 22 nt, Human
gcaggauggugcccuuucugcc

SEQ ID NO: 926532 - RNA, 21 nt, Human
aggaggcugucucuuucagcu

SEQ ID NO: 926533 - RNA, 22 nt, Human
auucuuaauugccaugcuguau

SEQ ID NO: 926534 - RNA, 22 nt, Human
ccucuggguaucuguggaagua

SEQ ID NO: 926535 - RNA, 22 nt, Human
uaaggcuuucuaaauaugcaga

SEQ ID NO: 926536 - RNA, 22 nt, Human
aguuuauuucuccauuuaccua

SEQ ID NO: 926537 - RNA, 22 nt, Human
caucagcagucacaugaugcug

SEQ ID NO: 926538 - RNA, 22 nt, Human
acccaggagcaggcugggcagu

SEQ ID NO: 926539 - RNA, 22 nt, Human
caagggugaaggcuccuccagg

SEQ ID NO: 926540 - RNA, 22 nt, Human
ccagcccugccucucagggccc

SEQ ID NO: 926541 - RNA, 22 nt, Human
ugcagagggaaaaggugcuccu

SEQ ID NO: 926542 - RNA, 22 nt, Human
ucugcacauggcgcugguccug

SEQ ID NO: 926543 - RNA, 22 nt, Human
cagaaaugacaaaguaagagga

SEQ ID NO: 926544 - RNA, 22 nt, Human
gcuuggcuugggcucagaggcc

SEQ ID NO: 926545 - RNA, 22 nt, Human
cugggccaugggccagcgaggc

SEQ ID NO: 926546 - RNA, 22 nt, Human
ugaggccaggcaaaggcgaucu

SEQ ID NO: 926547 - RNA, 22 nt, Human
guacaggucuuaucuccuagga

SEQ ID NO: 926548 - RNA, 22 nt, Human
uguuaacaauaaguccaggcau

SEQ ID NO: 926549 - RNA, 22 nt, Human
cugucacagguucaaacucccc

SEQ ID NO: 926550 - RNA, 22 nt, Human
cugcaggaggauccugagagug

SEQ ID NO: 926551 - RNA, 22 nt, Human
cgcccagcugaaaucuccaggc

SEQ ID NO: 926552 - RNA, 22 nt, Human
gggaacagccucaccagcccug

SEQ ID NO: 926553 - RNA, 22 nt, Human
uagaggcagaagaaauugacaa

SEQ ID NO: 926554 - RNA, 22 nt, Human
auggcuguuccugggaguucua

SEQ ID NO: 926555 - RNA, 22 nt, Human
agggaugaucaggguagaggcu

SEQ ID NO: 926556 - RNA, 22 nt, Human
agggccugugcuuccugagaua

SEQ ID NO: 926557 - RNA, 22 nt, Human
uaagguuuaacgcccugucucg

SEQ ID NO: 926558 - RNA, 22 nt, Human
caaagaggugagaggagccuuu

SEQ ID NO: 926559 - RNA, 22 nt, Human
aguguauugucucacaguucuu

SEQ ID NO: 926560 - RNA, 22 nt, Human
agggaagguagaggucaccggc

SEQ ID NO: 926561 - RNA, 22 nt, Human
ucccaggaaaacacucgaggac

SEQ ID NO: 926562 - RNA, 23 nt, Human
ggacccuguggagggugagaguc

SEQ ID NO: 926563 - RNA, 22 nt, Human
uaaagguuauugcacuggaguu

SEQ ID NO: 926564 - RNA, 22 nt, Human
cacagcuuccauuagaaugaga

SEQ ID NO: 926565 - RNA, 22 nt, Human
ggcuucagaagacuggacaggu

SEQ ID NO: 926566 - RNA, 22 nt, Human
augcagaaagcggcaaacaggu

SEQ ID NO: 926567 - RNA, 22 nt, Human
gcucagggaaagagcuccuguc

SEQ ID NO: 926568 - RNA, 22 nt, Human
gauuucaauccagcuuucuucu

SEQ ID NO: 926569 - RNA, 22 nt, Human
ugggaagcuacucaugcaggca

SEQ ID NO: 926570 - RNA, 22 nt, Human
auaacagacugauuuuuaaaug

SEQ ID NO: 926571 - RNA, 22 nt, Human
uaucuguugucuuuuacaugua

SEQ ID NO: 926572 - RNA, 22 nt, Human
ccacuuugcaagauauucagag

SEQ ID NO: 926573 - RNA, 19 nt, Human
ugagcuggcugagccucuc

SEQ ID NO: 926574 - RNA, 22 nt, Human
cugccguguuuuucauguuaaa

SEQ ID NO: 926575 - RNA, 22 nt, Human
agggaaauuaaugugagcaaug

SEQ ID NO: 926576 - RNA, 22 nt, Human
accaugccaguggcagccagac

SEQ ID NO: 926577 - RNA, 22 nt, Human
ugcaggugagugcaggggcuca

SEQ ID NO: 926578 - RNA, 22 nt, Human
acguuugcuuucuuuggccugg

SEQ ID NO: 926579 - RNA, 22 nt, Human
uuguagcuuuuuaaugugcugc

SEQ ID NO: 926580 - RNA, 18 nt, Human
ggcuuugcugggguuucu

SEQ ID NO: 926581 - RNA, 22 nt, Human
gaacacugcuguuggguucuga

SEQ ID NO: 926582 - RNA, 22 nt, Human
cuuugcugagcugguuguucaa

SEQ ID NO: 926583 - RNA, 22 nt, Human
uacaguuuuucacugaagaugu

SEQ ID NO: 926584 - RNA, 22 nt, Human
uugaaaggugcugugugcugau

SEQ ID NO: 926585 - RNA, 22 nt, Human
uuccuugaccacugcauaauga

SEQ ID NO: 926586 - RNA, 20 nt, Human
uggcaggaggcagcagugga

SEQ ID NO: 926587 - RNA, 22 nt, Human
uaguuauauccagucuuuaaaa

SEQ ID NO: 926588 - RNA, 22 nt, Human
ugagcccaugcucuuucuacga

SEQ ID NO: 926589 - RNA, 22 nt, Human
ggagagaggagcccacugcugu

SEQ ID NO: 926590 - RNA, 22 nt, Human
uggugccauuagcccugcuguu

SEQ ID NO: 926591 - RNA, 21 nt, Human
ccuguggucuggagggagcac

SEQ ID NO: 926592 - RNA, 23 nt, Human
uggcugagguccagguaguuuca

SEQ ID NO: 926593 - RNA, 22 nt, Human
cugugcugguccagggagcugg

SEQ ID NO: 926594 - RNA, 20 nt, Human
cccuggagagaagcuccacg

SEQ ID NO: 926595 - RNA, 22 nt, Human
gaggagcuugugagaagauguc

SEQ ID NO: 926596 - RNA, 22 nt, Human
guuuaucacaauaaauaauucu

SEQ ID NO: 926597 - RNA, 22 nt, Human
ugaucuuugguaguacgauaau

SEQ ID NO: 926598 - RNA, 22 nt, Human
gaaauuuauuaucuacaucauu

SEQ ID NO: 926599 - RNA, 22 nt, Human
uuugggcauguuguggccagcu

SEQ ID NO: 926600 - RNA, 22 nt, Human
ugaguccauguggaggggaggu

SEQ ID NO: 926601 - RNA, 22 nt, Human
auugucuguacuuuaaaaaugu

SEQ ID NO: 926602 - RNA, 22 nt, Human
uaaguuuaaauguacaugaagc

SEQ ID NO: 926603 - RNA, 22 nt, Human
cuggcacacagcaggcucucag

SEQ ID NO: 926604 - RNA, 22 nt, Human
uguagauuuuggagucuacaag

SEQ ID NO: 926605 - RNA, 22 nt, Human
cagcuggucaacugaaugaaca

SEQ ID NO: 926606 - RNA, 23 nt, Human
ccagcucccaggucugaggacug

SEQ ID NO: 926607 - RNA, 22 nt, Human
aggacccagaaggugcagcaga

SEQ ID NO: 926608 - RNA, 22 nt, Human
acuggacucacguauuccugag

SEQ ID NO: 926609 - RNA, 19 nt, Human
uucuggggccuggccuugg

SEQ ID NO: 926610 - RNA, 22 nt, Human
uuucaguuguuuuagcucugug

SEQ ID NO: 926611 - RNA, 22 nt, Human
ccauuuuucacaagacucacuu

SEQ ID NO: 926612 - RNA, 22 nt, Human
ucuucaaauccuacagugucug

SEQ ID NO: 926613 - RNA, 22 nt, Human
cagguauaugugcauccauaga

SEQ ID NO: 926614 - RNA, 22 nt, Human
ucuaccagggucacagaggccc

SEQ ID NO: 926615 - RNA, 22 nt, Human
cagcuugcuaauuuugacuuca

SEQ ID NO: 926616 - RNA, 22 nt, Human
gaggagacugacagcagauucu

SEQ ID NO: 926617 - RNA, 22 nt, Human
uucauauuaugauuugaaaugc

SEQ ID NO: 926618 - RNA, 22 nt, Human
gaggccuggucuaugagauguu

SEQ ID NO: 926619 - RNA, 22 nt, Human
acauuguauaaugauuaucaca

SEQ ID NO: 926620 - RNA, 22 nt, Human
cuccucacuuuccagacugggc

SEQ ID NO: 926621 - RNA, 22 nt, Human
gcagcugcuguggcaucaagcu

SEQ ID NO: 926622 - RNA, 22 nt, Human
uggacugaugcucccuauugaa

SEQ ID NO: 926623 - RNA, 22 nt, Human
aucucauaaacacacauauaug

SEQ ID NO: 926624 - RNA, 22 nt, Human
agcaggcugaugggcaugcuug

SEQ ID NO: 926625 - RNA, 22 nt, Human
ucagcuuugccaccagcuguaa

SEQ ID NO: 926626 - RNA, 22 nt, Human
gcaguguuuguguucucacaug

SEQ ID NO: 926627 - RNA, 22 nt, Human
cugggugucaggagacaugaug

SEQ ID NO: 926628 - RNA, 22 nt, Human
gggccagcucugugauguaggg

SEQ ID NO: 926629 - RNA, 17 nt, Human
cucugcagugcauggcu

SEQ ID NO: 926630 - RNA, 22 nt, Human
ccaggugugauuuggcaguguc

SEQ ID NO: 926631 - RNA, 22 nt, Human
guggcagcucucuugauuuccc

SEQ ID NO: 926632 - RNA, 20 nt, Human
uggcaggagccacuggaagc

SEQ ID NO: 926633 - RNA, 22 nt, Human
guggcucuaggugagcauggag

SEQ ID NO: 926634 - RNA, 22 nt, Human
agggcagcauugccuuucucca

SEQ ID NO: 926635 - RNA, 22 nt, Human
gagggcucuacucaccacccug

SEQ ID NO: 926636 - RNA, 22 nt, Human
acuccagggcugaacgaggccc

SEQ ID NO: 926637 - RNA, 22 nt, Human
cccugaggauagggcaggaccc

SEQ ID NO: 926638 - RNA, 22 nt, Human
guccuuggaaagucuaaucucu

SEQ ID NO: 926639 - RNA, 22 nt, Human
ggcucuggucagugaggggccu

SEQ ID NO: 926640 - RNA, 22 nt, Human
cugcgggcugucaggcgugcca

SEQ ID NO: 926641 - RNA, 22 nt, Human
uaugucaugggucaaaaugaag

SEQ ID NO: 926642 - RNA, 22 nt, Human
agcugcaggcgccggggccgau

SEQ ID NO: 926643 - RNA, 22 nt, Human
uucaaacauucaaauaaaccgg

SEQ ID NO: 926644 - RNA, 22 nt, Human
agaagaugucacugcagacagc

SEQ ID NO: 926645 - RNA, 22 nt, Human
agauuuccugcacugccuuuga

SEQ ID NO: 926646 - RNA, 22 nt, Human
ugacagugaacagguuaccacu

SEQ ID NO: 926647 - RNA, 22 nt, Human
uggcuucaggcagaauuuagac

SEQ ID NO: 926648 - RNA, 22 nt, Human
cagucaaacuuauaggcacauu

SEQ ID NO: 926649 - RNA, 22 nt, Human
cuggcuccauccuaggcaaaug

SEQ ID NO: 926650 - RNA, 22 nt, Human
uggcugugucaucauagcugug

SEQ ID NO: 926651 - RNA, 20 nt, Human
cccugagacaaaggaggggc

SEQ ID NO: 926652 - RNA, 22 nt, Human
ucugggcaguaccccucuccua

SEQ ID NO: 926653 - RNA, 22 nt, Human
augugagggaaaucagucagaa

SEQ ID NO: 926654 - RNA, 22 nt, Human
ucuaaagauguuuauugacaua

SEQ ID NO: 926655 - RNA, 23 nt, Human
aagcaauaccaggugugggcccu

SEQ ID NO: 926656 - RNA, 22 nt, Human
auguguaaugugguauuuuaau

SEQ ID NO: 926657 - RNA, 22 nt, Human
auacagaauucacuacaguuuc

SEQ ID NO: 926658 - RNA, 19 nt, Human
aaaaacuuaguccagaaag

SEQ ID NO: 926659 - RNA, 22 nt, Human
gauuuucugagccuucaaauuu

SEQ ID NO: 926660 - RNA, 22 nt, Human
gaauuuacagggugagcuucag

SEQ ID NO: 926661 - RNA, 22 nt, Human
cuuagaaggaacaguuuagugc

SEQ ID NO: 926662 - RNA, 22 nt, Human
uacuucaauuuguauaugugaa

SEQ ID NO: 926663 - RNA, 22 nt, Human
cuccugguucagagagcugaga

SEQ ID NO: 926664 - RNA, 22 nt, Human
aaggaagaaaugaauaggugga

SEQ ID NO: 926665 - RNA, 20 nt, Human
uccugggguaagccaugguc

SEQ ID NO: 926666 - RNA, 22 nt, Human
uagauguugaagucauauuugg

SEQ ID NO: 926667 - RNA, 22 nt, Human
cuggcagagucugcugucugca

SEQ ID NO: 926668 - RNA, 22 nt, Human
auguccagaaggguccccuguu

SEQ ID NO: 926669 - RNA, 19 nt, Human
cccuggcaggcaagccugg

SEQ ID NO: 926670 - RNA, 22 nt, Human
acuuccuuuugggaaacuguuu

SEQ ID NO: 926671 - RNA, 22 nt, Human
gacauucacagguaaacauucc

SEQ ID NO: 926672 - RNA, 22 nt, Human
gugcugagcaucaugaggcacu

SEQ ID NO: 926673 - RNA, 22 nt, Human
auuugcuggugaaauagugaca

SEQ ID NO: 926674 - RNA, 22 nt, Human
ugaggcagcauucuucaagaca

SEQ ID NO: 926675 - RNA, 22 nt, Human
agagcugcaccuaugcagaccu

SEQ ID NO: 926676 - RNA, 22 nt, Human
cacagcagagggagccauugaa

SEQ ID NO: 926677 - RNA, 18 nt, Human
uuauucuuccaggccacc

SEQ ID NO: 926678 - RNA, 23 nt, Human
agacccagagacuggcucugcuc

SEQ ID NO: 926679 - RNA, 22 nt, Human
ccagggcagccaacccagaugc

SEQ ID NO: 926680 - RNA, 22 nt, Human
uuaggaagcaggccuaaaauuu

SEQ ID NO: 926681 - RNA, 21 nt, Human
ccaggcaugacugcagagagc

SEQ ID NO: 926682 - RNA, 22 nt, Human
cuagcaggcuaauguaagcuug

SEQ ID NO: 926683 - RNA, 22 nt, Human
uuugaaccugagcuucugcaug

SEQ ID NO: 926684 - RNA, 22 nt, Human
aauaagaacaacuaagguuuau

SEQ ID NO: 926685 - RNA, 22 nt, Human
uaacaauuugcuucauuuguuu

SEQ ID NO: 926686 - RNA, 22 nt, Human
uggcuuuauaaauccacugguu

SEQ ID NO: 926687 - RNA, 22 nt, Human
ucuggaguugaaguucuucccc

SEQ ID NO: 926688 - RNA, 22 nt, Human
uauuugaagggagaaagugcca

SEQ ID NO: 926689 - RNA, 22 nt, Human
acgugugugacauugggaacgu

SEQ ID NO: 926690 - RNA, 22 nt, Human
gggggugaggacaggagcacug

SEQ ID NO: 926691 - RNA, 22 nt, Human
ggccagguggcuguccuggcgu

SEQ ID NO: 926692 - RNA, 22 nt, Human
cugcucuauguccucacccagg

SEQ ID NO: 926693 - RNA, 22 nt, Human
caacaauaugcugaguuuuuca

SEQ ID NO: 926694 - RNA, 22 nt, Human
gacacaggggggcgcuagaaga

SEQ ID NO: 926695 - RNA, 22 nt, Human
auguccaggaucuauccccaga

SEQ ID NO: 926696 - RNA, 22 nt, Human
gaggcuguucaguguccagcuu

SEQ ID NO: 926697 - RNA, 23 nt, Human
ugcgugugugcugaggggcgucc

SEQ ID NO: 926698 - RNA, 22 nt, Human
uggggaugucauauaagaggaa

SEQ ID NO: 926699 - RNA, 22 nt, Human
augggcagggcaguguauaaga

SEQ ID NO: 926700 - RNA, 22 nt, Human
uggcuuuacugucauucuuaug

SEQ ID NO: 926701 - RNA, 21 nt, Human
ugucacuuuaagcuagcucua

SEQ ID NO: 926702 - RNA, 22 nt, Human
ccucuugaaccuaggcaagacu

SEQ ID NO: 926703 - RNA, 22 nt, Human
aagguauagaguuuggaaaaau

SEQ ID NO: 926704 - RNA, 22 nt, Human
agcugaggcauggacaggcugc

SEQ ID NO: 926705 - RNA, 22 nt, Human
ugugaaaucaauuagcugcaga

SEQ ID NO: 926706 - RNA, 20 nt, Human
agugcauggagggagagggc

SEQ ID NO: 926707 - RNA, 22 nt, Human
gaaagcauguagccuguaucca

SEQ ID NO: 926708 - RNA, 22 nt, Human
uagaggagggcuguucuucagu

SEQ ID NO: 926709 - RNA, 22 nt, Human
acaagauguguuuauacaagcu

SEQ ID NO: 926710 - RNA, 22 nt, Human
aagggucuuagagguucauuuu

SEQ ID NO: 926711 - RNA, 22 nt, Human
caggaggcccacaggccccugc

SEQ ID NO: 926712 - RNA, 22 nt, Human
uuucuuuuacaguguggcuauu

SEQ ID NO: 926713 - RNA, 22 nt, Human
agagccugcaguggagaccuug

SEQ ID NO: 926714 - RNA, 22 nt, Human
acagacugauucauugcucagg

SEQ ID NO: 926715 - RNA, 22 nt, Human
ggcaauguagauucuguagauu

SEQ ID NO: 926716 - RNA, 22 nt, Human
aacauugaauuuaaaauacagu

SEQ ID NO: 926717 - RNA, 22 nt, Human
uguagaaagcucuucugaaauc

SEQ ID NO: 926718 - RNA, 22 nt, Human
acuucauguuucuauuagcuca

SEQ ID NO: 926719 - RNA, 22 nt, Human
guuggcacuucauaauaugaaa

SEQ ID NO: 926720 - RNA, 22 nt, Human
gaggagaagcuaagaaacacag

SEQ ID NO: 926721 - RNA, 22 nt, Human
agcucuuuggaaggugugcacu

SEQ ID NO: 926722 - RNA, 22 nt, Human
aaaugcagguaguauuuauuuu

SEQ ID NO: 926723 - RNA, 22 nt, Human
ugucagaacucuauugaugucc

SEQ ID NO: 926724 - RNA, 20 nt, Human
uuucugugauagagaggugu

SEQ ID NO: 926725 - RNA, 22 nt, Human
aauguguguauuucuaggcgag

SEQ ID NO: 926726 - RNA, 22 nt, Human
agcugaauguucucagaccaga

SEQ ID NO: 926727 - RNA, 23 nt, Human
uggccuggagagaaaagaugagu

SEQ ID NO: 926728 - RNA, 22 nt, Human
agaggggcucaagcaguggucu

SEQ ID NO: 926729 - RNA, 22 nt, Human
cauguggauggucuccucauca

SEQ ID NO: 926730 - RNA, 22 nt, Human
uagaggcuucuacugcucacuu

SEQ ID NO: 926731 - RNA, 22 nt, Human
aagugacacauuugugaugaau

SEQ ID NO: 926732 - RNA, 20 nt, Human
uaugauaauuacaaaauagu

SEQ ID NO: 926733 - RNA, 22 nt, Human
uuucaugauccauuuacaaaau

SEQ ID NO: 926734 - RNA, 22 nt, Human
uuccagaggccugggcacacuc

SEQ ID NO: 926735 - RNA, 22 nt, Human
uggcucagcgcggccuggucuu

SEQ ID NO: 926736 - RNA, 19 nt, Human
aauacaguguuauagaauu

SEQ ID NO: 926737 - RNA, 22 nt, Human
agaacagccuauaguggccuuu

SEQ ID NO: 926738 - RNA, 22 nt, Human
uuucucuucacugugugccuca

SEQ ID NO: 926739 - RNA, 22 nt, Human
caaguuaauauauagaauuuug

SEQ ID NO: 926740 - RNA, 22 nt, Human
cucccagagagcaggugggccg

SEQ ID NO: 926741 - RNA, 22 nt, Human
aaggaaagcugugguucugaga

SEQ ID NO: 926742 - RNA, 22 nt, Human
gcugccauuaugggaacgagaa

SEQ ID NO: 926743 - RNA, 22 nt, Human
cagaaauggucuguucagcuua

SEQ ID NO: 926744 - RNA, 20 nt, Human
uucuuuacgaccuuucugca

SEQ ID NO: 926745 - RNA, 22 nt, Human
uggauaaaaucuguaaggcuca

SEQ ID NO: 926746 - RNA, 21 nt, Human
gggccacaccuucugcagacc

SEQ ID NO: 926747 - RNA, 23 nt, Human
ccuugucuggcuggcuggacuuu

SEQ ID NO: 926748 - RNA, 22 nt, Human
ggacuuuaggugagaaggcauu

SEQ ID NO: 926749 - RNA, 22 nt, Human
cuccagugucucagagcagaug

SEQ ID NO: 926750 - RNA, 22 nt, Human
ucuuggcaaguggcagauucuu

SEQ ID NO: 926751 - RNA, 22 nt, Human
cacaggaauaagucaaacuuca

SEQ ID NO: 926752 - RNA, 22 nt, Human
ggcagccaugugggcagcgagu

SEQ ID NO: 926753 - RNA, 22 nt, Human
acacuuuuagcuaugaguuaau

SEQ ID NO: 926754 - RNA, 22 nt, Human
uccucagacacccugcuggcuu

SEQ ID NO: 926755 - RNA, 22 nt, Human
uaggggcuuguaauuuaauaga

SEQ ID NO: 926756 - RNA, 20 nt, Human
ccuguguggccagcugaggc

SEQ ID NO: 926757 - RNA, 19 nt, Human
uuuaccuucuugagagcag

SEQ ID NO: 926758 - RNA, 22 nt, Human
gauauucuauuuuagccagcua

SEQ ID NO: 926759 - RNA, 22 nt, Human
agggcagccauugagggauucu

SEQ ID NO: 926760 - RNA, 22 nt, Human
agagaacaaauuaaaggugguu

SEQ ID NO: 926761 - RNA, 22 nt, Human
cucaggcuaagaaggccaagug

SEQ ID NO: 926762 - RNA, 22 nt, Human
uuucugcagguauugcauaagu

SEQ ID NO: 926763 - RNA, 22 nt, Human
uaggaaauacuguaaguuuggg

SEQ ID NO: 926764 - RNA, 22 nt, Human
aaggcacauauuuuagagucac

SEQ ID NO: 926765 - RNA, 23 nt, Human
augcucugggcugugggaccugc

SEQ ID NO: 926766 - RNA, 22 nt, Human
aguuaacucauuuuauaaugcc

SEQ ID NO: 926767 - RNA, 22 nt, Human
cugaggcacugguaaugggcau

SEQ ID NO: 926768 - RNA, 22 nt, Human
gcccauuuguuuauauacuguc

SEQ ID NO: 926769 - RNA, 18 nt, Human
ugaggcagucagugaugg

SEQ ID NO: 926770 - RNA, 21 nt, Human
cuuuucucuccgcaggacauu

SEQ ID NO: 926771 - RNA, 22 nt, Human
ccuggugcugcuaucaggggua

SEQ ID NO: 926772 - RNA, 22 nt, Human
uuguauuucuccacuuucuguu

SEQ ID NO: 926773 - RNA, 22 nt, Human
gccuggcugcucagccacucac

SEQ ID NO: 926774 - RNA, 22 nt, Human
aaaaucuugacuguuuuuagaa

SEQ ID NO: 926775 - RNA, 20 nt, Human
uggcuccagccuccccuacc

SEQ ID NO: 926776 - RNA, 22 nt, Human
aagaggaauggguguguuuaug

SEQ ID NO: 926777 - RNA, 22 nt, Human
gcacacagauuaggaaacagaa

SEQ ID NO: 926778 - RNA, 22 nt, Human
gggggcaguaaggauauggaaa

SEQ ID NO: 926779 - RNA, 22 nt, Human
uccuaggccuggccugguggau

SEQ ID NO: 926780 - RNA, 22 nt, Human
aagaaguuggaaaugauugaga

SEQ ID NO: 926781 - RNA, 22 nt, Human
cagggcugcuggccgugcccuc

SEQ ID NO: 926782 - RNA, 22 nt, Human
ugcagugggccggaggccaggg

SEQ ID NO: 926783 - RNA, 22 nt, Human
ucaacauacauacauggucagg

SEQ ID NO: 926784 - RNA, 19 nt, Human
aagcaucuuugaaacuggg

SEQ ID NO: 926785 - RNA, 22 nt, Human
agcugggcagacugcagugguu

SEQ ID NO: 926786 - RNA, 19 nt, Human
cccaggagcaguauugaug

SEQ ID NO: 926787 - RNA, 22 nt, Human
uaauacauuaccuaaccucucu

SEQ ID NO: 926788 - RNA, 22 nt, Human
uaucagaagacuuacaguaucg

SEQ ID NO: 926789 - RNA, 22 nt, Human
ggccacugcugcucugguggag

SEQ ID NO: 926790 - RNA, 22 nt, Human
gaaaguuuauagguuauauaau

SEQ ID NO: 926791 - RNA, 22 nt, Human
acaguggaugugauguccaggu

SEQ ID NO: 926792 - RNA, 22 nt, Human
gagaagcaaucaguggccaccc

SEQ ID NO: 926793 - RNA, 22 nt, Human
aauguguauaugaacauacagg

SEQ ID NO: 926794 - RNA, 22 nt, Human
ggucagagcuggagagauaggg

SEQ ID NO: 926795 - RNA, 22 nt, Human
ccagcagcucccucaggguccg

SEQ ID NO: 926796 - RNA, 22 nt, Human
acagaguaucuaucaggaguau

SEQ ID NO: 926797 - RNA, 22 nt, Human
uaccugagguaaggaugaugag

SEQ ID NO: 926798 - RNA, 22 nt, Human
gcagacggaguaucuuguacau

SEQ ID NO: 926799 - RNA, 22 nt, Human
cuguuuaaugcaaugaaaugag

SEQ ID NO: 926800 - RNA, 22 nt, Human
ugagccugccugcaggugugcu

SEQ ID NO: 926801 - RNA, 22 nt, Human
agaaaaggcuugaagagguuuu

SEQ ID NO: 926802 - RNA, 19 nt, Human
gguuaccagugugucuggc

SEQ ID NO: 926803 - RNA, 22 nt, Human
aacacugucagccuuugaugga

SEQ ID NO: 926804 - RNA, 22 nt, Human
ugugccaaucugcugacugucu

SEQ ID NO: 926805 - RNA, 19 nt, Human
aggcuucauccugggcagc

SEQ ID NO: 926806 - RNA, 22 nt, Human
aggaaacauugauauugggaaa

SEQ ID NO: 926807 - RNA, 22 nt, Human
ccaucugacugccacccaggcc

SEQ ID NO: 926808 - RNA, 19 nt, Human
ccugugacuaucuuuguaa

SEQ ID NO: 926809 - RNA, 22 nt, Human
cuuugggauuucaugagagcua

SEQ ID NO: 926810 - RNA, 20 nt, Human
gucagaggacccuagagcga

SEQ ID NO: 926811 - RNA, 20 nt, Human
uguaacaaucuggauguugc

SEQ ID NO: 926812 - RNA, 22 nt, Human
gcacacagcuagauuaccauuc

SEQ ID NO: 926813 - RNA, 22 nt, Human
ucagagguuacccaugggacag

SEQ ID NO: 926814 - RNA, 22 nt, Human
aauguugaccuccugaauguuu

SEQ ID NO: 926815 - RNA, 22 nt, Human
ccacagugaaaucuugauggag

SEQ ID NO: 926816 - RNA, 22 nt, Human
aaacauuuuucuucaucauccu

SEQ ID NO: 926817 - RNA, 22 nt, Human
agcuaagguguccuggaggccc

SEQ ID NO: 926818 - RNA, 22 nt, Human
aagacacaaagcuucccuuuuc

SEQ ID NO: 926819 - RNA, 21 nt, Human
gcagaaaggaaucuuaggucc

SEQ ID NO: 926820 - RNA, 22 nt, Human
ugccuugggauauauggacacu

SEQ ID NO: 926821 - RNA, 22 nt, Human
uguuaacagccagauuugguga

SEQ ID NO: 926822 - RNA, 22 nt, Human
uauuauuaugcauagcaugaaa

SEQ ID NO: 926823 - RNA, 22 nt, Human
aaucuagaguucccagcauaaa

SEQ ID NO: 926824 - RNA, 22 nt, Human
aauuaaauugguuuagagagga

SEQ ID NO: 926825 - RNA, 22 nt, Human
aucaaguuuucuuaguugacug

SEQ ID NO: 926826 - RNA, 22 nt, Human
cagcaucuccauggcuuuggag

SEQ ID NO: 926827 - RNA, 22 nt, Human
uucugcauacacugaauguagu

SEQ ID NO: 926828 - RNA, 22 nt, Human
guuggagugcagcuugugcgau

SEQ ID NO: 926829 - RNA, 22 nt, Human
ugaccacagacccaaugacuac

SEQ ID NO: 926830 - RNA, 22 nt, Human
gaggccugaaaggggaccuaug

SEQ ID NO: 926831 - RNA, 22 nt, Human
caugaguucaaaaugccugccu

SEQ ID NO: 926832 - RNA, 22 nt, Human
aaagcacaugaguaguguagua

SEQ ID NO: 926833 - RNA, 22 nt, Human
uagccaaaguagcuguuauagc

SEQ ID NO: 926834 - RNA, 20 nt, Human
gcccaagcgccggccgcaga

SEQ ID NO: 926835 - RNA, 22 nt, Human
cuggaagaggacacacgaauca

SEQ ID NO: 926836 - RNA, 22 nt, Human
ggaagggaguaguuggaaugca

SEQ ID NO: 926837 - RNA, 22 nt, Human
uuucaaacauagaucugaauau

SEQ ID NO: 926838 - RNA, 22 nt, Human
aaauauagcaauuaugccuacu

SEQ ID NO: 926839 - RNA, 22 nt, Human
agagacuaagaaguuuuaacuu

SEQ ID NO: 926840 - RNA, 22 nt, Human
gcaagcuucauauggcauuuuc

SEQ ID NO: 926841 - RNA, 22 nt, Human
gagcuggccgcagagagggcag

SEQ ID NO: 926842 - RNA, 20 nt, Human
aagggagaauaaugauugua

SEQ ID NO: 926843 - RNA, 22 nt, Human
ugcuggcuuauuuaguaaaugu

SEQ ID NO: 926844 - RNA, 22 nt, Human
gccccagcucugccacaacuag

SEQ ID NO: 926845 - RNA, 22 nt, Human
augaggccagggugccaugaaa

SEQ ID NO: 926846 - RNA, 22 nt, Human
uccaaaguguugggauuauagg

SEQ ID NO: 926847 - RNA, 22 nt, Human
cugaagaaugacagugcuuuga

SEQ ID NO: 926848 - RNA, 22 nt, Human
ggaguggcacucugaggcgggg

SEQ ID NO: 926849 - RNA, 22 nt, Human
uccagacucuuuaaguucauuu

SEQ ID NO: 926850 - RNA, 22 nt, Human
uuacagaaaagggguuguccuu

SEQ ID NO: 926851 - RNA, 22 nt, Human
aagcaucuccucaucauuuggg

SEQ ID NO: 926852 - RNA, 22 nt, Human
ugugugagacaauuggcugugg

SEQ ID NO: 926853 - RNA, 22 nt, Human
aaagcagagaucauggcuugua

SEQ ID NO: 926854 - RNA, 21 nt, Human
agccuggguauccuuugagga

SEQ ID NO: 926855 - RNA, 22 nt, Human
cugcagccuaggugcagcuggg

SEQ ID NO: 926856 - RNA, 22 nt, Human
agguggggaaaccagcgauccc

SEQ ID NO: 926857 - RNA, 22 nt, Human
aauaacaggguugauuugcaau

SEQ ID NO: 926858 - RNA, 22 nt, Human
uggacugggcuaauggcagaca

SEQ ID NO: 926859 - RNA, 22 nt, Human
ggugcugacauucagagucugg

SEQ ID NO: 926860 - RNA, 22 nt, Human
cagggugguaccagcaucuagu

SEQ ID NO: 926861 - RNA, 23 nt, Human
gcucccugugcuccaggagaugc

SEQ ID NO: 926862 - RNA, 22 nt, Human
caggcccuuuccugggcauagg

SEQ ID NO: 926863 - RNA, 20 nt, Human
gcagccguggagacuaggag

SEQ ID NO: 926864 - RNA, 22 nt, Human
gcagaggucaaauaccucauuu

SEQ ID NO: 926865 - RNA, 22 nt, Human
cacaguguggcaaauuucaacu

SEQ ID NO: 926866 - RNA, 22 nt, Human
cuagggacagaaagaggguaga

SEQ ID NO: 926867 - RNA, 22 nt, Human
uggcggggcagcucuggcuucu

SEQ ID NO: 926868 - RNA, 22 nt, Human
agggccugcucuaucacucuca

SEQ ID NO: 926869 - RNA, 22 nt, Human
ccaccaggacagcccugagggg

SEQ ID NO: 926870 - RNA, 22 nt, Human
gcuggagagauaggcauggggu

SEQ ID NO: 926871 - RNA, 22 nt, Human
uaaagcaaugaaaguuuugcag

SEQ ID NO: 926872 - RNA, 22 nt, Human
agcccagugggccgaggcgggg

SEQ ID NO: 926873 - RNA, 22 nt, Human
gguguguguggauuagcaugcc

SEQ ID NO: 926874 - RNA, 22 nt, Human
ugucuauaccugauacagaguu

SEQ ID NO: 926875 - RNA, 22 nt, Human
gcaaaucaccaccuagcuggau

SEQ ID NO: 926876 - RNA, 19 nt, Human
aaacacagauuucuuacca

SEQ ID NO: 926877 - RNA, 22 nt, Human
uggaggauuccacuuacaugag

SEQ ID NO: 926878 - RNA, 22 nt, Human
ggucccaggauugguugcgcag

SEQ ID NO: 926879 - RNA, 22 nt, Human
aacaaggcugguaucuuaaaga

SEQ ID NO: 926880 - RNA, 22 nt, Human
gcucaagggaugggagugggug

SEQ ID NO: 926881 - RNA, 22 nt, Human
ccugccuggcuuccagaagaga

SEQ ID NO: 926882 - RNA, 22 nt, Human
ugggcaggaugcguugauucuu

SEQ ID NO: 926883 - RNA, 22 nt, Human
uggcccagggaguucauggugu

SEQ ID NO: 926884 - RNA, 22 nt, Human
uacaacacugguucgacaugug

SEQ ID NO: 926885 - RNA, 22 nt, Human
acagguuuuggacuccagauuu

SEQ ID NO: 926886 - RNA, 22 nt, Human
ugagaaauauugcacagugagg

SEQ ID NO: 926887 - RNA, 22 nt, Human
ccauuccaugugcuacacauaa

SEQ ID NO: 926888 - RNA, 22 nt, Human
auacaaagacaaaucucaaucu

SEQ ID NO: 926889 - RNA, 22 nt, Human
acacugguugaauuguauaacu

SEQ ID NO: 926890 - RNA, 22 nt, Human
acagcugugacuuagagaaguu

SEQ ID NO: 926891 - RNA, 22 nt, Human
auacacacaaucagguuuugua

SEQ ID NO: 926892 - RNA, 22 nt, Human
gugcugguauaugacugaguuu

SEQ ID NO: 926893 - RNA, 22 nt, Human
ugugaaaggaaggcaugaaaag

SEQ ID NO: 926894 - RNA, 22 nt, Human
acucugggaugagaaaaggguu

SEQ ID NO: 926895 - RNA, 22 nt, Human
ccucugccaccucccacgaggc

SEQ ID NO: 926896 - RNA, 22 nt, Human
aaaccacuccugauucacuuca

SEQ ID NO: 926897 - RNA, 22 nt, Human
ugauaaauccauguaaauggua

SEQ ID NO: 926898 - RNA, 21 nt, Human
agcgucaauaucgucaacagg

SEQ ID NO: 926899 - RNA, 22 nt, Human
acacugaagagcacuuucaaag

SEQ ID NO: 926900 - RNA, 22 nt, Human
aguacauuuauuaaugguaaaa

SEQ ID NO: 926901 - RNA, 22 nt, Human
ggucaacagaauuuguacucag

SEQ ID NO: 926902 - RNA, 22 nt, Human
uugggacagaaaaggagaagau

SEQ ID NO: 926903 - RNA, 22 nt, Human
cagguccuuuaguguccagaac

SEQ ID NO: 926904 - RNA, 21 nt, Human
agcagcuugagucuggagcuc

SEQ ID NO: 926905 - RNA, 22 nt, Human
auucuucauacagacaaguccu

SEQ ID NO: 926906 - RNA, 22 nt, Human
cugcucuagguuccugcauaug

SEQ ID NO: 926907 - RNA, 22 nt, Human
caugaaaaugucaaguucugcu

SEQ ID NO: 926908 - RNA, 22 nt, Human
ggcugugccucuggcagcacau

SEQ ID NO: 926909 - RNA, 19 nt, Human
aaaguucugacuguagagc

SEQ ID NO: 926910 - RNA, 22 nt, Human
ccugggcucugaggagggaguc

SEQ ID NO: 926911 - RNA, 22 nt, Human
gcuguuggggccagcaggucau

SEQ ID NO: 926912 - RNA, 22 nt, Human
gcccaagucagugcuucuggca

SEQ ID NO: 926913 - RNA, 22 nt, Human
agguauaugcuauuacuucugc

SEQ ID NO: 926914 - RNA, 22 nt, Human
uuuuggcacugcgucuacaugg

SEQ ID NO: 926915 - RNA, 22 nt, Human
cacagaagaaucaugcuguguu

SEQ ID NO: 926916 - RNA, 22 nt, Human
ucugacaggauuuuuucaggca

SEQ ID NO: 926917 - RNA, 22 nt, Human
aagcagcuuuugaagagugagg

SEQ ID NO: 926918 - RNA, 22 nt, Human
guaacacuagcucugucacuuu

SEQ ID NO: 926919 - RNA, 22 nt, Human
ucaaagagcucuaucuucaaaa

SEQ ID NO: 926920 - RNA, 22 nt, Human
ccacauuuggagaagauacuuu

SEQ ID NO: 926921 - RNA, 22 nt, Human
ggaugcaggaguugaagaagga

SEQ ID NO: 926922 - RNA, 22 nt, Human
cucugugucagcugggugugca

SEQ ID NO: 926923 - RNA, 22 nt, Human
uaaaggaaucaguuuuagagau

SEQ ID NO: 926924 - RNA, 22 nt, Human
gcugcuggcgcugggcguccgg

SEQ ID NO: 926925 - RNA, 22 nt, Human
aaacacuggcaauuucaugcac

SEQ ID NO: 926926 - RNA, 22 nt, Human
aacugaaacggugaucuuuuaa

SEQ ID NO: 926927 - RNA, 22 nt, Human
acaguaaauaaugcauguugau

SEQ ID NO: 926928 - RNA, 22 nt, Human
aaauucuggccuaucacaguga

SEQ ID NO: 926929 - RNA, 23 nt, Human
aagcuuccuugacuggccccuag

SEQ ID NO: 926930 - RNA, 22 nt, Human
uaccaaaagcuuguuucauaca

SEQ ID NO: 926931 - RNA, 22 nt, Human
augagcaugugacucaaaccaa

SEQ ID NO: 926932 - RNA, 21 nt, Human
ccaggucuugguccuuggacu

SEQ ID NO: 926933 - RNA, 23 nt, Human
aaugauuucaugaugauagcagc

SEQ ID NO: 926934 - RNA, 22 nt, Human
agucugcacucagguggagguc

SEQ ID NO: 926935 - RNA, 22 nt, Human
uuuccucuucuggcaggcaggg

SEQ ID NO: 926936 - RNA, 22 nt, Human
ccaggaggggucucugucuccc

SEQ ID NO: 926937 - RNA, 21 nt, Human
agcucccuguuuccucacucu

SEQ ID NO: 926938 - RNA, 22 nt, Human
cagcugcaggagcugagcacuu

SEQ ID NO: 926939 - RNA, 22 nt, Human
uaacacauuuuaagccauuuua

SEQ ID NO: 926940 - RNA, 22 nt, Human
gcaguguuuacauauuagaaac

SEQ ID NO: 926941 - RNA, 22 nt, Human
gaaugcuggcuuacaggcaguu

SEQ ID NO: 926942 - RNA, 22 nt, Human
agguacagcaauauaagagguc

SEQ ID NO: 926943 - RNA, 22 nt, Human
ucauugcagacuaacaaucuca

SEQ ID NO: 926944 - RNA, 22 nt, Human
auaggaaagaaaauuauguagg

SEQ ID NO: 926945 - RNA, 21 nt, Human
cagugcagggguuagcgugua

SEQ ID NO: 926946 - RNA, 22 nt, Human
aaaggcaugauuaauucugugu

SEQ ID NO: 926947 - RNA, 22 nt, Human
gagaggcugcauaugcacacug

SEQ ID NO: 926948 - RNA, 22 nt, Human
cauguuuuguguacagaauauu

SEQ ID NO: 926949 - RNA, 22 nt, Human
ugaagaauguugcagugagcau

SEQ ID NO: 926950 - RNA, 22 nt, Human
ucagagguggccccugcccuca

SEQ ID NO: 926951 - RNA, 22 nt, Human
uaagagaaugucaggaguggau

SEQ ID NO: 926952 - RNA, 22 nt, Human
cuuccucugccucccgugcuca

SEQ ID NO: 926953 - RNA, 22 nt, Human
gaauagcuuccuuuuuuccaaa

SEQ ID NO: 926954 - RNA, 22 nt, Human
ugggggagagugcaagcaugaa

SEQ ID NO: 926955 - RNA, 22 nt, Human
uuuaguguggcacugauguuca

SEQ ID NO: 926956 - RNA, 22 nt, Human
aaacugugaagcaaguacaagg

SEQ ID NO: 926957 - RNA, 22 nt, Human
agccugguuuaagcauuuuaua

SEQ ID NO: 926958 - RNA, 22 nt, Human
aggcucagccugggccuagagc

SEQ ID NO: 926959 - RNA, 22 nt, Human
cagcccugucccugagggaccu

SEQ ID NO: 926960 - RNA, 20 nt, Human
agcuucagcccuaggauugc

SEQ ID NO: 926961 - RNA, 22 nt, Human
uuccuuuuuacauaaucacauu

SEQ ID NO: 926962 - RNA, 22 nt, Human
agaggccaucugcucugugggg

SEQ ID NO: 926963 - RNA, 18 nt, Human
ccuuuccuccccucagcu

SEQ ID NO: 926964 - RNA, 22 nt, Human
aaggccaaggcugcagugagcc

SEQ ID NO: 926965 - RNA, 22 nt, Human
gugggggaugcugaguuggaaa

SEQ ID NO: 926966 - RNA, 22 nt, Human
gggcaaagugguggaggcaguu

SEQ ID NO: 926967 - RNA, 22 nt, Human
uuuacauggaauauugucuugu

SEQ ID NO: 926968 - RNA, 22 nt, Human
ucuauuuuuauaguugaagugc

SEQ ID NO: 926969 - RNA, 22 nt, Human
aaucuacauagagaucaaauga

SEQ ID NO: 926970 - RNA, 22 nt, Human
ggcagggaggaggugaaaguga

SEQ ID NO: 926971 - RNA, 22 nt, Human
ugguggcuguaagggagagaag

SEQ ID NO: 926972 - RNA, 22 nt, Human
guuuggugugaguucauaccac

SEQ ID NO: 926973 - RNA, 22 nt, Human
ucagaaagaacacaggcaguag

SEQ ID NO: 926974 - RNA, 22 nt, Human
uuacaguuuaagaggaaacaaa

SEQ ID NO: 926975 - RNA, 22 nt, Human
accacauuucugaauagcauaa

SEQ ID NO: 926976 - RNA, 22 nt, Human
ggcaaacaccaggcgagggagc

SEQ ID NO: 926977 - RNA, 22 nt, Human
ugaaugaucuaguuuuguagac

SEQ ID NO: 926978 - RNA, 22 nt, Human
uucuucaacaaggacacuguua

SEQ ID NO: 926979 - RNA, 22 nt, Human
uuuggcuuaacuuacaugauau

SEQ ID NO: 926980 - RNA, 22 nt, Human
ggacaggcgcagggccaaggaa

SEQ ID NO: 926981 - RNA, 22 nt, Human
acaacaagagcuaaggguaagg

SEQ ID NO: 926982 - RNA, 22 nt, Human
cucugagacuuagcaucuacau

SEQ ID NO: 926983 - RNA, 22 nt, Human
auccacuugccacuguauaguu

SEQ ID NO: 926984 - RNA, 22 nt, Human
gacuucaaaggucaaacaucgc

SEQ ID NO: 926985 - RNA, 22 nt, Human
uccagcagcccgaaggcccauc

SEQ ID NO: 926986 - RNA, 22 nt, Human
cugagucucccggcaguggagg

SEQ ID NO: 926987 - RNA, 19 nt, Human
ugcuucuggggcuucucca

SEQ ID NO: 926988 - RNA, 22 nt, Human
uauucaaaguaccuucauugcc

SEQ ID NO: 926989 - RNA, 22 nt, Human
aguggcaguggggcagggcccu

SEQ ID NO: 926990 - RNA, 22 nt, Human
guaaaacauguuuuaacuagga

SEQ ID NO: 926991 - RNA, 22 nt, Human
guuucauagcuacgauuuuggg

SEQ ID NO: 926992 - RNA, 22 nt, Human
aaugagaucagagauaacucaa

SEQ ID NO: 926993 - RNA, 22 nt, Human
uaugugcaaauuaauugcuaga

SEQ ID NO: 926994 - RNA, 18 nt, Human
ggcaaaugcaauucaaag

SEQ ID NO: 926995 - RNA, 22 nt, Human
ugaagacuuugcucuuaaccac

SEQ ID NO: 926996 - RNA, 22 nt, Human
agcgugugccucgggguacacg

SEQ ID NO: 926997 - RNA, 22 nt, Human
cauuaaaauaucucaugguguu

SEQ ID NO: 926998 - RNA, 22 nt, Human
cccaguggagauaggagugugg

SEQ ID NO: 926999 - RNA, 22 nt, Human
cacuguggcuuaccaaagcuaa

SEQ ID NO: 927000 - RNA, 21 nt, Human
aagaguggcugaggaggugau

SEQ ID NO: 927001 - RNA, 22 nt, Human
ccaauguuaggcucugguuuua

SEQ ID NO: 927002 - RNA, 22 nt, Human
uaacagugaccugaaugucaau

SEQ ID NO: 927003 - RNA, 20 nt, Human
gauacacagcuucacuguug

SEQ ID NO: 927004 - RNA, 19 nt, Human
ccugggacuuaggcugggu

SEQ ID NO: 927005 - RNA, 22 nt, Human
aguuauguccucagcaaaucaa

SEQ ID NO: 927006 - RNA, 22 nt, Human
ucacagaaugucagaguugggg

SEQ ID NO: 927007 - RNA, 22 nt, Human
gagggcugauaacaggaauaca

SEQ ID NO: 927008 - RNA, 22 nt, Human
aucugggggagcugcucaugga

SEQ ID NO: 927009 - RNA, 22 nt, Human
ucuccaggaaccaucaugguaa

SEQ ID NO: 927010 - RNA, 22 nt, Human
guucagcagcagugauuuugug

SEQ ID NO: 927011 - RNA, 22 nt, Human
uacugaaaauccugccuguccu

SEQ ID NO: 927012 - RNA, 23 nt, Human
uauugcacacauagaaacauaga

SEQ ID NO: 927013 - RNA, 22 nt, Human
agggcugccccaguccagccgg

SEQ ID NO: 927014 - RNA, 22 nt, Human
cuucuuauuaauccuucucugu

SEQ ID NO: 927015 - RNA, 22 nt, Human
acaggcuuuuacggauaucuuu

SEQ ID NO: 927016 - RNA, 22 nt, Human
ucugccuguaauauuuggagaa

SEQ ID NO: 927017 - RNA, 22 nt, Human
auuucaucccaggcucuggaag

SEQ ID NO: 927018 - RNA, 22 nt, Human
ucauaguuauggagauuaagga

SEQ ID NO: 927019 - RNA, 17 nt, Human
accacuuugccaaguug

SEQ ID NO: 927020 - RNA, 22 nt, Human
agccugugagggaugcugcagu

SEQ ID NO: 927021 - RNA, 22 nt, Human
uucuucaggaagagccuggacu

SEQ ID NO: 927022 - RNA, 22 nt, Human
uggagcagugguccuggagaug

SEQ ID NO: 927023 - RNA, 22 nt, Human
guucuccaggggcuguucaucu

SEQ ID NO: 927024 - RNA, 22 nt, Human
gcucuugauuuccaggagcuag

SEQ ID NO: 927025 - RNA, 22 nt, Human
uuuuauauugagugagaguucc

SEQ ID NO: 927026 - RNA, 22 nt, Human
ugggugaggagaggcugucuaa

SEQ ID NO: 927027 - RNA, 22 nt, Human
cuguccugugcauugucagaug

SEQ ID NO: 927028 - RNA, 22 nt, Human
ucauacaaggaggguguucaaa

SEQ ID NO: 927029 - RNA, 22 nt, Human
cugcucugcagcuuggacuccc

SEQ ID NO: 927030 - RNA, 22 nt, Human
auguagagcuccuugauccucc

SEQ ID NO: 927031 - RNA, 19 nt, Human
gcugagggccacccagccc

SEQ ID NO: 927032 - RNA, 22 nt, Human
cuuauguauauuuggaacguac

SEQ ID NO: 927033 - RNA, 22 nt, Human
aguaucagcagagcuuaaaaga

SEQ ID NO: 927034 - RNA, 22 nt, Human
cccuuagaauuuuguaguuauu

SEQ ID NO: 927035 - RNA, 22 nt, Human
uguaccaguguugagaaugaga

SEQ ID NO: 927036 - RNA, 22 nt, Human
gcauucuucacuaggugagagc

SEQ ID NO: 927037 - RNA, 22 nt, Human
gaacuacaguaagaauugaugu

SEQ ID NO: 927038 - RNA, 22 nt, Human
uucucauagaugcuauagacag

SEQ ID NO: 927039 - RNA, 22 nt, Human
caggguuucuguugagaagucc

SEQ ID NO: 927040 - RNA, 22 nt, Human
ucuuugcagaauuuaacuuugc

SEQ ID NO: 927041 - RNA, 22 nt, Human
ggcugccuacuuucccagaguu

SEQ ID NO: 927042 - RNA, 22 nt, Human
uggggcagcuccaucuauucca

SEQ ID NO: 927043 - RNA, 22 nt, Human
aguagucacuucuauuaauggc

SEQ ID NO: 927044 - RNA, 19 nt, Human
gcaugcagaguaagaaggu

SEQ ID NO: 927045 - RNA, 22 nt, Human
cauuucaauacuaucugagaau

SEQ ID NO: 927046 - RNA, 22 nt, Human
gugggccacugggaggcaaggg

SEQ ID NO: 927047 - RNA, 22 nt, Human
guguccuuauaagaagagaugc

SEQ ID NO: 927048 - RNA, 22 nt, Human
gcagggugugucucauacaguu

SEQ ID NO: 927049 - RNA, 22 nt, Human
acaaugaaagguauucugaacu

SEQ ID NO: 927050 - RNA, 22 nt, Human
caccagguuccgggcagagcug

SEQ ID NO: 927051 - RNA, 21 nt, Human
agcagcugggcaacauggagg

SEQ ID NO: 927052 - RNA, 22 nt, Human
uggcagagagagugcagucgac

SEQ ID NO: 927053 - RNA, 22 nt, Human
cuccacaguugcugcuuuuaau

SEQ ID NO: 927054 - RNA, 22 nt, Human
uuuagaacagauauuguaacuu

SEQ ID NO: 927055 - RNA, 17 nt, Human
agcagcuggguugaucu

SEQ ID NO: 927056 - RNA, 22 nt, Human
uuuccuguugccaucaagaaug

SEQ ID NO: 927057 - RNA, 17 nt, Human
cugaagauaauggcaac

SEQ ID NO: 927058 - RNA, 22 nt, Human
ucuacuuuauaaguauauaagu

SEQ ID NO: 927059 - RNA, 22 nt, Human
ucugcaacagugcccuguaaau

SEQ ID NO: 927060 - RNA, 22 nt, Human
ugccaggccucaggagucucca

SEQ ID NO: 927061 - RNA, 22 nt, Human
gaaaacuaacggaaaaguuagg

SEQ ID NO: 927062 - RNA, 21 nt, Human
ggcuguggagccaugacucac

SEQ ID NO: 927063 - RNA, 22 nt, Human
uagcccagauacaaaucaugau

SEQ ID NO: 927064 - RNA, 22 nt, Human
cuggaauggcaaugggaagucc

SEQ ID NO: 927065 - RNA, 22 nt, Human
acauuucuugaugccucuguga

SEQ ID NO: 927066 - RNA, 22 nt, Human
acagauggaauguguuauggga

SEQ ID NO: 927067 - RNA, 22 nt, Human
aaaguucugagaagcaguuuac

SEQ ID NO: 927068 - RNA, 22 nt, Human
aaaguauuugugauuuuuacca

SEQ ID NO: 927069 - RNA, 22 nt, Human
cucaggcugugaugugauggca

SEQ ID NO: 927070 - RNA, 22 nt, Human
uccugaaaauaauuucacaaga

SEQ ID NO: 927071 - RNA, 22 nt, Human
cauuuuauguuuauggagugcu

SEQ ID NO: 927072 - RNA, 18 nt, Human
ggcuccaggaccuaccca

SEQ ID NO: 927073 - RNA, 22 nt, Human
cacauucaggauuuuccauguc

SEQ ID NO: 927074 - RNA, 22 nt, Human
auuuggaacuuauaauaaguuu

SEQ ID NO: 927075 - RNA, 22 nt, Human
aggaaacauccuuaucuauucu

SEQ ID NO: 927076 - RNA, 19 nt, Human
augcaacaaaaguguaaga

SEQ ID NO: 927077 - RNA, 22 nt, Human
aggagggucauguugaagugua

SEQ ID NO: 927078 - RNA, 22 nt, Human
caggcccugugcugggugaugu

SEQ ID NO: 927079 - RNA, 22 nt, Human
aggcagguuggugagaagacug

SEQ ID NO: 927080 - RNA, 22 nt, Human
ccagacagcaguuaaaggacau

SEQ ID NO: 927081 - RNA, 22 nt, Human
cuggagccaugucuugacugcu

SEQ ID NO: 927082 - RNA, 22 nt, Human
gguggaagccuucagaacagca

SEQ ID NO: 927083 - RNA, 22 nt, Human
caaguuaauugguauuuugauc

SEQ ID NO: 927084 - RNA, 22 nt, Human
auguguguguauauacacacau

SEQ ID NO: 927085 - RNA, 22 nt, Human
uggggucugaguaucugcauuu

SEQ ID NO: 927086 - RNA, 22 nt, Human
caagggcaggagaggauggaug

SEQ ID NO: 927087 - RNA, 22 nt, Human
aacuugguaccaccuucugaag

SEQ ID NO: 927088 - RNA, 22 nt, Human
augggcuaucaaauggagguau

SEQ ID NO: 927089 - RNA, 22 nt, Human
ucccuguacuuacacagcgucc

SEQ ID NO: 927090 - RNA, 22 nt, Human
caugcagggagugcuccuauua

SEQ ID NO: 927091 - RNA, 22 nt, Human
cagugaaguucuacugaauggu

SEQ ID NO: 927092 - RNA, 22 nt, Human
aggcaguggcugagaccagggg

SEQ ID NO: 927093 - RNA, 22 nt, Human
gaugaucugcaagaacuacaug

SEQ ID NO: 927094 - RNA, 22 nt, Human
cgcagagggcaggcagugcugg

SEQ ID NO: 927095 - RNA, 17 nt, Human
agguguggucaagggag

SEQ ID NO: 927096 - RNA, 22 nt, Human
aguuauuacucuuuaacauauu

SEQ ID NO: 927097 - RNA, 22 nt, Human
uucuuuucaagaggggcaagga

SEQ ID NO: 927098 - RNA, 22 nt, Human
aguccccucuaacccaacuuua

SEQ ID NO: 927099 - RNA, 22 nt, Human
gcuggccacauugugccguccu

SEQ ID NO: 927100 - RNA, 22 nt, Human
gcuuccuucuaccacaucaugc

SEQ ID NO: 927101 - RNA, 22 nt, Human
cugagaggcagccagagaaaau

SEQ ID NO: 927102 - RNA, 22 nt, Human
uacagagaugugaaaagcucua

SEQ ID NO: 927103 - RNA, 22 nt, Human
uaagcauaguaccguagcagcu

SEQ ID NO: 927104 - RNA, 22 nt, Human
acuuauagccagaauuaauuau

SEQ ID NO: 927105 - RNA, 22 nt, Human
ggcuuauauugcucuauucaca

SEQ ID NO: 927106 - RNA, 22 nt, Human
gcacaauaacagccaagguuau

SEQ ID NO: 927107 - RNA, 22 nt, Human
gguugcuggggguggcagagcu

SEQ ID NO: 927108 - RNA, 22 nt, Human
uucauagugcuuaauuugauaa

SEQ ID NO: 927109 - RNA, 22 nt, Human
ugaacagucaaaaagugaccau

SEQ ID NO: 927110 - RNA, 20 nt, Human
acauugauuauguuuguaga

SEQ ID NO: 927111 - RNA, 22 nt, Human
gaguaacauguauuggaaggcc

SEQ ID NO: 927112 - RNA, 22 nt, Human
uuuaguguagccuaagcagaau

SEQ ID NO: 927113 - RNA, 22 nt, Human
uucccacacaauuaagucauuu

SEQ ID NO: 927114 - RNA, 22 nt, Human
agugagcauucguuuggaaccc

SEQ ID NO: 927115 - RNA, 22 nt, Human
agauauguuuguauauauuugu

SEQ ID NO: 927116 - RNA, 22 nt, Human
cuucccuuuuuaugucuucagc

SEQ ID NO: 927117 - RNA, 22 nt, Human
uucaauaugauauuagcugugg

SEQ ID NO: 927118 - RNA, 22 nt, Human
cagaguggagauguguguggaa

SEQ ID NO: 927119 - RNA, 22 nt, Human
uacacacagaggccaugggauu

SEQ ID NO: 927120 - RNA, 22 nt, Human
ccaggcuggauuuugcaguuca

SEQ ID NO: 927121 - RNA, 22 nt, Human
uuccauaaucaccuuauucuuu

SEQ ID NO: 927122 - RNA, 22 nt, Human
ccaggcugaauauguuccaggg

SEQ ID NO: 927123 - RNA, 22 nt, Human
ugaacacuguauauucuucuug

SEQ ID NO: 927124 - RNA, 22 nt, Human
accuccccauuaggucacccac

SEQ ID NO: 927125 - RNA, 20 nt, Human
uuucuugucggcuguugcug

SEQ ID NO: 927126 - RNA, 22 nt, Human
ucaggccuuugaacuuggagug

SEQ ID NO: 927127 - RNA, 22 nt, Human
acaguguuuaagagauggcauu

SEQ ID NO: 927128 - RNA, 22 nt, Human
cacauuuauuugaggcuaauug

SEQ ID NO: 927129 - RNA, 22 nt, Human
uuccuugauuaguacaugaagg

SEQ ID NO: 927130 - RNA, 23 nt, Human
aacacauugcuaauuacauucaa

SEQ ID NO: 927131 - RNA, 22 nt, Human
ccauguugucaaacuuagagua

SEQ ID NO: 927132 - RNA, 22 nt, Human
guacaaaaguuauugcgguuuu

SEQ ID NO: 927133 - RNA, 22 nt, Human
aguauuugcauguuagggaccu

SEQ ID NO: 927134 - RNA, 22 nt, Human
uucaaguaaugcuacuccuaug

SEQ ID NO: 927135 - RNA, 22 nt, Human
acagagauggcacagagaaggu

SEQ ID NO: 927136 - RNA, 18 nt, Human
aggccugggaagcugagg

SEQ ID NO: 927137 - RNA, 22 nt, Human
gcugcucugugacagccuccgg

SEQ ID NO: 927138 - RNA, 22 nt, Human
ggagaaagcuguaguggaaugu

SEQ ID NO: 927139 - RNA, 22 nt, Human
ucugagaaugaguguuuucuua

SEQ ID NO: 927140 - RNA, 21 nt, Human
ccuagccucuuacccagcuuu

SEQ ID NO: 927141 - RNA, 22 nt, Human
auggaacagauuaaagugaggg

SEQ ID NO: 927142 - RNA, 22 nt, Human
cagccaccauacagcagaagcu

SEQ ID NO: 927143 - RNA, 22 nt, Human
ucuguagguuaaaaguagacaa

SEQ ID NO: 927144 - RNA, 22 nt, Human
auguggauuguaggaaacugau

SEQ ID NO: 927145 - RNA, 22 nt, Human
ucuguccauuuuccauuuuggc

SEQ ID NO: 927146 - RNA, 22 nt, Human
cuggaccagaaaggacauggcu

SEQ ID NO: 927147 - RNA, 22 nt, Human
auccucacauucucaggacaac

SEQ ID NO: 927148 - RNA, 22 nt, Human
cugaggccgucugggucugcag

SEQ ID NO: 927149 - RNA, 22 nt, Human
acagggcuauauuccucagagu

SEQ ID NO: 927150 - RNA, 22 nt, Human
gcugcucucucccuaaguuggg

SEQ ID NO: 927151 - RNA, 23 nt, Human
cugaggccugcugcguucagguu

SEQ ID NO: 927152 - RNA, 22 nt, Human
auuguugagugcuucagcugua

SEQ ID NO: 927153 - RNA, 22 nt, Human
gcagacaugggaucuauucaca

SEQ ID NO: 927154 - RNA, 22 nt, Human
uuggccuuugucaucaagauca

SEQ ID NO: 927155 - RNA, 22 nt, Human
ucauauuaggguaaugauaaga

SEQ ID NO: 927156 - RNA, 22 nt, Human
gagggccaggcggagacaggcg

SEQ ID NO: 927157 - RNA, 22 nt, Human
aauuucaaagcucacuggcaua

SEQ ID NO: 927158 - RNA, 22 nt, Human
ggggaagaccuggcacuacagc

SEQ ID NO: 927159 - RNA, 22 nt, Human
acaguuaggcacggguacagca

SEQ ID NO: 927160 - RNA, 22 nt, Human
uggaaggagcuaaggaccuggg

SEQ ID NO: 927161 - RNA, 22 nt, Human
uggcugaguaaguugugauaug

SEQ ID NO: 927162 - RNA, 22 nt, Human
gcaugcugcugaggcuggaaua

SEQ ID NO: 927163 - RNA, 22 nt, Human
aggacaaaggaccagaucugga

SEQ ID NO: 927164 - RNA, 22 nt, Human
aaagcaguauaaguaacggaag

SEQ ID NO: 927165 - RNA, 22 nt, Human
guuccuaaauuugaaggacuuu

SEQ ID NO: 927166 - RNA, 22 nt, Human
agcagcaggguguaauugggca

SEQ ID NO: 927167 - RNA, 22 nt, Human
aacagagcucugcucucagauu

SEQ ID NO: 927168 - RNA, 22 nt, Human
uucagccagucaucagucuugu

SEQ ID NO: 927169 - RNA, 22 nt, Human
gaaaggaaauauucuaagcacu

SEQ ID NO: 927170 - RNA, 22 nt, Human
agguuucuacuguguuaagaaa

SEQ ID NO: 927171 - RNA, 22 nt, Human
ccauuagaagauguaauagaga

SEQ ID NO: 927172 - RNA, 22 nt, Human
gauucucugcuaucuaucaccu

SEQ ID NO: 927173 - RNA, 22 nt, Human
uuguuaaaaugaggucauucug

SEQ ID NO: 927174 - RNA, 22 nt, Human
gcucccugaaaagaacaaaguc

SEQ ID NO: 927175 - RNA, 22 nt, Human
cuaauucuguauuuggucauug

SEQ ID NO: 927176 - RNA, 22 nt, Human
caguuucuucuauuuugaacua

SEQ ID NO: 927177 - RNA, 22 nt, Human
cugggcucagaaccuuguuaag

SEQ ID NO: 927178 - RNA, 22 nt, Human
gcagcugcuggagggaggcagg

SEQ ID NO: 927179 - RNA, 22 nt, Human
ugugaggaccucagcagagucu

SEQ ID NO: 927180 - RNA, 22 nt, Human
caguggaauacgagcagauguc

SEQ ID NO: 927181 - RNA, 22 nt, Human
ccacccagaccagggaucuggg

SEQ ID NO: 927182 - RNA, 22 nt, Human
auuucuucaggucagaaauaga

SEQ ID NO: 927183 - RNA, 22 nt, Human
uguuccgaccgugggguuugau

SEQ ID NO: 927184 - RNA, 21 nt, Human
aggcagaaagagcccaggcug

SEQ ID NO: 927185 - RNA, 17 nt, Human
gagacccccacuacacc

SEQ ID NO: 927186 - RNA, 22 nt, Human
caaauagguaaauguaugcugu

SEQ ID NO: 927187 - RNA, 22 nt, Human
agggugcagaaggagccuagga

SEQ ID NO: 927188 - RNA, 22 nt, Human
ugcaaaaagagcgaggagcccu

SEQ ID NO: 927189 - RNA, 22 nt, Human
uucagcaauuuuuuaagcuaau

SEQ ID NO: 927190 - RNA, 21 nt, Human
aagcuuuuccugagaguuguc

SEQ ID NO: 927191 - RNA, 22 nt, Human
acccaugugcucuuuuguaccc

SEQ ID NO: 927192 - RNA, 22 nt, Human
ugugaaccuuggugagucagua

SEQ ID NO: 927193 - RNA, 22 nt, Human
cuuagaaaugcagauucucagg

SEQ ID NO: 927194 - RNA, 22 nt, Human
cuggcucuucagugcuugguuc

SEQ ID NO: 927195 - RNA, 22 nt, Human
cucugcuuuccucuuacacacu

SEQ ID NO: 927196 - RNA, 22 nt, Human
aaguaacaggcaugugaaugac

SEQ ID NO: 927197 - RNA, 22 nt, Human
uuaaagaggcaugggaauguau

SEQ ID NO: 927198 - RNA, 22 nt, Human
cucagggaggccucugcugguu

SEQ ID NO: 927199 - RNA, 22 nt, Human
gaguuuguaaacuauucacuaa

SEQ ID NO: 927200 - RNA, 22 nt, Human
uucaauacaaagaaaggaauuu

SEQ ID NO: 927201 - RNA, 22 nt, Human
gcaugugggaacacuuaggcac

SEQ ID NO: 927202 - RNA, 22 nt, Human
cugcugugugaccauggacagg

SEQ ID NO: 927203 - RNA, 22 nt, Human
aaacaugagcacuugcuucaua

SEQ ID NO: 927204 - RNA, 22 nt, Human
uggaaugaauauguuuuaagga

SEQ ID NO: 927205 - RNA, 22 nt, Human
augcagggauuaaaugacugcc

SEQ ID NO: 927206 - RNA, 22 nt, Human
guccaucuguaggagggacaca

SEQ ID NO: 927207 - RNA, 22 nt, Human
ggucugugucauaggcugaguu

SEQ ID NO: 927208 - RNA, 22 nt, Human
uucuuggcuguucauggucagg

SEQ ID NO: 927209 - RNA, 20 nt, Human
acuuuaugaguucaauuuug

SEQ ID NO: 927210 - RNA, 22 nt, Human
ucauccaguaugacuggugucu

SEQ ID NO: 927211 - RNA, 22 nt, Human
gagaggcuggguuggagaucga

SEQ ID NO: 927212 - RNA, 18 nt, Human
aaaugcugcucaaauucc

SEQ ID NO: 927213 - RNA, 22 nt, Human
uagccucuggaauccuuucucu

SEQ ID NO: 927214 - RNA, 22 nt, Human
uccaagaagcuuacaaucuaau

SEQ ID NO: 927215 - RNA, 22 nt, Human
gaggcugcuuugaugacaggag

SEQ ID NO: 927216 - RNA, 22 nt, Human
uauacacacaugcuccggccuu

SEQ ID NO: 927217 - RNA, 22 nt, Human
auggcccaaacugcaauuacuu

SEQ ID NO: 927218 - RNA, 22 nt, Human
aaguuuggccaaggagacaugg

SEQ ID NO: 927219 - RNA, 22 nt, Human
agcaggugggaucaagcuggca

SEQ ID NO: 927220 - RNA, 22 nt, Human
ccucacagcuugggcaaacggc

SEQ ID NO: 927221 - RNA, 22 nt, Human
uauucaaagugcgaggucaggg

SEQ ID NO: 927222 - RNA, 19 nt, Human
caggcccuggacccaucug

SEQ ID NO: 927223 - RNA, 22 nt, Human
gcuucugaugucagacuucugg

SEQ ID NO: 927224 - RNA, 22 nt, Human
ucauauaaguuuaaaacuaucu

SEQ ID NO: 927225 - RNA, 22 nt, Human
aggugggcacuccgcucgaggu

SEQ ID NO: 927226 - RNA, 22 nt, Human
ucugggcugcuaugaggcagag

SEQ ID NO: 927227 - RNA, 22 nt, Human
ugugcucugaagagugcauguc

SEQ ID NO: 927228 - RNA, 22 nt, Human
aauggcagaaugggccagaagc

SEQ ID NO: 927229 - RNA, 22 nt, Human
acaggcccagcucuucaccaga

SEQ ID NO: 927230 - RNA, 22 nt, Human
aaagcacagggugcuagagagu

SEQ ID NO: 927231 - RNA, 22 nt, Human
cuggaagggucagagugaugag

SEQ ID NO: 927232 - RNA, 22 nt, Human
uggggcuggcuauugucucccu

SEQ ID NO: 927233 - RNA, 22 nt, Human
ugcagaguaaaagcagaugcua

SEQ ID NO: 927234 - RNA, 22 nt, Human
ucagaggaauuugcuuuucaug

SEQ ID NO: 927235 - RNA, 22 nt, Human
gaagcugugaacaagcuacgug

SEQ ID NO: 927236 - RNA, 22 nt, Human
ucucugugguacugagagucua

SEQ ID NO: 927237 - RNA, 20 nt, Human
aauccugggacagaggcagg

SEQ ID NO: 927238 - RNA, 19 nt, Human
ggcuaaugucuuugaaaua

SEQ ID NO: 927239 - RNA, 22 nt, Human
gggaucugauuuaggaugggag

SEQ ID NO: 927240 - RNA, 22 nt, Human
gagggccacguucagggcucuc

SEQ ID NO: 927241 - RNA, 22 nt, Human
ucaaugaagagauuuaaaucau

SEQ ID NO: 927242 - RNA, 22 nt, Human
gaaggagagggucaaggauaau

SEQ ID NO: 927243 - RNA, 22 nt, Human
agaggacacaucuuuccucaaa

SEQ ID NO: 927244 - RNA, 22 nt, Human
uuccuucuuccagaggcugccc

SEQ ID NO: 927245 - RNA, 22 nt, Human
agccugcuucccuuugugcccc

SEQ ID NO: 927246 - RNA, 22 nt, Human
acugagagucuuagaaacacau

SEQ ID NO: 927247 - RNA, 22 nt, Human
aauauuucuggugcuucucacu

SEQ ID NO: 927248 - RNA, 22 nt, Human
auuugaauggcuuaacacaacg

SEQ ID NO: 927249 - RNA, 22 nt, Human
auagcaccaugacuaaacaauu

SEQ ID NO: 927250 - RNA, 22 nt, Human
caagauuuggcaacuuugucau

SEQ ID NO: 927251 - RNA, 22 nt, Human
acagcagaccacuacuaguagg

SEQ ID NO: 927252 - RNA, 22 nt, Human
acaguggaaagaacauggauuu

SEQ ID NO: 927253 - RNA, 22 nt, Human
ugcaggccggcccuaggccuca

SEQ ID NO: 927254 - RNA, 22 nt, Human
uggcuucaggguugucuucagc

SEQ ID NO: 927255 - RNA, 20 nt, Human
gcucaggugacagucaggag

SEQ ID NO: 927256 - RNA, 22 nt, Human
augaagacaaacgacguugcaa

SEQ ID NO: 927257 - RNA, 22 nt, Human
caagggcugcuaucagcuacug

SEQ ID NO: 927258 - RNA, 17 nt, Human
gaacaguguaagacacu

SEQ ID NO: 927259 - RNA, 22 nt, Human
uggcacagaccuuaucuucucu

SEQ ID NO: 927260 - RNA, 22 nt, Human
uucuguggcugggagccuggcu

SEQ ID NO: 927261 - RNA, 22 nt, Human
cagccagaucagggcagggguu

SEQ ID NO: 927262 - RNA, 22 nt, Human
cuuguacauagagaagaagccu

SEQ ID NO: 927263 - RNA, 22 nt, Human
ccugggaggcggagguugcagg

SEQ ID NO: 927264 - RNA, 22 nt, Human
cuacagcuguguguuuaugugc

SEQ ID NO: 927265 - RNA, 23 nt, Human
ccccucugguggcucagcuccug

SEQ ID NO: 927266 - RNA, 22 nt, Human
gucugucccaauagccaacagg

SEQ ID NO: 927267 - RNA, 22 nt, Human
cugggcugagccugggcugugu

SEQ ID NO: 927268 - RNA, 22 nt, Human
caguauguccuuccucguuggc

SEQ ID NO: 927269 - RNA, 22 nt, Human
gaagagcauaugaagagcauau

SEQ ID NO: 927270 - RNA, 22 nt, Human
aaggccacagagccucagagag

SEQ ID NO: 927271 - RNA, 22 nt, Human
gaagacauguuuuuaauaugua

SEQ ID NO: 927272 - RNA, 22 nt, Human
cuccugucaauaggcuccuggc

SEQ ID NO: 927273 - RNA, 22 nt, Human
cugaggugcuauggaggauacg

SEQ ID NO: 927274 - RNA, 22 nt, Human
cugagguagccauggcccaagu

SEQ ID NO: 927275 - RNA, 22 nt, Human
agcagggacauggcaucucucc

SEQ ID NO: 927276 - RNA, 22 nt, Human
acagcucuucuucaagccuggc

SEQ ID NO: 927277 - RNA, 22 nt, Human
ugaaugauaugugaaaaggaac

SEQ ID NO: 927278 - RNA, 22 nt, Human
agaggggaguccuaaucugauu

SEQ ID NO: 927279 - RNA, 22 nt, Human
gccaggcaugggcuucugggcg

SEQ ID NO: 927280 - RNA, 21 nt, Human
cagaggguuucucagguguuu

SEQ ID NO: 927281 - RNA, 20 nt, Human
aggaggucaaauggaaucug

SEQ ID NO: 927282 - RNA, 22 nt, Human
cuucuuuagggaucucuugcug

SEQ ID NO: 927283 - RNA, 17 nt, Human
gugaauggcauagucgg

SEQ ID NO: 927284 - RNA, 22 nt, Human
acaguggaaagaaacgaauuag

SEQ ID NO: 927285 - RNA, 22 nt, Human
uuucauuucauagaauuguguu

SEQ ID NO: 927286 - RNA, 22 nt, Human
uggacccaggcaggucuguccu

SEQ ID NO: 927287 - RNA, 22 nt, Human
aagucuuuuugaaucuauaacu

SEQ ID NO: 927288 - RNA, 17 nt, Human
gaagguuucucuuaggu

SEQ ID NO: 927289 - RNA, 22 nt, Human
caaauguuauucauucuuguuu

SEQ ID NO: 927290 - RNA, 22 nt, Human
agcuggccuccgggugccuggg

SEQ ID NO: 927291 - RNA, 21 nt, Human
cuggagucuggggguggcagu

SEQ ID NO: 927292 - RNA, 22 nt, Human
ggcagcuguuggcucucuagga

SEQ ID NO: 927293 - RNA, 22 nt, Human
uucacauuauaaucaguucugc

SEQ ID NO: 927294 - RNA, 22 nt, Human
acggccuggugcagcaggucgc

SEQ ID NO: 927295 - RNA, 22 nt, Human
aagagauuucuguaaaauguaa

SEQ ID NO: 927296 - RNA, 22 nt, Human
aaaguguugggaagaaagugca

SEQ ID NO: 927297 - RNA, 22 nt, Human
gcccaggaucugcucagaucau

SEQ ID NO: 927298 - RNA, 22 nt, Human
auuuacuagggcuguuuaagua

SEQ ID NO: 927299 - RNA, 22 nt, Human
caugcacacacgugcauguacg

SEQ ID NO: 927300 - RNA, 22 nt, Human
gugaaugguugugaacaucuuu

SEQ ID NO: 927301 - RNA, 22 nt, Human
aguggcagagugcacucaggca

SEQ ID NO: 927302 - RNA, 22 nt, Human
ucagaaguuaauauauaaauuu

SEQ ID NO: 927303 - RNA, 22 nt, Human
uucacuaugcuuggaaacuucu

SEQ ID NO: 927304 - RNA, 22 nt, Human
aaaaguauggugguccuuuuua

SEQ ID NO: 927305 - RNA, 22 nt, Human
uuacacuaugaaugagaauaua

SEQ ID NO: 927306 - RNA, 22 nt, Human
aguaucauguuggaauuaauca

SEQ ID NO: 927307 - RNA, 19 nt, Human
gcugugugaccuugggcaa

SEQ ID NO: 927308 - RNA, 22 nt, Human
cugaaguuaacaucuugauguc

SEQ ID NO: 927309 - RNA, 22 nt, Human
ucaacagaagugauagcuauua

SEQ ID NO: 927310 - RNA, 22 nt, Human
uuuacuuucucaaguauauagg

SEQ ID NO: 927311 - RNA, 22 nt, Human
uuacacacagagcugggccugg

SEQ ID NO: 927312 - RNA, 22 nt, Human
aauugcauguuaaugacuaagu

SEQ ID NO: 927313 - RNA, 23 nt, Human
agugugacuuuuuugacugucac

SEQ ID NO: 927314 - RNA, 22 nt, Human
gcugagggaggcugaacugagu

SEQ ID NO: 927315 - RNA, 22 nt, Human
cagccagugugaccgaggagga

SEQ ID NO: 927316 - RNA, 22 nt, Human
cugaggccucacuguagucccu

SEQ ID NO: 927317 - RNA, 22 nt, Human
ucuucaggguaugggaaaggga

SEQ ID NO: 927318 - RNA, 22 nt, Human
uuucaagagaaaacuaaccuau

SEQ ID NO: 927319 - RNA, 22 nt, Human
auuauaaauauuuucuaggggu

SEQ ID NO: 927320 - RNA, 22 nt, Human
cugagguauuuuauugggcuag

SEQ ID NO: 927321 - RNA, 22 nt, Human
gaggagagaagcuaacggugcu

SEQ ID NO: 927322 - RNA, 22 nt, Human
ugcaaauagccuauauuuauag

SEQ ID NO: 927323 - RNA, 22 nt, Human
aaacagacugcacugccaguca

SEQ ID NO: 927324 - RNA, 23 nt, Human
uucuuacaaggcuggcccacuug

SEQ ID NO: 927325 - RNA, 22 nt, Human
uuuuguuuaaaauccuggaugg

SEQ ID NO: 927326 - RNA, 22 nt, Human
gacaggcuucaugauggcagga

SEQ ID NO: 927327 - RNA, 22 nt, Human
gggccugauuagcaggcuagcu

SEQ ID NO: 927328 - RNA, 22 nt, Human
caucacagauguuguguggagu

SEQ ID NO: 927329 - RNA, 19 nt, Human
cuggaaggagggacuguuc

SEQ ID NO: 927330 - RNA, 22 nt, Human
auucuagcucaucuacuuucca

SEQ ID NO: 927331 - RNA, 18 nt, Human
agcaugagucaggggugc

SEQ ID NO: 927332 - RNA, 22 nt, Human
ucaagacagugugauacuggcc

SEQ ID NO: 927333 - RNA, 22 nt, Human
ggcagugguuagaaacaugagc

SEQ ID NO: 927334 - RNA, 22 nt, Human
cagaagacagcuguuucacucg

SEQ ID NO: 927335 - RNA, 22 nt, Human
ccacacagucaguuuccaagaa

SEQ ID NO: 927336 - RNA, 21 nt, Human
uuccacaguccugaggauuca

SEQ ID NO: 927337 - RNA, 22 nt, Human
cacauucuuucacaguucugaa

SEQ ID NO: 927338 - RNA, 22 nt, Human
gagcuggcuccgccaugcugcu

SEQ ID NO: 927339 - RNA, 22 nt, Human
ugucagcauugcgucacugagc

SEQ ID NO: 927340 - RNA, 22 nt, Human
aggcccaguccucugccgucug

SEQ ID NO: 927341 - RNA, 22 nt, Human
ugucacuucaggaaugcaggga

SEQ ID NO: 927342 - RNA, 22 nt, Human
agcagccucccagggagcagcc

SEQ ID NO: 927343 - RNA, 22 nt, Human
gagagggcugccuggugugagg

SEQ ID NO: 927344 - RNA, 22 nt, Human
auugacaggucuuugggaguau

SEQ ID NO: 927345 - RNA, 22 nt, Human
ggcaauuuggucauuuguauug

SEQ ID NO: 927346 - RNA, 22 nt, Human
uccuuggcaagacacagcacag

SEQ ID NO: 927347 - RNA, 22 nt, Human
uaaugucagcauaguuuauuuu

SEQ ID NO: 927348 - RNA, 22 nt, Human
cuguauuuuuuaagugaucugg

SEQ ID NO: 927349 - RNA, 22 nt, Human
ccccacacucuuuacauucaua

SEQ ID NO: 927350 - RNA, 22 nt, Human
ucuucuuaugugccauuaucuc

SEQ ID NO: 927351 - RNA, 22 nt, Human
uugcaauuaacauaugucaacu

SEQ ID NO: 927352 - RNA, 22 nt, Human
uucagaaggugcagccugggcc

SEQ ID NO: 927353 - RNA, 19 nt, Human
uuucuaguuucagcuuguc

SEQ ID NO: 927354 - RNA, 22 nt, Human
gcaggaguuaaaauauguaaug

SEQ ID NO: 927355 - RNA, 22 nt, Human
uuaaacaccugucuaguguagc

SEQ ID NO: 927356 - RNA, 22 nt, Human
uucaaaucccugcuccacuauu

SEQ ID NO: 927357 - RNA, 22 nt, Human
acuuucuaaaauugcuagcacu

SEQ ID NO: 927358 - RNA, 22 nt, Human
caggcugcuccaggguaggaaa

SEQ ID NO: 927359 - RNA, 22 nt, Human
uuucaagugacuaugguuuuug

SEQ ID NO: 927360 - RNA, 22 nt, Human
uuuuaugugcuggacuggcagu

SEQ ID NO: 927361 - RNA, 22 nt, Human
cuggcaggagcauucacagagg

SEQ ID NO: 927362 - RNA, 17 nt, Human
uauauguaugccucucc

SEQ ID NO: 927363 - RNA, 22 nt, Human
auguuugacugaguuuggcaga

SEQ ID NO: 927364 - RNA, 22 nt, Human
caucuugcuguuauguuuaugu

SEQ ID NO: 927365 - RNA, 22 nt, Human
gccuggagcccaguguggggcu

SEQ ID NO: 927366 - RNA, 22 nt, Human
gacuggagauaaaaccaugagu

SEQ ID NO: 927367 - RNA, 22 nt, Human
ugcucugucaagaaaagaugcc

SEQ ID NO: 927368 - RNA, 22 nt, Human
cucccagaaaauucucagacaa

SEQ ID NO: 927369 - RNA, 22 nt, Human
uuggcaaaauuuaaagaaguga

SEQ ID NO: 927370 - RNA, 22 nt, Human
acaguucuuuguuuauagcuug

SEQ ID NO: 927371 - RNA, 22 nt, Human
ccuucaaauucucuuagcugaa

SEQ ID NO: 927372 - RNA, 22 nt, Human
aaauucuaugucaauguuuauu

SEQ ID NO: 927373 - RNA, 22 nt, Human
agccuugcagaauaauuugaag

SEQ ID NO: 927374 - RNA, 22 nt, Human
uggcugucagucgccugcauuc

SEQ ID NO: 927375 - RNA, 22 nt, Human
ugaccuccaauaccuuucuucc

SEQ ID NO: 927376 - RNA, 20 nt, Human
acugugaaugcugaauuagc

SEQ ID NO: 927377 - RNA, 22 nt, Human
acaguacagcugaaacuuuagu

SEQ ID NO: 927378 - RNA, 22 nt, Human
gggagcugccuuagaccggagg

SEQ ID NO: 927379 - RNA, 22 nt, Human
gccagcauccugguggugguug

SEQ ID NO: 927380 - RNA, 22 nt, Human
uucuacagugacugcagccaua

SEQ ID NO: 927381 - RNA, 22 nt, Human
uacauugcuuucuaauacaucu

SEQ ID NO: 927382 - RNA, 22 nt, Human
uuucaggagagaccagaaauga

SEQ ID NO: 927383 - RNA, 22 nt, Human
ugcuaaauucauuauugauuua

SEQ ID NO: 927384 - RNA, 20 nt, Human
uauuggaucuaagaaauggg

SEQ ID NO: 927385 - RNA, 22 nt, Human
ugacacaaacaagauauuugcc

SEQ ID NO: 927386 - RNA, 21 nt, Human
ggaauugcaggcugucuuuug

SEQ ID NO: 927387 - RNA, 19 nt, Human
agcaccugugagagccugg

SEQ ID NO: 927388 - RNA, 23 nt, Human
gcugcagcuguggauguucucag

SEQ ID NO: 927389 - RNA, 22 nt, Human
uuucaauuccaccaaagcgccc

SEQ ID NO: 927390 - RNA, 22 nt, Human
uacagagauacucuagaucaaa

SEQ ID NO: 927391 - RNA, 22 nt, Human
uuuggcucugcgucuucaccca

SEQ ID NO: 927392 - RNA, 22 nt, Human
gcuccucccugugcagacccag

SEQ ID NO: 927393 - RNA, 22 nt, Human
ggcuggccucuacagggaggca

SEQ ID NO: 927394 - RNA, 22 nt, Human
gcuggagcugcagccugggccu

SEQ ID NO: 927395 - RNA, 22 nt, Human
gugggccuugcagggugcaggg

SEQ ID NO: 927396 - RNA, 22 nt, Human
cagcaggguuaagugacucacc

SEQ ID NO: 927397 - RNA, 22 nt, Human
agaacucuaggauuggcuggau

SEQ ID NO: 927398 - RNA, 18 nt, Human
uucacaggaaaugucuuu

SEQ ID NO: 927399 - RNA, 21 nt, Human
ccuuuagauuucuaugcaguu

SEQ ID NO: 927400 - RNA, 22 nt, Human
cuggagugaagcuuauuuuuca

SEQ ID NO: 927401 - RNA, 22 nt, Human
aauguucagugccuuuaaacau

SEQ ID NO: 927402 - RNA, 22 nt, Human
ugguccugccccgugcacagag

SEQ ID NO: 927403 - RNA, 18 nt, Human
ucuuuguuuccuucuugc

SEQ ID NO: 927404 - RNA, 22 nt, Human
aagauucuugacuagaaugauu

SEQ ID NO: 927405 - RNA, 22 nt, Human
guggccauuuggaaggcaagua

SEQ ID NO: 927406 - RNA, 22 nt, Human
auggacagacacuggccuucug

SEQ ID NO: 927407 - RNA, 22 nt, Human
ggcuccaguuuccccuuggggc

SEQ ID NO: 927408 - RNA, 22 nt, Human
gcugcccagcaggccccagggg

SEQ ID NO: 927409 - RNA, 21 nt, Human
uggggaggggaccugauuaug

SEQ ID NO: 927410 - RNA, 22 nt, Human
ccagcugugccguguggauagc

SEQ ID NO: 927411 - RNA, 22 nt, Human
ccugcugucccucugggcucca

SEQ ID NO: 927412 - RNA, 22 nt, Human
caccccagucuaaaaccagccu

SEQ ID NO: 927413 - RNA, 22 nt, Human
aaugguuuuugcauauucaggu

SEQ ID NO: 927414 - RNA, 22 nt, Human
ucuuuauguuuacuccagcuga

SEQ ID NO: 927415 - RNA, 22 nt, Human
uguccauaccuuuaccugugua

SEQ ID NO: 927416 - RNA, 22 nt, Human
auaaagcaagcauaccauuaag

SEQ ID NO: 927417 - RNA, 22 nt, Human
augauuuucugauaaagaacug

SEQ ID NO: 927418 - RNA, 22 nt, Human
agggggugcccagaugaaggau

SEQ ID NO: 927419 - RNA, 22 nt, Human
auagcuguuuuuaggccaaaua

SEQ ID NO: 927420 - RNA, 22 nt, Human
gaguccagcagaaugagccaag

SEQ ID NO: 927421 - RNA, 22 nt, Human
cacagugaccucuuuaaaaggg

SEQ ID NO: 927422 - RNA, 22 nt, Human
aaguuucauuguucauguaaca

SEQ ID NO: 927423 - RNA, 22 nt, Human
uggcugagagucauccugugug

SEQ ID NO: 927424 - RNA, 22 nt, Human
aggcagaggaaggguggauuug

SEQ ID NO: 927425 - RNA, 22 nt, Human
ucaaacuugguaagagaaauac

SEQ ID NO: 927426 - RNA, 17 nt, Human
uguccauuugccuggag

SEQ ID NO: 927427 - RNA, 22 nt, Human
ucugaaauaggcuucuuuuggu

SEQ ID NO: 927428 - RNA, 22 nt, Human
ucuguguugagaaggaucauga

SEQ ID NO: 927429 - RNA, 22 nt, Human
ucccugugggcagaggcugccu

SEQ ID NO: 927430 - RNA, 22 nt, Human
ggcccagcugggcggggacacg

SEQ ID NO: 927431 - RNA, 21 nt, Human
acuugaaguuggaguuucugu

SEQ ID NO: 927432 - RNA, 22 nt, Human
ucucaggaucuaauacauggua

SEQ ID NO: 927433 - RNA, 22 nt, Human
agaggcacagaggcaguccccu

SEQ ID NO: 927434 - RNA, 22 nt, Human
ccaggguguagggauuccagau

SEQ ID NO: 927435 - RNA, 22 nt, Human
ucccugugacaagucugaguuc

SEQ ID NO: 927436 - RNA, 22 nt, Human
auguguguaugugccuauaucu

SEQ ID NO: 927437 - RNA, 22 nt, Human
aaugggauaauagaaguagaau

SEQ ID NO: 927438 - RNA, 22 nt, Human
ccugucacuguugcagccagcu

SEQ ID NO: 927439 - RNA, 22 nt, Human
gaaccacaagauucaaaggggu

SEQ ID NO: 927440 - RNA, 22 nt, Human
guuaaugucuuccuauucuaca

SEQ ID NO: 927441 - RNA, 22 nt, Human
gaaacuuuggcuaaaagccaga

SEQ ID NO: 927442 - RNA, 22 nt, Human
acugggacuguaugugcuggac

SEQ ID NO: 927443 - RNA, 22 nt, Human
acagacauuuuaagacacuuua

SEQ ID NO: 927444 - RNA, 21 nt, Human
ugacagcauagagcagggagg

SEQ ID NO: 927445 - RNA, 22 nt, Human
aaccugaaacuacauucuugau

SEQ ID NO: 927446 - RNA, 22 nt, Human
aagagauguugaaguuuauuag

SEQ ID NO: 927447 - RNA, 18 nt, Human
auuaaggaauucuuuaga

SEQ ID NO: 927448 - RNA, 22 nt, Human
gaaauaauuuagaagguauucc

SEQ ID NO: 927449 - RNA, 21 nt, Human
acagggcuucagggaggguua

SEQ ID NO: 927450 - RNA, 22 nt, Human
cagacuuuugacauuaauacag

SEQ ID NO: 927451 - RNA, 22 nt, Human
gaggcugcaggcaaugcugccc

SEQ ID NO: 927452 - RNA, 22 nt, Human
gagacacaggcacagaagaggc

SEQ ID NO: 927453 - RNA, 22 nt, Human
ggcaguguggccugaguaaguc

SEQ ID NO: 927454 - RNA, 22 nt, Human
cuguccauuuucgugccuccuu

SEQ ID NO: 927455 - RNA, 22 nt, Human
acugccuguagcccugagaugu

SEQ ID NO: 927456 - RNA, 22 nt, Human
gagaggcugacuggcuguccug

SEQ ID NO: 927457 - RNA, 22 nt, Human
uaaaggcuuuuagugaugguaa

SEQ ID NO: 927458 - RNA, 22 nt, Human
uuccucagagggcgcuggggaa

SEQ ID NO: 927459 - RNA, 22 nt, Human
gguucagggcuaccagugggug

SEQ ID NO: 927460 - RNA, 22 nt, Human
aaagauuccuuuauucuccaag

SEQ ID NO: 927461 - RNA, 22 nt, Human
uagaaccuccacaggaccucca

SEQ ID NO: 927462 - RNA, 22 nt, Human
ccuggggaaucuugcaggggaa

SEQ ID NO: 927463 - RNA, 19 nt, Human
gcagagugggguggagggu

SEQ ID NO: 927464 - RNA, 22 nt, Human
agggaagcuuguuacugagaag

SEQ ID NO: 927465 - RNA, 22 nt, Human
acaguggaauuuguagaugugu

SEQ ID NO: 927466 - RNA, 22 nt, Human
aguggaggcacuaauuggauuu

SEQ ID NO: 927467 - RNA, 22 nt, Human
caaaggcucaguaaaucuuugu

SEQ ID NO: 927468 - RNA, 22 nt, Human
aggaggggcaaugauagucugg

SEQ ID NO: 927469 - RNA, 22 nt, Human
agggcucucuuggacaacugcu

SEQ ID NO: 927470 - RNA, 22 nt, Human
uggcuucugucccugcuacauu

SEQ ID NO: 927471 - RNA, 22 nt, Human
uaaguucucagaagauuuugua

SEQ ID NO: 927472 - RNA, 22 nt, Human
uucucuaaacauauuggaucug

SEQ ID NO: 927473 - RNA, 18 nt, Human
uagauuaaaauugaauuc

SEQ ID NO: 927474 - RNA, 22 nt, Human
ucucccaggugggugccuggag

SEQ ID NO: 927475 - RNA, 18 nt, Human
aguugcuuauucugugca

SEQ ID NO: 927476 - RNA, 22 nt, Human
ucagugucacaggaugcuaugc

SEQ ID NO: 927477 - RNA, 22 nt, Human
uuagcaauugauucucauaagc

SEQ ID NO: 927478 - RNA, 22 nt, Human
ucaguuuuguauguuguaaguc

SEQ ID NO: 927479 - RNA, 22 nt, Human
aacuacagcucuugucuuucug

SEQ ID NO: 927480 - RNA, 22 nt, Human
ggcaagaaggcuucagguagcu

SEQ ID NO: 927481 - RNA, 19 nt, Human
agcaaauauaauaguguuc

SEQ ID NO: 927482 - RNA, 22 nt, Human
ugugaaaagggcuuuguacaaa

SEQ ID NO: 927483 - RNA, 22 nt, Human
cuccccaccuucgcggucccug

SEQ ID NO: 927484 - RNA, 19 nt, Human
uggcagcauugguaccuug

SEQ ID NO: 927485 - RNA, 22 nt, Human
auucagaauuuuggggagcuaa

SEQ ID NO: 927486 - RNA, 22 nt, Human
aguuauauuccauagauucaga

SEQ ID NO: 927487 - RNA, 22 nt, Human
uuacccagugugguuuauagca

SEQ ID NO: 927488 - RNA, 22 nt, Human
gugugccacugccugaggaccc

SEQ ID NO: 927489 - RNA, 22 nt, Human
ccaugccccaauacaggacacc

SEQ ID NO: 927490 - RNA, 22 nt, Human
cuucuucaucuguaaaacuugg

SEQ ID NO: 927491 - RNA, 22 nt, Human
auccagagagguuaggugacau

SEQ ID NO: 927492 - RNA, 22 nt, Human
cacccacugagcucauguccca

SEQ ID NO: 927493 - RNA, 20 nt, Human
ccagaggguagggccgcccc

SEQ ID NO: 927494 - RNA, 22 nt, Human
uaaauuuacccaaggaacaugu

SEQ ID NO: 927495 - RNA, 17 nt, Human
gucugggcuuuagagac

SEQ ID NO: 927496 - RNA, 22 nt, Human
uguaauauaagcauuaauaguu

SEQ ID NO: 927497 - RNA, 22 nt, Human
cccuggggcugagggauggccg

SEQ ID NO: 927498 - RNA, 22 nt, Human
ggcagcaagguggcggaaauga

SEQ ID NO: 927499 - RNA, 22 nt, Human
gcagccaccucccauggcgggg

SEQ ID NO: 927500 - RNA, 22 nt, Human
cacgccagccggacacugggcc

SEQ ID NO: 927501 - RNA, 22 nt, Human
uuuggaaacaucucagaaaaua

SEQ ID NO: 927502 - RNA, 22 nt, Human
uguacuuaugagauccuagucg

SEQ ID NO: 927503 - RNA, 22 nt, Human
ggcaagugugagaagggacugg

SEQ ID NO: 927504 - RNA, 22 nt, Human
cccugggcagucugcacuucag

SEQ ID NO: 927505 - RNA, 22 nt, Human
agcugccaggccccugagaacc

SEQ ID NO: 927506 - RNA, 22 nt, Human
agaaccuucagauuaggaggug

SEQ ID NO: 927507 - RNA, 22 nt, Human
auacacauauauacacguuuaa

SEQ ID NO: 927508 - RNA, 22 nt, Human
uggcucaguuaggucagaaaca

SEQ ID NO: 927509 - RNA, 22 nt, Human
cagucacuuacaaaaauauaau

SEQ ID NO: 927510 - RNA, 23 nt, Human
aggcagugggggccacuuugcuu

SEQ ID NO: 927511 - RNA, 22 nt, Human
uaaucucucuaaguuuccauuu

SEQ ID NO: 927512 - RNA, 22 nt, Human
agcagcuuagggaauucucccu

SEQ ID NO: 927513 - RNA, 22 nt, Human
caucuuugaacucuguauaaac

SEQ ID NO: 927514 - RNA, 22 nt, Human
uaauguguugaauauuuguaca

SEQ ID NO: 927515 - RNA, 22 nt, Human
cuuggcuuuagaacaugggagc

SEQ ID NO: 927516 - RNA, 22 nt, Human
uagggcaggggaggaaucugaa

SEQ ID NO: 927517 - RNA, 22 nt, Human
uggcagcacuugaacuugagcc

SEQ ID NO: 927518 - RNA, 22 nt, Human
gagccuggacaucucaggccca

SEQ ID NO: 927519 - RNA, 22 nt, Human
gaauacauguuguuucccugga

SEQ ID NO: 927520 - RNA, 22 nt, Human
cauuuguacuguucaaugucau

SEQ ID NO: 927521 - RNA, 22 nt, Human
cugcuguguuucacaccucugg

SEQ ID NO: 927522 - RNA, 22 nt, Human
uaagaaacuuaacugggaacua

SEQ ID NO: 927523 - RNA, 22 nt, Human
cucuuucuggaaggcagagugg

SEQ ID NO: 927524 - RNA, 22 nt, Human
ccuccagguguuacauaugacu

SEQ ID NO: 927525 - RNA, 19 nt, Human
aucuaagagaugggggaaa

SEQ ID NO: 927526 - RNA, 22 nt, Human
uggcuggcuagugggcaggauu

SEQ ID NO: 927527 - RNA, 22 nt, Human
cuucaugguaaaucugccuuua

SEQ ID NO: 927528 - RNA, 22 nt, Human
agauuucuguggucauguaaug

SEQ ID NO: 927529 - RNA, 22 nt, Human
ugugaaaucugaacucaaagau

SEQ ID NO: 927530 - RNA, 22 nt, Human
ucuguacacuucagcaugcauc

SEQ ID NO: 927531 - RNA, 22 nt, Human
gagccagccuucuucugagguc

SEQ ID NO: 927532 - RNA, 22 nt, Human
gccugcugccacccuggcuccg

SEQ ID NO: 927533 - RNA, 22 nt, Human
gaggcugaauggccagaagcca

SEQ ID NO: 927534 - RNA, 22 nt, Human
auaacacuaaauguauguaaca

SEQ ID NO: 927535 - RNA, 22 nt, Human
ugaagacagggucuuuaacgag

SEQ ID NO: 927536 - RNA, 22 nt, Human
aagguaaucagccuuuccacaa

SEQ ID NO: 927537 - RNA, 20 nt, Human
gcauugaguauagacagaug

SEQ ID NO: 927538 - RNA, 22 nt, Human
aggcaggagcaagcccuacaag

SEQ ID NO: 927539 - RNA, 22 nt, Human
cugccagcuggagaccaaggaa

SEQ ID NO: 927540 - RNA, 22 nt, Human
caugggggcugaggcugcugua

SEQ ID NO: 927541 - RNA, 22 nt, Human
ucucagggccucccucuguuuc

SEQ ID NO: 927542 - RNA, 22 nt, Human
agaauuagguaaguucaucuga

SEQ ID NO: 927543 - RNA, 22 nt, Human
caagugugacuauuuuuucaua

SEQ ID NO: 927544 - RNA, 22 nt, Human
aaccaugaauggguucuggugu

SEQ ID NO: 927545 - RNA, 22 nt, Human
uacauuuauaaggcuucucugu

SEQ ID NO: 927546 - RNA, 22 nt, Human
aaagcaagaugcauccgucaag

SEQ ID NO: 927547 - RNA, 22 nt, Human
aacaaaggccguuaauaaccac

SEQ ID NO: 927548 - RNA, 22 nt, Human
ccugcugguuuuuacaaagaug

SEQ ID NO: 927549 - RNA, 22 nt, Human
ggccccaguucacuccuggccg

SEQ ID NO: 927550 - RNA, 22 nt, Human
ccucaagaacaauccaccauua

SEQ ID NO: 927551 - RNA, 22 nt, Human
ugggcugcccugaugguccuca

SEQ ID NO: 927552 - RNA, 22 nt, Human
acccucuggcucauuuccuagu

SEQ ID NO: 927553 - RNA, 22 nt, Human
uggcagacacugucgaagccua

SEQ ID NO: 927554 - RNA, 22 nt, Human
aaaagcauuacaugguacguau

SEQ ID NO: 927555 - RNA, 22 nt, Human
aagagagggguugcauggaaau

SEQ ID NO: 927556 - RNA, 22 nt, Human
gagacaaaaguuggagugcaag

SEQ ID NO: 927557 - RNA, 22 nt, Human
ugcagcaggcacaggacggaag

SEQ ID NO: 927558 - RNA, 22 nt, Human
auucagugucuugaucugggaa

SEQ ID NO: 927559 - RNA, 22 nt, Human
cugccaggcgauggauuggcug

SEQ ID NO: 927560 - RNA, 22 nt, Human
gaaggcaagugcuccuuggguc

SEQ ID NO: 927561 - RNA, 17 nt, Human
gcucccugaggacagcu

SEQ ID NO: 927562 - RNA, 22 nt, Human
gagcugcaugcaacucgaaaau

SEQ ID NO: 927563 - RNA, 22 nt, Human
uauauuaaacccucucuguagg

SEQ ID NO: 927564 - RNA, 22 nt, Human
cuguuauuccccuugcuguggu

SEQ ID NO: 927565 - RNA, 20 nt, Human
uucagagauagggucuuuaa

SEQ ID NO: 927566 - RNA, 22 nt, Human
uaaauacagucauuugagccau

SEQ ID NO: 927567 - RNA, 22 nt, Human
auaaagcaauagauuguguaau

SEQ ID NO: 927568 - RNA, 22 nt, Human
agaacacucuccugaaaauuaa

SEQ ID NO: 927569 - RNA, 22 nt, Human
ugcagaagcagagaguugccaa

SEQ ID NO: 927570 - RNA, 22 nt, Human
gugugcaugaggauaggaauaa

SEQ ID NO: 927571 - RNA, 22 nt, Human
uaauuuugcugugaccauugaa

SEQ ID NO: 927572 - RNA, 21 nt, Human
acauggacugugaauggggac

SEQ ID NO: 927573 - RNA, 22 nt, Human
ggcaggugaccuggccucccag

SEQ ID NO: 927574 - RNA, 22 nt, Human
guuuacaugcagaaaaucaaug

SEQ ID NO: 927575 - RNA, 22 nt, Human
acauuaaagaguaagguuaguu

SEQ ID NO: 927576 - RNA, 23 nt, Human
agcugaggugcagauccaaagaa

SEQ ID NO: 927577 - RNA, 22 nt, Human
ugaguucaaguccaaguugcug

SEQ ID NO: 927578 - RNA, 22 nt, Human
cuagccugggauuugaacuuau

SEQ ID NO: 927579 - RNA, 22 nt, Human
ugcucaguccuaccuuggcucc

SEQ ID NO: 927580 - RNA, 20 nt, Human
agcugcccuuuucacauguu

SEQ ID NO: 927581 - RNA, 22 nt, Human
aaaugcagguucuugagccaag

SEQ ID NO: 927582 - RNA, 23 nt, Human
ugucuuaucuagcuucuagaggc

SEQ ID NO: 927583 - RNA, 23 nt, Human
aaggccagaauuucaauggugcc

SEQ ID NO: 927584 - RNA, 22 nt, Human
ccaaagugauaugugcuguaag

SEQ ID NO: 927585 - RNA, 22 nt, Human
gugccucccggggcucuuccuu

SEQ ID NO: 927586 - RNA, 22 nt, Human
caagugagugaccagaguuggu

SEQ ID NO: 927587 - RNA, 22 nt, Human
guuuccugaaguuauuucaucc

SEQ ID NO: 927588 - RNA, 22 nt, Human
acaguaggaauagauguagaua

SEQ ID NO: 927589 - RNA, 22 nt, Human
gcagcugccgugagcucacgcc

SEQ ID NO: 927590 - RNA, 22 nt, Human
gacccagcuuaagucacauguu

SEQ ID NO: 927591 - RNA, 22 nt, Human
uuugaagaccuuaucucuaaau

SEQ ID NO: 927592 - RNA, 17 nt, Human
cucuggggacaguucua

SEQ ID NO: 927593 - RNA, 22 nt, Human
aagugcuuuauaaacaaugaag

SEQ ID NO: 927594 - RNA, 22 nt, Human
cccugauggccuaucuggcagu

SEQ ID NO: 927595 - RNA, 22 nt, Human
ucaugaaaaauuuuccauguca

SEQ ID NO: 927596 - RNA, 22 nt, Human
agucugggaggcuuauaaacag

SEQ ID NO: 927597 - RNA, 22 nt, Human
acucaucagccucuaggaaaga

SEQ ID NO: 927598 - RNA, 22 nt, Human
gccuggaguacuccuugaagug

SEQ ID NO: 927599 - RNA, 22 nt, Human
accagggcaaauguuuguacuc

SEQ ID NO: 927600 - RNA, 22 nt, Human
aaacaguaaguucuaguauuau

SEQ ID NO: 927601 - RNA, 22 nt, Human
gaggccacggaagggagcugug

SEQ ID NO: 927602 - RNA, 22 nt, Human
guauuauuaaguguauuugacc

SEQ ID NO: 927603 - RNA, 20 nt, Human
ggaauugcuuuccugucuuu

SEQ ID NO: 927604 - RNA, 22 nt, Human
gaaguuuauggugcuuguaagg

SEQ ID NO: 927605 - RNA, 22 nt, Human
ucaucugugaauaaugaacugg

SEQ ID NO: 927606 - RNA, 22 nt, Human
ucccccuccaauugccauguua

SEQ ID NO: 927607 - RNA, 22 nt, Human
ugguuagaggcuucuugcuugg

SEQ ID NO: 927608 - RNA, 22 nt, Human
ucuguccaggucagccuacauu

SEQ ID NO: 927609 - RNA, 23 nt, Human
uauuuuccaaaugaugacuacau

SEQ ID NO: 927610 - RNA, 20 nt, Human
ugauucuggucuacgcuuua

SEQ ID NO: 927611 - RNA, 22 nt, Human
uuggauucuguuaggcaccuuc

SEQ ID NO: 927612 - RNA, 22 nt, Human
aggccagggccagauuagccac

SEQ ID NO: 927613 - RNA, 22 nt, Human
ucuucauguauacucaugguac

SEQ ID NO: 927614 - RNA, 22 nt, Human
uuccaggagacuuccagaaaua

SEQ ID NO: 927615 - RNA, 22 nt, Human
agagucaaaauuuaccagaaug

SEQ ID NO: 927616 - RNA, 22 nt, Human
aggcuucaccagacucuuaauc

SEQ ID NO: 927617 - RNA, 22 nt, Human
ucagcugugauccaucuaucua

SEQ ID NO: 927618 - RNA, 20 nt, Human
cucaggauacugcaaaguug

SEQ ID NO: 927619 - RNA, 22 nt, Human
ggcuccuguccuccuggagcuc

SEQ ID NO: 927620 - RNA, 22 nt, Human
ucagugcauucauggguggcug

SEQ ID NO: 927621 - RNA, 22 nt, Human
ucuccaggggcugcugugccac

SEQ ID NO: 927622 - RNA, 22 nt, Human
uccugaggugcucagccaggaa

SEQ ID NO: 927623 - RNA, 23 nt, Human
uuuaacauuugaacauguggcca

SEQ ID NO: 927624 - RNA, 20 nt, Human
uguccuaauagacaagcaga

SEQ ID NO: 927625 - RNA, 22 nt, Human
cagacacuuauugagcaaguac

SEQ ID NO: 927626 - RNA, 22 nt, Human
ccaguguguuuuucucugacuc

SEQ ID NO: 927627 - RNA, 22 nt, Human
uuaccuguaaaacugcgauaua

SEQ ID NO: 927628 - RNA, 22 nt, Human
acauuucugcauguaggguaau

SEQ ID NO: 927629 - RNA, 20 nt, Human
cuuucucuaauuuauaagua

SEQ ID NO: 927630 - RNA, 22 nt, Human
uucaccauguaaaccauguggc

SEQ ID NO: 927631 - RNA, 22 nt, Human
uucuaagucacucagauuuugg

SEQ ID NO: 927632 - RNA, 22 nt, Human
uuguuuuccugggauaccaacc

SEQ ID NO: 927633 - RNA, 22 nt, Human
uguucaaaucuuuugcuuauuu

SEQ ID NO: 927634 - RNA, 22 nt, Human
uaucuauaaguacuaacauggu

SEQ ID NO: 927635 - RNA, 22 nt, Human
caaugcuuuauuuccuccccuu

SEQ ID NO: 927636 - RNA, 22 nt, Human
auauuacacacgguaucacggg

SEQ ID NO: 927637 - RNA, 22 nt, Human
uggcugcuuaaaauugcugcaa

SEQ ID NO: 927638 - RNA, 22 nt, Human
accaggccaaaaucauauuuac

SEQ ID NO: 927639 - RNA, 22 nt, Human
agagcagagggcucugggacaa

SEQ ID NO: 927640 - RNA, 22 nt, Human
gcacagaaaugucuacacaugu

SEQ ID NO: 927641 - RNA, 22 nt, Human
agcuaggagauuuugugaggcu

SEQ ID NO: 927642 - RNA, 22 nt, Human
ggcagguguggaguguuauuuu

SEQ ID NO: 927643 - RNA, 22 nt, Human
ggcacaauugcagcaauaaaca

SEQ ID NO: 927644 - RNA, 22 nt, Human
ucaggagacuggcagugcccac

SEQ ID NO: 927645 - RNA, 22 nt, Human
caccaucugguaggcauuagug

SEQ ID NO: 927646 - RNA, 19 nt, Human
ccugcugcaccacuuguua

SEQ ID NO: 927647 - RNA, 22 nt, Human
aucugcuggcaucucuagccca

SEQ ID NO: 927648 - RNA, 22 nt, Human
uuugucauauugaaggugcuua

SEQ ID NO: 927649 - RNA, 23 nt, Human
uccuuccuuugagaggcuccauc

SEQ ID NO: 927650 - RNA, 22 nt, Human
ccagaaaauauggcuaagguga

SEQ ID NO: 927651 - RNA, 22 nt, Human
ggagcuggcccucugaguuugu

SEQ ID NO: 927652 - RNA, 22 nt, Human
gaaaaguucaucauauauucag

SEQ ID NO: 927653 - RNA, 19 nt, Human
auuucaagagguuuauugg

SEQ ID NO: 927654 - RNA, 22 nt, Human
gaguuauauuugcgauauugga

SEQ ID NO: 927655 - RNA, 22 nt, Human
caucugucuuuuguuacaaggc

SEQ ID NO: 927656 - RNA, 22 nt, Human
cacaguaacuccugaccccucg

SEQ ID NO: 927657 - RNA, 22 nt, Human
cccuuccuccucgccugucaga

SEQ ID NO: 927658 - RNA, 22 nt, Human
ucugggugucacuccugccugc

SEQ ID NO: 927659 - RNA, 22 nt, Human
agaaaacugggaggagagcuuc

SEQ ID NO: 927660 - RNA, 22 nt, Human
acuguggcaaaagaacauugga

SEQ ID NO: 927661 - RNA, 22 nt, Human
ugcagcugcucuucauuucccc

SEQ ID NO: 927662 - RNA, 22 nt, Human
guuauuuucauuggcucagacu

SEQ ID NO: 927663 - RNA, 22 nt, Human
uaaacaagaaacauuuucuguu

SEQ ID NO: 927664 - RNA, 18 nt, Human
cugccugcucuccagcuu

SEQ ID NO: 927665 - RNA, 19 nt, Human
agacaaguuuccagaagcc

SEQ ID NO: 927666 - RNA, 22 nt, Human
uaaagcagccagggucuaagcc

SEQ ID NO: 927667 - RNA, 22 nt, Human
uauuccaaugucaguuauauca

SEQ ID NO: 927668 - RNA, 19 nt, Human
ggcucuggcggcuguagcc

SEQ ID NO: 927669 - RNA, 22 nt, Human
gagagcaauggggacgggcagg

SEQ ID NO: 927670 - RNA, 22 nt, Human
gccaagcuguuuuucagagacg

SEQ ID NO: 927671 - RNA, 22 nt, Human
uggcaguucaggcugcaaucau

SEQ ID NO: 927672 - RNA, 22 nt, Human
gaacaucugugaucucuuuggg

SEQ ID NO: 927673 - RNA, 16 nt, Human
ucacacauuuguuggu

SEQ ID NO: 927674 - RNA, 19 nt, Human
ucagaacucagaaugugua

SEQ ID NO: 927675 - RNA, 22 nt, Human
ggccacagcaaugcugugaugu

SEQ ID NO: 927676 - RNA, 22 nt, Human
aaugccaauauucauuuguguu

SEQ ID NO: 927677 - RNA, 22 nt, Human
ucagacaucucauaauguauua

SEQ ID NO: 927678 - RNA, 22 nt, Human
augcauuguaacgaugugcaca

SEQ ID NO: 927679 - RNA, 22 nt, Human
agacaauggaccaagcaccuuc

SEQ ID NO: 927680 - RNA, 22 nt, Human
ucugagaguacgggcugcgcgc

SEQ ID NO: 927681 - RNA, 22 nt, Human
cugagguagggacgugccguag

SEQ ID NO: 927682 - RNA, 22 nt, Human
ugaagccagggacugacacuuc

SEQ ID NO: 927683 - RNA, 22 nt, Human
gggagaaguggaaaucucauua

SEQ ID NO: 927684 - RNA, 22 nt, Human
ugcuccaggcugcugaagaucu

SEQ ID NO: 927685 - RNA, 22 nt, Human
ucgaaauaauuuagaauauaga

SEQ ID NO: 927686 - RNA, 22 nt, Human
gcagggaagggaaacagagacc

SEQ ID NO: 927687 - RNA, 22 nt, Human
aacauugaaauauuugcaauag

SEQ ID NO: 927688 - RNA, 22 nt, Human
auaagauugucauaguauggac

SEQ ID NO: 927689 - RNA, 22 nt, Human
cagauagcaaauggguaagcua

SEQ ID NO: 927690 - RNA, 22 nt, Human
uugcugaagaaaaaauauguua

SEQ ID NO: 927691 - RNA, 22 nt, Human
ugacacaguugucgacucuaca

SEQ ID NO: 927692 - RNA, 22 nt, Human
uuuuguaugagaagugcuuuac

SEQ ID NO: 927693 - RNA, 22 nt, Human
cugcugagacuggcuuuguguc

SEQ ID NO: 927694 - RNA, 22 nt, Human
aggugccaccucuggugcuguc

SEQ ID NO: 927695 - RNA, 22 nt, Human
agcaccugccugcauuggcuau

SEQ ID NO: 927696 - RNA, 22 nt, Human
agguggcagagcuggcccagcg

SEQ ID NO: 927697 - RNA, 22 nt, Human
ucaggccccuugucagcucugu

SEQ ID NO: 927698 - RNA, 17 nt, Human
uggaaggcuucaauauu

SEQ ID NO: 927699 - RNA, 22 nt, Human
ugcuggcaucuuaauguucugu

SEQ ID NO: 927700 - RNA, 22 nt, Human
uaucuuaaaaaucgaagcagau

SEQ ID NO: 927701 - RNA, 22 nt, Human
uccuggcccgaucccugugaag

SEQ ID NO: 927702 - RNA, 22 nt, Human
ugcuuauuuauagucaauagag

SEQ ID NO: 927703 - RNA, 22 nt, Human
cuguggugagcaacugacugaa

SEQ ID NO: 927704 - RNA, 22 nt, Human
cuguacaucuuaaauggaaaaa

SEQ ID NO: 927705 - RNA, 22 nt, Human
aauguguagcauuuaaugcagu

SEQ ID NO: 927706 - RNA, 22 nt, Human
aggggugauuugggacaggaca

SEQ ID NO: 927707 - RNA, 22 nt, Human
agacacaggauucugcauuucu

SEQ ID NO: 927708 - RNA, 22 nt, Human
cucauucauucccgcagccacc

SEQ ID NO: 927709 - RNA, 22 nt, Human
gaacuacaggugcagcaaguga

SEQ ID NO: 927710 - RNA, 22 nt, Human
cucugccauuuaucagaacugu

SEQ ID NO: 927711 - RNA, 22 nt, Human
aaugucuagaguuuuaagcuua

SEQ ID NO: 927712 - RNA, 22 nt, Human
uuuuaguuuggauuucuaaagc

SEQ ID NO: 927713 - RNA, 20 nt, Human
uuggucagugguucaguuug

SEQ ID NO: 927714 - RNA, 22 nt, Human
caacaguguugcaaucugaaaa

SEQ ID NO: 927715 - RNA, 19 nt, Human
ugucccagacuccgugucu

SEQ ID NO: 927716 - RNA, 22 nt, Human
ggggugggguuacucauugugc

SEQ ID NO: 927717 - RNA, 21 nt, Human
ggaggaaaaaggaaugacuug

SEQ ID NO: 927718 - RNA, 22 nt, Human
guuuccuauggcugcugcagga

SEQ ID NO: 927719 - RNA, 22 nt, Human
ucuuucuuauuagccauuguuc

SEQ ID NO: 927720 - RNA, 23 nt, Human
agaagcugggagccuggggaugg

SEQ ID NO: 927721 - RNA, 22 nt, Human
caguaauagauuugagaguggu

SEQ ID NO: 927722 - RNA, 22 nt, Human
ucugugggugccuccagcagug

SEQ ID NO: 927723 - RNA, 22 nt, Human
ugcagcugaugauacccccaug

SEQ ID NO: 927724 - RNA, 22 nt, Human
gaaaggcaucuucagucucuga

SEQ ID NO: 927725 - RNA, 22 nt, Human
uuuaaauuuguguuuagagggu

SEQ ID NO: 927726 - RNA, 22 nt, Human
ggcaggcugcuugggucauguc

SEQ ID NO: 927727 - RNA, 22 nt, Human
cugcccugcucuccgggaucuu

SEQ ID NO: 927728 - RNA, 22 nt, Human
uacaaacuguccagcccagagg

SEQ ID NO: 927729 - RNA, 22 nt, Human
uauguuuuuaagagaaugcauu

SEQ ID NO: 927730 - RNA, 22 nt, Human
ccugcucuaaaucucauggaac

SEQ ID NO: 927731 - RNA, 22 nt, Human
ucagccaguuaagucaagaaau

SEQ ID NO: 927732 - RNA, 22 nt, Human
aggcuggugcuuccuagggcag

SEQ ID NO: 927733 - RNA, 23 nt, Human
ugacacaggucaaaaauaagaug

SEQ ID NO: 927734 - RNA, 22 nt, Human
ugagguagguaccauuaucacu

SEQ ID NO: 927735 - RNA, 22 nt, Human
uugcuuuuaaucuuuguacauc

SEQ ID NO: 927736 - RNA, 22 nt, Human
gcaggcagagagggguuuccag

SEQ ID NO: 927737 - RNA, 22 nt, Human
caguccugaggaagagcugcug

SEQ ID NO: 927738 - RNA, 20 nt, Human
uggggccuguuucugugguu

SEQ ID NO: 927739 - RNA, 19 nt, Human
ucugaaguccagggcauac

SEQ ID NO: 927740 - RNA, 22 nt, Human
cagcagccgagagggggcucug

SEQ ID NO: 927741 - RNA, 22 nt, Human
caucucauuuauuccaacucag

SEQ ID NO: 927742 - RNA, 22 nt, Human
cagccuccugggacacucaccg

SEQ ID NO: 927743 - RNA, 22 nt, Human
aggcccugauccgaauccagau

SEQ ID NO: 927744 - RNA, 22 nt, Human
ucccucagaaauucucucugaa

SEQ ID NO: 927745 - RNA, 22 nt, Human
uguucugcaaugcugccuccuu

SEQ ID NO: 927746 - RNA, 22 nt, Human
guggccaggagaccuugggcau

SEQ ID NO: 927747 - RNA, 22 nt, Human
auguuaugacaagcaugacaga

SEQ ID NO: 927748 - RNA, 22 nt, Human
cacaugaauugaugccaagugc

SEQ ID NO: 927749 - RNA, 22 nt, Human
uggcaaaaugagcaauuacuuu

SEQ ID NO: 927750 - RNA, 22 nt, Human
gaaucuuauccccaguccuuaa

SEQ ID NO: 927751 - RNA, 22 nt, Human
uggcauccagauacccugaggg

SEQ ID NO: 927752 - RNA, 22 nt, Human
aagcuaggccucaguuuccuga

SEQ ID NO: 927753 - RNA, 22 nt, Human
aaguuuaacuugaauucuuucu

SEQ ID NO: 927754 - RNA, 22 nt, Human
caaauacuuacugaaccugugc

SEQ ID NO: 927755 - RNA, 22 nt, Human
guuguacauaugaggauaaguu

SEQ ID NO: 927756 - RNA, 22 nt, Human
gcagaauucuacagaugauaaa

SEQ ID NO: 927757 - RNA, 23 nt, Human
aaauaccugaauuagauauuauc

SEQ ID NO: 927758 - RNA, 22 nt, Human
uacacaugcauguacuccagga

SEQ ID NO: 927759 - RNA, 22 nt, Human
uagaagauucuaaaguggagag

SEQ ID NO: 927760 - RNA, 22 nt, Human
uauuauuaucuuugaaugggac

SEQ ID NO: 927761 - RNA, 22 nt, Human
ucaauagcauagcaauuaaugu

SEQ ID NO: 927762 - RNA, 22 nt, Human
ccagaccagacugacuugagcc

SEQ ID NO: 927763 - RNA, 22 nt, Human
gcaagcugcucuuauguggagg

SEQ ID NO: 927764 - RNA, 22 nt, Human
ggucagagaaaaguaggguguu

SEQ ID NO: 927765 - RNA, 22 nt, Human
gagggagggccaggucccaacc

SEQ ID NO: 927766 - RNA, 22 nt, Human
gcuguacauucugcacaggccc

SEQ ID NO: 927767 - RNA, 22 nt, Human
cuuaggcaagcagagcccaucc

SEQ ID NO: 927768 - RNA, 22 nt, Human
uaaaagauuuuauaggaacaag

SEQ ID NO: 927769 - RNA, 22 nt, Human
caaugcuugcugacucccuguc

SEQ ID NO: 927770 - RNA, 22 nt, Human
auaagcuuccuguuagaaaccg

SEQ ID NO: 927771 - RNA, 22 nt, Human
uuucugaauaacucuaugauau

SEQ ID NO: 927772 - RNA, 22 nt, Human
cagagccacugucugccaggca

SEQ ID NO: 927773 - RNA, 22 nt, Human
uacagagaacucauagaaagaa

SEQ ID NO: 927774 - RNA, 22 nt, Human
uaaauucuacaacuucaaagau

SEQ ID NO: 927775 - RNA, 22 nt, Human
uuuuauaagcaagaaagggaaa

SEQ ID NO: 927776 - RNA, 18 nt, Human
gagcagcaggaucaagaa

SEQ ID NO: 927777 - RNA, 22 nt, Human
gagaaagggauaauuugaagag

SEQ ID NO: 927778 - RNA, 22 nt, Human
ucacagaauuuuugcuuccagu

SEQ ID NO: 927779 - RNA, 22 nt, Human
ugggagaaagaacccugaguga

SEQ ID NO: 927780 - RNA, 22 nt, Human
cauucacaacugagcauuguug

SEQ ID NO: 927781 - RNA, 22 nt, Human
caggaccccauauucacugaac

SEQ ID NO: 927782 - RNA, 22 nt, Human
guuuaucauuauuauuagcaac

SEQ ID NO: 927783 - RNA, 22 nt, Human
gugugugccaacuuuaugugca

SEQ ID NO: 927784 - RNA, 22 nt, Human
auucaguuacucuagacacuuc

SEQ ID NO: 927785 - RNA, 22 nt, Human
ggaacugagcaauggcaugaaa

SEQ ID NO: 927786 - RNA, 22 nt, Human
ccuggagcuuuuccauccugga

SEQ ID NO: 927787 - RNA, 22 nt, Human
aaugaauugcaguacugacuug

SEQ ID NO: 927788 - RNA, 20 nt, Human
ucuuggcaaaugggaguguc

SEQ ID NO: 927789 - RNA, 22 nt, Human
ugcuggcuuuuugguccuugcu

SEQ ID NO: 927790 - RNA, 23 nt, Human
cugccugcuggggagacagaucu

SEQ ID NO: 927791 - RNA, 22 nt, Human
gagggugguggcuuaaggugcu

SEQ ID NO: 927792 - RNA, 21 nt, Human
uaggccacauggguuggagau

SEQ ID NO: 927793 - RNA, 22 nt, Human
guuucauaugcaguuaacagca

SEQ ID NO: 927794 - RNA, 22 nt, Human
ccccacaggugucugaggcagg

SEQ ID NO: 927795 - RNA, 22 nt, Human
ugugaaaugcuauuuccaugag

SEQ ID NO: 927796 - RNA, 22 nt, Human
ucagaggccugaaagaauuugg

SEQ ID NO: 927797 - RNA, 22 nt, Human
auaucacuagagaaguuguuaa

SEQ ID NO: 927798 - RNA, 22 nt, Human
aacaggaggccuuccaguccag

SEQ ID NO: 927799 - RNA, 20 nt, Human
ucaaagacaagcucucaucc

SEQ ID NO: 927800 - RNA, 22 nt, Human
ugcuggcuggccuggccuggac

SEQ ID NO: 927801 - RNA, 22 nt, Human
agaagugaguugugacuauggg

SEQ ID NO: 927802 - RNA, 22 nt, Human
gggugggacugaagucugaggg

SEQ ID NO: 927803 - RNA, 22 nt, Human
uggcccagacucugcucuuauc

SEQ ID NO: 927804 - RNA, 22 nt, Human
acacagugccaaauugcaguua

SEQ ID NO: 927805 - RNA, 22 nt, Human
gugagacaagauuuguaggcag

SEQ ID NO: 927806 - RNA, 22 nt, Human
cugggccauggaagucucugcc

SEQ ID NO: 927807 - RNA, 22 nt, Human
uuuccuacccuuccaggcagag

SEQ ID NO: 927808 - RNA, 22 nt, Human
ucuagcagggaaagcagagaau

SEQ ID NO: 927809 - RNA, 22 nt, Human
gcaugugucuccccaguggagg

SEQ ID NO: 927810 - RNA, 20 nt, Human
uuggcauuuagacaagaguu

SEQ ID NO: 927811 - RNA, 22 nt, Human
acaugcauaagccuagccauca

SEQ ID NO: 927812 - RNA, 22 nt, Human
augucugucaucuuccaggaag

SEQ ID NO: 927813 - RNA, 22 nt, Human
gccaggagugucccacucauuu

SEQ ID NO: 927814 - RNA, 22 nt, Human
gcccaggauggcuggaggugcu

SEQ ID NO: 927815 - RNA, 22 nt, Human
uggcaaagacugcaaggacuuu

SEQ ID NO: 927816 - RNA, 22 nt, Human
ucaggaaguugaggcguagaga

SEQ ID NO: 927817 - RNA, 22 nt, Human
caggaggcgucuucaguuuguu

SEQ ID NO: 927818 - RNA, 22 nt, Human
uccaaauauuaugauuauagga

SEQ ID NO: 927819 - RNA, 22 nt, Human
aaacugaggaguuagacuaggg

SEQ ID NO: 927820 - RNA, 22 nt, Human
ucaaaggcgguccaggaauaaa

SEQ ID NO: 927821 - RNA, 22 nt, Human
agagggagugaaauggaauaga

SEQ ID NO: 927822 - RNA, 22 nt, Human
cugaaacuuuaguucugcaaca

SEQ ID NO: 927823 - RNA, 22 nt, Human
uuaaagaauagugccccuauug

SEQ ID NO: 927824 - RNA, 22 nt, Human
gaauucugggagagaucugaca

SEQ ID NO: 927825 - RNA, 22 nt, Human
gggcccugaucugugagcgcag

SEQ ID NO: 927826 - RNA, 22 nt, Human
aguuuaggcaggcuccuauggu

SEQ ID NO: 927827 - RNA, 22 nt, Human
ugucucuccacacagccagugc

SEQ ID NO: 927828 - RNA, 22 nt, Human
cagaagcauuccagcaaauagu

SEQ ID NO: 927829 - RNA, 23 nt, Human
aaugaguugggcagcauacaggc

SEQ ID NO: 927830 - RNA, 22 nt, Human
uggccaggaggcugcuucugac

SEQ ID NO: 927831 - RNA, 22 nt, Human
uuccccuugauaaugcaguaag

SEQ ID NO: 927832 - RNA, 22 nt, Human
uguucuagcaacacaguuuugg

SEQ ID NO: 927833 - RNA, 22 nt, Human
ugucuucaggaguaaauaucau

SEQ ID NO: 927834 - RNA, 22 nt, Human
ccuccuggaggcucuagggaaa

SEQ ID NO: 927835 - RNA, 22 nt, Human
ggcccugucugucugcccagcu

SEQ ID NO: 927836 - RNA, 22 nt, Human
accaggaguuuugaccaggggc

SEQ ID NO: 927837 - RNA, 22 nt, Human
gugaaaguaagaaaguaggacu

SEQ ID NO: 927838 - RNA, 19 nt, Human
accuggcuggcgcacuugu

SEQ ID NO: 927839 - RNA, 22 nt, Human
ucaaugcaaucauuggacaagu

SEQ ID NO: 927840 - RNA, 22 nt, Human
ugacaaauacaauaagaucugu

SEQ ID NO: 927841 - RNA, 22 nt, Human
gcuuggccagcagccgggaugc

SEQ ID NO: 927842 - RNA, 22 nt, Human
auaaaaugguaaacgaagcuga

SEQ ID NO: 927843 - RNA, 22 nt, Human
uuauucaccgcaggugcuuccc

SEQ ID NO: 927844 - RNA, 22 nt, Human
uacagauagaauuagugaguua

SEQ ID NO: 927845 - RNA, 22 nt, Human
cugccuucaucucugagcuggg

SEQ ID NO: 927846 - RNA, 22 nt, Human
agcuaagaacuugagcucugga

SEQ ID NO: 927847 - RNA, 22 nt, Human
auguauuugcguauggacauac

SEQ ID NO: 927848 - RNA, 22 nt, Human
guuuacauguacucauuauacu

SEQ ID NO: 927849 - RNA, 22 nt, Human
uggcucagcuuuccccaucugg

SEQ ID NO: 927850 - RNA, 22 nt, Human
uguaaauaaugcauguaaauca

SEQ ID NO: 927851 - RNA, 22 nt, Human
uguaaaccagggucauccuuag

SEQ ID NO: 927852 - RNA, 22 nt, Human
ugggugcaggaugagugcuggc

SEQ ID NO: 927853 - RNA, 22 nt, Human
auaaacuggguaucaagaggcc

SEQ ID NO: 927854 - RNA, 22 nt, Human
auuugcauaauagugauuugua

SEQ ID NO: 927855 - RNA, 22 nt, Human
cagggacaauggcagagccuga

SEQ ID NO: 927856 - RNA, 22 nt, Human
cacaguuuugucuugguuucca

SEQ ID NO: 927857 - RNA, 20 nt, Human
ucaggguuucccauucuugg

SEQ ID NO: 927858 - RNA, 20 nt, Human
gugaaggcuaagcacagagg

SEQ ID NO: 927859 - RNA, 22 nt, Human
cuucauaaucugaaauuuguaa

SEQ ID NO: 927860 - RNA, 22 nt, Human
uccuccagugucuggggccuug

SEQ ID NO: 927861 - RNA, 22 nt, Human
caucagugaaagugaauguucu

SEQ ID NO: 927862 - RNA, 22 nt, Human
acccaggacacagagaugaccc

SEQ ID NO: 927863 - RNA, 22 nt, Human
cugggaagccauguuucuagga

SEQ ID NO: 927864 - RNA, 22 nt, Human
caucaaaauuagacauuguuga

SEQ ID NO: 927865 - RNA, 19 nt, Human
cagagccucagagcuagaa

SEQ ID NO: 927866 - RNA, 22 nt, Human
auugagcaccuacuaugugcua

SEQ ID NO: 927867 - RNA, 22 nt, Human
cuuagaauuuugccuacuacaa

SEQ ID NO: 927868 - RNA, 22 nt, Human
ucuguagcaagugagaggcauu

SEQ ID NO: 927869 - RNA, 22 nt, Human
guggcaggagugggccuugaag

SEQ ID NO: 927870 - RNA, 22 nt, Human
ccaaaauuauuacauuuguagg

SEQ ID NO: 927871 - RNA, 22 nt, Human
acagaugagaagcugcauucaa

SEQ ID NO: 927872 - RNA, 19 nt, Human
ccuauggcaggauggaggc

SEQ ID NO: 927873 - RNA, 20 nt, Human
gugccaggcaagacaggugg

SEQ ID NO: 927874 - RNA, 22 nt, Human
auacuacauuugaaaauugcag

SEQ ID NO: 927875 - RNA, 22 nt, Human
auuccucaaagguagcccauua

SEQ ID NO: 927876 - RNA, 22 nt, Human
uaaggcuuuguagugauugcuu

SEQ ID NO: 927877 - RNA, 22 nt, Human
gaggccuggugugucucccgcu

SEQ ID NO: 927878 - RNA, 22 nt, Human
ucucagaacacccuucuauggu

SEQ ID NO: 927879 - RNA, 22 nt, Human
caggcaggcugcuuuuuguuca

SEQ ID NO: 927880 - RNA, 22 nt, Human
agggcagagggugccucaccug

SEQ ID NO: 927881 - RNA, 22 nt, Human
auacaaauuauaggccccaucc

SEQ ID NO: 927882 - RNA, 20 nt, Human
cgcccagugcgguucugacc

SEQ ID NO: 927883 - RNA, 22 nt, Human
acuggcugaguugcuucagcaa

SEQ ID NO: 927884 - RNA, 22 nt, Human
cauccauuaacucauuuguuuc

SEQ ID NO: 927885 - RNA, 23 nt, Human
uggagcugggcucagacccuggg

SEQ ID NO: 927886 - RNA, 22 nt, Human
gaaauguaugucuucccccauu

SEQ ID NO: 927887 - RNA, 22 nt, Human
ggcuccagaaacuucaguccau

SEQ ID NO: 927888 - RNA, 22 nt, Human
uacaaacucuuuauauuucaua

SEQ ID NO: 927889 - RNA, 22 nt, Human
auuauucuuaaugcagggauua

SEQ ID NO: 927890 - RNA, 22 nt, Human
uucuuucuucucaggcugggua

SEQ ID NO: 927891 - RNA, 22 nt, Human
agccagcacggauuucccagga

SEQ ID NO: 927892 - RNA, 20 nt, Human
acaauacagguugugucuga

SEQ ID NO: 927893 - RNA, 22 nt, Human
acaaccaagaacagagggaaag

SEQ ID NO: 927894 - RNA, 22 nt, Human
aggcaagaacagacaugggagu

SEQ ID NO: 927895 - RNA, 22 nt, Human
ggagagacccuggagaaggucc

SEQ ID NO: 927896 - RNA, 22 nt, Human
uucagcagcuuuuaguacauug

SEQ ID NO: 927897 - RNA, 22 nt, Human
uuugaauagggcuuugcaggga

SEQ ID NO: 927898 - RNA, 22 nt, Human
ugagggcagagcacuggggagc

SEQ ID NO: 927899 - RNA, 19 nt, Human
gcuuuuauugcucaggugc

SEQ ID NO: 927900 - RNA, 17 nt, Human
uuauuuuuugggcugag

SEQ ID NO: 927901 - RNA, 22 nt, Human
aagaaucuuaauccagaaaccu

SEQ ID NO: 927902 - RNA, 23 nt, Human
aucugaaaaggcauuuucuuccc

SEQ ID NO: 927903 - RNA, 22 nt, Human
agcuggggcauuuauccacuaa

SEQ ID NO: 927904 - RNA, 22 nt, Human
agcccuugguauuuuccgaucc

SEQ ID NO: 927905 - RNA, 22 nt, Human
agcuggauuaaauauagcuuuc

SEQ ID NO: 927906 - RNA, 22 nt, Human
uacagugauagagaguagcuau

SEQ ID NO: 927907 - RNA, 22 nt, Human
uuauucuuuaaacauauauguu

SEQ ID NO: 927908 - RNA, 18 nt, Human
aagcacagguguuucagg

SEQ ID NO: 927909 - RNA, 22 nt, Human
caggagccgccaggcacguugg

SEQ ID NO: 927910 - RNA, 22 nt, Human
cuggccagaagcaccuuuggcg

SEQ ID NO: 927911 - RNA, 22 nt, Human
ugccgcagugcggggagggccc

SEQ ID NO: 927912 - RNA, 22 nt, Human
ccucuugccaaucagcuacaga

SEQ ID NO: 927913 - RNA, 22 nt, Human
gcccugagaagaagucggaggg

SEQ ID NO: 927914 - RNA, 22 nt, Human
guaggguuggagagcacaacca

SEQ ID NO: 927915 - RNA, 20 nt, Human
cuguagggugcagcaggcuc

SEQ ID NO: 927916 - RNA, 22 nt, Human
cuacauagauggaugauuguaa

SEQ ID NO: 927917 - RNA, 22 nt, Human
guaaacacuacaaaucaaggcu

SEQ ID NO: 927918 - RNA, 22 nt, Human
uugucuuuggaaauuuaauguu

SEQ ID NO: 927919 - RNA, 22 nt, Human
ggucaggguauaaucaagugag

SEQ ID NO: 927920 - RNA, 22 nt, Human
ugucucuuggcucuaucacuua

SEQ ID NO: 927921 - RNA, 22 nt, Human
cagcaaagguagaagcacagga

SEQ ID NO: 927922 - RNA, 22 nt, Human
aagauuuacuagcauaauagcu

SEQ ID NO: 927923 - RNA, 22 nt, Human
cuugucugugucggauaaaacu

SEQ ID NO: 927924 - RNA, 20 nt, Human
agccaagaacaggcagaacc

SEQ ID NO: 927925 - RNA, 22 nt, Human
ugugucagaaaucagugccucg

SEQ ID NO: 927926 - RNA, 22 nt, Human
aggaagcuagaaggucuucuuu

SEQ ID NO: 927927 - RNA, 22 nt, Human
uagaaagugguugagaguuuag

SEQ ID NO: 927928 - RNA, 22 nt, Human
ucccuggacaacagacuucacu

SEQ ID NO: 927929 - RNA, 22 nt, Human
ccaggagcagaguagguguuca

SEQ ID NO: 927930 - RNA, 22 nt, Human
cgagcagaagccugguggucug

SEQ ID NO: 927931 - RNA, 22 nt, Human
gaggauggauccgaccccuucc

SEQ ID NO: 927932 - RNA, 22 nt, Human
gagcacugagcuggaauuggag

SEQ ID NO: 927933 - RNA, 22 nt, Human
ccagcagagcucaaacuuccug

SEQ ID NO: 927934 - RNA, 22 nt, Human
ugggccugaaggagcugcgccc

SEQ ID NO: 927935 - RNA, 22 nt, Human
gaggggcuggcuguggucccau

SEQ ID NO: 927936 - RNA, 22 nt, Human
ggcaggcaguguggugugaaac

SEQ ID NO: 927937 - RNA, 23 nt, Human
uaggcaggacucagauaugacag

SEQ ID NO: 927938 - RNA, 22 nt, Human
uauguacacauacacuuguaau

SEQ ID NO: 927939 - RNA, 21 nt, Human
ucauuucucuauguauuucac

SEQ ID NO: 927940 - RNA, 22 nt, Human
caaauguaauggcagguuuugc

SEQ ID NO: 927941 - RNA, 22 nt, Human
agcaaauacuugaauaaaaaga

SEQ ID NO: 927942 - RNA, 20 nt, Human
uucucuagccuuccccuggg

SEQ ID NO: 927943 - RNA, 22 nt, Human
ucaagcaaguugcauauugcua

SEQ ID NO: 927944 - RNA, 22 nt, Human
augugucucuaccaaugcaauu

SEQ ID NO: 927945 - RNA, 22 nt, Human
aaugcugucuuagcaugaaagc

SEQ ID NO: 927946 - RNA, 22 nt, Human
aggguggggugcuacaucuuua

SEQ ID NO: 927947 - RNA, 22 nt, Human
cucuggguucuggccugcaccc

SEQ ID NO: 927948 - RNA, 22 nt, Human
ggucccaguccucucccugcua

SEQ ID NO: 927949 - RNA, 22 nt, Human
aaaaggcuaauccagagcaacu

SEQ ID NO: 927950 - RNA, 18 nt, Human
gaacuuuuggcuuugugu

SEQ ID NO: 927951 - RNA, 22 nt, Human
agauauuuaaaucagacaaaga

SEQ ID NO: 927952 - RNA, 22 nt, Human
aggggagccgaggggcaucugu

SEQ ID NO: 927953 - RNA, 22 nt, Human
ggcaucguccugggcauaggga

SEQ ID NO: 927954 - RNA, 22 nt, Human
agauugauagauguuucuaaaa

SEQ ID NO: 927955 - RNA, 22 nt, Human
agggagccaggaacgcaggucg

SEQ ID NO: 927956 - RNA, 22 nt, Human
cuccuggcacucaguguggaag

SEQ ID NO: 927957 - RNA, 22 nt, Human
agcccagguggagugugugggg

SEQ ID NO: 927958 - RNA, 22 nt, Human
ggucccuggaaggcacuaguga

SEQ ID NO: 927959 - RNA, 22 nt, Human
ucacagaagcccucgcaaacua

SEQ ID NO: 927960 - RNA, 22 nt, Human
cucuuagugcaucucauuaguu

SEQ ID NO: 927961 - RNA, 18 nt, Human
aaggcaguaugauugcac

SEQ ID NO: 927962 - RNA, 22 nt, Human
cagaguaaggagcugucaaacg

SEQ ID NO: 927963 - RNA, 20 nt, Human
accaggcccggugucuccuc

SEQ ID NO: 927964 - RNA, 22 nt, Human
agaggccaggcagcccaaggug

SEQ ID NO: 927965 - RNA, 22 nt, Human
gcacugggaagaaugagccugu

SEQ ID NO: 927966 - RNA, 22 nt, Human
ccagaagucaggaaugagucuu

SEQ ID NO: 927967 - RNA, 22 nt, Human
agacaauuaaaaaauuaugcuu

SEQ ID NO: 927968 - RNA, 22 nt, Human
cugagcacugggcacauagcug

SEQ ID NO: 927969 - RNA, 22 nt, Human
gaacacuguuucuucgugaaca

SEQ ID NO: 927970 - RNA, 22 nt, Human
ugugggaggaauuagaauggga

SEQ ID NO: 927971 - RNA, 22 nt, Human
cuuuagcaacgaugaugauauu

SEQ ID NO: 927972 - RNA, 23 nt, Human
cauaaaauauuaguaugguagca

SEQ ID NO: 927973 - RNA, 22 nt, Human
ucuaaacaguuucacucuuaau

SEQ ID NO: 927974 - RNA, 22 nt, Human
agguaguguagcugagugggau

SEQ ID NO: 927975 - RNA, 23 nt, Human
aaguucuauuagugcuggucuag

SEQ ID NO: 927976 - RNA, 22 nt, Human
gcugcccugugguagagggugg

SEQ ID NO: 927977 - RNA, 19 nt, Human
guggcucauguagugggcc

SEQ ID NO: 927978 - RNA, 22 nt, Human
ucaaaugagugacucacacagg

SEQ ID NO: 927979 - RNA, 22 nt, Human
ucauaguucuguuuugaaggau

SEQ ID NO: 927980 - RNA, 22 nt, Human
auaaagauagaaugcuuuccug

SEQ ID NO: 927981 - RNA, 22 nt, Human
ucuaauuuuggcauuuuaaccu

SEQ ID NO: 927982 - RNA, 22 nt, Human
ugcuggcuggagugccucugga

SEQ ID NO: 927983 - RNA, 22 nt, Human
ccuucagaaugaaauucuaaug

SEQ ID NO: 927984 - RNA, 22 nt, Human
aaacagcuuucagaaucucuca

SEQ ID NO: 927985 - RNA, 22 nt, Human
aauauugagaaccagcauguuu

SEQ ID NO: 927986 - RNA, 22 nt, Human
uaauguuuuucucaacauugcu

SEQ ID NO: 927987 - RNA, 22 nt, Human
agagccaaggccucagucucaa

SEQ ID NO: 927988 - RNA, 22 nt, Human
uccacagggauguugaguucuu

SEQ ID NO: 927989 - RNA, 22 nt, Human
uuacaacugggcuugucagcuu

SEQ ID NO: 927990 - RNA, 22 nt, Human
uugugcuaagugcuaugaaggc

SEQ ID NO: 927991 - RNA, 19 nt, Human
cccagaggaaugccuggaa

SEQ ID NO: 927992 - RNA, 22 nt, Human
cagugucucaaaacaaguugcu

SEQ ID NO: 927993 - RNA, 22 nt, Human
ggaggcugagaggucgcagugg

SEQ ID NO: 927994 - RNA, 22 nt, Human
aaauuaacuaucacuuuuguga

SEQ ID NO: 927995 - RNA, 22 nt, Human
uuuacaaguacaccuaacagcu

SEQ ID NO: 927996 - RNA, 22 nt, Human
uuuaugacauuacaauaucaag

SEQ ID NO: 927997 - RNA, 22 nt, Human
uguucauauuccuguccgcuga

SEQ ID NO: 927998 - RNA, 22 nt, Human
acaguuaauaugugacagaacu

SEQ ID NO: 927999 - RNA, 22 nt, Human
acagaggccgccucucucacgg

SEQ ID NO: 928000 - RNA, 22 nt, Human
aauaagaugugcuugaguuugg

SEQ ID NO: 928001 - RNA, 22 nt, Human
agcagggcuccugaaagccgcg

SEQ ID NO: 928002 - RNA, 22 nt, Human
ggauggcagacagugaguggcu

SEQ ID NO: 928003 - RNA, 17 nt, Human
ucaaagaaugcaugcag

SEQ ID NO: 928004 - RNA, 22 nt, Human
cuuucuucaaccucauucugca

SEQ ID NO: 928005 - RNA, 22 nt, Human
agaaucagugagcaguugugau

SEQ ID NO: 928006 - RNA, 22 nt, Human
gcagugaagccagaucugaaau

SEQ ID NO: 928007 - RNA, 22 nt, Human
ucaccaggcaacuauguacucc

SEQ ID NO: 928008 - RNA, 22 nt, Human
ucuuuuucuucuguggaaggug

SEQ ID NO: 928009 - RNA, 22 nt, Human
cugggggccuuacggaacucca

SEQ ID NO: 928010 - RNA, 22 nt, Human
ggcugugcccucacauggggca

SEQ ID NO: 928011 - RNA, 22 nt, Human
agaacagggacuggaggcuuca

SEQ ID NO: 928012 - RNA, 22 nt, Human
acaaguuucauuguuuagaacc

SEQ ID NO: 928013 - RNA, 22 nt, Human
ggcugaaggaugaaagcugcag

SEQ ID NO: 928014 - RNA, 23 nt, Human
uucugggcuguggaagccucggg

SEQ ID NO: 928015 - RNA, 22 nt, Human
agcucagggcaaagacucaaau

SEQ ID NO: 928016 - RNA, 22 nt, Human
augccaaguacaggcacugcuc

SEQ ID NO: 928017 - RNA, 22 nt, Human
uaagaggcauuagagacauagc

SEQ ID NO: 928018 - RNA, 22 nt, Human
aggauuucugugccuggaaaau

SEQ ID NO: 928019 - RNA, 22 nt, Human
cuuuuuguguaugcuacaguug

SEQ ID NO: 928020 - RNA, 22 nt, Human
agauuucugucaccuucuaugc

SEQ ID NO: 928021 - RNA, 22 nt, Human
aguaucaaggaucuccagcacc

SEQ ID NO: 928022 - RNA, 22 nt, Human
aauuuguuuucaagucacugga

SEQ ID NO: 928023 - RNA, 22 nt, Human
uccagcagacucaucagcaagg

SEQ ID NO: 928024 - RNA, 22 nt, Human
aggcaggcugcuauggaguaga

SEQ ID NO: 928025 - RNA, 22 nt, Human
aggaaauugagaaucagaauaa

SEQ ID NO: 928026 - RNA, 22 nt, Human
uuggcuuucagaaucccuaucu

SEQ ID NO: 928027 - RNA, 22 nt, Human
agagcuguggauaguccuggau

SEQ ID NO: 928028 - RNA, 22 nt, Human
uguuauuugggaaaguuguaca

SEQ ID NO: 928029 - RNA, 22 nt, Human
guuugaaaugucugcaagggaa

SEQ ID NO: 928030 - RNA, 23 nt, Human
gugcuuuaugaucugcugucccu

SEQ ID NO: 928031 - RNA, 22 nt, Human
ccagcccugauuagagaauguc

SEQ ID NO: 928032 - RNA, 22 nt, Human
guccacagggauggccacacau

SEQ ID NO: 928033 - RNA, 22 nt, Human
uuguugauguggacgucuggaa

SEQ ID NO: 928034 - RNA, 22 nt, Human
cccugucacaauggaugacauu

SEQ ID NO: 928035 - RNA, 22 nt, Human
ugugaugcuggagugcgaauau

SEQ ID NO: 928036 - RNA, 16 nt, Human
agguggagaaguucac

SEQ ID NO: 928037 - RNA, 22 nt, Human
agaagaauacuugauguucaug

SEQ ID NO: 928038 - RNA, 22 nt, Human
acuuccaaaacacagcauggca

SEQ ID NO: 928039 - RNA, 22 nt, Human
gacauauacuauggaugguucu

SEQ ID NO: 928040 - RNA, 22 nt, Human
gugccucccuguugacuagggu

SEQ ID NO: 928041 - RNA, 22 nt, Human
ggaggucccaggccuggcagca

SEQ ID NO: 928042 - RNA, 22 nt, Human
cugggacuugcagagcaggagg

SEQ ID NO: 928043 - RNA, 22 nt, Human
ccuugggucuaggccagggagu

SEQ ID NO: 928044 - RNA, 22 nt, Human
ucucaacuuugagaaacauugu

SEQ ID NO: 928045 - RNA, 22 nt, Human
aaguauuucguucugaaaaagu

SEQ ID NO: 928046 - RNA, 22 nt, Human
aguacaaacuguuucaaaguag

SEQ ID NO: 928047 - RNA, 22 nt, Human
cugggaggcaccgcgucgugcu

SEQ ID NO: 928048 - RNA, 22 nt, Human
cacacaugugugcagcuuagaa

SEQ ID NO: 928049 - RNA, 22 nt, Human
uccucugggccuauuuguucac

SEQ ID NO: 928050 - RNA, 22 nt, Human
caugagaaguggccuucaaaaa

SEQ ID NO: 928051 - RNA, 22 nt, Human
guuuuauaggcuguugcuauau

SEQ ID NO: 928052 - RNA, 22 nt, Human
gagcucuguguggcuugggugg

SEQ ID NO: 928053 - RNA, 22 nt, Human
cagacacaccaggcccauucug

SEQ ID NO: 928054 - RNA, 22 nt, Human
uaacaauacccauucuaauuac

SEQ ID NO: 928055 - RNA, 22 nt, Human
ggagggguggucgcgaagagca

SEQ ID NO: 928056 - RNA, 16 nt, Human
guucucucacuguacc

SEQ ID NO: 928057 - RNA, 23 nt, Human
auaguuuucccugguucuugcca

SEQ ID NO: 928058 - RNA, 22 nt, Human
caaauacugaguuuauuuucaa

SEQ ID NO: 928059 - RNA, 19 nt, Human
ggaugagggucaggcauag

SEQ ID NO: 928060 - RNA, 22 nt, Human
aaggggaaguagcaccagaggu

SEQ ID NO: 928061 - RNA, 22 nt, Human
caaaagauacuugcaucuaacu

SEQ ID NO: 928062 - RNA, 22 nt, Human
cuguguauugaaaaaggguuaa

SEQ ID NO: 928063 - RNA, 19 nt, Human
agcagagcccugaagaucc

SEQ ID NO: 928064 - RNA, 22 nt, Human
uggcauggcuacuggaauggcg

SEQ ID NO: 928065 - RNA, 22 nt, Human
aaagaacaucggagugggcggg

SEQ ID NO: 928066 - RNA, 18 nt, Human
cagacacucugcucugca

SEQ ID NO: 928067 - RNA, 22 nt, Human
ggcuguguccccaccugagcag

SEQ ID NO: 928068 - RNA, 22 nt, Human
uuccauauuguacucuuuggag

SEQ ID NO: 928069 - RNA, 22 nt, Human
cuguggcugccucaccuacagg

SEQ ID NO: 928070 - RNA, 22 nt, Human
ugagauggggucaugcuuuguc

SEQ ID NO: 928071 - RNA, 22 nt, Human
auacaugugugugcauacaugu

SEQ ID NO: 928072 - RNA, 22 nt, Human
augccauuguauauucauugau

SEQ ID NO: 928073 - RNA, 22 nt, Human
gugcaguaucucugggaguggg

SEQ ID NO: 928074 - RNA, 22 nt, Human
cacaguggcaaaggggcuuggg

SEQ ID NO: 928075 - RNA, 22 nt, Human
cggcuucagucucaucaucgcc

SEQ ID NO: 928076 - RNA, 22 nt, Human
ccacguccagcuaauuuucgua

SEQ ID NO: 928077 - RNA, 22 nt, Human
auauagaaggugcuauuuacau

SEQ ID NO: 928078 - RNA, 21 nt, Human
cagcuucugaagguguaggaa

SEQ ID NO: 928079 - RNA, 22 nt, Human
uuuuacuuaauucuuggucaug

SEQ ID NO: 928080 - RNA, 22 nt, Human
ccuguguuaguuaugggucucu

SEQ ID NO: 928081 - RNA, 22 nt, Human
uggagcagaggcugagguuggg

SEQ ID NO: 928082 - RNA, 18 nt, Human
uuccuugguaacauaugc

SEQ ID NO: 928083 - RNA, 22 nt, Human
gagcauuugguuauaguaauuu

SEQ ID NO: 928084 - RNA, 20 nt, Human
cauuauuguaaucagcugua

SEQ ID NO: 928085 - RNA, 22 nt, Human
ugagcuguacuccuccccaggg

SEQ ID NO: 928086 - RNA, 22 nt, Human
gccaggcauuuauugauugaau

SEQ ID NO: 928087 - RNA, 22 nt, Human
acuuguguaacacagaaagaac

SEQ ID NO: 928088 - RNA, 22 nt, Human
uggucugauucuugcuccccaa

SEQ ID NO: 928089 - RNA, 22 nt, Human
agcugcagccucaugauucggu

SEQ ID NO: 928090 - RNA, 18 nt, Human
ccugucacguccaggccu

SEQ ID NO: 928091 - RNA, 22 nt, Human
cagaaauguucuaaugauucag

SEQ ID NO: 928092 - RNA, 22 nt, Human
cagggccucauggccggggugc

SEQ ID NO: 928093 - RNA, 22 nt, Human
aaauagcugaaaguuccuagau

SEQ ID NO: 928094 - RNA, 22 nt, Human
aagugauuuucuucuuaguuau

SEQ ID NO: 928095 - RNA, 22 nt, Human
auguauaggaguuaucuguugu

SEQ ID NO: 928096 - RNA, 22 nt, Human
augacugcucugggcucccaug

SEQ ID NO: 928097 - RNA, 22 nt, Human
aggccaaauguguauaaaacau

SEQ ID NO: 928098 - RNA, 22 nt, Human
acugagagcguguacaaacuua

SEQ ID NO: 928099 - RNA, 22 nt, Human
acaaauuaccauggaauuuggg

SEQ ID NO: 928100 - RNA, 21 nt, Human
ugcuggguuugcccaucaggc

SEQ ID NO: 928101 - RNA, 22 nt, Human
cacaucauguuaauucauuaca

SEQ ID NO: 928102 - RNA, 23 nt, Human
uuucaguuuggaccagccccgac

SEQ ID NO: 928103 - RNA, 22 nt, Human
aguauuugagagguccaggugu

SEQ ID NO: 928104 - RNA, 22 nt, Human
ggugcaugugagaaagacuggg

SEQ ID NO: 928105 - RNA, 22 nt, Human
ccugagccaagagucagaaucu

SEQ ID NO: 928106 - RNA, 22 nt, Human
uucugucuguaaacuucucaau

SEQ ID NO: 928107 - RNA, 22 nt, Human
caaguucaaguccuggcucugc

SEQ ID NO: 928108 - RNA, 19 nt, Human
gccuggcugggaugagccc

SEQ ID NO: 928109 - RNA, 22 nt, Human
uggcuggagggacccacucaga

SEQ ID NO: 928110 - RNA, 22 nt, Human
ucuuuggaucucaagguggcag

SEQ ID NO: 928111 - RNA, 22 nt, Human
uggcaggagccugcggggaggu

SEQ ID NO: 928112 - RNA, 22 nt, Human
uuguguaacuugagcaaacaca

SEQ ID NO: 928113 - RNA, 22 nt, Human
uguauagaugaggaagcuguua

SEQ ID NO: 928114 - RNA, 22 nt, Human
cugggacuggaccucugccugg

SEQ ID NO: 928115 - RNA, 22 nt, Human
acucagagcuuggcuccuugcu

SEQ ID NO: 928116 - RNA, 22 nt, Human
uuagacagagcuccuugagggc

SEQ ID NO: 928117 - RNA, 22 nt, Human
gccagagaggcaaauccuagca

SEQ ID NO: 928118 - RNA, 22 nt, Human
gagcugagaucgugccauugca

SEQ ID NO: 928119 - RNA, 22 nt, Human
ggaggggugcucagcugucacg

SEQ ID NO: 928120 - RNA, 22 nt, Human
cuggaaugucugcucaauguuu

SEQ ID NO: 928121 - RNA, 22 nt, Human
ggcuggacuuucugcugggcuc

SEQ ID NO: 928122 - RNA, 22 nt, Human
uacacaaucuguuuuuccauuu

SEQ ID NO: 928123 - RNA, 22 nt, Human
aacaaaacauuugucuuguuuc

SEQ ID NO: 928124 - RNA, 22 nt, Human
augcucuagagcucuuuucacu

SEQ ID NO: 928125 - RNA, 22 nt, Human
uccugagagguuuauaacgcag

SEQ ID NO: 928126 - RNA, 22 nt, Human
ugggugaccccagaagaggauc

SEQ ID NO: 928127 - RNA, 22 nt, Human
aaauaguucagcuuguaaaccc

SEQ ID NO: 928128 - RNA, 22 nt, Human
agaagugagacucaguugauga

SEQ ID NO: 928129 - RNA, 22 nt, Human
guuuccaugggagaagacagug

SEQ ID NO: 928130 - RNA, 22 nt, Human
gacacuuuaggccaccaugcaa

SEQ ID NO: 928131 - RNA, 22 nt, Human
ggcugagccacugcgccuggcu

SEQ ID NO: 928132 - RNA, 22 nt, Human
agagccugggaauuugcauguu

SEQ ID NO: 928133 - RNA, 22 nt, Human
acaguuaauaaguaguaaguca

SEQ ID NO: 928134 - RNA, 22 nt, Human
gucuuccacauuucaagaggcu

SEQ ID NO: 928135 - RNA, 22 nt, Human
acaggccuggguucaaauuugg

SEQ ID NO: 928136 - RNA, 22 nt, Human
uacauuuccuugacuccucaac

SEQ ID NO: 928137 - RNA, 22 nt, Human
aaucuuagguuuggcuucaucu

SEQ ID NO: 928138 - RNA, 22 nt, Human
ugcagcacuguucacaauagcc

SEQ ID NO: 928139 - RNA, 22 nt, Human
gcagggcaggauuugaacccag

SEQ ID NO: 928140 - RNA, 22 nt, Human
uuugcucaguucucuguauuuu

SEQ ID NO: 928141 - RNA, 22 nt, Human
uuugugcagcuaagaaaauggc

SEQ ID NO: 928142 - RNA, 22 nt, Human
agacauauuggcuugcuuuaau

SEQ ID NO: 928143 - RNA, 22 nt, Human
augaagucuauuuaccuaagcu

SEQ ID NO: 928144 - RNA, 22 nt, Human
acaugacagggaaugaggugaa

SEQ ID NO: 928145 - RNA, 22 nt, Human
ugggcucucucaccuggaggcu

SEQ ID NO: 928146 - RNA, 22 nt, Human
caccaucuuuuggaggggaauu

SEQ ID NO: 928147 - RNA, 22 nt, Human
auuaaacaauguaaaguucuug

SEQ ID NO: 928148 - RNA, 22 nt, Human
ucacaguguggcaacucacaga

SEQ ID NO: 928149 - RNA, 22 nt, Human
guauucuuauacucagugagcu

SEQ ID NO: 928150 - RNA, 22 nt, Human
ugccagucucacccuggguccu

SEQ ID NO: 928151 - RNA, 22 nt, Human
aaaaaugugaccacaggguguu

SEQ ID NO: 928152 - RNA, 22 nt, Human
uaacaucucccugacuuuugcu

SEQ ID NO: 928153 - RNA, 22 nt, Human
ccagagaggccaaggucguggu

SEQ ID NO: 928154 - RNA, 22 nt, Human
cuggccaggcggccccugcaug

SEQ ID NO: 928155 - RNA, 22 nt, Human
gcaguggauccaaugguaucuu

SEQ ID NO: 928156 - RNA, 22 nt, Human
uggaauagaggugcugauauua

SEQ ID NO: 928157 - RNA, 20 nt, Human
uccaugcaguuuccauacag

SEQ ID NO: 928158 - RNA, 22 nt, Human
caucucugguucagucucugug

SEQ ID NO: 928159 - RNA, 22 nt, Human
uucucucuuccaguucccacuu

SEQ ID NO: 928160 - RNA, 22 nt, Human
aucugaaaagccucuuacuccu

SEQ ID NO: 928161 - RNA, 23 nt, Human
cccuaacuaauucuagggccuaa

SEQ ID NO: 928162 - RNA, 22 nt, Human
ugcagcaucuccuuaaaucuug

SEQ ID NO: 928163 - RNA, 22 nt, Human
ucagugcucaggggagccgagg

SEQ ID NO: 928164 - RNA, 22 nt, Human
uuucuguuaggcaucauuuuaa

SEQ ID NO: 928165 - RNA, 22 nt, Human
gcauuacaggcuguaagaugca

SEQ ID NO: 928166 - RNA, 22 nt, Human
ugcuggccugguuagaaagggg

SEQ ID NO: 928167 - RNA, 20 nt, Human
ccauggccacaucugugcug

SEQ ID NO: 928168 - RNA, 22 nt, Human
gcugucacucaccaggccugca

SEQ ID NO: 928169 - RNA, 22 nt, Human
uucaaguucuguggagagcugu

SEQ ID NO: 928170 - RNA, 22 nt, Human
agaacagcagcacgucaagcug

SEQ ID NO: 928171 - RNA, 22 nt, Human
ugaaauuagaaauauguauggg

SEQ ID NO: 928172 - RNA, 22 nt, Human
agcugugugcauuugggucuca

SEQ ID NO: 928173 - RNA, 22 nt, Human
cuggcaggcacucaugaaauaa

SEQ ID NO: 928174 - RNA, 22 nt, Human
uacaacaauuuccacauuagaa

SEQ ID NO: 928175 - RNA, 22 nt, Human
aggcaaagaaguuggucaggag

SEQ ID NO: 928176 - RNA, 22 nt, Human
cugaaguucauacaauggccau

SEQ ID NO: 928177 - RNA, 22 nt, Human
aucauugaauugcuuuguucuu

SEQ ID NO: 928178 - RNA, 21 nt, Human
aggagaaacacaggucagccc

SEQ ID NO: 928179 - RNA, 22 nt, Human
cugacagauacuuaugacauaa

SEQ ID NO: 928180 - RNA, 22 nt, Human
uggggcagaguaggauuuuggc

SEQ ID NO: 928181 - RNA, 22 nt, Human
uaaugucuaugggccagauaau

SEQ ID NO: 928182 - RNA, 19 nt, Human
uuucucaggaaguuugugu

SEQ ID NO: 928183 - RNA, 22 nt, Human
augaaugaaauacagaguacuu

SEQ ID NO: 928184 - RNA, 22 nt, Human
uucuuucagaacacaagugauu

SEQ ID NO: 928185 - RNA, 22 nt, Human
uggcuacagcuuggccacagag

SEQ ID NO: 928186 - RNA, 22 nt, Human
ugaacagugaucuacauguggc

SEQ ID NO: 928187 - RNA, 22 nt, Human
caugaagcauguuuugucauga

SEQ ID NO: 928188 - RNA, 22 nt, Human
cugagcugguggaagcaugcag

SEQ ID NO: 928189 - RNA, 22 nt, Human
gucaugugacccaaccugagcc

SEQ ID NO: 928190 - RNA, 22 nt, Human
cagcucugacacaguacaaaau

SEQ ID NO: 928191 - RNA, 18 nt, Human
gugcugaauaacuacuuu

SEQ ID NO: 928192 - RNA, 22 nt, Human
cccugauggcacaguggcaggc

SEQ ID NO: 928193 - RNA, 22 nt, Human
ucagagcuuaucucuugcugga

SEQ ID NO: 928194 - RNA, 22 nt, Human
uggcccuguggaggucagugag

SEQ ID NO: 928195 - RNA, 22 nt, Human
gcugcucuacccaugcaucugu

SEQ ID NO: 928196 - RNA, 21 nt, Human
guggccugauuaugaaugggu

SEQ ID NO: 928197 - RNA, 22 nt, Human
aagcuuugcaaugcuucauuau

SEQ ID NO: 928198 - RNA, 22 nt, Human
aggcacaaagacagaaaagcac

SEQ ID NO: 928199 - RNA, 20 nt, Human
agacaaaaugacuucaugca

SEQ ID NO: 928200 - RNA, 22 nt, Human
auggaagggacagaagggcaag

SEQ ID NO: 928201 - RNA, 17 nt, Human
ugcagcaguucccaucu

SEQ ID NO: 928202 - RNA, 22 nt, Human
ucagaaccugcaagucuaaccu

SEQ ID NO: 928203 - RNA, 22 nt, Human
cuuugguguucauuaaacaugg

SEQ ID NO: 928204 - RNA, 22 nt, Human
uccuccagcuacuaggcaaaua

SEQ ID NO: 928205 - RNA, 22 nt, Human
gccagcagcucuugggcgggca

SEQ ID NO: 928206 - RNA, 22 nt, Human
aaugugugccuguuaaggggca

SEQ ID NO: 928207 - RNA, 22 nt, Human
cagcagcugacuccaagagagc

SEQ ID NO: 928208 - RNA, 22 nt, Human
cuggugccuccucccugugcuu

SEQ ID NO: 928209 - RNA, 22 nt, Human
ccagaagggcuauugcagugac

SEQ ID NO: 928210 - RNA, 20 nt, Human
gaaaucaguuaaugaugguu

SEQ ID NO: 928211 - RNA, 22 nt, Human
ucagcagccgcagcugacucag

SEQ ID NO: 928212 - RNA, 22 nt, Human
aggagugagcuuuggggucaga

SEQ ID NO: 928213 - RNA, 22 nt, Human
gauguacuuuaaaauacuucag

SEQ ID NO: 928214 - RNA, 22 nt, Human
aaagaaauaccuuucucagcuu

SEQ ID NO: 928215 - RNA, 22 nt, Human
gagucagauugcagacagggcu

SEQ ID NO: 928216 - RNA, 20 nt, Human
ucccaucacgccugugccag

SEQ ID NO: 928217 - RNA, 22 nt, Human
acugagccugugcccucaucag

SEQ ID NO: 928218 - RNA, 22 nt, Human
agggagcugggccacacugauc

SEQ ID NO: 928219 - RNA, 22 nt, Human
aaugggaggauuuucucucuug

SEQ ID NO: 928220 - RNA, 17 nt, Human
ggccuugggcugcucuu

SEQ ID NO: 928221 - RNA, 22 nt, Human
gguggccaggccagcucuggcc

SEQ ID NO: 928222 - RNA, 22 nt, Human
ucacugcagagaccucuaguca

SEQ ID NO: 928223 - RNA, 22 nt, Human
cagggguguuuuuggccaggag

SEQ ID NO: 928224 - RNA, 22 nt, Human
augagguacuaguauauacgua

SEQ ID NO: 928225 - RNA, 22 nt, Human
gaugaaaaucuugagaugucga

SEQ ID NO: 928226 - RNA, 23 nt, Human
aacaauagagauaaagugagauc

SEQ ID NO: 928227 - RNA, 22 nt, Human
uucuuuaucaguuacucauagg

SEQ ID NO: 928228 - RNA, 22 nt, Human
uuucugauuugacuugaaguau

SEQ ID NO: 928229 - RNA, 22 nt, Human
uacagugcaaugugauguagau

SEQ ID NO: 928230 - RNA, 22 nt, Human
ggguggagguggguuuugagau

SEQ ID NO: 928231 - RNA, 22 nt, Human
aagaagaaguguuauuuuuaga

SEQ ID NO: 928232 - RNA, 19 nt, Human
acaaggcugggagagcgcc

SEQ ID NO: 928233 - RNA, 22 nt, Human
uaaauguuacuuuccuuucaca

SEQ ID NO: 928234 - RNA, 22 nt, Human
uguguguuauuuucagccauua

SEQ ID NO: 928235 - RNA, 22 nt, Human
uuguuacagcagcaauagaaaa

SEQ ID NO: 928236 - RNA, 22 nt, Human
acaugcauacugcugccaacgc

SEQ ID NO: 928237 - RNA, 22 nt, Human
agaaccuuccaucacucccuac

SEQ ID NO: 928238 - RNA, 22 nt, Human
ucaguguuuccugugguacagc

SEQ ID NO: 928239 - RNA, 22 nt, Human
gaagauuuauaaggaccuuauu

SEQ ID NO: 928240 - RNA, 21 nt, Human
aucauucuggaaaauucaagc

SEQ ID NO: 928241 - RNA, 22 nt, Human
ucaggaaauggacaucuuugcu

SEQ ID NO: 928242 - RNA, 22 nt, Human
aagcaauucacaguucacuuaa

SEQ ID NO: 928243 - RNA, 22 nt, Human
uaacuucaagucuguggaucag

SEQ ID NO: 928244 - RNA, 21 nt, Human
uuuaugcagauaaugcuauuu

SEQ ID NO: 928245 - RNA, 18 nt, Human
gagagcugcuaccuagcu

SEQ ID NO: 928246 - RNA, 23 nt, Human
agacugaggcugccagggucaga

SEQ ID NO: 928247 - RNA, 22 nt, Human
acaugcuuguuuuucacaaccu

SEQ ID NO: 928248 - RNA, 22 nt, Human
acuuucaauucccuuagcaacu

SEQ ID NO: 928249 - RNA, 22 nt, Human
ggaggccagaaucuguguugga

SEQ ID NO: 928250 - RNA, 22 nt, Human
cauagaaaagaguagguaaugu

SEQ ID NO: 928251 - RNA, 22 nt, Human
auguuaccaucuuuuaucuaca

SEQ ID NO: 928252 - RNA, 19 nt, Human
aggcagcacccaguccuug

SEQ ID NO: 928253 - RNA, 22 nt, Human
gagugcuggggugcagagaggu

SEQ ID NO: 928254 - RNA, 22 nt, Human
gaagcagagccuaaggcagaca

SEQ ID NO: 928255 - RNA, 20 nt, Human
cuccucaguuccaugggagg

SEQ ID NO: 928256 - RNA, 22 nt, Human
gcugaccuguggcagaagcuca

SEQ ID NO: 928257 - RNA, 22 nt, Human
ugcuggcaccagaaugacugca

SEQ ID NO: 928258 - RNA, 22 nt, Human
ccagggcucuaugaggguggag

SEQ ID NO: 928259 - RNA, 22 nt, Human
uuggccagugaaccaggccugg

SEQ ID NO: 928260 - RNA, 22 nt, Human
cuggcugauuuucucacuucuc

SEQ ID NO: 928261 - RNA, 22 nt, Human
uagaaccucugauuauguuacu

SEQ ID NO: 928262 - RNA, 22 nt, Human
aaauuccauuuugugacuauuc

SEQ ID NO: 928263 - RNA, 22 nt, Human
aggucacaggguugaaguacuu

SEQ ID NO: 928264 - RNA, 20 nt, Human
agcuaagaggaaaagugaga

SEQ ID NO: 928265 - RNA, 22 nt, Human
ggagaguuguuuuugccuagau

SEQ ID NO: 928266 - RNA, 22 nt, Human
aagugauuugcaugcuuaauuc

SEQ ID NO: 928267 - RNA, 22 nt, Human
auagucuuagaaucuugagugu

SEQ ID NO: 928268 - RNA, 22 nt, Human
ugcauacugaacagcaugcuaa

SEQ ID NO: 928269 - RNA, 22 nt, Human
uuuaccuucuuuuaacuacagu

SEQ ID NO: 928270 - RNA, 22 nt, Human
acaaaggugagcagaagacaca

SEQ ID NO: 928271 - RNA, 22 nt, Human
acucagaaugacugaugcugug

SEQ ID NO: 928272 - RNA, 22 nt, Human
agucugugaacuuggcagggaa

SEQ ID NO: 928273 - RNA, 22 nt, Human
ggccagcuuugagcugcaggaa

SEQ ID NO: 928274 - RNA, 22 nt, Human
gugagccgaguauaguucauag

SEQ ID NO: 928275 - RNA, 21 nt, Human
ugccauuuuaaccaagugugc

SEQ ID NO: 928276 - RNA, 22 nt, Human
auuucauggcagacuuuaaccc

SEQ ID NO: 928277 - RNA, 22 nt, Human
acaaauucuacaaucauaugau

SEQ ID NO: 928278 - RNA, 23 nt, Human
ggauacaaagauuaauaguagag

SEQ ID NO: 928279 - RNA, 22 nt, Human
uucuguguugugacauucuaga

SEQ ID NO: 928280 - RNA, 22 nt, Human
guauguauguauauguuuaaga

SEQ ID NO: 928281 - RNA, 22 nt, Human
cuccagcugccaccagauguuu

SEQ ID NO: 928282 - RNA, 22 nt, Human
aagagggaaauuguuggcugcu

SEQ ID NO: 928283 - RNA, 22 nt, Human
uguguguccuugaccucagugg

SEQ ID NO: 928284 - RNA, 22 nt, Human
ggccuuggccuagcccuccagg

SEQ ID NO: 928285 - RNA, 22 nt, Human
guggcugaguggucgagucaga

SEQ ID NO: 928286 - RNA, 22 nt, Human
acauaauagguaccugaauaau

SEQ ID NO: 928287 - RNA, 22 nt, Human
ccacuuugaaccacugaggugg

SEQ ID NO: 928288 - RNA, 19 nt, Human
agcaucucccugaucauuc

SEQ ID NO: 928289 - RNA, 22 nt, Human
uggacccugaagcaacagggag

SEQ ID NO: 928290 - RNA, 22 nt, Human
uccagggcuuggcugggacggu

SEQ ID NO: 928291 - RNA, 22 nt, Human
cagcagcagccccaggaagguu

SEQ ID NO: 928292 - RNA, 22 nt, Human
gcaggcuggucugaccaucccu

SEQ ID NO: 928293 - RNA, 20 nt, Human
ugacauagcucuuggggugc

SEQ ID NO: 928294 - RNA, 22 nt, Human
ccugcucagccccagcucaccc

SEQ ID NO: 928295 - RNA, 22 nt, Human
agcagcugccagagagaguucc

SEQ ID NO: 928296 - RNA, 22 nt, Human
gccagcucagugccaggccccu

SEQ ID NO: 928297 - RNA, 22 nt, Human
augggcugggaucugaguguca

SEQ ID NO: 928298 - RNA, 22 nt, Human
augggaggaugcucgggugcuc

SEQ ID NO: 928299 - RNA, 22 nt, Human
ugugggaccucagagggucccc

SEQ ID NO: 928300 - RNA, 22 nt, Human
guucccauugcccuagcuugua

SEQ ID NO: 928301 - RNA, 22 nt, Human
guggcagaaaugggacuuugag

SEQ ID NO: 928302 - RNA, 22 nt, Human
cagcaaaagccagcauaagcuc

SEQ ID NO: 928303 - RNA, 22 nt, Human
agugaauucuccacccaguagg

SEQ ID NO: 928304 - RNA, 22 nt, Human
uaacacugugguguucuuuguc

SEQ ID NO: 928305 - RNA, 22 nt, Human
gagacugaggucaccaggcugu

SEQ ID NO: 928306 - RNA, 22 nt, Human
guggcagugugaggauccugcu

SEQ ID NO: 928307 - RNA, 22 nt, Human
auuugcaaagguuaacagcagu

SEQ ID NO: 928308 - RNA, 22 nt, Human
ugcaggaauauugaugaacuua

SEQ ID NO: 928309 - RNA, 22 nt, Human
aacagaaucuuggguucuuuuc

SEQ ID NO: 928310 - RNA, 22 nt, Human
aggaggguacaauggguggaaa

SEQ ID NO: 928311 - RNA, 22 nt, Human
cauuugaagacuuagaagagga

SEQ ID NO: 928312 - RNA, 22 nt, Human
aacuguacgauaauaaauuugu

SEQ ID NO: 928313 - RNA, 23 nt, Human
gcggaaggggucauaauggagac

SEQ ID NO: 928314 - RNA, 22 nt, Human
cauuagcauucagugacuugua

SEQ ID NO: 928315 - RNA, 22 nt, Human
auucuaauuaguucuacauguu

SEQ ID NO: 928316 - RNA, 22 nt, Human
uuucaaauagaaucuuuccaaa

SEQ ID NO: 928317 - RNA, 22 nt, Human
uuucucuuucaaucugcaguac

SEQ ID NO: 928318 - RNA, 22 nt, Human
aucaggaagccagucuaaugga

SEQ ID NO: 928319 - RNA, 22 nt, Human
gggcuccgcccuuggcugagcu

SEQ ID NO: 928320 - RNA, 22 nt, Human
uccugguggcuuucccugccuu

SEQ ID NO: 928321 - RNA, 22 nt, Human
cucagugcuucuagcuugauga

SEQ ID NO: 928322 - RNA, 22 nt, Human
cauggcagggcugugggcaggu

SEQ ID NO: 928323 - RNA, 22 nt, Human
uucugcuguaguugcaucuguu

SEQ ID NO: 928324 - RNA, 22 nt, Human
aaagggagcauggcugcaggga

SEQ ID NO: 928325 - RNA, 22 nt, Human
ugcuuaauguacgugaguguac

SEQ ID NO: 928326 - RNA, 22 nt, Human
acucuauaaagauaccucaauu

SEQ ID NO: 928327 - RNA, 22 nt, Human
gagcccaguaggcaaagcugca

SEQ ID NO: 928328 - RNA, 22 nt, Human
aagcugcagacccccugucuca

SEQ ID NO: 928329 - RNA, 19 nt, Human
ugagccagggaggccaugc

SEQ ID NO: 928330 - RNA, 22 nt, Human
cugggugguuuugaugugaauu

SEQ ID NO: 928331 - RNA, 22 nt, Human
uuguuuuaucuuucuacagacu

SEQ ID NO: 928332 - RNA, 22 nt, Human
ggaggccuugccugcaggcaca

SEQ ID NO: 928333 - RNA, 22 nt, Human
uauguacaccggggaagguggg

SEQ ID NO: 928334 - RNA, 22 nt, Human
augcaagauguauagaagacuu

SEQ ID NO: 928335 - RNA, 21 nt, Human
agcugcaaaaacauacaguuc

SEQ ID NO: 928336 - RNA, 22 nt, Human
caucagaaggccagaggguagc

SEQ ID NO: 928337 - RNA, 22 nt, Human
uucaaaguccugucagguagcc

SEQ ID NO: 928338 - RNA, 19 nt, Human
cuuguaaagggcuguuucu

SEQ ID NO: 928339 - RNA, 22 nt, Human
agcuccuggcaaggucauggug

SEQ ID NO: 928340 - RNA, 22 nt, Human
gguuccagagugggcugggaaa

SEQ ID NO: 928341 - RNA, 22 nt, Human
cuagagaaacgccgugggagga

SEQ ID NO: 928342 - RNA, 22 nt, Human
gggguaggaagagaaaauagug

SEQ ID NO: 928343 - RNA, 21 nt, Human
caguucgucuuagaaaauggc

SEQ ID NO: 928344 - RNA, 22 nt, Human
ugggagaggcugccaucuugca

SEQ ID NO: 928345 - RNA, 22 nt, Human
gcugaggucaggagcugugggg

SEQ ID NO: 928346 - RNA, 19 nt, Human
ccugugugggguagagauc

SEQ ID NO: 928347 - RNA, 22 nt, Human
uuucauugucagagcuuugaau

SEQ ID NO: 928348 - RNA, 22 nt, Human
agcaggagagcagugcgugguc

SEQ ID NO: 928349 - RNA, 22 nt, Human
accaggcuugauaccaagaaau

SEQ ID NO: 928350 - RNA, 22 nt, Human
gaugucuucucaacuguagacc

SEQ ID NO: 928351 - RNA, 22 nt, Human
uuccuaacaagucuaucuuuga

SEQ ID NO: 928352 - RNA, 22 nt, Human
uaguuuugauuaguauugucuu

SEQ ID NO: 928353 - RNA, 21 nt, Human
aggggacagaguagcuccagg

SEQ ID NO: 928354 - RNA, 22 nt, Human
aagaggccuggaggcagaggug

SEQ ID NO: 928355 - RNA, 22 nt, Human
auacauguacauaaauguagca

SEQ ID NO: 928356 - RNA, 22 nt, Human
uuacuuuagggauguuuugcuu

SEQ ID NO: 928357 - RNA, 22 nt, Human
ugucuucauucuguauguccag

SEQ ID NO: 928358 - RNA, 22 nt, Human
agaagugccauacuguggucca

SEQ ID NO: 928359 - RNA, 21 nt, Human
gcaaggcaaugccaugauuuc

SEQ ID NO: 928360 - RNA, 22 nt, Human
gcuauuuuugagccauuuauaa

SEQ ID NO: 928361 - RNA, 22 nt, Human
cagguuaguauuuuuaguucau

SEQ ID NO: 928362 - RNA, 22 nt, Human
uggcucaggggucuggcucugu

SEQ ID NO: 928363 - RNA, 22 nt, Human
uuucccaggcuggaaugcagug

SEQ ID NO: 928364 - RNA, 22 nt, Human
aaguccuagacuuggauaguuu

SEQ ID NO: 928365 - RNA, 22 nt, Human
uugugucaggggcccauacuca

SEQ ID NO: 928366 - RNA, 22 nt, Human
cuuuucauuguuuguacaugca

SEQ ID NO: 928367 - RNA, 22 nt, Human
uagcugccauugcuccaggaag

SEQ ID NO: 928368 - RNA, 23 nt, Human
aggcaaugcccugcugagaacuc

SEQ ID NO: 928369 - RNA, 22 nt, Human
gguuucaacuuuugugaggaau

SEQ ID NO: 928370 - RNA, 22 nt, Human
acaggcugcugggcuccgugcu

SEQ ID NO: 928371 - RNA, 22 nt, Human
augaccaguguugcuggccccg

SEQ ID NO: 928372 - RNA, 22 nt, Human
caggaaggcgcggcugugccug

SEQ ID NO: 928373 - RNA, 22 nt, Human
acagaauauuguaagugccacu

SEQ ID NO: 928374 - RNA, 21 nt, Human
aagaggaagcauuauggcaua

SEQ ID NO: 928375 - RNA, 22 nt, Human
uccagagcucugggcauagcug

SEQ ID NO: 928376 - RNA, 22 nt, Human
agaagcagacucugaggcaagg

SEQ ID NO: 928377 - RNA, 22 nt, Human
uugguuccuucugaaaguauug

SEQ ID NO: 928378 - RNA, 22 nt, Human
auacaguauuaccuguucagga

SEQ ID NO: 928379 - RNA, 22 nt, Human
gccagagugauguaacauauau

SEQ ID NO: 928380 - RNA, 22 nt, Human
cuuuuacauuuguugaagagua

SEQ ID NO: 928381 - RNA, 22 nt, Human
uuagaaucagguguuauaauca

SEQ ID NO: 928382 - RNA, 22 nt, Human
acuguguccuauuuccuugaca

SEQ ID NO: 928383 - RNA, 22 nt, Human
aaagauuuaugaaguucaauua

SEQ ID NO: 928384 - RNA, 22 nt, Human
caaguucuggacaggggaauau

SEQ ID NO: 928385 - RNA, 22 nt, Human
aggccagcagcaugacggcauc

SEQ ID NO: 928386 - RNA, 22 nt, Human
auggcagcuggcuugggcaccu

SEQ ID NO: 928387 - RNA, 22 nt, Human
ucuuuggccuuaggagcccuug

SEQ ID NO: 928388 - RNA, 22 nt, Human
acacagaguuugacacauggga

SEQ ID NO: 928389 - RNA, 22 nt, Human
aagcacaggaucuugaggagcg

SEQ ID NO: 928390 - RNA, 22 nt, Human
uuucaacagaauaugaucagag

SEQ ID NO: 928391 - RNA, 22 nt, Human
aguuuccaaauauuguuuuagc

SEQ ID NO: 928392 - RNA, 23 nt, Human
ugcagccacucaggagcucagug

SEQ ID NO: 928393 - RNA, 22 nt, Human
aacauagcuuuacucaaaugac

SEQ ID NO: 928394 - RNA, 22 nt, Human
gaaggaaggaaaaauauauuua

SEQ ID NO: 928395 - RNA, 22 nt, Human
ccuggguccuggcagccuccug

SEQ ID NO: 928396 - RNA, 22 nt, Human
auguaaaguucaguacaguuuu

SEQ ID NO: 928397 - RNA, 17 nt, Human
ccaggcuccaucacugu

SEQ ID NO: 928398 - RNA, 18 nt, Human
uucuccagaaaacauagc

SEQ ID NO: 928399 - RNA, 22 nt, Human
aaaguacuuacaguaugcuugg

SEQ ID NO: 928400 - RNA, 22 nt, Human
cccaauuucuuccucauuugcc

SEQ ID NO: 928401 - RNA, 22 nt, Human
aggcucaguucacgucaacuuu

SEQ ID NO: 928402 - RNA, 22 nt, Human
cuguccaucagaaaggggcuua

SEQ ID NO: 928403 - RNA, 22 nt, Human
acagggagaugggugaaagcgg

SEQ ID NO: 928404 - RNA, 22 nt, Human
cauaacuugcuuuggagcccgg

SEQ ID NO: 928405 - RNA, 22 nt, Human
cagcagggaagcugugcuguuu

SEQ ID NO: 928406 - RNA, 16 nt, Human
cuccucuccuucagga

SEQ ID NO: 928407 - RNA, 22 nt, Human
uccagcaguccaugugagacac

SEQ ID NO: 928408 - RNA, 22 nt, Human
uggaguaaguaugccuuggugg

SEQ ID NO: 928409 - RNA, 22 nt, Human
aauuuguacaaaauguuuauaa

SEQ ID NO: 928410 - RNA, 22 nt, Human
ggaggggaacuaaucccgugac

SEQ ID NO: 928411 - RNA, 22 nt, Human
ugcuugauuagggaagucacau

SEQ ID NO: 928412 - RNA, 21 nt, Human
ccuggagacaaagacagggug

SEQ ID NO: 928413 - RNA, 22 nt, Human
caggcuuuugcauagcacuggg

SEQ ID NO: 928414 - RNA, 22 nt, Human
gacaagacauugguaaagauau

SEQ ID NO: 928415 - RNA, 22 nt, Human
aauugaaaauauuguagaccau

SEQ ID NO: 928416 - RNA, 22 nt, Human
gcauucuucacaguauuccucc

SEQ ID NO: 928417 - RNA, 22 nt, Human
cacaguggaaacagcuaagccu

SEQ ID NO: 928418 - RNA, 22 nt, Human
caauugaacagaugaguuaaau

SEQ ID NO: 928419 - RNA, 22 nt, Human
uuucacauuuuauacuuaagcc

SEQ ID NO: 928420 - RNA, 22 nt, Human
gacccaggagugcagagagugg

SEQ ID NO: 928421 - RNA, 22 nt, Human
cccaguggcuuuugcccagguu

SEQ ID NO: 928422 - RNA, 22 nt, Human
ugguauggccuggagaaugcag

SEQ ID NO: 928423 - RNA, 22 nt, Human
aguuucugcaaaucauuuuuau

SEQ ID NO: 928424 - RNA, 22 nt, Human
cagcuccuguuggucuugagga

SEQ ID NO: 928425 - RNA, 22 nt, Human
gggaagggagggccuccaguca

SEQ ID NO: 928426 - RNA, 22 nt, Human
gcaguugcaggauuuguguugu

SEQ ID NO: 928427 - RNA, 22 nt, Human
uguuuucacaaugaugucagau

SEQ ID NO: 928428 - RNA, 22 nt, Human
cauuuuauccucugggaagcua

SEQ ID NO: 928429 - RNA, 22 nt, Human
ggcaggugcugggagcaucuca

SEQ ID NO: 928430 - RNA, 22 nt, Human
uacagugacagauagggauaga

SEQ ID NO: 928431 - RNA, 22 nt, Human
auuuaucucuggaaacuaagca

SEQ ID NO: 928432 - RNA, 22 nt, Human
uuucagcuuuaccauuccauga

SEQ ID NO: 928433 - RNA, 22 nt, Human
uucuaagggguucacaggcaua

SEQ ID NO: 928434 - RNA, 22 nt, Human
ugagcagacucugcagagccac

SEQ ID NO: 928435 - RNA, 22 nt, Human
cugccugugaacauacuggggg

SEQ ID NO: 928436 - RNA, 22 nt, Human
gcauacagagaggauguggcau

SEQ ID NO: 928437 - RNA, 22 nt, Human
cugcucuaacugcauuaguuuu

SEQ ID NO: 928438 - RNA, 23 nt, Human
uugcagggauggaguucaaaaug

SEQ ID NO: 928439 - RNA, 22 nt, Human
aauggcaaaaggaguuaguuga

SEQ ID NO: 928440 - RNA, 22 nt, Human
uaagauaugguaggaaguuugg

SEQ ID NO: 928441 - RNA, 21 nt, Human
cagcaagacauguuuaucaag

SEQ ID NO: 928442 - RNA, 22 nt, Human
acaguguacuagguacauguuc

SEQ ID NO: 928443 - RNA, 22 nt, Human
gcuuucuugcugcaugguggcu

SEQ ID NO: 928444 - RNA, 22 nt, Human
gcugucuggcauggcguggcug

SEQ ID NO: 928445 - RNA, 22 nt, Human
ccuccaggcugaauaucuagaa

SEQ ID NO: 928446 - RNA, 22 nt, Human
aaguucaaguguaaucuuuauu

SEQ ID NO: 928447 - RNA, 21 nt, Human
ucucuuucuggaagcuucccu

SEQ ID NO: 928448 - RNA, 22 nt, Human
ccaagaggguugcccugagcgu

SEQ ID NO: 928449 - RNA, 22 nt, Human
acucugaaugugcauguaaauc

SEQ ID NO: 928450 - RNA, 21 nt, Human
agacagaacaacugcucucca

SEQ ID NO: 928451 - RNA, 22 nt, Human
uaugucuggaaguguacuuguc

SEQ ID NO: 928452 - RNA, 22 nt, Human
ggcuggcuuucucuccgcaccu

SEQ ID NO: 928453 - RNA, 20 nt, Human
gagauuaacugagaaucuag

SEQ ID NO: 928454 - RNA, 22 nt, Human
ugauuucucuuggcaauauguu

SEQ ID NO: 928455 - RNA, 22 nt, Human
ccugcccagcuucccgagugca

SEQ ID NO: 928456 - RNA, 22 nt, Human
aaagugcugggauuacaggugu

SEQ ID NO: 928457 - RNA, 22 nt, Human
gugguuugugcauagcuccuau

SEQ ID NO: 928458 - RNA, 22 nt, Human
uauugcaucucuucauaucugu

SEQ ID NO: 928459 - RNA, 22 nt, Human
ccucuggcucacagcaccaacu

SEQ ID NO: 928460 - RNA, 22 nt, Human
aagacauuuugaaauuggaagc

SEQ ID NO: 928461 - RNA, 22 nt, Human
uguuuuaaagccauugccuuuc

SEQ ID NO: 928462 - RNA, 22 nt, Human
gcagccagcccuagucccacuu

SEQ ID NO: 928463 - RNA, 22 nt, Human
uauuaauucuugccaauucucc

SEQ ID NO: 928464 - RNA, 22 nt, Human
aaucuuuuaggggauccugagg

SEQ ID NO: 928465 - RNA, 22 nt, Human
agagucuguuacuuguccccua

SEQ ID NO: 928466 - RNA, 22 nt, Human
cauucauaagacuuugcucuug

SEQ ID NO: 928467 - RNA, 22 nt, Human
ggcuugggagcaggcaugugac

SEQ ID NO: 928468 - RNA, 21 nt, Human
ucagugcaauucuauggggaa

SEQ ID NO: 928469 - RNA, 22 nt, Human
aguguuaaugguguauauuagg

SEQ ID NO: 928470 - RNA, 22 nt, Human
ucccaggcagcuucuuucauca

SEQ ID NO: 928471 - RNA, 22 nt, Human
auggccugggcccgcuucagau

SEQ ID NO: 928472 - RNA, 22 nt, Human
gcuggcuugacagaggccuggg

SEQ ID NO: 928473 - RNA, 22 nt, Human
uauguugagugaaagaagcuag

SEQ ID NO: 928474 - RNA, 22 nt, Human
ggaaacauuccaagaguugaaa

SEQ ID NO: 928475 - RNA, 22 nt, Human
gcugcuuugacagugggaacag

SEQ ID NO: 928476 - RNA, 22 nt, Human
ucuucaugaaauugauugcuua

SEQ ID NO: 928477 - RNA, 22 nt, Human
cugugggcugaaagugcucccg

SEQ ID NO: 928478 - RNA, 22 nt, Human
uggcaggagguuuucuccagga

SEQ ID NO: 928479 - RNA, 22 nt, Human
uccuggauuaauagggagcugu

SEQ ID NO: 928480 - RNA, 21 nt, Human
guucuauuuugcaaacuucug

SEQ ID NO: 928481 - RNA, 21 nt, Human
augugaaauaucaucagagca

SEQ ID NO: 928482 - RNA, 20 nt, Human
uguuauuagcaagcuucuuu

SEQ ID NO: 928483 - RNA, 22 nt, Human
cccaggcugcguauccacaaua

SEQ ID NO: 928484 - RNA, 22 nt, Human
ucccugggccuccugcuaugca

SEQ ID NO: 928485 - RNA, 23 nt, Human
ucucagugccgauugcauacaca

SEQ ID NO: 928486 - RNA, 21 nt, Human
ggaagggcucugaggacggcu

SEQ ID NO: 928487 - RNA, 22 nt, Human
ccaagccuagucgugcacacag

SEQ ID NO: 928488 - RNA, 22 nt, Human
agucuccacuugacaucagcag

SEQ ID NO: 928489 - RNA, 22 nt, Human
uuuaagagcuaguaugucauuu

SEQ ID NO: 928490 - RNA, 22 nt, Human
gagagcccugcuccuaucccag

SEQ ID NO: 928491 - RNA, 22 nt, Human
acuuucaagcccucuagagaca

SEQ ID NO: 928492 - RNA, 22 nt, Human
cagccugggcuccagagucccu

SEQ ID NO: 928493 - RNA, 22 nt, Human
accacccucagcagagcugaaa

SEQ ID NO: 928494 - RNA, 22 nt, Human
cacagguauauguguauauacu

SEQ ID NO: 928495 - RNA, 22 nt, Human
auggcagggaccaagcugucau

SEQ ID NO: 928496 - RNA, 22 nt, Human
caguaguggggagcccaguguc

SEQ ID NO: 928497 - RNA, 22 nt, Human
acauguguggccgcuguagaca

SEQ ID NO: 928498 - RNA, 22 nt, Human
gaugucuuagguaacauucuau

SEQ ID NO: 928499 - RNA, 22 nt, Human
ugccagagaguggcuggguguc

SEQ ID NO: 928500 - RNA, 22 nt, Human
ugcagcucauugcuggggucug

SEQ ID NO: 928501 - RNA, 22 nt, Human
cugggugccagcauggcugagu

SEQ ID NO: 928502 - RNA, 22 nt, Human
uauaguaaaauuuucauuuaug

SEQ ID NO: 928503 - RNA, 20 nt, Human
ggcaugagaugugagggagg

SEQ ID NO: 928504 - RNA, 22 nt, Human
aagaaugagcucaaagaucuua

SEQ ID NO: 928505 - RNA, 22 nt, Human
acagacaguaaauaguguggcu

SEQ ID NO: 928506 - RNA, 21 nt, Human
uugagcauguacuuugugcuu

SEQ ID NO: 928507 - RNA, 22 nt, Human
acugacaccaccaauauguuca

SEQ ID NO: 928508 - RNA, 22 nt, Human
acauuagauaacucagaaagga

SEQ ID NO: 928509 - RNA, 22 nt, Human
acaggcagguugagaaacauuu

SEQ ID NO: 928510 - RNA, 22 nt, Human
acagcugcugcuucucacuggg

SEQ ID NO: 928511 - RNA, 22 nt, Human
acaugcuuugcacuuacaucau

SEQ ID NO: 928512 - RNA, 22 nt, Human
gcuggaagaaugagugccucgu

SEQ ID NO: 928513 - RNA, 22 nt, Human
auuuauuaugggauuuggcuca

SEQ ID NO: 928514 - RNA, 22 nt, Human
uuaaaaggguaagcagcaacuu

SEQ ID NO: 928515 - RNA, 21 nt, Human
guguaaacggacucaugcagu

SEQ ID NO: 928516 - RNA, 22 nt, Human
uuaauuaagagauacugcagua

SEQ ID NO: 928517 - RNA, 17 nt, Human
uucaagauauugaaaug

SEQ ID NO: 928518 - RNA, 15 nt, Human
uauacagaaguucag

SEQ ID NO: 928519 - RNA, 22 nt, Human
gggaugacaaagugucuguccc

SEQ ID NO: 928520 - RNA, 22 nt, Human
acuuuuuaguuuccucaaacau

SEQ ID NO: 928521 - RNA, 22 nt, Human
uucagagcuggugucuacagcu

SEQ ID NO: 928522 - RNA, 22 nt, Human
ucuaggguccacagggucagcc

SEQ ID NO: 928523 - RNA, 23 nt, Human
agugcuggagaagcuucuggcuu

SEQ ID NO: 928524 - RNA, 22 nt, Human
agacaugguuuauuuuaauggu

SEQ ID NO: 928525 - RNA, 22 nt, Human
cagagggaguuucugagguugc

SEQ ID NO: 928526 - RNA, 22 nt, Human
gagggggcuagcgcagugccca

SEQ ID NO: 928527 - RNA, 22 nt, Human
uggcugggagcuggaacugggc

SEQ ID NO: 928528 - RNA, 22 nt, Human
aaguuuagucuugucuuaguaa

SEQ ID NO: 928529 - RNA, 21 nt, Human
ccaggguccagcugccauggu

SEQ ID NO: 928530 - RNA, 22 nt, Human
aaguguuuuguaaacagaaaag

SEQ ID NO: 928531 - RNA, 22 nt, Human
ucuuuggcauuuaggagcagga

SEQ ID NO: 928532 - RNA, 20 nt, Human
uaggcagagcugugcagccu

SEQ ID NO: 928533 - RNA, 22 nt, Human
agcuguguguuuccacugagcu

SEQ ID NO: 928534 - RNA, 22 nt, Human
ugugaagaucaggguccuagag

SEQ ID NO: 928535 - RNA, 22 nt, Human
ccuggggagagaaagcccagcc

SEQ ID NO: 928536 - RNA, 22 nt, Human
acacauuuuggcuagguggaga

SEQ ID NO: 928537 - RNA, 22 nt, Human
ucccaaggcacagggcagggac

SEQ ID NO: 928538 - RNA, 22 nt, Human
gaaagccaucuggcugcuggga

SEQ ID NO: 928539 - RNA, 22 nt, Human
cccagaggugaaggagguggga

SEQ ID NO: 928540 - RNA, 22 nt, Human
gaaacagggaguaguaauuuac

SEQ ID NO: 928541 - RNA, 22 nt, Human
uaacuuuucuaggugugauaau

SEQ ID NO: 928542 - RNA, 22 nt, Human
ccagugugcaaucucuggcuua

SEQ ID NO: 928543 - RNA, 22 nt, Human
aaguucuacuguggguaaaaug

SEQ ID NO: 928544 - RNA, 22 nt, Human
auauacuuuucacuaauggcua

SEQ ID NO: 928545 - RNA, 22 nt, Human
aaauagacacaugcguucauau

SEQ ID NO: 928546 - RNA, 22 nt, Human
ccacaagacucugucagcauaa

SEQ ID NO: 928547 - RNA, 22 nt, Human
cacaggaagaucucccagaggu

SEQ ID NO: 928548 - RNA, 21 nt, Human
ugagugccaccugcuggccaa

SEQ ID NO: 928549 - RNA, 22 nt, Human
uuacaguuuaccaagaauauug

SEQ ID NO: 928550 - RNA, 22 nt, Human
gcaggaagggaaagguugacuc

SEQ ID NO: 928551 - RNA, 17 nt, Human
auguaagaagaaagcag

SEQ ID NO: 928552 - RNA, 22 nt, Human
ucucccuggagcccugaagcau

SEQ ID NO: 928553 - RNA, 22 nt, Human
uccaggccacauggauggcgau

SEQ ID NO: 928554 - RNA, 22 nt, Human
uuccaggaggcacugacagagg

SEQ ID NO: 928555 - RNA, 22 nt, Human
gacuacagauagccaauuaagu

SEQ ID NO: 928556 - RNA, 22 nt, Human
auggcagaauuaggauuucaag

SEQ ID NO: 928557 - RNA, 22 nt, Human
cugcccugcuaaugaguuccaa

SEQ ID NO: 928558 - RNA, 23 nt, Human
ccucccaggcugcgagucccgag

SEQ ID NO: 928559 - RNA, 22 nt, Human
gugggcagccuguccggagacc

SEQ ID NO: 928560 - RNA, 22 nt, Human
acaugcauggcugcuuaaauua

SEQ ID NO: 928561 - RNA, 22 nt, Human
auuggaaguauuucaucaaaag

SEQ ID NO: 928562 - RNA, 22 nt, Human
ugcccugugugugcaagcacug

SEQ ID NO: 928563 - RNA, 22 nt, Human
aaacacagggauauauauucca

SEQ ID NO: 928564 - RNA, 22 nt, Human
aggccacagucagugggugcug

SEQ ID NO: 928565 - RNA, 22 nt, Human
uggcagagugcagaagaggcau

SEQ ID NO: 928566 - RNA, 22 nt, Human
aaauuuuaguaaggaaguugag

SEQ ID NO: 928567 - RNA, 22 nt, Human
uccugccuagcaggugaccuau

SEQ ID NO: 928568 - RNA, 22 nt, Human
uggucagcuucagaguguucca

SEQ ID NO: 928569 - RNA, 22 nt, Human
ucuuuauuuaagucuguuguaa

SEQ ID NO: 928570 - RNA, 22 nt, Human
ugguggggucaucgucagaugc

SEQ ID NO: 928571 - RNA, 22 nt, Human
uguguacuaaacuuccauauau

SEQ ID NO: 928572 - RNA, 22 nt, Human
aggaagcugguuacgaagggau

SEQ ID NO: 928573 - RNA, 22 nt, Human
agaaaacuugucacagcucuca

SEQ ID NO: 928574 - RNA, 22 nt, Human
guuccuuggaagaacuugaggu

SEQ ID NO: 928575 - RNA, 22 nt, Human
uggcuucagacuucugcuacgu

SEQ ID NO: 928576 - RNA, 22 nt, Human
ucucucagauggggcacuagua

SEQ ID NO: 928577 - RNA, 22 nt, Human
uuaaaagggauguuaucuguaa

SEQ ID NO: 928578 - RNA, 23 nt, Human
auauaaacaccagauagauugua

SEQ ID NO: 928579 - RNA, 22 nt, Human
agcuuuaucacaauauuggcua

SEQ ID NO: 928580 - RNA, 22 nt, Human
uuuacaacccaaguccagagag

SEQ ID NO: 928581 - RNA, 22 nt, Human
cugcuucacguugugccuuguu

SEQ ID NO: 928582 - RNA, 22 nt, Human
agucccagcccaguccuguaag

SEQ ID NO: 928583 - RNA, 22 nt, Human
acacaagauuguguauugaauu

SEQ ID NO: 928584 - RNA, 20 nt, Human
acaaaauagguacuggguag

SEQ ID NO: 928585 - RNA, 22 nt, Human
uacacaauuaguugcaaaguga

SEQ ID NO: 928586 - RNA, 22 nt, Human
cugggguggugcaggccucaug

SEQ ID NO: 928587 - RNA, 22 nt, Human
agcuuuuauuggcugucauuug

SEQ ID NO: 928588 - RNA, 22 nt, Human
ggagggguggucaccuggcagg

SEQ ID NO: 928589 - RNA, 22 nt, Human
aucauuuuauggcugagaggac

SEQ ID NO: 928590 - RNA, 22 nt, Human
ccuuuguacucugguccaaacu

SEQ ID NO: 928591 - RNA, 22 nt, Human
gacagacaggaggccaccugcu

SEQ ID NO: 928592 - RNA, 22 nt, Human
gugcuguauugagacaaggucg

SEQ ID NO: 928593 - RNA, 22 nt, Human
gggcagugauuuuccuuagagg

SEQ ID NO: 928594 - RNA, 22 nt, Human
uagcugaaugugaccuuaaaga

SEQ ID NO: 928595 - RNA, 22 nt, Human
cacugaaaggaaaccagagcau

SEQ ID NO: 928596 - RNA, 22 nt, Human
aauacuauguagccaaaauaau

SEQ ID NO: 928597 - RNA, 22 nt, Human
uucaguguuuguagagauaacu

SEQ ID NO: 928598 - RNA, 22 nt, Human
ugccuucuucucccuggcucag

SEQ ID NO: 928599 - RNA, 22 nt, Human
aaagaucugacuuagacacaga

SEQ ID NO: 928600 - RNA, 22 nt, Human
uaucaauacauguuaucagugu

SEQ ID NO: 928601 - RNA, 22 nt, Human
uuccuggguugugcauuguaca

SEQ ID NO: 928602 - RNA, 22 nt, Human
cuccaggcccacgucgaggagg

SEQ ID NO: 928603 - RNA, 22 nt, Human
uggaaugugguaucaguagaaa

SEQ ID NO: 928604 - RNA, 22 nt, Human
aagcccaguuucacacugagac

SEQ ID NO: 928605 - RNA, 22 nt, Human
uuuauccagaaucaggauuuuu

SEQ ID NO: 928606 - RNA, 22 nt, Human
aggaagcucaaagccaugaugu

SEQ ID NO: 928607 - RNA, 22 nt, Human
aagcaagaggaaauguggaccu

SEQ ID NO: 928608 - RNA, 22 nt, Human
ugggcugaguguggaacuaguu

SEQ ID NO: 928609 - RNA, 17 nt, Human
gcucugccaggaaagag

SEQ ID NO: 928610 - RNA, 22 nt, Human
cauuugauuacuaaagauaauu

SEQ ID NO: 928611 - RNA, 22 nt, Human
agaugcugugucuguucccuug

SEQ ID NO: 928612 - RNA, 22 nt, Human
cagaaguuggagcuuuccauca

SEQ ID NO: 928613 - RNA, 22 nt, Human
acugccagguaagugcuccugc

SEQ ID NO: 928614 - RNA, 22 nt, Human
cagcaucuuucucuucuggagu

SEQ ID NO: 928615 - RNA, 22 nt, Human
agggcucagcaucucauucugu

SEQ ID NO: 928616 - RNA, 22 nt, Human
aggauggggucugcagccuggu

SEQ ID NO: 928617 - RNA, 22 nt, Human
uggaccaugagcugcagguguu

SEQ ID NO: 928618 - RNA, 22 nt, Human
ugagggagucaugauuaaggaa

SEQ ID NO: 928619 - RNA, 22 nt, Human
ucucacagcucugcugcaugcu

SEQ ID NO: 928620 - RNA, 22 nt, Human
cucccugugucuucacuuggcc

SEQ ID NO: 928621 - RNA, 20 nt, Human
aaaugaugggaauaaucuau

SEQ ID NO: 928622 - RNA, 22 nt, Human
guuucaugacugauguuguuga

SEQ ID NO: 928623 - RNA, 22 nt, Human
cagcagccuccacucgccccac

SEQ ID NO: 928624 - RNA, 22 nt, Human
gggaauugagguaugcugggcu

SEQ ID NO: 928625 - RNA, 22 nt, Human
aggcucugcauccaggcuuuau

SEQ ID NO: 928626 - RNA, 22 nt, Human
aggcccgagguucgugugcacc

SEQ ID NO: 928627 - RNA, 22 nt, Human
ccagagggaacugggccucauu

SEQ ID NO: 928628 - RNA, 22 nt, Human
ucuucauuuuacaggcagaccu

SEQ ID NO: 928629 - RNA, 22 nt, Human
gugcucauagaugaugcucuuu

SEQ ID NO: 928630 - RNA, 22 nt, Human
auguuucaggcgaacuaacaug

SEQ ID NO: 928631 - RNA, 22 nt, Human
uauuaauaagugacuacuagcu

SEQ ID NO: 928632 - RNA, 22 nt, Human
ccugggugaugugcugcccucg

SEQ ID NO: 928633 - RNA, 22 nt, Human
cagguggggggcuuccgagccu

SEQ ID NO: 928634 - RNA, 22 nt, Human
guggccuggaugagcuucgaca

SEQ ID NO: 928635 - RNA, 22 nt, Human
ucaguccaaugauuguaggaca

SEQ ID NO: 928636 - RNA, 22 nt, Human
uugaagaaauuauuuuauauag

SEQ ID NO: 928637 - RNA, 22 nt, Human
ucaggcugcuuucaugcuuaga

SEQ ID NO: 928638 - RNA, 22 nt, Human
aaggcucugcaaaaccuccaag

SEQ ID NO: 928639 - RNA, 22 nt, Human
aaaugcuguucuuuuagguaga

SEQ ID NO: 928640 - RNA, 22 nt, Human
aauaaugagacagcuuauuuaa

SEQ ID NO: 928641 - RNA, 22 nt, Human
ccagagagguagcuuacccucu

SEQ ID NO: 928642 - RNA, 22 nt, Human
guucucaguucaggaaggacau

SEQ ID NO: 928643 - RNA, 22 nt, Human
cagaccugagguugaguaccag

SEQ ID NO: 928644 - RNA, 22 nt, Human
uggcaugcaagaggaggcuccc

SEQ ID NO: 928645 - RNA, 23 nt, Human
agccucagccgguggcagaagug

SEQ ID NO: 928646 - RNA, 22 nt, Human
acuucucuucauagguggcaau

SEQ ID NO: 928647 - RNA, 22 nt, Human
ucacauuucgcaucaguccgau

SEQ ID NO: 928648 - RNA, 22 nt, Human
augaaagcaggaauuguucugu

SEQ ID NO: 928649 - RNA, 22 nt, Human
uuccuuccuccuccaguucugg

SEQ ID NO: 928650 - RNA, 21 nt, Human
uccugcaggaggccugagagg

SEQ ID NO: 928651 - RNA, 22 nt, Human
aaggacugcuaggaagccgugu

SEQ ID NO: 928652 - RNA, 22 nt, Human
uggagugcaauaguaauaaggu

SEQ ID NO: 928653 - RNA, 22 nt, Human
uacuauuuugacaugaaauuga

SEQ ID NO: 928654 - RNA, 22 nt, Human
cagcagcugcgugcccaggccg

SEQ ID NO: 928655 - RNA, 22 nt, Human
agcagcaaggaacagaauggac

SEQ ID NO: 928656 - RNA, 22 nt, Human
ucucuccaacaugguggugcug

SEQ ID NO: 928657 - RNA, 22 nt, Human
aaagcauuacuagacuggauuu

SEQ ID NO: 928658 - RNA, 22 nt, Human
cccaggcuggggcuccuccagc

SEQ ID NO: 928659 - RNA, 20 nt, Human
gccaggagggugugaugagc

SEQ ID NO: 928660 - RNA, 22 nt, Human
agaaaugaauauguagugguua

SEQ ID NO: 928661 - RNA, 22 nt, Human
uucuguaugccaauggguuuuu

SEQ ID NO: 928662 - RNA, 22 nt, Human
uuugaaucugauauggcagcau

SEQ ID NO: 928663 - RNA, 22 nt, Human
ccuggacuaaaaucuuuucuua

SEQ ID NO: 928664 - RNA, 22 nt, Human
aaucugugcucccugcauuugu

SEQ ID NO: 928665 - RNA, 22 nt, Human
uagaacagaggguugcccagau

SEQ ID NO: 928666 - RNA, 22 nt, Human
auuugcuucauagaucugugga

SEQ ID NO: 928667 - RNA, 22 nt, Human
cauucacagagggggaagcauc

SEQ ID NO: 928668 - RNA, 22 nt, Human
uguaaacucaguauguuuuacu

SEQ ID NO: 928669 - RNA, 22 nt, Human
augaaauucaucugagaaugcu

SEQ ID NO: 928670 - RNA, 19 nt, Human
agcugcagaccagaagugc

SEQ ID NO: 928671 - RNA, 22 nt, Human
uggcagcuugaaugcagucuuu

SEQ ID NO: 928672 - RNA, 21 nt, Human
ccagcagcucaaggaucucuu

SEQ ID NO: 928673 - RNA, 22 nt, Human
gagaacagaagcauuccuaauu

SEQ ID NO: 928674 - RNA, 18 nt, Human
acaggccucaguccugca

SEQ ID NO: 928675 - RNA, 22 nt, Human
cuuuauguacuguguauuugaa

SEQ ID NO: 928676 - RNA, 19 nt, Human
cuucagggaggggccaggc

SEQ ID NO: 928677 - RNA, 22 nt, Human
uggccagguguggguucucaga

SEQ ID NO: 928678 - RNA, 22 nt, Human
aggacuucugagcugcuuuaaa

SEQ ID NO: 928679 - RNA, 22 nt, Human
cccaggaggacauuccauaccc

SEQ ID NO: 928680 - RNA, 22 nt, Human
uggggcucuccacagugucuca

SEQ ID NO: 928681 - RNA, 22 nt, Human
auagacgcggccgcugaugcag

SEQ ID NO: 928682 - RNA, 22 nt, Human
uccagcucuucaguucugcaaa

SEQ ID NO: 928683 - RNA, 17 nt, Human
ugauucaacuagaaacu

SEQ ID NO: 928684 - RNA, 22 nt, Human
ucccugcagccccugagccuuc

SEQ ID NO: 928685 - RNA, 22 nt, Human
cuaucucuuguuuuccugaagc

SEQ ID NO: 928686 - RNA, 22 nt, Human
gugugggggcagcucugauaug

SEQ ID NO: 928687 - RNA, 22 nt, Human
agggcucugugacuaucacugc

SEQ ID NO: 928688 - RNA, 22 nt, Human
uucugggccuccuaggacaggc

SEQ ID NO: 928689 - RNA, 22 nt, Human
uggcucagaugcucuuccagug

SEQ ID NO: 928690 - RNA, 22 nt, Human
uguauguaaaggucuucauguu

SEQ ID NO: 928691 - RNA, 22 nt, Human
ucugaaauaaaugcacuguuag

SEQ ID NO: 928692 - RNA, 22 nt, Human
cucugugguuagacuauggcug

SEQ ID NO: 928693 - RNA, 22 nt, Human
cugcugagcaucagggcugccc

SEQ ID NO: 928694 - RNA, 22 nt, Human
agggccuggaacugugggcagg

SEQ ID NO: 928695 - RNA, 22 nt, Human
ucacacauacucaugugugagu

SEQ ID NO: 928696 - RNA, 22 nt, Human
uguuacaauauuaucaacugag

SEQ ID NO: 928697 - RNA, 22 nt, Human
ccagaagagaucacaguucuug

SEQ ID NO: 928698 - RNA, 22 nt, Human
cuggguugcccugggccuguga

SEQ ID NO: 928699 - RNA, 22 nt, Human
cauuuguaguuaaaaaugucuc

SEQ ID NO: 928700 - RNA, 22 nt, Human
aagaauguucuuguagucauga

SEQ ID NO: 928701 - RNA, 22 nt, Human
cagagaacuccaguggcuggcg

SEQ ID NO: 928702 - RNA, 22 nt, Human
aaguuugagagccuuuaguaua

SEQ ID NO: 928703 - RNA, 22 nt, Human
aaacugaagccuuggagugaca

SEQ ID NO: 928704 - RNA, 22 nt, Human
ucugggaaccaaagggugcuua

SEQ ID NO: 928705 - RNA, 22 nt, Human
auuccaaagccugaauaaugga

SEQ ID NO: 928706 - RNA, 22 nt, Human
auguaacaggugaagcucugag

SEQ ID NO: 928707 - RNA, 21 nt, Human
ucccucagacagggugccuau

SEQ ID NO: 928708 - RNA, 22 nt, Human
caggagugucgggucacuaggu

SEQ ID NO: 928709 - RNA, 21 nt, Human
aggcugcuggcucaggguccu

SEQ ID NO: 928710 - RNA, 22 nt, Human
cccugggagaaguugagggcug

SEQ ID NO: 928711 - RNA, 22 nt, Human
uucucaggcacuucuuccccgc

SEQ ID NO: 928712 - RNA, 22 nt, Human
gaggcacagaguaggugcacac

SEQ ID NO: 928713 - RNA, 22 nt, Human
agccaaaguccaaaugcagugu

SEQ ID NO: 928714 - RNA, 22 nt, Human
uaauaaaugaaagugcuggcau

SEQ ID NO: 928715 - RNA, 22 nt, Human
ccagcagccccucaaugaucug

SEQ ID NO: 928716 - RNA, 20 nt, Human
aggcuuggcuuggcaggaac

SEQ ID NO: 928717 - RNA, 22 nt, Human
uuugucuuggccaagguucuga

SEQ ID NO: 928718 - RNA, 22 nt, Human
auguagcagaagauguuuuccu

SEQ ID NO: 928719 - RNA, 22 nt, Human
ggcaggugcgcauguugcauua

SEQ ID NO: 928720 - RNA, 22 nt, Human
agcugcuguuuggugagucuug

SEQ ID NO: 928721 - RNA, 22 nt, Human
cccagggcuugagucauccaug

SEQ ID NO: 928722 - RNA, 22 nt, Human
gugugcaguagagaaagagcag

SEQ ID NO: 928723 - RNA, 22 nt, Human
agaauucagaaugcauuucuaa

SEQ ID NO: 928724 - RNA, 19 nt, Human
agcuguggaugugggauuu

SEQ ID NO: 928725 - RNA, 22 nt, Human
uauuccagugugaucuuuguag

SEQ ID NO: 928726 - RNA, 22 nt, Human
agcucuggcacuggcgcgggau

SEQ ID NO: 928727 - RNA, 22 nt, Human
gcaucuguuagagugugcaugc

SEQ ID NO: 928728 - RNA, 19 nt, Human
gacacaguugguuccuuug

SEQ ID NO: 928729 - RNA, 22 nt, Human
ugagcuuccucccugcauccau

SEQ ID NO: 928730 - RNA, 21 nt, Human
caguguggugaccagggucuc

SEQ ID NO: 928731 - RNA, 22 nt, Human
uuucagaguuaguagagcaugu

SEQ ID NO: 928732 - RNA, 22 nt, Human
auucuacaaucauguagauccu

SEQ ID NO: 928733 - RNA, 22 nt, Human
gguggacaguguuagcucuggg

SEQ ID NO: 928734 - RNA, 22 nt, Human
aucugucuuuuauucaugagcu

SEQ ID NO: 928735 - RNA, 22 nt, Human
ugucauuuucugguuaguuaau

SEQ ID NO: 928736 - RNA, 22 nt, Human
aaagcuuugcuggaaggaagag

SEQ ID NO: 928737 - RNA, 22 nt, Human
cauuggaaugcauuugaagaga

SEQ ID NO: 928738 - RNA, 22 nt, Human
aggucugagcuccuuccucuga

SEQ ID NO: 928739 - RNA, 21 nt, Human
uacauagaggugauaucuguu

SEQ ID NO: 928740 - RNA, 22 nt, Human
aacacagucauuagaggcagcc

SEQ ID NO: 928741 - RNA, 22 nt, Human
ugcagaguagugaggggacaga

SEQ ID NO: 928742 - RNA, 22 nt, Human
aaguugcuuuccggcgggcagg

SEQ ID NO: 928743 - RNA, 22 nt, Human
agcaagaugaaggauucaagac

SEQ ID NO: 928744 - RNA, 22 nt, Human
ccugcuguaaugugucuuuauu

SEQ ID NO: 928745 - RNA, 22 nt, Human
uucuucaaaguaauagagacua

SEQ ID NO: 928746 - RNA, 22 nt, Human
auuugucuagugguauucacgu

SEQ ID NO: 928747 - RNA, 22 nt, Human
gacacagcuaauggcuuaggac

SEQ ID NO: 928748 - RNA, 22 nt, Human
gacaaauguaccccuagagucu

SEQ ID NO: 928749 - RNA, 22 nt, Human
auacaugaggaggcuggaaaca

SEQ ID NO: 928750 - RNA, 22 nt, Human
guggagaggaacccagcucugu

SEQ ID NO: 928751 - RNA, 22 nt, Human
cucccucccuacgugagcucac

SEQ ID NO: 928752 - RNA, 22 nt, Human
ccaugugucgggccugcagugg

SEQ ID NO: 928753 - RNA, 22 nt, Human
uaacucuuuacuauacauuuau

SEQ ID NO: 928754 - RNA, 22 nt, Human
uauacacauccuccaaagauag

SEQ ID NO: 928755 - RNA, 21 nt, Human
aaguuugggauucaguuucca

SEQ ID NO: 928756 - RNA, 22 nt, Human
gcaagaaaaaggcuucaugaac

SEQ ID NO: 928757 - RNA, 22 nt, Human
gcuguuagucaaaucaguugag

SEQ ID NO: 928758 - RNA, 22 nt, Human
auuuacacuugguuuacuagag

SEQ ID NO: 928759 - RNA, 22 nt, Human
cuggagccagccagggcccucu

SEQ ID NO: 928760 - RNA, 22 nt, Human
aucagaaauugcuaccagugga

SEQ ID NO: 928761 - RNA, 22 nt, Human
uguguguauaauaaugucugca

SEQ ID NO: 928762 - RNA, 22 nt, Human
auauguuuugugcuucauuggu

SEQ ID NO: 928763 - RNA, 22 nt, Human
uuggaagacagugaaacagcac

SEQ ID NO: 928764 - RNA, 22 nt, Human
aggcccaugugagucuuguccu

SEQ ID NO: 928765 - RNA, 22 nt, Human
auguguaggugaaucgaggcug

SEQ ID NO: 928766 - RNA, 19 nt, Human
ucaaaacacaaaugguuga

SEQ ID NO: 928767 - RNA, 22 nt, Human
uuuugcuuaucugagugcagcc

SEQ ID NO: 928768 - RNA, 22 nt, Human
aagauacauuuucuucagagaa

SEQ ID NO: 928769 - RNA, 22 nt, Human
agcagaaccugcagaccugucu

SEQ ID NO: 928770 - RNA, 22 nt, Human
uaacaguguggacuugagaucu

SEQ ID NO: 928771 - RNA, 22 nt, Human
uagaaaauagggccuguggagc

SEQ ID NO: 928772 - RNA, 22 nt, Human
uggauuuauuagguuggugaaa

SEQ ID NO: 928773 - RNA, 22 nt, Human
uucauugaugugguuuaaugua

SEQ ID NO: 928774 - RNA, 22 nt, Human
gggccagagcacagaggauguu

SEQ ID NO: 928775 - RNA, 22 nt, Human
uugaaaaccgugggaggcugaa

SEQ ID NO: 928776 - RNA, 22 nt, Human
aauucacaaaaccagauugcuu

SEQ ID NO: 928777 - RNA, 22 nt, Human
guucuuaaagauucaucaagca

SEQ ID NO: 928778 - RNA, 22 nt, Human
ucaugcagguuuccagccagau

SEQ ID NO: 928779 - RNA, 22 nt, Human
aucuuagaaguuugauaaaauc

SEQ ID NO: 928780 - RNA, 22 nt, Human
auguauuugcgagguuaggaaa

SEQ ID NO: 928781 - RNA, 22 nt, Human
gaauguucugaggaaucagaga

SEQ ID NO: 928782 - RNA, 22 nt, Human
uaaagcuagaauuguuccagca

SEQ ID NO: 928783 - RNA, 22 nt, Human
guccaugguugcuuucauguaa

SEQ ID NO: 928784 - RNA, 22 nt, Human
cuugcuuaccuaguuagcucca

SEQ ID NO: 928785 - RNA, 22 nt, Human
cugggagacgcagcuggggauc

SEQ ID NO: 928786 - RNA, 22 nt, Human
gcuagcaaaugucauuuggaag

SEQ ID NO: 928787 - RNA, 22 nt, Human
acccaggauaaucuguguaucu

SEQ ID NO: 928788 - RNA, 22 nt, Human
uguuccuucacagcaguggaca

SEQ ID NO: 928789 - RNA, 22 nt, Human
ugccgugucccauugugcucug

SEQ ID NO: 928790 - RNA, 22 nt, Human
gcugcaggcggccgugguggcg

SEQ ID NO: 928791 - RNA, 19 nt, Human
ugggcagcucccucugucc

SEQ ID NO: 928792 - RNA, 22 nt, Human
guuucaaagucagaaaaggagg

SEQ ID NO: 928793 - RNA, 22 nt, Human
aaugguuuauggggaccgcaaa

SEQ ID NO: 928794 - RNA, 22 nt, Human
aaagugacugccagugcugggc

SEQ ID NO: 928795 - RNA, 22 nt, Human
cucuagggugcaggccccagga

SEQ ID NO: 928796 - RNA, 22 nt, Human
uguccagagucacagagcucaa

SEQ ID NO: 928797 - RNA, 22 nt, Human
agaaccuuucuuuagaaauuca

SEQ ID NO: 928798 - RNA, 22 nt, Human
aggcuccugagaggcagaggcu

SEQ ID NO: 928799 - RNA, 22 nt, Human
aauguucaguagaauaggaaug

SEQ ID NO: 928800 - RNA, 22 nt, Human
auuguaaauagugccacaauaa

SEQ ID NO: 928801 - RNA, 22 nt, Human
uuugcugaccccauucugaguc

SEQ ID NO: 928802 - RNA, 22 nt, Human
agcuggagaugcccagcaccgg

SEQ ID NO: 928803 - RNA, 22 nt, Human
ugaguccacuuuaaaaugucag

SEQ ID NO: 928804 - RNA, 22 nt, Human
gggagcugaacugcugaaguug

SEQ ID NO: 928805 - RNA, 22 nt, Human
gcauuagaagggaccucugggg

SEQ ID NO: 928806 - RNA, 22 nt, Human
agguauuuaugagagcacauau

SEQ ID NO: 928807 - RNA, 20 nt, Human
acugccuugguucaguaggu

SEQ ID NO: 928808 - RNA, 22 nt, Human
agauucuacucuagauccaugg

SEQ ID NO: 928809 - RNA, 22 nt, Human
uucuagggaaugggaugaggau

SEQ ID NO: 928810 - RNA, 22 nt, Human
gagccagggagggucugguaua

SEQ ID NO: 928811 - RNA, 21 nt, Human
aggcucagcagguguauaaag

SEQ ID NO: 928812 - RNA, 19 nt, Human
uggagggguuugaaugugg

SEQ ID NO: 928813 - RNA, 22 nt, Human
acauucuuugaguuuuguuaaa

SEQ ID NO: 928814 - RNA, 22 nt, Human
gagaggcccuguggucccagcu

SEQ ID NO: 928815 - RNA, 22 nt, Human
cucugagcucgugcaguacuuc

SEQ ID NO: 928816 - RNA, 22 nt, Human
aaaugcugaguguuuagagauc

SEQ ID NO: 928817 - RNA, 20 nt, Human
caccacagaauuggggacag

SEQ ID NO: 928818 - RNA, 22 nt, Human
aucucugauuuacagcaucucu

SEQ ID NO: 928819 - RNA, 22 nt, Human
uggaaccuaaaaaugucauugc

SEQ ID NO: 928820 - RNA, 22 nt, Human
caugguuucaugagaauuaccc

SEQ ID NO: 928821 - RNA, 22 nt, Human
acaagguaucaucuuggaagca

SEQ ID NO: 928822 - RNA, 22 nt, Human
agcuagaauauugaucugaaau

SEQ ID NO: 928823 - RNA, 22 nt, Human
uuauauaaagauaacuuuucuu

SEQ ID NO: 928824 - RNA, 22 nt, Human
caggauaacagaaaauagcuga

SEQ ID NO: 928825 - RNA, 20 nt, Human
aacuccuagccucaagugau

SEQ ID NO: 928826 - RNA, 22 nt, Human
agaggagguccuuuucugaugu

SEQ ID NO: 928827 - RNA, 22 nt, Human
ugucugaggaagucagcccuuu

SEQ ID NO: 928828 - RNA, 22 nt, Human
ugcucaggucguucugccccuu

SEQ ID NO: 928829 - RNA, 22 nt, Human
ucauuguauacuuuauuuauga

SEQ ID NO: 928830 - RNA, 16 nt, Human
ucugagcacaaaacac

SEQ ID NO: 928831 - RNA, 22 nt, Human
uacucuaaaaagaagcagaucu

SEQ ID NO: 928832 - RNA, 22 nt, Human
uggcagcauuaauuauucaggu

SEQ ID NO: 928833 - RNA, 22 nt, Human
ucuuugggcuaggaguuuggau

SEQ ID NO: 928834 - RNA, 19 nt, Human
auauagcauuauucaauuu

SEQ ID NO: 928835 - RNA, 21 nt, Human
ccuguggauuuuaaaauugga

SEQ ID NO: 928836 - RNA, 22 nt, Human
aaccacaugaaaagaguaauau

SEQ ID NO: 928837 - RNA, 22 nt, Human
ugaguucugcccuacaccugaa

SEQ ID NO: 928838 - RNA, 22 nt, Human
aggccuccuggcuccaggccuu

SEQ ID NO: 928839 - RNA, 19 nt, Human
uaccaaauugcauuauggc

SEQ ID NO: 928840 - RNA, 22 nt, Human
gccucagccggcggacgccagg

SEQ ID NO: 928841 - RNA, 22 nt, Human
agcuccagauuaauuguaggag

SEQ ID NO: 928842 - RNA, 22 nt, Human
uaacaggugguaguuugugcuc

SEQ ID NO: 928843 - RNA, 22 nt, Human
uuguacuagaaaauuauucuuu

SEQ ID NO: 928844 - RNA, 22 nt, Human
cagggcagcuuccuuuguuagg

SEQ ID NO: 928845 - RNA, 23 nt, Human
aguguucagcauguaguaaauac

SEQ ID NO: 928846 - RNA, 22 nt, Human
augcccugcugccaucuggccg

SEQ ID NO: 928847 - RNA, 23 nt, Human
aauaaggccaaacuaucuggucu

SEQ ID NO: 928848 - RNA, 22 nt, Human
uguccuuuuucuuaggaaauau

SEQ ID NO: 928849 - RNA, 22 nt, Human
aggggccuggcacugagcuggc

SEQ ID NO: 928850 - RNA, 22 nt, Human
acaggguuguggccuuaaaggc

SEQ ID NO: 928851 - RNA, 22 nt, Human
aggcaggaacccugugugcgcc

SEQ ID NO: 928852 - RNA, 21 nt, Human
accaucuuccaugcauuauau

SEQ ID NO: 928853 - RNA, 22 nt, Human
auacaguaagugucccugaaac

SEQ ID NO: 928854 - RNA, 22 nt, Human
cuggguguuggguacugaccgu

SEQ ID NO: 928855 - RNA, 22 nt, Human
aagucugacuagaaucucuccc

SEQ ID NO: 928856 - RNA, 22 nt, Human
gugugccaccagucaaggugaa

SEQ ID NO: 928857 - RNA, 22 nt, Human
agagguaugguauauuggaaga

SEQ ID NO: 928858 - RNA, 22 nt, Human
uacuaugugaaaauacuauagu

SEQ ID NO: 928859 - RNA, 22 nt, Human
cagguucccuagcagcaaagcc

SEQ ID NO: 928860 - RNA, 22 nt, Human
aaggguuugucucccucaaggc

SEQ ID NO: 928861 - RNA, 22 nt, Human
acuguggcgucaggaagaaauu

SEQ ID NO: 928862 - RNA, 22 nt, Human
cugaggugagcuucccugggcu

SEQ ID NO: 928863 - RNA, 23 nt, Human
cacacccaucacuaagagcuccu

SEQ ID NO: 928864 - RNA, 22 nt, Human
gcauuuugaggcugggggagca

SEQ ID NO: 928865 - RNA, 22 nt, Human
aagcagggucuuccucaguugg

SEQ ID NO: 928866 - RNA, 22 nt, Human
caugucuuuguuaugcucacca

SEQ ID NO: 928867 - RNA, 22 nt, Human
cuucaauaccugcguugcuagu

SEQ ID NO: 928868 - RNA, 18 nt, Human
guggaggguucucagaau

SEQ ID NO: 928869 - RNA, 22 nt, Human
uguagaacugacauuuuggacu

SEQ ID NO: 928870 - RNA, 22 nt, Human
acacaguaggauaguuugagga

SEQ ID NO: 928871 - RNA, 22 nt, Human
gacagcugaaggaugauucagg

SEQ ID NO: 928872 - RNA, 22 nt, Human
augaacagaggaauagaauucu

SEQ ID NO: 928873 - RNA, 22 nt, Human
agaugcugccucuccucacaag

SEQ ID NO: 928874 - RNA, 22 nt, Human
ucccuguaagguucugagauuu

SEQ ID NO: 928875 - RNA, 22 nt, Human
agacuuuauaguuuuuggcuau

SEQ ID NO: 928876 - RNA, 22 nt, Human
uuauuauugauucgcucucaaa

SEQ ID NO: 928877 - RNA, 21 nt, Human
agaugcagugacccacugggg

SEQ ID NO: 928878 - RNA, 22 nt, Human
gggcuggcucccagguguugaa

SEQ ID NO: 928879 - RNA, 22 nt, Human
agucauaauuauaaacaucagu

SEQ ID NO: 928880 - RNA, 22 nt, Human
aguacaaauuauagcgcuugga

SEQ ID NO: 928881 - RNA, 20 nt, Human
ucuggcucuuugcuccuccc

SEQ ID NO: 928882 - RNA, 22 nt, Human
uucuggaagcugggcagcaccc

SEQ ID NO: 928883 - RNA, 22 nt, Human
ugugaauggacaauuaaaucua

SEQ ID NO: 928884 - RNA, 22 nt, Human
aaggcauuaccuaaguuuggga

SEQ ID NO: 928885 - RNA, 17 nt, Human
agagggcucaaggcauc

SEQ ID NO: 928886 - RNA, 22 nt, Human
ccagaggcuggcagccagcuga

SEQ ID NO: 928887 - RNA, 22 nt, Human
agguaaggaaauugaggcaauu

SEQ ID NO: 928888 - RNA, 22 nt, Human
uggcuggauaucaggcaagggg

SEQ ID NO: 928889 - RNA, 22 nt, Human
acaugaaaguuauucugaguug

SEQ ID NO: 928890 - RNA, 22 nt, Human
guccugggggcagcugugucca

SEQ ID NO: 928891 - RNA, 22 nt, Human
uccugaggacuaacaggaagga

SEQ ID NO: 928892 - RNA, 22 nt, Human
cuggaagaguccuaaacagaua

SEQ ID NO: 928893 - RNA, 22 nt, Human
uuuuuccuuagggguuacucac

SEQ ID NO: 928894 - RNA, 22 nt, Human
uucauggaucaugccuuuugug

SEQ ID NO: 928895 - RNA, 22 nt, Human
uauugaagagauaagugacaga

SEQ ID NO: 928896 - RNA, 22 nt, Human
accagcuguuaggcuuggugcu

SEQ ID NO: 928897 - RNA, 22 nt, Human
uaaggacaaucagguuaguagc

SEQ ID NO: 928898 - RNA, 19 nt, Human
auccuaaauccaguuucua

SEQ ID NO: 928899 - RNA, 22 nt, Human
cugcagggugacguugcccacc

SEQ ID NO: 928900 - RNA, 22 nt, Human
ugugccuggucccugagucgag

SEQ ID NO: 928901 - RNA, 22 nt, Human
cuacauaaauauuuaugugucu

SEQ ID NO: 928902 - RNA, 22 nt, Human
cccagagccgguggugcucaca

SEQ ID NO: 928903 - RNA, 22 nt, Human
cccaggcagaauuaguguuuca

SEQ ID NO: 928904 - RNA, 22 nt, Human
caaauauuccagguacaucccu

SEQ ID NO: 928905 - RNA, 22 nt, Human
cugugugaauagugaggucuau

SEQ ID NO: 928906 - RNA, 22 nt, Human
gcagauggcugagccugcagau

SEQ ID NO: 928907 - RNA, 22 nt, Human
ggaagggcaauaaaaucucagg

SEQ ID NO: 928908 - RNA, 22 nt, Human
acauucaacauggcuggucuag

SEQ ID NO: 928909 - RNA, 22 nt, Human
auaucacagguguuuaccugau

SEQ ID NO: 928910 - RNA, 22 nt, Human
aaaaacagaaugugucuaacuc

SEQ ID NO: 928911 - RNA, 22 nt, Human
cauuuaguacaacuuuuacagu

SEQ ID NO: 928912 - RNA, 20 nt, Human
cagaagcaaggcagguaccu

SEQ ID NO: 928913 - RNA, 22 nt, Human
cguuuauuuugaagauuccacu

SEQ ID NO: 928914 - RNA, 22 nt, Human
ugcaucuguucauucguuccca

SEQ ID NO: 928915 - RNA, 22 nt, Human
uagcuccuggcugcagggccuc

SEQ ID NO: 928916 - RNA, 22 nt, Human
agaugaagaugccacuaagacc

SEQ ID NO: 928917 - RNA, 23 nt, Human
agguucaggagauggaggaacaa

SEQ ID NO: 928918 - RNA, 22 nt, Human
guuucuuucuauugacugaaca

SEQ ID NO: 928919 - RNA, 22 nt, Human
caaggucccagccccucuuggc

SEQ ID NO: 928920 - RNA, 22 nt, Human
acuuuagauauuccucuguaca

SEQ ID NO: 928921 - RNA, 22 nt, Human
aagagguuucaugauuuucuua

SEQ ID NO: 928922 - RNA, 19 nt, Human
aucucaacccuacucucug

SEQ ID NO: 928923 - RNA, 23 nt, Human
ucaugaguggcugcggggcugag

SEQ ID NO: 928924 - RNA, 20 nt, Human
cugagcugagcuccaugggu

SEQ ID NO: 928925 - RNA, 22 nt, Human
agcuguuuucuaaugcauuuga

SEQ ID NO: 928926 - RNA, 22 nt, Human
uugucuauuuguucagguaagg

SEQ ID NO: 928927 - RNA, 22 nt, Human
cagggcaaagagagcacaugcu

SEQ ID NO: 928928 - RNA, 22 nt, Human
gaguggggcguggauccagcgu

SEQ ID NO: 928929 - RNA, 22 nt, Human
acagcagcacuauugacauuuu

SEQ ID NO: 928930 - RNA, 22 nt, Human
cagauguaguagcuuuauugca

SEQ ID NO: 928931 - RNA, 22 nt, Human
cuggcuuucuauuuggugcuau

SEQ ID NO: 928932 - RNA, 22 nt, Human
uggaauguauagauguuaugua

SEQ ID NO: 928933 - RNA, 22 nt, Human
agcagacaccaggaguaaagaa

SEQ ID NO: 928934 - RNA, 22 nt, Human
uagaaagcuugggguguuuaaa

SEQ ID NO: 928935 - RNA, 22 nt, Human
uacagcugcaaggguuucuggg

SEQ ID NO: 928936 - RNA, 22 nt, Human
uauauuuaauccuagagccauu

SEQ ID NO: 928937 - RNA, 22 nt, Human
ucugggagugugucuggccauc

SEQ ID NO: 928938 - RNA, 22 nt, Human
cugggaccuccucacuguucua

SEQ ID NO: 928939 - RNA, 22 nt, Human
acacugaguauugaguagggua

SEQ ID NO: 928940 - RNA, 22 nt, Human
agcauuacuauucucaaaaaca

SEQ ID NO: 928941 - RNA, 22 nt, Human
gagggaaacagauggguugugg

SEQ ID NO: 928942 - RNA, 22 nt, Human
aguuuauagcccagauucaugg

SEQ ID NO: 928943 - RNA, 22 nt, Human
ucuucacagcuuuguccagaag

SEQ ID NO: 928944 - RNA, 22 nt, Human
uugcauuugacaaauuauuuaa

SEQ ID NO: 928945 - RNA, 22 nt, Human
uccuggggccaggcaccucugg

SEQ ID NO: 928946 - RNA, 20 nt, Human
uccaggcccacucagcugaa

SEQ ID NO: 928947 - RNA, 22 nt, Human
gugagguagcagagacagugaa

SEQ ID NO: 928948 - RNA, 22 nt, Human
cagcauggagacaaagugggca

SEQ ID NO: 928949 - RNA, 22 nt, Human
auaagccugauucacuugucau

SEQ ID NO: 928950 - RNA, 22 nt, Human
gcgcaagccacacagccugggg

SEQ ID NO: 928951 - RNA, 22 nt, Human
ucaaauaguugacauuaacuug

SEQ ID NO: 928952 - RNA, 22 nt, Human
cuaauaauagagguggcauuug

SEQ ID NO: 928953 - RNA, 22 nt, Human
aggccagaaauuuggaguaugu

SEQ ID NO: 928954 - RNA, 22 nt, Human
cugggacacccaaggaaagagc

SEQ ID NO: 928955 - RNA, 22 nt, Human
agaauucuggaguugggaggaa

SEQ ID NO: 928956 - RNA, 21 nt, Human
gcucaugguggagaaaagcag

SEQ ID NO: 928957 - RNA, 22 nt, Human
ggugaguccagaguccaaaucc

SEQ ID NO: 928958 - RNA, 23 nt, Human
agcuggguggccugcgugaagcu

SEQ ID NO: 928959 - RNA, 20 nt, Human
ccacaggaguccagucgacc

SEQ ID NO: 928960 - RNA, 22 nt, Human
gcacaggccaugggaggacagc

SEQ ID NO: 928961 - RNA, 16 nt, Human
cagccugcagugguca

SEQ ID NO: 928962 - RNA, 22 nt, Human
ggggaccugggcuucaaggguu

SEQ ID NO: 928963 - RNA, 22 nt, Human
aaauuucuggaagugucagagu

SEQ ID NO: 928964 - RNA, 22 nt, Human
aagaggcugaaugagaaaguac

SEQ ID NO: 928965 - RNA, 22 nt, Human
acagagcugggaucugaaccca

SEQ ID NO: 928966 - RNA, 22 nt, Human
gggcuucugggcaccacucccu

SEQ ID NO: 928967 - RNA, 17 nt, Human
uuaagcauguaaucugc

SEQ ID NO: 928968 - RNA, 22 nt, Human
gagaaucauggcaacagaauga

SEQ ID NO: 928969 - RNA, 23 nt, Human
uugcauuaauguggaggcacagg

SEQ ID NO: 928970 - RNA, 22 nt, Human
uuacauauuauccaaaacugcu

SEQ ID NO: 928971 - RNA, 22 nt, Human
agcaggugaucgcgugugcucc

SEQ ID NO: 928972 - RNA, 22 nt, Human
auauggaaugguaaucuacaau

SEQ ID NO: 928973 - RNA, 22 nt, Human
ucaggcugggcuccucucccca

SEQ ID NO: 928974 - RNA, 22 nt, Human
gcuuguuugugauuucuccaga

SEQ ID NO: 928975 - RNA, 22 nt, Human
augaggcccaaacauuacaaau

SEQ ID NO: 928976 - RNA, 22 nt, Human
uagauguuuugauauuugcuga

SEQ ID NO: 928977 - RNA, 20 nt, Human
ucagacccagauuagcaggu

SEQ ID NO: 928978 - RNA, 22 nt, Human
auuauuacuccugauuguacug

SEQ ID NO: 928979 - RNA, 22 nt, Human
auuugucaauaagaugaacaua

SEQ ID NO: 928980 - RNA, 22 nt, Human
cagugggacaugggcacugggc

SEQ ID NO: 928981 - RNA, 22 nt, Human
ugugaaaugaguauauuugaau

SEQ ID NO: 928982 - RNA, 22 nt, Human
ucacaguuucuuuucugauaaa

SEQ ID NO: 928983 - RNA, 22 nt, Human
ucaauguaauaaaauacucuau

SEQ ID NO: 928984 - RNA, 22 nt, Human
gggcuggaguugggaagacaaa

SEQ ID NO: 928985 - RNA, 22 nt, Human
uagaaaguaaaucaguuuuauu

SEQ ID NO: 928986 - RNA, 20 nt, Human
uauuugaaauggccaagugu

SEQ ID NO: 928987 - RNA, 22 nt, Human
uguuauaucuaaauagccacau

SEQ ID NO: 928988 - RNA, 22 nt, Human
acuacaucuugcauaucuauaa

SEQ ID NO: 928989 - RNA, 22 nt, Human
uucuggaguugugaccucaggg

SEQ ID NO: 928990 - RNA, 22 nt, Human
ugcugucaagaaaacaagcaau

SEQ ID NO: 928991 - RNA, 22 nt, Human
gaaggcugaugacagauucugc

SEQ ID NO: 928992 - RNA, 22 nt, Human
cuccagaaauucaacagcaaau

SEQ ID NO: 928993 - RNA, 22 nt, Human
cuauauuucuuggcuuuaaaca

SEQ ID NO: 928994 - RNA, 22 nt, Human
guacaauuccugucaagcuggc

SEQ ID NO: 928995 - RNA, 22 nt, Human
guaaaaaggccaagcccuugug

SEQ ID NO: 928996 - RNA, 22 nt, Human
cugccuggggcaucagucaagg

SEQ ID NO: 928997 - RNA, 21 nt, Human
uuagcaaagcaaacacaugcu

SEQ ID NO: 928998 - RNA, 22 nt, Human
uggcccugaggacccagugugg

SEQ ID NO: 928999 - RNA, 22 nt, Human
auugacaaucuacuauguucug

SEQ ID NO: 929000 - RNA, 22 nt, Human
gggcaacugaaaaauuguauuc

SEQ ID NO: 929001 - RNA, 22 nt, Human
gaaauguaauucucuugaagau

SEQ ID NO: 929002 - RNA, 22 nt, Human
uucugcaucccagaagaggaca

SEQ ID NO: 929003 - RNA, 22 nt, Human
ggaacuggguuagggucucuuc

SEQ ID NO: 929004 - RNA, 21 nt, Human
gugaagacuuugccuuuaaga

SEQ ID NO: 929005 - RNA, 22 nt, Human
auagacacagcuaugauuugag

SEQ ID NO: 929006 - RNA, 22 nt, Human
gagaggcugguaaagucugaac

SEQ ID NO: 929007 - RNA, 21 nt, Human
gccaggaguagauuacauuua

SEQ ID NO: 929008 - RNA, 22 nt, Human
ucacuuaaaaauucuaguuaug

SEQ ID NO: 929009 - RNA, 19 nt, Human
ugcccaggccucccaaaag

SEQ ID NO: 929010 - RNA, 19 nt, Human
gcugggagcagacccuccc

SEQ ID NO: 929011 - RNA, 22 nt, Human
gagagugaggccugggaaucua

SEQ ID NO: 929012 - RNA, 22 nt, Human
gcuacccagagccucacccugu

SEQ ID NO: 929013 - RNA, 22 nt, Human
caucaucaaaagugacagagaa

SEQ ID NO: 929014 - RNA, 22 nt, Human
ggaagcugcagucccccccaag

SEQ ID NO: 929015 - RNA, 22 nt, Human
uggggucuggaguugcccauga

SEQ ID NO: 929016 - RNA, 22 nt, Human
gggcucuaggccaagagucccg

SEQ ID NO: 929017 - RNA, 22 nt, Human
uccagcucuggcuuggcuagcu

SEQ ID NO: 929018 - RNA, 22 nt, Human
aaagcagagguugcagugagcu

SEQ ID NO: 929019 - RNA, 22 nt, Human
cuugcugugugguguucucaga

SEQ ID NO: 929020 - RNA, 22 nt, Human
aaugucugagucucuguauccc

SEQ ID NO: 929021 - RNA, 22 nt, Human
aggcucugugacaaucaagcug

SEQ ID NO: 929022 - RNA, 22 nt, Human
cagagcuuuuuacauuaaugau

SEQ ID NO: 929023 - RNA, 22 nt, Human
ucuguucaugaaauaucuuuuu

SEQ ID NO: 929024 - RNA, 18 nt, Human
ugaauuaguuugugguuu

SEQ ID NO: 929025 - RNA, 20 nt, Human
uauauuuucucuuuggccuu

SEQ ID NO: 929026 - RNA, 22 nt, Human
ggccaaaugaaggcaaugggac

SEQ ID NO: 929027 - RNA, 22 nt, Human
uggagccaaugaacauuugcug

SEQ ID NO: 929028 - RNA, 22 nt, Human
auucacaauuagaaguagauaa

SEQ ID NO: 929029 - RNA, 22 nt, Human
aagaacauguuaaaagauucac

SEQ ID NO: 929030 - RNA, 22 nt, Human
aauuagcagcauauucugcgau

SEQ ID NO: 929031 - RNA, 22 nt, Human
ugggucccuucagcucucaugg

SEQ ID NO: 929032 - RNA, 22 nt, Human
cucuggcuuugcucaugcaucc

SEQ ID NO: 929033 - RNA, 22 nt, Human
caccugaagauuuagagauuga

SEQ ID NO: 929034 - RNA, 22 nt, Human
caggaaaauggaaucaccugua

SEQ ID NO: 929035 - RNA, 22 nt, Human
caguccugagccaaucaugaug

SEQ ID NO: 929036 - RNA, 22 nt, Human
guucccaucagggaugagggug

SEQ ID NO: 929037 - RNA, 22 nt, Human
cuaggcuggagugcaguggcau

SEQ ID NO: 929038 - RNA, 22 nt, Human
agcuagaaguccuagauaaagg

SEQ ID NO: 929039 - RNA, 22 nt, Human
guaggcagauaggagugcagcc

SEQ ID NO: 929040 - RNA, 22 nt, Human
cauuagcaagucacuauuuuau

SEQ ID NO: 929041 - RNA, 19 nt, Human
cacacccaugcuugccaag

SEQ ID NO: 929042 - RNA, 23 nt, Human
aacuccugaaucgugagccaucu

SEQ ID NO: 929043 - RNA, 22 nt, Human
uccugagccccagggagguugg

SEQ ID NO: 929044 - RNA, 22 nt, Human
augggaagguuuugagagcggg

SEQ ID NO: 929045 - RNA, 22 nt, Human
uuuuuguauagaaaugaacuaa

SEQ ID NO: 929046 - RNA, 22 nt, Human
ucccacagguggagcuugcagu

SEQ ID NO: 929047 - RNA, 22 nt, Human
auuauucuuaugucaucauggc

SEQ ID NO: 929048 - RNA, 22 nt, Human
cugcaagauguugucauaugcu

SEQ ID NO: 929049 - RNA, 22 nt, Human
aguuucauuucuuaguaccagu

SEQ ID NO: 929050 - RNA, 22 nt, Human
ucagaaagcugauucuugauac

SEQ ID NO: 929051 - RNA, 17 nt, Human
gucagcagcuugcuugu

SEQ ID NO: 929052 - RNA, 22 nt, Human
acacccagcuuuugaaugcccu

SEQ ID NO: 929053 - RNA, 22 nt, Human
uaaagcagucuguguaugugaa

SEQ ID NO: 929054 - RNA, 22 nt, Human
cacuucaagagcaagggugcca

SEQ ID NO: 929055 - RNA, 20 nt, Human
ugcuuuuauaccuauaauga

SEQ ID NO: 929056 - RNA, 22 nt, Human
ugggccuguugggguugaguua

SEQ ID NO: 929057 - RNA, 22 nt, Human
uucuucaugcuguugcugcuug

SEQ ID NO: 929058 - RNA, 22 nt, Human
uccaggagguaugaguggcccc

SEQ ID NO: 929059 - RNA, 22 nt, Human
aauacugagaucccacaaagca

SEQ ID NO: 929060 - RNA, 23 nt, Human
uucauugauugcaaggagauugg

SEQ ID NO: 929061 - RNA, 22 nt, Human
uggcugaggagggucuucuggu

SEQ ID NO: 929062 - RNA, 22 nt, Human
agccuggagaggcgccauacac

SEQ ID NO: 929063 - RNA, 18 nt, Human
uagcacagagcaggaugu

SEQ ID NO: 929064 - RNA, 17 nt, Human
aggcaggcagagcggga

SEQ ID NO: 929065 - RNA, 22 nt, Human
ucaccuaauugaagucaggagu

SEQ ID NO: 929066 - RNA, 22 nt, Human
cccaggaguucgaggcuguagu

SEQ ID NO: 929067 - RNA, 22 nt, Human
gaauucuuuucuuucugaaagu

SEQ ID NO: 929068 - RNA, 22 nt, Human
uucccagugauuaaggcagugg

SEQ ID NO: 929069 - RNA, 22 nt, Human
gccgggcccugaccucagaguu

SEQ ID NO: 929070 - RNA, 19 nt, Human
guccucauguuguucucca

SEQ ID NO: 929071 - RNA, 22 nt, Human
aucauagaggaaaauccacguu

SEQ ID NO: 929072 - RNA, 22 nt, Human
uaaauguaccuucugccuuacu

SEQ ID NO: 929073 - RNA, 22 nt, Human
aggcuuggaaaauuuacagugu

SEQ ID NO: 929074 - RNA, 22 nt, Human
uggagcagaaauggccucuugu

SEQ ID NO: 929075 - RNA, 22 nt, Human
ggucacagggaagggcucucaa

SEQ ID NO: 929076 - RNA, 22 nt, Human
auuacaauaagguuuauuugua

SEQ ID NO: 929077 - RNA, 23 nt, Human
ugucaaguauagcaggcccuccc

SEQ ID NO: 929078 - RNA, 22 nt, Human
cagaccaucuugaagcaaacug

SEQ ID NO: 929079 - RNA, 22 nt, Human
guuuccaagucucucaacaccc

SEQ ID NO: 929080 - RNA, 22 nt, Human
cagggaggaugggcuguuuugc

SEQ ID NO: 929081 - RNA, 22 nt, Human
uuugacaaauguaucugcauua

SEQ ID NO: 929082 - RNA, 22 nt, Human
gggaucugaguaggcagaagcu

SEQ ID NO: 929083 - RNA, 19 nt, Human
gcccugagagcuuggguuc

SEQ ID NO: 929084 - RNA, 22 nt, Human
uugucuaaugagcuccacuuca

SEQ ID NO: 929085 - RNA, 22 nt, Human
uguacagauaaagacuguaaau

SEQ ID NO: 929086 - RNA, 22 nt, Human
ugaaggguggcauggcaggcag

SEQ ID NO: 929087 - RNA, 22 nt, Human
aaauguucauuaagggccuguu

SEQ ID NO: 929088 - RNA, 22 nt, Human
ucuccagguucagucgauggaa

SEQ ID NO: 929089 - RNA, 22 nt, Human
caggccuuuuuuccugcagugu

SEQ ID NO: 929090 - RNA, 22 nt, Human
cuccuguauguugggcuucaca

SEQ ID NO: 929091 - RNA, 22 nt, Human
gcagccucugaugauggccgua

SEQ ID NO: 929092 - RNA, 22 nt, Human
uguguagcucauauuaguguua

SEQ ID NO: 929093 - RNA, 22 nt, Human
uucaaaauuguucuaagcucug

SEQ ID NO: 929094 - RNA, 21 nt, Human
agguacuaaugaaaagugauu

SEQ ID NO: 929095 - RNA, 20 nt, Human
ugucugaaaaggaagcuauc

SEQ ID NO: 929096 - RNA, 21 nt, Human
caucaugcuuguguuggagaa

SEQ ID NO: 929097 - RNA, 22 nt, Human
uauuauugcaaguauauaaagu

SEQ ID NO: 929098 - RNA, 22 nt, Human
caggcuccuucccagggauggu

SEQ ID NO: 929099 - RNA, 22 nt, Human
gccagggcucgcggucccucgu

SEQ ID NO: 929100 - RNA, 22 nt, Human
ucaggccaagguagacaugacu

SEQ ID NO: 929101 - RNA, 22 nt, Human
uguguucauguugauucauagc

SEQ ID NO: 929102 - RNA, 22 nt, Human
cagggccugccugguuccugga

SEQ ID NO: 929103 - RNA, 22 nt, Human
auguuucaguucuaaaguuaga

SEQ ID NO: 929104 - RNA, 22 nt, Human
guaauuuaauucucugacuuga

SEQ ID NO: 929105 - RNA, 22 nt, Human
uucacaggauagcuauugcacg

SEQ ID NO: 929106 - RNA, 22 nt, Human
caucuucaccagagacaagcaa

SEQ ID NO: 929107 - RNA, 22 nt, Human
uaaagcaggcaucucucuccuc

SEQ ID NO: 929108 - RNA, 22 nt, Human
gggcagcacguuucaggaggau

SEQ ID NO: 929109 - RNA, 22 nt, Human
agcuggagcuucaagcagguaa

SEQ ID NO: 929110 - RNA, 22 nt, Human
acaggcaaggccagugagaaau

SEQ ID NO: 929111 - RNA, 22 nt, Human
ggagacagcaggaagaaauauc

SEQ ID NO: 929112 - RNA, 22 nt, Human
acagaugaaacccagcuaguug

SEQ ID NO: 929113 - RNA, 22 nt, Human
uacauguauguguuaauaucug

SEQ ID NO: 929114 - RNA, 22 nt, Human
uuugcuuaaaagcggagcaaga

SEQ ID NO: 929115 - RNA, 22 nt, Human
ccuggcucccugcacagggcuc

SEQ ID NO: 929116 - RNA, 22 nt, Human
aggaccaacauagcagcagugg

SEQ ID NO: 929117 - RNA, 22 nt, Human
acuugcuuaguuugcaacagag

SEQ ID NO: 929118 - RNA, 19 nt, Human
uuuauucaccuuuaccuug

SEQ ID NO: 929119 - RNA, 22 nt, Human
aauaucagcucugucacuuacu

SEQ ID NO: 929120 - RNA, 22 nt, Human
cagaagaugcuuuguaaaauga

SEQ ID NO: 929121 - RNA, 22 nt, Human
uguggccacuguuucuuuuccu

SEQ ID NO: 929122 - RNA, 22 nt, Human
cuaggccauauuuugagaacug

SEQ ID NO: 929123 - RNA, 22 nt, Human
gccagauguagauagcaaggua

SEQ ID NO: 929124 - RNA, 22 nt, Human
ucucagagaagugaugagcaau

SEQ ID NO: 929125 - RNA, 22 nt, Human
cagcacagugcagaugcugacu

SEQ ID NO: 929126 - RNA, 22 nt, Human
caguagcaggcacucagcacgu

SEQ ID NO: 929127 - RNA, 22 nt, Human
ggccauggggacagagggugaa

SEQ ID NO: 929128 - RNA, 22 nt, Human
uacagacaguuuuucagauauu

SEQ ID NO: 929129 - RNA, 22 nt, Human
uuucuaguggguauucccuguu

SEQ ID NO: 929130 - RNA, 22 nt, Human
agucacauuugggggugucaaa

SEQ ID NO: 929131 - RNA, 22 nt, Human
cagcagcuagaggaagggcaga

SEQ ID NO: 929132 - RNA, 22 nt, Human
agaagccacaggccucgucugg

SEQ ID NO: 929133 - RNA, 22 nt, Human
gccugccugcugucaucugccu

SEQ ID NO: 929134 - RNA, 22 nt, Human
aguaucauuuuggcauuaguau

SEQ ID NO: 929135 - RNA, 22 nt, Human
guggcugcuguccucucugguu

SEQ ID NO: 929136 - RNA, 23 nt, Human
cagagcuggcucagagcugccug

SEQ ID NO: 929137 - RNA, 22 nt, Human
auguccaauagaagggagaagc

SEQ ID NO: 929138 - RNA, 22 nt, Human
uuuaaaagggguauuaagucca

SEQ ID NO: 929139 - RNA, 22 nt, Human
gaaggcaagaucucaguggagg

SEQ ID NO: 929140 - RNA, 22 nt, Human
aggagcacuaauuccugcagag

SEQ ID NO: 929141 - RNA, 20 nt, Human
auguuucucugucgugauuu

SEQ ID NO: 929142 - RNA, 22 nt, Human
uguggccagccacaggcauggu

SEQ ID NO: 929143 - RNA, 22 nt, Human
ugcugcugauggcaccuaggca

SEQ ID NO: 929144 - RNA, 22 nt, Human
aaacugcaauuauguuugcaga

SEQ ID NO: 929145 - RNA, 22 nt, Human
ggcagaagugaugggauauaac

SEQ ID NO: 929146 - RNA, 22 nt, Human
cagcugaggucaaagaagcagg

SEQ ID NO: 929147 - RNA, 22 nt, Human
cggcuggagcuuugaaccugau

SEQ ID NO: 929148 - RNA, 23 nt, Human
cgugucugugggcgauccggccu

SEQ ID NO: 929149 - RNA, 22 nt, Human
gauauuuacaaauuugccaaua

SEQ ID NO: 929150 - RNA, 22 nt, Human
gugugugugcaucucuuuuauu

SEQ ID NO: 929151 - RNA, 22 nt, Human
uccuuuccaugcuucuagaggc

SEQ ID NO: 929152 - RNA, 22 nt, Human
gccaugggucugcuggcucagc

SEQ ID NO: 929153 - RNA, 18 nt, Human
agagacagcagcaaaaga

SEQ ID NO: 929154 - RNA, 22 nt, Human
aaauucauauguugaaaugcua

SEQ ID NO: 929155 - RNA, 22 nt, Human
gcuguagggcugagcuggaccg

SEQ ID NO: 929156 - RNA, 22 nt, Human
ucucuuuaaagacucagagauu

SEQ ID NO: 929157 - RNA, 22 nt, Human
cugacucuccucaagcauaaau

SEQ ID NO: 929158 - RNA, 22 nt, Human
gcacaaggguggucucuggagc

SEQ ID NO: 929159 - RNA, 22 nt, Human
gugauggagucaaggcuagaac

SEQ ID NO: 929160 - RNA, 22 nt, Human
ggcugagcacuuuaggcaggag

SEQ ID NO: 929161 - RNA, 22 nt, Human
gcuaagggaggcaugccguggu

SEQ ID NO: 929162 - RNA, 22 nt, Human
uuaccacagugccugucuaaug

SEQ ID NO: 929163 - RNA, 22 nt, Human
cauguguguccaugugacuaag

SEQ ID NO: 929164 - RNA, 22 nt, Human
ucaguguugaauuuuuugcaaa

SEQ ID NO: 929165 - RNA, 22 nt, Human
agcagcaaagaauaggcccucu

SEQ ID NO: 929166 - RNA, 22 nt, Human
cuccagggcagcauggcagugg

SEQ ID NO: 929167 - RNA, 22 nt, Human
ugaccuauuagauuuccuugcc

SEQ ID NO: 929168 - RNA, 22 nt, Human
ggguccaggcguggcccagaug

SEQ ID NO: 929169 - RNA, 22 nt, Human
ggagguggagcuggaaguucca

SEQ ID NO: 929170 - RNA, 22 nt, Human
uuuccagugaaauuuugaaugu

SEQ ID NO: 929171 - RNA, 22 nt, Human
aaacauagcacacacagcucuu

SEQ ID NO: 929172 - RNA, 22 nt, Human
uauguauaaucacagaguguca

SEQ ID NO: 929173 - RNA, 22 nt, Human
gcucaggcaaauuucuggugaa

SEQ ID NO: 929174 - RNA, 22 nt, Human
ugggccuggggcagcccaaauc

SEQ ID NO: 929175 - RNA, 22 nt, Human
aacaguguguuuuguuauuaag

SEQ ID NO: 929176 - RNA, 22 nt, Human
acaucucacuucuuugaaggcu

SEQ ID NO: 929177 - RNA, 22 nt, Human
uucuucuacagugauuaauagu

SEQ ID NO: 929178 - RNA, 22 nt, Human
uuaagaagguacucaaagaucu

SEQ ID NO: 929179 - RNA, 22 nt, Human
uacuguuuucuauaauggcugu

SEQ ID NO: 929180 - RNA, 22 nt, Human
aaagccuuuuaugaucaguuaa

SEQ ID NO: 929181 - RNA, 22 nt, Human
uuaugcuaguugaaauaacaca

SEQ ID NO: 929182 - RNA, 22 nt, Human
uggagcaggugccaggugugug

SEQ ID NO: 929183 - RNA, 23 nt, Human
cugcuuucccacuccaugcucuu

SEQ ID NO: 929184 - RNA, 19 nt, Human
agucuucaucugccaggcc

SEQ ID NO: 929185 - RNA, 22 nt, Human
uaaauacuuuacaggaugucuc

SEQ ID NO: 929186 - RNA, 22 nt, Human
caucucacugagggguuuacaa

SEQ ID NO: 929187 - RNA, 22 nt, Human
uccugccucaggcucuggagua

SEQ ID NO: 929188 - RNA, 19 nt, Human
uaaaaacugaaggaagcag

SEQ ID NO: 929189 - RNA, 22 nt, Human
agagcuggugcauauucagaaa

SEQ ID NO: 929190 - RNA, 22 nt, Human
gccaguggcccucuggagaagg

SEQ ID NO: 929191 - RNA, 20 nt, Human
agagugggugucacaggcug

SEQ ID NO: 929192 - RNA, 22 nt, Human
cauuacaaacauguuaagauuu

SEQ ID NO: 929193 - RNA, 22 nt, Human
ugcccagcuauuccuuucuuag

SEQ ID NO: 929194 - RNA, 22 nt, Human
acaaggaggauauguuuaaggg

SEQ ID NO: 929195 - RNA, 21 nt, Human
uuggaaucucuucaucucugc

SEQ ID NO: 929196 - RNA, 22 nt, Human
gcaggcuuugacuuggggcagc

SEQ ID NO: 929197 - RNA, 22 nt, Human
cagcaagucagugaguagaaga

SEQ ID NO: 929198 - RNA, 22 nt, Human
gugcucuaggggucagugguua

SEQ ID NO: 929199 - RNA, 22 nt, Human
uagcaguagcauuuaacauaua

SEQ ID NO: 929200 - RNA, 22 nt, Human
ucuguuuuugaggcuaucuucu

SEQ ID NO: 929201 - RNA, 22 nt, Human
auugcccuagggcuaagcagga

SEQ ID NO: 929202 - RNA, 22 nt, Human
uuagaacauuuuuagaccaaua

SEQ ID NO: 929203 - RNA, 22 nt, Human
agaggcuucuuucugauuugcg

SEQ ID NO: 929204 - RNA, 22 nt, Human
ugcuucuggaaacaguggcugu

SEQ ID NO: 929205 - RNA, 19 nt, Human
ccagagagcuagguacaga

SEQ ID NO: 929206 - RNA, 22 nt, Human
caaacauugggggcuucaacac

SEQ ID NO: 929207 - RNA, 19 nt, Human
accuuuccuuucucagaug

SEQ ID NO: 929208 - RNA, 22 nt, Human
ucacucuguguuugaacucaag

SEQ ID NO: 929209 - RNA, 22 nt, Human
gcuucugcagccaaagaagccg

SEQ ID NO: 929210 - RNA, 22 nt, Human
cugugcugcuagaccuggauuc

SEQ ID NO: 929211 - RNA, 22 nt, Human
cucuuuuucagccuuaccaaag

SEQ ID NO: 929212 - RNA, 22 nt, Human
cagaggcuaaggguagcuuggg

SEQ ID NO: 929213 - RNA, 22 nt, Human
agcaguggugugaggagggcuc

SEQ ID NO: 929214 - RNA, 22 nt, Human
cacauccuucagcugagcccag

SEQ ID NO: 929215 - RNA, 22 nt, Human
ucagaguccaugguacuuaauu

SEQ ID NO: 929216 - RNA, 22 nt, Human
ccugccagggccagaggccagc

SEQ ID NO: 929217 - RNA, 22 nt, Human
uugcccuuguggaguuuacaug

SEQ ID NO: 929218 - RNA, 22 nt, Human
aagagcuggauggaaucuggga

SEQ ID NO: 929219 - RNA, 22 nt, Human
uaacugcaccaucaaauuagag

SEQ ID NO: 929220 - RNA, 18 nt, Human
ugagacagcuaccacuug

SEQ ID NO: 929221 - RNA, 22 nt, Human
ccucucugucacaccaguggcc

SEQ ID NO: 929222 - RNA, 20 nt, Human
uucccuggaaggagaagcag

SEQ ID NO: 929223 - RNA, 22 nt, Human
uggccaggccucuuggugccca

SEQ ID NO: 929224 - RNA, 22 nt, Human
uaccaugauguuugaguuacua

SEQ ID NO: 929225 - RNA, 22 nt, Human
uuugugugcgucuggccugggg

SEQ ID NO: 929226 - RNA, 19 nt, Human
acagaguccagaggaaagg

SEQ ID NO: 929227 - RNA, 22 nt, Human
uuccuugaaugagucauggaaa

SEQ ID NO: 929228 - RNA, 22 nt, Human
cugugaauuaaguauuguuauc

SEQ ID NO: 929229 - RNA, 22 nt, Human
ccaguccacgucaagaagaggu

SEQ ID NO: 929230 - RNA, 22 nt, Human
gcccuaggcuuuugugacugcc

SEQ ID NO: 929231 - RNA, 22 nt, Human
aggccagugcagcuggaacaga

SEQ ID NO: 929232 - RNA, 22 nt, Human
ccaccagcagugugcaaggauu

SEQ ID NO: 929233 - RNA, 22 nt, Human
ugcugcaggaauucucaaggga

SEQ ID NO: 929234 - RNA, 22 nt, Human
gagcaguggucacagggaggga

SEQ ID NO: 929235 - RNA, 22 nt, Human
cuuauuuaugucugucucuaau

SEQ ID NO: 929236 - RNA, 22 nt, Human
ugggccaguccagccccaggga

SEQ ID NO: 929237 - RNA, 22 nt, Human
ggcugccugaacuuuggggaaa

SEQ ID NO: 929238 - RNA, 22 nt, Human
ccccagcacuuggaguggggag

SEQ ID NO: 929239 - RNA, 22 nt, Human
agaggccggccgagcccauggg

SEQ ID NO: 929240 - RNA, 22 nt, Human
guuuccugaugugggagaucuu

SEQ ID NO: 929241 - RNA, 22 nt, Human
agcccuggcagagccagguagu

SEQ ID NO: 929242 - RNA, 22 nt, Human
cuggaacuccuggggagcuggu

SEQ ID NO: 929243 - RNA, 22 nt, Human
cccuggguucuggcugggcugc

SEQ ID NO: 929244 - RNA, 14 nt, Human
aagaucaccuuccu

SEQ ID NO: 929245 - RNA, 22 nt, Human
cugcguguuugcacccugucug

SEQ ID NO: 929246 - RNA, 22 nt, Human
ucugccgugcgaggucccacca

SEQ ID NO: 929247 - RNA, 22 nt, Human
ugggucccucaugagaggcauu

SEQ ID NO: 929248 - RNA, 22 nt, Human
cuuaaucauggcuugugggagg

SEQ ID NO: 929249 - RNA, 22 nt, Human
cucucuguuaugcuuucaugaa

SEQ ID NO: 929250 - RNA, 22 nt, Human
cugcagagcaaguaacauccuc

SEQ ID NO: 929251 - RNA, 22 nt, Human
ccagggugagaaaaggcuggau

SEQ ID NO: 929252 - RNA, 22 nt, Human
guucucucaaacuuuguguuug

SEQ ID NO: 929253 - RNA, 21 nt, Human
agcaugcacuacuucaucuua

SEQ ID NO: 929254 - RNA, 22 nt, Human
gcaggcaggaaggacuaaguaa

SEQ ID NO: 929255 - RNA, 22 nt, Human
cuucugccccuguagccugagu

SEQ ID NO: 929256 - RNA, 19 nt, Human
gucccugggcagaggcacc

SEQ ID NO: 929257 - RNA, 22 nt, Human
aggugucuucagggugagacag

SEQ ID NO: 929258 - RNA, 22 nt, Human
uuucuaguauauaacuagaucu

SEQ ID NO: 929259 - RNA, 22 nt, Human
guacacacuauguauuguacac

SEQ ID NO: 929260 - RNA, 22 nt, Human
cugaaauaaaguugcuaaaauu

SEQ ID NO: 929261 - RNA, 22 nt, Human
cacuagaaccaaugacauuucu

SEQ ID NO: 929262 - RNA, 22 nt, Human
acucucugagcuaccaggugag

SEQ ID NO: 929263 - RNA, 22 nt, Human
gcugagacuggcagcaggaagu

SEQ ID NO: 929264 - RNA, 22 nt, Human
uuguguuucugugauauguaaa

SEQ ID NO: 929265 - RNA, 22 nt, Human
uagcaagaaaacacaagaauua

SEQ ID NO: 929266 - RNA, 21 nt, Human
uuucgcauguguuaacuguga

SEQ ID NO: 929267 - RNA, 22 nt, Human
gauuucaagcccccagagauuc

SEQ ID NO: 929268 - RNA, 19 nt, Human
cuggccaggccaggggccc

SEQ ID NO: 929269 - RNA, 22 nt, Human
uaguuuaccaaauugaucuucc

SEQ ID NO: 929270 - RNA, 22 nt, Human
cuccagugggggugagccuaga

SEQ ID NO: 929271 - RNA, 22 nt, Human
ggcugugcgggcagccguggga

SEQ ID NO: 929272 - RNA, 22 nt, Human
auggagguguuugauaauuugg

SEQ ID NO: 929273 - RNA, 22 nt, Human
ucuaaaguaugcuaauauguga

SEQ ID NO: 929274 - RNA, 22 nt, Human
ugcaguggaaagacucagacuu

SEQ ID NO: 929275 - RNA, 22 nt, Human
caucuugcugacuugcauuauu

SEQ ID NO: 929276 - RNA, 22 nt, Human
ugggccugaguuugggaacugg

SEQ ID NO: 929277 - RNA, 22 nt, Human
uuuagcauuaagcuuuucaaau

SEQ ID NO: 929278 - RNA, 22 nt, Human
gugggcagauuaauuucucaau

SEQ ID NO: 929279 - RNA, 20 nt, Human
agugucuggugcagggccuc

SEQ ID NO: 929280 - RNA, 22 nt, Human
ucugggagguggcagggugcau

SEQ ID NO: 929281 - RNA, 22 nt, Human
gacaggggucccucugggcugu

SEQ ID NO: 929282 - RNA, 16 nt, Human
aaagaaacaggugucc

SEQ ID NO: 929283 - RNA, 22 nt, Human
uugcagggucccagaggccugg

SEQ ID NO: 929284 - RNA, 22 nt, Human
ucuggggagugccuaaguggaa

SEQ ID NO: 929285 - RNA, 22 nt, Human
cugccaggcugucccagguccg

SEQ ID NO: 929286 - RNA, 21 nt, Human
ucccugcuuucuggcccaguc

SEQ ID NO: 929287 - RNA, 22 nt, Human
agaguggccucagagaaauaca

SEQ ID NO: 929288 - RNA, 22 nt, Human
uuggaagaaauaucaauagugu

SEQ ID NO: 929289 - RNA, 22 nt, Human
ucuuuugugccaaguaaugaau

SEQ ID NO: 929290 - RNA, 22 nt, Human
gcaguagcaguauccagaagca

SEQ ID NO: 929291 - RNA, 22 nt, Human
ucagccugcgucauggugacac

SEQ ID NO: 929292 - RNA, 22 nt, Human
cuggagcccaggccuggugucu

SEQ ID NO: 929293 - RNA, 22 nt, Human
ggcugggcaggucugcacaggg

SEQ ID NO: 929294 - RNA, 22 nt, Human
ccugaagaauucaaauccagau

SEQ ID NO: 929295 - RNA, 22 nt, Human
aaauacuggcaagugcuaauuc

SEQ ID NO: 929296 - RNA, 22 nt, Human
uuuccucugucaugacagcuga

SEQ ID NO: 929297 - RNA, 22 nt, Human
agcaagaauauuucugccacug

SEQ ID NO: 929298 - RNA, 22 nt, Human
caggcucacuuucucagucaca

SEQ ID NO: 929299 - RNA, 19 nt, Human
gggugaggaagagcguugc

SEQ ID NO: 929300 - RNA, 23 nt, Human
gugcgccaggacaaccugacgga

SEQ ID NO: 929301 - RNA, 22 nt, Human
ggacuuuaggaagggccaagug

SEQ ID NO: 929302 - RNA, 20 nt, Human
aagggcagagggaacagacu

SEQ ID NO: 929303 - RNA, 22 nt, Human
gcacacaugcguguauaugggu

SEQ ID NO: 929304 - RNA, 22 nt, Human
gguuuccacuugcugaagaaag

SEQ ID NO: 929305 - RNA, 22 nt, Human
ggacauggagcuccauggaggc

SEQ ID NO: 929306 - RNA, 22 nt, Human
ggcucaggaugagccuucucau

SEQ ID NO: 929307 - RNA, 22 nt, Human
caggggcuagcacuuaauguuu

SEQ ID NO: 929308 - RNA, 20 nt, Human
agagacccuguagcuugcag

SEQ ID NO: 929309 - RNA, 22 nt, Human
agucugaagacucaugucugaa

SEQ ID NO: 929310 - RNA, 22 nt, Human
aucagaaaggugggcaagcaga

SEQ ID NO: 929311 - RNA, 22 nt, Human
acuugguugaugucauaagguu

SEQ ID NO: 929312 - RNA, 22 nt, Human
cccuggagguggagguugcagg

SEQ ID NO: 929313 - RNA, 22 nt, Human
cugggccuggagcccacgagcc

SEQ ID NO: 929314 - RNA, 22 nt, Human
aauaacagaaacuugagcauca

SEQ ID NO: 929315 - RNA, 22 nt, Human
aaagaccugugguagcucuaaa

SEQ ID NO: 929316 - RNA, 22 nt, Human
auggguggagggugacacggau

SEQ ID NO: 929317 - RNA, 22 nt, Human
uccugagcacagagacaaggaa

SEQ ID NO: 929318 - RNA, 22 nt, Human
cagcuggguuuaguggggugug

SEQ ID NO: 929319 - RNA, 22 nt, Human
uggcugaggcuggagugcagug

SEQ ID NO: 929320 - RNA, 22 nt, Human
guggcauggagaaggaggcagu

SEQ ID NO: 929321 - RNA, 22 nt, Human
gaggacugaaacuuacaggaaa

SEQ ID NO: 929322 - RNA, 22 nt, Human
ccaagcugagcaccaucugauc

SEQ ID NO: 929323 - RNA, 22 nt, Human
cuacaacauagucuucuacaga

SEQ ID NO: 929324 - RNA, 19 nt, Human
aaaguguuuuaaagaggau

SEQ ID NO: 929325 - RNA, 22 nt, Human
guuauauucaaaaugaggcugu

SEQ ID NO: 929326 - RNA, 22 nt, Human
ugaggccagcuucagcagugga

SEQ ID NO: 929327 - RNA, 17 nt, Human
gagguaggaagugaguc

SEQ ID NO: 929328 - RNA, 22 nt, Human
acauggcauucacucccacagg

SEQ ID NO: 929329 - RNA, 19 nt, Human
ucucaauucuccccacugc

SEQ ID NO: 929330 - RNA, 22 nt, Human
uauuucuaagagauaucuguac

SEQ ID NO: 929331 - RNA, 22 nt, Human
aaguucaaggcucuagaguucc

SEQ ID NO: 929332 - RNA, 22 nt, Human
gcagugugucucuuggcuuccu

SEQ ID NO: 929333 - RNA, 22 nt, Human
uaugaauucuguucauugauga

SEQ ID NO: 929334 - RNA, 22 nt, Human
auaaauguuuguugaaugaaua

SEQ ID NO: 929335 - RNA, 22 nt, Human
aaggcuggguaaccuguccacu

SEQ ID NO: 929336 - RNA, 22 nt, Human
ggagcugugcugggugaucagg

SEQ ID NO: 929337 - RNA, 22 nt, Human
cacacugcuuacacaaaaugau

SEQ ID NO: 929338 - RNA, 22 nt, Human
augugacaguguuugacagaug

SEQ ID NO: 929339 - RNA, 22 nt, Human
ugugcugugggacucaggcucc

SEQ ID NO: 929340 - RNA, 20 nt, Human
aaaugcuguaauguuuggga

SEQ ID NO: 929341 - RNA, 22 nt, Human
gcuuguuugugccucugcagaa

SEQ ID NO: 929342 - RNA, 23 nt, Human
uauccuaaaggcaacaggaaguc

SEQ ID NO: 929343 - RNA, 22 nt, Human
agagcacagaagaauaggugcu

SEQ ID NO: 929344 - RNA, 22 nt, Human
guagcagcucuccaggguucac

SEQ ID NO: 929345 - RNA, 22 nt, Human
ugcuccaggagcaaccuuugag

SEQ ID NO: 929346 - RNA, 23 nt, Human
guggagccacaucacaggcuccu

SEQ ID NO: 929347 - RNA, 22 nt, Human
ggaaguguggcuaagccaagaa

SEQ ID NO: 929348 - RNA, 22 nt, Human
cugcaguucucaauuucuauug

SEQ ID NO: 929349 - RNA, 22 nt, Human
ugccaaauaugcacguguaugc

SEQ ID NO: 929350 - RNA, 23 nt, Human
agucagagagugugagacaacug

SEQ ID NO: 929351 - RNA, 22 nt, Human
ggaaggaggaugcucuggccuu

SEQ ID NO: 929352 - RNA, 22 nt, Human
uauuggaagugaacaccaggcu

SEQ ID NO: 929353 - RNA, 21 nt, Human
cuuguuccaagcaugucugag

SEQ ID NO: 929354 - RNA, 20 nt, Human
gcuuggcagguuuuguugcc

SEQ ID NO: 929355 - RNA, 22 nt, Human
ucccugugagucaacuaaacaa

SEQ ID NO: 929356 - RNA, 22 nt, Human
auaguacagcauuuuuccugag

SEQ ID NO: 929357 - RNA, 22 nt, Human
auugaaaaugacauuugugccc

SEQ ID NO: 929358 - RNA, 22 nt, Human
cugaccugagugguacaaggca

SEQ ID NO: 929359 - RNA, 22 nt, Human
ucugugcacuaacauuccuggu

SEQ ID NO: 929360 - RNA, 22 nt, Human
aagaaaugcagaaaugugcugg

SEQ ID NO: 929361 - RNA, 19 nt, Human
uccugcagguggcuugcag

SEQ ID NO: 929362 - RNA, 18 nt, Human
ucugccugcagggcaucu

SEQ ID NO: 929363 - RNA, 22 nt, Human
agcagcagaggucagaaaggua

SEQ ID NO: 929364 - RNA, 22 nt, Human
ugagcagggacuuugaguguag

SEQ ID NO: 929365 - RNA, 22 nt, Human
uagaggcauuaaugaauaaaca

SEQ ID NO: 929366 - RNA, 22 nt, Human
gugaguguuaacccacugcuuc

SEQ ID NO: 929367 - RNA, 22 nt, Human
cauuguucaacacugacuugca

SEQ ID NO: 929368 - RNA, 22 nt, Human
ugggagcugggguuggacgucu

SEQ ID NO: 929369 - RNA, 22 nt, Human
caggcaguggcucacagcaacc

SEQ ID NO: 929370 - RNA, 22 nt, Human
ucaagaauuuggauaagaaaug

SEQ ID NO: 929371 - RNA, 22 nt, Human
ucaggagggucucuauuuuccu

SEQ ID NO: 929372 - RNA, 22 nt, Human
ugagcuguaaggcugucacuga

SEQ ID NO: 929373 - RNA, 22 nt, Human
auacagaggguuucaugggcag

SEQ ID NO: 929374 - RNA, 22 nt, Human
ccauuaaacuuguggacccagu

SEQ ID NO: 929375 - RNA, 22 nt, Human
agcagcuugaggcuggauucca

SEQ ID NO: 929376 - RNA, 22 nt, Human
ugugaacauuucugguuauuug

SEQ ID NO: 929377 - RNA, 21 nt, Human
ucagauaccagacucaagggg

SEQ ID NO: 929378 - RNA, 22 nt, Human
uuacaaucugauugucucaucu

SEQ ID NO: 929379 - RNA, 22 nt, Human
ucaaaacaaucauuggaugugc

SEQ ID NO: 929380 - RNA, 22 nt, Human
gugucccagccccacaggccug

SEQ ID NO: 929381 - RNA, 21 nt, Human
ugcagccucugcccagcagug

SEQ ID NO: 929382 - RNA, 22 nt, Human
ggauucagcgaggcagccugga

SEQ ID NO: 929383 - RNA, 22 nt, Human
uacacagaagccagaaggccug

SEQ ID NO: 929384 - RNA, 22 nt, Human
aagcugaugucccaguuugaag

SEQ ID NO: 929385 - RNA, 22 nt, Human
gaauguaauaggaaacgugugg

SEQ ID NO: 929386 - RNA, 22 nt, Human
aaagugaauugauuuaagggga

SEQ ID NO: 929387 - RNA, 22 nt, Human
cuguggaccugcucuuagagac

SEQ ID NO: 929388 - RNA, 22 nt, Human
cucagggcucugcaugcacacg

SEQ ID NO: 929389 - RNA, 22 nt, Human
agaaggguaguuguaagaguga

SEQ ID NO: 929390 - RNA, 22 nt, Human
cagguccaguaaaaagaguccu

SEQ ID NO: 929391 - RNA, 22 nt, Human
uggcuucucagaauacucugga

SEQ ID NO: 929392 - RNA, 22 nt, Human
cauucaaaugugccacuguccu

SEQ ID NO: 929393 - RNA, 20 nt, Human
cagacaucuccaaaucugug

SEQ ID NO: 929394 - RNA, 22 nt, Human
augucacagucugacucaguga

SEQ ID NO: 929395 - RNA, 22 nt, Human
gaggagggcuuuguugauguua

SEQ ID NO: 929396 - RNA, 20 nt, Human
ugaucaugugaaagucaugu

SEQ ID NO: 929397 - RNA, 22 nt, Human
cuacaaagcucuucuacaggca

SEQ ID NO: 929398 - RNA, 21 nt, Human
ccuggcugcacaguugcuggu

SEQ ID NO: 929399 - RNA, 20 nt, Human
gccuccacacucaccccuua

SEQ ID NO: 929400 - RNA, 22 nt, Human
ucugcugcugcagcuacacuau

SEQ ID NO: 929401 - RNA, 22 nt, Human
uacaggucuaacuaaaugaauu

SEQ ID NO: 929402 - RNA, 22 nt, Human
ucuuguuacaguuuauuacaug

SEQ ID NO: 929403 - RNA, 22 nt, Human
ucuguccauuuacagauaugca

SEQ ID NO: 929404 - RNA, 22 nt, Human
gaggcucagagacuuuaaguuu

SEQ ID NO: 929405 - RNA, 22 nt, Human
uaaagguuauaaagguuagggg

SEQ ID NO: 929406 - RNA, 22 nt, Human
uggagaaagcugcauauggaaa

SEQ ID NO: 929407 - RNA, 22 nt, Human
caggcucccgaaaucacccaug

SEQ ID NO: 929408 - RNA, 22 nt, Human
cauggcuggcacacagcaacca

SEQ ID NO: 929409 - RNA, 22 nt, Human
agcugcugcaaguggugcuaac

SEQ ID NO: 929410 - RNA, 22 nt, Human
ucacuccucauugcugcccauu

SEQ ID NO: 929411 - RNA, 22 nt, Human
ugugggcagauacacagacacg

SEQ ID NO: 929412 - RNA, 22 nt, Human
uagcaucuuuuucugucuucua

SEQ ID NO: 929413 - RNA, 22 nt, Human
uuuaugucacuuugaaagagag

SEQ ID NO: 929414 - RNA, 22 nt, Human
ugcuccagcaacaggcuuagcu

SEQ ID NO: 929415 - RNA, 22 nt, Human
cauuacgagcucuaaaauacua

SEQ ID NO: 929416 - RNA, 22 nt, Human
caaggaggcagugggacuugaa

SEQ ID NO: 929417 - RNA, 22 nt, Human
gggauggcugccugcaucagga

SEQ ID NO: 929418 - RNA, 22 nt, Human
uagguacagcuaaaaauuaucu

SEQ ID NO: 929419 - RNA, 22 nt, Human
auauuuuguaacuuggaauagg

SEQ ID NO: 929420 - RNA, 22 nt, Human
guucguauuuaugucgcagaag

SEQ ID NO: 929421 - RNA, 22 nt, Human
aaucuguauuguuaacaaguaa

SEQ ID NO: 929422 - RNA, 22 nt, Human
uaaauacuuuuacuccacugau

SEQ ID NO: 929423 - RNA, 22 nt, Human
ggcucuucugguugucacauuu

SEQ ID NO: 929424 - RNA, 17 nt, Human
aguguuuccuuaucauu

SEQ ID NO: 929425 - RNA, 22 nt, Human
uucucauacaggaucucuuauu

SEQ ID NO: 929426 - RNA, 20 nt, Human
acacuguucuucacacauuu

SEQ ID NO: 929427 - RNA, 22 nt, Human
ugaagagauagaaguacaugcu

SEQ ID NO: 929428 - RNA, 22 nt, Human
gcacugauuacccauugcugcu

SEQ ID NO: 929429 - RNA, 18 nt, Human
gacaaaaguacagacaga

SEQ ID NO: 929430 - RNA, 22 nt, Human
caagaauccuguucuugaagau

SEQ ID NO: 929431 - RNA, 22 nt, Human
ugagccagucugucugggugaa

SEQ ID NO: 929432 - RNA, 22 nt, Human
ucuggaugaagacccagaggcu

SEQ ID NO: 929433 - RNA, 22 nt, Human
guuucauucggcagcucauaag

SEQ ID NO: 929434 - RNA, 19 nt, Human
auauauguauacaaugugg

SEQ ID NO: 929435 - RNA, 22 nt, Human
uccuggccuuagcgaggcgguc

SEQ ID NO: 929436 - RNA, 19 nt, Human
uggggccuccugucccugg

SEQ ID NO: 929437 - RNA, 22 nt, Human
aucccaccucaaucugaagcuc

SEQ ID NO: 929438 - RNA, 22 nt, Human
ggcagugccugaugcugcagga

SEQ ID NO: 929439 - RNA, 22 nt, Human
cacagaauggaccaguuuuaga

SEQ ID NO: 929440 - RNA, 22 nt, Human
aacauucaccucuaccuccuuc

SEQ ID NO: 929441 - RNA, 22 nt, Human
uagggagaggaagcaggccgcu

SEQ ID NO: 929442 - RNA, 22 nt, Human
agcagcauuaagggaacugcag

SEQ ID NO: 929443 - RNA, 22 nt, Human
agccaguuggcuaugaggagga

SEQ ID NO: 929444 - RNA, 22 nt, Human
gcauucuugguaugaaggacag

SEQ ID NO: 929445 - RNA, 22 nt, Human
gacauuuauuagaaaacuauca

SEQ ID NO: 929446 - RNA, 22 nt, Human
ccaaggagaaugacaccaugga

SEQ ID NO: 929447 - RNA, 22 nt, Human
gaaagcugugaaauagugcucu

SEQ ID NO: 929448 - RNA, 22 nt, Human
uuuaacauguucaagaaacaua

SEQ ID NO: 929449 - RNA, 22 nt, Human
uacagaaucuaugcuucacagu

SEQ ID NO: 929450 - RNA, 22 nt, Human
uuugacagcauauccucauauu

SEQ ID NO: 929451 - RNA, 22 nt, Human
ggagucagaauggcaggguggu

SEQ ID NO: 929452 - RNA, 22 nt, Human
aggaagagcaucuuugggucug

SEQ ID NO: 929453 - RNA, 23 nt, Human
agaacagugacuaauauagagag

SEQ ID NO: 929454 - RNA, 22 nt, Human
uccagcuaacaccuacuggcca

SEQ ID NO: 929455 - RNA, 22 nt, Human
ugguuaaaugcuccgaucuugg

SEQ ID NO: 929456 - RNA, 21 nt, Human
aauuuugaaggaagauuaagg

SEQ ID NO: 929457 - RNA, 22 nt, Human
uuccuuggugcgccugcugcag

SEQ ID NO: 929458 - RNA, 22 nt, Human
ugcuccaggcaagcugagaguu

SEQ ID NO: 929459 - RNA, 22 nt, Human
uagaaacaaguuucucuuuggg

SEQ ID NO: 929460 - RNA, 22 nt, Human
ucuucaaagcauaugcaggcau

SEQ ID NO: 929461 - RNA, 22 nt, Human
gcuggcugcagauuuuagaggu

SEQ ID NO: 929462 - RNA, 22 nt, Human
cauaaucccaggcuugcauuca

SEQ ID NO: 929463 - RNA, 22 nt, Human
auuccacacaguaauacucaau

SEQ ID NO: 929464 - RNA, 22 nt, Human
cugcugggucuaugcaagugga

SEQ ID NO: 929465 - RNA, 22 nt, Human
gaagcccuauccucuccuggga

SEQ ID NO: 929466 - RNA, 22 nt, Human
agccuuaaaugcuagauucaua

SEQ ID NO: 929467 - RNA, 22 nt, Human
cccuuccuugugacuggugggg

SEQ ID NO: 929468 - RNA, 22 nt, Human
aaguacauaaaggaauuagcca

SEQ ID NO: 929469 - RNA, 21 nt, Human
ucagaaucugugagcuaucuc

SEQ ID NO: 929470 - RNA, 22 nt, Human
uccuuggccuggguggggucuc

SEQ ID NO: 929471 - RNA, 22 nt, Human
gaagucugcugcucaggaguuu

SEQ ID NO: 929472 - RNA, 22 nt, Human
aagaaucuaugguacauccaag

SEQ ID NO: 929473 - RNA, 22 nt, Human
gagcuggugaucagcuggagga

SEQ ID NO: 929474 - RNA, 22 nt, Human
gugucaugggguuuguuauaca

SEQ ID NO: 929475 - RNA, 22 nt, Human
auguuccuuccagagagcagaa

SEQ ID NO: 929476 - RNA, 22 nt, Human
gaccacugaaugcacuucuaau

SEQ ID NO: 929477 - RNA, 22 nt, Human
aggcaggccgugucccuccuca

SEQ ID NO: 929478 - RNA, 22 nt, Human
aguacauauugaguggugauau

SEQ ID NO: 929479 - RNA, 16 nt, Human
uaucuagaguugaggu

SEQ ID NO: 929480 - RNA, 22 nt, Human
ucagaauuuaaaauguguagau

SEQ ID NO: 929481 - RNA, 22 nt, Human
cguuuccaacugugaugagguc

SEQ ID NO: 929482 - RNA, 22 nt, Human
aaauccuaaggagaauaugauu

SEQ ID NO: 929483 - RNA, 22 nt, Human
cggcuggguucggcugcaggcc

SEQ ID NO: 929484 - RNA, 22 nt, Human
uaauuuuccacucuguuuaucu

SEQ ID NO: 929485 - RNA, 22 nt, Human
aagcugccugccacgcuagaua

SEQ ID NO: 929486 - RNA, 22 nt, Human
caggcagugucccaggaagcca

SEQ ID NO: 929487 - RNA, 23 nt, Human
auuauuaaggacauggacuuugu

SEQ ID NO: 929488 - RNA, 22 nt, Human
auaaacuauguaauuugcucua

SEQ ID NO: 929489 - RNA, 22 nt, Human
ggugagaaagggauuccuguuc

SEQ ID NO: 929490 - RNA, 19 nt, Human
acuucaaaucuuagagaaa

SEQ ID NO: 929491 - RNA, 23 nt, Human
cccaggaguuucacugcaaaggu

SEQ ID NO: 929492 - RNA, 22 nt, Human
aagacaugacugcacagccaaa

SEQ ID NO: 929493 - RNA, 19 nt, Human
cuggaauguggcuggugca

SEQ ID NO: 929494 - RNA, 22 nt, Human
gggaagagugucgguugaagug

SEQ ID NO: 929495 - RNA, 22 nt, Human
uuagcagcuaaacugacagacc

SEQ ID NO: 929496 - RNA, 22 nt, Human
gcuuuagaagacacucuguuuu

SEQ ID NO: 929497 - RNA, 22 nt, Human
aaacaauguacauuuauaaugc

SEQ ID NO: 929498 - RNA, 22 nt, Human
ugcuggcuauuuaaagaagaaa

SEQ ID NO: 929499 - RNA, 22 nt, Human
uaguuaacucuugguaauaggu

SEQ ID NO: 929500 - RNA, 22 nt, Human
gcacuaaaccaacauguaauaa

SEQ ID NO: 929501 - RNA, 22 nt, Human
caugcacacacaguucuaauua

SEQ ID NO: 929502 - RNA, 22 nt, Human
gccuucucugugagcuccuagg

SEQ ID NO: 929503 - RNA, 22 nt, Human
ccuggcuccaaagcugugacuc

SEQ ID NO: 929504 - RNA, 18 nt, Human
uccuuuucucccacccac

SEQ ID NO: 929505 - RNA, 18 nt, Human
cccagccucuccuuucua

SEQ ID NO: 929506 - RNA, 22 nt, Human
ucccccacucuaaaggagccuu

SEQ ID NO: 929507 - RNA, 22 nt, Human
uaauuauucuagucacauagca

SEQ ID NO: 929508 - RNA, 22 nt, Human
cagugccugucuuauucuuaca

SEQ ID NO: 929509 - RNA, 22 nt, Human
ucagaggaauaaugcugcauuu

SEQ ID NO: 929510 - RNA, 22 nt, Human
gugggacucuucuuuggcagug

SEQ ID NO: 929511 - RNA, 22 nt, Human
auaaauuuucuugcuguacuua

SEQ ID NO: 929512 - RNA, 22 nt, Human
uuacauuuugcacagauguccc

SEQ ID NO: 929513 - RNA, 22 nt, Human
cacagggagaggaacagcgcag

SEQ ID NO: 929514 - RNA, 22 nt, Human
acaaaaagggagaugagguaga

SEQ ID NO: 929515 - RNA, 20 nt, Human
ucugucucugagcuagacuu

SEQ ID NO: 929516 - RNA, 22 nt, Human
ucuuuuuuuccugugcagagcu

SEQ ID NO: 929517 - RNA, 22 nt, Human
cagguagguauggugcagucuu

SEQ ID NO: 929518 - RNA, 22 nt, Human
ugggggagauugugcaucucua

SEQ ID NO: 929519 - RNA, 22 nt, Human
auugcuguaaauuaucuuauua

SEQ ID NO: 929520 - RNA, 22 nt, Human
aacagauuguaaccugauagcc

SEQ ID NO: 929521 - RNA, 22 nt, Human
guuagcaacaagucucaaugac

SEQ ID NO: 929522 - RNA, 22 nt, Human
ggcagauggaagaggcuggguc

SEQ ID NO: 929523 - RNA, 22 nt, Human
uaacaugauuugcuauuuagau

SEQ ID NO: 929524 - RNA, 22 nt, Human
uaggugaguuuggggaagauag

SEQ ID NO: 929525 - RNA, 22 nt, Human
uucuuaagcaccuaaaaagugg

SEQ ID NO: 929526 - RNA, 22 nt, Human
cuccugggagcagggauggaug

SEQ ID NO: 929527 - RNA, 21 nt, Human
uucucuccauaugcccagccc

SEQ ID NO: 929528 - RNA, 22 nt, Human
gcauuuuaaugagguuuaugag

SEQ ID NO: 929529 - RNA, 22 nt, Human
aggagcugauaaaaggggguca

SEQ ID NO: 929530 - RNA, 22 nt, Human
uguagaaguucuucaggagaau

SEQ ID NO: 929531 - RNA, 22 nt, Human
auagcagcauuucuuccaagga

SEQ ID NO: 929532 - RNA, 22 nt, Human
cucugggucuaccuguggccag

SEQ ID NO: 929533 - RNA, 22 nt, Human
ugcagggacacgaagacaaaua

SEQ ID NO: 929534 - RNA, 22 nt, Human
ucagaaggaugugcagguggca

SEQ ID NO: 929535 - RNA, 22 nt, Human
agccuaggggguccugggccac

SEQ ID NO: 929536 - RNA, 22 nt, Human
auugaaagcacaaagaacaagu

SEQ ID NO: 929537 - RNA, 22 nt, Human
uguuugcuuacuuguaugcugc

SEQ ID NO: 929538 - RNA, 22 nt, Human
acacugguuguuaauaguaaca

SEQ ID NO: 929539 - RNA, 22 nt, Human
ucaucuuuaccccuugcuucaa

SEQ ID NO: 929540 - RNA, 20 nt, Human
uguuugugccagcuuuguca

SEQ ID NO: 929541 - RNA, 22 nt, Human
guugagcaaggccagagaagcc

SEQ ID NO: 929542 - RNA, 17 nt, Human
cuauuuuggagauuaaa

SEQ ID NO: 929543 - RNA, 22 nt, Human
uccuguggucuggaaggaaugg

SEQ ID NO: 929544 - RNA, 23 nt, Human
cugcagagaacugagggacagcc

SEQ ID NO: 929545 - RNA, 22 nt, Human
uuugagaagcugucuugggcuc

SEQ ID NO: 929546 - RNA, 22 nt, Human
gcccugugguuccaggaagcaa

SEQ ID NO: 929547 - RNA, 22 nt, Human
auuccaaaaggauguuagaaug

SEQ ID NO: 929548 - RNA, 22 nt, Human
uguguaaagcuuguuccagaaa

SEQ ID NO: 929549 - RNA, 16 nt, Human
aggagcuggguaggag

SEQ ID NO: 929550 - RNA, 22 nt, Human
gcuggaggcuggagugcagugg

SEQ ID NO: 929551 - RNA, 22 nt, Human
acuuucaagaacuucuuuaaug

SEQ ID NO: 929552 - RNA, 22 nt, Human
auugucuuacauacuguggagg

SEQ ID NO: 929553 - RNA, 22 nt, Human
uauaugcaugcccauguauaca

SEQ ID NO: 929554 - RNA, 22 nt, Human
ggcugccccaugggcugggcug

SEQ ID NO: 929555 - RNA, 22 nt, Human
aaauacugugaauaaagguuuu

SEQ ID NO: 929556 - RNA, 22 nt, Human
uaucagcauauuuacuuucuug

SEQ ID NO: 929557 - RNA, 22 nt, Human
agagaaacaggucagcugggag

SEQ ID NO: 929558 - RNA, 21 nt, Human
cuauuggaaaagaaaauauuu

SEQ ID NO: 929559 - RNA, 21 nt, Human
cauuccucggcucauagagga

SEQ ID NO: 929560 - RNA, 22 nt, Human
aaagccaucuguauuaagugaa

SEQ ID NO: 929561 - RNA, 22 nt, Human
ccucacugaagaggugacauuu

SEQ ID NO: 929562 - RNA, 22 nt, Human
acagagcuguacaugugccaug

SEQ ID NO: 929563 - RNA, 22 nt, Human
guggcagagguuccucagugug

SEQ ID NO: 929564 - RNA, 22 nt, Human
ucccagccauuccuuuaggugu

SEQ ID NO: 929565 - RNA, 21 nt, Human
augucuguucuuucuggcagg

SEQ ID NO: 929566 - RNA, 22 nt, Human
acacaauggcgugugccacaga

SEQ ID NO: 929567 - RNA, 19 nt, Human
cagcugccuuuucuuugca

SEQ ID NO: 929568 - RNA, 22 nt, Human
caggaaggggcucacucuggcc

SEQ ID NO: 929569 - RNA, 22 nt, Human
cagauuuaggcuuaguccaagc

SEQ ID NO: 929570 - RNA, 22 nt, Human
ucugggccucaccugcugcuca

SEQ ID NO: 929571 - RNA, 22 nt, Human
uagcagcugcaucauuuuacag

SEQ ID NO: 929572 - RNA, 22 nt, Human
cucugagguuccuuugcccucg

SEQ ID NO: 929573 - RNA, 22 nt, Human
ugcuccaugcgcucggccggcg

SEQ ID NO: 929574 - RNA, 22 nt, Human
aagaaaguggguaauaugauuu

SEQ ID NO: 929575 - RNA, 22 nt, Human
acucaguuaucauguguccaca

SEQ ID NO: 929576 - RNA, 22 nt, Human
aauaccuuuccugccauucacu

SEQ ID NO: 929577 - RNA, 22 nt, Human
ugcaaauacaaaaugguacagc

SEQ ID NO: 929578 - RNA, 23 nt, Human
ucccaggaaucugcauuuuuaac

SEQ ID NO: 929579 - RNA, 23 nt, Human
uaauuauggaauaauuugcaacg

SEQ ID NO: 929580 - RNA, 19 nt, Human
cccucaggucugagcaguc

SEQ ID NO: 929581 - RNA, 21 nt, Human
uguaaguuucaucugaauugg

SEQ ID NO: 929582 - RNA, 22 nt, Human
caaguuuaaggcacugauaagu

SEQ ID NO: 929583 - RNA, 22 nt, Human
uauaagauacuuggcauagugc

SEQ ID NO: 929584 - RNA, 19 nt, Human
augacagaguugauaagug

SEQ ID NO: 929585 - RNA, 22 nt, Human
auuuccaaucucugcauauggg

SEQ ID NO: 929586 - RNA, 22 nt, Human
cugugcccucuuugcuggccuu

SEQ ID NO: 929587 - RNA, 22 nt, Human
aggaggacucucugagccagcc

SEQ ID NO: 929588 - RNA, 22 nt, Human
uguuguacucaacagaugaauu

SEQ ID NO: 929589 - RNA, 22 nt, Human
ccugcguccacggcugggagac

SEQ ID NO: 929590 - RNA, 22 nt, Human
ccucagggaggccucuguggcu

SEQ ID NO: 929591 - RNA, 22 nt, Human
ugaguauuccuuaucugaaaug

SEQ ID NO: 929592 - RNA, 22 nt, Human
auguuuuuggcuucaaguuucu

SEQ ID NO: 929593 - RNA, 22 nt, Human
ugugugggugguaaggaaggcc

SEQ ID NO: 929594 - RNA, 22 nt, Human
ccuucaaacuuucauuaaccag

SEQ ID NO: 929595 - RNA, 22 nt, Human
uuauggaaaacuccagagagua

SEQ ID NO: 929596 - RNA, 22 nt, Human
aggcuucuugggcuucauucug

SEQ ID NO: 929597 - RNA, 22 nt, Human
cuucugugcuucacaguugcca

SEQ ID NO: 929598 - RNA, 22 nt, Human
gagugugggcacgggggccuug

SEQ ID NO: 929599 - RNA, 22 nt, Human
aucuuagacccuugguagaaaa

SEQ ID NO: 929600 - RNA, 22 nt, Human
agggcuggccacaugauuuggu

SEQ ID NO: 929601 - RNA, 22 nt, Human
ucccuggaacagagagacaacg

SEQ ID NO: 929602 - RNA, 22 nt, Human
agagccagcauuugacacuggc

SEQ ID NO: 929603 - RNA, 22 nt, Human
acaaggagaagaaauuggucau

SEQ ID NO: 929604 - RNA, 22 nt, Human
augugucuagauugcuguaccg

SEQ ID NO: 929605 - RNA, 22 nt, Human
cacagcugcacagaggaggugc

SEQ ID NO: 929606 - RNA, 22 nt, Human
ugggcaaguaucggacucugag

SEQ ID NO: 929607 - RNA, 22 nt, Human
gaaaguucacacauccacaugg

SEQ ID NO: 929608 - RNA, 22 nt, Human
gcuggcagagacaagaagacua

SEQ ID NO: 929609 - RNA, 22 nt, Human
agcagggcacuggaaggcacug

SEQ ID NO: 929610 - RNA, 22 nt, Human
aauguuacgaucaacaacacau

SEQ ID NO: 929611 - RNA, 22 nt, Human
uggcagaguuauggguauuuau

SEQ ID NO: 929612 - RNA, 22 nt, Human
ccuucacaccaucuuuaccagg

SEQ ID NO: 929613 - RNA, 22 nt, Human
uucugagaugugaaucugucaa

SEQ ID NO: 929614 - RNA, 22 nt, Human
ucacagaaucucugauaagucu

SEQ ID NO: 929615 - RNA, 22 nt, Human
gauugaaagacuguuugggaga

SEQ ID NO: 929616 - RNA, 22 nt, Human
ugcugccaccugguggcugaag

SEQ ID NO: 929617 - RNA, 22 nt, Human
aaugcuauucauuaagccuacu

SEQ ID NO: 929618 - RNA, 22 nt, Human
gcugagcucccagcaguaucug

SEQ ID NO: 929619 - RNA, 22 nt, Human
agucacagaaugauggcuccag

SEQ ID NO: 929620 - RNA, 22 nt, Human
caugugauuacacuaagaaggu

SEQ ID NO: 929621 - RNA, 22 nt, Human
ugggaaggauaccuuggaacau

SEQ ID NO: 929622 - RNA, 22 nt, Human
aucuuuggacggucccaacuga

SEQ ID NO: 929623 - RNA, 22 nt, Human
aaacauuccauuucuauguaag

SEQ ID NO: 929624 - RNA, 22 nt, Human
cagugagggcccccuuccaggu

SEQ ID NO: 929625 - RNA, 22 nt, Human
cauuucuccugggugauaaauu

SEQ ID NO: 929626 - RNA, 22 nt, Human
uuaagaagccacacaccucuuu

SEQ ID NO: 929627 - RNA, 22 nt, Human
ugaagcccugugucagcuucca

SEQ ID NO: 929628 - RNA, 22 nt, Human
ucaaucaaugugucaguuccca

SEQ ID NO: 929629 - RNA, 22 nt, Human
uuuaaagaaauuccucaucuuu

SEQ ID NO: 929630 - RNA, 22 nt, Human
ugggagcuccuggagggcagga

SEQ ID NO: 929631 - RNA, 22 nt, Human
gaagguuugaaauagguauaga

SEQ ID NO: 929632 - RNA, 22 nt, Human
cagggcugaaaucaagguguag

SEQ ID NO: 929633 - RNA, 22 nt, Human
aaagguaucauguccauacagu

SEQ ID NO: 929634 - RNA, 22 nt, Human
gcacccacuuaggccagucaau

SEQ ID NO: 929635 - RNA, 22 nt, Human
agggccaguaccaggugggugg

SEQ ID NO: 929636 - RNA, 21 nt, Human
cucaggaucuuauauauuagu

SEQ ID NO: 929637 - RNA, 22 nt, Human
uagauuucgcugcaucucaauc

SEQ ID NO: 929638 - RNA, 22 nt, Human
uuacacaugaagguccaauguu

SEQ ID NO: 929639 - RNA, 22 nt, Human
uaaaaaacauuacucuguccug

SEQ ID NO: 929640 - RNA, 22 nt, Human
guuacaacucccugaaccucgg

SEQ ID NO: 929641 - RNA, 22 nt, Human
cugugucacucacugcguuaug

SEQ ID NO: 929642 - RNA, 22 nt, Human
auaaugaaugcagaguuauuuu

SEQ ID NO: 929643 - RNA, 22 nt, Human
agccagcuaccggggcuccugg

SEQ ID NO: 929644 - RNA, 22 nt, Human
agcagccaguucucugugguag

SEQ ID NO: 929645 - RNA, 22 nt, Human
caaacauucagaugcaauggua

SEQ ID NO: 929646 - RNA, 22 nt, Human
uccuagaaggaucauucuagug

SEQ ID NO: 929647 - RNA, 22 nt, Human
ugaggcacugggagagcacacu

SEQ ID NO: 929648 - RNA, 22 nt, Human
aacaguacuugauaauuugcac

SEQ ID NO: 929649 - RNA, 22 nt, Human
gggaagccaugcucagagguac

SEQ ID NO: 929650 - RNA, 22 nt, Human
uuuggaagggaaagaaaguacu

SEQ ID NO: 929651 - RNA, 22 nt, Human
gacagguaccggucagacuacg

SEQ ID NO: 929652 - RNA, 22 nt, Human
uaggaagguguuuuuaaggagc

SEQ ID NO: 929653 - RNA, 22 nt, Human
cugucuguucagauucauuacu

SEQ ID NO: 929654 - RNA, 22 nt, Human
agcuccugaguagcuuuacuca

SEQ ID NO: 929655 - RNA, 22 nt, Human
auucaguuauuuacuuugcuau

SEQ ID NO: 929656 - RNA, 22 nt, Human
auauaaugauuuucuggugagu

SEQ ID NO: 929657 - RNA, 22 nt, Human
cuuagaaugggacccaaugggu

SEQ ID NO: 929658 - RNA, 22 nt, Human
uuuaccaaggcauaguaaucuc

SEQ ID NO: 929659 - RNA, 22 nt, Human
gucuagaauggaugagcauuuu

SEQ ID NO: 929660 - RNA, 22 nt, Human
uuuucaguuacuguuuauguga

SEQ ID NO: 929661 - RNA, 22 nt, Human
gcuucacacuaaaaauguuaaa

SEQ ID NO: 929662 - RNA, 22 nt, Human
uuagaaauauggugcugccgcc

SEQ ID NO: 929663 - RNA, 22 nt, Human
acaggcaaguacacaggcucau

SEQ ID NO: 929664 - RNA, 22 nt, Human
agcagccacagucugggacagg

SEQ ID NO: 929665 - RNA, 21 nt, Human
ucacguggucacaugagcuuu

SEQ ID NO: 929666 - RNA, 22 nt, Human
agcuuuaucuucaccugggaau

SEQ ID NO: 929667 - RNA, 22 nt, Human
ggguggcaucucucugagcugu

SEQ ID NO: 929668 - RNA, 19 nt, Human
gaggcccaugagggugcuc

SEQ ID NO: 929669 - RNA, 22 nt, Human
ccucaggcuugugagccuucag

SEQ ID NO: 929670 - RNA, 22 nt, Human
aaaaaugcuuggacuuaauaaa

SEQ ID NO: 929671 - RNA, 22 nt, Human
cccuggccuacaggcccagaga

SEQ ID NO: 929672 - RNA, 22 nt, Human
aacuuucugaaaagcuugauca

SEQ ID NO: 929673 - RNA, 22 nt, Human
aaugucuuucuguucuaugaga

SEQ ID NO: 929674 - RNA, 22 nt, Human
uucuccaacacaagcaugaugu

SEQ ID NO: 929675 - RNA, 23 nt, Human
aaacuacaacgccaggcacugag

SEQ ID NO: 929676 - RNA, 22 nt, Human
aggcucagccccugggaggaga

SEQ ID NO: 929677 - RNA, 22 nt, Human
uauauauucuuaaguaguguag

SEQ ID NO: 929678 - RNA, 22 nt, Human
uuacaucacuuuacuuaauaau

SEQ ID NO: 929679 - RNA, 22 nt, Human
uaaaugcagcaguuucuguucu

SEQ ID NO: 929680 - RNA, 22 nt, Human
gugugcagggggccagcgcagc

SEQ ID NO: 929681 - RNA, 22 nt, Human
cuggcucugagugguaucuuga

SEQ ID NO: 929682 - RNA, 22 nt, Human
caguuucugccaggauguguua

SEQ ID NO: 929683 - RNA, 22 nt, Human
augugugugcauuucucucccu

SEQ ID NO: 929684 - RNA, 22 nt, Human
acaggccugacacacagagggc

SEQ ID NO: 929685 - RNA, 22 nt, Human
uuagaaucuuguaucagaaguu

SEQ ID NO: 929686 - RNA, 22 nt, Human
uuuccacacugcagccagcaaa

SEQ ID NO: 929687 - RNA, 22 nt, Human
cuguggcuggccuuauugcugc

SEQ ID NO: 929688 - RNA, 17 nt, Human
ugucuacucugacuaaa

SEQ ID NO: 929689 - RNA, 21 nt, Human
ugcuggccucaagggugacuu

SEQ ID NO: 929690 - RNA, 22 nt, Human
uugggguguuggauggagcaag

SEQ ID NO: 929691 - RNA, 22 nt, Human
aguuucuuggucacaguuuuca

SEQ ID NO: 929692 - RNA, 22 nt, Human
aggaaugauucaagacuuggcu

SEQ ID NO: 929693 - RNA, 19 nt, Human
uucuggacagcagaaacca

SEQ ID NO: 929694 - RNA, 22 nt, Human
agucaagguggaccagaaaaau

SEQ ID NO: 929695 - RNA, 22 nt, Human
auuucucuaagcauccguuugc

SEQ ID NO: 929696 - RNA, 22 nt, Human
cucacagguagaauaacaacau

SEQ ID NO: 929697 - RNA, 22 nt, Human
gcauguggugcugaggcugucg

SEQ ID NO: 929698 - RNA, 22 nt, Human
uuuuauauggcacauugguugg

SEQ ID NO: 929699 - RNA, 22 nt, Human
ccaguguggccaggugcuggua

SEQ ID NO: 929700 - RNA, 22 nt, Human
cccgacuagcugggauuacagg

SEQ ID NO: 929701 - RNA, 22 nt, Human
aaaguucagugccuucuauaca

SEQ ID NO: 929702 - RNA, 22 nt, Human
aauucaaagacuagaauuuugc

SEQ ID NO: 929703 - RNA, 22 nt, Human
gggagagagaaaacguggcgca

SEQ ID NO: 929704 - RNA, 22 nt, Human
acacaguuuaugguauucuguu

SEQ ID NO: 929705 - RNA, 22 nt, Human
uggcagccuggaaucucucagc

SEQ ID NO: 929706 - RNA, 21 nt, Human
agcuggcucucucuggagaga

SEQ ID NO: 929707 - RNA, 22 nt, Human
aucaucuaaauugaguccagcu

SEQ ID NO: 929708 - RNA, 22 nt, Human
acauuaaaauugggugggguaa

SEQ ID NO: 929709 - RNA, 22 nt, Human
caugcaaaugguggcuaaaugg

SEQ ID NO: 929710 - RNA, 22 nt, Human
aaagcuaguaauauuuuaaucc

SEQ ID NO: 929711 - RNA, 22 nt, Human
cuauagaaacaaccucucuuuc

SEQ ID NO: 929712 - RNA, 22 nt, Human
gacagcaugaucaaggagccca

SEQ ID NO: 929713 - RNA, 22 nt, Human
acugucacuaacuaagucuagu

SEQ ID NO: 929714 - RNA, 22 nt, Human
gacacaugaccauaaaugcuaa

SEQ ID NO: 929715 - RNA, 22 nt, Human
cagagaugugauccagcugucu

SEQ ID NO: 929716 - RNA, 22 nt, Human
ugucuccacaggugucagcuca

SEQ ID NO: 929717 - RNA, 22 nt, Human
ucccugugaaucagaagcaggu

SEQ ID NO: 929718 - RNA, 22 nt, Human
uccaaaguaauuucacuucugu

SEQ ID NO: 929719 - RNA, 22 nt, Human
gcuuuacugucuggaaaguuug

SEQ ID NO: 929720 - RNA, 22 nt, Human
uccuggguucauguccuggugc

SEQ ID NO: 929721 - RNA, 22 nt, Human
cugacagucuugccaaguuucu

SEQ ID NO: 929722 - RNA, 22 nt, Human
cugccucacauuggcuguguga

SEQ ID NO: 929723 - RNA, 22 nt, Human
uacaaccauagacauauacuag

SEQ ID NO: 929724 - RNA, 22 nt, Human
acaguacucuaaugaaaagugc

SEQ ID NO: 929725 - RNA, 18 nt, Human
ggguccccagcugcaggg

SEQ ID NO: 929726 - RNA, 23 nt, Human
acuucauggcacugucuuagagg

SEQ ID NO: 929727 - RNA, 22 nt, Human
uggcccaagucugcuagaagag

SEQ ID NO: 929728 - RNA, 22 nt, Human
cuuauagaauuagagagauuuu

SEQ ID NO: 929729 - RNA, 22 nt, Human
ggaggucacgacugggaugccu

SEQ ID NO: 929730 - RNA, 22 nt, Human
cucugcccgcggaugccacguc

SEQ ID NO: 929731 - RNA, 22 nt, Human
aagaggcagcccgcugaggcug

SEQ ID NO: 929732 - RNA, 16 nt, Human
gcuggagggagggguu

SEQ ID NO: 929733 - RNA, 22 nt, Human
uuuauaguuauauacagauguu

SEQ ID NO: 929734 - RNA, 22 nt, Human
uaagugaugaaagcagaugucu

SEQ ID NO: 929735 - RNA, 22 nt, Human
aaaacuuucagggauacagaaa

SEQ ID NO: 929736 - RNA, 22 nt, Human
ucuggccagugaaaugcagaau

SEQ ID NO: 929737 - RNA, 22 nt, Human
agaugaaaagauaagcagcaau

SEQ ID NO: 929738 - RNA, 22 nt, Human
uguacagggugcagcgagcgga

SEQ ID NO: 929739 - RNA, 22 nt, Human
ucuuauuuagagaggacuagag

SEQ ID NO: 929740 - RNA, 22 nt, Human
gugcacaucgugcagguuuguu

SEQ ID NO: 929741 - RNA, 22 nt, Human
uuuggaggggaagaccuuggag

SEQ ID NO: 929742 - RNA, 22 nt, Human
cucugggucccacgucauugcu

SEQ ID NO: 929743 - RNA, 22 nt, Human
uggcagugggaauggacaaaca

SEQ ID NO: 929744 - RNA, 22 nt, Human
cuguuuauugagcaaucugcca

SEQ ID NO: 929745 - RNA, 22 nt, Human
uagcaaaggccuuggacacgcu

SEQ ID NO: 929746 - RNA, 20 nt, Human
cuagucucacaucccuggca

SEQ ID NO: 929747 - RNA, 22 nt, Human
gagcuguguaugcaucauucug

SEQ ID NO: 929748 - RNA, 22 nt, Human
aaaugacagaguaagcuguuua

SEQ ID NO: 929749 - RNA, 22 nt, Human
cuaggugauccacugcucucuu

SEQ ID NO: 929750 - RNA, 22 nt, Human
ugcagcugcaaguccaggucag

SEQ ID NO: 929751 - RNA, 22 nt, Human
ucugggaaguccucugucaugc

SEQ ID NO: 929752 - RNA, 21 nt, Human
gcaugccugcaucuuaguguu

SEQ ID NO: 929753 - RNA, 19 nt, Human
cuggagauagggccuuuaa

SEQ ID NO: 929754 - RNA, 22 nt, Human
ugcuguauuuauggccacugaa

SEQ ID NO: 929755 - RNA, 22 nt, Human
gaggccagugugcuguguuuuc

SEQ ID NO: 929756 - RNA, 22 nt, Human
aaaagcaagaggcuggauuaaa

SEQ ID NO: 929757 - RNA, 21 nt, Human
auguccuggcuaccagcgcag

SEQ ID NO: 929758 - RNA, 22 nt, Human
cccccucugccgggguccuuca

SEQ ID NO: 929759 - RNA, 20 nt, Human
acacaguagaugagugacug

SEQ ID NO: 929760 - RNA, 22 nt, Human
gauuuccuugcauauugguaau

SEQ ID NO: 929761 - RNA, 22 nt, Human
ucauauauuuaguugugcaaca

SEQ ID NO: 929762 - RNA, 22 nt, Human
augacaaaggcugaaagggaaa

SEQ ID NO: 929763 - RNA, 22 nt, Human
augugcagccuuucuucaucau

SEQ ID NO: 929764 - RNA, 22 nt, Human
guuauauaauuccugugguagu

SEQ ID NO: 929765 - RNA, 22 nt, Human
accaugucauuuauuggccaaa

SEQ ID NO: 929766 - RNA, 22 nt, Human
aagcaagacagaaguuacugcc

SEQ ID NO: 929767 - RNA, 22 nt, Human
ucaggaaaggcagagugucugu

SEQ ID NO: 929768 - RNA, 22 nt, Human
uccuuggagucaugauggaggu

SEQ ID NO: 929769 - RNA, 22 nt, Human
acagauaauuagcauaaaugcu

SEQ ID NO: 929770 - RNA, 22 nt, Human
caagcuccuuacauccacaggg

SEQ ID NO: 929771 - RNA, 22 nt, Human
gggcagcccagaacugcugcag

SEQ ID NO: 929772 - RNA, 22 nt, Human
uuccaguucuucuguaagcacu

SEQ ID NO: 929773 - RNA, 17 nt, Human
cuaggcuuggcagcucg

SEQ ID NO: 929774 - RNA, 22 nt, Human
aguacagauuucugggcccuac

SEQ ID NO: 929775 - RNA, 22 nt, Human
cagccucuaagcacagccucuc

SEQ ID NO: 929776 - RNA, 22 nt, Human
ggaaacuuggaugccagcacuc

SEQ ID NO: 929777 - RNA, 22 nt, Human
aguuuguaugccaacagcaaag

SEQ ID NO: 929778 - RNA, 19 nt, Human
uucuagaacuguucucuca

SEQ ID NO: 929779 - RNA, 22 nt, Human
augaaguucucaauaaucaugu

SEQ ID NO: 929780 - RNA, 22 nt, Human
acagagguuuccauugagguuu

SEQ ID NO: 929781 - RNA, 22 nt, Human
gugggcaggcccuaggcgauuu

SEQ ID NO: 929782 - RNA, 22 nt, Human
cuggaaaguacagugugucaca

SEQ ID NO: 929783 - RNA, 22 nt, Human
uuuuugucuagcgucucuaguu

SEQ ID NO: 929784 - RNA, 22 nt, Human
uugcccugccucccugagguga

SEQ ID NO: 929785 - RNA, 22 nt, Human
guggaagccuaagaguagggag

SEQ ID NO: 929786 - RNA, 22 nt, Human
agacagaccauggcuauucaga

SEQ ID NO: 929787 - RNA, 22 nt, Human
aaguccaaggcugggugcagug

SEQ ID NO: 929788 - RNA, 22 nt, Human
acagaguucccacuccagaagc

SEQ ID NO: 929789 - RNA, 19 nt, Human
accaggagacagugagcuu

SEQ ID NO: 929790 - RNA, 22 nt, Human
agaccccauaccucagcaggua

SEQ ID NO: 929791 - RNA, 22 nt, Human
ugcuuagaaucuggacuuguug

SEQ ID NO: 929792 - RNA, 22 nt, Human
uaacagaagaaaacauauugga

SEQ ID NO: 929793 - RNA, 22 nt, Human
uauauuaaaugaccaguuuuaa

SEQ ID NO: 929794 - RNA, 22 nt, Human
gcaguguuucagugcuuuuucu

SEQ ID NO: 929795 - RNA, 22 nt, Human
gauuuauuggucuuucauuggu

SEQ ID NO: 929796 - RNA, 22 nt, Human
gcuggccauagaagccaaagag

SEQ ID NO: 929797 - RNA, 22 nt, Human
ucugccagcuucuggugguugc

SEQ ID NO: 929798 - RNA, 22 nt, Human
aaauguuccggguaaggagaaa

SEQ ID NO: 929799 - RNA, 22 nt, Human
auauaacucuuguucuuauagu

SEQ ID NO: 929800 - RNA, 22 nt, Human
gucugcugcagagcauggcuuu

SEQ ID NO: 929801 - RNA, 22 nt, Human
ccugccaggccagugagcuucc

SEQ ID NO: 929802 - RNA, 22 nt, Human
uuucucauagucaugccucuua

SEQ ID NO: 929803 - RNA, 22 nt, Human
gguuaaaaauaauuuacuuggc

SEQ ID NO: 929804 - RNA, 22 nt, Human
gugugcgcgcucauaggugugu

SEQ ID NO: 929805 - RNA, 22 nt, Human
gcauggcagccaguacauggug

SEQ ID NO: 929806 - RNA, 22 nt, Human
acuucauguuguuuacaacuua

SEQ ID NO: 929807 - RNA, 22 nt, Human
aagucuuucauaagucucuuau

SEQ ID NO: 929808 - RNA, 22 nt, Human
uuaagaggagaucauacuggag

SEQ ID NO: 929809 - RNA, 22 nt, Human
gucauuuuugacuuugaaguga

SEQ ID NO: 929810 - RNA, 22 nt, Human
ucccauuuuggaugcggauugg

SEQ ID NO: 929811 - RNA, 22 nt, Human
aggcugggcuccgcccaacucc

SEQ ID NO: 929812 - RNA, 23 nt, Human
uagaauccucugagauggaauag

SEQ ID NO: 929813 - RNA, 20 nt, Human
uuguuuuaaauccuggauga

SEQ ID NO: 929814 - RNA, 22 nt, Human
uaagaggcaaaagauacucaga

SEQ ID NO: 929815 - RNA, 22 nt, Human
uuguccugcaaccucacauggc

SEQ ID NO: 929816 - RNA, 22 nt, Human
ucuucaggagcugaaagccugc

SEQ ID NO: 929817 - RNA, 22 nt, Human
uggcugagggggcaguucagga

SEQ ID NO: 929818 - RNA, 22 nt, Human
cugcccagaaucacucacucga

SEQ ID NO: 929819 - RNA, 22 nt, Human
uuuguuuggcaacuugguaaag

SEQ ID NO: 929820 - RNA, 22 nt, Human
cuuccuagcuucagagucuguu

SEQ ID NO: 929821 - RNA, 22 nt, Human
gaggcucagggaaacagcgcag

SEQ ID NO: 929822 - RNA, 22 nt, Human
acacauaugguugcugcaguga

SEQ ID NO: 929823 - RNA, 22 nt, Human
ggccuuggugccauggccaguu

SEQ ID NO: 929824 - RNA, 21 nt, Human
aaaugcuuuguauauaucugu

SEQ ID NO: 929825 - RNA, 22 nt, Human
gguggcggccacuucagcccug

SEQ ID NO: 929826 - RNA, 22 nt, Human
ccugccuggagcugagugugga

SEQ ID NO: 929827 - RNA, 22 nt, Human
agugaaguaaaagaugugcauc

SEQ ID NO: 929828 - RNA, 22 nt, Human
gaaagguugggugaauggugga

SEQ ID NO: 929829 - RNA, 22 nt, Human
caggagcagaggguggucagca

SEQ ID NO: 929830 - RNA, 22 nt, Human
aaaggcaaaggcugguauggcu

SEQ ID NO: 929831 - RNA, 22 nt, Human
gugggugauguacuggaggcca

SEQ ID NO: 929832 - RNA, 22 nt, Human
cugucuggaaugcaguacauag

SEQ ID NO: 929833 - RNA, 22 nt, Human
acacaggcauagccauacaugu

SEQ ID NO: 929834 - RNA, 22 nt, Human
cggcucaggccacaggacggca

SEQ ID NO: 929835 - RNA, 22 nt, Human
guggcagcggugugcaaggagg

SEQ ID NO: 929836 - RNA, 22 nt, Human
gaaagagaaccugggccuagau

SEQ ID NO: 929837 - RNA, 22 nt, Human
gguccccagcaguggcugcuuc

SEQ ID NO: 929838 - RNA, 22 nt, Human
caggcagcauuuacucugauga

SEQ ID NO: 929839 - RNA, 22 nt, Human
ucagcccuggcacugucuccca

SEQ ID NO: 929840 - RNA, 19 nt, Human
auacacuaauauaaaccac

SEQ ID NO: 929841 - RNA, 22 nt, Human
acucacauuucaucaggccaag

SEQ ID NO: 929842 - RNA, 22 nt, Human
uccaggccugccugguguuugc

SEQ ID NO: 929843 - RNA, 21 nt, Human
augucuguucugauuggugcg

SEQ ID NO: 929844 - RNA, 22 nt, Human
ucaggagcagcaugggugagag

SEQ ID NO: 929845 - RNA, 22 nt, Human
uagaaaccucagggaaaucuuu

SEQ ID NO: 929846 - RNA, 22 nt, Human
aguuuugauacuuucucuucau

SEQ ID NO: 929847 - RNA, 22 nt, Human
accagaggaggaauuaccuucc

SEQ ID NO: 929848 - RNA, 21 nt, Human
ggccucugucauccugggaag

SEQ ID NO: 929849 - RNA, 22 nt, Human
cgaaaucagcaucuugaggcaa

SEQ ID NO: 929850 - RNA, 22 nt, Human
aguggcugaauauauuuuacua

SEQ ID NO: 929851 - RNA, 22 nt, Human
ucccgcuucuuccgaaucgcga

SEQ ID NO: 929852 - RNA, 22 nt, Human
aggcuccuuuaccauucuggag

SEQ ID NO: 929853 - RNA, 22 nt, Human
aacuguagaagggacacaaaag

SEQ ID NO: 929854 - RNA, 22 nt, Human
cugcuccaguagccccaugugg

SEQ ID NO: 929855 - RNA, 22 nt, Human
cuuguccagauguuuguuaggu

SEQ ID NO: 929856 - RNA, 22 nt, Human
aguuauaaucugcuacugauau

SEQ ID NO: 929857 - RNA, 22 nt, Human
gacauguauuaguacauauggu

SEQ ID NO: 929858 - RNA, 22 nt, Human
uccaaauauauucacguccuag

SEQ ID NO: 929859 - RNA, 22 nt, Human
aggccagcucacccuggcuccu

SEQ ID NO: 929860 - RNA, 22 nt, Human
aaaucagacuugaauuuucauc

SEQ ID NO: 929861 - RNA, 22 nt, Human
aggacacagcugcucugcagag

SEQ ID NO: 929862 - RNA, 16 nt, Human
agaggcuguaauggaa

SEQ ID NO: 929863 - RNA, 22 nt, Human
agugggagcggcagucggggac

SEQ ID NO: 929864 - RNA, 22 nt, Human
agcuccugaaaagcgcuugcuu

SEQ ID NO: 929865 - RNA, 22 nt, Human
cagggagaucuuggcuccuggu

SEQ ID NO: 929866 - RNA, 22 nt, Human
gggaagugagcuggaaucaagg

SEQ ID NO: 929867 - RNA, 22 nt, Human
cugagguagaggaaauguagcu

SEQ ID NO: 929868 - RNA, 22 nt, Human
caggaggaaaguuccacucaac

SEQ ID NO: 929869 - RNA, 22 nt, Human
uugccaggagacaucuggagcc

SEQ ID NO: 929870 - RNA, 22 nt, Human
gaggucaggggagaggcugaug

SEQ ID NO: 929871 - RNA, 22 nt, Human
agucuggagugauuauguggga

SEQ ID NO: 929872 - RNA, 21 nt, Human
ccaccaggucuucugcucggg

SEQ ID NO: 929873 - RNA, 22 nt, Human
ggguggaaaguauuuggggacc

SEQ ID NO: 929874 - RNA, 21 nt, Human
uaggugggagccccaguaugc

SEQ ID NO: 929875 - RNA, 22 nt, Human
agcuggugauguggucccucac

SEQ ID NO: 929876 - RNA, 22 nt, Human
ggugugggucagcuuuauuaau

SEQ ID NO: 929877 - RNA, 22 nt, Human
uuuugaauaauucagaaacagc

SEQ ID NO: 929878 - RNA, 22 nt, Human
ccuggccugugaaucugagagc

SEQ ID NO: 929879 - RNA, 21 nt, Human
gcaggguuugugcugugaguu

SEQ ID NO: 929880 - RNA, 22 nt, Human
caggguggaacaggcaauacuu

SEQ ID NO: 929881 - RNA, 22 nt, Human
agguagcuggugcugggcuccu

SEQ ID NO: 929882 - RNA, 22 nt, Human
cuagggcagggaguguuugcgc

SEQ ID NO: 929883 - RNA, 19 nt, Human
acugcagggaggaggugug

SEQ ID NO: 929884 - RNA, 22 nt, Human
cuggcaguguccagcucgugau

SEQ ID NO: 929885 - RNA, 23 nt, Human
uggcuugcuaauguuccaaauaa

SEQ ID NO: 929886 - RNA, 22 nt, Human
augcaggaagagcccuggagcu

SEQ ID NO: 929887 - RNA, 22 nt, Human
gccacaggucggcuagaggguc

SEQ ID NO: 929888 - RNA, 22 nt, Human
aggccugggacgggagccguga

SEQ ID NO: 929889 - RNA, 22 nt, Human
ggcagaggaagcuggaaguggg

SEQ ID NO: 929890 - RNA, 22 nt, Human
ggccuugggauguggcugcagc

SEQ ID NO: 929891 - RNA, 19 nt, Human
gaugcucauucagguggaa

SEQ ID NO: 929892 - RNA, 22 nt, Human
gaggagcuucagaggaaucuua

SEQ ID NO: 929893 - RNA, 22 nt, Human
agaggaaguaaucaggaccugc

SEQ ID NO: 929894 - RNA, 22 nt, Human
ggccuugguaaauuggcauuug

SEQ ID NO: 929895 - RNA, 18 nt, Human
uggguggcuagggaguuu

SEQ ID NO: 929896 - RNA, 22 nt, Human
gggagcugaaggagccggcggg

SEQ ID NO: 929897 - RNA, 22 nt, Human
ggagaagggaacugaguuuuug

SEQ ID NO: 929898 - RNA, 22 nt, Human
ucagguagugguuaaguucugu

SEQ ID NO: 929899 - RNA, 22 nt, Human
gagggccaaugugucccugagc

SEQ ID NO: 929900 - RNA, 22 nt, Human
ggcuagggagacagagggcaug

SEQ ID NO: 929901 - RNA, 22 nt, Human
guaaagcaaaauguagagauug

SEQ ID NO: 929902 - RNA, 22 nt, Human
aggaagagcuggaccagaggac

SEQ ID NO: 929903 - RNA, 23 nt, Human
uacugggcagcugcucugacacc

SEQ ID NO: 929904 - RNA, 22 nt, Human
uugagcugccuggcuguggcuc

SEQ ID NO: 929905 - RNA, 22 nt, Human
caggccacacggcggcucccug

SEQ ID NO: 929906 - RNA, 22 nt, Human
aggacugggugcagagggcauc

SEQ ID NO: 929907 - RNA, 21 nt, Human
ugugacagaggcggugccuac

SEQ ID NO: 929908 - RNA, 22 nt, Human
auuugugggacuauaaugcagg

SEQ ID NO: 929909 - RNA, 22 nt, Human
gggcugaauuuguugcauguaa

SEQ ID NO: 929910 - RNA, 22 nt, Human
gcacugggggcagcagugaggg

SEQ ID NO: 929911 - RNA, 22 nt, Human
agggaggucuggcugcccugag

SEQ ID NO: 929912 - RNA, 18 nt, Human
ggugagggagcuggaagc

SEQ ID NO: 929913 - RNA, 22 nt, Human
aggagggagcuuaagccaggca

SEQ ID NO: 929914 - RNA, 22 nt, Human
ugggggagccuucacaguagcu

SEQ ID NO: 929915 - RNA, 22 nt, Human
gggacgugagugaagaaggucu

SEQ ID NO: 929916 - RNA, 23 nt, Human
gguuggcuguacccaggcucccu

SEQ ID NO: 929917 - RNA, 22 nt, Human
aggcugagccugggcguggugg

SEQ ID NO: 929918 - RNA, 18 nt, Human
ggaaggugcuggagugca

SEQ ID NO: 929919 - RNA, 22 nt, Human
uggcugaggcuuuucuuaaaga

SEQ ID NO: 929920 - RNA, 22 nt, Human
augcggagccccaagcuugaag

SEQ ID NO: 929921 - RNA, 22 nt, Human
gagcugcauagcugggauccuc

SEQ ID NO: 929922 - RNA, 22 nt, Human
ccaggugugcucugcaguggau

SEQ ID NO: 929923 - RNA, 22 nt, Human
uggccugauuuugcuaagagaa

SEQ ID NO: 929924 - RNA, 22 nt, Human
ugggcaaggcuggagccugcag

SEQ ID NO: 929925 - RNA, 22 nt, Human
cauuggcuccugugggacauga

SEQ ID NO: 929926 - RNA, 22 nt, Human
agggcccuagggaaugagacau

SEQ ID NO: 929927 - RNA, 22 nt, Human
aggggcagccucacaauccucu

SEQ ID NO: 929928 - RNA, 22 nt, Human
uuaaggaacuugucuuucucuu

SEQ ID NO: 929929 - RNA, 21 nt, Human
uccaggagcacgggacuagga

SEQ ID NO: 929930 - RNA, 22 nt, Human
ucugggaguuucugugggagcu

SEQ ID NO: 929931 - RNA, 22 nt, Human
gucaggaugagggaugaggagu

SEQ ID NO: 929932 - RNA, 22 nt, Human
gcuuuggaaauauagacucaag

SEQ ID NO: 929933 - RNA, 20 nt, Human
ucagugggaaagugagagug

SEQ ID NO: 929934 - RNA, 22 nt, Human
ggcuguggucauuaggagguug

SEQ ID NO: 929935 - RNA, 22 nt, Human
acuggaaaguauucuuucacug

SEQ ID NO: 929936 - RNA, 22 nt, Human
gagcugggaagauagcuugagc

SEQ ID NO: 929937 - RNA, 21 nt, Human
agggaaaaggcugagugaggg

SEQ ID NO: 929938 - RNA, 22 nt, Human
gucuggaggaggaagaaggcac

SEQ ID NO: 929939 - RNA, 19 nt, Human
ggaggcuucuuggggucgg

SEQ ID NO: 929940 - RNA, 22 nt, Human
gaggggccuggcgaggacaugu

SEQ ID NO: 929941 - RNA, 22 nt, Human
acccggaggcgggggaugcagu

SEQ ID NO: 929942 - RNA, 22 nt, Human
gcugcagggagcuggaaggcuc

SEQ ID NO: 929943 - RNA, 22 nt, Human
cugagcugguucucuugugaaa

SEQ ID NO: 929944 - RNA, 18 nt, Human
agggagagaccgcggguc

SEQ ID NO: 929945 - RNA, 22 nt, Human
uugucaggaacuaugauuaugc

SEQ ID NO: 929946 - RNA, 22 nt, Human
ccaggaaguaugacccaacaga

SEQ ID NO: 929947 - RNA, 22 nt, Human
ggcuggccuguguggccgccac

SEQ ID NO: 929948 - RNA, 22 nt, Human
gcuggguuuucuuccgggccua

SEQ ID NO: 929949 - RNA, 22 nt, Human
uggcugaggucuggggcuucug

SEQ ID NO: 929950 - RNA, 22 nt, Human
caguauuuaggauuaggagaga

SEQ ID NO: 929951 - RNA, 22 nt, Human
ugggaugggaucucgcuguguc

SEQ ID NO: 929952 - RNA, 22 nt, Human
aaagcagaacugagagagcugg

SEQ ID NO: 929953 - RNA, 22 nt, Human
gacaggugcuaagggaccuggc

SEQ ID NO: 929954 - RNA, 22 nt, Human
aggacagcagugcuggcacuug

SEQ ID NO: 929955 - RNA, 22 nt, Human
guagaggggugauucugugaga

SEQ ID NO: 929956 - RNA, 20 nt, Human
uugaggagauauugaauacu

SEQ ID NO: 929957 - RNA, 22 nt, Human
uagggcucugagaguucagccu

SEQ ID NO: 929958 - RNA, 22 nt, Human
gggagggucugagagcugcacc

SEQ ID NO: 929959 - RNA, 22 nt, Human
uuuuuaagagucuggaaauagu

SEQ ID NO: 929960 - RNA, 22 nt, Human
agguaagguuuggaggcagugg

SEQ ID NO: 929961 - RNA, 22 nt, Human
auggccagcaagguagggcaau

SEQ ID NO: 929962 - RNA, 22 nt, Human
aggcugcagaggugcugccaga

SEQ ID NO: 929963 - RNA, 22 nt, Human
aggaauguggaagguggcggcg

SEQ ID NO: 929964 - RNA, 22 nt, Human
gagaugugucagguccuggggg

SEQ ID NO: 929965 - RNA, 22 nt, Human
ggcuggaaggcccuuuguugau

SEQ ID NO: 929966 - RNA, 22 nt, Human
ggagcagggaauuacagcgcag

SEQ ID NO: 929967 - RNA, 22 nt, Human
uggaaggggagcuggaaagggg

SEQ ID NO: 929968 - RNA, 22 nt, Human
uucacagaauugucuugacugg

SEQ ID NO: 929969 - RNA, 22 nt, Human
uggcuggggccugaauccugca

SEQ ID NO: 929970 - RNA, 22 nt, Human
cagggccugccugguuccugga

SEQ ID NO: 929971 - RNA, 19 nt, Human
ugguggaggugcaccugac

SEQ ID NO: 929972 - RNA, 22 nt, Human
gggcagcaucaggaggggcuuu

SEQ ID NO: 929973 - RNA, 23 nt, Human
ugagagccuggcagccuggguuc

SEQ ID NO: 929974 - RNA, 22 nt, Human
aaggggaguuagugauaaaacc

SEQ ID NO: 929975 - RNA, 21 nt, Human
ucaggaagagccaguucaugc

SEQ ID NO: 929976 - RNA, 23 nt, Human
ggucccaguggagaggccucacc

SEQ ID NO: 929977 - RNA, 22 nt, Human
gggcugagggguaucucauggg

SEQ ID NO: 929978 - RNA, 22 nt, Human
ccugaggaugccagcaugggug

SEQ ID NO: 929979 - RNA, 22 nt, Human
uugaggagucaggggcacggaa

SEQ ID NO: 929980 - RNA, 21 nt, Human
ggagucagggucuggcugggg

SEQ ID NO: 929981 - RNA, 22 nt, Human
uggcuggcuguccagcugggca

SEQ ID NO: 929982 - RNA, 22 nt, Human
auggccugcagugcugccacag

SEQ ID NO: 929983 - RNA, 20 nt, Human
acacugugcuaaggauuuuc

SEQ ID NO: 929984 - RNA, 22 nt, Human
cuggagcucuguguguuccuga

SEQ ID NO: 929985 - RNA, 22 nt, Human
ugaacaggugccuucagggagu

SEQ ID NO: 929986 - RNA, 22 nt, Human
gauggaggagauggcagggugc

SEQ ID NO: 929987 - RNA, 22 nt, Human
caggccugugacaccgugucug

SEQ ID NO: 929988 - RNA, 22 nt, Human
gagggcugccacguugggcgag

SEQ ID NO: 929989 - RNA, 22 nt, Human
uggcugaguuacgaacagagca

SEQ ID NO: 929990 - RNA, 22 nt, Human
aggccgugugagcaugugugag

SEQ ID NO: 929991 - RNA, 22 nt, Human
uggcugggagcuggaacugggc

SEQ ID NO: 929992 - RNA, 22 nt, Human
aggggagguggcagaaaugugc

SEQ ID NO: 929993 - RNA, 22 nt, Human
gcaggaguguggugggacaucc

SEQ ID NO: 929994 - RNA, 22 nt, Human
cagaggccuggcuuggacaccu

SEQ ID NO: 929995 - RNA, 22 nt, Human
uugggagaaauaguugauccgc

SEQ ID NO: 929996 - RNA, 22 nt, Human
cugggagaugacucagagcagg

SEQ ID NO: 929997 - RNA, 20 nt, Human
cugggcagguguuugaucuc

SEQ ID NO: 929998 - RNA, 22 nt, Human
gcccagggcugcaaguggacgc

SEQ ID NO: 929999 - RNA, 22 nt, Human
ccauggccaggaaagccaaggu

SEQ ID NO: 930000 - RNA, 22 nt, Human
ggcuggacuugguccuguuuug

SEQ ID NO: 930001 - RNA, 22 nt, Human
uacugaaagagugguggacucu

SEQ ID NO: 930002 - RNA, 22 nt, Human
uaaaguauaagcauuggaguau

SEQ ID NO: 930003 - RNA, 22 nt, Human
cagcaguguacaaggugucaga

SEQ ID NO: 930004 - RNA, 22 nt, Human
ggcuuggaaauugcaggacaca

SEQ ID NO: 930005 - RNA, 22 nt, Human
auguuugaaauuguaaguauau

SEQ ID NO: 930006 - RNA, 22 nt, Human
aggcugucucaccucaggaggg

SEQ ID NO: 930007 - RNA, 22 nt, Human
agagcuggguggacuuguaguu

SEQ ID NO: 930008 - RNA, 17 nt, Human
ucugcagggggccgugu

SEQ ID NO: 930009 - RNA, 22 nt, Human
ccagcuggcccagcugugcucc

SEQ ID NO: 930010 - RNA, 17 nt, Human
ggccugcaccuccugcu

SEQ ID NO: 930011 - RNA, 22 nt, Human
uuauugcuaugaugauguguag

SEQ ID NO: 930012 - RNA, 22 nt, Human
gcugggcaggccucgugagggc

SEQ ID NO: 930013 - RNA, 22 nt, Human
uggggcaugugaaccuggaugu

SEQ ID NO: 930014 - RNA, 19 nt, Human
ugguggaggccccauguuc

SEQ ID NO: 930015 - RNA, 22 nt, Human
aaacaguguguuucagagaggc

SEQ ID NO: 930016 - RNA, 22 nt, Human
uuugagaagcauggcuguauuc

SEQ ID NO: 930017 - RNA, 22 nt, Human
ugggguagguaugaaaacuagg

SEQ ID NO: 930018 - RNA, 22 nt, Human
gucugcugacagagcauggacc

SEQ ID NO: 930019 - RNA, 22 nt, Human
ccugaggcccuggcugugcuga

SEQ ID NO: 930020 - RNA, 22 nt, Human
agggaaauuaaugugagcaaug

SEQ ID NO: 930021 - RNA, 22 nt, Human
aguucugggaggugcacgucca

SEQ ID NO: 930022 - RNA, 22 nt, Human
ggaaacugcuuacacuagaggg

SEQ ID NO: 930023 - RNA, 22 nt, Human
ugggaagaguuagagacagcug

SEQ ID NO: 930024 - RNA, 22 nt, Human
ugcuggccucggcgcugggccu

SEQ ID NO: 930025 - RNA, 22 nt, Human
uagggagugcguagcagggugg

SEQ ID NO: 930026 - RNA, 22 nt, Human
cgggaagguggagguugcagug

SEQ ID NO: 930027 - RNA, 22 nt, Human
caggugggagccacagcguaca

SEQ ID NO: 930028 - RNA, 23 nt, Human
agguggagcugugcagccggggc

SEQ ID NO: 930029 - RNA, 22 nt, Human
ucccacugucuucucgugcucg

SEQ ID NO: 930030 - RNA, 22 nt, Human
ggcuggaacuucuucuggcauu

SEQ ID NO: 930031 - RNA, 22 nt, Human
gccugagccgccugagcggcgg

SEQ ID NO: 930032 - RNA, 22 nt, Human
gggagcugagcuggaagagaau

SEQ ID NO: 930033 - RNA, 23 nt, Human
uccaguuaaugguucccagucug

SEQ ID NO: 930034 - RNA, 22 nt, Human
agcaggaaggggaugaugggca

SEQ ID NO: 930035 - RNA, 22 nt, Human
aguaacuuaagcaauuguguau

SEQ ID NO: 930036 - RNA, 22 nt, Human
cugggaggcggagguuguagug

SEQ ID NO: 930037 - RNA, 22 nt, Human
gugcugagugcagagugcagag

SEQ ID NO: 930038 - RNA, 22 nt, Human
agcaaggcagcuuucacugcuu

SEQ ID NO: 930039 - RNA, 22 nt, Human
cugagggagcugcuggccuugg

SEQ ID NO: 930040 - RNA, 22 nt, Human
ugaaggccuccccgagcauuag

SEQ ID NO: 930041 - RNA, 22 nt, Human
gggagcugaacugcugaaguug

SEQ ID NO: 930042 - RNA, 22 nt, Human
cgucuaggccgugcccugaggu

SEQ ID NO: 930043 - RNA, 22 nt, Human
uccaggaggacugagggggcug

SEQ ID NO: 930044 - RNA, 22 nt, Human
cuggccuggcaggggaccucua

SEQ ID NO: 930045 - RNA, 20 nt, Human
ugggguccuggaggggaucc

SEQ ID NO: 930046 - RNA, 22 nt, Human
ggugagagaaaagaaacacugu

SEQ ID NO: 930047 - RNA, 22 nt, Human
agguggucuuguggaugccgca

SEQ ID NO: 930048 - RNA, 22 nt, Human
cuugccagggacucagucaggg

SEQ ID NO: 930049 - RNA, 22 nt, Human
gcugggagucgcgucuguggcc

SEQ ID NO: 930050 - RNA, 22 nt, Human
gcggggggcaggcaguacguug

SEQ ID NO: 930051 - RNA, 22 nt, Human
gacuggcucuaucuccuuggcg

SEQ ID NO: 930052 - RNA, 22 nt, Human
uggcaaggccacaggugcaguu

SEQ ID NO: 930053 - RNA, 21 nt, Human
ccuggagacaaagacagggug

SEQ ID NO: 930054 - RNA, 22 nt, Human
ucacaggagcccaggggagcug

SEQ ID NO: 930055 - RNA, 22 nt, Human
cuggagcagcagguggccaggg

SEQ ID NO: 930056 - RNA, 22 nt, Human
auggguggccccgugugcaguc

SEQ ID NO: 930057 - RNA, 22 nt, Human
ggagggaaccuuggcuggauug

SEQ ID NO: 930058 - RNA, 22 nt, Human
uguuuuaagggucaacugucac

SEQ ID NO: 930059 - RNA, 22 nt, Human
ggcucugcugguaagaugccuc

SEQ ID NO: 930060 - RNA, 22 nt, Human
agggcccaccuuggugcugagg

SEQ ID NO: 930061 - RNA, 23 nt, Human
ugacagagcacagugggggagau

SEQ ID NO: 930062 - RNA, 22 nt, Human
cagggcuccccagagagccucu

SEQ ID NO: 930063 - RNA, 22 nt, Human
aggugcuuggcucgugcacaca

SEQ ID NO: 930064 - RNA, 22 nt, Human
agucaggacagauuuucugggg

SEQ ID NO: 930065 - RNA, 22 nt, Human
agguggcagacuaacagaagga

SEQ ID NO: 930066 - RNA, 22 nt, Human
agguggaguuaagugugaacug

SEQ ID NO: 930067 - RNA, 22 nt, Human
ugggugguugcugaggcuccuu

SEQ ID NO: 930068 - RNA, 22 nt, Human
uggcugagcugcagcguggcuu

SEQ ID NO: 930069 - RNA, 22 nt, Human
caggcucgguccaguggcaccc

SEQ ID NO: 930070 - RNA, 22 nt, Human
cuggaagcgucggaggaagggc

SEQ ID NO: 930071 - RNA, 22 nt, Human
aggggagguguccccaaaucuc

SEQ ID NO: 930072 - RNA, 22 nt, Human
uagaaaagccccagcuggaggg

SEQ ID NO: 930073 - RNA, 22 nt, Human
uucugggcacacaggcccuggu

SEQ ID NO: 930074 - RNA, 22 nt, Human
uggcaguagagcuggaacuuga

SEQ ID NO: 930075 - RNA, 22 nt, Human
gaggaggcuuccgggaggcacg

SEQ ID NO: 930076 - RNA, 22 nt, Human
caugggaauaaaguuauuucaa

SEQ ID NO: 930077 - RNA, 22 nt, Human
ccugggcaaaugccagagacaa

SEQ ID NO: 930078 - RNA, 22 nt, Human
uggcugaggcacagcugccgcc

SEQ ID NO: 930079 - RNA, 22 nt, Human
ccaggagaaugggauuacccua

SEQ ID NO: 930080 - RNA, 22 nt, Human
gugcaggugguuggcccagccg

SEQ ID NO: 930081 - RNA, 22 nt, Human
uggguguguccauauuuugacu

SEQ ID NO: 930082 - RNA, 22 nt, Human
gugagagugguuuauguccaug

SEQ ID NO: 930083 - RNA, 22 nt, Human
cugagggccuucuaugcugagc

SEQ ID NO: 930084 - RNA, 18 nt, Human
gggcuuuacagaguggag

SEQ ID NO: 930085 - RNA, 22 nt, Human
ggucccagucccuuuccaccgu

SEQ ID NO: 930086 - RNA, 19 nt, Human
cccuggaggaguguuggcu

SEQ ID NO: 930087 - RNA, 22 nt, Human
cggcuggagcugagaaaggagc

SEQ ID NO: 930088 - RNA, 21 nt, Human
cagaggggcuagccuggcugc

SEQ ID NO: 930089 - RNA, 22 nt, Human
gaggcuggcagaaaagcacagg

SEQ ID NO: 930090 - RNA, 21 nt, Human
ggucaggcaugugcccugagc

SEQ ID NO: 930091 - RNA, 22 nt, Human
uuggaggaagcucaugggggau

SEQ ID NO: 930092 - RNA, 22 nt, Human
acggagcccgugucagguggga

SEQ ID NO: 930093 - RNA, 20 nt, Human
ccagguggugccuggagagg

SEQ ID NO: 930094 - RNA, 22 nt, Human
uggcuuuugaaaaggugaugua

SEQ ID NO: 930095 - RNA, 22 nt, Human
ucugagagcuguagaagccuau

SEQ ID NO: 930096 - RNA, 22 nt, Human
aggcugcugccuuggagagugu

SEQ ID NO: 930097 - RNA, 22 nt, Human
agaggagguccuuuucugaugu

SEQ ID NO: 930098 - RNA, 22 nt, Human
cugaaggauguguggugggagu

SEQ ID NO: 930099 - RNA, 22 nt, Human
gaaggagaggauugugaggcug

SEQ ID NO: 930100 - RNA, 22 nt, Human
gaaaggagaggguuaaggagcu

SEQ ID NO: 930101 - RNA, 22 nt, Human
uggcaggaaaaagggccagagg

SEQ ID NO: 930102 - RNA, 19 nt, Human
ggauaagguuggagugauc

SEQ ID NO: 930103 - RNA, 22 nt, Human
gggcuguaggagcuggaauggg

SEQ ID NO: 930104 - RNA, 22 nt, Human
uauuagggaacugcaagacuaa

SEQ ID NO: 930105 - RNA, 22 nt, Human
guuuauuggguauuguggagcc

SEQ ID NO: 930106 - RNA, 22 nt, Human
gggacuggaguagaggccggug

SEQ ID NO: 930107 - RNA, 22 nt, Human
agcacuggaaaguuaagaguuu

SEQ ID NO: 930108 - RNA, 17 nt, Human
agcagcuggguugaucu

SEQ ID NO: 930109 - RNA, 23 nt, Human
ugucuugguuucuucacccuagu

SEQ ID NO: 930110 - RNA, 23 nt, Human
ucugaccucguuugcuguguucu

SEQ ID NO: 930111 - RNA, 22 nt, Human
gucuagggcuccucagugacaa

SEQ ID NO: 930112 - RNA, 22 nt, Human
ccuggagacccacuucugccaa

SEQ ID NO: 930113 - RNA, 22 nt, Human
cagaguggugcaagggcagugu

SEQ ID NO: 930114 - RNA, 22 nt, Human
uggagcugguucuggggaagcu

SEQ ID NO: 930115 - RNA, 22 nt, Human
ccaggagagcucucguucagug

SEQ ID NO: 930116 - RNA, 19 nt, Human
cugggacaaugaaagcauc

SEQ ID NO: 930117 - RNA, 22 nt, Human
uagcugggacuacuggcccugc

SEQ ID NO: 930118 - RNA, 22 nt, Human
uggaaauacaagaaguauguca

SEQ ID NO: 930119 - RNA, 22 nt, Human
gccuggggaacuugauccuguc

SEQ ID NO: 930120 - RNA, 22 nt, Human
ugugcuugucguggagccaggc

SEQ ID NO: 930121 - RNA, 22 nt, Human
gcagagauccaggguauagguu

SEQ ID NO: 930122 - RNA, 22 nt, Human
uggcacaguuaaaguuguagaa

SEQ ID NO: 930123 - RNA, 22 nt, Human
uggugcugccaccuccucugcu

SEQ ID NO: 930124 - RNA, 21 nt, Human
uggcaggcagcuggaagcuug

SEQ ID NO: 930125 - RNA, 22 nt, Human
acugggcaaggauaugaugggu

SEQ ID NO: 930126 - RNA, 22 nt, Human
agccacugugugaccagcuguc

SEQ ID NO: 930127 - RNA, 22 nt, Human
aggagucaccugcccaaaguca

SEQ ID NO: 930128 - RNA, 22 nt, Human
ugcaggaacucgaaaacuauag

SEQ ID NO: 930129 - RNA, 21 nt, Human
agggccucuguguacuggggg

SEQ ID NO: 930130 - RNA, 20 nt, Human
ccuggagccuggaaggaguc

SEQ ID NO: 930131 - RNA, 19 nt, Human
cccagaggaaugccuggaa

SEQ ID NO: 930132 - RNA, 22 nt, Human
ggcaguggugggaggcucgcuc

SEQ ID NO: 930133 - RNA, 18 nt, Human
gagaggagccagaauuuu

SEQ ID NO: 930134 - RNA, 22 nt, Human
gggagcuggagcuggaagacuc

SEQ ID NO: 930135 - RNA, 22 nt, Human
agggcaguguggugggacugac

SEQ ID NO: 930136 - RNA, 22 nt, Human
aagcuggccuguaccugcugag

SEQ ID NO: 930137 - RNA, 22 nt, Human
ugggguccucucacuuggaggg

SEQ ID NO: 930138 - RNA, 22 nt, Human
aagaggaggacgguucccagaa

SEQ ID NO: 930139 - RNA, 22 nt, Human
uugcaaauaauagccugaaacu

SEQ ID NO: 930140 - RNA, 22 nt, Human
agagaagagucuugucaaauua

SEQ ID NO: 930141 - RNA, 22 nt, Human
aggagacaguuuggacguguag

SEQ ID NO: 930142 - RNA, 19 nt, Human
gggaaugauggaagacuuc

SEQ ID NO: 930143 - RNA, 22 nt, Human
uuagaaaucaccucugaagauc

SEQ ID NO: 930144 - RNA, 22 nt, Human
cauaggcucuucagagaacuga

SEQ ID NO: 930145 - RNA, 22 nt, Human
aggcaguuguugcugagcagcu

SEQ ID NO: 930146 - RNA, 22 nt, Human
cgaggaggaaacgcggagaacu

SEQ ID NO: 930147 - RNA, 22 nt, Human
aaggaggaauguagccagcucc

SEQ ID NO: 930148 - RNA, 22 nt, Human
guggcaggagggcaucacuugg

SEQ ID NO: 930149 - RNA, 22 nt, Human
gaggagaggcuggacgcgguga

SEQ ID NO: 930150 - RNA, 17 nt, Human
gugagcugagucaggac

SEQ ID NO: 930151 - RNA, 22 nt, Human
aaggcacauauuuuagagucac

SEQ ID NO: 930152 - RNA, 22 nt, Human
aggugcugccccgagaaggaug

SEQ ID NO: 930153 - RNA, 18 nt, Human
ggaaaaggagugucuagc

SEQ ID NO: 930154 - RNA, 22 nt, Human
uggcugagugaacauguccauu

SEQ ID NO: 930155 - RNA, 22 nt, Human
uuuccagggaggaauguggggu

SEQ ID NO: 930156 - RNA, 22 nt, Human
agagaugcuguggguagaggca

SEQ ID NO: 930157 - RNA, 22 nt, Human
cugggagggguagccaauccua

SEQ ID NO: 930158 - RNA, 18 nt, Human
auggcuccagugucuucc

SEQ ID NO: 930159 - RNA, 22 nt, Human
ucaggagaguguucaguggagg

SEQ ID NO: 930160 - RNA, 22 nt, Human
gagguuggagggcuggccugca

SEQ ID NO: 930161 - RNA, 22 nt, Human
ucaaaggcuugugguucuggga

SEQ ID NO: 930162 - RNA, 22 nt, Human
aggcaguugaguggcuuuuuca

SEQ ID NO: 930163 - RNA, 22 nt, Human
gcugcaggcucugcaggaauug

SEQ ID NO: 930164 - RNA, 22 nt, Human
gggggcuggacuuucccacaca

SEQ ID NO: 930165 - RNA, 22 nt, Human
ggugggugagcccugggagcug

SEQ ID NO: 930166 - RNA, 23 nt, Human
uggggcugauggagacggaccag

SEQ ID NO: 930167 - RNA, 22 nt, Human
agucaggaagcuggagcugggg

SEQ ID NO: 930168 - RNA, 22 nt, Human
uugccaggggacaucuggagcc

SEQ ID NO: 930169 - RNA, 22 nt, Human
gaaagcagaugaaauugcaaca

SEQ ID NO: 930170 - RNA, 22 nt, Human
uggcugaggagagggcggaagu

SEQ ID NO: 930171 - RNA, 18 nt, Human
ggccucagccuggccgga

SEQ ID NO: 930172 - RNA, 22 nt, Human
ggcugagcuuuucaugaugguu

SEQ ID NO: 930173 - RNA, 22 nt, Human
uuuccaaggaugugucucucua

SEQ ID NO: 930174 - RNA, 22 nt, Human
ugcuggaguggcacuguguggc

SEQ ID NO: 930175 - RNA, 22 nt, Human
ugggaagauaugagugaccaac

SEQ ID NO: 930176 - RNA, 22 nt, Human
ugggcagggagcuggaaccaca

SEQ ID NO: 930177 - RNA, 22 nt, Human
aaggggggcaccugcaugcccg

SEQ ID NO: 930178 - RNA, 22 nt, Human
gcaggaguuagagguuuaaucu

SEQ ID NO: 930179 - RNA, 22 nt, Human
augggaggcagacacuaaguuc

SEQ ID NO: 930180 - RNA, 22 nt, Human
gggcaugguggcaggcaccugu

SEQ ID NO: 930181 - RNA, 22 nt, Human
ugggcagacgggagcuugccuu

SEQ ID NO: 930182 - RNA, 22 nt, Human
ucugagcuggagcccaucaccu

SEQ ID NO: 930183 - RNA, 22 nt, Human
gagggugguggcuuaaggugcu

SEQ ID NO: 930184 - RNA, 22 nt, Human
agcaggaacucagggaguucuc

SEQ ID NO: 930185 - RNA, 20 nt, Human
aggaaggagaaucugagcaa

SEQ ID NO: 930186 - RNA, 22 nt, Human
ccaggaagaaacagucuuuaua

SEQ ID NO: 930187 - RNA, 20 nt, Human
ggccugagcauggcuggcag

SEQ ID NO: 930188 - RNA, 23 nt, Human
cugagggcuggucugaagucugc

SEQ ID NO: 930189 - RNA, 22 nt, Human
accuggaggcagagguugcagu

SEQ ID NO: 930190 - RNA, 22 nt, Human
gggaugagagcugggacagaag

SEQ ID NO: 930191 - RNA, 22 nt, Human
gaggggcucuugggcaugaagg

SEQ ID NO: 930192 - RNA, 20 nt, Human
agcuugccccugucuuugcc

SEQ ID NO: 930193 - RNA, 20 nt, Human
aggggcaccugcgacggggc

SEQ ID NO: 930194 - RNA, 22 nt, Human
cugggaggcagucucucuagaa

SEQ ID NO: 930195 - RNA, 18 nt, Human
agggcugaugaguuuggg

SEQ ID NO: 930196 - RNA, 22 nt, Human
uccgggagcugaacgucuugcg

SEQ ID NO: 930197 - RNA, 22 nt, Human
gcauuacuucuuucauagguca

SEQ ID NO: 930198 - RNA, 22 nt, Human
aguguuugaguuugcggcauug

SEQ ID NO: 930199 - RNA, 22 nt, Human
agguggagaagagaugggcagu

SEQ ID NO: 930200 - RNA, 22 nt, Human
uuauugagcacauaguaugugg

SEQ ID NO: 930201 - RNA, 22 nt, Human
uuggaggacuaguuaagagacc

SEQ ID NO: 930202 - RNA, 22 nt, Human
gcuggccugcgagggcaggcug

SEQ ID NO: 930203 - RNA, 22 nt, Human
auuagguaguauaaucuuuguu

SEQ ID NO: 930204 - RNA, 22 nt, Human
ugaggcuggaugggaugccucc

SEQ ID NO: 930205 - RNA, 22 nt, Human
ugggagagauaggcuucuggac

SEQ ID NO: 930206 - RNA, 22 nt, Human
cagggccucugugggcucucuc

SEQ ID NO: 930207 - RNA, 22 nt, Human
gggagaguagcuggaagguucu

SEQ ID NO: 930208 - RNA, 22 nt, Human
ccagcagcucccucaggguccg

SEQ ID NO: 930209 - RNA, 22 nt, Human
gcaugcaggaagggcuugggga

SEQ ID NO: 930210 - RNA, 22 nt, Human
gcuggccugaccugaggcuggg

SEQ ID NO: 930211 - RNA, 22 nt, Human
aagccugagccaugcuuuacug

SEQ ID NO: 930212 - RNA, 22 nt, Human
ggcagagcuugcagugagccga

SEQ ID NO: 930213 - RNA, 21 nt, Human
ucuuggggaggagggcugcac

SEQ ID NO: 930214 - RNA, 22 nt, Human
agaguuaaugcaggccaagccu

SEQ ID NO: 930215 - RNA, 22 nt, Human
agguggcagaugggggugcucg

SEQ ID NO: 930216 - RNA, 22 nt, Human
gcugaagagagaugcguccagc

SEQ ID NO: 930217 - RNA, 22 nt, Human
acagcuggaggucugugagcac

SEQ ID NO: 930218 - RNA, 22 nt, Human
cugagcagaagggugcacgugc

SEQ ID NO: 930219 - RNA, 22 nt, Human
ggagggaguuucauuccugccc

SEQ ID NO: 930220 - RNA, 22 nt, Human
gagaggaagccuucuguacuug

SEQ ID NO: 930221 - RNA, 22 nt, Human
gggagagcgcgcuagggccgag

SEQ ID NO: 930222 - RNA, 22 nt, Human
uggaaggggccaggcgcggagu

SEQ ID NO: 930223 - RNA, 22 nt, Human
ugucaaguuguuaaguucuggg

SEQ ID NO: 930224 - RNA, 22 nt, Human
gggaggaaggcuugggugagua

SEQ ID NO: 930225 - RNA, 22 nt, Human
ggagacagugacuuagagacug

SEQ ID NO: 930226 - RNA, 22 nt, Human
gugcaggacagcacaucuccug

SEQ ID NO: 930227 - RNA, 22 nt, Human
cagguguugcaguugaagacug

SEQ ID NO: 930228 - RNA, 23 nt, Human
gggcagcuuaagcuuguuuuucu

SEQ ID NO: 930229 - RNA, 22 nt, Human
gcaggcuuauggggagacagag

SEQ ID NO: 930230 - RNA, 22 nt, Human
ggcugcccucggggucgcaggc

SEQ ID NO: 930231 - RNA, 22 nt, Human
agguuuggguucauugcuggcu

SEQ ID NO: 930232 - RNA, 19 nt, Human
ggccuggauuuagggcucc

SEQ ID NO: 930233 - RNA, 22 nt, Human
agcuggguacacguugucacaa

SEQ ID NO: 930234 - RNA, 22 nt, Human
agauggcagggguaccuggaag

SEQ ID NO: 930235 - RNA, 22 nt, Human
gucaggggccaugggccaagga

SEQ ID NO: 930236 - RNA, 22 nt, Human
uaggcagggauuaggguugauu

SEQ ID NO: 930237 - RNA, 22 nt, Human
uaaggagagaauuuagagguuu

SEQ ID NO: 930238 - RNA, 22 nt, Human
gacaguggagccacguugggag

SEQ ID NO: 930239 - RNA, 22 nt, Human
gaggcugugugucccucuggac

SEQ ID NO: 930240 - RNA, 22 nt, Human
ggcagguguggugaccagagau

SEQ ID NO: 930241 - RNA, 22 nt, Human
caggguggcaggcaccauggcc

SEQ ID NO: 930242 - RNA, 22 nt, Human
acccggagucggagguugcagu

SEQ ID NO: 930243 - RNA, 22 nt, Human
ucuggaaggggaucugugguca

SEQ ID NO: 930244 - RNA, 22 nt, Human
ggaaggggagcuggaaagggua

SEQ ID NO: 930245 - RNA, 22 nt, Human
cugggaguugacgaggcuugua

SEQ ID NO: 930246 - RNA, 22 nt, Human
ggcuagggaucuagaccaggac

SEQ ID NO: 930247 - RNA, 22 nt, Human
uuccuuggagucaaacagggag

SEQ ID NO: 930248 - RNA, 20 nt, Human
gucagaggacccuagagcga

SEQ ID NO: 930249 - RNA, 23 nt, Human
aggcugcagaagaauagggucau

SEQ ID NO: 930250 - RNA, 22 nt, Human
aggcggcuccgggagugugggc

SEQ ID NO: 930251 - RNA, 22 nt, Human
ggaagaggcugaggccaugcug

SEQ ID NO: 930252 - RNA, 22 nt, Human
acgggcugggacggggaagcuc

SEQ ID NO: 930253 - RNA, 22 nt, Human
ggccacuguuuccugggcaguu

SEQ ID NO: 930254 - RNA, 22 nt, Human
ggagugggaacaaugacauggu

SEQ ID NO: 930255 - RNA, 22 nt, Human
ugguggggccagacuucagcuc

SEQ ID NO: 930256 - RNA, 22 nt, Human
gccuggagcucggcugagggcg

SEQ ID NO: 930257 - RNA, 20 nt, Human
ugcuggaggcgccggcgcuc

SEQ ID NO: 930258 - RNA, 22 nt, Human
uuuggucuggaaucuucagggu

SEQ ID NO: 930259 - RNA, 22 nt, Human
agaguggcaccuuaccugagac

SEQ ID NO: 930260 - RNA, 19 nt, Human
ugcuugccugccuuuccca

SEQ ID NO: 930261 - RNA, 22 nt, Human
ggcgaggugucugccaucaagc

SEQ ID NO: 930262 - RNA, 22 nt, Human
ggaagcuguuaucaucuguauc

SEQ ID NO: 930263 - RNA, 22 nt, Human
uuuucuuggaguggcuguccuu

SEQ ID NO: 930264 - RNA, 18 nt, Human
augggcagguaagaucca

SEQ ID NO: 930265 - RNA, 22 nt, Human
gggcuguuugcauauguuuaua

SEQ ID NO: 930266 - RNA, 22 nt, Human
aguggcugugaaauacauggga

SEQ ID NO: 930267 - RNA, 22 nt, Human
gggggaaaguggagguucguga

SEQ ID NO: 930268 - RNA, 19 nt, Human
gcagcugugggaagagcca

SEQ ID NO: 930269 - RNA, 22 nt, Human
ccugagcuuacaauuuaagaac

SEQ ID NO: 930270 - RNA, 22 nt, Human
ggccuugguggcuuugcugaug

SEQ ID NO: 930271 - RNA, 22 nt, Human
ggaggaggggugacugaaugcu

SEQ ID NO: 930272 - RNA, 22 nt, Human
ggguuguagagcuggaagggga

SEQ ID NO: 930273 - RNA, 22 nt, Human
cugaagcugggcacuuccuuuu

SEQ ID NO: 930274 - RNA, 21 nt, Human
gcccacagugaggaggauccc

SEQ ID NO: 930275 - RNA, 22 nt, Human
gcacugagcuuuggaggagcag

SEQ ID NO: 930276 - RNA, 22 nt, Human
guaggggccagaaagacuuaga

SEQ ID NO: 930277 - RNA, 22 nt, Human
aggaaagcucccaguagggcuc

SEQ ID NO: 930278 - RNA, 22 nt, Human
cugcagggcagggccuccuggc

SEQ ID NO: 930279 - RNA, 22 nt, Human
ugugcugcucucagugacagcc

SEQ ID NO: 930280 - RNA, 22 nt, Human
aggccacucagggggccaagau

SEQ ID NO: 930281 - RNA, 22 nt, Human
aggcugagguaggaggaucgcu

SEQ ID NO: 930282 - RNA, 23 nt, Human
agacagaggcugaggcuggccgc

SEQ ID NO: 930283 - RNA, 22 nt, Human
uagggggcuuugcugcuugaca

SEQ ID NO: 930284 - RNA, 22 nt, Human
agccuggacagcuacggagaac

SEQ ID NO: 930285 - RNA, 22 nt, Human
agugagaguauuaaugugaacu

SEQ ID NO: 930286 - RNA, 22 nt, Human
gagcugagggucuaggaggguu

SEQ ID NO: 930287 - RNA, 22 nt, Human
ugguuuguauauguuugugaga

SEQ ID NO: 930288 - RNA, 22 nt, Human
cugaaggacacgugaggagcca

SEQ ID NO: 930289 - RNA, 22 nt, Human
ugucuuggccacuaggagugcc

SEQ ID NO: 930290 - RNA, 22 nt, Human
cuggagaggcugggaacagguu

SEQ ID NO: 930291 - RNA, 22 nt, Human
gcuagagaccagaggccuugaa

SEQ ID NO: 930292 - RNA, 22 nt, Human
agguggcuaugaggaugcaguc

SEQ ID NO: 930293 - RNA, 22 nt, Human
ggugagaggcagugcuguggaa

SEQ ID NO: 930294 - RNA, 22 nt, Human
uggcagaaugaagacuggggcc

SEQ ID NO: 930295 - RNA, 22 nt, Human
caguguuuagcacagugcuugg

SEQ ID NO: 930296 - RNA, 22 nt, Human
uccuuggagaaucuuguuuuac

SEQ ID NO: 930297 - RNA, 22 nt, Human
cuggaaggagcccgggcggauc

SEQ ID NO: 930298 - RNA, 22 nt, Human
guuguuuuugaacggugguggc

SEQ ID NO: 930299 - RNA, 20 nt, Human
ugggaucgaaucaagucugu

SEQ ID NO: 930300 - RNA, 23 nt, Human
uagacugcaggcuccuugagggc

SEQ ID NO: 930301 - RNA, 22 nt, Human
gccagugccugcugcucagggc

SEQ ID NO: 930302 - RNA, 22 nt, Human
aggacaaaggaccagaucugga

SEQ ID NO: 930303 - RNA, 23 nt, Human
aagaaugcuucugaagagcugcc

SEQ ID NO: 930304 - RNA, 22 nt, Human
cggagaggugggggcagcaucu

SEQ ID NO: 930305 - RNA, 22 nt, Human
aaggcacuugcccagagcugca

SEQ ID NO: 930306 - RNA, 22 nt, Human
cagggccagggcuauggugaag

SEQ ID NO: 930307 - RNA, 22 nt, Human
ggcaagagggcagauggagugc

SEQ ID NO: 930308 - RNA, 22 nt, Human
gaagcgcggcgucggcgugggu

SEQ ID NO: 930309 - RNA, 22 nt, Human
aagaguggagcuggaaaguggg

SEQ ID NO: 930310 - RNA, 19 nt, Human
agacaaguuuccagaagcc

SEQ ID NO: 930311 - RNA, 22 nt, Human
gucuguggaguugcuugcugga

SEQ ID NO: 930312 - RNA, 22 nt, Human
gaaggaagcugucuggaugugu

SEQ ID NO: 930313 - RNA, 19 nt, Human
gaauggguucuguagggag

SEQ ID NO: 930314 - RNA, 19 nt, Human
ugggcagugccagggcuua

SEQ ID NO: 930315 - RNA, 22 nt, Human
cacagagagcuacgugcagcgu

SEQ ID NO: 930316 - RNA, 22 nt, Human
cugggaggcccacguugggaag

SEQ ID NO: 930317 - RNA, 22 nt, Human
aguggcuguuccaggugaggac

SEQ ID NO: 930318 - RNA, 18 nt, Human
uggggggcuugucugaag

SEQ ID NO: 930319 - RNA, 22 nt, Human
aggggcuuguggaguugcuggu

SEQ ID NO: 930320 - RNA, 22 nt, Human
ggggucugggcuuagcuggaau

SEQ ID NO: 930321 - RNA, 21 nt, Human
ggccuuggcgggggccgaauu

SEQ ID NO: 930322 - RNA, 22 nt, Human
cuugccaguguugcagaagcuc

SEQ ID NO: 930323 - RNA, 20 nt, Human
agcuggcccccgguggccug

SEQ ID NO: 930324 - RNA, 22 nt, Human
ccagcaggaaagugacguuuga

SEQ ID NO: 930325 - RNA, 22 nt, Human
uugagcagaucgggcugugggg

SEQ ID NO: 930326 - RNA, 19 nt, Human
aggaaggcggcggcugccc

SEQ ID NO: 930327 - RNA, 22 nt, Human
uaagggcugacuuggaacuguc

SEQ ID NO: 930328 - RNA, 22 nt, Human
ugggaaggggagcuggaaagga

SEQ ID NO: 930329 - RNA, 22 nt, Human
cucacaggguucuaucgaagag

SEQ ID NO: 930330 - RNA, 22 nt, Human
gugggcaucuccuuggaagcca

SEQ ID NO: 930331 - RNA, 22 nt, Human
uggccaggcagguagaacggcc

SEQ ID NO: 930332 - RNA, 22 nt, Human
gaggcugaacagguucucauga

SEQ ID NO: 930333 - RNA, 18 nt, Human
ggaggcucugugguuucc

SEQ ID NO: 930334 - RNA, 22 nt, Human
gagaugggcgagaagguggacu

SEQ ID NO: 930335 - RNA, 22 nt, Human
augaggagucaaggagucggag

SEQ ID NO: 930336 - RNA, 22 nt, Human
ggagaguggauuccagcuguau

SEQ ID NO: 930337 - RNA, 22 nt, Human
agagccuguucggaggcgcccc

SEQ ID NO: 930338 - RNA, 22 nt, Human
uggaagggguuacgcagcagga

SEQ ID NO: 930339 - RNA, 22 nt, Human
agcuggguguagggcuggacaa

SEQ ID NO: 930340 - RNA, 22 nt, Human
gggaggugauuaggaccaugua

SEQ ID NO: 930341 - RNA, 22 nt, Human
uagcugcacaggaaguaagauu

SEQ ID NO: 930342 - RNA, 22 nt, Human
cugagcugcucccgcugcagcg

SEQ ID NO: 930343 - RNA, 22 nt, Human
ggggaggaagcuggaacacggg

SEQ ID NO: 930344 - RNA, 22 nt, Human
ugaggaggugggcacacagagu

SEQ ID NO: 930345 - RNA, 22 nt, Human
gagguggcugcuugcugggaaa

SEQ ID NO: 930346 - RNA, 22 nt, Human
cagaggccccauuggcugugcg

SEQ ID NO: 930347 - RNA, 22 nt, Human
cugaugcucuggauguagucaa

SEQ ID NO: 930348 - RNA, 22 nt, Human
agagcagaggcauggccguggg

SEQ ID NO: 930349 - RNA, 22 nt, Human
aagggugguguaggagaucaaa

SEQ ID NO: 930350 - RNA, 22 nt, Human
gcggggggcagcagucgcucag

SEQ ID NO: 930351 - RNA, 22 nt, Human
ugaggauggaaugcugugcaag

SEQ ID NO: 930352 - RNA, 22 nt, Human
gagucgagcagaaagccgucgg

SEQ ID NO: 930353 - RNA, 22 nt, Human
aguggcaguagaugagcugguu

SEQ ID NO: 930354 - RNA, 22 nt, Human
agacagcgaggacagaggggug

SEQ ID NO: 930355 - RNA, 22 nt, Human
ugccuggauggcucugagcagg

SEQ ID NO: 930356 - RNA, 18 nt, Human
agcugaggggacugaaga

SEQ ID NO: 930357 - RNA, 19 nt, Human
auagaguagaguaucuguu

SEQ ID NO: 930358 - RNA, 22 nt, Human
gaggagagaagcuaacggugcu

SEQ ID NO: 930359 - RNA, 21 nt, Human
agaugaggauacugaggccua

SEQ ID NO: 930360 - RNA, 19 nt, Human
gggugaggaagagcguugc

SEQ ID NO: 930361 - RNA, 22 nt, Human
gcaaggagcaccuuucuggaac

SEQ ID NO: 930362 - RNA, 17 nt, Human
gagguaggaagugaguc

SEQ ID NO: 930363 - RNA, 22 nt, Human
cauugcuguuaauugucucuag

SEQ ID NO: 930364 - RNA, 22 nt, Human
gcaggguaggugacagguaguc

SEQ ID NO: 930365 - RNA, 22 nt, Human
ggagccuggaguuucugauggg

SEQ ID NO: 930366 - RNA, 22 nt, Human
ggaaggaucuggcugaaaucca

SEQ ID NO: 930367 - RNA, 17 nt, Human
uaagggggaaacggagc

SEQ ID NO: 930368 - RNA, 21 nt, Human
gggcuggauauuggaaagagg

SEQ ID NO: 930369 - RNA, 22 nt, Human
gggcuggagagucccacguggg

SEQ ID NO: 930370 - RNA, 22 nt, Human
ugggccagauccauggcaauaa

SEQ ID NO: 930371 - RNA, 22 nt, Human
aagggggaaauccuagcgccgc

SEQ ID NO: 930372 - RNA, 21 nt, Human
agaaggcaaaagcagacaucu

SEQ ID NO: 930373 - RNA, 22 nt, Human
ggccuuggaguccuccacugga

SEQ ID NO: 930374 - RNA, 22 nt, Human
ggacauggaaguauggagugga

SEQ ID NO: 930375 - RNA, 22 nt, Human
gaguaaaagaugaggcaguaga

SEQ ID NO: 930376 - RNA, 22 nt, Human
guggcuaggcccaacggcagga

SEQ ID NO: 930377 - RNA, 21 nt, Human
uggagagugauuucagugugg

SEQ ID NO: 930378 - RNA, 22 nt, Human
auggaggaugugcagcaugggc

SEQ ID NO: 930379 - RNA, 22 nt, Human
uuugaagauaaauauggagaaa

SEQ ID NO: 930380 - RNA, 22 nt, Human
aagguggcggcugccagguccu

SEQ ID NO: 930381 - RNA, 22 nt, Human
ggcggugguugagaggacggcg

SEQ ID NO: 930382 - RNA, 22 nt, Human
gguggcugugagcauuauguga

SEQ ID NO: 930383 - RNA, 22 nt, Human
cugaaacuauggggaggggagc

SEQ ID NO: 930384 - RNA, 22 nt, Human
agaagcagaaggaagcagggcc

SEQ ID NO: 930385 - RNA, 22 nt, Human
gccaggguggcagaaggcccca

SEQ ID NO: 930386 - RNA, 22 nt, Human
cagguagaggcugccaucagcu

SEQ ID NO: 930387 - RNA, 22 nt, Human
gcugguggcagagcuccgcggc

SEQ ID NO: 930388 - RNA, 22 nt, Human
gaggcaaagcauguggcucagg

SEQ ID NO: 930389 - RNA, 22 nt, Human
uggaaauaguugugagucaggc

SEQ ID NO: 930390 - RNA, 22 nt, Human
agcaggaggagagccuggcggu

SEQ ID NO: 930391 - RNA, 20 nt, Human
gugcccaguuggugacagac

SEQ ID NO: 930392 - RNA, 22 nt, Human
gggcagcaaaucugagucuggu

SEQ ID NO: 930393 - RNA, 22 nt, Human T-lymphotropic virus 1
ggguuuuuuaggcuggacaacu

SEQ ID NO: 930394 - RNA, 19 nt, Human T-lymphotropic virus 1
guccaggccugacaagccc

SEQ ID NO: 930395 - RNA, 22 nt, Human
cuguuguaucauuuguucacau

SEQ ID NO: 930396 - RNA, 22 nt, Human
gcuauacaaguguagaauagag

SEQ ID NO: 930397 - RNA, 22 nt, Human
acaguuaccacuuagcaguuac

SEQ ID NO: 930398 - RNA, 22 nt, Human
auguagcaugaggcacugugcc

SEQ ID NO: 930399 - RNA, 22 nt, Human
uaaguucaaugaacucaguucu

SEQ ID NO: 930400 - RNA, 22 nt, Human
ugcauagaggauccaguguggu

SEQ ID NO: 930401 - RNA, 22 nt, Human
gcucugccucuuugcugcguca

SEQ ID NO: 930402 - RNA, 22 nt, Human
uuacacaaacacauuccagaua

SEQ ID NO: 930403 - RNA, 22 nt, Human
ccugucuacauaacugugugaa

SEQ ID NO: 930404 - RNA, 22 nt, Human
aaucuagucuccuuaagucuuu

SEQ ID NO: 930405 - RNA, 22 nt, Human
uggcuuuacuuaaacugaauca

SEQ ID NO: 930406 - RNA, 17 nt, Human
uaugcuuuucuucucca

SEQ ID NO: 930407 - RNA, 22 nt, Human
aacagacauauuuuuaauaugc

SEQ ID NO: 930408 - RNA, 22 nt, Human
uacaugucuacaugcauuuuug

SEQ ID NO: 930409 - RNA, 22 nt, Human
ugguaaugguucucuugcuaua

SEQ ID NO: 930410 - RNA, 22 nt, Human
auagcaauggcaacaacuaagc

SEQ ID NO: 930411 - RNA, 20 nt, Human
augugaaagaucaguugucu

SEQ ID NO: 930412 - RNA, 22 nt, Human
ucacagaagggaaagaugccaa

SEQ ID NO: 930413 - RNA, 22 nt, Human
acacauguauggcacuuacauu

SEQ ID NO: 930414 - RNA, 20 nt, Human
uuuacauccccaccagcaau

SEQ ID NO: 930415 - RNA, 22 nt, Human
acaaaggugagcagaagacaca

SEQ ID NO: 930416 - RNA, 22 nt, Human
uucaaguacuguagauuucagg

SEQ ID NO: 930417 - RNA, 22 nt, Human
gcagcaguaggaaauaacacag

SEQ ID NO: 930418 - RNA, 22 nt, Human
gaaggcaagaucucaguggagg

SEQ ID NO: 930419 - RNA, 21 nt, Human
acuuuacaauuuacauaguga

SEQ ID NO: 930420 - RNA, 22 nt, Human
uacagcauuuuguagaguacua

SEQ ID NO: 930421 - RNA, 22 nt, Human
caguaacaugaagagacaugga

SEQ ID NO: 930422 - RNA, 22 nt, Human
acaguuagggacuauaaucauu

SEQ ID NO: 930423 - RNA, 22 nt, Human
ugaguuuugucuugcuagaagu

SEQ ID NO: 930424 - RNA, 22 nt, Human
uauggcuucuauaaggaagcuu

SEQ ID NO: 930425 - RNA, 22 nt, Human
aaauggcuuugaggguaggaca

SEQ ID NO: 930426 - RNA, 22 nt, Human
cauuuacacuucuaaccacaag

SEQ ID NO: 930427 - RNA, 22 nt, Human
cauggcuuggagcaggaugaga

SEQ ID NO: 930428 - RNA, 22 nt, Human
acaugaaugcagccauaacacu

SEQ ID NO: 930429 - RNA, 22 nt, Human
ugagaauuuuuggcagaaacaa

SEQ ID NO: 930430 - RNA, 23 nt, Human
acacuuucaaauaugcacagagc

SEQ ID NO: 930431 - RNA, 20 nt, Human
ucacacaugguaagcuauga

SEQ ID NO: 930432 - RNA, 22 nt, Human
uuagucaauagugaauauagag

SEQ ID NO: 930433 - RNA, 21 nt, Human
gaauggcucgcgcgccacacu

SEQ ID NO: 930434 - RNA, 22 nt, Human
cugcuuggcauugguaaagaau

SEQ ID NO: 930435 - RNA, 22 nt, Human
uagcucucuuuaucuuucuaua

SEQ ID NO: 930436 - RNA, 22 nt, Human
ucuaacuugaacucaugacugu

SEQ ID NO: 930437 - RNA, 22 nt, Human
aauggcuuagugcuucacuucu

SEQ ID NO: 930438 - RNA, 22 nt, Human
aucuguuauugaauaggugcua

SEQ ID NO: 930439 - RNA, 22 nt, Human
cauuucaauuauuugcucuucu

SEQ ID NO: 930440 - RNA, 22 nt, Human
ggaaugcucaguucuuggugcu

SEQ ID NO: 930441 - RNA, 22 nt, Human
ucuguugguucuguuucucuga

SEQ ID NO: 930442 - RNA, 22 nt, Human
uuccaagagccuuucuucuaga

SEQ ID NO: 930443 - RNA, 22 nt, Human
acacaauguaccauaucuccaa

SEQ ID NO: 930444 - RNA, 22 nt, Human
uccugaagucacaggcucugag

SEQ ID NO: 930445 - RNA, 22 nt, Human
uggcuucucauuugcauuaaac

SEQ ID NO: 930446 - RNA, 21 nt, Human
cugccaccugcuccaucagca

SEQ ID NO: 930447 - RNA, 22 nt, Human
acauaugcgaucauaggaugca

SEQ ID NO: 930448 - RNA, 22 nt, Human
aguaacaagugccaacguuaga

SEQ ID NO: 930449 - RNA, 22 nt, Human
gaagggaaggaaagaaccagca

SEQ ID NO: 930450 - RNA, 22 nt, Human
gaaagacauaguugcaagaugg

SEQ ID NO: 930451 - RNA, 22 nt, Human
uucagaguaggauacuagcuua

SEQ ID NO: 930452 - RNA, 22 nt, Human
gacacaugaccauaaaugcuaa

SEQ ID NO: 930453 - RNA, 22 nt, Human
uauaccaaaauaucagaaaggg

SEQ ID NO: 930454 - RNA, 22 nt, Human
uagucuaagaaaucuuuacuuu

SEQ ID NO: 930455 - RNA, 22 nt, Human
uuuccacacugcagccagcaaa

SEQ ID NO: 930456 - RNA, 22 nt, Human
gagucagaagaaacuauuuaca

SEQ ID NO: 930457 - RNA, 22 nt, Human
aaacaguaaguucuaguauuau

SEQ ID NO: 930458 - RNA, 22 nt, Human
ugcguuuaguuucaagacacgu

SEQ ID NO: 930459 - RNA, 22 nt, Human
ucugcuugugucuguccagccu

SEQ ID NO: 930460 - RNA, 22 nt, Human
uauggcuugucuuuauaccagg

SEQ ID NO: 930461 - RNA, 22 nt, Human
aauagcuugccuaauccucaug

SEQ ID NO: 930462 - RNA, 22 nt, Human
uccuguuaguguuagacuuccc

SEQ ID NO: 930463 - RNA, 22 nt, Human
uacaccugggacccauccaaga

SEQ ID NO: 930464 - RNA, 22 nt, Human
auguaguuuggggcuagauuua

SEQ ID NO: 930465 - RNA, 22 nt, Human
ccugucacauauuugcuguuca

SEQ ID NO: 930466 - RNA, 22 nt, Human
acuaaauuugucaaugacacuu

SEQ ID NO: 930467 - RNA, 22 nt, Human
aguaacagagcauggguucaga

SEQ ID NO: 930468 - RNA, 17 nt, Human
gcucugccccagccucu

SEQ ID NO: 930469 - RNA, 22 nt, Human
cuuacacuuuccgaaagcuugu

SEQ ID NO: 930470 - RNA, 22 nt, Human
uagaauuaugccuugcugucca

SEQ ID NO: 930471 - RNA, 22 nt, Human
auaaauuaugaauggcccuuuu

SEQ ID NO: 930472 - RNA, 22 nt, Human
cacauuuaucucucuccgguga

SEQ ID NO: 930473 - RNA, 22 nt, Human
cacacacaguuuuguauucugu

SEQ ID NO: 930474 - RNA, 22 nt, Human
cccuguuaaugucaaccugccu

SEQ ID NO: 930475 - RNA, 21 nt, Human
auggaaauuggcaaaugcuac

SEQ ID NO: 930476 - RNA, 22 nt, Human
cagcagaguuuggcuucuaaug

SEQ ID NO: 930477 - RNA, 22 nt, Human
ugugaaagucaaauuaauugaa

SEQ ID NO: 930478 - RNA, 22 nt, Human
cugcuuggguccuggcaugggu

SEQ ID NO: 930479 - RNA, 22 nt, Human
gucaucuuaaggacugcuauag

SEQ ID NO: 930480 - RNA, 22 nt, Human
aacauuuaggaaggaccuccuc

SEQ ID NO: 930481 - RNA, 22 nt, Human
acacauuccugcagacaugaug

SEQ ID NO: 930482 - RNA, 22 nt, Human
aacaugaaguuuucuauaguga

SEQ ID NO: 930483 - RNA, 22 nt, Human
cugugaauuuaaagcacacauc

SEQ ID NO: 930484 - RNA, 22 nt, Human
cugccacuuuggagugcucaga

SEQ ID NO: 930485 - RNA, 21 nt, Human
auggcuucucaggugcacuga

SEQ ID NO: 930486 - RNA, 22 nt, Human
uccugaaggcagauggggauca

SEQ ID NO: 930487 - RNA, 20 nt, Human
aacaaacuacaaaauuaugu

SEQ ID NO: 930488 - RNA, 22 nt, Human
aacuucaccuuuuugccacacu

SEQ ID NO: 930489 - RNA, 22 nt, Human
uagcuuuaaaaaucaucaaagc

SEQ ID NO: 930490 - RNA, 22 nt, Human
ccuucgagauuuaaacacugau

SEQ ID NO: 930491 - RNA, 22 nt, Human
gacagagaggcugagcaguaca

SEQ ID NO: 930492 - RNA, 22 nt, Human
ggcuucucuccaguaugcauuc

SEQ ID NO: 930493 - RNA, 22 nt, Human
aaguuuacuggggagaucaccu

SEQ ID NO: 930494 - RNA, 22 nt, Human
aauaacuucauguaacauuuaa

SEQ ID NO: 930495 - RNA, 22 nt, Human
aagucacacuagacaacugagg

SEQ ID NO: 930496 - RNA, 22 nt, Human
uguugguaggauuugcuucagc

SEQ ID NO: 930497 - RNA, 22 nt, Human
uauggcuuaaaauuucagcaug

SEQ ID NO: 930498 - RNA, 22 nt, Human
uuuguaugugauaagacuauuc

SEQ ID NO: 930499 - RNA, 22 nt, Human
aaugguuuucuagaacaugaaa

SEQ ID NO: 930500 - RNA, 22 nt, Human
ugucaucugcggguggcacugc

SEQ ID NO: 930501 - RNA, 22 nt, Human
uacagcauauacagaaugaaca

SEQ ID NO: 930502 - RNA, 22 nt, Human
aauggcuuagcucagcgcucag

SEQ ID NO: 930503 - RNA, 20 nt, Human
ccuuuauuauuuguaugaug

SEQ ID NO: 930504 - RNA, 22 nt, Human
ucucuggcugauauuccucugc

SEQ ID NO: 930505 - RNA, 22 nt, Human
agcuucucucaggguaucuuuc

SEQ ID NO: 930506 - RNA, 17 nt, Human
cuaaauacuugcguuuc

SEQ ID NO: 930507 - RNA, 22 nt, Human
ucucuucuauuugagacuauuu

SEQ ID NO: 930508 - RNA, 19 nt, Human
cugugcuuuaaacuccuau

SEQ ID NO: 930509 - RNA, 22 nt, Human
cagcuucaauaauggcugaugg

SEQ ID NO: 930510 - RNA, 22 nt, Human
uccugaagcucucuuaaggaaa

SEQ ID NO: 930511 - RNA, 22 nt, Human
uuguagcauuuuaaaugagcau

SEQ ID NO: 930512 - RNA, 22 nt, Human
aacacuguaucagucuucaaua

SEQ ID NO: 930513 - RNA, 22 nt, Human
uccuucaggccucauucucaua

SEQ ID NO: 930514 - RNA, 22 nt, Human
uccugaagaacgaagucaugua

SEQ ID NO: 930515 - RNA, 22 nt, Human
uucacaaaacacuauuuucugg

SEQ ID NO: 930516 - RNA, 22 nt, Human
aaaugacauuaggauccugcau

SEQ ID NO: 930517 - RNA, 22 nt, Human
uugcauagugcugagguucggg

SEQ ID NO: 930518 - RNA, 22 nt, Human
aagacaugcaguuuguuccauu

SEQ ID NO: 930519 - RNA, 22 nt, Human
aacaguaaaaaucauuuaguug

SEQ ID NO: 930520 - RNA, 22 nt, Human
cagcagaggugguucacauugu

SEQ ID NO: 930521 - RNA, 22 nt, Human
aaugucuuuugauacaaguuac

SEQ ID NO: 930522 - RNA, 22 nt, Human
auacaauuauucugcagauauu

SEQ ID NO: 930523 - RNA, 22 nt, Human
aaaucuguaagcaauugcucag

SEQ ID NO: 930524 - RNA, 22 nt, Human
gcuuuacagggcacaaagggag

SEQ ID NO: 930525 - RNA, 22 nt, Human
cauggcuucgcgcguccccgcu

SEQ ID NO: 930526 - RNA, 22 nt, Human
gagcuucagaauuuaacagacu

SEQ ID NO: 930527 - RNA, 22 nt, Human
uuguagcagggaucagaauaca

SEQ ID NO: 930528 - RNA, 22 nt, Human
acacauuauagagaguauaaua

SEQ ID NO: 930529 - RNA, 20 nt, Human
aagcuuccaggaucuggugu

SEQ ID NO: 930530 - RNA, 22 nt, Human
uagcagcucacagccucccauu

SEQ ID NO: 930531 - RNA, 22 nt, Human
aagcuuuaugaucucucagcua

SEQ ID NO: 930532 - RNA, 22 nt, Human
guuauucaacuugugucucuua

SEQ ID NO: 930533 - RNA, 22 nt, Human
augugcuuuagguuuguuuaca

SEQ ID NO: 930534 - RNA, 22 nt, Human
aagaaacaaccacugcucuccu

SEQ ID NO: 930535 - RNA, 22 nt, Human
cagacacacaagcaaucuaagu

SEQ ID NO: 930536 - RNA, 22 nt, Human
uuacaguuguucuaucagcaug

SEQ ID NO: 930537 - RNA, 22 nt, Human
guacacaaaagaggaaaccgga

SEQ ID NO: 930538 - RNA, 22 nt, Human
aucauaaaccacuuuguaaucu

SEQ ID NO: 930539 - RNA, 22 nt, Human
uuuacacugugaaacagguauc

SEQ ID NO: 930540 - RNA, 22 nt, Human
gcauucccaaaagacacuuacc

SEQ ID NO: 930541 - RNA, 22 nt, Human
uuauuauguggaugaaagaugu

SEQ ID NO: 930542 - RNA, 22 nt, Human
auacacauguguaugugcaugc

SEQ ID NO: 930543 - RNA, 22 nt, Human
gccuucagcccugacuggccag

SEQ ID NO: 930544 - RNA, 22 nt, Human
aacaugaugacauuguaagcuu

SEQ ID NO: 930545 - RNA, 22 nt, Human
aucaagaauguucauucuucua

SEQ ID NO: 930546 - RNA, 22 nt, Human
caacuucacugugccucuaguu

SEQ ID NO: 930547 - RNA, 20 nt, Human
uuuagcacauuguacaaaac

SEQ ID NO: 930548 - RNA, 22 nt, Human
gauggcuucucucuagcuuggu

SEQ ID NO: 930549 - RNA, 22 nt, Human
uccuucagugucccgcucaggu

SEQ ID NO: 930550 - RNA, 22 nt, Human
ucacauuucugauuauaccaaa

SEQ ID NO: 930551 - RNA, 22 nt, Human
cuucuuucccaggcauguuuua

SEQ ID NO: 930552 - RNA, 22 nt, Human
aguacacagaguuauuuugugu

SEQ ID NO: 930553 - RNA, 23 nt, Human
auaaauuacuaucucccuagagc

SEQ ID NO: 930554 - RNA, 22 nt, Human
uuccagagaggcucauguuccc

SEQ ID NO: 930555 - RNA, 22 nt, Human
uaacaguauagccuaacauuuc

SEQ ID NO: 930556 - RNA, 20 nt, Human
uccugccacaccucaguugc

SEQ ID NO: 930557 - RNA, 18 nt, Human
cagcagagacauucaaaa

SEQ ID NO: 930558 - RNA, 22 nt, Human
acacacugaauuuuguggaaac

SEQ ID NO: 930559 - RNA, 22 nt, Human
caucuguugcuuccuaacaagu

SEQ ID NO: 930560 - RNA, 22 nt, Human
uucacaaagcuggagcauuucc

SEQ ID NO: 930561 - RNA, 22 nt, Human
gcuucucucucagacugcaagc

SEQ ID NO: 930562 - RNA, 22 nt, Human
uuugcacacacaauaacaaaug

SEQ ID NO: 930563 - RNA, 22 nt, Human
guggcuucaucaacugugcuua

SEQ ID NO: 930564 - RNA, 22 nt, Human
cuuauucagaaggagaaaugga

SEQ ID NO: 930565 - RNA, 22 nt, Human
augcuuggaugcugccauggga

SEQ ID NO: 930566 - RNA, 22 nt, Human
ugaagcuugagugucaguuccu

SEQ ID NO: 930567 - RNA, 22 nt, Human
aauggcuugcaaauggguccau

SEQ ID NO: 930568 - RNA, 22 nt, Human
aaucuguuuguuuacaccuuuu

SEQ ID NO: 930569 - RNA, 22 nt, Human
acaaauagaaaaucuggauugg

SEQ ID NO: 930570 - RNA, 22 nt, Human
uucuagcagagggcaucugcug

SEQ ID NO: 930571 - RNA, 22 nt, Human
uuuauugcauacacaaauguca

SEQ ID NO: 930572 - RNA, 22 nt, Human
uuucacacuagucagaauacca

SEQ ID NO: 930573 - RNA, 22 nt, Human
agcagagaccauauagcccaga

SEQ ID NO: 930574 - RNA, 22 nt, Human
aggaugugaguggacacagucc

SEQ ID NO: 930575 - RNA, 20 nt, Human
gauggcuuuagaagcuggua

SEQ ID NO: 930576 - RNA, 22 nt, Human
cauuuaugauaguaauaugaaa

SEQ ID NO: 930577 - RNA, 22 nt, Human
aaucuguuuuugaaacuuugua

SEQ ID NO: 930578 - RNA, 22 nt, Human
uuaaccuguuaugcccccagag

SEQ ID NO: 930579 - RNA, 22 nt, Human
ucacaaauagcuauauuaagga

SEQ ID NO: 930580 - RNA, 22 nt, Human
uacaguuucccagcagaugcaa

SEQ ID NO: 930581 - RNA, 22 nt, Human
agaagacagagucuacauucua

SEQ ID NO: 930582 - RNA, 22 nt, Human
cuggcccucggaguccagcugc

SEQ ID NO: 930583 - RNA, 18 nt, Human
ccuggcacacuggcucau

SEQ ID NO: 930584 - RNA, 22 nt, Human
uuuacacuuuccugggaacauc

SEQ ID NO: 930585 - RNA, 20 nt, Human
auacacauauucuugcaacu

SEQ ID NO: 930586 - RNA, 22 nt, Human
uacacaauucuggaugcauguc

SEQ ID NO: 930587 - RNA, 22 nt, Human
aggcccuguuaugagccacugu

SEQ ID NO: 930588 - RNA, 22 nt, Human
ccacaugaugaggaagcugaac

SEQ ID NO: 930589 - RNA, 22 nt, Human
caugagaagguuuuggcauaua

SEQ ID NO: 930590 - RNA, 22 nt, Human
gaagcaucagcaauggcuggaa

SEQ ID NO: 930591 - RNA, 22 nt, Human
aaagcacauuacaagcucaguc

SEQ ID NO: 930592 - RNA, 22 nt, Human
aagucacacugcugggaacucu

SEQ ID NO: 930593 - RNA, 19 nt, Human
cuuauacagauuuucucau

SEQ ID NO: 930594 - RNA, 22 nt, Human
ucugugcuaaugcuucacaaua

SEQ ID NO: 930595 - RNA, 22 nt, Human
ucacaaaugaggaaaucgagca

SEQ ID NO: 930596 - RNA, 20 nt, Human
auguagcagugugcugggaa

SEQ ID NO: 930597 - RNA, 22 nt, Human
ucuuggcuaguaccuuccugcc

SEQ ID NO: 930598 - RNA, 22 nt, Human
ugcuuagggcuccuccaauaga

SEQ ID NO: 930599 - RNA, 21 nt, Human
uucacagaugggaaaacugag

SEQ ID NO: 930600 - RNA, 22 nt, Human
aauuccaaauguuuucaaucca

SEQ ID NO: 930601 - RNA, 22 nt, Human
aucuggcucucucauuuacaaa

SEQ ID NO: 930602 - RNA, 22 nt, Human
uuauuacaaugcagaaaauaga

SEQ ID NO: 930603 - RNA, 22 nt, Human
cuuauucagcacuugcucugua

SEQ ID NO: 930604 - RNA, 22 nt, Human
ccacuguggaaagcaguucaga

SEQ ID NO: 930605 - RNA, 22 nt, Human
ucacaaauuucagcucccugaa

SEQ ID NO: 930606 - RNA, 20 nt, Human
auacacaugcagacagaugc

SEQ ID NO: 930607 - RNA, 22 nt, Human
uuaaauuauugagggauuguca

SEQ ID NO: 930608 - RNA, 22 nt, Human
agaucacauaauuuccugugac

SEQ ID NO: 930609 - RNA, 22 nt, Human
uauggcuugaguuucagacuau

SEQ ID NO: 930610 - RNA, 22 nt, Human
uuuagcaaguucucugagagaa

SEQ ID NO: 930611 - RNA, 22 nt, Human
uggcuuccugcacagugucugc

SEQ ID NO: 930612 - RNA, 22 nt, Human
cauucccugucucuucaauccu

SEQ ID NO: 930613 - RNA, 22 nt, Human
uccuucagccaugggcucucca

SEQ ID NO: 930614 - RNA, 22 nt, Human
auccaugauugcccagaggugu

SEQ ID NO: 930615 - RNA, 22 nt, Human
aauuaagaaaauguuuuaugau

SEQ ID NO: 930616 - RNA, 22 nt, Human
cacacaguggaguauuacucag

SEQ ID NO: 930617 - RNA, 22 nt, Human
aagcuucaguggacuguagugu

SEQ ID NO: 930618 - RNA, 22 nt, Human
aauggcuuuggcaggaauuuca

SEQ ID NO: 930619 - RNA, 22 nt, Human
acauauuuccaugcagcauguc

SEQ ID NO: 930620 - RNA, 22 nt, Human
auuccacaugaaaggagcugaa

SEQ ID NO: 930621 - RNA, 22 nt, Human
aaagagucuggcguuuuaaugg

SEQ ID NO: 930622 - RNA, 22 nt, Human
gcuuuacagagaaaguuugccu

SEQ ID NO: 930623 - RNA, 22 nt, Human
augcaguggcuucagugucagu

SEQ ID NO: 930624 - RNA, 21 nt, Human
acuuaaauuccuugauauuua

SEQ ID NO: 930625 - RNA, 22 nt, Human
aaccaugucuuguuuuccuagu

SEQ ID NO: 930626 - RNA, 21 nt, Human
ucuguuggaggccucucuucc

SEQ ID NO: 930627 - RNA, 22 nt, Human
caugugaauuccaaagcuaggu

SEQ ID NO: 930628 - RNA, 22 nt, Human
uacacauauguguguauaugug

SEQ ID NO: 930629 - RNA, 22 nt, Human
agaaacaucauuggaacacaag

SEQ ID NO: 930630 - RNA, 22 nt, Human
gagguggcacugugaggagcac

SEQ ID NO: 930631 - RNA, 22 nt, Human
acagaucacuugacuaaaauga

SEQ ID NO: 930632 - RNA, 22 nt, Human
aguucacagcaaaguggggacc

SEQ ID NO: 930633 - RNA, 22 nt, Human
uaauuuuaauaguauguggcau

SEQ ID NO: 930634 - RNA, 22 nt, Human
aagcauuuuguuuuaagaauga

SEQ ID NO: 930635 - RNA, 22 nt, Human
ugucauuuaucuuauaguaauc

SEQ ID NO: 930636 - RNA, 22 nt, Human
uuauucuguauuucagguaugu

SEQ ID NO: 930637 - RNA, 22 nt, Human
acauuuauuuuggcacggcaca

SEQ ID NO: 930638 - RNA, 22 nt, Human
auaacuucaucaaauaggcaca

SEQ ID NO: 930639 - RNA, 22 nt, Human
uuccacagaugaaaauuaaguu

SEQ ID NO: 930640 - RNA, 22 nt, Human
gacauuuauuagaaaacuauca

SEQ ID NO: 930641 - RNA, 22 nt, Human
acaagguugauucuggcaucug

SEQ ID NO: 930642 - RNA, 17 nt, Human
auuucacuuagcaugag

SEQ ID NO: 930643 - RNA, 22 nt, Human
gauggcuuugugcaccaugauu

SEQ ID NO: 930644 - RNA, 22 nt, Human
ugugacuucuuuuugaguucaa

SEQ ID NO: 930645 - RNA, 22 nt, Human
auugugaauagugccgcaguaa

SEQ ID NO: 930646 - RNA, 22 nt, Human
auacaugucaucauauguuugu

SEQ ID NO: 930647 - RNA, 22 nt, Human
uuuuaugcaaguuaugauuaaa

SEQ ID NO: 930648 - RNA, 22 nt, Human
accugucaugucaauguucagu

SEQ ID NO: 930649 - RNA, 22 nt, Human
augcuuggcagaguucuuuuuc

SEQ ID NO: 930650 - RNA, 23 nt, Human
ugcuuggacaagacucuauuaag

SEQ ID NO: 930651 - RNA, 22 nt, Human
caagaguuuaaaucaauggcca

SEQ ID NO: 930652 - RNA, 20 nt, Human
acacugugcuaaggauuuuc

SEQ ID NO: 930653 - RNA, 22 nt, Human
aagagaauucugguuuuccuau

SEQ ID NO: 930654 - RNA, 22 nt, Human
cugaggccuggccccaccacag

SEQ ID NO: 930655 - RNA, 22 nt, Human
gaaccuguccugagugaggagu

SEQ ID NO: 930656 - RNA, 22 nt, Human
acuguuauuuguaauccauuau

SEQ ID NO: 930657 - RNA, 22 nt, Human
aaccauguacuuuauucuguuu

SEQ ID NO: 930658 - RNA, 22 nt, Human
aaucuucauaaaaaucuaguag

SEQ ID NO: 930659 - RNA, 22 nt, Human
ucccugcugagagugcucuccc

SEQ ID NO: 930660 - RNA, 22 nt, Human
acacuaagguuggagucacagu

SEQ ID NO: 930661 - RNA, 22 nt, Human
gccaaccauuggcuucuuguca

SEQ ID NO: 930662 - RNA, 22 nt, Human
acacugugucuagcauuuuaca

SEQ ID NO: 930663 - RNA, 22 nt, Human
acauuucauguuuuccagagca

SEQ ID NO: 930664 - RNA, 22 nt, Human
gcuguaugugaggccacaguga

SEQ ID NO: 930665 - RNA, 22 nt, Human
cuuuccuggcuggcaguugugg

SEQ ID NO: 930666 - RNA, 22 nt, Human
ccacaaauuagguuuugcuugu

SEQ ID NO: 930667 - RNA, 22 nt, Human
cuuauucaaugcuggaaauguu

SEQ ID NO: 930668 - RNA, 22 nt, Human
cuguagcuccagccugucuaca

SEQ ID NO: 930669 - RNA, 22 nt, Human
uccugaagaggcuacacugcuu

SEQ ID NO: 930670 - RNA, 21 nt, Human
acacaagcacucguacauacg

SEQ ID NO: 930671 - RNA, 22 nt, Human
cacacauggcugccagggaggu

SEQ ID NO: 930672 - RNA, 22 nt, Human
caguaugugaugcaacggaaua

SEQ ID NO: 930673 - RNA, 22 nt, Human
ggacugagcugacaucuguugg

SEQ ID NO: 930674 - RNA, 22 nt, Human
uaggccuucggugugugcuugg

SEQ ID NO: 930675 - RNA, 22 nt, Human
uuggacugguuuacauuucaag

SEQ ID NO: 930676 - RNA, 18 nt, Human
cugugacuccuagaucuc

SEQ ID NO: 930677 - RNA, 22 nt, Human
cuguugaucucaguuagcuaga

SEQ ID NO: 930678 - RNA, 22 nt, Human
aauucacauguugaaguccuaa

SEQ ID NO: 930679 - RNA, 22 nt, Human
acucaugauaugccuauaagau

SEQ ID NO: 930680 - RNA, 22 nt, Human
uaagacauaccaaguuguguga

SEQ ID NO: 930681 - RNA, 22 nt, Human
cauggcuucuaagugauaacgu

SEQ ID NO: 930682 - RNA, 22 nt, Human
acaugcuuugcacuuacaucau

SEQ ID NO: 930683 - RNA, 22 nt, Human
uucuucugccucccaccugaua

SEQ ID NO: 930684 - RNA, 22 nt, Human
uucacacucucacucccugacc

SEQ ID NO: 930685 - RNA, 22 nt, Human
ugcuuugccagacaguucccuu

SEQ ID NO: 930686 - RNA, 22 nt, Human
auacacaggcaugcuucugauu

SEQ ID NO: 930687 - RNA, 22 nt, Human
aauggcuuaaguauaagugaga

SEQ ID NO: 930688 - RNA, 22 nt, Human
aaugcuuccaaaauaccaagcc

SEQ ID NO: 930689 - RNA, 22 nt, Human
uauggcuucauugugcuccgca

SEQ ID NO: 930690 - RNA, 22 nt, Human
uuugcacacauucuuagaaaug

SEQ ID NO: 930691 - RNA, 22 nt, Human
acacacuggagguaaauggggu

SEQ ID NO: 930692 - RNA, 22 nt, Human
acagcagagugugagauagcca

SEQ ID NO: 930693 - RNA, 22 nt, Human
gcuuccucccugcugcucacua

SEQ ID NO: 930694 - RNA, 22 nt, Human
acaguacugaguacugaguugg

SEQ ID NO: 930695 - RNA, 22 nt, Human
uagacuauuucuuuugcauagg

SEQ ID NO: 930696 - RNA, 22 nt, Human
ucuuuacaucacaauuguaugg

SEQ ID NO: 930697 - RNA, 22 nt, Human
uucacaaagcugguuccuucug

SEQ ID NO: 930698 - RNA, 22 nt, Human
auucacaaagucacccuuacac

SEQ ID NO: 930699 - RNA, 22 nt, Human
ccacccugaggaaugguccggc

SEQ ID NO: 930700 - RNA, 22 nt, Human
auuuaugcaucccagcauguga

SEQ ID NO: 930701 - RNA, 22 nt, Human
uuauccaagcagaagcugcaca

SEQ ID NO: 930702 - RNA, 22 nt, Human
acuucacauuagcuaaaaggga

SEQ ID NO: 930703 - RNA, 22 nt, Human
acacauaagaaacuacaaagag

SEQ ID NO: 930704 - RNA, 22 nt, Human
uuacacagugcacaagcagagu

SEQ ID NO: 930705 - RNA, 22 nt, Human
augugcuugacuacucucuauu

SEQ ID NO: 930706 - RNA, 22 nt, Human
uagaaacaagggagaggauucu

SEQ ID NO: 930707 - RNA, 22 nt, Human
acacauuagugcucugucucau

SEQ ID NO: 930708 - RNA, 22 nt, Human
ccuuuuauauggcucaucacag

SEQ ID NO: 930709 - RNA, 22 nt, Human
ugcaguucuaaguagacaaguc

SEQ ID NO: 930710 - RNA, 22 nt, Human
gaaauugucagcuucuuucagu

SEQ ID NO: 930711 - RNA, 22 nt, Human
uacauuagcaaacaucuuggug

SEQ ID NO: 930712 - RNA, 22 nt, Human
cucugugcccuacugcucagcu

SEQ ID NO: 930713 - RNA, 20 nt, Human
aucuuugucucuguaguugu

SEQ ID NO: 930714 - RNA, 22 nt, Human
auacacauaucagguguauaca

SEQ ID NO: 930715 - RNA, 22 nt, Human
uuucucugaguuguuacaaaac

SEQ ID NO: 930716 - RNA, 22 nt, Human
cugucauuuaagacauucugga

SEQ ID NO: 930717 - RNA, 22 nt, Human
ucuaacuuguauguauaguuuu

SEQ ID NO: 930718 - RNA, 22 nt, Human
agacuuuaaugugcaaaugaaa

SEQ ID NO: 930719 - RNA, 22 nt, Human
ugucacaauaucccaaucugcc

SEQ ID NO: 930720 - RNA, 23 nt, Human
acuagaaaaugacuuucucccug

SEQ ID NO: 930721 - RNA, 22 nt, Human
ccugcaagacuauuuaguucca

SEQ ID NO: 930722 - RNA, 22 nt, Human
gccuucaguagugucagcugua

SEQ ID NO: 930723 - RNA, 22 nt, Human
cuucaauugccaccagcuagca

SEQ ID NO: 930724 - RNA, 22 nt, Human
acagaauuuacacaucucuaaa

SEQ ID NO: 930725 - RNA, 22 nt, Human
ugaaggaaugagggaguggguc

SEQ ID NO: 930726 - RNA, 22 nt, Human
auucuccaguagucauucuauc

SEQ ID NO: 930727 - RNA, 19 nt, Human
augugcuugggccaugcua

SEQ ID NO: 930728 - RNA, 22 nt, Human
uucuaacuccacuucccacucc

SEQ ID NO: 930729 - RNA, 22 nt, Human
acaguaaauaaugcauguugau

SEQ ID NO: 930730 - RNA, 21 nt, Human
uccuucagucuagaugauugu

SEQ ID NO: 930731 - RNA, 22 nt, Human
auuguaaaaguauucuaagauu

SEQ ID NO: 930732 - RNA, 22 nt, Human
uucauucagguguauuuauggg

SEQ ID NO: 930733 - RNA, 22 nt, Human
acauaucuuucccucuccugaa

SEQ ID NO: 930734 - RNA, 22 nt, Human
uuuagcaagaugcccuggcuuu

SEQ ID NO: 930735 - RNA, 22 nt, Human
aacaugauguauuuucuugucu

SEQ ID NO: 930736 - RNA, 22 nt, Human
uuugauugucaccuaccuugca

SEQ ID NO: 930737 - RNA, 22 nt, Human
auagacaaucccccauccuacc

SEQ ID NO: 930738 - RNA, 22 nt, Human
aacaugauaguauuuugaggug

SEQ ID NO: 930739 - RNA, 22 nt, Human
aaaacaguuuaggcaucacagu

SEQ ID NO: 930740 - RNA, 22 nt, Human
uuacuuuagaaauagucaucaa

SEQ ID NO: 930741 - RNA, 22 nt, Human
cacacaugugagcagagaggcg

SEQ ID NO: 930742 - RNA, 22 nt, Human
augaugaagcaugguuacacug

SEQ ID NO: 930743 - RNA, 22 nt, Human
ccacacuggcaugggauggagg

SEQ ID NO: 930744 - RNA, 22 nt, Human
aagcaugguuucugacgucaug

SEQ ID NO: 930745 - RNA, 22 nt, Human
ugucuacugagaagcuaugcaa

SEQ ID NO: 930746 - RNA, 22 nt, Human
auguuuaugcaaacaugugagu

SEQ ID NO: 930747 - RNA, 22 nt, Human
uauggcuugacuugcaccggca

SEQ ID NO: 930748 - RNA, 22 nt, Human
uagcacauacauaauagauaga

SEQ ID NO: 930749 - RNA, 22 nt, Human
ugcacaaaggcucccugcugag

SEQ ID NO: 930750 - RNA, 22 nt, Human
uuacacugacagcugaaaagca

SEQ ID NO: 930751 - RNA, 22 nt, Human
gagaaacaggaauugagucgcu

SEQ ID NO: 930752 - RNA, 22 nt, Human
uggcuucccauagcuugcuagu

SEQ ID NO: 930753 - RNA, 18 nt, Human
uaacauguuuucauuaag

SEQ ID NO: 930754 - RNA, 22 nt, Human
uuaccuguguguuugauacaua

SEQ ID NO: 930755 - RNA, 22 nt, Human
uggcuuuaagaagacugacagc

SEQ ID NO: 930756 - RNA, 21 nt, Human
aaguugucucuuuugguuccu

SEQ ID NO: 930757 - RNA, 17 nt, Human
cucugggucuccugcuu

SEQ ID NO: 930758 - RNA, 22 nt, Human
auaaucuggucuuuguaugagu

SEQ ID NO: 930759 - RNA, 22 nt, Human
acacagaggcaugacaguggcu

SEQ ID NO: 930760 - RNA, 17 nt, Human
cugcuuggccucugggg

SEQ ID NO: 930761 - RNA, 22 nt, Human
gaggaggaaguucucuguaggc

SEQ ID NO: 930762 - RNA, 22 nt, Human
aagucacagaacccauuguaac

SEQ ID NO: 930763 - RNA, 22 nt, Human
uuauugcaacuuuagggauaga

SEQ ID NO: 930764 - RNA, 22 nt, Human
aaacuucagggaauaaaagagu

SEQ ID NO: 930765 - RNA, 22 nt, Human
ugucuacuugggcucuacagca

SEQ ID NO: 930766 - RNA, 22 nt, Human
ccacccugccuugggccaguga

SEQ ID NO: 930767 - RNA, 22 nt, Human
agacagcaugauacaugaugcu

SEQ ID NO: 930768 - RNA, 22 nt, Human
caauagcagaccuagaaagcaa

SEQ ID NO: 930769 - RNA, 22 nt, Human
augagaaugcauucauguuuug

SEQ ID NO: 930770 - RNA, 22 nt, Human
agagaaacaggucagcugggag

SEQ ID NO: 930771 - RNA, 22 nt, Human
agggcccucugggcacuguggc

SEQ ID NO: 930772 - RNA, 22 nt, Human
uuucuauuguaagucuccuaua

SEQ ID NO: 930773 - RNA, 22 nt, Human
accacuguacagcagauauagu

SEQ ID NO: 930774 - RNA, 22 nt, Human
uguuuucugaugguuaaugagu

SEQ ID NO: 930775 - RNA, 18 nt, Human
acauuuaggagagucaau

SEQ ID NO: 930776 - RNA, 17 nt, Human
cacuugcuggucuaccu

SEQ ID NO: 930777 - RNA, 22 nt, Human
cauacugugaagcuuacuauuu

SEQ ID NO: 930778 - RNA, 22 nt, Human
uuacacuuuggcaagcuauuaa

SEQ ID NO: 930779 - RNA, 22 nt, Human
cauuucaauacaguuuguaaau

SEQ ID NO: 930780 - RNA, 22 nt, Human
aauggcuuuaggaauccagugc

SEQ ID NO: 930781 - RNA, 22 nt, Human
ugaagacucagaagcuaagaua

SEQ ID NO: 930782 - RNA, 20 nt, Human
ccucugccuuucuagucuga

SEQ ID NO: 930783 - RNA, 22 nt, Human
uugauacagcagccugugaucc

SEQ ID NO: 930784 - RNA, 23 nt, Human
aacuuugccaggagacagcacag

SEQ ID NO: 930785 - RNA, 22 nt, Human
cuguuacugcuggagccauuga

SEQ ID NO: 930786 - RNA, 22 nt, Human
gagguggcuuagucucuggaca

SEQ ID NO: 930787 - RNA, 22 nt, Human
uuacuacauuguaacacaguac

SEQ ID NO: 930788 - RNA, 22 nt, Human
uuuacacaaaauguuaguagau

SEQ ID NO: 930789 - RNA, 22 nt, Human
aaauuaagggugagaagaguug

SEQ ID NO: 930790 - RNA, 22 nt, Human
uauuaugaucccagcccuggag

SEQ ID NO: 930791 - RNA, 22 nt, Human
agaaacagaaccaggugucauu

SEQ ID NO: 930792 - RNA, 22 nt, Human
ugccugaugcaggaguaucaga

SEQ ID NO: 930793 - RNA, 22 nt, Human
uggcuucugagcauugaaacgu

SEQ ID NO: 930794 - RNA, 22 nt, Human
gagaaacacuguuaguuuauua

SEQ ID NO: 930795 - RNA, 22 nt, Human
ugagggaauccucacaucaauc

SEQ ID NO: 930796 - RNA, 22 nt, Human
acagaugagagacaaugugcua

SEQ ID NO: 930797 - RNA, 22 nt, Human
uaccacagucugccauuagaug

SEQ ID NO: 930798 - RNA, 18 nt, Human
gagcuucaggcuaaccug

SEQ ID NO: 930799 - RNA, 22 nt, Human
uuugugaacacugcgcagaacu

SEQ ID NO: 930800 - RNA, 22 nt, Human
ucgcuuuaauggucuucacagc

SEQ ID NO: 930801 - RNA, 21 nt, Human
gaacauuuggguuguuucuac

SEQ ID NO: 930802 - RNA, 23 nt, Human
caacacugccuucaggugaagaa

SEQ ID NO: 930803 - RNA, 22 nt, Human
cauuucaaaagaauugccagaa

SEQ ID NO: 930804 - RNA, 22 nt, Human
caaggcuucacguccccagugc

SEQ ID NO: 930805 - RNA, 22 nt, Human
guuuacacauaacuccuaucaa

SEQ ID NO: 930806 - RNA, 22 nt, Human
auuuaauuuucucaacagugcu

SEQ ID NO: 930807 - RNA, 19 nt, Human
gcagcaguggaaggaaaaa

SEQ ID NO: 930808 - RNA, 22 nt, Human
ugugaauggacaauuaaaucua

SEQ ID NO: 930809 - RNA, 22 nt, Human
gcagcaguggucuguagaagga

SEQ ID NO: 930810 - RNA, 22 nt, Human
augugcuuuuacuccccagagu

SEQ ID NO: 930811 - RNA, 23 nt, Human
uguagcugucugagcagacacug

SEQ ID NO: 930812 - RNA, 22 nt, Human
aacuuuacuugaaagaacaugu

SEQ ID NO: 930813 - RNA, 22 nt, Human
aaccucuuugugaaugucauga

SEQ ID NO: 930814 - RNA, 19 nt, Human
gaauuuuaggacuucagca

SEQ ID NO: 930815 - RNA, 22 nt, Human
cuguugugaauuuaguuaccaa

SEQ ID NO: 930816 - RNA, 22 nt, Human
augcuucucagcucaaggcaaa

SEQ ID NO: 930817 - RNA, 22 nt, Human
cagcaaauacuacuaguuuuua

SEQ ID NO: 930818 - RNA, 22 nt, Human
ucagaacauggcauguuccauc

SEQ ID NO: 930819 - RNA, 22 nt, Human
gaaacagucaacuuucuuuccc

SEQ ID NO: 930820 - RNA, 22 nt, Human
cauuuaguuauacuaaaacauu

SEQ ID NO: 930821 - RNA, 22 nt, Human
ucacacauacucaugugugagu

SEQ ID NO: 930822 - RNA, 22 nt, Human
uucucaguaguuagcauuugug

SEQ ID NO: 930823 - RNA, 22 nt, Human
aagcuguucucuaaguuucaug

SEQ ID NO: 930824 - RNA, 22 nt, Human
uuggacugagaguuccaccauu

SEQ ID NO: 930825 - RNA, 22 nt, Human
gcuuauacucuggagaauaaga

SEQ ID NO: 930826 - RNA, 22 nt, Human
auuuaaauuuucugauggagag

SEQ ID NO: 930827 - RNA, 22 nt, Human
uucagcaaacacgaugcuuguu

SEQ ID NO: 930828 - RNA, 22 nt, Human
uauugcauccccauugugcccc

SEQ ID NO: 930829 - RNA, 22 nt, Human
uuuauagcugugagaccuuggg

SEQ ID NO: 930830 - RNA, 22 nt, Human
uuagacuagaagcuuccacuuu

SEQ ID NO: 930831 - RNA, 22 nt, Human
gaguaauucugguaaaucauug

SEQ ID NO: 930832 - RNA, 22 nt, Human
cugcuuggaggccugggugcua

SEQ ID NO: 930833 - RNA, 22 nt, Human
uucaguaaaacacugcaauguc

SEQ ID NO: 930834 - RNA, 22 nt, Human
ugugcucuguggaucugagcaa

SEQ ID NO: 930835 - RNA, 22 nt, Human
acauuaaacuugcuuggcugua

SEQ ID NO: 930836 - RNA, 22 nt, Human
cuucagcaacuuuggaauguuu

SEQ ID NO: 930837 - RNA, 22 nt, Human
ucuucucuacaccagcagcccc

SEQ ID NO: 930838 - RNA, 22 nt, Human
aucuggcuauugacauguuaua

SEQ ID NO: 930839 - RNA, 22 nt, Human
acaagagucugcauuucuaaca

SEQ ID NO: 930840 - RNA, 22 nt, Human
agaggaauggagacuaaacgcu

SEQ ID NO: 930841 - RNA, 22 nt, Human
uagcacuauuuuucacuauccu

SEQ ID NO: 930842 - RNA, 20 nt, Human
uuuauugagcacguacugug

SEQ ID NO: 930843 - RNA, 22 nt, Human
aguacacacaguagaauagagu

SEQ ID NO: 930844 - RNA, 22 nt, Human
uacauuaaggauauggacauga

SEQ ID NO: 930845 - RNA, 22 nt, Human
cuucuacacaucccucuugcuu

SEQ ID NO: 930846 - RNA, 22 nt, Human
gagucacauacuauguaauaga

SEQ ID NO: 930847 - RNA, 22 nt, Human
augucaaaucaguuuuaucaga

SEQ ID NO: 930848 - RNA, 22 nt, Human
agagaacaugacguaauagugg

SEQ ID NO: 930849 - RNA, 22 nt, Human
cacaguaugaucuaaaguaagu

SEQ ID NO: 930850 - RNA, 22 nt, Human
gugcuuggaccaggucaucuuc

SEQ ID NO: 930851 - RNA, 22 nt, Human
uuuaucugagcugauagauagu

SEQ ID NO: 930852 - RNA, 22 nt, Human
aauggcuuugaguauuuucugg

SEQ ID NO: 930853 - RNA, 22 nt, Human
aguacacagaauucuacuuguu

SEQ ID NO: 930854 - RNA, 21 nt, Human
gcagagaaugaacuuuggcuu

SEQ ID NO: 930855 - RNA, 22 nt, Human
gauggcuuaagaguaaaaggca

SEQ ID NO: 930856 - RNA, 22 nt, Human
aaaaugcaugagaaugugcucg

SEQ ID NO: 930857 - RNA, 22 nt, Human
uuuaccaagaguugucacuguu

SEQ ID NO: 930858 - RNA, 22 nt, Human
cacacaugguagcagguacaag

SEQ ID NO: 930859 - RNA, 22 nt, Human
uuccaaagugcuggaauuacau

SEQ ID NO: 930860 - RNA, 22 nt, Human
gauggcuuugaggaauuugaau

SEQ ID NO: 930861 - RNA, 22 nt, Human
aggucacaggcuuugaaaucaa

SEQ ID NO: 930862 - RNA, 22 nt, Human
cuguuuauaaaccaccaguuua

SEQ ID NO: 930863 - RNA, 22 nt, Human
ucacaugaagaucccucaauuu

SEQ ID NO: 930864 - RNA, 22 nt, Human
uggcuucugucccugcuacauu

SEQ ID NO: 930865 - RNA, 18 nt, Human
uggcugcuuccagguaca

SEQ ID NO: 930866 - RNA, 22 nt, Human
gcucugccuggucgcgugcugg

SEQ ID NO: 930867 - RNA, 22 nt, Human
cuuucccagaguaguugaugcu

SEQ ID NO: 930868 - RNA, 22 nt, Human
ccugugcuggcuuuauucucag

SEQ ID NO: 930869 - RNA, 19 nt, Human
cucuuacagaauagacaca

SEQ ID NO: 930870 - RNA, 22 nt, Human
aggcaauccucuuacagauggg

SEQ ID NO: 930871 - RNA, 22 nt, Human
auuuaccagcugugcacugaua

SEQ ID NO: 930872 - RNA, 22 nt, Human
aacaucaucaugaacaacuaau

SEQ ID NO: 930873 - RNA, 17 nt, Human
agcauuuguguuaacag

SEQ ID NO: 930874 - RNA, 22 nt, Human
acaguaaaacauuuuuauuagg

SEQ ID NO: 930875 - RNA, 22 nt, Human
auggaaauccaagucaccguag

SEQ ID NO: 930876 - RNA, 22 nt, Human
aaccuguuuugguugcauuuca

SEQ ID NO: 930877 - RNA, 22 nt, Human
auagaauucuuugaaauuuaug

SEQ ID NO: 930878 - RNA, 22 nt, Human
cuguggcucaggccuguaagcc

SEQ ID NO: 930879 - RNA, 22 nt, Human
cugagcucaagugaucugccca

SEQ ID NO: 930880 - RNA, 22 nt, Human
ucccaucuccaacauuuuucuu

SEQ ID NO: 930881 - RNA, 22 nt, Human
auggucuugugagaguaacagu

SEQ ID NO: 930882 - RNA, 22 nt, Human
ucacagcaaaagugugcagagc

SEQ ID NO: 930883 - RNA, 22 nt, Human
acacacugcucgcucagauuaa

SEQ ID NO: 930884 - RNA, 22 nt, Human
uggcucucagcucccagcagcc

SEQ ID NO: 930885 - RNA, 22 nt, Human
uuuagcacgguaacacauaaag

SEQ ID NO: 930886 - RNA, 22 nt, Human
ccacacugaaccucagugucuu

SEQ ID NO: 930887 - RNA, 22 nt, Human
uccacuguggucccuugcugcc

SEQ ID NO: 930888 - RNA, 22 nt, Human
uuuuuagccaagccauaggucu

SEQ ID NO: 930889 - RNA, 22 nt, Human
auucuagcaguuacaggcugau

SEQ ID NO: 930890 - RNA, 22 nt, Human
gacauuuauuggauuuuacgag

SEQ ID NO: 930891 - RNA, 22 nt, Human
cagaugaacugugacugaaaau

SEQ ID NO: 930892 - RNA, 22 nt, Human
uaaccuuugaccuugcuugugc

SEQ ID NO: 930893 - RNA, 19 nt, Human
uggcuuccugacucucauc

SEQ ID NO: 930894 - RNA, 22 nt, Human
uauagcaacuccaaagagacuu

SEQ ID NO: 930895 - RNA, 22 nt, Human
guacaauuaagugcacaaauag

SEQ ID NO: 930896 - RNA, 22 nt, Human
uuucacacugcagcaucagaga

SEQ ID NO: 930897 - RNA, 22 nt, Human
uggauaccugguuuuuauuuac

SEQ ID NO: 930898 - RNA, 22 nt, Human
aguggcuuggcugcacuacagg

SEQ ID NO: 930899 - RNA, 22 nt, Human
uuaugaaagacauuucuguugg

SEQ ID NO: 930900 - RNA, 22 nt, Human
agagaacagccuccuagagaaa

SEQ ID NO: 930901 - RNA, 22 nt, Human
uaguaacagauuuauacagucu

SEQ ID NO: 930902 - RNA, 18 nt, Human
guuaacaauuacuaacgc

SEQ ID NO: 930903 - RNA, 22 nt, Human
acagaauugauggaaaucucag

SEQ ID NO: 930904 - RNA, 22 nt, Human
uuugucaccaguggcuuuggua

SEQ ID NO: 930905 - RNA, 22 nt, Human
gcacaugacaguaaguagagca

SEQ ID NO: 930906 - RNA, 19 nt, Human
ggaaacaggggccagagga

SEQ ID NO: 930907 - RNA, 22 nt, Human
gaguuacauuuggugacacuuc

SEQ ID NO: 930908 - RNA, 22 nt, Human
cuucacaaucaccuuuucggaa

SEQ ID NO: 930909 - RNA, 22 nt, Human
acaguaaaucaacagaauaucu

SEQ ID NO: 930910 - RNA, 20 nt, Human
gaaacauuggcagcaacuga

SEQ ID NO: 930911 - RNA, 22 nt, Human
augcuucuguguauguuucagg

SEQ ID NO: 930912 - RNA, 22 nt, Human
cacacaugguuccgcaggaugc

SEQ ID NO: 930913 - RNA, 22 nt, Human
uagaaacagauguuuuugaaga

SEQ ID NO: 930914 - RNA, 22 nt, Human
ugugccugaguuggcugaguac

SEQ ID NO: 930915 - RNA, 19 nt, Human
agcuuccauauucucuagu

SEQ ID NO: 930916 - RNA, 22 nt, Human
aucuggcuccuacacuugaaga

SEQ ID NO: 930917 - RNA, 22 nt, Human
uuacacaaguucuuuaaccuau

SEQ ID NO: 930918 - RNA, 20 nt, Human
ugugucuuccuuucuuuaug

SEQ ID NO: 930919 - RNA, 22 nt, Human
uacagaaaucacaucgcuuuga

SEQ ID NO: 930920 - RNA, 22 nt, Human
aagacaauccuggacagucagc

SEQ ID NO: 930921 - RNA, 22 nt, Human
uccuucagauuccugcuucugg

SEQ ID NO: 930922 - RNA, 22 nt, Human
cuggcccuggagggcugugcga

SEQ ID NO: 930923 - RNA, 22 nt, Human
aucacaaaggguuuucucugag

SEQ ID NO: 930924 - RNA, 21 nt, Human
gcuugccuuccuaucuuuggc

SEQ ID NO: 930925 - RNA, 18 nt, Human
ugcaaauggcuguuugau

SEQ ID NO: 930926 - RNA, 22 nt, Human
uucaagaaagaguggcuauucc

SEQ ID NO: 930927 - RNA, 22 nt, Human
gcuuuacaacaaauugaauaug

SEQ ID NO: 930928 - RNA, 22 nt, Human
uaauuuacagagauacagucag

SEQ ID NO: 930929 - RNA, 21 nt, Human
auacacauacacauaaaugug

SEQ ID NO: 930930 - RNA, 22 nt, Human
cacacugauagcacuaagucag

SEQ ID NO: 930931 - RNA, 22 nt, Human
caaugcuuuauuuccuccccuu

SEQ ID NO: 930932 - RNA, 22 nt, Human
ugugaaagagucuuauaguuuc

SEQ ID NO: 930933 - RNA, 22 nt, Human
aacauuuaugguagucauugca

SEQ ID NO: 930934 - RNA, 22 nt, Human
gauggcuucugaaucagggccu

SEQ ID NO: 930935 - RNA, 22 nt, Human
caagcagagguuuauguauuag

SEQ ID NO: 930936 - RNA, 17 nt, Human
ugcuuggcuucuuuagg

SEQ ID NO: 930937 - RNA, 22 nt, Human
uucaguguggugcacaguuuug

SEQ ID NO: 930938 - RNA, 22 nt, Human
acauuuaguaugagucucugua

SEQ ID NO: 930939 - RNA, 22 nt, Human
uaacaauacccauucuaauuac

SEQ ID NO: 930940 - RNA, 22 nt, Human
gccuucaguaacugagacggaa

SEQ ID NO: 930941 - RNA, 22 nt, Human
uaauagaauaguggaaacauug

SEQ ID NO: 930942 - RNA, 22 nt, Human
uucagagucagggaucucagag

SEQ ID NO: 930943 - RNA, 22 nt, Human
augugcuuggacauucuaggaa

SEQ ID NO: 930944 - RNA, 22 nt, Human
ucccugccaguccuggucugaa

SEQ ID NO: 930945 - RNA, 22 nt, Human
cuacagaguucacaggauuuua

SEQ ID NO: 930946 - RNA, 22 nt, Human
cuaacugucaugcacauguguu

SEQ ID NO: 930947 - RNA, 22 nt, Human
uuggacugaaucuuucucacac

SEQ ID NO: 930948 - RNA, 21 nt, Human
augugaaauaucaucagagca

SEQ ID NO: 930949 - RNA, 22 nt, Human
gacuguuaccuauauuuaugug

SEQ ID NO: 930950 - RNA, 22 nt, Human
uggcuucuggcuggugagaaau

SEQ ID NO: 930951 - RNA, 22 nt, Human
ugucucuuggcucuaucacuua

SEQ ID NO: 930952 - RNA, 22 nt, Human
uuuauuauccaguguugucaug

SEQ ID NO: 930953 - RNA, 20 nt, Human
uuuccacuguaauguaugau

SEQ ID NO: 930954 - RNA, 22 nt, Human
agcauuuaccucaaugcaucug

SEQ ID NO: 930955 - RNA, 22 nt, Human
gaugucuuacuaacuagccuuu

SEQ ID NO: 930956 - RNA, 22 nt, Human
ugucuacuccugugcuagcucc

SEQ ID NO: 930957 - RNA, 22 nt, Human
ugacauuucuuguugauauaaa

SEQ ID NO: 930958 - RNA, 22 nt, Human
ucuuuacaaucuaagcauaguu

SEQ ID NO: 930959 - RNA, 22 nt, Human
auacaccaccuuggaucuuuca

SEQ ID NO: 930960 - RNA, 22 nt, Human
uggccucuuaggacauccucua

SEQ ID NO: 930961 - RNA, 20 nt, Human
gacuuuacaucagcacucuu

SEQ ID NO: 930962 - RNA, 22 nt, Human
cuagagaaacagugcucugaac

SEQ ID NO: 930963 - RNA, 22 nt, Human
cuguuguauuauucaauauuau

SEQ ID NO: 930964 - RNA, 22 nt, Human
aagaguauagcuuuaggauuga

SEQ ID NO: 930965 - RNA, 22 nt, Human
gucaucuuaucauuguugcugu

SEQ ID NO: 930966 - RNA, 22 nt, Human
acacggcacuuuaggaaggggc

SEQ ID NO: 930967 - RNA, 22 nt, Human
auggcuaaaccugaacuggucu

SEQ ID NO: 930968 - RNA, 22 nt, Human
cuuuauuccuacaagauuuucu

SEQ ID NO: 930969 - RNA, 22 nt, Human
guaaauuauuucaagaucaucu

SEQ ID NO: 930970 - RNA, 22 nt, Human
cuuuaccacaaggacagaacuu

SEQ ID NO: 930971 - RNA, 22 nt, Human
ucacagaauuuuugcuuccagu

SEQ ID NO: 930972 - RNA, 22 nt, Human
aguucucagcuuaguaugcugu

SEQ ID NO: 930973 - RNA, 22 nt, Human
gaucagaauuuacuuauaauug

SEQ ID NO: 930974 - RNA, 22 nt, Human
uacaguaaaugugguagaaacu

SEQ ID NO: 930975 - RNA, 23 nt, Human
acaccugugcuguagucacuaca

SEQ ID NO: 930976 - RNA, 22 nt, Human
agacaauguuuggucuacacuu

SEQ ID NO: 930977 - RNA, 22 nt, Human
ggaauucuguagcucuuccucu

SEQ ID NO: 930978 - RNA, 22 nt, Human
auuuagucucccuuaucaagga

SEQ ID NO: 930979 - RNA, 22 nt, Human
uagacaauauuugaaaguagug

SEQ ID NO: 930980 - RNA, 22 nt, Human
ucaccacucacucaggcaaguc

SEQ ID NO: 930981 - RNA, 22 nt, Human
uagaaacagcauauauuagccc

SEQ ID NO: 930982 - RNA, 22 nt, Human
accuuuaugauucacaauguau

SEQ ID NO: 930983 - RNA, 22 nt, Human
aacagcauauuucauauauuga

SEQ ID NO: 930984 - RNA, 23 nt, Human
aguucucaaaaccagcuugacaa

SEQ ID NO: 930985 - RNA, 22 nt, Human
cagaaacagacaugacgcagua

SEQ ID NO: 930986 - RNA, 22 nt, Human
aauuccaaaucaacuagucuag

SEQ ID NO: 930987 - RNA, 22 nt, Human
accugugcaaagacuggucagg

SEQ ID NO: 930988 - RNA, 21 nt, Human
auggcugaugauauugaacau

SEQ ID NO: 930989 - RNA, 21 nt, Human
acagcagagaucaagacuaag

SEQ ID NO: 930990 - RNA, 22 nt, Human
gaauuccacuuuggcuuuuggg

SEQ ID NO: 930991 - RNA, 22 nt, Human
ucuaaaaugcagaucuacuggu

SEQ ID NO: 930992 - RNA, 22 nt, Human
auggcauugaguaaagucagua

SEQ ID NO: 930993 - RNA, 22 nt, Human
aaugguuuggacuauucaauag

SEQ ID NO: 930994 - RNA, 22 nt, Human
uauggcuuuuuauucaucuuac

SEQ ID NO: 930995 - RNA, 22 nt, Human
uacacauuucucuuagagacac

SEQ ID NO: 930996 - RNA, 22 nt, Human
aagcuguuuuggccuuaguuga

SEQ ID NO: 930997 - RNA, 22 nt, Human
gagauauuuauucauacuguca

SEQ ID NO: 930998 - RNA, 22 nt, Human
uaccauuuugaaacauuucauc

SEQ ID NO: 930999 - RNA, 22 nt, Human
uugucugaauauguauguaucc

SEQ ID NO: 931000 - RNA, 22 nt, Human
uuccaagaguaaauucaaauug

SEQ ID NO: 931001 - RNA, 22 nt, Human
uuugugaaaugaagucacaacu

SEQ ID NO: 931002 - RNA, 22 nt, Human
uacguuuagcuuuaugagacau

SEQ ID NO: 931003 - RNA, 22 nt, Human
acacaugaggaaggccucaccc

SEQ ID NO: 931004 - RNA, 22 nt, Human
augugaaauauuaagccgagga

SEQ ID NO: 931005 - RNA, 23 nt, Human
cccugcucaggggucugauucuc

SEQ ID NO: 931006 - RNA, 22 nt, Human
uagaaacagaauaugagugaga

SEQ ID NO: 931007 - RNA, 22 nt, Human
agcacauuuuauuuaagaaaau

SEQ ID NO: 931008 - RNA, 22 nt, Human
auagcaaugaucaagacagaca

SEQ ID NO: 931009 - RNA, 22 nt, Human
augagucacucagcagaaaagg

SEQ ID NO: 931010 - RNA, 22 nt, Human
uuuauauguuuguacaauuaag

SEQ ID NO: 931011 - RNA, 22 nt, Human
cuugcuuggagaagagaucagu

SEQ ID NO: 931012 - RNA, 22 nt, Human
ucugacuuuucucacuguugug

SEQ ID NO: 931013 - RNA, 22 nt, Human
acuuuacauuugaucucucuaa

SEQ ID NO: 931014 - RNA, 22 nt, Human
auuuacacuaaaggaaggagga

SEQ ID NO: 931015 - RNA, 22 nt, Human
acagcaguggguugccaguggg

SEQ ID NO: 931016 - RNA, 22 nt, Human
uaacauguucagacuaccugug

SEQ ID NO: 931017 - RNA, 22 nt, Human
aagcuucaguucuggggcaaug

SEQ ID NO: 931018 - RNA, 22 nt, Human
gaaaaaugcuccaaaucugugg

SEQ ID NO: 931019 - RNA, 22 nt, Human
aucccacaccccuacaacauau

SEQ ID NO: 931020 - RNA, 22 nt, Human
uuuauuauucucuggagaaugu

SEQ ID NO: 931021 - RNA, 22 nt, Human
uucaacaggaaagcacuuuaca

SEQ ID NO: 931022 - RNA, 22 nt, Human
aguucacaagugcauuucagga

SEQ ID NO: 931023 - RNA, 22 nt, Human
uguagcuuuauauuguguuggg

SEQ ID NO: 931024 - RNA, 22 nt, Human
aacuuuuaaaauacacagacaa

SEQ ID NO: 931025 - RNA, 22 nt, Human
gugcaggauguugggaaucagg

SEQ ID NO: 931026 - RNA, 22 nt, Human
ucaauuucuugguuugauaaua

SEQ ID NO: 931027 - RNA, 22 nt, Human
uuugaauguuggauugacuuag

SEQ ID NO: 931028 - RNA, 22 nt, Human
aagcuuuaagugucagucagcc

SEQ ID NO: 931029 - RNA, 22 nt, Human
ucuucauuuugaagaggcagaa

SEQ ID NO: 931030 - RNA, 22 nt, Human
ucacaaauauuuuaacaguagg

SEQ ID NO: 931031 - RNA, 22 nt, Human
cagagcagauuucuaaguauug

SEQ ID NO: 931032 - RNA, 19 nt, Human
ucuuggcuuugucuacugu

SEQ ID NO: 931033 - RNA, 22 nt, Human
ucaauuuuaugaaacaaaguga

SEQ ID NO: 931034 - RNA, 22 nt, Human
aauagcuuuuacuccuccgagg

SEQ ID NO: 931035 - RNA, 22 nt, Human
aaggcuuugauuccauugcccu

SEQ ID NO: 931036 - RNA, 22 nt, Human
uuccaaauuccaauccccugaa

SEQ ID NO: 931037 - RNA, 22 nt, Human
acacaauggcgugugccacaga

SEQ ID NO: 931038 - RNA, 22 nt, Human
ucuguagcauucaccagcccug

SEQ ID NO: 931039 - RNA, 22 nt, Human
acacacuguaaggacuaucacu

SEQ ID NO: 931040 - RNA, 22 nt, Human
uguguuggcuugccuguuaggc

SEQ ID NO: 931041 - RNA, 22 nt, Human
auuauucaaauucccacuauac

SEQ ID NO: 931042 - RNA, 22 nt, Human
auuucacucucccugccacuua

SEQ ID NO: 931043 - RNA, 22 nt, Human
uuuacaccaaaaugacacagag

SEQ ID NO: 931044 - RNA, 22 nt, Human
auuuguuuaucgucgauuguag

SEQ ID NO: 931045 - RNA, 22 nt, Human
ggcucugcugcacccuuggcuc

SEQ ID NO: 931046 - RNA, 22 nt, Human
ggaaggaagaggaccgagcugg

SEQ ID NO: 931047 - RNA, 22 nt, Human
uucaacagacccuucuuucuuu

SEQ ID NO: 931048 - RNA, 22 nt, Human
uagaaacaaaaucugaugacuc

SEQ ID NO: 931049 - RNA, 22 nt, Human
acacauuuauggaucgcagaaa

SEQ ID NO: 931050 - RNA, 22 nt, Human
ggcuucaccugugcacucuacc

SEQ ID NO: 931051 - RNA, 22 nt, Human
aaaggcaugauuaauucugugu

SEQ ID NO: 931052 - RNA, 22 nt, Human
auuugcaaagguuaacagcagu

SEQ ID NO: 931053 - RNA, 22 nt, Human
ugucuucuguauucaagucuau

SEQ ID NO: 931054 - RNA, 17 nt, Human
uuacacaggagagcucu

SEQ ID NO: 931055 - RNA, 22 nt, Human
cccuggcaaaacacucucuuga

SEQ ID NO: 931056 - RNA, 22 nt, Human
acaaacuaccuacagauguuca

SEQ ID NO: 931057 - RNA, 22 nt, Human
uggcuucucccgacacccuggc

SEQ ID NO: 931058 - RNA, 22 nt, Human
acacaugauaagaaaguuuaaa

SEQ ID NO: 931059 - RNA, 22 nt, Human
uacacaaaggcacucuguuguu

SEQ ID NO: 931060 - RNA, 22 nt, Human
aacacuaaaggucaguuagaag

SEQ ID NO: 931061 - RNA, 22 nt, Human
agaauaaccaguguuucacagu

SEQ ID NO: 931062 - RNA, 22 nt, Human
gauggcuuguuuucuggcugaa

SEQ ID NO: 931063 - RNA, 22 nt, Human
aagagcaucuauuucacagugg

SEQ ID NO: 931064 - RNA, 19 nt, Human
cuguccuuggcugcacugu

SEQ ID NO: 931065 - RNA, 18 nt, Human
uauaaccuguuuugaugg

SEQ ID NO: 931066 - RNA, 22 nt, Human
uguaggaauuccagugacuuca

SEQ ID NO: 931067 - RNA, 22 nt, Human
uuccuuguuuguagcucuggga

SEQ ID NO: 931068 - RNA, 22 nt, Human
cagcagagacgguaagcagaac

SEQ ID NO: 931069 - RNA, 22 nt, Human
ccuucagaaugaaauucuaaug

SEQ ID NO: 931070 - RNA, 22 nt, Human
aaggcuuuaaauaaccguaaag

SEQ ID NO: 931071 - RNA, 22 nt, Human
acagaacaggcugagaaaaaca

SEQ ID NO: 931072 - RNA, 22 nt, Human
uccugaagaaggcagauauuug

SEQ ID NO: 931073 - RNA, 22 nt, Human
aacacagaucaaaauauuuccu

SEQ ID NO: 931074 - RNA, 22 nt, Human
uuacacaauuuuauugaccuaa

SEQ ID NO: 931075 - RNA, 20 nt, Human
uccuucagacgacaagcaag

SEQ ID NO: 931076 - RNA, 22 nt, Human
cuccugcccacgugcuacuucu

SEQ ID NO: 931077 - RNA, 22 nt, Human
uaaccuuuguucaauguaagau

SEQ ID NO: 931078 - RNA, 22 nt, Human
augugcuucaggaugucagugu

SEQ ID NO: 931079 - RNA, 22 nt, Human
cuuucacuuuaaucugacaccu

SEQ ID NO: 931080 - RNA, 22 nt, Human
aauucacaugcaugucugugca

SEQ ID NO: 931081 - RNA, 17 nt, Human
ugagcuucaaucaggug

SEQ ID NO: 931082 - RNA, 22 nt, Human
uggcuuccagagcugcuccacc

SEQ ID NO: 931083 - RNA, 22 nt, Human
uacacuaauguuuuugcaaagc

SEQ ID NO: 931084 - RNA, 22 nt, Human
ugccaagaccacaauugcuuuu

SEQ ID NO: 931085 - RNA, 22 nt, Human
ugugagcacuauggcuaggcuc

SEQ ID NO: 931086 - RNA, 22 nt, Human
acugucuucauaucugugucuc

SEQ ID NO: 931087 - RNA, 21 nt, Human
cucuuuguggcaauguauuuu

SEQ ID NO: 931088 - RNA, 22 nt, Human
aaugguuuugucucaucaaugu

SEQ ID NO: 931089 - RNA, 22 nt, Human
agagaagggggaaagaucucac

SEQ ID NO: 931090 - RNA, 22 nt, Human
aaacaugagcaucucuucaagc

SEQ ID NO: 931091 - RNA, 22 nt, Human
guucucauaguggaaaauaggu

SEQ ID NO: 931092 - RNA, 22 nt, Human
uggcuuaguucuagaaauuugg

SEQ ID NO: 931093 - RNA, 22 nt, Human
ccuguaaguaguuugccugagc

SEQ ID NO: 931094 - RNA, 18 nt, Human
agcaguguggcaagcaga

SEQ ID NO: 931095 - RNA, 22 nt, Human
ugugaaagcaagucuaguucuc

SEQ ID NO: 931096 - RNA, 22 nt, Human
ggaggaggggugacugaaugcu

SEQ ID NO: 931097 - RNA, 21 nt, Human
aagcuucccugcucuccaggg

SEQ ID NO: 931098 - RNA, 22 nt, Human
cagcaguaauuagugcugcaug

SEQ ID NO: 931099 - RNA, 22 nt, Human
augucccagacacuuuaucuua

SEQ ID NO: 931100 - RNA, 22 nt, Human
ugacuuuaaagcucacucuuuu

SEQ ID NO: 931101 - RNA, 22 nt, Human
aaaaaccauugucuucagucuc

SEQ ID NO: 931102 - RNA, 22 nt, Human
acuguuaugauuuacacagucc

SEQ ID NO: 931103 - RNA, 22 nt, Human
ucagagaauguccuucuucauu

SEQ ID NO: 931104 - RNA, 22 nt, Human
uuuaccacagaaaaaaguaacu

SEQ ID NO: 931105 - RNA, 22 nt, Human
cacaaugauuugguucaaaaau

SEQ ID NO: 931106 - RNA, 22 nt, Human
aagcagaaggggaauaauauuu

SEQ ID NO: 931107 - RNA, 22 nt, Human
uggcucuccagcucuaaggccu

SEQ ID NO: 931108 - RNA, 22 nt, Human
cacaugcaggagccaauguaca

SEQ ID NO: 931109 - RNA, 22 nt, Human
ugugccagaauguuuuuauaca

SEQ ID NO: 931110 - RNA, 23 nt, Human
cuguagcuaaaagcugggauuug

SEQ ID NO: 931111 - RNA, 22 nt, Human
caauuagcugguacugacagga

SEQ ID NO: 931112 - RNA, 22 nt, Human
acuguuauguuauuacccaugu

SEQ ID NO: 931113 - RNA, 22 nt, Human
uuuccaaaggaggaaccaguuu

SEQ ID NO: 931114 - RNA, 22 nt, Human
caugcaguugaagcacagagag

SEQ ID NO: 931115 - RNA, 22 nt, Human
uaacacuguccaaagaauucca

SEQ ID NO: 931116 - RNA, 22 nt, Human
uaacuucacuggacucagcagc

SEQ ID NO: 931117 - RNA, 22 nt, Human
cuaaacuuuuauaacauugaga

SEQ ID NO: 931118 - RNA, 22 nt, Human
auacacaugcacacaugugugu

SEQ ID NO: 931119 - RNA, 22 nt, Human
cugucacugaugggcucaccag

SEQ ID NO: 931120 - RNA, 22 nt, Human
agcuucacuuuguacuuuguca

SEQ ID NO: 931121 - RNA, 21 nt, Human
aaacugaccuugccugagaca

SEQ ID NO: 931122 - RNA, 22 nt, Human
uuaggaaaagaagacauuucua

SEQ ID NO: 931123 - RNA, 22 nt, Human
cuuguugggucgugaauucugu

SEQ ID NO: 931124 - RNA, 22 nt, Human
aaauuuuagacuccugggucua

SEQ ID NO: 931125 - RNA, 22 nt, Human
cuagagaaucuuuuaagaagug

SEQ ID NO: 931126 - RNA, 22 nt, Human
uccuggcucugcugccuccuag

SEQ ID NO: 931127 - RNA, 22 nt, Human
auucacaacugauccuugcuca

SEQ ID NO: 931128 - RNA, 22 nt, Human
uucacaaacuucaugauggcac

SEQ ID NO: 931129 - RNA, 22 nt, Human
acauuaagaaacgagagagcaa

SEQ ID NO: 931130 - RNA, 22 nt, Human
auggaaaucagguucauccaag

SEQ ID NO: 931131 - RNA, 23 nt, Human
uucuaaccuuaaagcccuuugga

SEQ ID NO: 931132 - RNA, 22 nt, Human
uuaggaauuuaucacagacugg

SEQ ID NO: 931133 - RNA, 22 nt, Human
uuacacaauauaugguacuugg

SEQ ID NO: 931134 - RNA, 22 nt, Human
ugugcuucucuuucucacuuaa

SEQ ID NO: 931135 - RNA, 22 nt, Human
ugcuuuaccuucccagaaacca

SEQ ID NO: 931136 - RNA, 22 nt, Human
uuacucagucucccauacauug

SEQ ID NO: 931137 - RNA, 22 nt, Human
agaaaucaggaacaguaaggag

SEQ ID NO: 931138 - RNA, 22 nt, Human
ucugugcugcccaacuucucaa

SEQ ID NO: 931139 - RNA, 22 nt, Human
aacacugucagccuuugaugga

SEQ ID NO: 931140 - RNA, 22 nt, Human
uuuuacaccucagaugagcaga

SEQ ID NO: 931141 - RNA, 22 nt, Human
uauggcuucugggccaaauuua

SEQ ID NO: 931142 - RNA, 22 nt, Human
ugaucuuugguaguacgauaau

SEQ ID NO: 931143 - RNA, 22 nt, Human
uucaucugcuucuuccuauucc

SEQ ID NO: 931144 - RNA, 22 nt, Human
uaacuuuaguguaugagguaag

SEQ ID NO: 931145 - RNA, 22 nt, Human
uuuccaaagguggcaggaacaa

SEQ ID NO: 931146 - RNA, 22 nt, Human
ucaaacagaggaacaauuguuu

SEQ ID NO: 931147 - RNA, 22 nt, Human
uacaaagcaaaucaucuaagag

SEQ ID NO: 931148 - RNA, 22 nt, Human
uaucuguuaggaucagagcugg

SEQ ID NO: 931149 - RNA, 22 nt, Human
acacuuuacucuuacaccauug

SEQ ID NO: 931150 - RNA, 22 nt, Human
ucacacauuucucaaguguagg

SEQ ID NO: 931151 - RNA, 22 nt, Human
caucacaccacaggcauuuucu

SEQ ID NO: 931152 - RNA, 19 nt, Human
uaaaucuguauucuucaaa

SEQ ID NO: 931153 - RNA, 22 nt, Human
aaacauguaaguucagaucacc

SEQ ID NO: 931154 - RNA, 22 nt, Human
cagucacugguucuauaggccc

SEQ ID NO: 931155 - RNA, 22 nt, Human
uaacuuuaugacaugucuugcu

SEQ ID NO: 931156 - RNA, 22 nt, Human
agacaauuuuugguuuugcaag

SEQ ID NO: 931157 - RNA, 22 nt, Human
aucuuugucacucuacugucua

SEQ ID NO: 931158 - RNA, 22 nt, Human
aauggcuuucagcaaggauaga

SEQ ID NO: 931159 - RNA, 22 nt, Human
cacauuuagguuccuauagcca

SEQ ID NO: 931160 - RNA, 19 nt, Human
aaaccuguuaguagagcac

SEQ ID NO: 931161 - RNA, 22 nt, Human
uuguacacacaggaacaaacgu

SEQ ID NO: 931162 - RNA, 23 nt, Human
acaugauacacaauuagcaaacc

SEQ ID NO: 931163 - RNA, 22 nt, Human
aucugucuaugauauagucugu

SEQ ID NO: 931164 - RNA, 22 nt, Human
aaccuguaaauccaaacaaucu

SEQ ID NO: 931165 - RNA, 22 nt, Human
cagucuucuaaccuagcagccu

SEQ ID NO: 931166 - RNA, 22 nt, Human
uuaugcaaagaaauagacuaau

SEQ ID NO: 931167 - RNA, 22 nt, Human
cccuucaggguuaaguagaggg

SEQ ID NO: 931168 - RNA, 21 nt, Human
agcauucaaaagaugccauaa

SEQ ID NO: 931169 - RNA, 19 nt, Human
aaguucucagaguucaaag

SEQ ID NO: 931170 - RNA, 22 nt, Human
ggcuucuccagguacugagcau

SEQ ID NO: 931171 - RNA, 22 nt, Human
uggcuucuuuccacuguccugu

SEQ ID NO: 931172 - RNA, 22 nt, Human
uauggcuuugaaagggcuuuuc

SEQ ID NO: 931173 - RNA, 22 nt, Human
aguaaacacgugggguuucuuu

SEQ ID NO: 931174 - RNA, 22 nt, Human
ucagaacaguucuuaauauugc

SEQ ID NO: 931175 - RNA, 22 nt, Human
uauggcuuuucuuccuccccca

SEQ ID NO: 931176 - RNA, 22 nt, Human
ggcucugcuucucaccuguucc

SEQ ID NO: 931177 - RNA, 22 nt, Human
auuccacagcuacguuuugagc

SEQ ID NO: 931178 - RNA, 22 nt, Human
uuucacacaacgugaauauacu

SEQ ID NO: 931179 - RNA, 22 nt, Human
ucugaguuuaggaccaggcuga

SEQ ID NO: 931180 - RNA, 22 nt, Human
gaacuuuaggauuuucacaggu

SEQ ID NO: 931181 - RNA, 22 nt, Human
cuugcuuuaucugguuucucau

SEQ ID NO: 931182 - RNA, 22 nt, Human
uuuuauauggcacauugguugg

SEQ ID NO: 931183 - RNA, 22 nt, Human
agguggcucugacagcucuggu

SEQ ID NO: 931184 - RNA, 22 nt, Human
ucacagcaguaaagaaaacacu

SEQ ID NO: 931185 - RNA, 22 nt, Human
cagcauuguaagaaugaagacc

SEQ ID NO: 931186 - RNA, 22 nt, Human
uaaucuguaauuuuugcaauag

SEQ ID NO: 931187 - RNA, 22 nt, Human
uacauuuacagagccuucucug

SEQ ID NO: 931188 - RNA, 22 nt, Human
acugugcuaucuacugaauuau

SEQ ID NO: 931189 - RNA, 22 nt, Human
ugagaauuugcauuucuaacaa

SEQ ID NO: 931190 - RNA, 21 nt, Human
ugguaauguucaguauccacu

SEQ ID NO: 931191 - RNA, 22 nt, Human
gugcuuggcuuggugugaccug

SEQ ID NO: 931192 - RNA, 22 nt, Human
uguuggaaaggccaggcugugg

SEQ ID NO: 931193 - RNA, 22 nt, Human
auuacacaggcuggcucuuuga

SEQ ID NO: 931194 - RNA, 22 nt, Human
uacacaugaucauuuaguagca

SEQ ID NO: 931195 - RNA, 22 nt, Human
cauggcuuuuuagcauauucaa

SEQ ID NO: 931196 - RNA, 22 nt, Human
ugaaggaaagagggaacauccc

SEQ ID NO: 931197 - RNA, 22 nt, Human
auucacaauagcagcuugcaug

SEQ ID NO: 931198 - RNA, 22 nt, Human
aaacaugaugucauauaugcca

SEQ ID NO: 931199 - RNA, 22 nt, Human
acuuuacaggcacuucaaguau

SEQ ID NO: 931200 - RNA, 22 nt, Human
caaucacaaagagacaaguguc

SEQ ID NO: 931201 - RNA, 22 nt, Human
gcagagaaaguuuuguccucag

SEQ ID NO: 931202 - RNA, 22 nt, Human
ucuucucuccugcuuggcagaa

SEQ ID NO: 931203 - RNA, 22 nt, Human
uuuaucucuuuugaccaagauu

SEQ ID NO: 931204 - RNA, 21 nt, Human
gcucuggccuacuguucccuc

SEQ ID NO: 931205 - RNA, 22 nt, Human
aauaacagagucuucaagauag

SEQ ID NO: 931206 - RNA, 22 nt, Human
uaacaguauugaagauaaacua

SEQ ID NO: 931207 - RNA, 22 nt, Human
ccacuguuuuucaguuaacuuu

SEQ ID NO: 931208 - RNA, 22 nt, Human
caucuguuuuugucaauuacau

SEQ ID NO: 931209 - RNA, 22 nt, Human
uauuacaauuuacauugcacuu

SEQ ID NO: 931210 - RNA, 22 nt, Human
guccaaauuccacagauuucuc

SEQ ID NO: 931211 - RNA, 18 nt, Human
guuuacacauucuagaaa

SEQ ID NO: 931212 - RNA, 22 nt, Human
cuggcuuccaugcuguaguggc

SEQ ID NO: 931213 - RNA, 22 nt, Human
uagaaacauauguuugagacau

SEQ ID NO: 931214 - RNA, 22 nt, Human
uacagcaugaucacaauggaaa

SEQ ID NO: 931215 - RNA, 21 nt, Human
gagaaucaggaaggauugaug

SEQ ID NO: 931216 - RNA, 22 nt, Human
aacaguaucuacgggaacuauu

SEQ ID NO: 931217 - RNA, 22 nt, Human
ucugugcucaaguucugccucu

SEQ ID NO: 931218 - RNA, 23 nt, Human
ucauuucauccagccuugagagu

SEQ ID NO: 931219 - RNA, 22 nt, Human
gccuucaggugcugccaggcua

SEQ ID NO: 931220 - RNA, 22 nt, Human
aguugcagccuucaggagaccc

SEQ ID NO: 931221 - RNA, 16 nt, Human
auucacaaggcaucgg

SEQ ID NO: 931222 - RNA, 22 nt, Human
cccugugcacacacuucacucu

SEQ ID NO: 931223 - RNA, 22 nt, Human
aacacaugaaaguuggugagua

SEQ ID NO: 931224 - RNA, 22 nt, Human
uagcaaauacaugauguaauuu

SEQ ID NO: 931225 - RNA, 22 nt, Human
uuuaucugcauucugaccaucu

SEQ ID NO: 931226 - RNA, 22 nt, Human
accugauauguuugaucacccu

SEQ ID NO: 931227 - RNA, 22 nt, Human
aauggcuucaugucuguggaaa

SEQ ID NO: 931228 - RNA, 22 nt, Human
uuuagucagguaagaugcaggg

SEQ ID NO: 931229 - RNA, 22 nt, Human
gcagcgagugcggcugccacag

SEQ ID NO: 931230 - RNA, 22 nt, Human
cugccaccaugccccagcagag

SEQ ID NO: 931231 - RNA, 22 nt, Human
ucccuaaacucugaacugauuc

SEQ ID NO: 931232 - RNA, 20 nt, Human
auagacaaagacaugccaga

SEQ ID NO: 931233 - RNA, 22 nt, Human
aaaaccaaguuuuccuuagucu

SEQ ID NO: 931234 - RNA, 22 nt, Human
gaaugucuucuguucccagcug

SEQ ID NO: 931235 - RNA, 22 nt, Human
ggagcaucugaacagggagaag

SEQ ID NO: 931236 - RNA, 22 nt, Human
uucacccuggaccagaaauugg

SEQ ID NO: 931237 - RNA, 22 nt, Human
gacacaugucagacggacaccc

SEQ ID NO: 931238 - RNA, 22 nt, Human
uacacagggagagauuggaaac

SEQ ID NO: 931239 - RNA, 22 nt, Human
guuguacaauuguuucacaugc

SEQ ID NO: 931240 - RNA, 22 nt, Human
ccugcucaccugauguggcaac

SEQ ID NO: 931241 - RNA, 22 nt, Human
acaugucuuguggcuuugaucu

SEQ ID NO: 931242 - RNA, 22 nt, Human
caguaugacuacaaacagcuuu

SEQ ID NO: 931243 - RNA, 22 nt, Human
aaaccuguagcaguuuguuaca

SEQ ID NO: 931244 - RNA, 22 nt, Human
aagcuucagugugagcauguaa

SEQ ID NO: 931245 - RNA, 22 nt, Human
uauggcuuuucauuccuaugug

SEQ ID NO: 931246 - RNA, 22 nt, Human
auggcucuugaauugauacucu

SEQ ID NO: 931247 - RNA, 22 nt, Human
uuggcaauggaccagccacugg

SEQ ID NO: 931248 - RNA, 20 nt, Human
uuacacuuuguagcauuuuu

SEQ ID NO: 931249 - RNA, 22 nt, Human
ggucacaagguacuguaagaaa

SEQ ID NO: 931250 - RNA, 22 nt, Human
uaaacaugugagugugcauaua

SEQ ID NO: 931251 - RNA, 21 nt, Human
accuucaguguucucagcugc

SEQ ID NO: 931252 - RNA, 22 nt, Human
ucagagaacugcagcccuuccu

SEQ ID NO: 931253 - RNA, 22 nt, Human
acagauauaugauuguguaaau

SEQ ID NO: 931254 - RNA, 18 nt, Human
uuauggcugugaaagagu

SEQ ID NO: 931255 - RNA, 22 nt, Human
augaaacaaggguauuuucucu

SEQ ID NO: 931256 - RNA, 22 nt, Human
acagcagugcacagagaacccu

SEQ ID NO: 931257 - RNA, 22 nt, Human
uuaugaaaacaaucaguaggca

SEQ ID NO: 931258 - RNA, 22 nt, Human
cauggcuuuugcuuuugcccau

SEQ ID NO: 931259 - RNA, 22 nt, Human
cuuaaucucaccugcaaagucc

SEQ ID NO: 931260 - RNA, 22 nt, Human
aaauguaagucuuuguuucuua

SEQ ID NO: 931261 - RNA, 22 nt, Human
auggcuuugaaguucagcuuuu

SEQ ID NO: 931262 - RNA, 22 nt, Human
uuaagagaagaguaucuagaac

SEQ ID NO: 931263 - RNA, 22 nt, Human
uuccagaacaauguggacguau

SEQ ID NO: 931264 - RNA, 22 nt, Human
acuucacagguuuucauaaaac

SEQ ID NO: 931265 - RNA, 22 nt, Human
agcaaucagcuucuuuguguuu

SEQ ID NO: 931266 - RNA, 22 nt, Human
auaacccucuggauaggacagg

SEQ ID NO: 931267 - RNA, 22 nt, Human
gacauuuaaggcagucacuuaa

SEQ ID NO: 931268 - RNA, 22 nt, Human
guacacauauuuccaaggguaa

SEQ ID NO: 931269 - RNA, 22 nt, Human
agucagacauaauucuaacauu

SEQ ID NO: 931270 - RNA, 22 nt, Human
gcuuggcuuugucuuguucacu

SEQ ID NO: 931271 - RNA, 23 nt, Human
aaaugacauaugguuucugaagg

SEQ ID NO: 931272 - RNA, 22 nt, Human
acagaugaauuuuaauuguguu

SEQ ID NO: 931273 - RNA, 22 nt, Human
gacuucacaauaaugugacacu

SEQ ID NO: 931274 - RNA, 22 nt, Human
accuuuauagcugauuaugaca

SEQ ID NO: 931275 - RNA, 22 nt, Human
aucuuuguuuugaugcagaucu

SEQ ID NO: 931276 - RNA, 22 nt, Human
ccacccuguguuuuugccauug

SEQ ID NO: 931277 - RNA, 22 nt, Human
ugcuuggcuuucugagcuucug

SEQ ID NO: 931278 - RNA, 22 nt, Human
gacauuaauuucuuugguaauu

SEQ ID NO: 931279 - RNA, 22 nt, Human
cagcaguuaugaguagaauagu

SEQ ID NO: 931280 - RNA, 23 nt, Human
gccuucagcucgggaaggcuccc

SEQ ID NO: 931281 - RNA, 20 nt, Human
aacacugugcgugguaggug

SEQ ID NO: 931282 - RNA, 22 nt, Human
uuuagcaauuauuaaggguuga

SEQ ID NO: 931283 - RNA, 20 nt, Human
ugagcuucagauaucgugca

SEQ ID NO: 931284 - RNA, 22 nt, Human
cugagcucagucccagcucuac

SEQ ID NO: 931285 - RNA, 22 nt, Human
cauggcuuuuuuauucugaaug

SEQ ID NO: 931286 - RNA, 23 nt, Human
gcucugccacuuaauagcugugu

SEQ ID NO: 931287 - RNA, 23 nt, Human
uuacuuuugcaccaaccuaauau

SEQ ID NO: 931288 - RNA, 22 nt, Human
uuuacacauuauuuucagugug

SEQ ID NO: 931289 - RNA, 22 nt, Human
caagcagaaaucuagaacucca

SEQ ID NO: 931290 - RNA, 22 nt, Human
auagcaauuaagcuccagaauu

SEQ ID NO: 931291 - RNA, 22 nt, Human
uaacuuucacaucacacugacu

SEQ ID NO: 931292 - RNA, 22 nt, Human
guagcagcagagcagguccucc

SEQ ID NO: 931293 - RNA, 22 nt, Human
uuagcacuggauuucaucagaa

SEQ ID NO: 931294 - RNA, 22 nt, Human
uggcuucuuugugacagcucuu

SEQ ID NO: 931295 - RNA, 22 nt, Human
acacaggagauauguaauggcu

SEQ ID NO: 931296 - RNA, 22 nt, Human
cuucccauauaacuaauuucug

SEQ ID NO: 931297 - RNA, 22 nt, Human
ggcugcuccuuuacccuggcag

SEQ ID NO: 931298 - RNA, 22 nt, Human
uccugaagccugagugaugacu

SEQ ID NO: 931299 - RNA, 22 nt, Human
uuuucugaccuaucuacauuua

SEQ ID NO: 931300 - RNA, 22 nt, Human
acauguguacauauauaugugc

SEQ ID NO: 931301 - RNA, 22 nt, Human
cauggcuugcuaguggcccaag

SEQ ID NO: 931302 - RNA, 20 nt, Human
uuuuagcacuuguuauggug

SEQ ID NO: 931303 - RNA, 22 nt, Human
ggaauacuaugacacacaggug

SEQ ID NO: 931304 - RNA, 22 nt, Human
aauagcauguucaugauaaaau

SEQ ID NO: 931305 - RNA, 23 nt, Human
ugauuacaggaaguucaaguguu

SEQ ID NO: 931306 - RNA, 23 nt, Human
guacacauaguguaguuauauuu

SEQ ID NO: 931307 - RNA, 22 nt, Human
agcuuccuugaauucuguagaa

SEQ ID NO: 931308 - RNA, 22 nt, Human
uucagaguacacagagaucuuc

SEQ ID NO: 931309 - RNA, 22 nt, Human
uuuauacauggagaauuuuugc

SEQ ID NO: 931310 - RNA, 22 nt, Human
acaauuagugaucagugaugcc

SEQ ID NO: 931311 - RNA, 22 nt, Human
ugacuucucuggccuggugcag

SEQ ID NO: 931312 - RNA, 22 nt, Human
uuauuacacugaaagaauugcg

SEQ ID NO: 931313 - RNA, 22 nt, Human
accacagaggaauuugaagagg

SEQ ID NO: 931314 - RNA, 22 nt, Human
cagauguacaugaagggcaaug

SEQ ID NO: 931315 - RNA, 20 nt, Human
guacacauauauguaugugu

SEQ ID NO: 931316 - RNA, 22 nt, Human
aguaaacugugugccuuugacu

SEQ ID NO: 931317 - RNA, 22 nt, Human
acuuuacaagcuuauagccuag

SEQ ID NO: 931318 - RNA, 22 nt, Human
auugaguacuuagugucauaua

SEQ ID NO: 931319 - RNA, 22 nt, Human
ucugcuuuagaauccaguagcu

SEQ ID NO: 931320 - RNA, 22 nt, Human
ugcagauucaaaugaaaugcaa

SEQ ID NO: 931321 - RNA, 22 nt, Human
uuuuauugucucccaguucugg

SEQ ID NO: 931322 - RNA, 22 nt, Human
auuucaacguuagauguaauag

SEQ ID NO: 931323 - RNA, 22 nt, Human
auuucacagcugucaguguuac

SEQ ID NO: 931324 - RNA, 22 nt, Human
aacacaugccuuaagaauaagu

SEQ ID NO: 931325 - RNA, 22 nt, Human
acuuuacaaacuccucacuguu

SEQ ID NO: 931326 - RNA, 22 nt, Human
cacauuuacuuuuaucccuugg

SEQ ID NO: 931327 - RNA, 19 nt, Human
uucacauuuuuguggcacu

SEQ ID NO: 931328 - RNA, 22 nt, Human
uggcuucugcauauuuuuagag

SEQ ID NO: 931329 - RNA, 22 nt, Human
gaugucuuugaggcucacugcu

SEQ ID NO: 931330 - RNA, 22 nt, Human
caguuuaguguugcauuuggag

SEQ ID NO: 931331 - RNA, 22 nt, Human
uuuaucuguuguacauuuaugc

SEQ ID NO: 931332 - RNA, 18 nt, Human
ucacagaauauugagugg

SEQ ID NO: 931333 - RNA, 22 nt, Human
aaaggcaugccuccauuucuau

SEQ ID NO: 931334 - RNA, 23 nt, Human
aguucucauucaucacggccuau

SEQ ID NO: 931335 - RNA, 22 nt, Human
cacagcauugccuuccaaaagg

SEQ ID NO: 931336 - RNA, 22 nt, Human
auggucuuaggguaggcagcug

SEQ ID NO: 931337 - RNA, 22 nt, Human
auuauucagucuuguaaggagu

SEQ ID NO: 931338 - RNA, 22 nt, Human
uuuauaucuuaugucauuucaa

SEQ ID NO: 931339 - RNA, 22 nt, Human
auagcaauuugcccaauuaccu

SEQ ID NO: 931340 - RNA, 22 nt, Human
aagaacaugaaccucuucuaac

SEQ ID NO: 931341 - RNA, 20 nt, Human
ugccuuuccuguuucaucuu

SEQ ID NO: 931342 - RNA, 22 nt, Human
ucuggcuccugaguccaugcuc

SEQ ID NO: 931343 - RNA, 22 nt, Human
cucuguugagcauuuuuccccu

SEQ ID NO: 931344 - RNA, 22 nt, Human
ucccugcccugccuucaugguu

SEQ ID NO: 931345 - RNA, 22 nt, Human
aacacuguggucuuuucaguaa

SEQ ID NO: 931346 - RNA, 22 nt, Human
uggaccaugagcugcagguguu

SEQ ID NO: 931347 - RNA, 19 nt, Human
auggaaaaugccagacuga

SEQ ID NO: 931348 - RNA, 22 nt, Human
uggcuucucccuccccaucuag

SEQ ID NO: 931349 - RNA, 22 nt, Human
aaugcuucaaccucccacaugu

SEQ ID NO: 931350 - RNA, 22 nt, Human
augcgcuuugugugaagcagug

SEQ ID NO: 931351 - RNA, 22 nt, Human
auucauuccaggucagucagac

SEQ ID NO: 931352 - RNA, 22 nt, Human
uaaaugagauguacauaacuca

SEQ ID NO: 931353 - RNA, 22 nt, Human
aucugaguguuggauuuauugu

SEQ ID NO: 931354 - RNA, 22 nt, Human
acuggcuugaaguagauucaaa

SEQ ID NO: 931355 - RNA, 22 nt, Human
ucuuuguaagacauguaagucc

SEQ ID NO: 931356 - RNA, 22 nt, Human
uccuucagcuuguuagagugac

SEQ ID NO: 931357 - RNA, 22 nt, Human
uauggcuugucccuggucaguc

SEQ ID NO: 931358 - RNA, 22 nt, Human
acacacugagugccauaggacc

SEQ ID NO: 931359 - RNA, 22 nt, Human
ugcauuuacgguacaacagcag

SEQ ID NO: 931360 - RNA, 22 nt, Human
aauagcauguaaguuuaaaaga

SEQ ID NO: 931361 - RNA, 18 nt, Human
cugcuugggagacgucag

SEQ ID NO: 931362 - RNA, 22 nt, Human
acccuguauacgcuacauuuuu

SEQ ID NO: 931363 - RNA, 22 nt, Human
uacacuuguucaaacagcaaaa

SEQ ID NO: 931364 - RNA, 22 nt, Human
auauuguguguacaaguaguua

SEQ ID NO: 931365 - RNA, 22 nt, Human
agaaaugugagccccuuaucaa

SEQ ID NO: 931366 - RNA, 22 nt, Human
auucagucaaaccacuggucau

SEQ ID NO: 931367 - RNA, 22 nt, Human
gccuucaggaggguuccagaca

SEQ ID NO: 931368 - RNA, 22 nt, Human
uuauucagugcauauauuaaaa

SEQ ID NO: 931369 - RNA, 22 nt, Human
uuccuuguggaaacuauggacg

SEQ ID NO: 931370 - RNA, 22 nt, Human
agcacaugacuuuuagucgagu

SEQ ID NO: 931371 - RNA, 22 nt, Human
caaugcuucaggcuccuuauag

SEQ ID NO: 931372 - RNA, 22 nt, Human
ccuaacuuuaaugggaccagga

SEQ ID NO: 931373 - RNA, 22 nt, Human
aucacacuguuauuuuaguuaa

SEQ ID NO: 931374 - RNA, 22 nt, Human
uuccagaaaguucuggaacugg

SEQ ID NO: 931375 - RNA, 22 nt, Human
uuaaauuagucaagcuucucug

SEQ ID NO: 931376 - RNA, 22 nt, Human
cacuccuguuccacuaaaugag

SEQ ID NO: 931377 - RNA, 22 nt, Human
agaucagaaagccaauaucaua

SEQ ID NO: 931378 - RNA, 22 nt, Human
gaguagacauuaaauuacacug

SEQ ID NO: 931379 - RNA, 22 nt, Human
cagagaaagggugaauuccuuc

SEQ ID NO: 931380 - RNA, 22 nt, Human
acacaugaggaugaggggauca

SEQ ID NO: 931381 - RNA, 22 nt, Human
acaggacaaggggaagaagaua

SEQ ID NO: 931382 - RNA, 22 nt, Human
acauuuacccuggaacauugga

SEQ ID NO: 931383 - RNA, 20 nt, Human
uacuguuguugcuguugcca

SEQ ID NO: 931384 - RNA, 22 nt, Human
auaacuucaguuucuguguccu

SEQ ID NO: 931385 - RNA, 22 nt, Human
cucuuuguagccuuugcauauu

SEQ ID NO: 931386 - RNA, 22 nt, Human
uagugaaaccugacagaucaug

SEQ ID NO: 931387 - RNA, 22 nt, Human
aauggcuuuuaaaaauagcauu

SEQ ID NO: 931388 - RNA, 22 nt, Human
augcuucuccugaacaucccug

SEQ ID NO: 931389 - RNA, 22 nt, Human
aacacugucuuauacuucaaug

SEQ ID NO: 931390 - RNA, 22 nt, Human
uauuccaacuucacuauugucu

SEQ ID NO: 931391 - RNA, 22 nt, Human
uaugaaaagguggccaauguag

SEQ ID NO: 931392 - RNA, 18 nt, Human
uggcuucugaacaacugc

SEQ ID NO: 931393 - RNA, 22 nt, Human
aucacagauugugaauaacuau

SEQ ID NO: 931394 - RNA, 22 nt, Human
uggcuucucagaauacucugga

SEQ ID NO: 931395 - RNA, 20 nt, Human
acacuguucuucacacauuu

SEQ ID NO: 931396 - RNA, 23 nt, Human
uaguuacauuauugucagagcug

SEQ ID NO: 931397 - RNA, 22 nt, Human
ugucaacagauacuagagagcu

SEQ ID NO: 931398 - RNA, 22 nt, Human
ucacagcagaauuuaggaggca

SEQ ID NO: 931399 - RNA, 22 nt, Human
guaaccugggauguagcacaga

SEQ ID NO: 931400 - RNA, 22 nt, Human
uguugguaaauagcuuagcaau

SEQ ID NO: 931401 - RNA, 22 nt, Human
ucccauguguuccucuagucua

SEQ ID NO: 931402 - RNA, 22 nt, Human
cacaugaagauucaacuggaug

SEQ ID NO: 931403 - RNA, 22 nt, Human
acugugaaucacuacuaguaga

SEQ ID NO: 931404 - RNA, 22 nt, Human
uucuccugcccuuggacuucca

SEQ ID NO: 931405 - RNA, 22 nt, Human
uaagcaaauaaugcaucaaggg

SEQ ID NO: 931406 - RNA, 22 nt, Human
ugugcuaaguauuuucuuauuu

SEQ ID NO: 931407 - RNA, 22 nt, Human
ugagucacagccuugccuuggu

SEQ ID NO: 931408 - RNA, 22 nt, Human
uuucucugugccauuuccauaa

SEQ ID NO: 931409 - RNA, 22 nt, Human
gcuuuacaugauuucucacccu

SEQ ID NO: 931410 - RNA, 22 nt, Human
cucacagagccucugugucuuc

SEQ ID NO: 931411 - RNA, 22 nt, Human
augugaaaaauuucuuauuaca

SEQ ID NO: 931412 - RNA, 22 nt, Human
uggcuccuucauucuccugcca

SEQ ID NO: 931413 - RNA, 22 nt, Human
acaagguuuaaauagccaucag

SEQ ID NO: 931414 - RNA, 22 nt, Human
uauacacauuuuuaccuauagu

SEQ ID NO: 931415 - RNA, 22 nt, Human
aagaaauaagacuucucugucc

SEQ ID NO: 931416 - RNA, 22 nt, Human
acuaaauacacacauuuguuca

SEQ ID NO: 931417 - RNA, 22 nt, Human
acacuguuccacacuaagaagg

SEQ ID NO: 931418 - RNA, 22 nt, Human
uagacaaucucagcaaacacac

SEQ ID NO: 931419 - RNA, 22 nt, Human
uguuuacagcugaucaggcauc

SEQ ID NO: 931420 - RNA, 20 nt, Human
ccugugcuuaucacuugcug

SEQ ID NO: 931421 - RNA, 22 nt, Human
ucaguuuaagaugacuaacaau

SEQ ID NO: 931422 - RNA, 22 nt, Human
aaugguuucaaacacacuaagu

SEQ ID NO: 931423 - RNA, 22 nt, Human
gacauuaaaugucuuaguugcc

SEQ ID NO: 931424 - RNA, 22 nt, Human
caguuuaguaggugauaucaau

SEQ ID NO: 931425 - RNA, 22 nt, Human
acagucuuuagaguauuguccu

SEQ ID NO: 931426 - RNA, 22 nt, Human
uauuaugagccaggugcugucu

SEQ ID NO: 931427 - RNA, 22 nt, Human
uaacauuagguagacauaagcc

SEQ ID NO: 931428 - RNA, 22 nt, Human
auuucagaauguccuaauuuag

SEQ ID NO: 931429 - RNA, 22 nt, Human
uaacauguuaagaaauuagaua

SEQ ID NO: 931430 - RNA, 23 nt, Human
ucuaaaauucaucauuuacguuc

SEQ ID NO: 931431 - RNA, 22 nt, Human
uuacaauuacuugaucucagcu

SEQ ID NO: 931432 - RNA, 22 nt, Human
uugcagagaucagcagguuuga

SEQ ID NO: 931433 - RNA, 22 nt, Human
uagaaacagaaaacuguaauag

SEQ ID NO: 931434 - RNA, 22 nt, Human
caaccaguagcugaguucaaaa

SEQ ID NO: 931435 - RNA, 22 nt, Human
aacauaauguggccaaagucac

SEQ ID NO: 931436 - RNA, 22 nt, Human
aaugguuugauggacaaaauga

SEQ ID NO: 931437 - RNA, 22 nt, Human
aguaacaggguauuuguguggg

SEQ ID NO: 931438 - RNA, 22 nt, Human
uuuccccagguagauagauaau

SEQ ID NO: 931439 - RNA, 22 nt, Human
uuacagagcucauuucuaaggg

SEQ ID NO: 931440 - RNA, 22 nt, Human
cuuucaacuacauacaggcgau

SEQ ID NO: 931441 - RNA, 21 nt, Human
ugcuuugcucguucccagagu

SEQ ID NO: 931442 - RNA, 22 nt, Human
auaaauucucugauguauagua

SEQ ID NO: 931443 - RNA, 22 nt, Human
uugcuaacgcucacccuuugcc

SEQ ID NO: 931444 - RNA, 22 nt, Human
auaauguugaugauugucuuug

SEQ ID NO: 931445 - RNA, 22 nt, Human
agauggcugggcucguccgcag

SEQ ID NO: 931446 - RNA, 22 nt, Human
caugagaaguggccuucaaaaa

SEQ ID NO: 931447 - RNA, 22 nt, Human
gcuucacaggcaaguuaagccu

SEQ ID NO: 931448 - RNA, 21 nt, Human
ccuucuccauuacaguaagcu

SEQ ID NO: 931449 - RNA, 21 nt, Human
acauguaagagaguuucaaga

SEQ ID NO: 931450 - RNA, 22 nt, Human
ucuuggcuacuuuccugucugc

SEQ ID NO: 931451 - RNA, 22 nt, Human
ucacagaauaaauguacuggcc

SEQ ID NO: 931452 - RNA, 22 nt, Human
aaucuguuuaacagauuucugu

SEQ ID NO: 931453 - RNA, 22 nt, Human
cacacugucuuuaugagcugua

SEQ ID NO: 931454 - RNA, 22 nt, Human
uuacacaaaagcaagugugugu

SEQ ID NO: 931455 - RNA, 22 nt, Human
aagauaauguucuagcugucag

SEQ ID NO: 931456 - RNA, 22 nt, Human
uccugaaggagcaguugcuggg

SEQ ID NO: 931457 - RNA, 22 nt, Human
uaaccugcugugcuggucaguc

SEQ ID NO: 931458 - RNA, 22 nt, Human
uucaauucuaaacuaauauucu

SEQ ID NO: 931459 - RNA, 22 nt, Human
uauggcuuuuggcuucucucug

SEQ ID NO: 931460 - RNA, 22 nt, Human
uuacacaucuagacccauuuuu

SEQ ID NO: 931461 - RNA, 22 nt, Human
agaaacauccugcuuuccauuu

SEQ ID NO: 931462 - RNA, 22 nt, Human
acagcaugucuaguuaaauacu

SEQ ID NO: 931463 - RNA, 22 nt, Human
aaaaaccuuucauugcaaaugu

SEQ ID NO: 931464 - RNA, 22 nt, Human
gccuucagcggccgcucgcugc

SEQ ID NO: 931465 - RNA, 22 nt, Human
agacuguacuuucugcagcucu

SEQ ID NO: 931466 - RNA, 22 nt, Human
aagcaucuccucaucauuuggg

SEQ ID NO: 931467 - RNA, 22 nt, Human
ugacaauggguggacaagauag

SEQ ID NO: 931468 - RNA, 22 nt, Human
auacacauuacuuucugucuga

SEQ ID NO: 931469 - RNA, 22 nt, Human
acauuuaaguuaaaaccucagu

SEQ ID NO: 931470 - RNA, 22 nt, Human
gagcuucagcgugugcuaaggg

SEQ ID NO: 931471 - RNA, 22 nt, Human
auuguagcccaugcauaaaccg

SEQ ID NO: 931472 - RNA, 22 nt, Human
cuuucccacgcaguggaugaga

SEQ ID NO: 931473 - RNA, 22 nt, Human
ucuggcuccacaccucacugca

SEQ ID NO: 931474 - RNA, 20 nt, Human
aucagacuugcauuucagga

SEQ ID NO: 931475 - RNA, 22 nt, Human
uuuauugaacacuugcacuggc

SEQ ID NO: 931476 - RNA, 22 nt, Human
cagagaaacucagauagcugau

SEQ ID NO: 931477 - RNA, 22 nt, Human
uagauguuuuaacucuugguua

SEQ ID NO: 931478 - RNA, 22 nt, Human
gauggcuuccuucucacugugu

SEQ ID NO: 931479 - RNA, 22 nt, Human
gaacacaagcguaugucuuugu

SEQ ID NO: 931480 - RNA, 22 nt, Human
uuuccaaaguugccauaagcuu

SEQ ID NO: 931481 - RNA, 22 nt, Human
gcaguacuuuaagggaugaagc

SEQ ID NO: 931482 - RNA, 22 nt, Human
aacauuuauucuaauucuggga

SEQ ID NO: 931483 - RNA, 22 nt, Human
cacagugacuggcacauaguaa

SEQ ID NO: 931484 - RNA, 22 nt, Human
cauggcuucgucacagagggca

SEQ ID NO: 931485 - RNA, 22 nt, Human
cuguagcugacaggaucacuua

SEQ ID NO: 931486 - RNA, 22 nt, Human
aguuacaaccaugacacaagca

SEQ ID NO: 931487 - RNA, 19 nt, Human
uuaggaaaccacuuuccuu

SEQ ID NO: 931488 - RNA, 22 nt, Human
ucacaugaguauuauuuuccaa

SEQ ID NO: 931489 - RNA, 22 nt, Human
augaguucauugcauuugacag

SEQ ID NO: 931490 - RNA, 22 nt, Human
cauuuagucaaggacacguggc

SEQ ID NO: 931491 - RNA, 22 nt, Human
ugaaacagucuccagacuugga

SEQ ID NO: 931492 - RNA, 22 nt, Human
acuuuacagaugguuuccugac

SEQ ID NO: 931493 - RNA, 22 nt, Human
ucccugccucucagacuuccuu

SEQ ID NO: 931494 - RNA, 22 nt, Human
uaaucuguugacuaacuuggga

SEQ ID NO: 931495 - RNA, 22 nt, Human
acauuuaccuaguuaagucaau

SEQ ID NO: 931496 - RNA, 22 nt, Human
ugucuucuaccuugacagcauu

SEQ ID NO: 931497 - RNA, 22 nt, Human
cacacuuuguugaaguuuucau

SEQ ID NO: 931498 - RNA, 22 nt, Human
ucagagaaggcugagucacggc

SEQ ID NO: 931499 - RNA, 22 nt, Human
uggcuucuagagcccauccuuc

SEQ ID NO: 931500 - RNA, 22 nt, Human
auacagaagaacuauagccacu

SEQ ID NO: 931501 - RNA, 22 nt, Human
agaaaucugacugcugugcaca

SEQ ID NO: 931502 - RNA, 23 nt, Human
ccugacacaaaaggauucuugcu

SEQ ID NO: 931503 - RNA, 22 nt, Human
aaucuguugucaggaauccaca

SEQ ID NO: 931504 - RNA, 22 nt, Human
accugucugggcuacauuugca

SEQ ID NO: 931505 - RNA, 22 nt, Human
uuacacuuaucuagagccaugg

SEQ ID NO: 931506 - RNA, 20 nt, Human
ucacaugagcuggggcaggc

SEQ ID NO: 931507 - RNA, 22 nt, Human
uuugagcagagaaaggacauga

SEQ ID NO: 931508 - RNA, 20 nt, Human
uuuaccaacucaccaguauc

SEQ ID NO: 931509 - RNA, 22 nt, Human
acuaaauagccucugguaguug

SEQ ID NO: 931510 - RNA, 22 nt, Human
uccccagaggaauaugagauug

SEQ ID NO: 931511 - RNA, 22 nt, Human
uccuucaguuaaagaucucaca

SEQ ID NO: 931512 - RNA, 22 nt, Human
auuuacacuugguuuacuagag

SEQ ID NO: 931513 - RNA, 22 nt, Human
uacacuaaaucuucaucuuuua

SEQ ID NO: 931514 - RNA, 19 nt, Human
ucagacugaaaguuuagau

SEQ ID NO: 931515 - RNA, 22 nt, Human
ugcuugacuuugucacagcaug

SEQ ID NO: 931516 - RNA, 22 nt, Human
auuauucaacacuugagaaauu

SEQ ID NO: 931517 - RNA, 22 nt, Human
auggcuucuagcauugucacaa

SEQ ID NO: 931518 - RNA, 22 nt, Human
cuuuaccagauuccauugcaag

SEQ ID NO: 931519 - RNA, 22 nt, Human
cuuuccugaaaucucuucugca

SEQ ID NO: 931520 - RNA, 22 nt, Human
uucuacauauauuuuucucacu

SEQ ID NO: 931521 - RNA, 22 nt, Human
ugagaauucuacaauagaucaa

SEQ ID NO: 931522 - RNA, 19 nt, Human
cuguggcugaccucuggcc

SEQ ID NO: 931523 - RNA, 22 nt, Human
aaaacaguuauaaacagaguca

SEQ ID NO: 931524 - RNA, 22 nt, Human
acacaugaaagacauuaaggug

SEQ ID NO: 931525 - RNA, 22 nt, Human
uguauuaacauuaauaaaaugg

SEQ ID NO: 931526 - RNA, 22 nt, Human
ucuaaccuuguggucugcuggu

SEQ ID NO: 931527 - RNA, 22 nt, Human
augagcuugguccagcaggcuu

SEQ ID NO: 931528 - RNA, 23 nt, Human
cuuauucauucauguagcccauu

SEQ ID NO: 931529 - RNA, 22 nt, Human
aaccuguuuucuucucaucuag

SEQ ID NO: 931530 - RNA, 22 nt, Human
uucacagaugagaaaauugagg

SEQ ID NO: 931531 - RNA, 22 nt, Human
ggugaccucaccuggucccacc

SEQ ID NO: 931532 - RNA, 21 nt, Human
acagcauguuuguguguuugc

SEQ ID NO: 931533 - RNA, 22 nt, Human
aguuccaaagccuguauucuua

SEQ ID NO: 931534 - RNA, 22 nt, Human
uauuccaaugucaguuauauca

SEQ ID NO: 931535 - RNA, 22 nt, Human
cuguuuaucuaggaguugcagg

SEQ ID NO: 931536 - RNA, 22 nt, Human
acuuuacacaucuuuucucauu

SEQ ID NO: 931537 - RNA, 22 nt, Human
uuaccaaaugaaauagagauuu

SEQ ID NO: 931538 - RNA, 22 nt, Human
aguuuuauuaaauccacagaag

SEQ ID NO: 931539 - RNA, 17 nt, Human
auuccacagggaaucug

SEQ ID NO: 931540 - RNA, 21 nt, Human
gcauuaaaagcaguuguuggu

SEQ ID NO: 931541 - RNA, 22 nt, Human
guaaccugucggaaagccuugu

SEQ ID NO: 931542 - RNA, 22 nt, Human
uccugaaguauggguauggagu

SEQ ID NO: 931543 - RNA, 22 nt, Human
uccuucaguucaauuaguccgu

SEQ ID NO: 931544 - RNA, 20 nt, Human
uauuacacacaaugagcagu

SEQ ID NO: 931545 - RNA, 22 nt, Human
cacauuaagaauaaugagacua

SEQ ID NO: 931546 - RNA, 22 nt, Human
cuguggcucauaucuguaaucu

SEQ ID NO: 931547 - RNA, 22 nt, Human
agaaucaacugaaaauugguga

SEQ ID NO: 931548 - RNA, 22 nt, Human
acacaugaguucucaucuugug

SEQ ID NO: 931549 - RNA, 22 nt, Human
cagcaugaaaaguguugcuauc

SEQ ID NO: 931550 - RNA, 19 nt, Human
ucuuuguacaagucucugc

SEQ ID NO: 931551 - RNA, 20 nt, Human
gucuuauuuaacacaugacu

SEQ ID NO: 931552 - RNA, 22 nt, Human
uuuaucugugguaaauaacauu

SEQ ID NO: 931553 - RNA, 22 nt, Human
aaauccuuuggaggacaugaug

SEQ ID NO: 931554 - RNA, 22 nt, Human
uauacacauuacaguuucagga

SEQ ID NO: 931555 - RNA, 22 nt, Human
gaaauuuacaacuuucucaugg

SEQ ID NO: 931556 - RNA, 22 nt, Human
ugcuggcuuagauaucacugcc

SEQ ID NO: 931557 - RNA, 18 nt, Human
acaaucugaaaccuguca

SEQ ID NO: 931558 - RNA, 20 nt, Human
gaauuuuaugaacacuacca

SEQ ID NO: 931559 - RNA, 22 nt, Human
uagaaacaaagaccugggugcu

SEQ ID NO: 931560 - RNA, 22 nt, Human
ugagaaaacucaaagacagauc

SEQ ID NO: 931561 - RNA, 19 nt, Human
uagcuucacguggucuaga

SEQ ID NO: 931562 - RNA, 20 nt, Human
cagcuucaaugucagcuuga

SEQ ID NO: 931563 - RNA, 22 nt, Human
cuaacuuuuacagucauguugc

SEQ ID NO: 931564 - RNA, 22 nt, Human
auuauucauugguaggcaagcu

SEQ ID NO: 931565 - RNA, 22 nt, Human
agauggcugauuaacuccaugg

SEQ ID NO: 931566 - RNA, 22 nt, Human
cuauggcuguguucaugcuaca

SEQ ID NO: 931567 - RNA, 22 nt, Human
ugacaacagccaucacuuuuag

SEQ ID NO: 931568 - RNA, 18 nt, Human
uggcuucuugagcuaaca

SEQ ID NO: 931569 - RNA, 21 nt, Human
ugucacuuuaagcuagcucua

SEQ ID NO: 931570 - RNA, 22 nt, Human
ucuccuacucacucaaggcuug

SEQ ID NO: 931571 - RNA, 22 nt, Human
aacaugucuuacuuugcuuucu

SEQ ID NO: 931572 - RNA, 22 nt, Human
ucacagaaggaccuuguuucau

SEQ ID NO: 931573 - RNA, 22 nt, Human
aaacaaacauagguuugaaagu

SEQ ID NO: 931574 - RNA, 22 nt, Human
cuaagaaauguugugaaugcca

SEQ ID NO: 931575 - RNA, 22 nt, Human
aagucacaaagugcuguacaug

SEQ ID NO: 931576 - RNA, 22 nt, Human
uuucaacucaugcuaaaggaag

SEQ ID NO: 931577 - RNA, 22 nt, Human
acauuucucccugcaugccugc

SEQ ID NO: 931578 - RNA, 22 nt, Human
aagcuucaucugaugccgaacu

SEQ ID NO: 931579 - RNA, 22 nt, Human
acaguaaagccuucugguugac

SEQ ID NO: 931580 - RNA, 22 nt, Human
uucuacaugagaaaauguauuu

SEQ ID NO: 931581 - RNA, 23 nt, Human
uccugccagaugacuccuuucuu

SEQ ID NO: 931582 - RNA, 22 nt, Human
uuccaauuguucuuuggaaucu

SEQ ID NO: 931583 - RNA, 22 nt, Human
uuuauucacuggggucugcccg

SEQ ID NO: 931584 - RNA, 22 nt, Human
uacuuuuagccuauuugauucu

SEQ ID NO: 931585 - RNA, 22 nt, Human
acccuguuaugguguaacauuu

SEQ ID NO: 931586 - RNA, 22 nt, Human
uauccuguuuugcacaauuaua

SEQ ID NO: 931587 - RNA, 19 nt, Human
ucacucucccugucugucc

SEQ ID NO: 931588 - RNA, 22 nt, Human
ucuuuacauaguguggacuacu

SEQ ID NO: 931589 - RNA, 22 nt, Human
aagucacagcuaaauagcuaag

SEQ ID NO: 931590 - RNA, 22 nt, Human
acauuaguuucucagaucauuu

SEQ ID NO: 931591 - RNA, 22 nt, Human
ccugccuauguaagugguuucu

SEQ ID NO: 931592 - RNA, 22 nt, Human
uagcagugcccuguggaauaag

SEQ ID NO: 931593 - RNA, 22 nt, Human
uagacuuuucaaaaucuagacc

SEQ ID NO: 931594 - RNA, 19 nt, Human
aaugguuugaugaaguaua

SEQ ID NO: 931595 - RNA, 22 nt, Human
uaccaugauguuugaguuacua

SEQ ID NO: 931596 - RNA, 22 nt, Human
cuucaccuccuccucugugggc

SEQ ID NO: 931597 - RNA, 22 nt, Human
cccuggcagcaaucacuggugu

SEQ ID NO: 931598 - RNA, 22 nt, Human
ucagcacugucuauuagugaga

SEQ ID NO: 931599 - RNA, 22 nt, Human
aacacuaaugggagaacaaccc

SEQ ID NO: 931600 - RNA, 22 nt, Human
cagaaacugcuccccugguagg

SEQ ID NO: 931601 - RNA, 22 nt, Human
uaagauuacagugagaaauaaa

SEQ ID NO: 931602 - RNA, 22 nt, Human
cagauaacugaaauaucauacc

SEQ ID NO: 931603 - RNA, 22 nt, Human
acacacuggcccccaguacuga

SEQ ID NO: 931604 - RNA, 22 nt, Human
cuggcuucagcugccaucaaug

SEQ ID NO: 931605 - RNA, 22 nt, Human
gacaaaacugagaucacacugu

SEQ ID NO: 931606 - RNA, 22 nt, Human
auuuugugaacccucaagcaau

SEQ ID NO: 931607 - RNA, 22 nt, Human
acaagucuguuaugcaccugga

SEQ ID NO: 931608 - RNA, 22 nt, Human
uagcacauuguugaccagaagg

SEQ ID NO: 931609 - RNA, 22 nt, Human
agcaacaggcauaauguguuga

SEQ ID NO: 931610 - RNA, 22 nt, Human
uuucacagcuuccacuuaagga

SEQ ID NO: 931611 - RNA, 21 nt, Human
ugcuaggccauauugguugcu

SEQ ID NO: 931612 - RNA, 22 nt, Human
guaaccuggaaguuuagggaag

SEQ ID NO: 931613 - RNA, 22 nt, Human
gauacacacccuugauaggacu

SEQ ID NO: 931614 - RNA, 22 nt, Human
cuuauucauauauucucgguag

SEQ ID NO: 931615 - RNA, 22 nt, Human
uuccuuguucuacaucccugcc

SEQ ID NO: 931616 - RNA, 22 nt, Human
uuacacuucuaaaaaaagcagg

SEQ ID NO: 931617 - RNA, 22 nt, Human
uaaccugcaacagaucugucuu

SEQ ID NO: 931618 - RNA, 22 nt, Human
uuaacaaaaauaucaggcauca

SEQ ID NO: 931619 - RNA, 22 nt, Human
uauuaugagguauuuggacuuu

SEQ ID NO: 931620 - RNA, 22 nt, Human
acccugaagaaacuucuaagug

SEQ ID NO: 931621 - RNA, 22 nt, Human
ugcucuggguucuugcuguuac

SEQ ID NO: 931622 - RNA, 20 nt, Human
gcuucuuuucuggcccauga

SEQ ID NO: 931623 - RNA, 22 nt, Human
aaugucuucaguguauacaugg

SEQ ID NO: 931624 - RNA, 22 nt, Human
uauuccaacugucauagucaua

SEQ ID NO: 931625 - RNA, 21 nt, Human
acacugugucauaaugcuuaa

SEQ ID NO: 931626 - RNA, 22 nt, Human
gcagagaacccagcagauuggc

SEQ ID NO: 931627 - RNA, 21 nt, Human
uccuucaguucugcacuuucu

SEQ ID NO: 931628 - RNA, 22 nt, Human
uacaugucuggguuuuguuucc

SEQ ID NO: 931629 - RNA, 22 nt, Human
cacagaaauauugugucccuug

SEQ ID NO: 931630 - RNA, 22 nt, Human
uguuuauagauggccacaauga

SEQ ID NO: 931631 - RNA, 22 nt, Human
aaaagacaucuauuucaggcag

SEQ ID NO: 931632 - RNA, 22 nt, Human
uuucccuacuuguaacuggaaa

SEQ ID NO: 931633 - RNA, 22 nt, Human
augcuguuaagaaucucuuccu

SEQ ID NO: 931634 - RNA, 22 nt, Human
uauaaccuuuucuuuauccucc

SEQ ID NO: 931635 - RNA, 22 nt, Human
uauuacacuuucuucuucaagc

SEQ ID NO: 931636 - RNA, 22 nt, Human
aaccagugaaacaccaggcaag

SEQ ID NO: 931637 - RNA, 18 nt, Human
ucucuucuuggcagucaa

SEQ ID NO: 931638 - RNA, 22 nt, Human
ucacaaauguuugcaugugucu

SEQ ID NO: 931639 - RNA, 22 nt, Human
aguaaacaguaucuuuaguguc

SEQ ID NO: 931640 - RNA, 22 nt, Human
acauucuauagcaagcugaucu

SEQ ID NO: 931641 - RNA, 22 nt, Human
ucaacaguugcacuggagaggu

SEQ ID NO: 931642 - RNA, 22 nt, Human
aacuuguaggacugcacuguag

SEQ ID NO: 931643 - RNA, 22 nt, Human
acauuucuucccuuuagcagaa

SEQ ID NO: 931644 - RNA, 22 nt, Human
augaugaaaacugaagguuagg

SEQ ID NO: 931645 - RNA, 19 nt, Human
uuacaucugcaacacuggu

SEQ ID NO: 931646 - RNA, 22 nt, Human
acacaaugucaucauaauguca

SEQ ID NO: 931647 - RNA, 22 nt, Human
auggcuucucgcuggcaccugu

SEQ ID NO: 931648 - RNA, 22 nt, Human
uuccaaauuaaaauguacaaug

SEQ ID NO: 931649 - RNA, 22 nt, Human
agauggcuuagccuggcuccca

SEQ ID NO: 931650 - RNA, 22 nt, Human
uauuccaaaauaguuaagcacu

SEQ ID NO: 931651 - RNA, 22 nt, Human
cuagcuucaaguccuggcugug

SEQ ID NO: 931652 - RNA, 22 nt, Human
uugacuuuucuuggucacauga

SEQ ID NO: 931653 - RNA, 22 nt, Human
ugcuuugcaaauaauagaaugu

SEQ ID NO: 931654 - RNA, 22 nt, Human
auaaccugguaguauuaaaugu

SEQ ID NO: 931655 - RNA, 22 nt, Human
cacauuuaggagguggggaagc

SEQ ID NO: 931656 - RNA, 22 nt, Human
caucuguuuccuaaucuguagc

SEQ ID NO: 931657 - RNA, 22 nt, Human
aaaguaacaauaagguucuauu

SEQ ID NO: 931658 - RNA, 22 nt, Human
ucacagaagcaucauacccgga

SEQ ID NO: 931659 - RNA, 22 nt, Human
ccuggcaccuguguuuucugga

SEQ ID NO: 931660 - RNA, 22 nt, Human
cccugugcugucaugcugggcg

SEQ ID NO: 931661 - RNA, 22 nt, Human
auauuaaauggauuuugggagc

SEQ ID NO: 931662 - RNA, 22 nt, Human
uuugugaauagguuggcuucca

SEQ ID NO: 931663 - RNA, 23 nt, Human
uaaauuucuugauucuuauguga

SEQ ID NO: 931664 - RNA, 22 nt, Human
auggcucucuagggcccagguu

SEQ ID NO: 931665 - RNA, 22 nt, Human
gugaaggaggggccacagauau

SEQ ID NO: 931666 - RNA, 22 nt, Human
cuacacuuugguugacuuugug

SEQ ID NO: 931667 - RNA, 22 nt, Human
cacacaugugugcagcuuagaa

SEQ ID NO: 931668 - RNA, 22 nt, Human
agagaauuacagaagaauguca

SEQ ID NO: 931669 - RNA, 22 nt, Human
ucaccacuaggaauuguguagu

SEQ ID NO: 931670 - RNA, 22 nt, Human
ugucucaucucuuaaccccacu

SEQ ID NO: 931671 - RNA, 22 nt, Human
gcaguaggagggacaacuaccu

SEQ ID NO: 931672 - RNA, 22 nt, Human
auacccuuuacaggaacagcaa

SEQ ID NO: 931673 - RNA, 22 nt, Human
cacacaugacccacuuuuaccg

SEQ ID NO: 931674 - RNA, 22 nt, Human
agcagucauuuuaggucaugca

SEQ ID NO: 931675 - RNA, 22 nt, Human
auccacagugcagcaagggccc

SEQ ID NO: 931676 - RNA, 22 nt, Human
ccugucacgaugacugcacucu

SEQ ID NO: 931677 - RNA, 22 nt, Human
cugcuugggguuaggguguccu

SEQ ID NO: 931678 - RNA, 22 nt, Human
acugucuuccaggucuggaggu

SEQ ID NO: 931679 - RNA, 22 nt, Human
uacaguaaccuuauuugucauu

SEQ ID NO: 931680 - RNA, 21 nt, Human
aauaaccacuaauauaguggc

SEQ ID NO: 931681 - RNA, 22 nt, Human
uuuguuuucaaugugucauuca

SEQ ID NO: 931682 - RNA, 22 nt, Human
ucaacaaauacuuaaagcagag

SEQ ID NO: 931683 - RNA, 22 nt, Human
acuacacagggaugugacuacc

SEQ ID NO: 931684 - RNA, 22 nt, Human
auaguuuuauagauauugugua

SEQ ID NO: 931685 - RNA, 22 nt, Human
gacacuuuuuuaaagcucauua

SEQ ID NO: 931686 - RNA, 22 nt, Human
aaucuguuuccaauacuugcua

SEQ ID NO: 931687 - RNA, 22 nt, Human
gaacaguaacugucugcugugu

SEQ ID NO: 931688 - RNA, 22 nt, Human
ccugucaccuagguacugagca

SEQ ID NO: 931689 - RNA, 22 nt, Human
acauucuauucugcaggacaag

SEQ ID NO: 931690 - RNA, 22 nt, Human
aaaucguuauaauguuaagccu

SEQ ID NO: 931691 - RNA, 22 nt, Human
uauuaugaucgugacucaagga

SEQ ID NO: 931692 - RNA, 22 nt, Human
acacauguauguuuuguauuug

SEQ ID NO: 931693 - RNA, 23 nt, Human
ucuuuacauacugaugaguucuc

SEQ ID NO: 931694 - RNA, 22 nt, Human
auggaguuuggggucaaauacu

SEQ ID NO: 931695 - RNA, 23 nt, Human
agaucacauaguuaucagaugac

SEQ ID NO: 931696 - RNA, 22 nt, Human
augaguuaguuucuugucuaga

SEQ ID NO: 931697 - RNA, 22 nt, Human
agcaguuguagucauggaaaau

SEQ ID NO: 931698 - RNA, 20 nt, Human
ccuucuccagcuuguucuug

SEQ ID NO: 931699 - RNA, 22 nt, Human
ccuguuguuuagcacuuagaac

SEQ ID NO: 931700 - RNA, 22 nt, Human
augugcuuucuuuccaaggggc

SEQ ID NO: 931701 - RNA, 22 nt, Human
auugaguaguaggaaaauaacu

SEQ ID NO: 931702 - RNA, 22 nt, Human
ucuagaaaaccaauauuacaug

SEQ ID NO: 931703 - RNA, 22 nt, Human
auuuaccauccugugaauggcc

SEQ ID NO: 931704 - RNA, 22 nt, Human
uuuacucaaguaugcauuuaug

SEQ ID NO: 931705 - RNA, 22 nt, Human
uguuuguagagacagcugaugc

SEQ ID NO: 931706 - RNA, 22 nt, Human
cacauuuagagguuagcauggu

SEQ ID NO: 931707 - RNA, 22 nt, Human
ccuuuacaaaguucuucauggg

SEQ ID NO: 931708 - RNA, 22 nt, Human
ucccuucaauaauucaacauua

SEQ ID NO: 931709 - RNA, 22 nt, Human
uauaaccuggauucuggcacua

SEQ ID NO: 931710 - RNA, 22 nt, Human
agcacuuuaagcaacagaucaa

SEQ ID NO: 931711 - RNA, 22 nt, Human
ucaccacugaacagaccuuugg

SEQ ID NO: 931712 - RNA, 22 nt, Human
uucccgucuuugcuaugccugc

SEQ ID NO: 931713 - RNA, 22 nt, Human
uaaccaugcaugucucuaguuu

SEQ ID NO: 931714 - RNA, 22 nt, Human
uuucucugggcacucuccaaac

SEQ ID NO: 931715 - RNA, 22 nt, Human
uuaaauggagggggaaauacgu

SEQ ID NO: 931716 - RNA, 22 nt, Human
gcuucuacccacgagaugcaaa

SEQ ID NO: 931717 - RNA, 22 nt, Human
gaguaauuuucuugauuucuua

SEQ ID NO: 931718 - RNA, 22 nt, Human
cauggcuuucccucaagagcaa

SEQ ID NO: 931719 - RNA, 22 nt, Human
uucaucuguagcaucuuccaau

SEQ ID NO: 931720 - RNA, 22 nt, Human
cuacacuugcaugagucuugaa

SEQ ID NO: 931721 - RNA, 22 nt, Human
gucacaaagcgcgguggucggu

SEQ ID NO: 931722 - RNA, 22 nt, Human
auggaaaugauggaacauuaaa

SEQ ID NO: 931723 - RNA, 21 nt, Human
uauggcuuuacuaagcugcac

SEQ ID NO: 931724 - RNA, 22 nt, Human
aaacuucagacuccccacuucu

SEQ ID NO: 931725 - RNA, 22 nt, Human
ggcucugccacuucuuggcugu

SEQ ID NO: 931726 - RNA, 22 nt, Human
caugagaaccaggucuguguuu

SEQ ID NO: 931727 - RNA, 23 nt, Human
guaggaauuuucacuuccucuug

SEQ ID NO: 931728 - RNA, 22 nt, Human
cagugcuuugggaggcugagga

SEQ ID NO: 931729 - RNA, 22 nt, Human
ugucucuuggauugcuugcucu

SEQ ID NO: 931730 - RNA, 22 nt, Human
aaaucguuucguuccugguuuu

SEQ ID NO: 931731 - RNA, 22 nt, Human
acugaguuauggguaugccuug

SEQ ID NO: 931732 - RNA, 22 nt, Human
accacuuuacagaaauggaaag

SEQ ID NO: 931733 - RNA, 22 nt, Human
uuacaguuuaccaagaauauug

SEQ ID NO: 931734 - RNA, 22 nt, Human
gagcacuguacucauuugcacu

SEQ ID NO: 931735 - RNA, 17 nt, Human
uauacacagacagacug

SEQ ID NO: 931736 - RNA, 22 nt, Human
cagcaacauauaugaaacugug

SEQ ID NO: 931737 - RNA, 22 nt, Human
aaccuguuuugauuaacaagua

SEQ ID NO: 931738 - RNA, 22 nt, Human
uccugccauuugcuuuuucucc

SEQ ID NO: 931739 - RNA, 22 nt, Human
uuauacaguuuauacuuagaau

SEQ ID NO: 931740 - RNA, 22 nt, Human
auucauucuugguaugaacagc

SEQ ID NO: 931741 - RNA, 22 nt, Human
auuuauugguuugcauggugaa

SEQ ID NO: 931742 - RNA, 22 nt, Human
agcaggaaggucugugugaguc

SEQ ID NO: 931743 - RNA, 22 nt, Human
auccacuuggcugguuguucua

SEQ ID NO: 931744 - RNA, 22 nt, Human
uuauugaaggaacugaaauaaa

SEQ ID NO: 931745 - RNA, 22 nt, Human
gcacaugagcugcugggauggg

SEQ ID NO: 931746 - RNA, 20 nt, Human
acauuugaguaucaucuacu

SEQ ID NO: 931747 - RNA, 22 nt, Human
gacauuuagguagcuuccaguu

SEQ ID NO: 931748 - RNA, 22 nt, Human
uauucacaguugauuuacaguu

SEQ ID NO: 931749 - RNA, 22 nt, Human
uuauucaccucuauuagacuca

SEQ ID NO: 931750 - RNA, 22 nt, Human
gcuucucccuacagaugucagu

SEQ ID NO: 931751 - RNA, 22 nt, Human
ucuaaccuuugaaacugcuuuc

SEQ ID NO: 931752 - RNA, 21 nt, Human
uuguagcuuguuagaccaugu

SEQ ID NO: 931753 - RNA, 23 nt, Human
agcuucgccuuccuuucucugca

SEQ ID NO: 931754 - RNA, 22 nt, Human
cuguggcugcagccuugguccu

SEQ ID NO: 931755 - RNA, 23 nt, Human
aucaccagcggaagcugcagacc

SEQ ID NO: 931756 - RNA, 20 nt, Human
cuguggcucaugcaucugcc

SEQ ID NO: 931757 - RNA, 22 nt, Human
acuuucaagaacuucuuuaaug

SEQ ID NO: 931758 - RNA, 19 nt, Human
uuuauucaccuuuaccuug

SEQ ID NO: 931759 - RNA, 22 nt, Human
cuacaugaauggguguauuacu

SEQ ID NO: 931760 - RNA, 20 nt, Human
uuaugcaagcaucaauauug

SEQ ID NO: 931761 - RNA, 22 nt, Human
gcagagaaggauugaaaccaga

SEQ ID NO: 931762 - RNA, 22 nt, Human
cauggcuuagaaguuccagccc

SEQ ID NO: 931763 - RNA, 22 nt, Human
cagaaacauguauaaaguugua

SEQ ID NO: 931764 - RNA, 22 nt, Human
ucuuuacaagucacauuuucug

SEQ ID NO: 931765 - RNA, 22 nt, Human
ucuccucugugccacagcuugg

SEQ ID NO: 931766 - RNA, 22 nt, Human
uaugaaaauuuagcugaagcau

SEQ ID NO: 931767 - RNA, 22 nt, Human
uaagcuucaaagaacauauugg

SEQ ID NO: 931768 - RNA, 22 nt, Human
ucuuuacacaagacaagaauaa

SEQ ID NO: 931769 - RNA, 22 nt, Human
augaaggauggcuggcugcccu

SEQ ID NO: 931770 - RNA, 21 nt, Human
agaaaaacacgauauaagccc

SEQ ID NO: 931771 - RNA, 22 nt, Human
guuuacacuccaggcuggggug

SEQ ID NO: 931772 - RNA, 22 nt, Human
aguggaccagaagacugaagcu

SEQ ID NO: 931773 - RNA, 22 nt, Human
uuugcuuguucaagauuucugu

SEQ ID NO: 931774 - RNA, 22 nt, Human
uauggcuucuuuugcaacuacu

SEQ ID NO: 931775 - RNA, 22 nt, Human
acagcaguuacugaaauaaagu

SEQ ID NO: 931776 - RNA, 22 nt, Human
auucagagauuguuauucagac

SEQ ID NO: 931777 - RNA, 22 nt, Human
guggcuuccaagacuaagucac

SEQ ID NO: 931778 - RNA, 22 nt, Human
ucuggcuccguguccgcuccca

SEQ ID NO: 931779 - RNA, 22 nt, Human
cacaugguggugcuugauaagc

SEQ ID NO: 931780 - RNA, 22 nt, Human
uacaacagacaggaauaagauu

SEQ ID NO: 931781 - RNA, 22 nt, Human
ugucaucuguguuuugcuggag

SEQ ID NO: 931782 - RNA, 22 nt, Human
aaacaguguuuuuaugauuuau

SEQ ID NO: 931783 - RNA, 22 nt, Human
uuuguaacugagugcucagagc

SEQ ID NO: 931784 - RNA, 22 nt, Human
ccuuuacaguagcccuuuugaa

SEQ ID NO: 931785 - RNA, 22 nt, Human
cuugcuugauuaugaucauaaa

SEQ ID NO: 931786 - RNA, 22 nt, Human
aaaccauggaguaaguucacau

SEQ ID NO: 931787 - RNA, 22 nt, Human
auggccuuggcugcagagacau

SEQ ID NO: 931788 - RNA, 22 nt, Human
acauuuagcuguacaaucuaug

SEQ ID NO: 931789 - RNA, 22 nt, Human
gaguuacauggacauucucucc

SEQ ID NO: 931790 - RNA, 22 nt, Human
cacuuuuaacaggagaauuccc

SEQ ID NO: 931791 - RNA, 22 nt, Human
cagugccauauugaaagacauu

SEQ ID NO: 931792 - RNA, 22 nt, Human
ucacaugagucacuaucuuaau

SEQ ID NO: 931793 - RNA, 22 nt, Human
uaacacaugguuaguacacaau

SEQ ID NO: 931794 - RNA, 22 nt, Human
uacccaaggcccuuucaauuuc

SEQ ID NO: 931795 - RNA, 22 nt, Human
aaauacuguccaccauggagca

SEQ ID NO: 931796 - RNA, 22 nt, Human
uucuauugggcagcauugcuuc

SEQ ID NO: 931797 - RNA, 21 nt, Human
ucucacugucugcuuuguuua

SEQ ID NO: 931798 - RNA, 22 nt, Human
aaucuaacuucauagcugauuu

SEQ ID NO: 931799 - RNA, 22 nt, Human
augugcuuuauuaaguaaaaau

SEQ ID NO: 931800 - RNA, 22 nt, Human
ccacaguaaagaaacaacuucg

SEQ ID NO: 931801 - RNA, 22 nt, Human
ggcuucuccccuuugagucuuc

SEQ ID NO: 931802 - RNA, 22 nt, Human
aaaaaccuuucccauacuaaga

SEQ ID NO: 931803 - RNA, 22 nt, Human
guuccacaaaaggucuaguuua

SEQ ID NO: 931804 - RNA, 22 nt, Human
ugcuugacuuaguuucucauuu

SEQ ID NO: 931805 - RNA, 22 nt, Human
cacauuuaaagguugaagcuga

SEQ ID NO: 931806 - RNA, 22 nt, Human
cuuacacacuagaugguaggug

SEQ ID NO: 931807 - RNA, 22 nt, Human
cacauuuaucuguucuuucuag

SEQ ID NO: 931808 - RNA, 21 nt, Human
auucagaguaauucaucuuua

SEQ ID NO: 931809 - RNA, 22 nt, Human
uagucuuuuuaauaaauaaugc

SEQ ID NO: 931810 - RNA, 22 nt, Human
ccugugcucccuauguaucugg

SEQ ID NO: 931811 - RNA, 22 nt, Human
uaguuacagugcauagcaagau

SEQ ID NO: 931812 - RNA, 22 nt, Human
cacauuuaagugcuuguucaga

SEQ ID NO: 931813 - RNA, 22 nt, Human
uuaggaaaggguuuucuaacag

SEQ ID NO: 931814 - RNA, 22 nt, Human
uaacaguauauuuaccaaaccu

SEQ ID NO: 931815 - RNA, 22 nt, Human
ucagcuucucaaaauggcuuag

SEQ ID NO: 931816 - RNA, 22 nt, Human
cugugcuucagagucagugcug

SEQ ID NO: 931817 - RNA, 22 nt, Human
cauggcuuacuuucagggagua

SEQ ID NO: 931818 - RNA, 22 nt, Human
aagagcauuuggugagauuuga

SEQ ID NO: 931819 - RNA, 22 nt, Human
aaaucguggaagacaccagugg

SEQ ID NO: 931820 - RNA, 20 nt, Human
uauggcuugcagccacccuu

SEQ ID NO: 931821 - RNA, 22 nt, Human
caugaugucacagagaagcaca

SEQ ID NO: 931822 - RNA, 17 nt, Human
acacaagcaccuugagg

SEQ ID NO: 931823 - RNA, 22 nt, Human
guuuauucuucagcaacaucug

SEQ ID NO: 931824 - RNA, 22 nt, Human
uauacacauaucuucuaggccu

SEQ ID NO: 931825 - RNA, 22 nt, Human
cuagucacuguaauaaucugcu

SEQ ID NO: 931826 - RNA, 22 nt, Human
acauuguacucuuagcguuguu

SEQ ID NO: 931827 - RNA, 22 nt, Human
auuuugaaaagcauuugaguaa

SEQ ID NO: 931828 - RNA, 22 nt, Human
uggaauucccaaguaacuuuua

SEQ ID NO: 931829 - RNA, 22 nt, Human
agaaacaacuuguuucucuugc

SEQ ID NO: 931830 - RNA, 22 nt, Human
gauggcuucagucuccuugggu

SEQ ID NO: 931831 - RNA, 22 nt, Human
auccacuugccacuguauaguu

SEQ ID NO: 931832 - RNA, 22 nt, Human
uggcuucucccucugccugauu

SEQ ID NO: 931833 - RNA, 22 nt, Human
uuucucugugggcuuuaugcau

SEQ ID NO: 931834 - RNA, 22 nt, Human
aaucuguuccugaggcaccaga

SEQ ID NO: 931835 - RNA, 22 nt, Human
cagcagagaugagauuccuaua

SEQ ID NO: 931836 - RNA, 22 nt, Human
aaucauguacugcuguggcuuu

SEQ ID NO: 931837 - RNA, 22 nt, Human
aaacaguagaaguguauuuuau

SEQ ID NO: 931838 - RNA, 22 nt, Human
cagaaacacuuguagagaaguu

SEQ ID NO: 931839 - RNA, 19 nt, Human
uagacuuuuccagcaggca

SEQ ID NO: 931840 - RNA, 22 nt, Human
agauggcugauggcaggagcca

SEQ ID NO: 931841 - RNA, 22 nt, Human
gacaauuagaucauuccuuuga

SEQ ID NO: 931842 - RNA, 22 nt, Human
aaacaaugaaauucauucuuca

SEQ ID NO: 931843 - RNA, 22 nt, Human
aacuguugucauauggucuuaa

SEQ ID NO: 931844 - RNA, 22 nt, Human
cugugcuuagccaucacauuca

SEQ ID NO: 931845 - RNA, 22 nt, Human
aguaaacacugucuuuauauau

SEQ ID NO: 931846 - RNA, 22 nt, Human
cuacaaauauguuaagguguuu

SEQ ID NO: 931847 - RNA, 22 nt, Human
gucacaaaggugagggacauga

SEQ ID NO: 931848 - RNA, 22 nt, Human
cuggcccuaugagccuccugau

SEQ ID NO: 931849 - RNA, 18 nt, Human
ugcucuggucucacuugg

SEQ ID NO: 931850 - RNA, 22 nt, Human
ccacaagacucugucagcauaa

SEQ ID NO: 931851 - RNA, 22 nt, Human
aacagcaucaccccauaacauu

SEQ ID NO: 931852 - RNA, 22 nt, Human
agaaacaucauuguuugguauu

SEQ ID NO: 931853 - RNA, 22 nt, Human
guggaccaagguggaagauaaa

SEQ ID NO: 931854 - RNA, 22 nt, Human
auuauucaaucauauuaaaagu

SEQ ID NO: 931855 - RNA, 22 nt, Human
caugcagugguaaaaagucagg

SEQ ID NO: 931856 - RNA, 22 nt, Human
ucacagaacaauguuuaguucu

SEQ ID NO: 931857 - RNA, 22 nt, Human
cuacacuuguucgacugcagga

SEQ ID NO: 931858 - RNA, 22 nt, Human
acuguuacagagcaggaaauug

SEQ ID NO: 931859 - RNA, 22 nt, Human
uagagcuauuuaucagccagaa

SEQ ID NO: 931860 - RNA, 22 nt, Human
aucuggcuuuuacugaauugcu

SEQ ID NO: 931861 - RNA, 19 nt, Human
acauuuaaauucagaucuc

SEQ ID NO: 931862 - RNA, 22 nt, Human
cuacaacauuaugcuuucuguc

SEQ ID NO: 931863 - RNA, 22 nt, Human
uacacuauuuuacugauacaaa

SEQ ID NO: 931864 - RNA, 22 nt, Human
uugugggauggcucuucccaaa

SEQ ID NO: 931865 - RNA, 22 nt, Human
accuuuuauguaaauauauguu

SEQ ID NO: 931866 - RNA, 22 nt, Human
acacuguuccugaaauuguuau

SEQ ID NO: 931867 - RNA, 22 nt, Human
acacauuaggcagugcuuaaau

SEQ ID NO: 931868 - RNA, 22 nt, Human
uuuuacacuucgguugugugca

SEQ ID NO: 931869 - RNA, 22 nt, Human
ucucuucugaccuagccuugga

SEQ ID NO: 931870 - RNA, 22 nt, Human
uuccacugaaggaucuagggaa

SEQ ID NO: 931871 - RNA, 22 nt, Human
ccuuuacacauggaaugggucu

SEQ ID NO: 931872 - RNA, 22 nt, Human
uauuaugauucggacguggcag

SEQ ID NO: 931873 - RNA, 22 nt, Human
cuucacacccacuaaaaugaug

SEQ ID NO: 931874 - RNA, 22 nt, Human
cagaaacaggcaacgugugcac

SEQ ID NO: 931875 - RNA, 22 nt, Human
cuggcccuucucuugcuuccug

SEQ ID NO: 931876 - RNA, 17 nt, Human
uccuucagugccucugc

SEQ ID NO: 931877 - RNA, 22 nt, Human
cacagaauggaccaguuuuaga

SEQ ID NO: 931878 - RNA, 22 nt, Human
agaaacauuuagauuauauguc

SEQ ID NO: 931879 - RNA, 22 nt, Human
agugaaagguugagaauauucu

SEQ ID NO: 931880 - RNA, 22 nt, Human
cuauacacuuuuugaaaauaga

SEQ ID NO: 931881 - RNA, 22 nt, Human
gcagcagugcgggcagcuacag

SEQ ID NO: 931882 - RNA, 17 nt, Human
acacagagauuaacaca

SEQ ID NO: 931883 - RNA, 22 nt, Human
uauggcuuuaaacuuuucauuu

SEQ ID NO: 931884 - RNA, 23 nt, Human
uauacacauguggcaguauagug

SEQ ID NO: 931885 - RNA, 22 nt, Human
cccuggcagaaugucucugggc

SEQ ID NO: 931886 - RNA, 22 nt, Human
cuucagaagaaaagcagugugu

SEQ ID NO: 931887 - RNA, 18 nt, Human
agcagagagugaauggga

SEQ ID NO: 931888 - RNA, 22 nt, Human
uacacaugcucagauuccugug

SEQ ID NO: 931889 - RNA, 22 nt, Human
cuuguagcugcuucuucugaag

SEQ ID NO: 931890 - RNA, 22 nt, Human
cuucuucuggacaggcagcucc

SEQ ID NO: 931891 - RNA, 22 nt, Human
cuaaccugcauggcagcuagaa

SEQ ID NO: 931892 - RNA, 21 nt, Human
gcagcaguguucuagaauacu

SEQ ID NO: 931893 - RNA, 22 nt, Human
cuucugugcgccucuauucccu

SEQ ID NO: 931894 - RNA, 22 nt, Human
uguuacacccacaaaaaauucc

SEQ ID NO: 931895 - RNA, 22 nt, Human
ucauuuauagcuaaccuugaau

SEQ ID NO: 931896 - RNA, 22 nt, Human
aacauuuacaaauccuucugca

SEQ ID NO: 931897 - RNA, 22 nt, Human
augaaauuugcugcuaaguucc

SEQ ID NO: 931898 - RNA, 18 nt, Human
cuccccuguuuucccugc

SEQ ID NO: 931899 - RNA, 23 nt, Human
ugcuggcuguguuauugccaaca

SEQ ID NO: 931900 - RNA, 23 nt, Human
uauggcuuacagugcuuuaggua

SEQ ID NO: 931901 - RNA, 22 nt, Human
uggcuaagauuuaaauguuugc

SEQ ID NO: 931902 - RNA, 22 nt, Human
uucacaaaaaugcugaacaguu

SEQ ID NO: 931903 - RNA, 22 nt, Human
uguaugcuuuccuucuuucugg

SEQ ID NO: 931904 - RNA, 22 nt, Human
acaagcagagauuaaauguuuu

SEQ ID NO: 931905 - RNA, 21 nt, Human
uuggauguauuuauguuuuag

SEQ ID NO: 931906 - RNA, 22 nt, Human
auacagaauacuaauuccugag

SEQ ID NO: 931907 - RNA, 22 nt, Human
caaaacauucagagagcucacu

SEQ ID NO: 931908 - RNA, 22 nt, Human
ucacaugagguuaugacaaagc

SEQ ID NO: 931909 - RNA, 22 nt, Human
caaauagacucuagaauuuauu

SEQ ID NO: 931910 - RNA, 22 nt, Human
cuuuuacaguggaccugccauu

SEQ ID NO: 931911 - RNA, 22 nt, Human
uggcuucauucagcaugacagu

SEQ ID NO: 931912 - RNA, 22 nt, Human
aaacaugaauagauauuaaaca

SEQ ID NO: 931913 - RNA, 20 nt, Human
acuuuacagagaagacugac

SEQ ID NO: 931914 - RNA, 22 nt, Human
cagcagagcuuauuaacuaaaa

SEQ ID NO: 931915 - RNA, 22 nt, Human
ugugaaacggagucagggaagg

SEQ ID NO: 931916 - RNA, 22 nt, Human
agaguaacuuuuaacuuuacgu

SEQ ID NO: 931917 - RNA, 22 nt, Human
gcuuuacaugagaugaggacaa

SEQ ID NO: 931918 - RNA, 22 nt, Human
cacauuaaaauccuaacuucca

SEQ ID NO: 931919 - RNA, 22 nt, Human
cauggcuucugaucaaggaacu

SEQ ID NO: 931920 - RNA, 22 nt, Human
gaucuguuuuuucuuagacagu

SEQ ID NO: 931921 - RNA, 20 nt, Human
cuaaccuuaaccaucaccag

SEQ ID NO: 931922 - RNA, 22 nt, Human
acagaugauuuuuaugaaaaca

SEQ ID NO: 931923 - RNA, 22 nt, Human
uugcuuggcaggcuuccagucu

SEQ ID NO: 931924 - RNA, 22 nt, Human
ggcugaggcggcgaugcccuug

SEQ ID NO: 931925 - RNA, 22 nt, Human
aagcuguuggcagauagcucug

SEQ ID NO: 931926 - RNA, 22 nt, Human
cacacaugaaucccuaguaccu

SEQ ID NO: 931927 - RNA, 22 nt, Human
uuauugcagauggugugagaga

SEQ ID NO: 931928 - RNA, 22 nt, Human
cagcaaggucugucaauagugg

SEQ ID NO: 931929 - RNA, 22 nt, Human
acuuugcacuucaauauaacuu

SEQ ID NO: 931930 - RNA, 22 nt, Human
ugauucagaccugucagacuuc

SEQ ID NO: 931931 - RNA, 22 nt, Human
uacacagacucuucaauucaga

SEQ ID NO: 931932 - RNA, 22 nt, Human
cuaacuuuuugauucuugggga

SEQ ID NO: 931933 - RNA, 22 nt, Human
aauuagaagggaguuauugaua

SEQ ID NO: 931934 - RNA, 22 nt, Human
uucagacuagacacauuucaag

SEQ ID NO: 931935 - RNA, 22 nt, Human
aaucauguccaucuuaacuuuc

SEQ ID NO: 931936 - RNA, 22 nt, Human
guuacacacaauauauccuaaa

SEQ ID NO: 931937 - RNA, 22 nt, Human
ggcucccugggugcuccugcuc

SEQ ID NO: 931938 - RNA, 22 nt, Human
accuuuaucgccaucauugugc

SEQ ID NO: 931939 - RNA, 22 nt, Human
auuucacagcugcuguucaggu

SEQ ID NO: 931940 - RNA, 23 nt, Human
uguaacuuugggcauguugcuuc

SEQ ID NO: 931941 - RNA, 22 nt, Human
aaaugacagaguaagcuguuua

SEQ ID NO: 931942 - RNA, 22 nt, Human
auucuagcugaguaucagcccc

SEQ ID NO: 931943 - RNA, 22 nt, Human
gcuuuacauuuuggaaagguga

SEQ ID NO: 931944 - RNA, 22 nt, Human
auggcugagaugggcuccaggc

SEQ ID NO: 931945 - RNA, 22 nt, Human
aguucacauuccgagguacugg

SEQ ID NO: 931946 - RNA, 22 nt, Human
agugaauucugcacuacugaag

SEQ ID NO: 931947 - RNA, 22 nt, Human
guuccacaucacacuacuugau

SEQ ID NO: 931948 - RNA, 22 nt, Human
aucuguuguuuguuugcuaaag

SEQ ID NO: 931949 - RNA, 22 nt, Human
aauuaagagagaguugaagcaa

SEQ ID NO: 931950 - RNA, 22 nt, Human
uauuacacagugaaagcaugga

SEQ ID NO: 931951 - RNA, 22 nt, Human
auggcucugagaaccugagcua

SEQ ID NO: 931952 - RNA, 22 nt, Human
cagaacaugauauaaacagaag

SEQ ID NO: 931953 - RNA, 22 nt, Human
uuaaauuauuucuagugaggug

SEQ ID NO: 931954 - RNA, 22 nt, Human
cccugugccuaguuggccuaaa

SEQ ID NO: 931955 - RNA, 22 nt, Human
aauugcuuuaguuaccauagug

SEQ ID NO: 931956 - RNA, 22 nt, Human
acagagcaacuuuauuucaugg

SEQ ID NO: 931957 - RNA, 20 nt, Human
ugacaaaugaucugauuuuc

SEQ ID NO: 931958 - RNA, 22 nt, Human
aacauuuauugagcaccuacug

SEQ ID NO: 931959 - RNA, 22 nt, Human
uccugcgagugcgcuuuugguc

SEQ ID NO: 931960 - RNA, 22 nt, Human
cauggcuuguaauaaauuuaua

SEQ ID NO: 931961 - RNA, 22 nt, Human
uagaaacauucaguugcagucc

SEQ ID NO: 931962 - RNA, 22 nt, Human
gaagagcuccaaaaacagugag

SEQ ID NO: 931963 - RNA, 20 nt, Human
uuuaccaaaggaguuaugau

SEQ ID NO: 931964 - RNA, 22 nt, Human
ggaauucugcauguucaguugg

SEQ ID NO: 931965 - RNA, 22 nt, Human
ccuuuacaucugacuucuuuca

SEQ ID NO: 931966 - RNA, 23 nt, Human
ccuggcacacaguugacauggaa

SEQ ID NO: 931967 - RNA, 22 nt, Human
cauggcuugucuugucuucuga

SEQ ID NO: 931968 - RNA, 22 nt, Human
cuguagcagcugaccuggcuaa

SEQ ID NO: 931969 - RNA, 22 nt, Human
auccacagagaggaagaauagu

SEQ ID NO: 931970 - RNA, 22 nt, Human
uuuguaaccuaaagcaccagau

SEQ ID NO: 931971 - RNA, 19 nt, Human
gaaugucuccuacuucuga

SEQ ID NO: 931972 - RNA, 22 nt, Human
aacacugugcuccccaggcugu

SEQ ID NO: 931973 - RNA, 22 nt, Human
uuuagcaaagguaggguucaga

SEQ ID NO: 931974 - RNA, 22 nt, Human
uuuaucugaaaaaacucuugga

SEQ ID NO: 931975 - RNA, 22 nt, Human
agcaagauuuuccuugaauguu

SEQ ID NO: 931976 - RNA, 22 nt, Human
acagcaugagaguagcaaaagg

SEQ ID NO: 931977 - RNA, 22 nt, Human
augcuugggacucccuguagca

SEQ ID NO: 931978 - RNA, 21 nt, Human
uaaaccuggcgcuguucaaag

SEQ ID NO: 931979 - RNA, 22 nt, Human
acauugauacugagauacaaag

SEQ ID NO: 931980 - RNA, 22 nt, Human
acaugaaaagacuaucugauua

SEQ ID NO: 931981 - RNA, 23 nt, Human
aaacuacauuuauaguuuuucuc

SEQ ID NO: 931982 - RNA, 22 nt, Human
uguuguagcuugacagcagcca

SEQ ID NO: 931983 - RNA, 22 nt, Human
cuguggcucaauugccuacuga

SEQ ID NO: 931984 - RNA, 22 nt, Human
ugcuuggagaaucagucccagc

SEQ ID NO: 931985 - RNA, 22 nt, Human
uuuacacugacagcacauaagg

SEQ ID NO: 931986 - RNA, 22 nt, Human
cuuauucagaccuuggauucuu

SEQ ID NO: 931987 - RNA, 22 nt, Human
ccacaugaaauugcuuauauuu

SEQ ID NO: 931988 - RNA, 22 nt, Human
agcuucucuggucuucugccaa

SEQ ID NO: 931989 - RNA, 21 nt, Human
cauuucaugauuauagaaaug

SEQ ID NO: 931990 - RNA, 22 nt, Human
aucauuuacaaacucagcauug

SEQ ID NO: 931991 - RNA, 22 nt, Human
gucuuauuaugagguuagacuu

SEQ ID NO: 931992 - RNA, 22 nt, Human
cacacaugugggauccgcaggg

SEQ ID NO: 931993 - RNA, 22 nt, Human
uaucuguuugcucacagguguu

SEQ ID NO: 931994 - RNA, 22 nt, Human
uaucuguuccaggcacucagcu

SEQ ID NO: 931995 - RNA, 22 nt, Human
aucacaaaggucucagagcaca

SEQ ID NO: 931996 - RNA, 22 nt, Human
aagucacaagcauauaugcauu

SEQ ID NO: 931997 - RNA, 22 nt, Human
agaauuagucacaauuauagga

SEQ ID NO: 931998 - RNA, 22 nt, Human
ugaucuuuuuggucauuugggu

SEQ ID NO: 931999 - RNA, 22 nt, Human
cagaaacagagaaauauuggcu

SEQ ID NO: 932000 - RNA, 22 nt, Human
aacccauuaauccuugcaagca

SEQ ID NO: 932001 - RNA, 22 nt, Human
acaugaguacagauggauguaa

SEQ ID NO: 932002 - RNA, 22 nt, Human
cuuauacacccucuucccaggc

SEQ ID NO: 932003 - RNA, 22 nt, Human
uacauuaacuuacguccacaug

SEQ ID NO: 932004 - RNA, 18 nt, Human
uuauucagacgcauauga

SEQ ID NO: 932005 - RNA, 22 nt, Human
gucaaaaaguagucauuucugu

SEQ ID NO: 932006 - RNA, 22 nt, Human
cucuggcucugacaguugaucc

SEQ ID NO: 932007 - RNA, 22 nt, Human
acugucacuaacuaagucuagu

SEQ ID NO: 932008 - RNA, 22 nt, Human
uacacauucuagggcacaguua

SEQ ID NO: 932009 - RNA, 22 nt, Human
caacacugauuauggcugagcu

SEQ ID NO: 932010 - RNA, 22 nt, Human
gcaguacuuuaucacauggaau

SEQ ID NO: 932011 - RNA, 22 nt, Human
uuacacuugaaaacaggauuua

SEQ ID NO: 932012 - RNA, 22 nt, Human
aacacuguaacagcaucauuuu

SEQ ID NO: 932013 - RNA, 22 nt, Human
uacaguuuuuauucaugacaag

SEQ ID NO: 932014 - RNA, 22 nt, Human
caacagaaggaagcagggucag

SEQ ID NO: 932015 - RNA, 22 nt, Human
ugucuauagccugauuuguugg

SEQ ID NO: 932016 - RNA, 22 nt, Human
uucacaacugccauagccagug

SEQ ID NO: 932017 - RNA, 22 nt, Human
cugugcuuaccugcccagguga

SEQ ID NO: 932018 - RNA, 20 nt, Human
cugcuugggacacugccaga

SEQ ID NO: 932019 - RNA, 22 nt, Human
cagcuaguaaauggcaagacua

SEQ ID NO: 932020 - RNA, 22 nt, Human
guuguacagcauuccauauagg

SEQ ID NO: 932021 - RNA, 18 nt, Human
ccugugcuccagcaucug

SEQ ID NO: 932022 - RNA, 22 nt, Human
uguacuuccccaaugacagcac

SEQ ID NO: 932023 - RNA, 22 nt, Human
ugaguaucaauuacauaguugu

SEQ ID NO: 932024 - RNA, 22 nt, Human
uauggcuuccaggcuggccagg

SEQ ID NO: 932025 - RNA, 22 nt, Human
aaggaauucaaauuuucucugg

SEQ ID NO: 932026 - RNA, 22 nt, Human
augagauaggaacaaacuuaca

SEQ ID NO: 932027 - RNA, 22 nt, Human
agcuguuguuaauuaacucauu

SEQ ID NO: 932028 - RNA, 22 nt, Human
gcuuggcugugagcuuugcugu

SEQ ID NO: 932029 - RNA, 22 nt, Human
ucacaugauguuuccucugugc

SEQ ID NO: 932030 - RNA, 22 nt, Human
acagaauuaaugaaaauuacaa

SEQ ID NO: 932031 - RNA, 22 nt, Human
uuuaccaagauagcaucugguu

SEQ ID NO: 932032 - RNA, 22 nt, Human
aggaaucaggagaugagcacgg

SEQ ID NO: 932033 - RNA, 22 nt, Human
aguucuaagaugcuccacagag

SEQ ID NO: 932034 - RNA, 18 nt, Human
accacaugauaucuugcc

SEQ ID NO: 932035 - RNA, 20 nt, Human
uuuacauuuugaaacaguga

SEQ ID NO: 932036 - RNA, 22 nt, Human
aacacauggguguuuauuguac

SEQ ID NO: 932037 - RNA, 22 nt, Human
aacuucuaaucuguacaguuuu

SEQ ID NO: 932038 - RNA, 22 nt, Human
cugcuuggaguccuccagcacc

SEQ ID NO: 932039 - RNA, 22 nt, Human
uauggcuuuuaaggagaucuga

SEQ ID NO: 932040 - RNA, 22 nt, Human
cuguggcucaaaaucccaugau

SEQ ID NO: 932041 - RNA, 22 nt, Human
cacuucacuuggaugccuuuuc

SEQ ID NO: 932042 - RNA, 22 nt, Human
augcauuuauguguguacauug

SEQ ID NO: 932043 - RNA, 22 nt, Human
cagcagagguuggaacaguucu

SEQ ID NO: 932044 - RNA, 22 nt, Human
cauggcuucaaagccuuuggca

SEQ ID NO: 932045 - RNA, 22 nt, Human
auaggaauuucuucagcacuga

SEQ ID NO: 932046 - RNA, 22 nt, Human
augagauagacuaugucauaca

SEQ ID NO: 932047 - RNA, 22 nt, Human
acacacuggcaggagcuauaaa

SEQ ID NO: 932048 - RNA, 22 nt, Human
agucuacaaagggaagcccuuu

SEQ ID NO: 932049 - RNA, 22 nt, Human
uguuuguacucaaagccaugag

SEQ ID NO: 932050 - RNA, 22 nt, Human
gagcaguaggagaacccugagc

SEQ ID NO: 932051 - RNA, 22 nt, Human
cacaugagacaauuaaagacuu

SEQ ID NO: 932052 - RNA, 22 nt, Human
uuaaccuguaaaaugggagaag

SEQ ID NO: 932053 - RNA, 20 nt, Human
aagcaucuggauguagcaau

SEQ ID NO: 932054 - RNA, 22 nt, Human
ccacaugaaucuuggaagcagg

SEQ ID NO: 932055 - RNA, 19 nt, Human
agacacaucacauuucucc

SEQ ID NO: 932056 - RNA, 22 nt, Human
cacuggcugagcuucucuaggg

SEQ ID NO: 932057 - RNA, 22 nt, Human
uuuuauuggagugauaccaagc

SEQ ID NO: 932058 - RNA, 22 nt, Human
gugcauuugugcaugcacaugu

SEQ ID NO: 932059 - RNA, 22 nt, Human
gcacaugagaagcuggcgaugc

SEQ ID NO: 932060 - RNA, 22 nt, Human
ugaguauuccuuaucugaaaug

SEQ ID NO: 932061 - RNA, 22 nt, Human
uggcuucacugcucaagugauu

SEQ ID NO: 932062 - RNA, 22 nt, Human
gcacaugaguuaagcuggggca

SEQ ID NO: 932063 - RNA, 22 nt, Human
accuucagacaucaacuaucuc

SEQ ID NO: 932064 - RNA, 22 nt, Human
uuuguaacauuauggacugcuu

SEQ ID NO: 932065 - RNA, 22 nt, Human
uccuucaguuaucacaguacug

SEQ ID NO: 932066 - RNA, 22 nt, Human
auucuccacuguaagguuauua

SEQ ID NO: 932067 - RNA, 22 nt, Human
aacuguuacauaguuauagauc

SEQ ID NO: 932068 - RNA, 23 nt, Human
uggcugagauccuacuguuugcu

SEQ ID NO: 932069 - RNA, 18 nt, Human
uuguagcaaauggcagug

SEQ ID NO: 932070 - RNA, 22 nt, Human
guggcuucaugaacacugauga

SEQ ID NO: 932071 - RNA, 22 nt, Human
gucacaaauccccucagcaacu

SEQ ID NO: 932072 - RNA, 22 nt, Human
cugagcuuaacccuguuagcaa

SEQ ID NO: 932073 - RNA, 22 nt, Human
guugcuuguuaguggugagguu

SEQ ID NO: 932074 - RNA, 22 nt, Human
agaaaucaugucuuauuucuau

SEQ ID NO: 932075 - RNA, 17 nt, Human
gcacaaaucaauuacua

SEQ ID NO: 932076 - RNA, 17 nt, Human
aacaguaagcccuguuu

SEQ ID NO: 932077 - RNA, 22 nt, Human
ucacaacuugaagcugauuuaa

SEQ ID NO: 932078 - RNA, 23 nt, Human
agacacauaggagcagcuauugg

SEQ ID NO: 932079 - RNA, 22 nt, Human
uccuucagggggccgccugcac

SEQ ID NO: 932080 - RNA, 22 nt, Human
uucccuuccucacucuacuugu

SEQ ID NO: 932081 - RNA, 19 nt, Human
uaacuuguagauaugaagu

SEQ ID NO: 932082 - RNA, 22 nt, Human
ccacccugugcaggcgugggua

SEQ ID NO: 932083 - RNA, 22 nt, Human
auauauaaccuggauaaggcuu

SEQ ID NO: 932084 - RNA, 22 nt, Human
uuuauugacccaaagcgagagu

SEQ ID NO: 932085 - RNA, 22 nt, Human
cucuguugucaguggaagcagc

SEQ ID NO: 932086 - RNA, 22 nt, Human
ucauggaugauagcuucauugc

SEQ ID NO: 932087 - RNA, 22 nt, Human
caugaguaugauuauacccagu

SEQ ID NO: 932088 - RNA, 22 nt, Human
cuguuacacggaccuucaaauc

SEQ ID NO: 932089 - RNA, 18 nt, Human
cacauuuaccuggcuccc

SEQ ID NO: 932090 - RNA, 22 nt, Human
ugagaagcagcuuacagguguc

SEQ ID NO: 932091 - RNA, 16 nt, Human
gacacaugggggaaaa

SEQ ID NO: 932092 - RNA, 22 nt, Human
uguauacauguguucaugcaug

SEQ ID NO: 932093 - RNA, 22 nt, Human
auggcucugcugggcaaagcaa

SEQ ID NO: 932094 - RNA, 22 nt, Human
cacaugaacaugcuggaaaagc

SEQ ID NO: 932095 - RNA, 22 nt, Human
cuuauucagcaaguuuggguac

SEQ ID NO: 932096 - RNA, 22 nt, Human
caguaugagaguugaaucaagg

SEQ ID NO: 932097 - RNA, 22 nt, Human
acuaacuucugagaaccaauug

SEQ ID NO: 932098 - RNA, 22 nt, Human
uacacauguauuuauguguaca

SEQ ID NO: 932099 - RNA, 22 nt, Human
uuuaucugauauucagcgauuu

SEQ ID NO: 932100 - RNA, 21 nt, Human
augugcuuagcugcugguagu

SEQ ID NO: 932101 - RNA, 22 nt, Human
cagcauauuacuuuaaaaaauc

SEQ ID NO: 932102 - RNA, 22 nt, Human
acaugauuuuaguaucauaaua

SEQ ID NO: 932103 - RNA, 22 nt, Human
ucuguuaugcauaagcaucagu

SEQ ID NO: 932104 - RNA, 22 nt, Human
accugucaucccggcugcaccg

SEQ ID NO: 932105 - RNA, 22 nt, Human
aaaaccugauugaauucuauuu

SEQ ID NO: 932106 - RNA, 22 nt, Human
gacauuuaaauugcaggcagcc

SEQ ID NO: 932107 - RNA, 19 nt, Human
cucuggcuuccaaagcauc

SEQ ID NO: 932108 - RNA, 22 nt, Human
cuguuguaaagcuauucauuug

SEQ ID NO: 932109 - RNA, 22 nt, Human
uuuccacagcuguauaaaauaa

SEQ ID NO: 932110 - RNA, 22 nt, Human
ggaauucucuaugcucuguucc

SEQ ID NO: 932111 - RNA, 22 nt, Human
gagaagcaaucaguggccaccc

SEQ ID NO: 932112 - RNA, 22 nt, Human
agaaacuaagucauaacucuuu

SEQ ID NO: 932113 - RNA, 22 nt, Human
cuguagcagacagacccuaggu

SEQ ID NO: 932114 - RNA, 22 nt, Human
cagcaugaugcucacacaaaac

SEQ ID NO: 932115 - RNA, 22 nt, Human
gacauuuagaagucuaauggcc

SEQ ID NO: 932116 - RNA, 22 nt, Human
aacauguauuuuccuuggcaac

SEQ ID NO: 932117 - RNA, 22 nt, Human
ccuuuacacguaaggcuguuga

SEQ ID NO: 932118 - RNA, 20 nt, Human
auacacauucauagaaaaau

SEQ ID NO: 932119 - RNA, 22 nt, Human
cucuggcuguuugcagcucaag

SEQ ID NO: 932120 - RNA, 17 nt, Human
gcucuggcacaggauug

SEQ ID NO: 932121 - RNA, 22 nt, Human
ugaguauccuauaugguguaag

SEQ ID NO: 932122 - RNA, 22 nt, Human
ucuacacugggggcuuugagca

SEQ ID NO: 932123 - RNA, 22 nt, Human
uuaagagauuuaggaacauuau

SEQ ID NO: 932124 - RNA, 22 nt, Human
uguccucuccaacagccucugu

SEQ ID NO: 932125 - RNA, 22 nt, Human
ucacagaauagcacuguaagcg

SEQ ID NO: 932126 - RNA, 17 nt, Human
ucauuucaguaaaucca

SEQ ID NO: 932127 - RNA, 19 nt, Human
agaugucuauuugacuauc

SEQ ID NO: 932128 - RNA, 23 nt, Human
gaauggcuaagcacauagacuug

SEQ ID NO: 932129 - RNA, 22 nt, Human
uuccaacuuugaaaauguuaug

SEQ ID NO: 932130 - RNA, 22 nt, Human
caugaucugguccuacuguggg

SEQ ID NO: 932131 - RNA, 22 nt, Human
ccuguugucauggaauaaguua

SEQ ID NO: 932132 - RNA, 22 nt, Human
cacugguguacaggagguaaaa

SEQ ID NO: 932133 - RNA, 22 nt, Human
ugcuggcuuuuugugucaaaga

SEQ ID NO: 932134 - RNA, 22 nt, Human
cacaugugggaaauggugcuua

SEQ ID NO: 932135 - RNA, 22 nt, Human
uaaaaccaggucuugggauuua

SEQ ID NO: 932136 - RNA, 22 nt, Human
ccuggcacgaagggcugagguu

SEQ ID NO: 932137 - RNA, 22 nt, Human
acagauauaaacuauaguagug

SEQ ID NO: 932138 - RNA, 22 nt, Human
augugcuuuccaaugcuguagg

SEQ ID NO: 932139 - RNA, 22 nt, Human
augugaaacgcaaugggaucau

SEQ ID NO: 932140 - RNA, 22 nt, Human
uaauaaaugaaagugcuggcau

SEQ ID NO: 932141 - RNA, 22 nt, Human
auuacacuuguucaucaucacc

SEQ ID NO: 932142 - RNA, 22 nt, Human
uuuagccaaucagcuugggagc

SEQ ID NO: 932143 - RNA, 22 nt, Human
cuuucacagcuugaaaaguauu

SEQ ID NO: 932144 - RNA, 21 nt, Human
aggaaugcugaggcucacuuu

SEQ ID NO: 932145 - RNA, 22 nt, Human
ucauuucagccauuuuuaaaug

SEQ ID NO: 932146 - RNA, 22 nt, Human
gaguaauuuucuuaaaacauca

SEQ ID NO: 932147 - RNA, 22 nt, Human
uccuucagaggauaaggaagaa

SEQ ID NO: 932148 - RNA, 22 nt, Human
agagaacacgugcaucugcaau

SEQ ID NO: 932149 - RNA, 21 nt, Human
uaaauaauaaguugcugagau

SEQ ID NO: 932150 - RNA, 22 nt, Human
agaaacagcauuagcaucaauu

SEQ ID NO: 932151 - RNA, 22 nt, Human
cuuuuacauuuguugaagagua

SEQ ID NO: 932152 - RNA, 22 nt, Human
acacuucucuuugaagaacaau

SEQ ID NO: 932153 - RNA, 20 nt, Human
auucacaaagccaguguugc

SEQ ID NO: 932154 - RNA, 22 nt, Human
agagcauccauuuuugucacau

SEQ ID NO: 932155 - RNA, 22 nt, Human
uaccaagguaguggagacagaa

SEQ ID NO: 932156 - RNA, 22 nt, Human
uucagcaagugucucuacuguc

SEQ ID NO: 932157 - RNA, 22 nt, Human
auacaugaggaggcuggaaaca

SEQ ID NO: 932158 - RNA, 22 nt, Human
gcuuccuucuaccacaucaugc

SEQ ID NO: 932159 - RNA, 22 nt, Human
agaucagagaugcuaaaagagc

SEQ ID NO: 932160 - RNA, 22 nt, Human
auuacaaucgagagaaacaaau

SEQ ID NO: 932161 - RNA, 18 nt, Human
ucacaugacagcuguugc

SEQ ID NO: 932162 - RNA, 22 nt, Human
uuuauuagugcuuguaucacug

SEQ ID NO: 932163 - RNA, 22 nt, Human
uauggcuuaugcugaacaccug

SEQ ID NO: 932164 - RNA, 22 nt, Human
caguauguuugggagacaugac

SEQ ID NO: 932165 - RNA, 22 nt, Human
gaucuguuucauucacagucug

SEQ ID NO: 932166 - RNA, 22 nt, Human
uucucuugugccaaguuguugc

SEQ ID NO: 932167 - RNA, 19 nt, Human
uacacuuguaaugagcaga

SEQ ID NO: 932168 - RNA, 22 nt, Human
uuacacauugcagaucaaaaug

SEQ ID NO: 932169 - RNA, 22 nt, Human
aaugcuguugaguuguuccugu

SEQ ID NO: 932170 - RNA, 22 nt, Human
ucacacauucuagguauguuga

SEQ ID NO: 932171 - RNA, 17 nt, Human
acaguaacuauguuaug

SEQ ID NO: 932172 - RNA, 22 nt, Human
aauggcuuauguaaugcuguuu

SEQ ID NO: 932173 - RNA, 22 nt, Human
ccuaacuucacuucauugaagu

SEQ ID NO: 932174 - RNA, 20 nt, Human
uggaccauaaacaccaggua

SEQ ID NO: 932175 - RNA, 22 nt, Human
uggcuucuucauaugugaucuu

SEQ ID NO: 932176 - RNA, 22 nt, Human
cacccuguacaaauggacaucu

SEQ ID NO: 932177 - RNA, 22 nt, Human
cuuuacaccaagcagaucuuuc

SEQ ID NO: 932178 - RNA, 22 nt, Human
uuuauuaauguagcauccaugg

SEQ ID NO: 932179 - RNA, 22 nt, Human
uccuucagaggacggcagccag

SEQ ID NO: 932180 - RNA, 22 nt, Human
accugucaaguccagcgcaaca

SEQ ID NO: 932181 - RNA, 22 nt, Human
uacaaugauuagcuaacuugcc

SEQ ID NO: 932182 - RNA, 22 nt, Human
caggagaugacagggaagaacc

SEQ ID NO: 932183 - RNA, 22 nt, Human
cacuuuacuaucuauaaaauaa

SEQ ID NO: 932184 - RNA, 22 nt, Human
ucugcuugcguucugcucccuc

SEQ ID NO: 932185 - RNA, 22 nt, Human
augucccuugucugugaugucu

SEQ ID NO: 932186 - RNA, 22 nt, Human
uuuacaucucaccagauucaua

SEQ ID NO: 932187 - RNA, 22 nt, Human
uacaucuuugucuaugaccagc

SEQ ID NO: 932188 - RNA, 22 nt, Human
aaacaguggccaauucuggaga

SEQ ID NO: 932189 - RNA, 22 nt, Human
gauggcuugcuuagugacagca

SEQ ID NO: 932190 - RNA, 22 nt, Human
uucuauuuccaguccuucagag

SEQ ID NO: 932191 - RNA, 22 nt, Human
uagaaacaugagagaaacucuu

SEQ ID NO: 932192 - RNA, 22 nt, Human
uucacauuacaaggccauauuu

SEQ ID NO: 932193 - RNA, 22 nt, Human
cagugccagagguacuagugga

SEQ ID NO: 932194 - RNA, 22 nt, Human
uucaacagcuuccaaagugugu

SEQ ID NO: 932195 - RNA, 22 nt, Human
cuucucuggcuccucagcgccc

SEQ ID NO: 932196 - RNA, 22 nt, Human
aauugauggacagagaugaaga

SEQ ID NO: 932197 - RNA, 22 nt, Human
acacucuugcauuaccugaaua

SEQ ID NO: 932198 - RNA, 21 nt, Human
uccuggcuuuaugcuaccucu

SEQ ID NO: 932199 - RNA, 22 nt, Human
cucuggcucuguugagauuugu

SEQ ID NO: 932200 - RNA, 22 nt, Human
agacauuuggaagauacacaua

SEQ ID NO: 932201 - RNA, 20 nt, Human
gauaaauugucucuuaagug

SEQ ID NO: 932202 - RNA, 22 nt, Human
uggcucucuuguaagguaguag

SEQ ID NO: 932203 - RNA, 22 nt, Human
uaucuguucauguuuauauguc

SEQ ID NO: 932204 - RNA, 22 nt, Human
ucugugcuaauuuauccuuccu

SEQ ID NO: 932205 - RNA, 22 nt, Human
cugaugcucuggauguagucaa

SEQ ID NO: 932206 - RNA, 21 nt, Human
aguucacaggaacaagcaggg

SEQ ID NO: 932207 - RNA, 22 nt, Human
aauaacaggguugauuugcaau

SEQ ID NO: 932208 - RNA, 22 nt, Human
agagaacuucuccuaaaucuca

SEQ ID NO: 932209 - RNA, 22 nt, Human
uagcacaucuucuuggccugca

SEQ ID NO: 932210 - RNA, 22 nt, Human
acacagaguuauuaugugaacu

SEQ ID NO: 932211 - RNA, 23 nt, Human
ccuguugggacagcuuuaccaga

SEQ ID NO: 932212 - RNA, 22 nt, Human
cuucaguauccuccacauguua

SEQ ID NO: 932213 - RNA, 22 nt, Human
gagcacugauuuauuuuugucu

SEQ ID NO: 932214 - RNA, 22 nt, Human
cccugcacacucgugucuugac

SEQ ID NO: 932215 - RNA, 22 nt, Human
gaugucuuucugugugccuaga

SEQ ID NO: 932216 - RNA, 22 nt, Human
ucacagcacauggaccgagucc

SEQ ID NO: 932217 - RNA, 22 nt, Human
aaucuguuuuaucauuuguuac

SEQ ID NO: 932218 - RNA, 20 nt, Human
ggaaggcuguuuuuccacca

SEQ ID NO: 932219 - RNA, 22 nt, Human
uuacacaaagcuccccaaauag

SEQ ID NO: 932220 - RNA, 22 nt, Human
ggcucugccauuuccuagcugc

SEQ ID NO: 932221 - RNA, 22 nt, Human
ugucaccacuggcugaaacacc

SEQ ID NO: 932222 - RNA, 22 nt, Human
aauucuaaauguaauuuagaau

SEQ ID NO: 932223 - RNA, 22 nt, Human
cauuucaccuuagagaauuauu

SEQ ID NO: 932224 - RNA, 22 nt, Human
ccacugauccugacuuuggagc

SEQ ID NO: 932225 - RNA, 22 nt, Human
ugaugcauugccgacuuacugg

SEQ ID NO: 932226 - RNA, 22 nt, Human
gcagagaagaugcccaggcuuc

SEQ ID NO: 932227 - RNA, 22 nt, Human
gacaaugguggauacaugucau

SEQ ID NO: 932228 - RNA, 22 nt, Human
uggcuagaauuggguucacagg

SEQ ID NO: 932229 - RNA, 22 nt, Human
gcagaggaucaggcucuggaaa

SEQ ID NO: 932230 - RNA, 22 nt, Human
uuguagcaucaaucaguacuuu

SEQ ID NO: 932231 - RNA, 22 nt, Human
acaugcuuguuuuucacaaccu

SEQ ID NO: 932232 - RNA, 22 nt, Human
gcuuuacauaaacauuuauuau

SEQ ID NO: 932233 - RNA, 22 nt, Human
ggaaggggagcuggaaagggua

SEQ ID NO: 932234 - RNA, 22 nt, Human
ucacagaagaugcuggauguug

SEQ ID NO: 932235 - RNA, 22 nt, Human
acacuuuaucucaucucagaca

SEQ ID NO: 932236 - RNA, 22 nt, Human
ggucuucuggaaagcagacugu

SEQ ID NO: 932237 - RNA, 22 nt, Human
ccaccaagucccacuauaauuu

SEQ ID NO: 932238 - RNA, 18 nt, Human
ucacaugauuacccuggg

SEQ ID NO: 932239 - RNA, 22 nt, Human
gacauuuaauaguauuguggga

SEQ ID NO: 932240 - RNA, 22 nt, Human
cacacauggucaguggcuacuc

SEQ ID NO: 932241 - RNA, 22 nt, Human
acccugauauagguccaagagc

SEQ ID NO: 932242 - RNA, 22 nt, Human
auucacaaguugauggauauuu

SEQ ID NO: 932243 - RNA, 22 nt, Human
ucacaaaugaccaugguuacua

SEQ ID NO: 932244 - RNA, 23 nt, Human
ucuuuacagcagcaggauuugga

SEQ ID NO: 932245 - RNA, 22 nt, Human
uucuuugggcaauugcuggccc

SEQ ID NO: 932246 - RNA, 22 nt, Human
ccauuucauugccuguaaagug

SEQ ID NO: 932247 - RNA, 22 nt, Human
acacaggacagggauguguuuu

SEQ ID NO: 932248 - RNA, 22 nt, Human
cauggcuuuguucauauaauuu

SEQ ID NO: 932249 - RNA, 22 nt, Human
acaugauauuaaugucuuauuu

SEQ ID NO: 932250 - RNA, 22 nt, Human
cacagagacaugaugucauugc

SEQ ID NO: 932251 - RNA, 22 nt, Human
caucuuauuuucuucuagugcu

SEQ ID NO: 932252 - RNA, 22 nt, Human
uuuauugcuggccaccuguagc

SEQ ID NO: 932253 - RNA, 22 nt, Human
cuguuggaugugacacuguuag

SEQ ID NO: 932254 - RNA, 22 nt, Human
cuucuuggacuacucacuagag

SEQ ID NO: 932255 - RNA, 22 nt, Human
acauucuagaagagcuucacuu

SEQ ID NO: 932256 - RNA, 22 nt, Human
caguuuauagcucuagcagcuu

SEQ ID NO: 932257 - RNA, 22 nt, Human
aaaccuguggccacuaaauuug

SEQ ID NO: 932258 - RNA, 22 nt, Human
aaacuguugugguuuaucauua

SEQ ID NO: 932259 - RNA, 22 nt, Human
uucuccuggagugcuuguuggg

SEQ ID NO: 932260 - RNA, 22 nt, Human
aucuguguaugugaccuuaucu

SEQ ID NO: 932261 - RNA, 22 nt, Human
auucaaauuaaguuaauucagc

SEQ ID NO: 932262 - RNA, 22 nt, Human
uauacacauccuccaaagauag

SEQ ID NO: 932263 - RNA, 22 nt, Human
ugugcuaaggcagucuaucaca

SEQ ID NO: 932264 - RNA, 22 nt, Human
uuacacaugcucacuuauuugu

SEQ ID NO: 932265 - RNA, 22 nt, Human
guggcuuccaugugcaucugac

SEQ ID NO: 932266 - RNA, 22 nt, Human
auaacagugaccucucagcacc

SEQ ID NO: 932267 - RNA, 22 nt, Human
uuacacaugaagguccaauguu

SEQ ID NO: 932268 - RNA, 17 nt, Human
cuucucuggcagaagau

SEQ ID NO: 932269 - RNA, 22 nt, Human
acaaacagcuaacauauguuaa

SEQ ID NO: 932270 - RNA, 22 nt, Human
aauucaaauuacaauaguuguu

SEQ ID NO: 932271 - RNA, 22 nt, Human
accuucaggugagcacacagau

SEQ ID NO: 932272 - RNA, 22 nt, Human
acucuggcuugaggaccagguc

SEQ ID NO: 932273 - RNA, 22 nt, Human
cuuuguuguuaauuggcgcuua

SEQ ID NO: 932274 - RNA, 23 nt, Human
ucugugcuacaaaucgcgucugu

SEQ ID NO: 932275 - RNA, 20 nt, Human
auuauucauacaugugugac

SEQ ID NO: 932276 - RNA, 21 nt, Human
uccucuccaugaucuguuugu

SEQ ID NO: 932277 - RNA, 22 nt, Human
cagcagagcugggaauaaaauu

SEQ ID NO: 932278 - RNA, 22 nt, Human
guggcuucaccccaguugucuc

SEQ ID NO: 932279 - RNA, 22 nt, Human
ccuggcacaucuaacucacucu

SEQ ID NO: 932280 - RNA, 22 nt, Human
uagaaacagagcagguggccca

SEQ ID NO: 932281 - RNA, 22 nt, Human
ucuucuccuuugccauguguuu

SEQ ID NO: 932282 - RNA, 22 nt, Human
acaguacagcugaaacuuuagu

SEQ ID NO: 932283 - RNA, 22 nt, Human
auuacacauagacauucguuca

SEQ ID NO: 932284 - RNA, 22 nt, Human
uuuauucaagaugagguucaug

SEQ ID NO: 932285 - RNA, 22 nt, Human
cauggcuuuguucuguuagaug

SEQ ID NO: 932286 - RNA, 22 nt, Human
acugucacuugcaacugugagg

SEQ ID NO: 932287 - RNA, 22 nt, Human
auggcuuccucuggauuggauu

SEQ ID NO: 932288 - RNA, 22 nt, Human
agcuucucucuuugcacucaca

SEQ ID NO: 932289 - RNA, 22 nt, Human
cagaagcuuugcucauaaccau

SEQ ID NO: 932290 - RNA, 22 nt, Human
cacauuuaauccuuuauaagua

SEQ ID NO: 932291 - RNA, 22 nt, Human
guucacaagaguuacagacaga

SEQ ID NO: 932292 - RNA, 22 nt, Human
uuuguuuugaacuagcucagaa

SEQ ID NO: 932293 - RNA, 22 nt, Human
aacaugugucuugcauuucuug

SEQ ID NO: 932294 - RNA, 23 nt, Human
uguaacuugauggaaugagcuau

SEQ ID NO: 932295 - RNA, 22 nt, Human
agcuuccuacaaccaucucaga

SEQ ID NO: 932296 - RNA, 22 nt, Human
gagcuucagagaccacuuaacu

SEQ ID NO: 932297 - RNA, 20 nt, Human
aauuuuaucuccauccuuug

SEQ ID NO: 932298 - RNA, 22 nt, Human
aucaccaggcaaaaugucagag

SEQ ID NO: 932299 - RNA, 23 nt, Human
uggcuucugccccauucucucca

SEQ ID NO: 932300 - RNA, 22 nt, Human
uuauugcaacuccuaaauagag

SEQ ID NO: 932301 - RNA, 22 nt, Human
ggcuucucagcacacuguccac

SEQ ID NO: 932302 - RNA, 22 nt, Human
agaaacaucgcuuaguccucau

SEQ ID NO: 932303 - RNA, 22 nt, Human
cacacaugucucuccaugcucu

SEQ ID NO: 932304 - RNA, 22 nt, Human
acaucaguaacuguaaaacagg

SEQ ID NO: 932305 - RNA, 18 nt, Human
uggcuucugcuagcugga

SEQ ID NO: 932306 - RNA, 22 nt, Human
uaccauuugagagagaacauaa

SEQ ID NO: 932307 - RNA, 22 nt, Human
ugugaaaaaaguucuagaagga

SEQ ID NO: 932308 - RNA, 22 nt, Human
agcagagaccugguuuuguuga

SEQ ID NO: 932309 - RNA, 22 nt, Human
ucucuucuagcuucuugugguu

SEQ ID NO: 932310 - RNA, 22 nt, Human
aaugucuuucucauaacagaua

SEQ ID NO: 932311 - RNA, 22 nt, Human
uuuauucagcagcagcaguggu

SEQ ID NO: 932312 - RNA, 22 nt, Human
aaucacauuagugaaacacuga

SEQ ID NO: 932313 - RNA, 22 nt, Human
ggcuuccuggggccuccugcaa

SEQ ID NO: 932314 - RNA, 22 nt, Human
gaagcuucuggcauuucucaaa

SEQ ID NO: 932315 - RNA, 22 nt, Human
acacuuuaagcauuucacacug

SEQ ID NO: 932316 - RNA, 22 nt, Human
uuuaccacaauuuuaaacaaug

SEQ ID NO: 932317 - RNA, 22 nt, Human
uauggcuucucagucaugaaaa

SEQ ID NO: 932318 - RNA, 22 nt, Human
aacagaaucuuggguucuuuuc

SEQ ID NO: 932319 - RNA, 22 nt, Human
uuacacuuuaaauccagcuugu

SEQ ID NO: 932320 - RNA, 22 nt, Human
cacuucaccacuaggcuauacu

SEQ ID NO: 932321 - RNA, 22 nt, Human
aagacaauuugauacuaguugc

SEQ ID NO: 932322 - RNA, 22 nt, Human
gcauggcuguugaagucagcuc

SEQ ID NO: 932323 - RNA, 22 nt, Human
aaucuguuuccauuagagucau

SEQ ID NO: 932324 - RNA, 22 nt, Human
ucacaagagcuggacugucuuu

SEQ ID NO: 932325 - RNA, 22 nt, Human
uaacacauagauauuuuaacuu

SEQ ID NO: 932326 - RNA, 22 nt, Human
cacaagauggucacauaagugc

SEQ ID NO: 932327 - RNA, 22 nt, Human
cucuggcuugguaaaaacuucu

SEQ ID NO: 932328 - RNA, 22 nt, Human
augugcuugaagccucagagaa

SEQ ID NO: 932329 - RNA, 22 nt, Human
uguuauccucagcucaccucua

SEQ ID NO: 932330 - RNA, 22 nt, Human
ucacagcacccugaggugcugg

SEQ ID NO: 932331 - RNA, 22 nt, Human
cacaugagugagaacaugcagu

SEQ ID NO: 932332 - RNA, 22 nt, Human
cuuuuagcuguuuccauggcaa

SEQ ID NO: 932333 - RNA, 19 nt, Human
cacuguuguccuaguacuu

SEQ ID NO: 932334 - RNA, 22 nt, Human
uuacaauugagucuauuguaug

SEQ ID NO: 932335 - RNA, 22 nt, Human
ucuguuaucucaagucacaaga

SEQ ID NO: 932336 - RNA, 22 nt, Human
uuuauuauguacaggcacuaua

SEQ ID NO: 932337 - RNA, 22 nt, Human
cuucccugagcuuucucaggcu

SEQ ID NO: 932338 - RNA, 22 nt, Human
guacuucuuaaauuaggaucaa

SEQ ID NO: 932339 - RNA, 19 nt, Human
uuucucugugcaccuuuuc

SEQ ID NO: 932340 - RNA, 22 nt, Human
cuugcuuguuuaguucacagau

SEQ ID NO: 932341 - RNA, 22 nt, Human
uuguugggcaugcaguggcugu

SEQ ID NO: 932342 - RNA, 22 nt, Human
aaagcagcaaguauuuguuacu

SEQ ID NO: 932343 - RNA, 22 nt, Human
acauuguaguuguucugcagca

SEQ ID NO: 932344 - RNA, 22 nt, Human
ggaaggaacaaacccugugugg

SEQ ID NO: 932345 - RNA, 22 nt, Human
aaaucaucucugcauccuuagc

SEQ ID NO: 932346 - RNA, 22 nt, Human
uugugaauggugccgcaauaaa

SEQ ID NO: 932347 - RNA, 20 nt, Human
uuuauucacagagaagaguu

SEQ ID NO: 932348 - RNA, 23 nt, Human
ucaucaaaggaaguacgugucac

SEQ ID NO: 932349 - RNA, 22 nt, Human
aguacacuaugguaacuggagu

SEQ ID NO: 932350 - RNA, 22 nt, Human
cguuuauuuugaagauuccacu

SEQ ID NO: 932351 - RNA, 22 nt, Human
uuacccagggaccaagagaaac

SEQ ID NO: 932352 - RNA, 20 nt, Human
agaagcaucauucugauguc

SEQ ID NO: 932353 - RNA, 22 nt, Human
ugcuuggcuucauuuaaguuuu

SEQ ID NO: 932354 - RNA, 22 nt, Human
uggcuucucgccugucaucccg

SEQ ID NO: 932355 - RNA, 22 nt, Human
gcuccugcccucuugcaauucc

SEQ ID NO: 932356 - RNA, 23 nt, Human
aaguaacagggauaauagcaguu

SEQ ID NO: 932357 - RNA, 22 nt, Human
acaguaugaaugcagaauguag

SEQ ID NO: 932358 - RNA, 22 nt, Human
aagauacauuuucuucagagaa

SEQ ID NO: 932359 - RNA, 22 nt, Human
uacaaucacccaaagagccaga

SEQ ID NO: 932360 - RNA, 22 nt, Human
aucacaaaggcugcuucaugau

SEQ ID NO: 932361 - RNA, 23 nt, Human
cuguuauauucuagggagcugca

SEQ ID NO: 932362 - RNA, 22 nt, Human
uauggcuuugggccaaaucuac

SEQ ID NO: 932363 - RNA, 22 nt, Human
auacacauuugcuagagauggg

SEQ ID NO: 932364 - RNA, 17 nt, Human
aaucuguuuacagucag

SEQ ID NO: 932365 - RNA, 22 nt, Human
ucacaugaggcauccccgggca

SEQ ID NO: 932366 - RNA, 22 nt, Human
aagaguaaaugucuaauuagga

SEQ ID NO: 932367 - RNA, 22 nt, Human
acacuuugggcuggauaauuau

SEQ ID NO: 932368 - RNA, 22 nt, Human
ccucucuguguggccucuccau

SEQ ID NO: 932369 - RNA, 22 nt, Human
cauucccuuggggaguucaugc

SEQ ID NO: 932370 - RNA, 22 nt, Human
acacaugaaauaauauuaugca

SEQ ID NO: 932371 - RNA, 22 nt, Human
ucacauuugauaaugcccauug

SEQ ID NO: 932372 - RNA, 22 nt, Human
gaaacacauaugaacaguugau

SEQ ID NO: 932373 - RNA, 22 nt, Human
caugcagugacucagacacagg

SEQ ID NO: 932374 - RNA, 22 nt, Human
uugaaacagacaaguaaauguc

SEQ ID NO: 932375 - RNA, 22 nt, Human
cuguccaccuuugauaggcucu

SEQ ID NO: 932376 - RNA, 22 nt, Human
auuguauaauuguauugccaaa

SEQ ID NO: 932377 - RNA, 22 nt, Human
cuguggcuucugggucaguuca

SEQ ID NO: 932378 - RNA, 22 nt, Human
ucuuuguaagaaauucuuccgu

SEQ ID NO: 932379 - RNA, 22 nt, Human
aauucaaauuugaguuugugau

SEQ ID NO: 932380 - RNA, 22 nt, Human
uggcugcugcucacucagccuc

SEQ ID NO: 932381 - RNA, 22 nt, Human
caucaguaaggcaacauagcuu

SEQ ID NO: 932382 - RNA, 22 nt, Human
ggaaggaaauuggggcaguugu

SEQ ID NO: 932383 - RNA, 21 nt, Human
uucaggguuucacaauacuaa

SEQ ID NO: 932384 - RNA, 22 nt, Human
gaagacuacuguugcacucaua

SEQ ID NO: 932385 - RNA, 22 nt, Human
uauggcuuguggagaguuguag

SEQ ID NO: 932386 - RNA, 22 nt, Human
ucacaggagucaaggaauagua

SEQ ID NO: 932387 - RNA, 22 nt, Human
cuaggcucagucucuggucugu

SEQ ID NO: 932388 - RNA, 22 nt, Human
acauugaugaaaagguaucauu

SEQ ID NO: 932389 - RNA, 22 nt, Human
acaguagucucaggaauaggca

SEQ ID NO: 932390 - RNA, 21 nt, Human
ucagagaauggccuacucuca

SEQ ID NO: 932391 - RNA, 22 nt, Human
cagguggcagaggucucuggaa

SEQ ID NO: 932392 - RNA, 22 nt, Human
uuuguaacuuuagaauugaucc

SEQ ID NO: 932393 - RNA, 19 nt, Human
uuuuaaguccucucuauuc

SEQ ID NO: 932394 - RNA, 22 nt, Human
uaaccuuuggugaaauauuaac

SEQ ID NO: 932395 - RNA, 22 nt, Human
cacauuuauuugaggcuaauug

SEQ ID NO: 932396 - RNA, 21 nt, Human
ccuuuacaauuuugcauuccu

SEQ ID NO: 932397 - RNA, 22 nt, Human
ucaucaaagcgcuuggaguagg

SEQ ID NO: 932398 - RNA, 22 nt, Human
caugauaacuucauuacacaau

SEQ ID NO: 932399 - RNA, 22 nt, Human
acuucacacagcaaauuuaucu

SEQ ID NO: 932400 - RNA, 22 nt, Human
uccacugugcagcucugcugau

SEQ ID NO: 932401 - RNA, 21 nt, Human
acuguuauucccauuuucacc

SEQ ID NO: 932402 - RNA, 22 nt, Human
uggcuucugggacuugugagca

SEQ ID NO: 932403 - RNA, 22 nt, Human
aagacuaaauguguucuaaagu

SEQ ID NO: 932404 - RNA, 22 nt, Human
cuuguuauuggaaaugucaugc

SEQ ID NO: 932405 - RNA, 22 nt, Human
ucacaaaugucuccuguccugu

SEQ ID NO: 932406 - RNA, 22 nt, Human
guucacaaauaugcacuuacga

SEQ ID NO: 932407 - RNA, 18 nt, Human
ggcuucucacugaccuca

SEQ ID NO: 932408 - RNA, 22 nt, Human
ccuucagucccauguuucucuu

SEQ ID NO: 932409 - RNA, 22 nt, Human
aaugucuuuucccuuacuuucc

SEQ ID NO: 932410 - RNA, 22 nt, Human
cucuuuguggaacggcaguguc

SEQ ID NO: 932411 - RNA, 22 nt, Human
cuuuacacauccuaaccagugu

SEQ ID NO: 932412 - RNA, 22 nt, Human
uacacugugguaaacucaaagu

SEQ ID NO: 932413 - RNA, 22 nt, Human
uaauggcuaaaauucagaagaa

SEQ ID NO: 932414 - RNA, 22 nt, Human
agcaguaagacuuuuuucugug

SEQ ID NO: 932415 - RNA, 22 nt, Human
acccaugaguguaucuuuaaaa

SEQ ID NO: 932416 - RNA, 22 nt, Human
ugucacuuugccuucuggacuu

SEQ ID NO: 932417 - RNA, 22 nt, Human
caauagcaggucuacagagaga

SEQ ID NO: 932418 - RNA, 20 nt, Human
cugcuugggccccucuggcc

SEQ ID NO: 932419 - RNA, 22 nt, Human
ugacuucugggugagccagcau

SEQ ID NO: 932420 - RNA, 22 nt, Human
acacaugugauucuaagacagc

SEQ ID NO: 932421 - RNA, 22 nt, Human
uuugugaagggaacagaagugu

SEQ ID NO: 932422 - RNA, 22 nt, Human
cacacaugagucuccccauugg

SEQ ID NO: 932423 - RNA, 22 nt, Human
caguaacaugucuguuaagaaa

SEQ ID NO: 932424 - RNA, 22 nt, Human
aaauacaguguguguucuuuga

SEQ ID NO: 932425 - RNA, 22 nt, Human
auucacaaaugcugccccauuc

SEQ ID NO: 932426 - RNA, 22 nt, Human
uuacacauuaacaggcagcuaa

SEQ ID NO: 932427 - RNA, 19 nt, Human
ucacaugaagccuagagaa

SEQ ID NO: 932428 - RNA, 22 nt, Human
acacaugcucauaaauaaauag

SEQ ID NO: 932429 - RNA, 21 nt, Human
acacauuaugagcauagacuc

SEQ ID NO: 932430 - RNA, 22 nt, Human
acaguaaaaagccuuagaauuu

SEQ ID NO: 932431 - RNA, 22 nt, Human
aagcauuuauagauaagaauuu

SEQ ID NO: 932432 - RNA, 22 nt, Human
ucuguuauaaaucacacugcau

SEQ ID NO: 932433 - RNA, 22 nt, Human
uggcuucuugacuucuuggcug

SEQ ID NO: 932434 - RNA, 22 nt, Human
uaaacagcuacugugucaaagg

SEQ ID NO: 932435 - RNA, 22 nt, Human
acacauuaucucauuaaauacu

SEQ ID NO: 932436 - RNA, 22 nt, Human
cagagaaagacuugcccuuagu

SEQ ID NO: 932437 - RNA, 22 nt, Human
gccaccaugucuggcugaguuu

SEQ ID NO: 932438 - RNA, 22 nt, Human
guagcaucuguuggcugcuccu

SEQ ID NO: 932439 - RNA, 22 nt, Human
agcucacauucucaucagaugu

SEQ ID NO: 932440 - RNA, 22 nt, Human
augaaacagaguacuuaauaua

SEQ ID NO: 932441 - RNA, 22 nt, Human
ucuggcucuauaacuccuagcu

SEQ ID NO: 932442 - RNA, 22 nt, Human
acacauggucuacuucuucuca

SEQ ID NO: 932443 - RNA, 22 nt, Human
caaggaauauuuaagaacguca

SEQ ID NO: 932444 - RNA, 22 nt, Human
auuuguugcuagcagcacugau

SEQ ID NO: 932445 - RNA, 22 nt, Human
augauauuugcaaugugcuugc

SEQ ID NO: 932446 - RNA, 22 nt, Human
ugucuuucugcaccaccucaca

SEQ ID NO: 932447 - RNA, 22 nt, Human
auggcuuuguguucagagcuga

SEQ ID NO: 932448 - RNA, 22 nt, Human
ucuguuauucugucuauugcca

SEQ ID NO: 932449 - RNA, 22 nt, Human
uuauucacucauuuaacauuau

SEQ ID NO: 932450 - RNA, 22 nt, Human
gauauauguaaaaguagacaga

SEQ ID NO: 932451 - RNA, 22 nt, Human
cuguuacuguauuuaaucaucu

SEQ ID NO: 932452 - RNA, 22 nt, Human
acacagugguguuuacaaaauu

SEQ ID NO: 932453 - RNA, 22 nt, Human
acacaugaccuccgcagcagca

SEQ ID NO: 932454 - RNA, 22 nt, Human
uuacacaugucucaguggaaau

SEQ ID NO: 932455 - RNA, 22 nt, Human
ucuuggcugcguccuggcugug

SEQ ID NO: 932456 - RNA, 22 nt, Human
uauggcuuaggagaguuuaacu

SEQ ID NO: 932457 - RNA, 22 nt, Human
guuuuacaagguuaaucagcag

SEQ ID NO: 932458 - RNA, 22 nt, Human
ucuguagcuucuugagaggcca

SEQ ID NO: 932459 - RNA, 22 nt, Human
agauggcugggccccaccccag

SEQ ID NO: 932460 - RNA, 22 nt, Human
ucugugcuuucccugccuucuu

SEQ ID NO: 932461 - RNA, 22 nt, Human
cauggcuuuuagcccuacauga

SEQ ID NO: 932462 - RNA, 22 nt, Human
uuuacacauaccucuuuaaagu

SEQ ID NO: 932463 - RNA, 22 nt, Human
auggcuugauagaaagcuaguu

SEQ ID NO: 932464 - RNA, 22 nt, Human
uaucuguuaaaacaagcuuuaa

SEQ ID NO: 932465 - RNA, 22 nt, Human
uuaaauaguaggucuauuuugg

SEQ ID NO: 932466 - RNA, 22 nt, Human
aguuacaaacacuaucaguucu

SEQ ID NO: 932467 - RNA, 22 nt, Human
gaaauguaggcauaauuauuuu

SEQ ID NO: 932468 - RNA, 22 nt, Human
aagagauugguuauaagagauu

SEQ ID NO: 932469 - RNA, 18 nt, Human
cauuccaaguucuaccuc

SEQ ID NO: 932470 - RNA, 22 nt, Human
uugucuggucaaaucacuugua

SEQ ID NO: 932471 - RNA, 19 nt, Human
auaaauaaaaagugggaga

SEQ ID NO: 932472 - RNA, 22 nt, Human
ugaguucucaugaaaucuaguu

SEQ ID NO: 932473 - RNA, 22 nt, Human
ccacuguuuccuuucugcuggc

SEQ ID NO: 932474 - RNA, 22 nt, Human
agccauuuugguaaugauaaca

SEQ ID NO: 932475 - RNA, 22 nt, Human
ugucucuucagcccauggcuuc

SEQ ID NO: 932476 - RNA, 23 nt, Human
ucacauuuaaccccucagaccuc

SEQ ID NO: 932477 - RNA, 22 nt, Human
ccuggcacauaauaguggcuca

SEQ ID NO: 932478 - RNA, 23 nt, Human
ugagucaccacaguuacagucac

SEQ ID NO: 932479 - RNA, 17 nt, Human
auggcuuugucacacag

SEQ ID NO: 932480 - RNA, 21 nt, Human
cuuauucacuguuauuuauca

SEQ ID NO: 932481 - RNA, 22 nt, Human
auuucuacaguacacaugcauu

SEQ ID NO: 932482 - RNA, 22 nt, Human
gaaaacauccagagauagaccu

SEQ ID NO: 932483 - RNA, 21 nt, Human
uacaugaguguaugagcauau

SEQ ID NO: 932484 - RNA, 18 nt, Human
acaguaaagaaaggaauu

SEQ ID NO: 932485 - RNA, 20 nt, Human
uucuaauuugauggaguagc

SEQ ID NO: 932486 - RNA, 22 nt, Human
ugaguucaaagacagguauagg

SEQ ID NO: 932487 - RNA, 22 nt, Human
aaaccaucagauaauucauacu

SEQ ID NO: 932488 - RNA, 22 nt, Human
acaagguuugguaccacaucca

SEQ ID NO: 932489 - RNA, 22 nt, Human
cauucuaucuuggacuggaucu

SEQ ID NO: 932490 - RNA, 22 nt, Human
aaacacaucauucaugucguca

SEQ ID NO: 932491 - RNA, 22 nt, Human
gacaguauccagguggugaaga

SEQ ID NO: 932492 - RNA, 21 nt, Human
gcacaugagggagggcaugcc

SEQ ID NO: 932493 - RNA, 22 nt, Human
gagaagcaaucagcagccaccc

SEQ ID NO: 932494 - RNA, 22 nt, Human
aguucccaggugaugcugaugu

SEQ ID NO: 932495 - RNA, 22 nt, Human
caccacuguaucccuagcacuu

SEQ ID NO: 932496 - RNA, 22 nt, Human
uuacucugaauguuucuacuga

SEQ ID NO: 932497 - RNA, 23 nt, Human
aaacuucaguagugucaucagcc

SEQ ID NO: 932498 - RNA, 22 nt, Human
uuauuauggcaguuuucuaggu

SEQ ID NO: 932499 - RNA, 22 nt, Human
uuugacaccaggagagaaaaca

SEQ ID NO: 932500 - RNA, 22 nt, Human
uuuuauugggaguccucuacug

SEQ ID NO: 932501 - RNA, 22 nt, Human
cuagaaacauuacauguguuaa

SEQ ID NO: 932502 - RNA, 22 nt, Human
gagaagcaaucgugacaucucc

SEQ ID NO: 932503 - RNA, 22 nt, Human
gcuuuacacagcugguucuugu

SEQ ID NO: 932504 - RNA, 18 nt, Human
ugcuuggagcauuuacca

SEQ ID NO: 932505 - RNA, 22 nt, Human
cuggcuucccugucuuauggaa

SEQ ID NO: 932506 - RNA, 22 nt, Human
ucuucauuuuacaggcagaccu

SEQ ID NO: 932507 - RNA, 22 nt, Human
agagaacauauuuuguaugauu

SEQ ID NO: 932508 - RNA, 18 nt, Human
auggcuucugaguggagg

SEQ ID NO: 932509 - RNA, 21 nt, Human
uggcuucugccaauguuaaga

SEQ ID NO: 932510 - RNA, 22 nt, Human
caucaugccccgcuacagugca

SEQ ID NO: 932511 - RNA, 22 nt, Human
uggcuucucuguuuuaguauuu

SEQ ID NO: 932512 - RNA, 22 nt, Human
caccacugaauuguucacuuuc

SEQ ID NO: 932513 - RNA, 22 nt, Human
auacagaacaagccucaccucc

SEQ ID NO: 932514 - RNA, 22 nt, Human
uaacauguguauugguuuccua

SEQ ID NO: 932515 - RNA, 22 nt, Human
uauggcuucugcuuucuugacu

SEQ ID NO: 932516 - RNA, 22 nt, Human
uaucuguuuauuguuacuguca

SEQ ID NO: 932517 - RNA, 22 nt, Human
uuaugcaaggacuuauuacagu

SEQ ID NO: 932518 - RNA, 22 nt, Human
aguaaacauagaauguucuucc

SEQ ID NO: 932519 - RNA, 20 nt, Human
gaaauguaucucuugauucu

SEQ ID NO: 932520 - RNA, 22 nt, Human
gacauuuagaaguuagauucaa

SEQ ID NO: 932521 - RNA, 17 nt, Human
aaacuucauucucagga

SEQ ID NO: 932522 - RNA, 22 nt, Human
ucacagaaagcuguguccugac

SEQ ID NO: 932523 - RNA, 22 nt, Human
uccuucagcuacucaguuucca

SEQ ID NO: 932524 - RNA, 22 nt, Human
auuguaacaggaucccuguggc

SEQ ID NO: 932525 - RNA, 22 nt, Human
augcaauuuacuguacauaaau

SEQ ID NO: 932526 - RNA, 22 nt, Human
uuucucuggccucaguuuaaca

SEQ ID NO: 932527 - RNA, 22 nt, Human
uccuucagaaaaccucagucuu

SEQ ID NO: 932528 - RNA, 22 nt, Human
auacacauauguguguauaugu

SEQ ID NO: 932529 - RNA, 22 nt, Human
auuacaauaauacaugcucauu

SEQ ID NO: 932530 - RNA, 22 nt, Human
guugugaauagugccgcaauaa

SEQ ID NO: 932531 - RNA, 22 nt, Human
uaacuucagcgaguucucuuaa

SEQ ID NO: 932532 - RNA, 22 nt, Human
cauuaaaucuuccagaccucac

SEQ ID NO: 932533 - RNA, 22 nt, Human
gucagacugcacucaaggacag

SEQ ID NO: 932534 - RNA, 22 nt, Human
ucuuugcaugcauuuucccuua

SEQ ID NO: 932535 - RNA, 21 nt, Human
aaagcaucacgaacauuuggg

SEQ ID NO: 932536 - RNA, 22 nt, Human
auaaccaugauuaaucuaagaa

SEQ ID NO: 932537 - RNA, 22 nt, Human
gugcuucucuucacacccaacu

SEQ ID NO: 932538 - RNA, 22 nt, Human
augugaaauagcuggauaugaa

SEQ ID NO: 932539 - RNA, 22 nt, Human
uagaaacauauaggauggcagg

SEQ ID NO: 932540 - RNA, 22 nt, Human
uccacagcuguccuguaacagg

SEQ ID NO: 932541 - RNA, 22 nt, Human
auucacaaaaugauauagauac

SEQ ID NO: 932542 - RNA, 18 nt, Human
aaguaacagaagagcaca

SEQ ID NO: 932543 - RNA, 22 nt, Human
uguuauucuaguggaucacguc

SEQ ID NO: 932544 - RNA, 22 nt, Human
ugugcucuggaguugccuucac

SEQ ID NO: 932545 - RNA, 22 nt, Human
uucagacuggcuacauuuucau

SEQ ID NO: 932546 - RNA, 22 nt, Human
aacacauggcaagagcaggaaa

SEQ ID NO: 932547 - RNA, 21 nt, Human
auuucagagcacacaaguaaa

SEQ ID NO: 932548 - RNA, 22 nt, Human
uuaaauuaggacucuaguucug

SEQ ID NO: 932549 - RNA, 22 nt, Human
agcucuccaucuaucugugaug

SEQ ID NO: 932550 - RNA, 22 nt, Human
auagaugguauuuagacuagcg

SEQ ID NO: 932551 - RNA, 22 nt, Human
acaugaaaacugguuccuucag

SEQ ID NO: 932552 - RNA, 22 nt, Human
aucaacagguauggaugagauu

SEQ ID NO: 932553 - RNA, 22 nt, Human
uguggcuuccacgauggucacc

SEQ ID NO: 932554 - RNA, 22 nt, Human
cugcuuggcuuauaaccucagg

SEQ ID NO: 932555 - RNA, 22 nt, Human
agcaugaagacuucagagcuag

SEQ ID NO: 932556 - RNA, 22 nt, Human
acacuguugcuggcacagacag

SEQ ID NO: 932557 - RNA, 22 nt, Human
augugcuuggaaaagcaguggu

SEQ ID NO: 932558 - RNA, 22 nt, Human
agacuguuaauuucaauuaaaa

SEQ ID NO: 932559 - RNA, 22 nt, Human
cuguuggagucauuccuuccag

SEQ ID NO: 932560 - RNA, 22 nt, Human
guccaaauuuuucacauguaga

SEQ ID NO: 932561 - RNA, 22 nt, Human
uacuuuuaugugaugaaaucug

SEQ ID NO: 932562 - RNA, 22 nt, Human
ccauuaaagcaccacuguaaua

SEQ ID NO: 932563 - RNA, 22 nt, Human
acacaugagaaacaucaguugu

SEQ ID NO: 932564 - RNA, 22 nt, Human
acacaaugcauauuuuuccaga

SEQ ID NO: 932565 - RNA, 22 nt, Human
aauggcuuugacauuuucaaau

SEQ ID NO: 932566 - RNA, 18 nt, Human
augcuucugauagaagca

SEQ ID NO: 932567 - RNA, 22 nt, Human
ugacaaugauuagguagcuucu

SEQ ID NO: 932568 - RNA, 22 nt, Human
aagacaauuuugaguaugcaca

SEQ ID NO: 932569 - RNA, 22 nt, Human
ccacugucuuuuccaggcugaa

SEQ ID NO: 932570 - RNA, 22 nt, Human
uaaccuguuaagggcugaccca

SEQ ID NO: 932571 - RNA, 22 nt, Human
auuuacaccuucuucgauucuc

SEQ ID NO: 932572 - RNA, 22 nt, Human
agauggcuagauugcaagaacu

SEQ ID NO: 932573 - RNA, 22 nt, Human
uuccaaaugcccaucuacacag

SEQ ID NO: 932574 - RNA, 22 nt, Human
ucacagaacaagccugguggag

SEQ ID NO: 932575 - RNA, 22 nt, Human
agaaaucuuugaaguguaaugu

SEQ ID NO: 932576 - RNA, 22 nt, Human
auggaaauguuccauauauuga

SEQ ID NO: 932577 - RNA, 22 nt, Human
caaugcuucucauuagccaaug

SEQ ID NO: 932578 - RNA, 21 nt, Human
ugucaguuauaaucaccacag

SEQ ID NO: 932579 - RNA, 22 nt, Human
acacuuuaucaauauucaaaaa

SEQ ID NO: 932580 - RNA, 22 nt, Human
aguucacaccaaaguuagguag

SEQ ID NO: 932581 - RNA, 22 nt, Human
ccugcucaacgaauauggcgau

SEQ ID NO: 932582 - RNA, 22 nt, Human
ugcucugggaccgucauuaaaa

SEQ ID NO: 932583 - RNA, 22 nt, Human
uuuccaaaggcuaaacucaguu

SEQ ID NO: 932584 - RNA, 22 nt, Human
gcaaauguggcuuccuuucuag

SEQ ID NO: 932585 - RNA, 22 nt, Human
acacuucuauucccugcacaaa

SEQ ID NO: 932586 - RNA, 23 nt, Human
ucuuggcuggacaagucacucac

SEQ ID NO: 932587 - RNA, 22 nt, Human
cacagaacaccaaagaaccuuc

SEQ ID NO: 932588 - RNA, 22 nt, Human
cauauuguaaaagguugaaucc

SEQ ID NO: 932589 - RNA, 22 nt, Human
gcacaugaggcugucuuugucu

SEQ ID NO: 932590 - RNA, 22 nt, Human
cuuuacacaugagaccugcaau

SEQ ID NO: 932591 - RNA, 22 nt, Human
auuaugaaguugagggacccug

SEQ ID NO: 932592 - RNA, 22 nt, Human
augcuuuacaguuuuccaaaca

SEQ ID NO: 932593 - RNA, 22 nt, Human
gcuuuacauguuucccuuuaag

SEQ ID NO: 932594 - RNA, 22 nt, Human
uuacaucuaaacugugaacaau

SEQ ID NO: 932595 - RNA, 22 nt, Human
ucagagaacuccacaccuuagg

SEQ ID NO: 932596 - RNA, 22 nt, Human
uuccacaagugauaucuagcug

SEQ ID NO: 932597 - RNA, 22 nt, Human
aacauuuaugauugagguaaau

SEQ ID NO: 932598 - RNA, 22 nt, Human
uaaucuguuguuaauauugacu

SEQ ID NO: 932599 - RNA, 22 nt, Human
caugagaaugaagaagacuuaa

SEQ ID NO: 932600 - RNA, 22 nt, Human
cuuacauugucuuaguuuucaa

SEQ ID NO: 932601 - RNA, 22 nt, Human
agagaaauuucccugccuucug

SEQ ID NO: 932602 - RNA, 22 nt, Human
uccugaagaugaaaagagaggu

SEQ ID NO: 932603 - RNA, 22 nt, Human
ucucuggcagacaccucccuga

SEQ ID NO: 932604 - RNA, 22 nt, Human
uuuauucacuucagugccaaag

SEQ ID NO: 932605 - RNA, 22 nt, Human
ccugugcucccauagcuucugu

SEQ ID NO: 932606 - RNA, 22 nt, Human
cuaaauuaucaugagaauuaug

SEQ ID NO: 932607 - RNA, 22 nt, Human
augugcuuauggucucugguug

SEQ ID NO: 932608 - RNA, 22 nt, Human
aaucagaccguucuggcugucc

SEQ ID NO: 932609 - RNA, 22 nt, Human
cuucucuggcauagcaagcagg

SEQ ID NO: 932610 - RNA, 23 nt, Human
uuuagucaguugacagccauaua

SEQ ID NO: 932611 - RNA, 22 nt, Human
gcaguguguggugagggcugcc

SEQ ID NO: 932612 - RNA, 20 nt, Human
uuuauucagccuacccucuu

SEQ ID NO: 932613 - RNA, 22 nt, Human
aaguaaauguuggagcucaaau

SEQ ID NO: 932614 - RNA, 22 nt, Human
uaucuguuaugggcugaauugc

SEQ ID NO: 932615 - RNA, 22 nt, Human
uucacaaaaugguuuguugaug

SEQ ID NO: 932616 - RNA, 18 nt, Human
acauuucucucugcguga

SEQ ID NO: 932617 - RNA, 22 nt, Human
acuuugcaaugggcagaaccca

SEQ ID NO: 932618 - RNA, 22 nt, Human
ccacagauuauuucuaaacagg

SEQ ID NO: 932619 - RNA, 22 nt, Human
uagaaacagagagauaugcccc

SEQ ID NO: 932620 - RNA, 22 nt, Human
acauuauaguugcuacagagua

SEQ ID NO: 932621 - RNA, 22 nt, Human
acaauagucaaugcacgucauu

SEQ ID NO: 932622 - RNA, 22 nt, Human
ugugcuucaucacuucucaguu

SEQ ID NO: 932623 - RNA, 22 nt, Human
ugauuacacuauuugggaauag

SEQ ID NO: 932624 - RNA, 22 nt, Human
acauuuauauaacucacuagga

SEQ ID NO: 932625 - RNA, 22 nt, Human
uccugaagagcccugcucugug

SEQ ID NO: 932626 - RNA, 22 nt, Human
ucaccaaggcauuuucacagca

SEQ ID NO: 932627 - RNA, 22 nt, Human
acaccaugaugagugauguagc

SEQ ID NO: 932628 - RNA, 22 nt, Human
auuuuguggcagaugcagaacc

SEQ ID NO: 932629 - RNA, 22 nt, Human
cuguuguagcugcgcugcuuca

SEQ ID NO: 932630 - RNA, 22 nt, Human
ucaucaaaagccuucuggguua

SEQ ID NO: 932631 - RNA, 22 nt, Human
caaauacuuacugaaccugugc

SEQ ID NO: 932632 - RNA, 17 nt, Human
uucagcaguguuucucc

SEQ ID NO: 932633 - RNA, 20 nt, Human
uggcuucucuucacuccugu

SEQ ID NO: 932634 - RNA, 22 nt, Human
aguucccuccacaacuucucac

SEQ ID NO: 932635 - RNA, 22 nt, Human
cccuggcaugcaugucccuggc

SEQ ID NO: 932636 - RNA, 22 nt, Human
ucaaauuaguggaauaauaaug

SEQ ID NO: 932637 - RNA, 22 nt, Human
auuccaauuguacuugcuuuua

SEQ ID NO: 932638 - RNA, 22 nt, Human
cugucacuuaaauucaggcuga

SEQ ID NO: 932639 - RNA, 22 nt, Human
ugaguuacugccuaguaacuug

SEQ ID NO: 932640 - RNA, 22 nt, Human
uucacaaacaccagaauggcua

SEQ ID NO: 932641 - RNA, 19 nt, Human
ucaacaguggugcugugga

SEQ ID NO: 932642 - RNA, 22 nt, Human
ugaagcuuuccuguggucagga

SEQ ID NO: 932643 - RNA, 22 nt, Human
caacuucaccaggguuccuaga

SEQ ID NO: 932644 - RNA, 22 nt, Human
uucacacuuuggaauuccaccu

SEQ ID NO: 932645 - RNA, 22 nt, Human
uugacuuuacaguuuucuuagg

SEQ ID NO: 932646 - RNA, 22 nt, Human
uacacaugcauguacuccagga

SEQ ID NO: 932647 - RNA, 22 nt, Human
ucaguuaccugacagugguuau

SEQ ID NO: 932648 - RNA, 22 nt, Human
caauuuuauugguccaaauaca

SEQ ID NO: 932649 - RNA, 22 nt, Human
uccuucagcucucuauuuagau

SEQ ID NO: 932650 - RNA, 22 nt, Human
ggcuccuggaggcaccacuggu

SEQ ID NO: 932651 - RNA, 22 nt, Human
auucauucugaccucaagagaa

SEQ ID NO: 932652 - RNA, 22 nt, Human
ccugaguagcuggaauuaaagg

SEQ ID NO: 932653 - RNA, 22 nt, Human
uuguaaaugaccuuuucuaauu

SEQ ID NO: 932654 - RNA, 22 nt, Human
auacacaucuauuuaagagaca

SEQ ID NO: 932655 - RNA, 22 nt, Human
cuguggcugugaaacuucucag

SEQ ID NO: 932656 - RNA, 22 nt, Human
uguuacacagcagaauagcaag

SEQ ID NO: 932657 - RNA, 22 nt, Human
uagcuagcugcacaggcccugg

SEQ ID NO: 932658 - RNA, 22 nt, Human
uuuaucuguuguaccugcauug

SEQ ID NO: 932659 - RNA, 22 nt, Human
caucaaauaaagaaauuccuug

SEQ ID NO: 932660 - RNA, 22 nt, Human
acaucaugagagacuuaaauug

SEQ ID NO: 932661 - RNA, 22 nt, Human
aggaagagcauucacaugguag

SEQ ID NO: 932662 - RNA, 22 nt, Human
acucuguuugcagguagcucag

SEQ ID NO: 932663 - RNA, 22 nt, Human
gcaggagacuggcugugguagu

SEQ ID NO: 932664 - RNA, 23 nt, Human
aagcaugguucacaguuaguacu

SEQ ID NO: 932665 - RNA, 19 nt, Human
acacaugaggagggacccc

SEQ ID NO: 932666 - RNA, 22 nt, Human
cuguagcagugugcucuuuuuc

SEQ ID NO: 932667 - RNA, 22 nt, Human
cauuucuccgccgagaucacug

SEQ ID NO: 932668 - RNA, 22 nt, Human
aagcuucauauaugugugaguc

SEQ ID NO: 932669 - RNA, 22 nt, Human
gcauggcuauucuaacucacau

SEQ ID NO: 932670 - RNA, 22 nt, Human
cuaaacauguuggugcuuuaaa

SEQ ID NO: 932671 - RNA, 22 nt, Human
uuuaucuggacugugauauaaa

SEQ ID NO: 932672 - RNA, 22 nt, Human
auggcuuuugaugcuaagccaa

SEQ ID NO: 932673 - RNA, 22 nt, Human
aaacacauuagcccuguggaaa

SEQ ID NO: 932674 - RNA, 22 nt, Human
cugcugcucuugugcauuagug

SEQ ID NO: 932675 - RNA, 22 nt, Human
acauuuagaugguguuauagua

SEQ ID NO: 932676 - RNA, 22 nt, Human
ucacaugacuuuuugguggccu

SEQ ID NO: 932677 - RNA, 22 nt, Human
augacuuuguuguuuuccagcg

SEQ ID NO: 932678 - RNA, 22 nt, Human
acacauuaugagcaguugucuu

SEQ ID NO: 932679 - RNA, 22 nt, Human
cuuguagcugacuaucuuguuc

SEQ ID NO: 932680 - RNA, 20 nt, Human
ccacaugagcucuuucugac

SEQ ID NO: 932681 - RNA, 20 nt, Human
uucagaguuuacucaaacug

SEQ ID NO: 932682 - RNA, 22 nt, Human
acacagagcuucucaacuggga

SEQ ID NO: 932683 - RNA, 22 nt, Human
uuuagcaauuucuaaaaguguu

SEQ ID NO: 932684 - RNA, 22 nt, Human
gaugucuuaagcccagaaguuc

SEQ ID NO: 932685 - RNA, 22 nt, Human
gcauaggccacuagugccagga

SEQ ID NO: 932686 - RNA, 22 nt, Human
uagcacauaacuuagaauaguu

SEQ ID NO: 932687 - RNA, 22 nt, Human
augugcuugagggaaaucaguu

SEQ ID NO: 932688 - RNA, 22 nt, Human
agcacaugcacagugcuacacu

SEQ ID NO: 932689 - RNA, 22 nt, Human
aagaguaugcaugcauguuugu

SEQ ID NO: 932690 - RNA, 22 nt, Human
aauagauucaugguuaagagca

SEQ ID NO: 932691 - RNA, 22 nt, Human
cauuuaguuuugcaguagcagg

SEQ ID NO: 932692 - RNA, 22 nt, Human
uuucacagagaaauauaacagg

SEQ ID NO: 932693 - RNA, 22 nt, Human
augcuuggcguuucacuuccug

SEQ ID NO: 932694 - RNA, 22 nt, Human
uacacaugacaguggacugaga

SEQ ID NO: 932695 - RNA, 22 nt, Human
auauauucuuaaagaaucugac

SEQ ID NO: 932696 - RNA, 19 nt, Human
uggcuucuguuuucauguu

SEQ ID NO: 932697 - RNA, 23 nt, Human
ccuucagaagaaguaacaggggc

SEQ ID NO: 932698 - RNA, 22 nt, Human
cccugcuaguccuuccuuggcu

SEQ ID NO: 932699 - RNA, 22 nt, Human
ccuaacuuucauuaggccccag

SEQ ID NO: 932700 - RNA, 22 nt, Human
auuuccaugucgguauuuuaua

SEQ ID NO: 932701 - RNA, 22 nt, Human
ucuuggcugugcaugcaucuuc

SEQ ID NO: 932702 - RNA, 22 nt, Human
acauggcuaaagcaagucuaga

SEQ ID NO: 932703 - RNA, 22 nt, Human
aaaccugucugauuauggagac

SEQ ID NO: 932704 - RNA, 22 nt, Human
ccacccuggguucugaugugga

SEQ ID NO: 932705 - RNA, 22 nt, Human
ucagaaauuuucucaguaguuc

SEQ ID NO: 932706 - RNA, 22 nt, Human
uuguaacaguagcugucagcuc

SEQ ID NO: 932707 - RNA, 22 nt, Human
aucuuugugcuaauguaguucu

SEQ ID NO: 932708 - RNA, 22 nt, Human
gaugucuucucaacuguagacc

SEQ ID NO: 932709 - RNA, 22 nt, Human
acacaugauuaaugccaagcau

SEQ ID NO: 932710 - RNA, 22 nt, Human
ccucuuugugccugcaggcugc

SEQ ID NO: 932711 - RNA, 22 nt, Human
aaaacauguccauacagaaacu

SEQ ID NO: 932712 - RNA, 22 nt, Human
cuggcaccuccagcucauggcc

SEQ ID NO: 932713 - RNA, 19 nt, Human
acucuguuguacuugaggg

SEQ ID NO: 932714 - RNA, 22 nt, Human
uauuaugaggcuuagggaugac

SEQ ID NO: 932715 - RNA, 18 nt, Human
uauaaccucuguuacuca

SEQ ID NO: 932716 - RNA, 22 nt, Human
gcuucuccucccgcucccaggc

SEQ ID NO: 932717 - RNA, 22 nt, Human
aacacugugcccacccuagucc

SEQ ID NO: 932718 - RNA, 22 nt, Human
ucucaucucaaauuguaauccc

SEQ ID NO: 932719 - RNA, 22 nt, Human
aauaggaaaauauuuaacaaga

SEQ ID NO: 932720 - RNA, 22 nt, Human
ggcuucucucccccagcuccac

SEQ ID NO: 932721 - RNA, 22 nt, Human
ucuuggcuucuguauuuccugu

SEQ ID NO: 932722 - RNA, 21 nt, Human
ucauuuauugagaaaugacug

SEQ ID NO: 932723 - RNA, 22 nt, Human
aucugagucaaauauuucauuu

SEQ ID NO: 932724 - RNA, 21 nt, Human
ucuuuacauuugccucuugca

SEQ ID NO: 932725 - RNA, 22 nt, Human
uggcaccaucaaggcugagaac

SEQ ID NO: 932726 - RNA, 22 nt, Human
aaauauguaagauuagcacuag

SEQ ID NO: 932727 - RNA, 22 nt, Human
uuuauugcccuguaguacagga

SEQ ID NO: 932728 - RNA, 22 nt, Human
uuguagcuuaucaaggcuguuu

SEQ ID NO: 932729 - RNA, 22 nt, Human
aagcacugugccucauaucuga

SEQ ID NO: 932730 - RNA, 22 nt, Human
ucuuuacaguccucugucaauc

SEQ ID NO: 932731 - RNA, 22 nt, Human
accugcuagaagcaaaugucug

SEQ ID NO: 932732 - RNA, 22 nt, Human
acagucuuuaauuucuuugugg

SEQ ID NO: 932733 - RNA, 22 nt, Human
ucugaguucauaccaggcuacc

SEQ ID NO: 932734 - RNA, 22 nt, Human
uuugugaacaaacaugaagaug

SEQ ID NO: 932735 - RNA, 20 nt, Human
aagcauggucaaaacuuaug

SEQ ID NO: 932736 - RNA, 22 nt, Human
ccuuccaguauguuaagauggu

SEQ ID NO: 932737 - RNA, 22 nt, Human
uauuaugaggacugguguaagg

SEQ ID NO: 932738 - RNA, 22 nt, Human
cugccacucugggugggccugg

SEQ ID NO: 932739 - RNA, 22 nt, Human
aaacuguuccuuuuucagcaac

SEQ ID NO: 932740 - RNA, 22 nt, Human
uauuucaacguaugaaaagcug

SEQ ID NO: 932741 - RNA, 22 nt, Human
aauggcuuacccuggauugugu

SEQ ID NO: 932742 - RNA, 17 nt, Human
ccuguuguugccuuugc

SEQ ID NO: 932743 - RNA, 22 nt, Human
agcagagaagacacaggcuuca

SEQ ID NO: 932744 - RNA, 22 nt, Human
uauccuguguacugucuaguac

SEQ ID NO: 932745 - RNA, 22 nt, Human
aauggcuucugaagcacacuuu

SEQ ID NO: 932746 - RNA, 22 nt, Human
cacagcaagagcuaaaugacca

SEQ ID NO: 932747 - RNA, 22 nt, Human
acaugacuauaauuacuuaaau

SEQ ID NO: 932748 - RNA, 22 nt, Human
ucuggcucuguguccucaccca

SEQ ID NO: 932749 - RNA, 20 nt, Human
cacauuaaggaaaacaacug

SEQ ID NO: 932750 - RNA, 22 nt, Human
cuccugucaauaggcuccuggc

SEQ ID NO: 932751 - RNA, 22 nt, Human
cuaaccuguugaaggaauugcu

SEQ ID NO: 932752 - RNA, 22 nt, Human
uagcuaauggugaagauucaga

SEQ ID NO: 932753 - RNA, 22 nt, Human
aaacagcaauggagaagccagg

SEQ ID NO: 932754 - RNA, 22 nt, Human
uauggcuuuucuuuccuagugu

SEQ ID NO: 932755 - RNA, 22 nt, Human
ucuuuaauguacuuucuuucac

SEQ ID NO: 932756 - RNA, 22 nt, Human
cagcaguacuucucagagguau

SEQ ID NO: 932757 - RNA, 22 nt, Human
aguaacaugaguuuuucuaaug

SEQ ID NO: 932758 - RNA, 22 nt, Human
cuguuggacuuuucaaggucug

SEQ ID NO: 932759 - RNA, 22 nt, Human
ccacccuggacaggccucugag

SEQ ID NO: 932760 - RNA, 22 nt, Human
cuguuacuaaucuuuucugcua

SEQ ID NO: 932761 - RNA, 22 nt, Human
cagcuucagggacagcuucuuu

SEQ ID NO: 932762 - RNA, 22 nt, Human
uuuguaacaaguugaucuggua

SEQ ID NO: 932763 - RNA, 22 nt, Human
ugucaucuacccguuaggcuuu

SEQ ID NO: 932764 - RNA, 22 nt, Human
uucucacagaagcacgaagccu

SEQ ID NO: 932765 - RNA, 22 nt, Human
ccugcucagagcgucuugugug

SEQ ID NO: 932766 - RNA, 22 nt, Human
uacuuugaccaccaucugauua

SEQ ID NO: 932767 - RNA, 16 nt, Human
gaucuguucuauuuca

SEQ ID NO: 932768 - RNA, 22 nt, Human
cuuugcuugacacugugauugu

SEQ ID NO: 932769 - RNA, 22 nt, Human
ugcccacaucugcuuauuucau

SEQ ID NO: 932770 - RNA, 22 nt, Human
aucuuugugaaucucaacuugg

SEQ ID NO: 932771 - RNA, 22 nt, Human
auacacauguuauuguggaagc

SEQ ID NO: 932772 - RNA, 22 nt, Human
cagagaaaaaauccugcucuca

SEQ ID NO: 932773 - RNA, 22 nt, Human
ccugaucaaguuuucuggcucc

SEQ ID NO: 932774 - RNA, 22 nt, Human
cuguggcuggccugucugacau

SEQ ID NO: 932775 - RNA, 22 nt, Human
ccuggcacugaccaggcacuga

SEQ ID NO: 932776 - RNA, 22 nt, Human
uaaccuggggcgguuucccaau

SEQ ID NO: 932777 - RNA, 22 nt, Human
uuauuaugugcuagagaaugua

SEQ ID NO: 932778 - RNA, 17 nt, Human
caacuucacaaacuguc

SEQ ID NO: 932779 - RNA, 22 nt, Human
caguaugucuacuggacaaagu

SEQ ID NO: 932780 - RNA, 22 nt, Human
gagucagaauuguauuuuaaac

SEQ ID NO: 932781 - RNA, 22 nt, Human
cauggcuuuccaguccuccacu

SEQ ID NO: 932782 - RNA, 20 nt, Human
agaaacauuucuugagaacu

SEQ ID NO: 932783 - RNA, 22 nt, Human
uauagcaauucagaauacaugu

SEQ ID NO: 932784 - RNA, 21 nt, Human
uucauucauggcauaauauag

SEQ ID NO: 932785 - RNA, 22 nt, Human
uaauaacaauuguaggacauga

SEQ ID NO: 932786 - RNA, 22 nt, Human
acuggauggugucaugagcagc

SEQ ID NO: 932787 - RNA, 22 nt, Human
uuuccacaauuugagcagcaga

SEQ ID NO: 932788 - RNA, 22 nt, Human
ucacaaaucauuuuaucugugu

SEQ ID NO: 932789 - RNA, 22 nt, Human
cauaacuuuaaagacagugugg

SEQ ID NO: 932790 - RNA, 22 nt, Human
uucuuugguguuacccagcuca

SEQ ID NO: 932791 - RNA, 20 nt, Human
aaugucuugagacauuucag

SEQ ID NO: 932792 - RNA, 22 nt, Human
uaacuucaaaauugccacaugu

SEQ ID NO: 932793 - RNA, 22 nt, Human
uuugaaugagaauuauugucau

SEQ ID NO: 932794 - RNA, 22 nt, Human
agacauuuuacauucuuccauu

SEQ ID NO: 932795 - RNA, 22 nt, Human
agaagcauuauaacaugcaagg

SEQ ID NO: 932796 - RNA, 22 nt, Human
auuuacacugguucucagagcu

SEQ ID NO: 932797 - RNA, 22 nt, Human
cacaugagguggagaugaauga

SEQ ID NO: 932798 - RNA, 22 nt, Human
uacacauguccaaggugucacc

SEQ ID NO: 932799 - RNA, 22 nt, Human
caguaacauuucaagguagagg

SEQ ID NO: 932800 - RNA, 22 nt, Human
uagaaacauguucuguucuguu

SEQ ID NO: 932801 - RNA, 22 nt, Human
cccuucagugcuaggcugccug

SEQ ID NO: 932802 - RNA, 22 nt, Human
ugucacaauuuauuucucuuga

SEQ ID NO: 932803 - RNA, 22 nt, Human
auuacacagcgguuacuacuag

SEQ ID NO: 932804 - RNA, 22 nt, Human
augacaauacuucaauaagcug

SEQ ID NO: 932805 - RNA, 22 nt, Human
ucuggcccaugauccugcuaac

SEQ ID NO: 932806 - RNA, 22 nt, Human
uuuauuccaugugucuaugacc

SEQ ID NO: 932807 - RNA, 22 nt, Human
aauuuccagaucagaugacuca

SEQ ID NO: 932808 - RNA, 22 nt, Human
uccugccaucugcuguugaucu

SEQ ID NO: 932809 - RNA, 22 nt, Human
uucacagaagaggucacauuuc

SEQ ID NO: 932810 - RNA, 22 nt, Human
ccuguaggaacgccuucauuug

SEQ ID NO: 932811 - RNA, 22 nt, Human
ucacauuugcaauugcauuguu

SEQ ID NO: 932812 - RNA, 22 nt, Human
gaacuuuaaucccuugggcuua

SEQ ID NO: 932813 - RNA, 22 nt, Human
gccuucaguaguauccucauga

SEQ ID NO: 932814 - RNA, 23 nt, Human
cacaugaccugaccuaggcuagg

SEQ ID NO: 932815 - RNA, 22 nt, Human
agagacaggguuuugucguguu

SEQ ID NO: 932816 - RNA, 22 nt, Human
uuccaagagcuuuaauuguuga

SEQ ID NO: 932817 - RNA, 22 nt, Human
accugucaacccaucaccuagg

SEQ ID NO: 932818 - RNA, 22 nt, Human
uucagaguuagacgaaaagcaa

SEQ ID NO: 932819 - RNA, 22 nt, Human
gaucuuuauacuguaauaauga

SEQ ID NO: 932820 - RNA, 18 nt, Human
caguaacuauguuguuac

SEQ ID NO: 932821 - RNA, 22 nt, Human
agaucacaguucucuauucgua

SEQ ID NO: 932822 - RNA, 22 nt, Human
gaaccuguuuauguuaccugcg

SEQ ID NO: 932823 - RNA, 22 nt, Human
aaccuguucccugguccuugac

SEQ ID NO: 932824 - RNA, 22 nt, Human
ccacaugagcuggcaaugcccu

SEQ ID NO: 932825 - RNA, 22 nt, Human
gcuuuacaaguggugcagauua

SEQ ID NO: 932826 - RNA, 21 nt, Human
ccuggcacuggccugcugagc

SEQ ID NO: 932827 - RNA, 22 nt, Human
acuguuacagggcacugaacau

SEQ ID NO: 932828 - RNA, 22 nt, Human
agucacaauaccgugugucagu

SEQ ID NO: 932829 - RNA, 22 nt, Human
aacagauaauuucuaaguuacu

SEQ ID NO: 932830 - RNA, 22 nt, Human
guacuucuggccaggcuggcca

SEQ ID NO: 932831 - RNA, 22 nt, Human
agauguguuucuaguuccugca

SEQ ID NO: 932832 - RNA, 22 nt, Human
accaaauaggcuuccuggguug

SEQ ID NO: 932833 - RNA, 19 nt, Human
cucuccaccuaacagguau

SEQ ID NO: 932834 - RNA, 22 nt, Human
cacuaaaacuacauuggaaaca

SEQ ID NO: 932835 - RNA, 22 nt, Human
auaaaucuauuggacaugugug

SEQ ID NO: 932836 - RNA, 22 nt, Human
gaacagacuuugccaauuacag

SEQ ID NO: 932837 - RNA, 22 nt, Human
augugcuuuaaagaagccagcu

SEQ ID NO: 932838 - RNA, 22 nt, Human
acuuuguagguuucagugaaac

SEQ ID NO: 932839 - RNA, 22 nt, Human
auggcucucuugaccuaggcac

SEQ ID NO: 932840 - RNA, 23 nt, Human
cuucucugagcuaggaaugcucu

SEQ ID NO: 932841 - RNA, 19 nt, Human
aagcguuucccacuugcuu

SEQ ID NO: 932842 - RNA, 22 nt, Human
gagaaaugagugauucacuuuu

SEQ ID NO: 932843 - RNA, 22 nt, Human
uucaagcagagauauuucaaga

SEQ ID NO: 932844 - RNA, 22 nt, Human
cuuucacucgagcuccugcagc

SEQ ID NO: 932845 - RNA, 22 nt, Human
acaugcauucucuaaaagcaaa

SEQ ID NO: 932846 - RNA, 22 nt, Human
uguacacauuuuuauguuaaca

SEQ ID NO: 932847 - RNA, 22 nt, Human
uuaguucacugcuauaucauca

SEQ ID NO: 932848 - RNA, 22 nt, Human
uggcuucuauugcuguggcauu

SEQ ID NO: 932849 - RNA, 22 nt, Human
aaaugugauacuguucuuuuua

SEQ ID NO: 932850 - RNA, 22 nt, Human
cucugugcucccaugcuaguaa

SEQ ID NO: 932851 - RNA, 22 nt, Human
gacauuuacugaauacugauua

SEQ ID NO: 932852 - RNA, 22 nt, Human
uuccaagaagucaacagguagu

SEQ ID NO: 932853 - RNA, 22 nt, Human
acacuguucuuugcacugagaa

SEQ ID NO: 932854 - RNA, 22 nt, Human
auuuacacauucauaagauuuc

SEQ ID NO: 932855 - RNA, 19 nt, Human
acuguagcacugcaguaua

SEQ ID NO: 932856 - RNA, 22 nt, Human
cacuguuauuacuacuauacau

SEQ ID NO: 932857 - RNA, 22 nt, Human
uuauagcagcaugauuuacaau

SEQ ID NO: 932858 - RNA, 22 nt, Human
aagacaauguuucugauagaua

SEQ ID NO: 932859 - RNA, 22 nt, Human
gcucugcccaggaccguccuug

SEQ ID NO: 932860 - RNA, 22 nt, Human
ucauguaaauguggaugcuucc

SEQ ID NO: 932861 - RNA, 22 nt, Human
cacauuuaagcagauguggacc

SEQ ID NO: 932862 - RNA, 22 nt, Human
ucacagcauuuuuagaaagauu

SEQ ID NO: 932863 - RNA, 20 nt, Human
uggcuccuggcuccucccuc

SEQ ID NO: 932864 - RNA, 22 nt, Human
uuuauucauuguuucgucgcag

SEQ ID NO: 932865 - RNA, 22 nt, Human
gaauggaaacugggagauggcc

SEQ ID NO: 932866 - RNA, 20 nt, Human
uggcugugggcaucuguuuc

SEQ ID NO: 932867 - RNA, 20 nt, Human
ucccugccuuuuacugcugg

SEQ ID NO: 932868 - RNA, 22 nt, Human
uguaaaacaaaauuuguggaga

SEQ ID NO: 932869 - RNA, 19 nt, Human
uccuguuauggagcuuagg

SEQ ID NO: 932870 - RNA, 22 nt, Human
uccuucagucuucugagccaua

SEQ ID NO: 932871 - RNA, 22 nt, Human
ccacacugaccagcugugagac

SEQ ID NO: 932872 - RNA, 22 nt, Human
acuucacauuugcaagucuugg

SEQ ID NO: 932873 - RNA, 22 nt, Human
uuacacaggcacuuaaaaugca

SEQ ID NO: 932874 - RNA, 22 nt, Human
cuguagcugggccucggcagug

SEQ ID NO: 932875 - RNA, 22 nt, Human
uccugaagcaguuagcaugagc

SEQ ID NO: 932876 - RNA, 22 nt, Human
guaaauaacugguaauuggggu

SEQ ID NO: 932877 - RNA, 22 nt, Human
aucuaaaaggagcucuuuaucu

SEQ ID NO: 932878 - RNA, 22 nt, Human
aagaaauacaugguuuuugagu

SEQ ID NO: 932879 - RNA, 22 nt, Human
cuaacauuuauugagcacuuag

SEQ ID NO: 932880 - RNA, 22 nt, Human
uagcacaugccgggagugaucu

SEQ ID NO: 932881 - RNA, 22 nt, Human
gagaagcaauuuccaacugugc

SEQ ID NO: 932882 - RNA, 22 nt, Human
uuucacacccacuaggacuguu

SEQ ID NO: 932883 - RNA, 22 nt, Human
augaaauaucuugaagaaauuc

SEQ ID NO: 932884 - RNA, 22 nt, Human
ggcuucucccuucuucugauug

SEQ ID NO: 932885 - RNA, 22 nt, Human
acacugugaucuugagaaaggu

SEQ ID NO: 932886 - RNA, 22 nt, Human
ucacaugaaaugcuguaaagaa

SEQ ID NO: 932887 - RNA, 22 nt, Human
auuacacuaaugugacaacaau

SEQ ID NO: 932888 - RNA, 22 nt, Human
agaagcauuauuuaauuuuacu

SEQ ID NO: 932889 - RNA, 22 nt, Human
uuaucugaaaaccucaaaauau

SEQ ID NO: 932890 - RNA, 22 nt, Human
acaguaacucuuuuacccuccu

SEQ ID NO: 932891 - RNA, 22 nt, Human
aaucuuuuaggggauccugagg

SEQ ID NO: 932892 - RNA, 22 nt, Human
uuugaaugugugaguuaacuuu

SEQ ID NO: 932893 - RNA, 22 nt, Human
cagagaaagaagcccauucauu

SEQ ID NO: 932894 - RNA, 22 nt, Human
acucacuucuuuuacuauaaaa

SEQ ID NO: 932895 - RNA, 22 nt, Human
uuccucagagagacagaaacua

SEQ ID NO: 932896 - RNA, 22 nt, Human
aagucacacaguuaacaugagg

SEQ ID NO: 932897 - RNA, 22 nt, Human
gauggcuuacagacaguuagga

SEQ ID NO: 932898 - RNA, 22 nt, Human
agugaugugggagaguauagcu

SEQ ID NO: 932899 - RNA, 22 nt, Human
aaaucuguuucagguauauuug

SEQ ID NO: 932900 - RNA, 22 nt, Human
acauuugacauuuaguaucagc

SEQ ID NO: 932901 - RNA, 22 nt, Human
augguuuauuagcugcacaggc

SEQ ID NO: 932902 - RNA, 22 nt, Human
aacacugugcaguguaaugcug

SEQ ID NO: 932903 - RNA, 22 nt, Human
gcuuccaucuaugucuucauca

SEQ ID NO: 932904 - RNA, 22 nt, Human
auuuagucuguaacaguacagu

SEQ ID NO: 932905 - RNA, 22 nt, Human
gaguaauuccaauauaaaucac

SEQ ID NO: 932906 - RNA, 22 nt, Human
auaaccuguuucagacauuugu

SEQ ID NO: 932907 - RNA, 22 nt, Human
uuuauucaucaucuguucauau

SEQ ID NO: 932908 - RNA, 22 nt, Human
uuugcuugauuaggauauggaa

SEQ ID NO: 932909 - RNA, 22 nt, Human
cucauauugcugguggucuaag

SEQ ID NO: 932910 - RNA, 22 nt, Human
aaacaguauuaucaauauauuu

SEQ ID NO: 932911 - RNA, 22 nt, Human
aaucuguucuacucuauucaga

SEQ ID NO: 932912 - RNA, 22 nt, Human
uuuacacaaaagauagcacacc

SEQ ID NO: 932913 - RNA, 22 nt, Human
agcuucucaggagucugaggca

SEQ ID NO: 932914 - RNA, 22 nt, Human
cguucacaucguauuauuggga

SEQ ID NO: 932915 - RNA, 22 nt, Human
uacacuuuuuacuacagauucu

SEQ ID NO: 932916 - RNA, 22 nt, Human
uugugaauagugccgcuauaaa

SEQ ID NO: 932917 - RNA, 22 nt, Human
uaagauuauacuuaaagagaaa

SEQ ID NO: 932918 - RNA, 22 nt, Human
ugccaccaucuggcuguguuga

SEQ ID NO: 932919 - RNA, 22 nt, Human
aauucacaauuauguugggaga

SEQ ID NO: 932920 - RNA, 22 nt, Human
uucagggucuagaguaucuacc

SEQ ID NO: 932921 - RNA, 22 nt, Human
ugaagagaagaaaauuaucuuu

SEQ ID NO: 932922 - RNA, 22 nt, Human
auguuucugaaguuuacagaua

SEQ ID NO: 932923 - RNA, 22 nt, Human
cacauuuaugggcugggaggca

SEQ ID NO: 932924 - RNA, 22 nt, Human
caccuguuagcucuaauuuucu

SEQ ID NO: 932925 - RNA, 22 nt, Human
cacauuuacauauaaaacuuuc

SEQ ID NO: 932926 - RNA, 22 nt, Human
aguacacaguagacuuucucau

SEQ ID NO: 932927 - RNA, 22 nt, Human
aucaagaauugggagcuauuga

SEQ ID NO: 932928 - RNA, 22 nt, Human
uuuacaacccaaguccagagag

SEQ ID NO: 932929 - RNA, 22 nt, Human
acacauuaaaacgucuacaaug

SEQ ID NO: 932930 - RNA, 22 nt, Human
uuuauuauucuguucucucuac

SEQ ID NO: 932931 - RNA, 22 nt, Human
uaauuucaccguugcuagaaau

SEQ ID NO: 932932 - RNA, 18 nt, Human
ucuuuuguccccugcugc

SEQ ID NO: 932933 - RNA, 20 nt, Human
aauggcuuauagcaugcuac

SEQ ID NO: 932934 - RNA, 22 nt, Human
aguaacagaaggccugacuuaa

SEQ ID NO: 932935 - RNA, 22 nt, Human
cccugccaaucccgucucucug

SEQ ID NO: 932936 - RNA, 22 nt, Human
cacaugaucacuucuugaaaau

SEQ ID NO: 932937 - RNA, 22 nt, Human
uacuaacuuguacacagccuaa

SEQ ID NO: 932938 - RNA, 22 nt, Human
agagaaacccuucaguguuuug

SEQ ID NO: 932939 - RNA, 22 nt, Human
uccaagaucaagguguuggcag

SEQ ID NO: 932940 - RNA, 22 nt, Human
agcuaucaguaggaccauguuc

SEQ ID NO: 932941 - RNA, 22 nt, Human
guuccacaaagauugucucucu

SEQ ID NO: 932942 - RNA, 22 nt, Human
acucacuuuccauucaagcacc

SEQ ID NO: 932943 - RNA, 22 nt, Human
aaauuucaguuggaaugagcuc

SEQ ID NO: 932944 - RNA, 22 nt, Human
cacacaugcauguaagaccucu

SEQ ID NO: 932945 - RNA, 22 nt, Human
uuccagaggagugauucagagg

SEQ ID NO: 932946 - RNA, 22 nt, Human
cagucacuccagccugccucag

SEQ ID NO: 932947 - RNA, 22 nt, Human
agaucacaguggcaacucccuu

SEQ ID NO: 932948 - RNA, 22 nt, Human
aaauuucaagcaaaguagcuau

SEQ ID NO: 932949 - RNA, 22 nt, Human
uauggcuuucuccauagggcag

SEQ ID NO: 932950 - RNA, 22 nt, Human
uuuugucuaagaacuuugcaaa

SEQ ID NO: 932951 - RNA, 22 nt, Human
uguuacuuggugucucuggcug

SEQ ID NO: 932952 - RNA, 22 nt, Human
gcuucuccagaccuucaucccc

SEQ ID NO: 932953 - RNA, 22 nt, Human
uuucucugccaguuauuuuccu

SEQ ID NO: 932954 - RNA, 20 nt, Human
uggcucucucuaguaagugg

SEQ ID NO: 932955 - RNA, 22 nt, Human
cuagagaacaacauucauaugg

SEQ ID NO: 932956 - RNA, 22 nt, Human
aaaacacacuggaccaauuuaa

SEQ ID NO: 932957 - RNA, 22 nt, Human
acauuucugcaucucagagcua

SEQ ID NO: 932958 - RNA, 22 nt, Human
aaacauguuuagaaagcagcug

SEQ ID NO: 932959 - RNA, 22 nt, Human
ucagagaauccguaagucacaa

SEQ ID NO: 932960 - RNA, 22 nt, Human
cccugcuaguugucucagugau

SEQ ID NO: 932961 - RNA, 22 nt, Human
ucuauuguaggcauguagcuug

SEQ ID NO: 932962 - RNA, 22 nt, Human
acauaacaaucauaggacauag

SEQ ID NO: 932963 - RNA, 22 nt, Human
gaccuucaagcaccauauuuau

SEQ ID NO: 932964 - RNA, 21 nt, Human
ucugugcuuuuuuggcuccua

SEQ ID NO: 932965 - RNA, 23 nt, Human
aagacuaauucuuaauugcuuag

SEQ ID NO: 932966 - RNA, 22 nt, Human
agaugucuguaauucuaagcau

SEQ ID NO: 932967 - RNA, 22 nt, Human
gauggcuucacuuacauggcug

SEQ ID NO: 932968 - RNA, 22 nt, Human
acacaugcagguauacauguuc

SEQ ID NO: 932969 - RNA, 22 nt, Human
cuaagcuuuucaaaaacauguu

SEQ ID NO: 932970 - RNA, 22 nt, Human
ucuucauuuuauagcaucugug

SEQ ID NO: 932971 - RNA, 22 nt, Human
gugcuucuuucuccucaagccu

SEQ ID NO: 932972 - RNA, 22 nt, Human
agauaaugucaaauucugucug

SEQ ID NO: 932973 - RNA, 22 nt, Human
acacaugaaucacugguggaag

SEQ ID NO: 932974 - RNA, 22 nt, Human
agaaauuaugcaguaguuuuau

SEQ ID NO: 932975 - RNA, 22 nt, Human
aggucacacuuggaucauagaa

SEQ ID NO: 932976 - RNA, 22 nt, Human
auacaguagacaaucucaugaa

SEQ ID NO: 932977 - RNA, 22 nt, Human
uaugugaauacagcaguggaug

SEQ ID NO: 932978 - RNA, 22 nt, Human
ugucucuucugccuccagcugu

SEQ ID NO: 932979 - RNA, 19 nt, Human
ccuuugaaucaggacacuu

SEQ ID NO: 932980 - RNA, 22 nt, Human
ccugccacuucuugcuauggag

SEQ ID NO: 932981 - RNA, 22 nt, Human
uggcuucuuagaccaguggccu

SEQ ID NO: 932982 - RNA, 22 nt, Human
agagaauucuggugcuaacaag

SEQ ID NO: 932983 - RNA, 22 nt, Human
cuguuaaagauaguuaagcuuc

SEQ ID NO: 932984 - RNA, 22 nt, Human
uagcauuucacugaucuucacu

SEQ ID NO: 932985 - RNA, 22 nt, Human
cugugcuuucaggccgcugugu

SEQ ID NO: 932986 - RNA, 22 nt, Human
acacagaguuugacacauggga

SEQ ID NO: 932987 - RNA, 22 nt, Human
caccacuggaggucuuggcuuu

SEQ ID NO: 932988 - RNA, 22 nt, Human
ugcaaaugcccauuuauuuucu

SEQ ID NO: 932989 - RNA, 22 nt, Human
uaauuuacuugcaaauaacaau

SEQ ID NO: 932990 - RNA, 22 nt, Human
aagcauuucaauauaauauuca

SEQ ID NO: 932991 - RNA, 22 nt, Human
uuuagcaauaucauaaggaaga

SEQ ID NO: 932992 - RNA, 22 nt, Human
aauuaauauuuguggaauuaau

SEQ ID NO: 932993 - RNA, 22 nt, Human
uucauucagcacauauuuauug

SEQ ID NO: 932994 - RNA, 22 nt, Human
aguaacaguaacaucuuccuag

SEQ ID NO: 932995 - RNA, 22 nt, Human
ugggugaaaauuuugguggcac

SEQ ID NO: 932996 - RNA, 22 nt, Human
aauggcuuuaaguagucucaca

SEQ ID NO: 932997 - RNA, 22 nt, Human
uaucuguucugcuugauuuuga

SEQ ID NO: 932998 - RNA, 22 nt, Human
cuguacuuuugcaggucacagc

SEQ ID NO: 932999 - RNA, 21 nt, Human
aacaugauauguguauggauu

SEQ ID NO: 933000 - RNA, 22 nt, Human
auaaauuaggaucugggguucc

SEQ ID NO: 933001 - RNA, 23 nt, Human
ugguggcuugugguggccaccag

SEQ ID NO: 933002 - RNA, 18 nt, Human
uuuccaagaagagagcuc

SEQ ID NO: 933003 - RNA, 22 nt, Human
ucugugcuuaacuacucacccc

SEQ ID NO: 933004 - RNA, 22 nt, Human
acuaaagucaucaaagaacuuu

SEQ ID NO: 933005 - RNA, 22 nt, Human
agcacuuugggagauaaagcug

SEQ ID NO: 933006 - RNA, 22 nt, Human
ucuuuguuauugugaauagggu

SEQ ID NO: 933007 - RNA, 22 nt, Human
auggcuucgaguauauacauag

SEQ ID NO: 933008 - RNA, 22 nt, Human
agaguauuuugauuauccugga

SEQ ID NO: 933009 - RNA, 22 nt, Human
gucuacaaagcuucaagucucu

SEQ ID NO: 933010 - RNA, 22 nt, Human
uguaggaauguuuuuaaguugg

SEQ ID NO: 933011 - RNA, 22 nt, Human
uauggcuuuaaacaacuuaggu

SEQ ID NO: 933012 - RNA, 22 nt, Human
uuacacaaaguuagcucuugca

SEQ ID NO: 933013 - RNA, 22 nt, Human
uccacaugacuucuaauaacug

SEQ ID NO: 933014 - RNA, 22 nt, Human
uucuuuggggucuccagcauag

SEQ ID NO: 933015 - RNA, 22 nt, Human
cacacaugaaguugcugagcua

SEQ ID NO: 933016 - RNA, 22 nt, Human
aacaguaucuuuuaucagaaau

SEQ ID NO: 933017 - RNA, 22 nt, Human
acauuaaauuucauagugauua

SEQ ID NO: 933018 - RNA, 22 nt, Human
ucuccuuucuggagccugcuca

SEQ ID NO: 933019 - RNA, 22 nt, Human
cauggcuugcaagcauaggaga

SEQ ID NO: 933020 - RNA, 22 nt, Human
ccacugucagaggggcugugcc

SEQ ID NO: 933021 - RNA, 22 nt, Human
agacaacaucuaguuuggugga

SEQ ID NO: 933022 - RNA, 22 nt, Human
acagcagucagugaauauuuaa

SEQ ID NO: 933023 - RNA, 22 nt, Human
uaauuuuaacugugcuguuugg

SEQ ID NO: 933024 - RNA, 20 nt, Human
uauggcuuggcaaagcuuca

SEQ ID NO: 933025 - RNA, 22 nt, Human
acuguagcugccacuggaugca

SEQ ID NO: 933026 - RNA, 22 nt, Human
auauggcuguugguagccaaca

SEQ ID NO: 933027 - RNA, 21 nt, Human
uuuagcaagaguauagugcau

SEQ ID NO: 933028 - RNA, 22 nt, Human
uugugaauagugccgcaauaaa

SEQ ID NO: 933029 - RNA, 22 nt, Human
augugaaaccugugaguagagu

SEQ ID NO: 933030 - RNA, 22 nt, Human
uggcuucugagucuccugacau

SEQ ID NO: 933031 - RNA, 22 nt, Human
acaucaguaauuaagucucaag

SEQ ID NO: 933032 - RNA, 22 nt, Human
cacaugcauaccuauguguaua

SEQ ID NO: 933033 - RNA, 22 nt, Human
ucuuuguacaggaaggcacugu

SEQ ID NO: 933034 - RNA, 22 nt, Human
augcaugauccugagcaaccca

SEQ ID NO: 933035 - RNA, 22 nt, Human
uuuuguguugccauguuaagca

SEQ ID NO: 933036 - RNA, 22 nt, Human
agaaucaaagagaaauacuuug

SEQ ID NO: 933037 - RNA, 22 nt, Human
aaauuaagaguaacucuguaga

SEQ ID NO: 933038 - RNA, 22 nt, Human
aauggcuuagcagaguuagaag

SEQ ID NO: 933039 - RNA, 22 nt, Human
uggcugagaccuucccaaauuc

SEQ ID NO: 933040 - RNA, 22 nt, Human
uauuaugaggggcagagggcau

SEQ ID NO: 933041 - RNA, 18 nt, Human
agcucacagaucuguuuu

SEQ ID NO: 933042 - RNA, 20 nt, Human
uucuuuguuccuuacauuug

SEQ ID NO: 933043 - RNA, 20 nt, Human
aguucacaggccaaauuucu

SEQ ID NO: 933044 - RNA, 22 nt, Human
aaucaguuaaauauugaguaca

SEQ ID NO: 933045 - RNA, 22 nt, Human
aauggcuuuggucuggguccca

SEQ ID NO: 933046 - RNA, 22 nt, Human
ugucaccuggaaaucacucuaa

SEQ ID NO: 933047 - RNA, 22 nt, Human
cucaaauaccucuccaugugac

SEQ ID NO: 933048 - RNA, 22 nt, Human
gugccaccuucaaaucacauug

SEQ ID NO: 933049 - RNA, 21 nt, Human
ugacuuuauuugacagcccag

SEQ ID NO: 933050 - RNA, 22 nt, Human
uuaugucaaaaugguugagauu

SEQ ID NO: 933051 - RNA, 21 nt, Human
aauggcuuauacagaaguaag

SEQ ID NO: 933052 - RNA, 22 nt, Human
cacauuuaauugguuuagggug

SEQ ID NO: 933053 - RNA, 22 nt, Human
aagcauggagcaauagaaugac

SEQ ID NO: 933054 - RNA, 22 nt, Human
aaccuuuauuugguacuauucu

SEQ ID NO: 933055 - RNA, 22 nt, Human
cuguuacaagagagagacauga

SEQ ID NO: 933056 - RNA, 23 nt, Human
aaaugugagggaaaaucuuucug

SEQ ID NO: 933057 - RNA, 22 nt, Human
accaagcacaaagaugaguaaa

SEQ ID NO: 933058 - RNA, 22 nt, Human
gcacaugacuuugaggaaacca

SEQ ID NO: 933059 - RNA, 22 nt, Human
cuguuguauuuccaacuaugua

SEQ ID NO: 933060 - RNA, 19 nt, Human
auucagcauucugcacuuc

SEQ ID NO: 933061 - RNA, 22 nt, Human
ccuggcacacgguggcauucaa

SEQ ID NO: 933062 - RNA, 19 nt, Human
auggcucugggaucacugc

SEQ ID NO: 933063 - RNA, 22 nt, Human
uuuacccauauuagcaucaagu

SEQ ID NO: 933064 - RNA, 22 nt, Human
aagcauggcuguucuagcuaua

SEQ ID NO: 933065 - RNA, 22 nt, Human
aagacacugggggcugcagcca

SEQ ID NO: 933066 - RNA, 22 nt, Human
cacagauaccuagugaaacaua

SEQ ID NO: 933067 - RNA, 22 nt, Human
ucacacaucucagguguuuaau

SEQ ID NO: 933068 - RNA, 22 nt, Human
cuuuaucagaaaacacauuagg

SEQ ID NO: 933069 - RNA, 22 nt, Human
uuggcagacugacaaucuguuu

SEQ ID NO: 933070 - RNA, 22 nt, Human
uuaaaccauaguuuaacauaag

SEQ ID NO: 933071 - RNA, 22 nt, Human
gucacacaauaguaaguggucc

SEQ ID NO: 933072 - RNA, 22 nt, Human
ucaacuuuaguguagcuauuua

SEQ ID NO: 933073 - RNA, 22 nt, Human
uagucagcaugaaauaagcagc

SEQ ID NO: 933074 - RNA, 22 nt, Human
cauggcuuaccccaggagcagc

SEQ ID NO: 933075 - RNA, 22 nt, Human
aauggcuuuugcacuuaaaucg

SEQ ID NO: 933076 - RNA, 22 nt, Human
aaugugcuccaauugucuacuu

SEQ ID NO: 933077 - RNA, 23 nt, Human
ucugugcucgggggagcucucug

SEQ ID NO: 933078 - RNA, 22 nt, Human
ucacaagauauuucaguccuuu

SEQ ID NO: 933079 - RNA, 19 nt, Human
agauggcuuggacugaaaa

SEQ ID NO: 933080 - RNA, 22 nt, Human
acacuuuuguguauauccaguu

SEQ ID NO: 933081 - RNA, 22 nt, Human
uugugaaauguuucaaaauagu

SEQ ID NO: 933082 - RNA, 19 nt, Human
gcucagagucccccugcgg

SEQ ID NO: 933083 - RNA, 22 nt, Human
acuaacuugcugagugaccaug

SEQ ID NO: 933084 - RNA, 22 nt, Human
accuuuauaugaaagaugacau

SEQ ID NO: 933085 - RNA, 22 nt, Human
uagacuauagcucacagugcuu

SEQ ID NO: 933086 - RNA, 22 nt, Human
cagcagaggaaagcaaaucuaa

SEQ ID NO: 933087 - RNA, 22 nt, Human
ugaguaauucacaaaacagaug

SEQ ID NO: 933088 - RNA, 22 nt, Human
acaguuuaucgauucaccuacc

SEQ ID NO: 933089 - RNA, 22 nt, Human
augcuuggccccuuuauagccu

SEQ ID NO: 933090 - RNA, 22 nt, Human
augugaaaauccaauggcagca

SEQ ID NO: 933091 - RNA, 22 nt, Human
caugcaguauucaggacaguuc

SEQ ID NO: 933092 - RNA, 22 nt, Human
ccuucagagguguagauugcgu

SEQ ID NO: 933093 - RNA, 22 nt, Human
aaaacacaagaagcaggguaca

SEQ ID NO: 933094 - RNA, 22 nt, Human
uuaacuggggaagcauuucaug

SEQ ID NO: 933095 - RNA, 22 nt, Human
aacauuuauauggguucaugaa

SEQ ID NO: 933096 - RNA, 22 nt, Human
ucagaucauggaucuauuacuu

SEQ ID NO: 933097 - RNA, 22 nt, Human
aaagcaugcuacuuuauauagg

SEQ ID NO: 933098 - RNA, 22 nt, Human
cuuauucauaagucagacacac

SEQ ID NO: 933099 - RNA, 22 nt, Human
acugucacugugauguuagaga

SEQ ID NO: 933100 - RNA, 22 nt, Human
uggaauucuuauucugacuuca

SEQ ID NO: 933101 - RNA, 22 nt, Human
cuucagcagccucuugcauaaa

SEQ ID NO: 933102 - RNA, 22 nt, Human
acagaguaggugcucaguaaau

SEQ ID NO: 933103 - RNA, 22 nt, Human
auccuucaaaaggaauagcagg

SEQ ID NO: 933104 - RNA, 21 nt, Human
cuucuuggggagcagcuagac

SEQ ID NO: 933105 - RNA, 22 nt, Human
cauggcuucaugaggguuuugc

SEQ ID NO: 933106 - RNA, 19 nt, Human
uucucugugcuagacucug

SEQ ID NO: 933107 - RNA, 22 nt, Human
uacacaugugcacgcguguccu

SEQ ID NO: 933108 - RNA, 22 nt, Human
gacauuuaugaaggagauaugc

SEQ ID NO: 933109 - RNA, 20 nt, Human
ucugugcuacacuccagauu

SEQ ID NO: 933110 - RNA, 22 nt, Human
uucaauucugcucugaucuuag

SEQ ID NO: 933111 - RNA, 22 nt, Human
ucuguuggcuuuuuaaaguugu

SEQ ID NO: 933112 - RNA, 22 nt, Human
ucuacaaauaaauuacuaugua

SEQ ID NO: 933113 - RNA, 21 nt, Human
agcucacaguucuguccuguc

SEQ ID NO: 933114 - RNA, 22 nt, Human
acacuuugaagauggaaacuug

SEQ ID NO: 933115 - RNA, 22 nt, Human
cagcagagggagccauugaaau

SEQ ID NO: 933116 - RNA, 22 nt, Human
ggaccaucucuagccagagcuu

SEQ ID NO: 933117 - RNA, 22 nt, Human
auuacaauaagguuuauuugua

SEQ ID NO: 933118 - RNA, 22 nt, Human
aagcagagccugagacagggau

SEQ ID NO: 933119 - RNA, 22 nt, Human
aaaucaacuugugacguuaggu

SEQ ID NO: 933120 - RNA, 22 nt, Human
cugugaauugcaacaauugcaa

SEQ ID NO: 933121 - RNA, 22 nt, Human
cacauugaaccauauauuagug

SEQ ID NO: 933122 - RNA, 22 nt, Human
cacauuuaaaaaauccacgauc

SEQ ID NO: 933123 - RNA, 22 nt, Human
cacuugcuggaugguggcucag

SEQ ID NO: 933124 - RNA, 22 nt, Human
aaacaaacaauuaguugugugg

SEQ ID NO: 933125 - RNA, 22 nt, Human
uuauuaugccauuaccucccug

SEQ ID NO: 933126 - RNA, 22 nt, Human
uagcuucagggaaaccacugcu

SEQ ID NO: 933127 - RNA, 22 nt, Human
aagacaauuuauguuaggguca

SEQ ID NO: 933128 - RNA, 22 nt, Human
gagaagcagguuuagcagacaa

SEQ ID NO: 933129 - RNA, 22 nt, Human
aaacuucaaggauuugcaaauc

SEQ ID NO: 933130 - RNA, 19 nt, Human
uccugaagauuuccucagc

SEQ ID NO: 933131 - RNA, 22 nt, Human
aacauaaauuugaaguggcaaa

SEQ ID NO: 933132 - RNA, 22 nt, Human
auuauucaauguuauuucagug

SEQ ID NO: 933133 - RNA, 22 nt, Human
cucuggcuggcaccugaucuga

SEQ ID NO: 933134 - RNA, 22 nt, Human
uuauuaugguauuucuuugcag

SEQ ID NO: 933135 - RNA, 22 nt, Human
agaaaucuauguuuugguuaga

SEQ ID NO: 933136 - RNA, 22 nt, Human
uaaccuuuuuaucuuaccucca

SEQ ID NO: 933137 - RNA, 22 nt, Human
uauggcuuucaaaggaacucgg

SEQ ID NO: 933138 - RNA, 22 nt, Human
cccugcacagccuggcucucuu

SEQ ID NO: 933139 - RNA, 19 nt, Human
ugauggaauuugacauucc

SEQ ID NO: 933140 - RNA, 20 nt, Human
gcuaggcuggugauugucaa

SEQ ID NO: 933141 - RNA, 22 nt, Human
acauuucagauucaugaaguga

SEQ ID NO: 933142 - RNA, 22 nt, Human
aaaccuguuaauagagcgaugc

SEQ ID NO: 933143 - RNA, 22 nt, Human
gucuuauugcguauguauacaa

SEQ ID NO: 933144 - RNA, 22 nt, Human
gaaacagugagaacuuuuccug

SEQ ID NO: 933145 - RNA, 22 nt, Human
cuuuacacaaugauuuucuuua

SEQ ID NO: 933146 - RNA, 22 nt, Human
uaugcagcaccacucacugcag

SEQ ID NO: 933147 - RNA, 22 nt, Human
uuuauuaugauggacaccuucg

SEQ ID NO: 933148 - RNA, 22 nt, Human
cacaaauaccaguuuccuaaca

SEQ ID NO: 933149 - RNA, 22 nt, Human
aguucucaggucagcugagucu

SEQ ID NO: 933150 - RNA, 22 nt, Human
caauuacauuuauugagcauuc

SEQ ID NO: 933151 - RNA, 22 nt, Human
auuauucauggucuuccacaau

SEQ ID NO: 933152 - RNA, 22 nt, Human
guuccaaagucucugagcugag

SEQ ID NO: 933153 - RNA, 22 nt, Human
cagacuguagaguuugagaagu

SEQ ID NO: 933154 - RNA, 22 nt, Human
agaagcauuggaccaggggccc

SEQ ID NO: 933155 - RNA, 22 nt, Human
acauaucugugagguuuuguug

SEQ ID NO: 933156 - RNA, 22 nt, Human
uacacauguuuggcaaguaugu

SEQ ID NO: 933157 - RNA, 22 nt, Human
agcagagacaugaaauaugcuu

SEQ ID NO: 933158 - RNA, 17 nt, Human
ugucuacucugacuaaa

SEQ ID NO: 933159 - RNA, 23 nt, Human
uaauuuuagccuuacaggacccu

SEQ ID NO: 933160 - RNA, 22 nt, Human
aaugucuuuauuucagguuuac

SEQ ID NO: 933161 - RNA, 22 nt, Human
uaaauacagucauuugagccau

SEQ ID NO: 933162 - RNA, 23 nt, Human
ucagagaaugguaugcuuuuccu

SEQ ID NO: 933163 - RNA, 22 nt, Human
uuggcaaugucuaaacacauuu

SEQ ID NO: 933164 - RNA, 22 nt, Human
aacuguugcuuguaauaugugc

SEQ ID NO: 933165 - RNA, 22 nt, Human
uuuauucacucauucagccagu

SEQ ID NO: 933166 - RNA, 22 nt, Human
guuucauuaccugacccaugag

SEQ ID NO: 933167 - RNA, 22 nt, Human
uagcaaccagaacagcacucua

SEQ ID NO: 933168 - RNA, 22 nt, Human
acuuuacaauauccugugacuu

SEQ ID NO: 933169 - RNA, 22 nt, Human
gauggcuuugccugcugugagg

SEQ ID NO: 933170 - RNA, 22 nt, Human
ccacuuuugggaacagugagua

SEQ ID NO: 933171 - RNA, 22 nt, Human
acacagagccagggaauacagu

SEQ ID NO: 933172 - RNA, 19 nt, Human
ggucacaaggaguugugaa

SEQ ID NO: 933173 - RNA, 22 nt, Human
ggcuucucuaaagaucaugcgu

SEQ ID NO: 933174 - RNA, 22 nt, Human
agagaacagacagaugcaauga

SEQ ID NO: 933175 - RNA, 22 nt, Human
gggcucaggccuggccucucac

SEQ ID NO: 933176 - RNA, 22 nt, Human
aaacaguccucuuuauuuaguc

SEQ ID NO: 933177 - RNA, 22 nt, Human
gcuucucuuguccaagggcagg

SEQ ID NO: 933178 - RNA, 22 nt, Human
guuacacagcuaagcuucuccu

SEQ ID NO: 933179 - RNA, 22 nt, Human
ugagaauuugugaacuuuucuc

SEQ ID NO: 933180 - RNA, 22 nt, Human
uacacuguuuuuggaaagaaga

SEQ ID NO: 933181 - RNA, 22 nt, Human
ugcaaagaugaaauauuaaagg

SEQ ID NO: 933182 - RNA, 22 nt, Human
cagcagagcugugugggaaggg

SEQ ID NO: 933183 - RNA, 20 nt, Human
auaaccugcccagaggauga

SEQ ID NO: 933184 - RNA, 21 nt, Human
agcagacugaauacauucuua

SEQ ID NO: 933185 - RNA, 19 nt, Human
acacauguguguuaugugc

SEQ ID NO: 933186 - RNA, 22 nt, Human
guucacacuuuugauaugugaa

SEQ ID NO: 933187 - RNA, 23 nt, Human
aaacuguugcuucaauguauccu

SEQ ID NO: 933188 - RNA, 22 nt, Human
gaagcaaucuggcucccagcca

SEQ ID NO: 933189 - RNA, 23 nt, Human
acuuaaaugguucuuuaucucag

SEQ ID NO: 933190 - RNA, 16 nt, Human
cuuccucuucacuggc

SEQ ID NO: 933191 - RNA, 22 nt, Human
uugcuuggcccauugcuucagu

SEQ ID NO: 933192 - RNA, 22 nt, Human
auacaugacacugggcuacagg

SEQ ID NO: 933193 - RNA, 22 nt, Human
acaguaacaccuacucuguccc

SEQ ID NO: 933194 - RNA, 22 nt, Human
ucuguguauuugugaccuguau

SEQ ID NO: 933195 - RNA, 22 nt, Human
cuacaguagagguugucaggga

SEQ ID NO: 933196 - RNA, 22 nt, Human
uuucuccuccagagagacacag

SEQ ID NO: 933197 - RNA, 22 nt, Human
uauggcuuuaaauugaaggagu

SEQ ID NO: 933198 - RNA, 23 nt, Human
ucauaaauauuagcacaguagga

SEQ ID NO: 933199 - RNA, 22 nt, Human
acuucacaaagagaucaucuaa

SEQ ID NO: 933200 - RNA, 22 nt, Human
accaguuaaagggaaauugaaa

SEQ ID NO: 933201 - RNA, 22 nt, Human
acacuguuuuagggaagaaaau

SEQ ID NO: 933202 - RNA, 22 nt, Human
ucuguuauacagucuguggcac

SEQ ID NO: 933203 - RNA, 22 nt, Human
uagacaaugccaucuugugguu

SEQ ID NO: 933204 - RNA, 22 nt, Human
uacauuuauaaggcuucucugu

SEQ ID NO: 933205 - RNA, 22 nt, Human
auuuagucaucacucauguguu

SEQ ID NO: 933206 - RNA, 22 nt, Human
ucuaacuuagggaauacuuuag

SEQ ID NO: 933207 - RNA, 22 nt, Human
cuuauucagauacagacucuug

SEQ ID NO: 933208 - RNA, 22 nt, Human
acauaaauagauuauugggagg

SEQ ID NO: 933209 - RNA, 22 nt, Human
ugcuuggccuacuuguccuuug

SEQ ID NO: 933210 - RNA, 22 nt, Human
cauguauugaagugugcaucug

SEQ ID NO: 933211 - RNA, 22 nt, Human
auacaguaauuuguaacucauc

SEQ ID NO: 933212 - RNA, 22 nt, Human
aucuaacuuauguuuuaccaaa

SEQ ID NO: 933213 - RNA, 22 nt, Human
cugaacuuauugagugcuugcu

SEQ ID NO: 933214 - RNA, 22 nt, Human
aaugguuuaguuaagacugagu

SEQ ID NO: 933215 - RNA, 23 nt, Human
ccugcucaggcgugugcccugcu

SEQ ID NO: 933216 - RNA, 22 nt, Human
agcagcagggacaaaggaacag

SEQ ID NO: 933217 - RNA, 22 nt, Human
uacacauuacauaauacuaucu

SEQ ID NO: 933218 - RNA, 22 nt, Human
auauacuuggagacuaucauug

SEQ ID NO: 933219 - RNA, 22 nt, Human
auuucaacagaguuugaaggca

SEQ ID NO: 933220 - RNA, 22 nt, Human
aauggcuuaaugauaccuuauc

SEQ ID NO: 933221 - RNA, 22 nt, Human
gcacaaauacaaaguugagaaa

SEQ ID NO: 933222 - RNA, 22 nt, Human
uggcuuccccuaccuuccaauu

SEQ ID NO: 933223 - RNA, 22 nt, Human
guuauucaauggcuuauaagga

SEQ ID NO: 933224 - RNA, 22 nt, Human
ucauauuaggguaaugauaaga

SEQ ID NO: 933225 - RNA, 22 nt, Human
aaucuucacucuuaacugugca

SEQ ID NO: 933226 - RNA, 22 nt, Human
gacauuuagcuguuuugcauuu

SEQ ID NO: 933227 - RNA, 22 nt, Human
gaaccuguaaguauagaugugg

SEQ ID NO: 933228 - RNA, 22 nt, Human
gucuacuuuuuaaucuuggcag

SEQ ID NO: 933229 - RNA, 23 nt, Human
agaugucuuagaaacugaagcug

SEQ ID NO: 933230 - RNA, 22 nt, Human
auagaauuugcacuaaaucugc

SEQ ID NO: 933231 - RNA, 18 nt, Human
acccuuuccaaacugcag

SEQ ID NO: 933232 - RNA, 17 nt, Human
ugacaaugacaagcacu

SEQ ID NO: 933233 - RNA, 22 nt, Human
uucacaaugccuuguugauggu

SEQ ID NO: 933234 - RNA, 22 nt, Human
uauacacauguguguauucaua

SEQ ID NO: 933235 - RNA, 22 nt, Human
agagaauuugagacuugcccaa

SEQ ID NO: 933236 - RNA, 22 nt, Human
agaaacagaagggaaagcuuuu

SEQ ID NO: 933237 - RNA, 22 nt, Human
ucacaaauauagugagaaccag

SEQ ID NO: 933238 - RNA, 22 nt, Human
augucuucuaagcucuaagcug

SEQ ID NO: 933239 - RNA, 22 nt, Human
ucuuuguacuuucuggcugucc

SEQ ID NO: 933240 - RNA, 22 nt, Human
ucacaaaucgaagccuuauaau

SEQ ID NO: 933241 - RNA, 22 nt, Human
ucccauguuagguguuucuguu

SEQ ID NO: 933242 - RNA, 22 nt, Human
auuccacaggagcugguuuucu

SEQ ID NO: 933243 - RNA, 22 nt, Human
acacaaauuguaggauaauugc

SEQ ID NO: 933244 - RNA, 22 nt, Human
acacuucucauuugauacuaac

SEQ ID NO: 933245 - RNA, 22 nt, Human
uucuccucuguuaccuugcaaa

SEQ ID NO: 933246 - RNA, 22 nt, Human
aaacuucaguaggagccaaccu

SEQ ID NO: 933247 - RNA, 20 nt, Human
uaaauuagccuugaagauua

SEQ ID NO: 933248 - RNA, 22 nt, Human
uuuaaauuuagaagaaacacug

SEQ ID NO: 933249 - RNA, 22 nt, Human
gcuucucuuucuccccuggcgg

SEQ ID NO: 933250 - RNA, 22 nt, Human
aauggaaccuaguuauccacau

SEQ ID NO: 933251 - RNA, 22 nt, Human
cacacuuugugcuaaucuauuu

SEQ ID NO: 933252 - RNA, 22 nt, Human
ccugcucaugggucccuggcag

SEQ ID NO: 933253 - RNA, 22 nt, Human
guggcuucugcggugugcgcag

SEQ ID NO: 933254 - RNA, 22 nt, Human
uacaucaaaucaauguuccagu

SEQ ID NO: 933255 - RNA, 22 nt, Human
ucagcuucccuaucugaccaua

SEQ ID NO: 933256 - RNA, 22 nt, Human
cuuuccugccuuauucauucau

SEQ ID NO: 933257 - RNA, 22 nt, Human
cacaugaucgucaugugaaagu

SEQ ID NO: 933258 - RNA, 22 nt, Human
agagacaaugccaaugcacacg

SEQ ID NO: 933259 - RNA, 22 nt, Human
ugcauguguuucccagcaagcu

SEQ ID NO: 933260 - RNA, 22 nt, Human
aaagacaugacacauuggagag

SEQ ID NO: 933261 - RNA, 22 nt, Human
agcagcaggcuuaaggaaaagu

SEQ ID NO: 933262 - RNA, 22 nt, Human
cuuuacauuaauuucuacugau

SEQ ID NO: 933263 - RNA, 22 nt, Human
uaaauuaaagauuggagaagga

SEQ ID NO: 933264 - RNA, 19 nt, Human
uccuucagucagaucuggg

SEQ ID NO: 933265 - RNA, 20 nt, Human
ucagagaaggagcuuuccug

SEQ ID NO: 933266 - RNA, 22 nt, Human
gaccuucaguguguuucucaca

SEQ ID NO: 933267 - RNA, 19 nt, Human
cuguccacacacucgcuuc

SEQ ID NO: 933268 - RNA, 22 nt, Human
uucacagauguauuggaacucc

SEQ ID NO: 933269 - RNA, 22 nt, Human
uaauuuuacuuccugagcaccu

SEQ ID NO: 933270 - RNA, 22 nt, Human
ucuuuguaaguuauauguagua

SEQ ID NO: 933271 - RNA, 22 nt, Human
gcccuguccuccugacugagug

SEQ ID NO: 933272 - RNA, 22 nt, Human
aacaaacucaaauggaagagug

SEQ ID NO: 933273 - RNA, 22 nt, Human
cuguuuaucucuaaccuguuua

SEQ ID NO: 933274 - RNA, 22 nt, Human
cagcagagcugggcuuugaauu

SEQ ID NO: 933275 - RNA, 22 nt, Human
aaaguacaugcaauucuucuga

SEQ ID NO: 933276 - RNA, 22 nt, Human
ugaguucuucacauuaccuacg

SEQ ID NO: 933277 - RNA, 22 nt, Human
uuuauuauagugguggggacug

SEQ ID NO: 933278 - RNA, 22 nt, Human
ugcuuauaauguuacugacaac

SEQ ID NO: 933279 - RNA, 22 nt, Human
agccauuuuccugaaauauaac

SEQ ID NO: 933280 - RNA, 22 nt, Human
uuuuacaccuguuaacucuaag

SEQ ID NO: 933281 - RNA, 23 nt, Human
cuguccuuggucuuggcugagug

SEQ ID NO: 933282 - RNA, 16 nt, Human
aaauggcuuaggcuua

SEQ ID NO: 933283 - RNA, 22 nt, Human
cuagagaaaaugauagcaggaa

SEQ ID NO: 933284 - RNA, 22 nt, Human
cuucuuuguucuguugucucac

SEQ ID NO: 933285 - RNA, 22 nt, Human
ugguggaaauaaacauccaauu

SEQ ID NO: 933286 - RNA, 21 nt, Human
gaaugucugccuucacaauga

SEQ ID NO: 933287 - RNA, 22 nt, Human
ucacaauucagaaaccaaguag

SEQ ID NO: 933288 - RNA, 22 nt, Human
ucuguuuagaugcuuuaucugu

SEQ ID NO: 933289 - RNA, 22 nt, Human
accaugaugcauccuuaaggaa

SEQ ID NO: 933290 - RNA, 22 nt, Human
ugcauucugacuuaguuaauau

SEQ ID NO: 933291 - RNA, 22 nt, Human
aagagaauaucgauagcacucu

SEQ ID NO: 933292 - RNA, 22 nt, Human
acaacuguuagacacuucuaag

SEQ ID NO: 933293 - RNA, 22 nt, Human
aaggauuuguccaaagucacac

SEQ ID NO: 933294 - RNA, 22 nt, Human
ccuuuacaguaugguuguauca

SEQ ID NO: 933295 - RNA, 22 nt, Human
aauggcuucuuuuugguauaau

SEQ ID NO: 933296 - RNA, 22 nt, Human
uuccacaaugguuaagcucguu

SEQ ID NO: 933297 - RNA, 22 nt, Human
gaagcaauguguuuucaacauu

SEQ ID NO: 933298 - RNA, 22 nt, Human
agauaaugauucugcauuucua

SEQ ID NO: 933299 - RNA, 22 nt, Human
cccugcagcauucucuaacugg

SEQ ID NO: 933300 - RNA, 22 nt, Human
cauuuccacuucugaaaacugg

SEQ ID NO: 933301 - RNA, 22 nt, Human
auugaguaauaauugaucuugg

SEQ ID NO: 933302 - RNA, 22 nt, Human
gcuucacagaaucaauaguugg

SEQ ID NO: 933303 - RNA, 22 nt, Human
uaaacauggauucugaucacag

SEQ ID NO: 933304 - RNA, 22 nt, Human
uuguuauaaagacuaaauaugu

SEQ ID NO: 933305 - RNA, 20 nt, Human
ucaaguuuugcuugacaaga

SEQ ID NO: 933306 - RNA, 22 nt, Human
uguagcuucagucugaucucau

SEQ ID NO: 933307 - RNA, 22 nt, Human
cugugacuggaaucuggcucuu

SEQ ID NO: 933308 - RNA, 22 nt, Human
ucuuuguaaaugccuagcauaa

SEQ ID NO: 933309 - RNA, 20 nt, Human
agaaacagcacaauucuguu

SEQ ID NO: 933310 - RNA, 22 nt, Human
uauuuagcuggagucagugcuu

SEQ ID NO: 933311 - RNA, 22 nt, Human
acuguuauaguucacuuuuccc

SEQ ID NO: 933312 - RNA, 22 nt, Human
uuccaaauguuggacaacugua

SEQ ID NO: 933313 - RNA, 22 nt, Human
aagugaauguagcaaacuugaa

SEQ ID NO: 933314 - RNA, 22 nt, Human
aacaguauugguugaacucaag

SEQ ID NO: 933315 - RNA, 23 nt, Human
gcucuggcagcuugugucagcac

SEQ ID NO: 933316 - RNA, 19 nt, Human
auuuauuguaugauuccau

SEQ ID NO: 933317 - RNA, 22 nt, Human
uacacaacugacaaccauucug

SEQ ID NO: 933318 - RNA, 22 nt, Human
uaacuguugugcgggucucugg

SEQ ID NO: 933319 - RNA, 22 nt, Human
gccucuccuggagaaggcaggg

SEQ ID NO: 933320 - RNA, 22 nt, Human
ggcaugcucuuuguccacagua

SEQ ID NO: 933321 - RNA, 22 nt, Human
gugcuugggggaaguaacagac

SEQ ID NO: 933322 - RNA, 22 nt, Human
aguucacaagcguaggugcuga

SEQ ID NO: 933323 - RNA, 22 nt, Human
augugcuugcagaugagccuca

SEQ ID NO: 933324 - RNA, 22 nt, Human
acacagcuuucagucauuaucu

SEQ ID NO: 933325 - RNA, 20 nt, Human
uauuaugaccuguguucugg

SEQ ID NO: 933326 - RNA, 22 nt, Human
gauacagaaaggcugcauugag

SEQ ID NO: 933327 - RNA, 22 nt, Human
cacaguauucacugggcagauu

SEQ ID NO: 933328 - RNA, 18 nt, Human
aacuguugaaauagcuug

SEQ ID NO: 933329 - RNA, 22 nt, Human
auguaagacuuuaagaaccuaa

SEQ ID NO: 933330 - RNA, 22 nt, Human
ucaccuguuggauguauacugu

SEQ ID NO: 933331 - RNA, 22 nt, Human
aauggcaugacuugcccaaggc

SEQ ID NO: 933332 - RNA, 22 nt, Human
cuuuguaaucauucccuugguu

SEQ ID NO: 933333 - RNA, 22 nt, Human
auaaccuggauauaaacagaug

SEQ ID NO: 933334 - RNA, 22 nt, Human
aacagaguggagccaaacuuug

SEQ ID NO: 933335 - RNA, 22 nt, Human
agucacaucgauuauaaaauuu

SEQ ID NO: 933336 - RNA, 22 nt, Human
gaacuaaaugaaauuacuggug

SEQ ID NO: 933337 - RNA, 22 nt, Human
ugaaggaaugaguauacuguuu

SEQ ID NO: 933338 - RNA, 22 nt, Human
acauuaaaaaauguugcaugaa

SEQ ID NO: 933339 - RNA, 23 nt, Human
acuuugcagagccccuugaaaca

SEQ ID NO: 933340 - RNA, 22 nt, Human
uuuaauuugaaaugaguaaccc

SEQ ID NO: 933341 - RNA, 22 nt, Human
auuucccaggacuagaaauaua

SEQ ID NO: 933342 - RNA, 22 nt, Human
agagaaacugauguccuuugaa

SEQ ID NO: 933343 - RNA, 22 nt, Human
acacauguuuccaaaagcaccc

SEQ ID NO: 933344 - RNA, 22 nt, Human
guagacagaaagcggaaucaua

SEQ ID NO: 933345 - RNA, 22 nt, Human
uuacaguuuaagaggaaacaaa

SEQ ID NO: 933346 - RNA, 22 nt, Human
gcauggcuuccaaaagugcuaa

SEQ ID NO: 933347 - RNA, 22 nt, Human
ucacagaaugucagaguugggg

SEQ ID NO: 933348 - RNA, 22 nt, Human
uauugcagacaaaaugagcuac

SEQ ID NO: 933349 - RNA, 22 nt, Human
ucuaacuugugaguauagauga

SEQ ID NO: 933350 - RNA, 22 nt, Human
uuaagagacaggagaaugaugu

SEQ ID NO: 933351 - RNA, 22 nt, Human
uagcagagaggggacaguggca

SEQ ID NO: 933352 - RNA, 22 nt, Human
agcuagacuuucccuuuccaug

SEQ ID NO: 933353 - RNA, 22 nt, Human
uuuagcaaaacauuaugucugu

SEQ ID NO: 933354 - RNA, 22 nt, Human
augcuugguuccuacuucuggc

SEQ ID NO: 933355 - RNA, 22 nt, Human
cuuuacacuuggacccacacuu

SEQ ID NO: 933356 - RNA, 22 nt, Human
uggcuucugggguggccugcau

SEQ ID NO: 933357 - RNA, 22 nt, Human
uaagacauaaauaggcuuuuua

SEQ ID NO: 933358 - RNA, 22 nt, Human
aguuauuucaguaacauaauag

SEQ ID NO: 933359 - RNA, 22 nt, Human
cagcuucauguccagguacugu

SEQ ID NO: 933360 - RNA, 22 nt, Human
aaauagacacaugcguucauau

SEQ ID NO: 933361 - RNA, 22 nt, Human
uacacagaggcugaugucuuag

SEQ ID NO: 933362 - RNA, 22 nt, Human
acagauaaauuuauaggagugu

SEQ ID NO: 933363 - RNA, 22 nt, Human
uauggcuuuuaacugucguaug

SEQ ID NO: 933364 - RNA, 21 nt, Human
uaacacauuuugguacuuugg

SEQ ID NO: 933365 - RNA, 22 nt, Human
agacaacuagaaaacuagacag

SEQ ID NO: 933366 - RNA, 22 nt, Human
cuagagaauugucuugagaguu

SEQ ID NO: 933367 - RNA, 22 nt, Human
gagaaacaacacuugaugccuu

SEQ ID NO: 933368 - RNA, 17 nt, Human
ggaaaagaagaguagga

SEQ ID NO: 933369 - RNA, 22 nt, Human
auaaccugagauugagcugccu

SEQ ID NO: 933370 - RNA, 22 nt, Human
uaacuucucugagccucauucc

SEQ ID NO: 933371 - RNA, 22 nt, Human
aaacuucagugaaugacuuaug

SEQ ID NO: 933372 - RNA, 22 nt, Human
cuguuggaugguuuccaaaaga

SEQ ID NO: 933373 - RNA, 16 nt, Human
ucucccuguucuccaa

SEQ ID NO: 933374 - RNA, 22 nt, Human
aaacaguacucgauuuuuguag

SEQ ID NO: 933375 - RNA, 22 nt, Human
guuacacaggaaaacauuagca

SEQ ID NO: 933376 - RNA, 22 nt, Human
uggcuucuuucuuuccaugugu

SEQ ID NO: 933377 - RNA, 22 nt, Human
aguucucaagacaauuaccugu

SEQ ID NO: 933378 - RNA, 20 nt, Human
gagucacagaagaagcugaa

SEQ ID NO: 933379 - RNA, 22 nt, Human
cagcagagaaauuaaacuucug

SEQ ID NO: 933380 - RNA, 22 nt, Human
auuaaauuaaguggcuaauuua

SEQ ID NO: 933381 - RNA, 22 nt, Human
uuuaugcagcguuucaccaccc

SEQ ID NO: 933382 - RNA, 22 nt, Human
ucuuuaauaucugccccagagc

SEQ ID NO: 933383 - RNA, 22 nt, Human
uggcugaauaauauucuguugu

SEQ ID NO: 933384 - RNA, 22 nt, Human
gacacuuugggacucagcccua

SEQ ID NO: 933385 - RNA, 22 nt, Human
cuuugcuucuccaaccugcuca

SEQ ID NO: 933386 - RNA, 22 nt, Human
cuuggcugcuuuugugcacauu

SEQ ID NO: 933387 - RNA, 23 nt, Human
cuggcuucuggggccucuguuuc

SEQ ID NO: 933388 - RNA, 22 nt, Human
uaggcuucccgcucacaugccc

SEQ ID NO: 933389 - RNA, 22 nt, Human
uauggcuucuuguguuacugug

SEQ ID NO: 933390 - RNA, 21 nt, Human
ucucaucuccugaccugugcc

SEQ ID NO: 933391 - RNA, 20 nt, Human
agaagcauucaaagaaaacu

SEQ ID NO: 933392 - RNA, 18 nt, Human
uuugcuuuccuucuucag

SEQ ID NO: 933393 - RNA, 22 nt, Human
cuucacuugcucaucaugcuau

SEQ ID NO: 933394 - RNA, 22 nt, Human
agaguauugugaccauuuguca

SEQ ID NO: 933395 - RNA, 22 nt, Human
agcagagaggagguggcccugu

SEQ ID NO: 933396 - RNA, 22 nt, Human
uugugauacugagcuuggcauu

SEQ ID NO: 933397 - RNA, 22 nt, Human
gcuuuacacagaugaauauuuc

SEQ ID NO: 933398 - RNA, 22 nt, Human
acuuuacccgcacucagacaca

SEQ ID NO: 933399 - RNA, 22 nt, Human
ucuguuggcuugagauuuaauu

SEQ ID NO: 933400 - RNA, 22 nt, Human
gagaggaagccuucuguacuug

SEQ ID NO: 933401 - RNA, 22 nt, Human
ugaggucuguccugucuuugga

SEQ ID NO: 933402 - RNA, 22 nt, Human
uggggugugcucagagcagggg

SEQ ID NO: 933403 - RNA, 22 nt, Human
cugguggaauggcagagggaac

SEQ ID NO: 933404 - RNA, 22 nt, Human
cagggccugccugguuccugga

SEQ ID NO: 933405 - RNA, 22 nt, Human
uggaaggggccaggcgcggagu

SEQ ID NO: 933406 - RNA, 22 nt, Human
ugagcagacuugaugaggcagc

SEQ ID NO: 933407 - RNA, 22 nt, Human
ggugagaggcagugcuguggaa

SEQ ID NO: 933408 - RNA, 20 nt, Human
gggugugggcccggccaggc

SEQ ID NO: 933409 - RNA, 22 nt, Human
aggagcagaacuguuguggagg

SEQ ID NO: 933410 - RNA, 22 nt, Human
ucugaggucauuccaaggacau

SEQ ID NO: 933411 - RNA, 22 nt, Human
cgcuuuggagucccugcuuuac

SEQ ID NO: 933412 - RNA, 22 nt, Human
ugaggaggugggcacacagagu

SEQ ID NO: 933413 - RNA, 22 nt, Human
agauguuuuuccaggucuaauu

SEQ ID NO: 933414 - RNA, 22 nt, Human
uggguagggagcuggaauccua

SEQ ID NO: 933415 - RNA, 22 nt, Human
aauggcuguucucugugauugg

SEQ ID NO: 933416 - RNA, 21 nt, Human
cuggagcuuggugagaagugu

SEQ ID NO: 933417 - RNA, 22 nt, Human
acgugcaggaucugguuggcga

SEQ ID NO: 933418 - RNA, 22 nt, Human
gggggcgccgccgcucaucuca

SEQ ID NO: 933419 - RNA, 22 nt, Human
uuuucaguuccaucucugcucu

SEQ ID NO: 933420 - RNA, 22 nt, Human
aggcugagccugggcguggugg

SEQ ID NO: 933421 - RNA, 22 nt, Human
uggaagggguuacgcagcagga

SEQ ID NO: 933422 - RNA, 22 nt, Human
ugcuuuggcccaacauugaugc

SEQ ID NO: 933423 - RNA, 22 nt, Human
gagaugggcgagaagguggacu

SEQ ID NO: 933424 - RNA, 22 nt, Human
ggacauugaagcuggaaaggga

SEQ ID NO: 933425 - RNA, 22 nt, Human
gacuuugguucagggcucagag

SEQ ID NO: 933426 - RNA, 22 nt, Human
gugggugucaguaucuuuaacg

SEQ ID NO: 933427 - RNA, 22 nt, Human
cgaggaggaaacgcggagaacu

SEQ ID NO: 933428 - RNA, 18 nt, Human
auggcuccagugucuucc

SEQ ID NO: 933429 - RNA, 19 nt, Human
cacuguccuagucgaggcc

SEQ ID NO: 933430 - RNA, 22 nt, Human
uggggcuccuccuggcaggagg

SEQ ID NO: 933431 - RNA, 22 nt, Human
gagguuggagggcuggccugca

SEQ ID NO: 933432 - RNA, 21 nt, Human
gcuccuggugcugcguggcgc

SEQ ID NO: 933433 - RNA, 22 nt, Human
ucucagaaaugacaggagguac

SEQ ID NO: 933434 - RNA, 23 nt, Human
uggcucugagcuuccugguggcc

SEQ ID NO: 933435 - RNA, 22 nt, Human
uaguguguggucucucccuugu

SEQ ID NO: 933436 - RNA, 22 nt, Human
agguaagguuuggaggcagugg

SEQ ID NO: 933437 - RNA, 22 nt, Human
aaggccaucuacuuacggaauu

SEQ ID NO: 933438 - RNA, 22 nt, Human
aggcugagguaggaggaucgcu

SEQ ID NO: 933439 - RNA, 16 nt, Human
aggagcuggguaggag

SEQ ID NO: 933440 - RNA, 22 nt, Human
cggagaggugggggcagcaucu

SEQ ID NO: 933441 - RNA, 22 nt, Human
ggcuucaguggccagagaugau

SEQ ID NO: 933442 - RNA, 22 nt, Human
ccugaggaugccagcaugggug

SEQ ID NO: 933443 - RNA, 22 nt, Human
gcggggggcaggcaguacguug

SEQ ID NO: 933444 - RNA, 22 nt, Human
ggaagccaguugcuuggugugg

SEQ ID NO: 933445 - RNA, 22 nt, Human
ccugucugaaggcagggggaug

SEQ ID NO: 933446 - RNA, 22 nt, Human
uagggggcuuugcugcuugaca

SEQ ID NO: 933447 - RNA, 18 nt, Human
gagaggagccagaauuuu

SEQ ID NO: 933448 - RNA, 20 nt, Human
ucuggggaugaggucuagga

SEQ ID NO: 933449 - RNA, 22 nt, Human
ggaaggcuuuaagcaccaaagc

SEQ ID NO: 933450 - RNA, 22 nt, Human
aggcugcugccuuggagagugu

SEQ ID NO: 933451 - RNA, 22 nt, Human
auggaggaugugcagcaugggc

SEQ ID NO: 933452 - RNA, 22 nt, Human
cugggagggguagccaauccua

SEQ ID NO: 933453 - RNA, 22 nt, Human
uggcuuuugaaaaggugaugua

SEQ ID NO: 933454 - RNA, 22 nt, Human
uuagggacagcucuguagguga

SEQ ID NO: 933455 - RNA, 22 nt, Human
uuggggaagcuuugaaauacuu

SEQ ID NO: 933456 - RNA, 22 nt, Human
uggcauuggaauuuguguugca

SEQ ID NO: 933457 - RNA, 22 nt, Human
gcugccaauccagcugugggag

SEQ ID NO: 933458 - RNA, 22 nt, Human
cgggaagguggagguugcagug

SEQ ID NO: 933459 - RNA, 22 nt, Human
agggcaguguggugggacugac

SEQ ID NO: 933460 - RNA, 22 nt, Human
gagcuaggauaucaugagggua

SEQ ID NO: 933461 - RNA, 22 nt, Human
ggagcugugcugggugaucagg

SEQ ID NO: 933462 - RNA, 20 nt, Human
ccagguggugccuggagagg

SEQ ID NO: 933463 - RNA, 22 nt, Human
gagggugguggcuuaaggugcu

SEQ ID NO: 933464 - RNA, 22 nt, Human
cacgccuggacggcggagggug

SEQ ID NO: 933465 - RNA, 22 nt, Human
cugagaggcacaaggcauuucg

SEQ ID NO: 933466 - RNA, 22 nt, Human
auuccucagcaggccuuuuguu

SEQ ID NO: 933467 - RNA, 22 nt, Human
ggagagagaccuccaugcccag

SEQ ID NO: 933468 - RNA, 22 nt, Human
cuaggugauccacugcucucuu

SEQ ID NO: 933469 - RNA, 22 nt, Human
aggagcggauguguccugccag

SEQ ID NO: 933470 - RNA, 22 nt, Human
cugggguaucugccacaacucu

SEQ ID NO: 933471 - RNA, 20 nt, Human
uccugggguaagccaugguc

SEQ ID NO: 933472 - RNA, 22 nt, Human
gccuggggaacuugauccuguc

SEQ ID NO: 933473 - RNA, 22 nt, Human
ggaggaggggugacugaaugcu

SEQ ID NO: 933474 - RNA, 22 nt, Human
cuggagggcugcagcgaggcug

SEQ ID NO: 933475 - RNA, 22 nt, Human
ggguggaaaguauuuggggacc

SEQ ID NO: 933476 - RNA, 22 nt, Human
uuuccucacacagaagaucuug

SEQ ID NO: 933477 - RNA, 22 nt, Human
ggaaggguuuaagcaggagagu

SEQ ID NO: 933478 - RNA, 19 nt, Human
aggaaggcggcggcugccc

SEQ ID NO: 933479 - RNA, 22 nt, Human
ugugaggaccucagcagagucu

SEQ ID NO: 933480 - RNA, 22 nt, Human
ggcggugguugagaggacggcg

SEQ ID NO: 933481 - RNA, 22 nt, Human
ccaggaggaaagaccagcccau

SEQ ID NO: 933482 - RNA, 22 nt, Human
ggcagaggaagcuggaaguggg

SEQ ID NO: 933483 - RNA, 22 nt, Human
gggccuuggcgaaguguggugg

SEQ ID NO: 933484 - RNA, 21 nt, Human
ucgaccugcugggcucgggcu

SEQ ID NO: 933485 - RNA, 22 nt, Human
uggggucagcaggccuggccug

SEQ ID NO: 933486 - RNA, 22 nt, Human
gguggcugugagcauuauguga

SEQ ID NO: 933487 - RNA, 22 nt, Human
augggaggcagacacuaaguuc

SEQ ID NO: 933488 - RNA, 22 nt, Human
cuggagcagcagguggccaggg

SEQ ID NO: 933489 - RNA, 22 nt, Human
uguccugugaccuggcaccaca

SEQ ID NO: 933490 - RNA, 22 nt, Human
agggaggucuggcugcccugag

SEQ ID NO: 933491 - RNA, 22 nt, Human
gggaagugcccucuucaggaga

SEQ ID NO: 933492 - RNA, 22 nt, Human
aucagagcuaguacuugcaggu

SEQ ID NO: 933493 - RNA, 20 nt, Human
ugugugaauuagggcauguu

SEQ ID NO: 933494 - RNA, 22 nt, Human
gaggugggaugugugugcuacu

SEQ ID NO: 933495 - RNA, 22 nt, Human
cagugacguaaacugcaugugc

SEQ ID NO: 933496 - RNA, 22 nt, Human
ggcaagagggcagauggagugc

SEQ ID NO: 933497 - RNA, 21 nt, Human
ucuuggggaggagggcugcac

SEQ ID NO: 933498 - RNA, 22 nt, Human
cugggguuggccagggcccuag

SEQ ID NO: 933499 - RNA, 21 nt, Human
uuggaacaagcagcaguuugc

SEQ ID NO: 933500 - RNA, 22 nt, Human
agcccugugugcuuguguuccu

SEQ ID NO: 933501 - RNA, 22 nt, Human
caggggacacuccugcuugggc

SEQ ID NO: 933502 - RNA, 22 nt, Human
uccugagauaggaguugaaggc

SEQ ID NO: 933503 - RNA, 22 nt, Human
gcaguuaccuauuuuguagaaa

SEQ ID NO: 933504 - RNA, 22 nt, Human
aggaaagcucccaguagggcuc

SEQ ID NO: 933505 - RNA, 22 nt, Human
auggcauuugaaucugucuuuu

SEQ ID NO: 933506 - RNA, 21 nt, Human
ucagagggcccuggaggcuca

SEQ ID NO: 933507 - RNA, 22 nt, Human
ccaggaaguaugacccaacaga

SEQ ID NO: 933508 - RNA, 22 nt, Human
gaguuugugggaauggaguauu

SEQ ID NO: 933509 - RNA, 22 nt, Human
auggguggccccgugugcaguc

SEQ ID NO: 933510 - RNA, 22 nt, Human
uccugccaccggggguggcgau

SEQ ID NO: 933511 - RNA, 22 nt, Human
cagggagccccaauuccaugcc

SEQ ID NO: 933512 - RNA, 22 nt, Human
gagugugucggucagcguggcg

SEQ ID NO: 933513 - RNA, 22 nt, Human
acagagccuccaggagugcugg

SEQ ID NO: 933514 - RNA, 22 nt, Human
gcuaggaguggugggucaagga

SEQ ID NO: 933515 - RNA, 22 nt, Human
ggguuguagagcuggaagggga

SEQ ID NO: 933516 - RNA, 22 nt, Human
ugggagagauaggcuucuggac

SEQ ID NO: 933517 - RNA, 22 nt, Human
ccaagaggggcagagggcugca

SEQ ID NO: 933518 - RNA, 22 nt, Human
auugagaaggagauuggcaucu

SEQ ID NO: 933519 - RNA, 22 nt, Human
ccugggaaggugaggcccugga

SEQ ID NO: 933520 - RNA, 22 nt, Human
auuguauacaagcuuaauuguu

SEQ ID NO: 933521 - RNA, 22 nt, Human
gucuggaggaggaagaaggcac

SEQ ID NO: 933522 - RNA, 22 nt, Human
gucuggagccacugcugcugcu

SEQ ID NO: 933523 - RNA, 21 nt, Human
agggaaaaggcugagugaggg

SEQ ID NO: 933524 - RNA, 22 nt, Human
caggaggaaaguuccacucaac

SEQ ID NO: 933525 - RNA, 22 nt, Human
ugugguuuugguucagaaacaa

SEQ ID NO: 933526 - RNA, 22 nt, Human
ggccuugguaaauuggcauuug

SEQ ID NO: 933527 - RNA, 22 nt, Human
cagggccagggcuauggugaag

SEQ ID NO: 933528 - RNA, 22 nt, Human
ugcuccaucuagagcucugcag

SEQ ID NO: 933529 - RNA, 22 nt, Human
ggugcggagacuccaugaggcc

SEQ ID NO: 933530 - RNA, 22 nt, Human
uuggaggaagcucaugggggau

SEQ ID NO: 933531 - RNA, 22 nt, Human
cugggaggcccacguugggaag

SEQ ID NO: 933532 - RNA, 22 nt, Human
ggccuugggauguggcugcagc

SEQ ID NO: 933533 - RNA, 22 nt, Human
ggagaagggaacugaguuuuug

SEQ ID NO: 933534 - RNA, 22 nt, Human
caggguggcaggcaccauggcc

SEQ ID NO: 933535 - RNA, 18 nt, Human
gccugccagccgagggac

SEQ ID NO: 933536 - RNA, 19 nt, Human
agcagagcagggccguggg

SEQ ID NO: 933537 - RNA, 22 nt, Human
gccagaggggcucgaaggcgcg

SEQ ID NO: 933538 - RNA, 22 nt, Human
aggcagccuauggggagcucag

SEQ ID NO: 933539 - RNA, 22 nt, Human
gaccaggagauuugagcuaggc

SEQ ID NO: 933540 - RNA, 22 nt, Human
ggccuugguggcuuugcugaug

SEQ ID NO: 933541 - RNA, 22 nt, Human
gagcugagggucuaggaggguu

SEQ ID NO: 933542 - RNA, 22 nt, Human
uucuggaguuugaagaucaggu

SEQ ID NO: 933543 - RNA, 20 nt, Human
ggcagagcuaugucuguugc

SEQ ID NO: 933544 - RNA, 22 nt, Human
gggaugagagcugggacagaag

SEQ ID NO: 933545 - RNA, 22 nt, Human
uuguaagacuguagaaugcaaa

SEQ ID NO: 933546 - RNA, 22 nt, Human
ggucuggccuccgggcaggugg

SEQ ID NO: 933547 - RNA, 22 nt, Human
guucucucagcgauagugaugg

SEQ ID NO: 933548 - RNA, 22 nt, Human
gguguuguacauucuguggauu

SEQ ID NO: 933549 - RNA, 22 nt, Human
cugagggagcugcuggccuugg

SEQ ID NO: 933550 - RNA, 22 nt, Human
augauugaaaaugacauugcca

SEQ ID NO: 933551 - RNA, 22 nt, Human
cugggagaugacucagagcagg

SEQ ID NO: 933552 - RNA, 22 nt, Human
aagcuguuagggagugguaggu

SEQ ID NO: 933553 - RNA, 22 nt, Human
ugggaaggggagcuggaaagga

SEQ ID NO: 933554 - RNA, 19 nt, Human
agcagggagugguuguggg

SEQ ID NO: 933555 - RNA, 22 nt, Human
cuguccuaugaguacucacuag

SEQ ID NO: 933556 - RNA, 22 nt, Human
cuggacacuggggaugcgcagu

SEQ ID NO: 933557 - RNA, 22 nt, Human
ugggguccucucacuuggaggg

SEQ ID NO: 933558 - RNA, 22 nt, Human
cccagaggcugaguugggagca

SEQ ID NO: 933559 - RNA, 22 nt, Human
gggagggucugagagcugcacc

SEQ ID NO: 933560 - RNA, 22 nt, Human
cuguggcugcgcccugggggag

SEQ ID NO: 933561 - RNA, 22 nt, Human
ggugggugagcccugggagcug

SEQ ID NO: 933562 - RNA, 22 nt, Human
uggcugggagcuggaacugggc

SEQ ID NO: 933563 - RNA, 22 nt, Human
aaggcuuugugcugaguugucg

SEQ ID NO: 933564 - RNA, 22 nt, Human
uagcccuugaugcugcggccag

SEQ ID NO: 933565 - RNA, 22 nt, Human
ggcuggaaggcccuuuguugau

SEQ ID NO: 933566 - RNA, 22 nt, Human
agccagcauauauauaguugaa

SEQ ID NO: 933567 - RNA, 22 nt, Human
uuauggcauucauuggggcuuu

SEQ ID NO: 933568 - RNA, 22 nt, Human
gugggggcaggcagugcuagga

SEQ ID NO: 933569 - RNA, 22 nt, Human
cuagcccuuggugagaacagcg

SEQ ID NO: 933570 - RNA, 22 nt, Human
gccuggagcucggcugagggcg

SEQ ID NO: 933571 - RNA, 22 nt, Human
cgggagccucugggucacacug

SEQ ID NO: 933572 - RNA, 22 nt, Human
aguguuugaguuugcggcauug

SEQ ID NO: 933573 - RNA, 22 nt, Human
gacggagcugguugcugcggcu

SEQ ID NO: 933574 - RNA, 22 nt, Human
gagaauguuaauguugaaguau

SEQ ID NO: 933575 - RNA, 22 nt, Human
ugguccugagcaccagccugac

SEQ ID NO: 933576 - RNA, 22 nt, Human
gggcggggcuuccguccuccac

SEQ ID NO: 933577 - RNA, 22 nt, Human
ggggaggaagcuggaacacggg

SEQ ID NO: 933578 - RNA, 21 nt, Human
ucaggaagagccaguucaugc

SEQ ID NO: 933579 - RNA, 22 nt, Human
gcagcuuuggagguggaacucu

SEQ ID NO: 933580 - RNA, 22 nt, Human
caauaguaaauuacggaggaga

SEQ ID NO: 933581 - RNA, 22 nt, Human
ccagguggacggcgaguacagg

SEQ ID NO: 933582 - RNA, 22 nt, Human
guugggcugaagugugugcuua

SEQ ID NO: 933583 - RNA, 22 nt, Human
ucagagccccuccgcuguccca

SEQ ID NO: 933584 - RNA, 22 nt, Human
gucauggaggauugugaguggu

SEQ ID NO: 933585 - RNA, 22 nt, Human
ccugggugaugugcugcccucg

SEQ ID NO: 933586 - RNA, 22 nt, Human
auggauggaacucugcuguggu

SEQ ID NO: 933587 - RNA, 22 nt, Human
ggagugggaacaaugacauggu

SEQ ID NO: 933588 - RNA, 22 nt, Human
gagugggugaaugugcucauaa

SEQ ID NO: 933589 - RNA, 22 nt, Human
aggggagguguccccaaaucuc

SEQ ID NO: 933590 - RNA, 18 nt, Human
gaaggcauucaguggcuu

SEQ ID NO: 933591 - RNA, 22 nt, Human
ggacauggaaguauggagugga

SEQ ID NO: 933592 - RNA, 22 nt, Human
aguggcaguagaugagcugguu

SEQ ID NO: 933593 - RNA, 22 nt, Human
gccugagccgccugagcggcgg

SEQ ID NO: 933594 - RNA, 22 nt, Human
gaaggcaguaaauggcuguuuu

SEQ ID NO: 933595 - RNA, 22 nt, Human
ggcagguguggugaccagagau

SEQ ID NO: 933596 - RNA, 22 nt, Human
ucuggcccaucuucugccacca

SEQ ID NO: 933597 - RNA, 22 nt, Human
ucuggggucaccuggggugcuu

SEQ ID NO: 933598 - RNA, 22 nt, Human
gagcagcagcugggccagguuc

SEQ ID NO: 933599 - RNA, 22 nt, Human
cagggaugggauggagucaguu

SEQ ID NO: 933600 - RNA, 22 nt, Human
uggaagguguggcaggucuagu

SEQ ID NO: 933601 - RNA, 22 nt, Human
ugaggauggaaugcugugcaag

SEQ ID NO: 933602 - RNA, 22 nt, Human
ugggugguugcugaggcuccuu

SEQ ID NO: 933603 - RNA, 22 nt, Human
guggcauugccuucugcaggaa

SEQ ID NO: 933604 - RNA, 22 nt, Human
ugugugaacucucugauguaca

SEQ ID NO: 933605 - RNA, 22 nt, Human
gggaagugagcuggaaucaagg

SEQ ID NO: 933606 - RNA, 22 nt, Human
ggaaggggagcuggaaagggua

SEQ ID NO: 933607 - RNA, 21 nt, Human
acugaacuuguguucuagagg

SEQ ID NO: 933608 - RNA, 22 nt, Human
agcuuugggcagaagaggauuc

SEQ ID NO: 933609 - RNA, 22 nt, Human
cauggaaggcaaaagacacaga

SEQ ID NO: 933610 - RNA, 22 nt, Human
ugcuggaguggcacuguguggc

SEQ ID NO: 933611 - RNA, 22 nt, Human
gaggcagagacuccaccuucag

SEQ ID NO: 933612 - RNA, 20 nt, Human
aggaaggagaaucugagcaa

SEQ ID NO: 933613 - RNA, 21 nt, Human
ccuggagacaaagacagggug

SEQ ID NO: 933614 - RNA, 22 nt, Human
uggcagcauuuuuuccagaaca

SEQ ID NO: 933615 - RNA, 22 nt, Human
uuggaggacuaguuaagagacc

SEQ ID NO: 933616 - RNA, 18 nt, Human
uggguggcuagggaguuu

SEQ ID NO: 933617 - RNA, 22 nt, Human
uggcuccuuccgcagcaugccu

SEQ ID NO: 933618 - RNA, 22 nt, Human
gugagagugguuuauguccaug

SEQ ID NO: 933619 - RNA, 22 nt, Human
ggaaacauuccaagaguugaaa

SEQ ID NO: 933620 - RNA, 22 nt, Human
uaagggaacagcuucaaacuca

SEQ ID NO: 933621 - RNA, 21 nt, Human
ccaugucagaugugggcugug

SEQ ID NO: 933622 - RNA, 22 nt, Human
auggaguugagcucuguugucc

SEQ ID NO: 933623 - RNA, 22 nt, Human
cagagccuuaguucuccuagaa

SEQ ID NO: 933624 - RNA, 21 nt, Human
uaggugggagccccaguaugc

SEQ ID NO: 933625 - RNA, 22 nt, Human
gccugagauucccggagccgug

SEQ ID NO: 933626 - RNA, 22 nt, Human
gcucugugggggaaauccuggg

SEQ ID NO: 933627 - RNA, 22 nt, Human
aagcccuuggcgcacaccgggc

SEQ ID NO: 933628 - RNA, 22 nt, Human
gaaagcagaugaaauugcaaca

SEQ ID NO: 933629 - RNA, 22 nt, Human
cagacaggguccuguccgucac

SEQ ID NO: 933630 - RNA, 22 nt, Human
gcugggcccugggugcccuagc

SEQ ID NO: 933631 - RNA, 22 nt, Human
ccuggggaccugccucagcccu

SEQ ID NO: 933632 - RNA, 22 nt, Human
gaaaccuuugccgauggggucc

SEQ ID NO: 933633 - RNA, 22 nt, Human
ccuaggccgcccggugcguggg

SEQ ID NO: 933634 - RNA, 21 nt, Human
uccaggagcacgggacuagga

SEQ ID NO: 933635 - RNA, 22 nt, Human
gaggggcucuugggcaugaagg

SEQ ID NO: 933636 - RNA, 22 nt, Human
aauggcugccagggcaggaggu

SEQ ID NO: 933637 - RNA, 22 nt, Human
cgaggagugugaaggcuugucg

SEQ ID NO: 933638 - RNA, 22 nt, Human
gacagggacacagccagugagg

SEQ ID NO: 933639 - RNA, 22 nt, Human
accaagaguccaagugagguug

SEQ ID NO: 933640 - RNA, 22 nt, Human
ccuggagacccacuucugccaa

SEQ ID NO: 933641 - RNA, 22 nt, Human
gaggaggcuuccgggaggcacg

SEQ ID NO: 933642 - RNA, 22 nt, Human
cccagagcaugugcugccuuug

SEQ ID NO: 933643 - RNA, 22 nt, Human
ugagccuggagucguggagggg

SEQ ID NO: 933644 - RNA, 17 nt, Human
uaagggggaaacggagc

SEQ ID NO: 933645 - RNA, 22 nt, Human
cagggagcuggugccagccgac

SEQ ID NO: 933646 - RNA, 23 nt, Human
uggggcugauggagacggaccag

SEQ ID NO: 933647 - RNA, 22 nt, Human
gguuguaguuggagguuguaua

SEQ ID NO: 933648 - RNA, 22 nt, Human
uucugauugcugaugaggccca

SEQ ID NO: 933649 - RNA, 22 nt, Human
aagaggaggacgguucccagaa

SEQ ID NO: 933650 - RNA, 22 nt, Human
gggaggugauuaggaccaugua

SEQ ID NO: 933651 - RNA, 22 nt, Human
cuggagaggcugggaacagguu

SEQ ID NO: 933652 - RNA, 22 nt, Human
gggcagcaaaucugagucuggu

SEQ ID NO: 933653 - RNA, 22 nt, Human
gcagaggggaagcugaggaauu

SEQ ID NO: 933654 - RNA, 22 nt, Human
gaacugggaaugcugucccauc

SEQ ID NO: 933655 - RNA, 19 nt, Human
aaggcuuucugagugaaaa

SEQ ID NO: 933656 - RNA, 22 nt, Human
cccaggaguuagagguuguggu

SEQ ID NO: 933657 - RNA, 22 nt, Human
gggacuggaguagaggccggug

SEQ ID NO: 933658 - RNA, 22 nt, Human
agagcuggguggacuuguaguu

SEQ ID NO: 933659 - RNA, 22 nt, Human
aagggugguguaggagaucaaa

SEQ ID NO: 933660 - RNA, 23 nt, Human
gggugcugccuguagucaugcug

SEQ ID NO: 933661 - RNA, 22 nt, Human
ggagcggagggagggccacugu

SEQ ID NO: 933662 - RNA, 22 nt, Human
ugaaggccuccccgagcauuag

SEQ ID NO: 933663 - RNA, 22 nt, Human
aggaagccuggaguccugccca

SEQ ID NO: 933664 - RNA, 22 nt, Human
ccugggcugcucauggggauga

SEQ ID NO: 933665 - RNA, 22 nt, Human
gccuggcaaggcccuguugacu

SEQ ID NO: 933666 - RNA, 19 nt, Human
ccuggcccugcugcgcggg

SEQ ID NO: 933667 - RNA, 22 nt, Human
agauguuuauaacucaugagug

SEQ ID NO: 933668 - RNA, 22 nt, Human
ugggggagccuucacaguagcu

SEQ ID NO: 933669 - RNA, 22 nt, Human
guggaaggaauuaacagacuag

SEQ ID NO: 933670 - RNA, 22 nt, Human
agaggagguccuuuucugaugu

SEQ ID NO: 933671 - RNA, 22 nt, Human
cagggagaggccucuguugccc

SEQ ID NO: 933672 - RNA, 22 nt, Human
cggcagagcccugagucagccu

SEQ ID NO: 933673 - RNA, 21 nt, Human
uggcccuggccacggcugcca

SEQ ID NO: 933674 - RNA, 22 nt, Human
aggaggguggggucugccuguc

SEQ ID NO: 933675 - RNA, 22 nt, Human
uccaggaggacugagggggcug

SEQ ID NO: 933676 - RNA, 22 nt, Human
ucaggggacagccagcuggagg

SEQ ID NO: 933677 - RNA, 19 nt, Human
ggggcccggggucugcgag

SEQ ID NO: 933678 - RNA, 22 nt, Human
uccuggggaggucgaggcugag

SEQ ID NO: 933679 - RNA, 22 nt, Human
augcaggaagagcccuggagcu

SEQ ID NO: 933680 - RNA, 22 nt, Human
aaaugcucgccuuggccgagac

SEQ ID NO: 933681 - RNA, 22 nt, Human
ccuccugggccuugcucuguga

SEQ ID NO: 933682 - RNA, 19 nt, Human
ggccuggauuuagggcucc

SEQ ID NO: 933683 - RNA, 19 nt, Human
ggauaagguuggagugauc

SEQ ID NO: 933684 - RNA, 22 nt, Human
uuggcgcccaggacgccgccgc

SEQ ID NO: 933685 - RNA, 22 nt, Human
uggcugaggagagggcggaagu

SEQ ID NO: 933686 - RNA, 22 nt, Human
uggccuugcccagcgccuaggu

SEQ ID NO: 933687 - RNA, 22 nt, Human
aaggggggcaccugcaugcccg

SEQ ID NO: 933688 - RNA, 22 nt, Human
gggagcugagcuggaagagaau

SEQ ID NO: 933689 - RNA, 22 nt, Human
ggaggugacuggaucaugggca

SEQ ID NO: 933690 - RNA, 22 nt, Human
agguggcuaugaggaugcaguc

SEQ ID NO: 933691 - RNA, 22 nt, Human
gaggggcugggguugacuccaa

SEQ ID NO: 933692 - RNA, 17 nt, Human
ggugaguguccaggugg

SEQ ID NO: 933693 - RNA, 22 nt, Human
ugggugugagcccgggagccgc

SEQ ID NO: 933694 - RNA, 22 nt, Human
ggagaggggaacuuguugcuug

SEQ ID NO: 933695 - RNA, 22 nt, Human
ccaggaagaaacagucuuuaua

SEQ ID NO: 933696 - RNA, 22 nt, Human
aggagucauugagagggguccu

SEQ ID NO: 933697 - RNA, 22 nt, Human
ugccuaggcuggaaugcagugg

SEQ ID NO: 933698 - RNA, 22 nt, Human
agcugcugcaaguggugcuaac

SEQ ID NO: 933699 - RNA, 20 nt, Human
gugcccaguuggugacagac

SEQ ID NO: 933700 - RNA, 22 nt, Human
uggcagaaugaagacuggggcc

SEQ ID NO: 933701 - RNA, 22 nt, Human
ggagacucaccccgcauucuag

SEQ ID NO: 933702 - RNA, 22 nt, Human
gauggaggagauggcagggugc

SEQ ID NO: 933703 - RNA, 22 nt, Human
ggccuuggaguccuccacugga

SEQ ID NO: 933704 - RNA, 22 nt, Human
ugaguggacgugaggcugagua

SEQ ID NO: 933705 - RNA, 22 nt, Human
uggcugagcugcagcguggcuu

SEQ ID NO: 933706 - RNA, 22 nt, Human
uagauuaucccugauuugucca

SEQ ID NO: 933707 - RNA, 22 nt, Human
ggccgcggauuuucccgcuggc

SEQ ID NO: 933708 - RNA, 22 nt, Human
gggaggaaggcuugggugagua

SEQ ID NO: 933709 - RNA, 22 nt, Human
gaggggccuggcgaggacaugu

SEQ ID NO: 933710 - RNA, 20 nt, Human
ggccggggagcucuccaggg

SEQ ID NO: 933711 - RNA, 22 nt, Human
ggaaggaucuggcugaaaucca

SEQ ID NO: 933712 - RNA, 19 nt, Human
uccuggggaggggcauggc

SEQ ID NO: 933713 - RNA, 22 nt, Human
agugggagcggcagucggggac

SEQ ID NO: 933714 - RNA, 22 nt, Human
agagggcgcccaggcccacgcc

SEQ ID NO: 933715 - RNA, 22 nt, Human
gccagagggauuccuggugugu

SEQ ID NO: 933716 - RNA, 22 nt, Human
gaaggagaggauugugaggcug

SEQ ID NO: 933717 - RNA, 22 nt, Human
gcugcucucucccuaaguuggg

SEQ ID NO: 933718 - RNA, 22 nt, Human
gggagagcgcgcuagggccgag

SEQ ID NO: 933719 - RNA, 22 nt, Human
uuuggagagaugaaguucugug

SEQ ID NO: 933720 - RNA, 22 nt, Human
uggcaggaaaaagggccagagg

SEQ ID NO: 933721 - RNA, 22 nt, Human
aguggcugugaaauacauggga

SEQ ID NO: 933722 - RNA, 21 nt, Human
gggcuggauauuggaaagagg

SEQ ID NO: 933723 - RNA, 22 nt, Human
uccuggguccauggcagccgaa

SEQ ID NO: 933724 - RNA, 22 nt, Human
uagggagugcguagcagggugg

SEQ ID NO: 933725 - RNA, 22 nt, Human
agagugaaguaauuguuaggau

SEQ ID NO: 933726 - RNA, 22 nt, Human
uguccugugcacuguagcaugu

SEQ ID NO: 933727 - RNA, 22 nt, Human
guccuggggauuauagaguguu

SEQ ID NO: 933728 - RNA, 23 nt, Human
uccugcagauaagcugguugaca

SEQ ID NO: 933729 - RNA, 22 nt, Human
uccaggaguccuggguggcccc

SEQ ID NO: 933730 - RNA, 22 nt, Human
agguggaguuaagugugaacug

SEQ ID NO: 933731 - RNA, 22 nt, Human
aggacugggugcagagggcauc

SEQ ID NO: 933732 - RNA, 22 nt, Human
gaggugaguggggucuccaggg

SEQ ID NO: 933733 - RNA, 18 nt, Human
uggggggcuugucugaag

SEQ ID NO: 933734 - RNA, 22 nt, Human
ucagaagcauccauuucaccac

SEQ ID NO: 933735 - RNA, 22 nt, Human
gcaaggagcaccuuucuggaac

SEQ ID NO: 933736 - RNA, 22 nt, Human
agcuuuggcaucugacuagccg

SEQ ID NO: 933737 - RNA, 22 nt, Human
gagaagguggaccugaaggagc

SEQ ID NO: 933738 - RNA, 22 nt, Human
ggcuuuggggguguccaagaaa

SEQ ID NO: 933739 - RNA, 22 nt, Human
agugacagauuaccggcagagc

SEQ ID NO: 933740 - RNA, 22 nt, Human
cauuuuccucugcugguguuca

SEQ ID NO: 933741 - RNA, 21 nt, Human
uuccuggaggcagaaacguga

SEQ ID NO: 933742 - RNA, 22 nt, Human
aggcuauuuccacucuucucau

SEQ ID NO: 933743 - RNA, 22 nt, Human
ggagggaaccuuggcuggauug

SEQ ID NO: 933744 - RNA, 22 nt, Human
auggagcagcagaaggggcuug

SEQ ID NO: 933745 - RNA, 22 nt, Human
acagggagucugaggggauagu

SEQ ID NO: 933746 - RNA, 22 nt, Human
ugucuuggccacuaggagugcc

SEQ ID NO: 933747 - RNA, 22 nt, Human
gaguggggcccacugcugggug

SEQ ID NO: 933748 - RNA, 22 nt, Human
agggaagcagcagccgccuguc

SEQ ID NO: 933749 - RNA, 19 nt, Human
uggcucugucgaaggcaca

SEQ ID NO: 933750 - RNA, 19 nt, Human
uggcagcauugguaccuug

SEQ ID NO: 933751 - RNA, 20 nt, Human
cagagccaggguuuuguuuu

SEQ ID NO: 933752 - RNA, 22 nt, Human
ccaggaugacccccacuuuccu

SEQ ID NO: 933753 - RNA, 22 nt, Human
ucugggagaguagauaaaggaa

SEQ ID NO: 933754 - RNA, 19 nt, Human
ggaggcuucuuggggucgg

SEQ ID NO: 933755 - RNA, 22 nt, Human
agcuccacucccugccuguuuc

SEQ ID NO: 933756 - RNA, 22 nt, Human
uucagagcuggugucuacagcu

SEQ ID NO: 933757 - RNA, 22 nt, Human
agggggcuccuuggugugcaga

SEQ ID NO: 933758 - RNA, 22 nt, Human
uuccuggggacuuaccgucauu

SEQ ID NO: 933759 - RNA, 22 nt, Human
aaggaucauguauauguuuaag

SEQ ID NO: 933760 - RNA, 22 nt, Human
uaccugagaagaaacccguguu

SEQ ID NO: 933761 - RNA, 22 nt, Human
gcauucuugguggagugcuaaa

SEQ ID NO: 933762 - RNA, 22 nt, Human
gagggcugccacguugggcgag

SEQ ID NO: 933763 - RNA, 22 nt, Human
uggcuuccagaacugagcaaca

SEQ ID NO: 933764 - RNA, 20 nt, Human
ugugguuuuugccaguugaa

SEQ ID NO: 933765 - RNA, 22 nt, Human
cagaggccuggcuuggacaccu

SEQ ID NO: 933766 - RNA, 22 nt, Human
ugguggggccagacuucagcuc

SEQ ID NO: 933767 - RNA, 22 nt, Human
acuuccagaaaugauuuaauuu

SEQ ID NO: 933768 - RNA, 22 nt, Human
uuggcugacaaauggaaucucu

SEQ ID NO: 933769 - RNA, 19 nt, Human
ugguggaggugcaccugac

SEQ ID NO: 933770 - RNA, 22 nt, Human
ggguucagugaugccuucagga

SEQ ID NO: 933771 - RNA, 22 nt, Human
aggggagccagggcugcgaguu

SEQ ID NO: 933772 - RNA, 22 nt, Human
cugaaggacacgugaggagcca

SEQ ID NO: 933773 - RNA, 22 nt, Human
cccuugggcuucagcccuaccg

SEQ ID NO: 933774 - RNA, 22 nt, Human
gaauguuuaaaaggugcaguuu

SEQ ID NO: 933775 - RNA, 22 nt, Human
aucagaagaaauggaugugacu

SEQ ID NO: 933776 - RNA, 22 nt, Human
accuggaggcagagguugcagu

SEQ ID NO: 933777 - RNA, 22 nt, Human
aggagccauugcaggauggcag

SEQ ID NO: 933778 - RNA, 22 nt, Human
cauuguuggcagagggacagag

SEQ ID NO: 933779 - RNA, 21 nt, Human
uuuaaggccagcaggagguga

SEQ ID NO: 933780 - RNA, 22 nt, Human
ggagcagggaauuacagcgcag

SEQ ID NO: 933781 - RNA, 22 nt, Human
ggggagaguauuuuauucaagu

SEQ ID NO: 933782 - RNA, 22 nt, Human
ggaaccuuaguguucuuuuacc

SEQ ID NO: 933783 - RNA, 22 nt, Human
acccggaggcgggggaugcagu

SEQ ID NO: 933784 - RNA, 22 nt, Human
aucuucccaggcuggggagagg

SEQ ID NO: 933785 - RNA, 22 nt, Human
ggggaagaaauagaacauuuug

SEQ ID NO: 933786 - RNA, 21 nt, Human
ugaggccugccagucucagaa

SEQ ID NO: 933787 - RNA, 22 nt, Human
uggagcugguucuggggaagcu

SEQ ID NO: 933788 - RNA, 22 nt, Human
gguguggcaguggaccugugaa

SEQ ID NO: 933789 - RNA, 22 nt, Human
aaggggaguuagugauaaaacc

SEQ ID NO: 933790 - RNA, 22 nt, Human
aggggcagccucacaauccucu

SEQ ID NO: 933791 - RNA, 22 nt, Human
ugugagacguaggccaucgagg

SEQ ID NO: 933792 - RNA, 22 nt, Human
ggcuagggaucuagaccaggac

SEQ ID NO: 933793 - RNA, 22 nt, Human
cacagaggacuguagcggggag

SEQ ID NO: 933794 - RNA, 20 nt, Human
aggggcaccugcgacggggc

SEQ ID NO: 933795 - RNA, 22 nt, Human
uggaagggagcuggaauuugga

SEQ ID NO: 933796 - RNA, 18 nt, Human
aggagcggcugcggcugc

SEQ ID NO: 933797 - RNA, 22 nt, Human
ggccaaggcucuugagggcuga

SEQ ID NO: 933798 - RNA, 22 nt, Human
uccaggagugauaaggccacug

SEQ ID NO: 933799 - RNA, 22 nt, Human
cuggagaacagagcuguuuaga

SEQ ID NO: 933800 - RNA, 18 nt, Human
ccucagggagagagacgc

SEQ ID NO: 933801 - RNA, 22 nt, Human
auccugggaaguggccuccucc

SEQ ID NO: 933802 - RNA, 22 nt, Human
gggcccuggacguggcggcaga

SEQ ID NO: 933803 - RNA, 22 nt, Human
uguaccgccuugugggguuggg

SEQ ID NO: 933804 - RNA, 22 nt, Human
agcgcuugccgcacuccaagca

SEQ ID NO: 933805 - RNA, 17 nt, Human
uguguaaguugcauaga

SEQ ID NO: 933806 - RNA, 22 nt, Human
uuucugugauaggcugcgacgc

SEQ ID NO: 933807 - RNA, 22 nt, Human
gggcugagggguaucucauggg

SEQ ID NO: 933808 - RNA, 23 nt, Human
gcugccaaggaggcaggggugcc

SEQ ID NO: 933809 - RNA, 22 nt, Human
uugggauuacagguguaagcca

SEQ ID NO: 933810 - RNA, 22 nt, Human
aggugggacccguggggugcga

SEQ ID NO: 933811 - RNA, 22 nt, Human
auggaguguggccaggcaguaa

SEQ ID NO: 933812 - RNA, 22 nt, Human
uccaaggacauuguucuaguug

SEQ ID NO: 933813 - RNA, 22 nt, Human
gucugcccuuggccugggacuu

SEQ ID NO: 933814 - RNA, 19 nt, Human
cccuggaggaguguuggcu

SEQ ID NO: 933815 - RNA, 22 nt, Human
uuccaaggcugcuauuuguuuc

SEQ ID NO: 933816 - RNA, 18 nt, Human
agguauaugaaucucuuu

SEQ ID NO: 933817 - RNA, 22 nt, Human
guccagagaguaaaggggguaa

SEQ ID NO: 933818 - RNA, 22 nt, Human
ucuggaaggggaucugugguca

SEQ ID NO: 933819 - RNA, 22 nt, Human
acccggagucggagguugcagu

SEQ ID NO: 933820 - RNA, 22 nt, Human
cacauuggcaaacgggguugca

SEQ ID NO: 933821 - RNA, 22 nt, Human
gggggcuggacuuucccacaca

SEQ ID NO: 933822 - RNA, 21 nt, Human
aggucccagguuugggcagca

SEQ ID NO: 933823 - RNA, 22 nt, Human
caggguggaacaggcaauacuu

SEQ ID NO: 933824 - RNA, 22 nt, Human
cuugggcuuagaagguaaguga

SEQ ID NO: 933825 - RNA, 22 nt, Human
agguggagaagagaugggcagu

SEQ ID NO: 933826 - RNA, 22 nt, Human
uuuucaguugugcucucuaguu

SEQ ID NO: 933827 - RNA, 20 nt, Human
ugagccugcuguaggaggcc

SEQ ID NO: 933828 - RNA, 22 nt, Human
aggggaauggguagacuguuga

SEQ ID NO: 933829 - RNA, 22 nt, Human
auauuuguuuggcagaguucag

SEQ ID NO: 933830 - RNA, 22 nt, Human
ggacugucuccuugcugguagg

SEQ ID NO: 933831 - RNA, 17 nt, Human
ugaggccugcaucagug

SEQ ID NO: 933832 - RNA, 21 nt, Human
cccuugccugcacuccucggc

SEQ ID NO: 933833 - RNA, 19 nt, Human
gaauggguucuguagggag

SEQ ID NO: 933834 - RNA, 22 nt, Human
cucagugaauuggaggauggcc

SEQ ID NO: 933835 - RNA, 22 nt, Human
gggcccugcgacucgcggcgga

SEQ ID NO: 933836 - RNA, 19 nt, Human
gggugaggaagagcguugc

SEQ ID NO: 933837 - RNA, 17 nt, Human
gagguaggaagugaguc

SEQ ID NO: 933838 - RNA, 22 nt, Human
aggggagguggcagaaaugugc

SEQ ID NO: 933839 - RNA, 21 nt, Human
cagaggggcuagccuggcugc

SEQ ID NO: 933840 - RNA, 22 nt, Human
uccgggagcugaacgucuugcg

SEQ ID NO: 933841 - RNA, 22 nt, Human
agcccuugguauuuuccgaucc

SEQ ID NO: 933842 - RNA, 22 nt, Human
uccuggcaaagauguugguguu

SEQ ID NO: 933843 - RNA, 22 nt, Human
aggguugaagucugguccucau

SEQ ID NO: 933844 - RNA, 22 nt, Human
gccuggaucccagggagucagg

SEQ ID NO: 933845 - RNA, 22 nt, Human
aaggcaguuaauuuggcuagaa

SEQ ID NO: 933846 - RNA, 22 nt, Human
agggagcauugugacauaucac

SEQ ID NO: 933847 - RNA, 22 nt, Human
ucgcuugaacccaggaagugga

SEQ ID NO: 933848 - RNA, 22 nt, Human
gcuggguggaucggaggcucug

SEQ ID NO: 933849 - RNA, 22 nt, Human
gucagcaggguccccuugagug

SEQ ID NO: 933850 - RNA, 22 nt, Human
agggcagagauuaauuaagaca

SEQ ID NO: 933851 - RNA, 22 nt, Human
gcugucucauacaaggcccugc

SEQ ID NO: 933852 - RNA, 22 nt, Human
uaaggcuguuaggaggauuaaa

SEQ ID NO: 933853 - RNA, 22 nt, Human
aggagggagcuuaagccaggca

SEQ ID NO: 933854 - RNA, 22 nt, Human
guagaggggugauucugugaga

SEQ ID NO: 933855 - RNA, 22 nt, Human
ggagugacucucggggccacua

SEQ ID NO: 933856 - RNA, 22 nt, Human
cugggaggcggagguuguagug

SEQ ID NO: 933857 - RNA, 20 nt, Human
ucucccugcccaucucagau

SEQ ID NO: 933858 - RNA, 22 nt, Human
ggcuagggagacagagggcaug

SEQ ID NO: 933859 - RNA, 22 nt, Human
agcaggggcaggguuuugugcu

SEQ ID NO: 933860 - RNA, 22 nt, Human
aguggcuguuccaggugaggac

SEQ ID NO: 933861 - RNA, 17 nt, Human
gugagcugagucaggac

SEQ ID NO: 933862 - RNA, 22 nt, Human
ccaggagagcucucguucagug

SEQ ID NO: 933863 - RNA, 22 nt, Human
ggccauggcgggagccggcguc

SEQ ID NO: 933864 - RNA, 22 nt, Human
uggaaggggagcuggaaagggg

SEQ ID NO: 933865 - RNA, 22 nt, Human
ugggaugggaucucgcuguguc

SEQ ID NO: 933866 - RNA, 22 nt, Human
ucccugggguaucgcugaggca

SEQ ID NO: 933867 - RNA, 22 nt, Human
aggcgaagggaccagacgguag

SEQ ID NO: 933868 - RNA, 22 nt, Human
ugccuggauggcucugagcagg

SEQ ID NO: 933869 - RNA, 22 nt, Human
ugaaggccagggauuugcagcc

SEQ ID NO: 933870 - RNA, 22 nt, Human
uggaauguuaaaccucaaugau

SEQ ID NO: 933871 - RNA, 20 nt, Human
cccuuuucacgaaaaggaga

SEQ ID NO: 933872 - RNA, 22 nt, Human
gagucgagcagaaagccgucgg

SEQ ID NO: 933873 - RNA, 22 nt, Human
cuggagcuggcccaggcuggcc

SEQ ID NO: 933874 - RNA, 22 nt, Human
gggagaguagcuggaagguucu

SEQ ID NO: 933875 - RNA, 19 nt, Human
ugguucuccuuccacaguc

SEQ ID NO: 933876 - RNA, 22 nt, Human
ggcuguggucauuaggagguug

SEQ ID NO: 933877 - RNA, 22 nt, Human
gccugccuucggugcgcagcgg

SEQ ID NO: 933878 - RNA, 22 nt, Human
ucuccuggcauuugguugagua

SEQ ID NO: 933879 - RNA, 22 nt, Human
ugcugggauuacagucaugagc

SEQ ID NO: 933880 - RNA, 22 nt, Human
acuugguggcgaacgaggguca

SEQ ID NO: 933881 - RNA, 22 nt, Human
agggagcugcucugcuuccgug

SEQ ID NO: 933882 - RNA, 22 nt, Human
gcuuggccagcagccgggaugc

SEQ ID NO: 933883 - RNA, 22 nt, Human
gagguggcugcuugcugggaaa

SEQ ID NO: 933884 - RNA, 22 nt, Human
uggcuggggccugaauccugca

SEQ ID NO: 933885 - RNA, 22 nt, Human
gaggagaggcuggacgcgguga

SEQ ID NO: 933886 - RNA, 22 nt, Human
uggggugccgacagggagggca

SEQ ID NO: 933887 - RNA, 22 nt, Human
gaagcccuggggucagugucgu

SEQ ID NO: 933888 - RNA, 18 nt, Human
agggagagaccgcggguc

SEQ ID NO: 933889 - RNA, 22 nt, Human
gggcuggagagucccacguggg

SEQ ID NO: 933890 - RNA, 22 nt, Human
gccugagauuggacauuauuua

SEQ ID NO: 933891 - RNA, 22 nt, Human
gguauggagucugaguuucuag

SEQ ID NO: 933892 - RNA, 22 nt, Human
cgcaggugccggcagauggggu

SEQ ID NO: 933893 - RNA, 22 nt, Human
ugggcagggagcuggaaccaca

SEQ ID NO: 933894 - RNA, 22 nt, Human
ccgggagguggagauugcggug

SEQ ID NO: 933895 - RNA, 22 nt, Human
ggagaggguagggguccugccc

SEQ ID NO: 933896 - RNA, 22 nt, Human
gaggagagaagcuaacggugcu

SEQ ID NO: 933897 - RNA, 22 nt, Human
aagcagccagccaucaugcccg

SEQ ID NO: 933898 - RNA, 22 nt, Human
ccaagaggggaagggccgcagc

SEQ ID NO: 933899 - RNA, 18 nt, Human
ggugagggagcuggaagc

SEQ ID NO: 933900 - RNA, 18 nt, Human
gggguagaguguccuauu

SEQ ID NO: 933901 - RNA, 22 nt, Human
ugaggagcaggguggcuuacuc

SEQ ID NO: 933902 - RNA, 22 nt, Human
ggagguggagcuggaaguucca

SEQ ID NO: 933903 - RNA, 22 nt, Human
gcucaugggcccagagcagccc

SEQ ID NO: 933904 - RNA, 22 nt, Human
ucugggaguuucugugggagcu

SEQ ID NO: 933905 - RNA, 22 nt, Human
uggcagcagggccccuggagga

SEQ ID NO: 933906 - RNA, 22 nt, Human
uuguuuguaaggcucuuagaau

SEQ ID NO: 933907 - RNA, 22 nt, Human
agaugcugcuccacaggccagg

SEQ ID NO: 933908 - RNA, 22 nt, Human
uugaggagucaggggcacggaa

SEQ ID NO: 933909 - RNA, 20 nt, Human
agcuuugguuaagccagugg

SEQ ID NO: 933910 - RNA, 22 nt, Human
agucuggagugauuauguggga

SEQ ID NO: 933911 - RNA, 22 nt, Human
gguuuguugggguccaggccca

SEQ ID NO: 933912 - RNA, 22 nt, Human
gggcuguuugcauauguuuaua

SEQ ID NO: 933913 - RNA, 22 nt, Human
aucagagcugcauuuuagagcc

SEQ ID NO: 933914 - RNA, 22 nt, Human
cuggaaggagcccgggcggauc

SEQ ID NO: 933915 - RNA, 22 nt, Human
accaggcccuccagcugcgugg

SEQ ID NO: 933916 - RNA, 22 nt, Human
gucaggggccaugggccaagga

SEQ ID NO: 933917 - RNA, 22 nt, Human
aaagggaaguugcacauguucc

SEQ ID NO: 933918 - RNA, 22 nt, Human
uggcagugugggaggaagguac

SEQ ID NO: 933919 - RNA, 22 nt, Human
cccgggaggaggaaguugcagu

SEQ ID NO: 933920 - RNA, 22 nt, Human
auggaguucugccagcgcugcu

SEQ ID NO: 933921 - RNA, 22 nt, Human
cccaggaggcagaaguugcagu

SEQ ID NO: 933922 - RNA, 18 nt, Human
ggaaggugcuggagugca

SEQ ID NO: 933923 - RNA, 22 nt, Human T-lymphotropic virus 2
aaugaaccuccauuuaccauuu

SEQ ID NO: 933924 - RNA, 22 nt, Human T-lymphotropic virus 2
uuuggcggaggauacaggggcc

SEQ ID NO: 933925 - RNA, 22 nt, Human T-lymphotropic virus 2
cucaugggguugaggacggcug

SEQ ID NO: 933926 - RNA, 22 nt, Human T-lymphotropic virus 2
caagcucuugggucccgguacc

SEQ ID NO: 933927 - RNA, 22 nt, Human T-lymphotropic virus 2
ccacggcaguuauguuguagag

SEQ ID NO: 933928 - RNA, 22 nt, Human T-lymphotropic virus 2
aaugaaccuccauuuaccauuu

SEQ ID NO: 933929 - RNA, 22 nt, Human T-lymphotropic virus 2
ugagggugguaguaauggcauu

SEQ ID NO: 933930 - RNA, 22 nt, Human T-lymphotropic virus 2
uauccacgcaaaccaugcagga

SEQ ID NO: 933931 - RNA, 21 nt, Human T-lymphotropic virus 2
uauagggauuguagguguuug

SEQ ID NO: 933932 - RNA, 22 nt, Human T-lymphotropic virus 2
ucuguaaggucagcuggauaaa

SEQ ID NO: 933933 - RNA, 22 nt, Human T-lymphotropic virus 2
cgguuuuguaaccgcuguggaa

SEQ ID NO: 933934 - RNA, 21 nt, Human T-lymphotropic virus 2
uaacgcauggaguuguugugg

SEQ ID NO: 933935 - RNA, 22 nt, Human
acacuucuauucccugcacaaa

SEQ ID NO: 933936 - RNA, 22 nt, Human
aggcagcccacaggacacagga

SEQ ID NO: 933937 - RNA, 22 nt, Human
cuucuucagcacaauauugaug

SEQ ID NO: 933938 - RNA, 22 nt, Human
cugcucuggcuguguacuucag

SEQ ID NO: 933939 - RNA, 22 nt, Human
ugggggagauugugcaucucua

SEQ ID NO: 933940 - RNA, 19 nt, Human
ucucugcuucucuuggcau

SEQ ID NO: 933941 - RNA, 22 nt, Human
uauauuaaaugaccaguuuuaa

SEQ ID NO: 933942 - RNA, 22 nt, Human
aaauaguuagcccugcauauau

SEQ ID NO: 933943 - RNA, 22 nt, Human
cccaggccccagggcuugucag

SEQ ID NO: 933944 - RNA, 22 nt, Human
agaggcccugggcuggugugcu

SEQ ID NO: 933945 - RNA, 22 nt, Human
uccucagaagaaccccuagauu

SEQ ID NO: 933946 - RNA, 22 nt, Human
gcagagccaggcuggggcaggu

SEQ ID NO: 933947 - RNA, 22 nt, Human
uggcaacauggacaggucugcc

SEQ ID NO: 933948 - RNA, 22 nt, Human
ccuguggcugccacuuggguga

SEQ ID NO: 933949 - RNA, 22 nt, Human
agggcagagaucugagugggca

SEQ ID NO: 933950 - RNA, 22 nt, Human
ugcagcuccucuggcugccuga

SEQ ID NO: 933951 - RNA, 20 nt, Human
gaggcucugggcauggcgcc

SEQ ID NO: 933952 - RNA, 22 nt, Human
accucugccaagaugugcuccc

SEQ ID NO: 933953 - RNA, 22 nt, Human
ccucugcugcuguugagcaccg

SEQ ID NO: 933954 - RNA, 22 nt, Human
aucuuucagagcuccaucaggg

SEQ ID NO: 933955 - RNA, 22 nt, Human
gcagaagcagcagaugggcgca

SEQ ID NO: 933956 - RNA, 22 nt, Human
ccagggugcucuguggcgucgc

SEQ ID NO: 933957 - RNA, 22 nt, Human
cgugucaucugagccuugggcg

SEQ ID NO: 933958 - RNA, 22 nt, Human
uuuuacuuaauucuuggucaug

SEQ ID NO: 933959 - RNA, 22 nt, Human
acuuccuguuaugugugccucu

SEQ ID NO: 933960 - RNA, 19 nt, Human
ucaaagcaagcauguucug

SEQ ID NO: 933961 - RNA, 22 nt, Human
caaaaguaauugugguuuucac

SEQ ID NO: 933962 - RNA, 22 nt, Human
cugucugucaaguucaucucca

SEQ ID NO: 933963 - RNA, 18 nt, Human
aguaguggguuuagcuuc

SEQ ID NO: 933964 - RNA, 22 nt, Human
acaaaaaccguggauucagcau

SEQ ID NO: 933965 - RNA, 20 nt, Human
gagagcuggggaugaggcug

SEQ ID NO: 933966 - RNA, 22 nt, Human
ggcagcaggcgacuucccuauu

SEQ ID NO: 933967 - RNA, 22 nt, Human
gggcucugggauucagagcaag

SEQ ID NO: 933968 - RNA, 17 nt, Human
acucugcugaaguagaa

SEQ ID NO: 933969 - RNA, 22 nt, Human
caagcagagacuagauagcugu

SEQ ID NO: 933970 - RNA, 22 nt, Human
cagccaggcccccgagucguug

SEQ ID NO: 933971 - RNA, 23 nt, Human
cccagcagagaugaggagggguc

SEQ ID NO: 933972 - RNA, 22 nt, Human
cccaggagcuucucucugccuc

SEQ ID NO: 933973 - RNA, 22 nt, Human
aaaucaguaaauguucauuaac

SEQ ID NO: 933974 - RNA, 22 nt, Human
gcagcaaucuucacagugucau

SEQ ID NO: 933975 - RNA, 22 nt, Human
gacagggcgcccagccuguuuc

SEQ ID NO: 933976 - RNA, 22 nt, Human
aauucuauaggcaagcuauuuu

SEQ ID NO: 933977 - RNA, 22 nt, Human
aaaaagcuuaaaugagcaguuc

SEQ ID NO: 933978 - RNA, 22 nt, Human
cauuggaaugcauuugaagaga

SEQ ID NO: 933979 - RNA, 22 nt, Human
auucuuggcaaggagauuuaaa

SEQ ID NO: 933980 - RNA, 22 nt, Human
agucaguguucuccggagaggc

SEQ ID NO: 933981 - RNA, 22 nt, Human
uggucucuucuuccaagauggc

SEQ ID NO: 933982 - RNA, 22 nt, Human
gagguggugguggaggcauagc

SEQ ID NO: 933983 - RNA, 23 nt, Human
ccagccucugggucuucauccag

SEQ ID NO: 933984 - RNA, 22 nt, Human
accaaggagccacauacaaccu

SEQ ID NO: 933985 - RNA, 22 nt, Human
cagggagaggcaucauagggaa

SEQ ID NO: 933986 - RNA, 22 nt, Human
uugaaagaagaagcugcgaugu

SEQ ID NO: 933987 - RNA, 22 nt, Human
aaaugcuugcucuugauuauuu

SEQ ID NO: 933988 - RNA, 22 nt, Human
gcucccagggcagcgcagaaga

SEQ ID NO: 933989 - RNA, 22 nt, Human
agcaggagcugugggaagaugg

SEQ ID NO: 933990 - RNA, 22 nt, Human
ugaggcuguucuaccagggcca

SEQ ID NO: 933991 - RNA, 22 nt, Human
aaacaugagcacuugcuucaua

SEQ ID NO: 933992 - RNA, 22 nt, Human
aauagaauuuguacuguguuuu

SEQ ID NO: 933993 - RNA, 22 nt, Human
ugcagcagcagggaggaggcuc

SEQ ID NO: 933994 - RNA, 22 nt, Human
acuuuguaauaguuuaagguca

SEQ ID NO: 933995 - RNA, 22 nt, Human
agugaaauacugucguuuuuag

SEQ ID NO: 933996 - RNA, 22 nt, Human
cugcagcuguagaggacagugg

SEQ ID NO: 933997 - RNA, 20 nt, Human
ccacaggaguccagucgacc

SEQ ID NO: 933998 - RNA, 22 nt, Human
uuguuacuaagccuuuaaauag

SEQ ID NO: 933999 - RNA, 22 nt, Human
auugaaagauuuugggcucaug

SEQ ID NO: 934000 - RNA, 22 nt, Human
ugcauuguaggauguuuagcag

SEQ ID NO: 934001 - RNA, 22 nt, Human
uauguguaggaggaggacaggg

SEQ ID NO: 934002 - RNA, 16 nt, Human
gggagggaguuggugg

SEQ ID NO: 934003 - RNA, 22 nt, Human
augcugagcagagcugacaugc

SEQ ID NO: 934004 - RNA, 22 nt, Human
uacuuuuugucucuuugaaugu

SEQ ID NO: 934005 - RNA, 22 nt, Human
gucccagaugucuggaacuccc

SEQ ID NO: 934006 - RNA, 19 nt, Human
agccacagaacuugcagga

SEQ ID NO: 934007 - RNA, 22 nt, Human
agcagacauaucucaugucaca

SEQ ID NO: 934008 - RNA, 22 nt, Human
augugucuuggaguuuuaaugu

SEQ ID NO: 934009 - RNA, 22 nt, Human
ggcuucauggaggaggugaguc

SEQ ID NO: 934010 - RNA, 22 nt, Human
uagggauguccugagacuuggc

SEQ ID NO: 934011 - RNA, 22 nt, Human
gugcaugugucuuuauaguaga

SEQ ID NO: 934012 - RNA, 22 nt, Human
auuugucuucaguagguucuuc

SEQ ID NO: 934013 - RNA, 22 nt, Human
cucacugacgaggaagcugaga

SEQ ID NO: 934014 - RNA, 22 nt, Human
auacaacuuuaucuguaaugag

SEQ ID NO: 934015 - RNA, 22 nt, Human
gcugcugugaauuuuuuaaaug

SEQ ID NO: 934016 - RNA, 22 nt, Human
cagucccaucucccagguggcu

SEQ ID NO: 934017 - RNA, 22 nt, Human
uuuggccacuugggaguccagg

SEQ ID NO: 934018 - RNA, 22 nt, Human
uccaagaucuacagcaguuuag

SEQ ID NO: 934019 - RNA, 22 nt, Human
cagggguggcugcagcagaggu

SEQ ID NO: 934020 - RNA, 21 nt, Human
cagcaaaucauugggcagacu

SEQ ID NO: 934021 - RNA, 22 nt, Human
aggcucagcaucugauucauau

SEQ ID NO: 934022 - RNA, 22 nt, Human
ucacucuguuagaggaaagugc

SEQ ID NO: 934023 - RNA, 22 nt, Human
aagacaagcaucaaaucaggca

SEQ ID NO: 934024 - RNA, 22 nt, Human
agcugccacauggugucacugu

SEQ ID NO: 934025 - RNA, 22 nt, Human
aaggaagggaaauagugauguc

SEQ ID NO: 934026 - RNA, 22 nt, Human
aguaacaagugccaacguuaga

SEQ ID NO: 934027 - RNA, 22 nt, Human
gucaggggccaugggccaagga

SEQ ID NO: 934028 - RNA, 22 nt, Human
ccccaggagaaaucuuaaacua

SEQ ID NO: 934029 - RNA, 22 nt, Human
gcaagauguuaacauagggaga

SEQ ID NO: 934030 - RNA, 21 nt, Human
guguuuccuguuuauggcuug

SEQ ID NO: 934031 - RNA, 22 nt, Human
aacacauauuuauauaugcaca

SEQ ID NO: 934032 - RNA, 20 nt, Human
aaaaucucccagaaacuuau

SEQ ID NO: 934033 - RNA, 22 nt, Human
ucugcagcgugcaggcuggugc

SEQ ID NO: 934034 - RNA, 22 nt, Human
cugccucucagccugaccgcca

SEQ ID NO: 934035 - RNA, 22 nt, Human
gagugagggcagcaggggcugc

SEQ ID NO: 934036 - RNA, 22 nt, Human
accugaggccuccccagcagac

SEQ ID NO: 934037 - RNA, 23 nt, Human
uguugaaguaacuguuacauaga

SEQ ID NO: 934038 - RNA, 22 nt, Human
agucccagccuaggcugugcug

SEQ ID NO: 934039 - RNA, 22 nt, Human
caaagcucaugcucuuagccau

SEQ ID NO: 934040 - RNA, 22 nt, Human
uggucaaaaacucucaguggac

SEQ ID NO: 934041 - RNA, 22 nt, Human
uggaccugcuggaugggcaggu

SEQ ID NO: 934042 - RNA, 22 nt, Human
cuccuggaagcccgcccugcug

SEQ ID NO: 934043 - RNA, 22 nt, Human
ucccagagaagagcuggaugga

SEQ ID NO: 934044 - RNA, 22 nt, Human
uuugaaauuaagauauugucca

SEQ ID NO: 934045 - RNA, 22 nt, Human
uugcuucagagggagacacuuu

SEQ ID NO: 934046 - RNA, 22 nt, Human
ccaggcugcagucaaggggcau

SEQ ID NO: 934047 - RNA, 22 nt, Human
gaggcagaggaagguggucucu

SEQ ID NO: 934048 - RNA, 22 nt, Human
gccaucacauccaggcuaccuc

SEQ ID NO: 934049 - RNA, 22 nt, Human
ugugcuucaucacuucucaguu

SEQ ID NO: 934050 - RNA, 22 nt, Human
uucauucugggcucuaaggaac

SEQ ID NO: 934051 - RNA, 22 nt, Human
uccuucaggguugaggccgacu

SEQ ID NO: 934052 - RNA, 22 nt, Human
gcuccuggcuccaggcagccaa

SEQ ID NO: 934053 - RNA, 22 nt, Human
uggcagcugaggggaggcuuug

SEQ ID NO: 934054 - RNA, 22 nt, Human
gaggaaggucccaucagaauuu

SEQ ID NO: 934055 - RNA, 22 nt, Human
auggccaagcauauacagauug

SEQ ID NO: 934056 - RNA, 22 nt, Human
cagauccaucucucagaaagag

SEQ ID NO: 934057 - RNA, 22 nt, Human
gagcugccagacaugggaauga

SEQ ID NO: 934058 - RNA, 20 nt, Human
ucuggcucuuugcuccuccc

SEQ ID NO: 934059 - RNA, 22 nt, Human
agggcagagggugccucaccug

SEQ ID NO: 934060 - RNA, 22 nt, Human
uuacuuugcuuucucauuacag

SEQ ID NO: 934061 - RNA, 22 nt, Human
gacagggccgcagauggagacu

SEQ ID NO: 934062 - RNA, 22 nt, Human
ccuggugcuuaccagagcuuuu

SEQ ID NO: 934063 - RNA, 22 nt, Human
auuucagguaccugugggaucc

SEQ ID NO: 934064 - RNA, 22 nt, Human
gucaggaucaaauugaaguuau

SEQ ID NO: 934065 - RNA, 21 nt, Human
ucauccagguccugcuucuuc

SEQ ID NO: 934066 - RNA, 22 nt, Human
acuccuggggauccauuccuuu

SEQ ID NO: 934067 - RNA, 22 nt, Human
ucucuggcagggauaucuggcu

SEQ ID NO: 934068 - RNA, 22 nt, Human
aagcaauaagccagauuuggau

SEQ ID NO: 934069 - RNA, 22 nt, Human
augcuuugauuugguuucucua

SEQ ID NO: 934070 - RNA, 23 nt, Human
uuuuccagaaucgacucuguaga

SEQ ID NO: 934071 - RNA, 22 nt, Human
aggcucugggaagcagugaguu

SEQ ID NO: 934072 - RNA, 22 nt, Human
aucuggcuauugacauguuaua

SEQ ID NO: 934073 - RNA, 22 nt, Human
gaaaaugugccuuuggguauug

SEQ ID NO: 934074 - RNA, 22 nt, Human
ucugagcuacgaugccugucac

SEQ ID NO: 934075 - RNA, 22 nt, Human
aggcggcugguguccugcaggu

SEQ ID NO: 934076 - RNA, 22 nt, Human
aggagcugaaacuucucauaug

SEQ ID NO: 934077 - RNA, 22 nt, Human
ucauuuccucaaauucaagguu

SEQ ID NO: 934078 - RNA, 22 nt, Human
gagcugcuucugugugccgggu

SEQ ID NO: 934079 - RNA, 22 nt, Human
ggcugcuggcauugagguaggu

SEQ ID NO: 934080 - RNA, 22 nt, Human
agccugagugcuuaggacuguu

SEQ ID NO: 934081 - RNA, 22 nt, Human
uguguuuuacaaauucucuuaa

SEQ ID NO: 934082 - RNA, 22 nt, Human
agcuucuugaccaagccuguaa

SEQ ID NO: 934083 - RNA, 22 nt, Human
agggcagaggcggacacggaag

SEQ ID NO: 934084 - RNA, 23 nt, Human
ugcaugugaauucauacuuguuu

SEQ ID NO: 934085 - RNA, 21 nt, Human
gggagcuggaaacugggugac

SEQ ID NO: 934086 - RNA, 22 nt, Human
aagauguaucaguuaagucuuc

SEQ ID NO: 934087 - RNA, 22 nt, Human
aagauuucugcuuuuggaggca

SEQ ID NO: 934088 - RNA, 22 nt, Human
aggcuggguaccugucauaugc

SEQ ID NO: 934089 - RNA, 19 nt, Human
aggccugggguuuugcacu

SEQ ID NO: 934090 - RNA, 22 nt, Human
acaaagcuagagaagagaauug

SEQ ID NO: 934091 - RNA, 22 nt, Human
aggagucaggaccaaauggaaa

SEQ ID NO: 934092 - RNA, 22 nt, Human
ugcugccauggucgcugguguc

SEQ ID NO: 934093 - RNA, 22 nt, Human
uccaugagacagauacuguaag

SEQ ID NO: 934094 - RNA, 22 nt, Human
gugucauuaaccaccaugcaaa

SEQ ID NO: 934095 - RNA, 22 nt, Human
uaguaacagauuuauacagucu

SEQ ID NO: 934096 - RNA, 21 nt, Human
ccagacuggccuaugugguag

SEQ ID NO: 934097 - RNA, 21 nt, Human
uuguucuuccagaagcaaagu

SEQ ID NO: 934098 - RNA, 22 nt, Human
uacauuguuuuuucuugccauc

SEQ ID NO: 934099 - RNA, 22 nt, Human
agauggggcucaguguggaggc

SEQ ID NO: 934100 - RNA, 19 nt, Human
acuuccugcccgcuccuuu

SEQ ID NO: 934101 - RNA, 22 nt, Human
caggugcugcguggcggagcug

SEQ ID NO: 934102 - RNA, 22 nt, Human
aucaggaucacagaaacuuuua

SEQ ID NO: 934103 - RNA, 22 nt, Human
gagccugagugcugccuccccu

SEQ ID NO: 934104 - RNA, 22 nt, Human
agagccaggugcugcuguuuga

SEQ ID NO: 934105 - RNA, 22 nt, Human
uacccaggagaaacagcagggc

SEQ ID NO: 934106 - RNA, 22 nt, Human
uacauagcaaggaaaugacaga

SEQ ID NO: 934107 - RNA, 22 nt, Human
uguaugcuuuccaaaaaugcug

SEQ ID NO: 934108 - RNA, 22 nt, Human
ugaggcaggaugcuugcacagg

SEQ ID NO: 934109 - RNA, 22 nt, Human
acccugggcuuggccugcucag

SEQ ID NO: 934110 - RNA, 22 nt, Human
gccucugcaggugcgguuaucc

SEQ ID NO: 934111 - RNA, 22 nt, Human
uuagccauugucagcacauggc

SEQ ID NO: 934112 - RNA, 22 nt, Human
ugcaggcuuuagccccauggcu

SEQ ID NO: 934113 - RNA, 22 nt, Human
acugcuuuuagaaaucuauaga

SEQ ID NO: 934114 - RNA, 22 nt, Human
uucaggauaguggugaguggca

SEQ ID NO: 934115 - RNA, 17 nt, Human
aggcuggcucacaggga

SEQ ID NO: 934116 - RNA, 22 nt, Human
aaggcagcagaggaaaggugcu

SEQ ID NO: 934117 - RNA, 22 nt, Human
uaaauguguaaaccuccauuac

SEQ ID NO: 934118 - RNA, 22 nt, Human
guggcagcggugugcaaggagg

SEQ ID NO: 934119 - RNA, 22 nt, Human
aacuaaaucuggcauuuagagc

SEQ ID NO: 934120 - RNA, 22 nt, Human
ggcagcagggucuagauugaug

SEQ ID NO: 934121 - RNA, 22 nt, Human
ucugcagggaugugagggguga

SEQ ID NO: 934122 - RNA, 22 nt, Human
ccuggccauuugaacuucagac

SEQ ID NO: 934123 - RNA, 22 nt, Human
aaaggccuugagcugggugcca

SEQ ID NO: 934124 - RNA, 19 nt, Human
uggcugggcgugccuccgu

SEQ ID NO: 934125 - RNA, 22 nt, Human
ccuggcacgaagggcugagguu

SEQ ID NO: 934126 - RNA, 22 nt, Human
uggggcuggcacagucucuauu

SEQ ID NO: 934127 - RNA, 22 nt, Human
uccuguuuaucugugugacucg

SEQ ID NO: 934128 - RNA, 22 nt, Human
gcuggagcugaguucccugggc

SEQ ID NO: 934129 - RNA, 22 nt, Human
cugggaggugaacagaaaaacu

SEQ ID NO: 934130 - RNA, 22 nt, Human
ccucagccuuggccccaggcag

SEQ ID NO: 934131 - RNA, 22 nt, Human
uuccuguauucuaaagggaaag

SEQ ID NO: 934132 - RNA, 22 nt, Human
auugacaauguauuuguaucug

SEQ ID NO: 934133 - RNA, 22 nt, Human
caggcagauuugcugcccucca

SEQ ID NO: 934134 - RNA, 22 nt, Human
caaaaguaaucguggcuuuugc

SEQ ID NO: 934135 - RNA, 22 nt, Human
agccagaggccagccugccuca

SEQ ID NO: 934136 - RNA, 22 nt, Human
cagccagagaaagggcacugcc

SEQ ID NO: 934137 - RNA, 22 nt, Human
cugggagucaccaggagcaagg

SEQ ID NO: 934138 - RNA, 17 nt, Human
uucaaagcuuaucaagg

SEQ ID NO: 934139 - RNA, 22 nt, Human
uuccaguugguagaauguaagg

SEQ ID NO: 934140 - RNA, 21 nt, Human
gauuucacuuaccuucauuua

SEQ ID NO: 934141 - RNA, 22 nt, Human
ggagaggggcaaguuuaucuag

SEQ ID NO: 934142 - RNA, 19 nt, Human
uuucccagcccuugcugug

SEQ ID NO: 934143 - RNA, 22 nt, Human
cagcaucuuucucuucuggagu

SEQ ID NO: 934144 - RNA, 22 nt, Human
acugaaggcuuucccaagguca

SEQ ID NO: 934145 - RNA, 22 nt, Human
uuauuugcccauguuuagcaga

SEQ ID NO: 934146 - RNA, 22 nt, Human
uuccaggacaagauguuucagg

SEQ ID NO: 934147 - RNA, 22 nt, Human
augcuguggggagugaggguag

SEQ ID NO: 934148 - RNA, 22 nt, Human
gcagagacuccacugucuugug

SEQ ID NO: 934149 - RNA, 21 nt, Human
uuugaaagcuacaucuauagc

SEQ ID NO: 934150 - RNA, 22 nt, Human
gugggcuggacccuccugcucc

SEQ ID NO: 934151 - RNA, 22 nt, Human
ugcugucugcaacaguacuaca

SEQ ID NO: 934152 - RNA, 22 nt, Human
uggccugguuauauugcuauca

SEQ ID NO: 934153 - RNA, 22 nt, Human
auuuauuaagcaucugcuaugu

SEQ ID NO: 934154 - RNA, 22 nt, Human
caguacuugggggguucuaagu

SEQ ID NO: 934155 - RNA, 19 nt, Human
ggucagcugggcuagaggc

SEQ ID NO: 934156 - RNA, 22 nt, Human
uugcuuccucgaggccagcgug

SEQ ID NO: 934157 - RNA, 22 nt, Human
cugaggcugcccagggccaggu

SEQ ID NO: 934158 - RNA, 22 nt, Human
ugggugaggaugaugaggcagc

SEQ ID NO: 934159 - RNA, 22 nt, Human
gaggccuggcugucagucccca

SEQ ID NO: 934160 - RNA, 22 nt, Human
guacucucuugaaggccuuucu

SEQ ID NO: 934161 - RNA, 22 nt, Human
ccugggagugucagacuugcuu

SEQ ID NO: 934162 - RNA, 22 nt, Human
aagggccauaacuugcaguguu

SEQ ID NO: 934163 - RNA, 22 nt, Human
aggcccugcccagagcuccucg

SEQ ID NO: 934164 - RNA, 22 nt, Human
cccuggagggcagacagaugcc

SEQ ID NO: 934165 - RNA, 20 nt, Human
ugaagcagccuugauucugu

SEQ ID NO: 934166 - RNA, 20 nt, Human
cagauggcacgucagggcau

SEQ ID NO: 934167 - RNA, 18 nt, Human
uuaauguggcuuacuaug

SEQ ID NO: 934168 - RNA, 22 nt, Human
cucugagagagcuggugagcac

SEQ ID NO: 934169 - RNA, 22 nt, Human
ggccagaggccauccuccugcu

SEQ ID NO: 934170 - RNA, 22 nt, Human
aguaaagcagaguugcaguaca

SEQ ID NO: 934171 - RNA, 20 nt, Human
agcuggagaagggcccuucc

SEQ ID NO: 934172 - RNA, 22 nt, Human
acagggcccuugccagcacaag

SEQ ID NO: 934173 - RNA, 22 nt, Human
auuuccauagagcgucucacag

SEQ ID NO: 934174 - RNA, 22 nt, Human
gcugcugguccucagagcucau

SEQ ID NO: 934175 - RNA, 22 nt, Human
caggaaagaaaugagaacacca

SEQ ID NO: 934176 - RNA, 22 nt, Human
uuuccuuccagguuccuaaggc

SEQ ID NO: 934177 - RNA, 22 nt, Human
ucucccacugcaagcccaggcu

SEQ ID NO: 934178 - RNA, 22 nt, Human
gcagggccagugcagagaggaa

SEQ ID NO: 934179 - RNA, 22 nt, Human
ggccaagauggaaggagagaug

SEQ ID NO: 934180 - RNA, 22 nt, Human
ucccagaguucaaugggaaggu

SEQ ID NO: 934181 - RNA, 22 nt, Human
acagucuacuugagcuuguaua

SEQ ID NO: 934182 - RNA, 22 nt, Human
ugucacagggauaccauggggc

SEQ ID NO: 934183 - RNA, 22 nt, Human
guguguccuugggccucugcag

SEQ ID NO: 934184 - RNA, 21 nt, Human
ugaggcaggggugcuuuuguc

SEQ ID NO: 934185 - RNA, 22 nt, Human
caguggcuguuucuggaaggca

SEQ ID NO: 934186 - RNA, 22 nt, Human
aaaucuguaagcaauugcucag

SEQ ID NO: 934187 - RNA, 22 nt, Human
acagaccaaguuuccagcaggu

SEQ ID NO: 934188 - RNA, 22 nt, Human
accaugggucagccaccucagc

SEQ ID NO: 934189 - RNA, 22 nt, Human
cacagaaaaaggcuugaaaauc

SEQ ID NO: 934190 - RNA, 22 nt, Human
cagaggcagaggucaucucugg

SEQ ID NO: 934191 - RNA, 22 nt, Human
uggcucagcugucacagccugg

SEQ ID NO: 934192 - RNA, 22 nt, Human
gggcugggauugcuugcuguga

SEQ ID NO: 934193 - RNA, 22 nt, Human
ccagcuccaaguuugggcauca

SEQ ID NO: 934194 - RNA, 22 nt, Human
ccuccugguugcaaugaaaugg

SEQ ID NO: 934195 - RNA, 22 nt, Human
cauuuguacagaacagcuuuau

SEQ ID NO: 934196 - RNA, 22 nt, Human
cugggccugguagggcuugaaa

SEQ ID NO: 934197 - RNA, 22 nt, Human
uuuccaagacuccaguucuccc

SEQ ID NO: 934198 - RNA, 22 nt, Human
gaggcuggcagaaaagcacagg

SEQ ID NO: 934199 - RNA, 22 nt, Human
ggacagcucugccaggagcuca

SEQ ID NO: 934200 - RNA, 21 nt, Human
ucuguacaucauugagucccc

SEQ ID NO: 934201 - RNA, 23 nt, Human
aaccagauaaauggcuccagggc

SEQ ID NO: 934202 - RNA, 22 nt, Human
ccuguguggccaggcuggaguc

SEQ ID NO: 934203 - RNA, 22 nt, Human
uuugcauuccugccugcauuca

SEQ ID NO: 934204 - RNA, 20 nt, Human
aaaaacaguaaugcugaaga

SEQ ID NO: 934205 - RNA, 22 nt, Human
uuguuucuucauuuagaagcuu

SEQ ID NO: 934206 - RNA, 22 nt, Human
aaguuguauauaccgcuuuaag

SEQ ID NO: 934207 - RNA, 22 nt, Human
cagguggguguaugaaugcaaa

SEQ ID NO: 934208 - RNA, 22 nt, Human
ccugccugcagaaaguaucucc

SEQ ID NO: 934209 - RNA, 22 nt, Human
gccuggguuccaugaucuccag

SEQ ID NO: 934210 - RNA, 17 nt, Human
ugagaaguaggcaucau

SEQ ID NO: 934211 - RNA, 22 nt, Human
ccagagcugauuccugggacuu

SEQ ID NO: 934212 - RNA, 22 nt, Human
cagggcagcuuccuuuguuagg

SEQ ID NO: 934213 - RNA, 22 nt, Human
auguaacaggugaagcucugag

SEQ ID NO: 934214 - RNA, 22 nt, Human
ucuucucuccugcuuggcagaa

SEQ ID NO: 934215 - RNA, 22 nt, Human
ugcagcuguaacagaggccuca

SEQ ID NO: 934216 - RNA, 22 nt, Human
ggagggagucagcugauuagaa

SEQ ID NO: 934217 - RNA, 22 nt, Human
ccacagggcacaagggagguug

SEQ ID NO: 934218 - RNA, 22 nt, Human
cugagaggcacaaggcauuucg

SEQ ID NO: 934219 - RNA, 22 nt, Human
ucacacguccuugcuacuccuc

SEQ ID NO: 934220 - RNA, 22 nt, Human
cugcuguguuccuccugcaucu

SEQ ID NO: 934221 - RNA, 22 nt, Human
uguuugaaagcaccuacauuuu

SEQ ID NO: 934222 - RNA, 18 nt, Human
ccuggcagccaugcgcgc

SEQ ID NO: 934223 - RNA, 22 nt, Human
ucagaacauugacauucuuauu

SEQ ID NO: 934224 - RNA, 22 nt, Human
uacccaggggcugagcagaggu

SEQ ID NO: 934225 - RNA, 22 nt, Human
uuugcauaagucauguccagug

SEQ ID NO: 934226 - RNA, 20 nt, Human
cugcucugcuuugcaggugg

SEQ ID NO: 934227 - RNA, 22 nt, Human
uucuuuaaaauagugagaaaga

SEQ ID NO: 934228 - RNA, 22 nt, Human
cuccugcgguacuacugugcuu

SEQ ID NO: 934229 - RNA, 22 nt, Human
ugcuugugagaguuuuuucaga

SEQ ID NO: 934230 - RNA, 22 nt, Human
agggaucaaaaaauguacaugc

SEQ ID NO: 934231 - RNA, 22 nt, Human
uccagccaagggagguuacuag

SEQ ID NO: 934232 - RNA, 22 nt, Human
guugaaauuugugauaauuuag

SEQ ID NO: 934233 - RNA, 22 nt, Human
gcaaggcugugcacuuugcauu

SEQ ID NO: 934234 - RNA, 22 nt, Human
gagacagaguuucacucuuguu

SEQ ID NO: 934235 - RNA, 22 nt, Human
agcagcuucuuucacuccugga

SEQ ID NO: 934236 - RNA, 22 nt, Human
gggcagcagagcccugccgagu

SEQ ID NO: 934237 - RNA, 22 nt, Human
uccagggcuggguuggcucagc

SEQ ID NO: 934238 - RNA, 22 nt, Human
acuuuguugaugaaauaguuuu

SEQ ID NO: 934239 - RNA, 22 nt, Human
cugagccacugcuuguucagug

SEQ ID NO: 934240 - RNA, 22 nt, Human
caauaagccagguguuuguguu

SEQ ID NO: 934241 - RNA, 22 nt, Human
uaagaacaagcuggggguucca

SEQ ID NO: 934242 - RNA, 22 nt, Human
gggugggguucaggaaucuuca

SEQ ID NO: 934243 - RNA, 22 nt, Human
gcuccuucaggugguagcuguu

SEQ ID NO: 934244 - RNA, 22 nt, Human
uucauucaucucuaaaaugccu

SEQ ID NO: 934245 - RNA, 22 nt, Human
ccugggcauucuuugaguucuc

SEQ ID NO: 934246 - RNA, 22 nt, Human
gauuuguagcuuuucagucugu

SEQ ID NO: 934247 - RNA, 22 nt, Human
ugcucugaugggguggacauag

SEQ ID NO: 934248 - RNA, 20 nt, Human
ucucugcuguccacauuugc

SEQ ID NO: 934249 - RNA, 22 nt, Human
uggucaaaagaaagcucagaac

SEQ ID NO: 934250 - RNA, 22 nt, Human
acacagggucuagaguuaggcc

SEQ ID NO: 934251 - RNA, 22 nt, Human
ucagcugaguucuagagcacuc

SEQ ID NO: 934252 - RNA, 22 nt, Human
ugaacaaacugcauucuucacu

SEQ ID NO: 934253 - RNA, 22 nt, Human
uuucaaaguugggaauuguaau

SEQ ID NO: 934254 - RNA, 22 nt, Human
agaagccauucccuguaggcuc

SEQ ID NO: 934255 - RNA, 22 nt, Human
cugucucugucuuaacucccag

SEQ ID NO: 934256 - RNA, 20 nt, Human
gggcaguggcgcuaucucag

SEQ ID NO: 934257 - RNA, 22 nt, Human
acugaaggaaagccuuugcaug

SEQ ID NO: 934258 - RNA, 22 nt, Human
gcugucuccauagcuguguguc

SEQ ID NO: 934259 - RNA, 22 nt, Human
ugaggcagaaauuccuguuuuc

SEQ ID NO: 934260 - RNA, 22 nt, Human
ggaugcaggaguugaagaagga

SEQ ID NO: 934261 - RNA, 22 nt, Human
cagcagggggcagcgcagauca

SEQ ID NO: 934262 - RNA, 22 nt, Human
aaugcauauguaggcaagcagu

SEQ ID NO: 934263 - RNA, 22 nt, Human
gcugccagucuaaugggaaaca

SEQ ID NO: 934264 - RNA, 22 nt, Human
gccagcucccaagugagccccu

SEQ ID NO: 934265 - RNA, 21 nt, Human
gccacugcacuccagccuggg

SEQ ID NO: 934266 - RNA, 22 nt, Human
ugagaaaagguugagaugauaa

SEQ ID NO: 934267 - RNA, 22 nt, Human
ucuggcucauaggaaggccauu

SEQ ID NO: 934268 - RNA, 22 nt, Human
agcugcccuucucuugcccuug

SEQ ID NO: 934269 - RNA, 22 nt, Human
uaucaauacauguuaucagugu

SEQ ID NO: 934270 - RNA, 17 nt, Human
ccagagcuacugagacu

SEQ ID NO: 934271 - RNA, 22 nt, Human
uccagucauuuccauuguuccc

SEQ ID NO: 934272 - RNA, 22 nt, Human
agcuggcuccagaaggagucgu

SEQ ID NO: 934273 - RNA, 23 nt, Human
acuuuagauaaauuaugugcaca

SEQ ID NO: 934274 - RNA, 22 nt, Human
uuucaaagacagccauauuugu

SEQ ID NO: 934275 - RNA, 22 nt, Human
gccuggcaggggccugggagug

SEQ ID NO: 934276 - RNA, 17 nt, Human
ccaggugggaggugggg

SEQ ID NO: 934277 - RNA, 21 nt, Human
gcauggcaggucacuggggca

SEQ ID NO: 934278 - RNA, 22 nt, Human
auucuccacacauccagaccuu

SEQ ID NO: 934279 - RNA, 22 nt, Human
agcagugggggaguguuaguuu

SEQ ID NO: 934280 - RNA, 22 nt, Human
auacagaauacuaauuccugag

SEQ ID NO: 934281 - RNA, 22 nt, Human
uuucaagcauaacugggaagag

SEQ ID NO: 934282 - RNA, 22 nt, Human
ugcagaaggccugacauugcac

SEQ ID NO: 934283 - RNA, 22 nt, Human
aaauauaauuucugccucaaua

SEQ ID NO: 934284 - RNA, 22 nt, Human
caggucagagucccccuguccu

SEQ ID NO: 934285 - RNA, 19 nt, Human
cuuauuagagugagagcuu

SEQ ID NO: 934286 - RNA, 22 nt, Human
ugcaauaaagugcuauaaaucc

SEQ ID NO: 934287 - RNA, 22 nt, Human
auugaaagcacaaagaacaagu

SEQ ID NO: 934288 - RNA, 22 nt, Human
uuuggaaugguaccuucaguug

SEQ ID NO: 934289 - RNA, 22 nt, Human
cagagcuggguuugggaaaccu

SEQ ID NO: 934290 - RNA, 17 nt, Human
gcccaggaaggacggcc

SEQ ID NO: 934291 - RNA, 22 nt, Human
uacucugccacuaggaguucug

SEQ ID NO: 934292 - RNA, 22 nt, Human
gcagggcugggugggagacaga

SEQ ID NO: 934293 - RNA, 22 nt, Human
ugccucuguggaaauggugguc

SEQ ID NO: 934294 - RNA, 22 nt, Human
ccugggucacucaggcaggcgg

SEQ ID NO: 934295 - RNA, 22 nt, Human
ggaggccagggacccagucagc

SEQ ID NO: 934296 - RNA, 22 nt, Human
gggaaaggaucagugggaggcu

SEQ ID NO: 934297 - RNA, 22 nt, Human
aaauugugagcuauagaucuag

SEQ ID NO: 934298 - RNA, 23 nt, Human
auaaggcauaaagguacauugga

SEQ ID NO: 934299 - RNA, 22 nt, Human
aaaugaccagaauacaggcuuc

SEQ ID NO: 934300 - RNA, 22 nt, Human
aaugucugccugaacuuuauau

SEQ ID NO: 934301 - RNA, 22 nt, Human
uuuuaagaugcuaguauuucag

SEQ ID NO: 934302 - RNA, 20 nt, Human
cccagguaggugccaugagu

SEQ ID NO: 934303 - RNA, 22 nt, Human
gagauuggauuuaauggccaaa

SEQ ID NO: 934304 - RNA, 22 nt, Human
uuauccaaacuggugaaucauu

SEQ ID NO: 934305 - RNA, 22 nt, Human
ugcaugcagcuggugauaagaa

SEQ ID NO: 934306 - RNA, 22 nt, Human
cccuggaggcuggaggcaguag

SEQ ID NO: 934307 - RNA, 22 nt, Human
ugucccaguucccaggguugcu

SEQ ID NO: 934308 - RNA, 22 nt, Human
uaaguucaaugaacucaguucu

SEQ ID NO: 934309 - RNA, 22 nt, Human
ucuggcuccugaguccaugcuc

SEQ ID NO: 934310 - RNA, 22 nt, Human
accaggaggaaguguuaaugau

SEQ ID NO: 934311 - RNA, 22 nt, Human
gggaucagaaacauagcccuga

SEQ ID NO: 934312 - RNA, 22 nt, Human
aggagaggguggcauuaaguuu

SEQ ID NO: 934313 - RNA, 22 nt, Human
agucucuuauucccuauugcug

SEQ ID NO: 934314 - RNA, 22 nt, Human
ggccaaaucuguaaggcaagau

SEQ ID NO: 934315 - RNA, 22 nt, Human
ucaggagaaaauaucaggaagu

SEQ ID NO: 934316 - RNA, 22 nt, Human
cccuugcacauuugucuuuaau

SEQ ID NO: 934317 - RNA, 22 nt, Human
aggcagcagccacaaggccuga

SEQ ID NO: 934318 - RNA, 22 nt, Human
uggucaaauuuagucucuggaa

SEQ ID NO: 934319 - RNA, 22 nt, Human
uugacagcaaagauugugccua

SEQ ID NO: 934320 - RNA, 22 nt, Human
cagcaauaacucaaagccauuu

SEQ ID NO: 934321 - RNA, 22 nt, Human
agagugaucagauaucaggugu

SEQ ID NO: 934322 - RNA, 22 nt, Human
auguuuccgugagcauccuuga

SEQ ID NO: 934323 - RNA, 22 nt, Human
cauuugaugacucaacucauaa

SEQ ID NO: 934324 - RNA, 22 nt, Human
uuucaaauggagucgugaaaug

SEQ ID NO: 934325 - RNA, 22 nt, Human
uagucaaaccucagaauacccc

SEQ ID NO: 934326 - RNA, 22 nt, Human
ucacauucucagcaucuauaca

SEQ ID NO: 934327 - RNA, 22 nt, Human
agggccuggaacugugggcagg

SEQ ID NO: 934328 - RNA, 22 nt, Human
gcagggucuugagaggcagcca

SEQ ID NO: 934329 - RNA, 21 nt, Human
cucacaggaugcaguguuacu

SEQ ID NO: 934330 - RNA, 22 nt, Human
ggaaccaguggaaugauaugcu

SEQ ID NO: 934331 - RNA, 22 nt, Human
uagggcagaguccaggaugggc

SEQ ID NO: 934332 - RNA, 22 nt, Human
aggcugcugccuuggagagugu

SEQ ID NO: 934333 - RNA, 22 nt, Human
gccagagccacuuuugggugau

SEQ ID NO: 934334 - RNA, 21 nt, Human
gccugccugcgugacccucuu

SEQ ID NO: 934335 - RNA, 22 nt, Human
uccaugagagguaacuuuacaa

SEQ ID NO: 934336 - RNA, 22 nt, Human
guggugcauccuugaguaagcu

SEQ ID NO: 934337 - RNA, 22 nt, Human
ucagaaauguaagcugaugacu

SEQ ID NO: 934338 - RNA, 22 nt, Human
caaggaaacaugaaaugcauug

SEQ ID NO: 934339 - RNA, 22 nt, Human
cgcugccaggauccccugccgg

SEQ ID NO: 934340 - RNA, 22 nt, Human
ggacaagccugugaguggguuu

SEQ ID NO: 934341 - RNA, 22 nt, Human
guaauuuuuaguucauucuauc

SEQ ID NO: 934342 - RNA, 22 nt, Human
gaagccccaaacccucgccauc

SEQ ID NO: 934343 - RNA, 22 nt, Human
gaaugugugacucuauugagca

SEQ ID NO: 934344 - RNA, 20 nt, Human
ccuggagccuggaaggaguc

SEQ ID NO: 934345 - RNA, 17 nt, Human
aggcagcucagaacauc

SEQ ID NO: 934346 - RNA, 22 nt, Human
uugagcacaacucuuggagagc

SEQ ID NO: 934347 - RNA, 22 nt, Human
aacagaacccgagugugaaucu

SEQ ID NO: 934348 - RNA, 22 nt, Human
aagauguguccauucuuugcuc

SEQ ID NO: 934349 - RNA, 22 nt, Human
cagaggccauauuucuucacuc

SEQ ID NO: 934350 - RNA, 22 nt, Human
uauuuaauaaaacuauggcaug

SEQ ID NO: 934351 - RNA, 22 nt, Human
gggcaggaugcaguuucagaga

SEQ ID NO: 934352 - RNA, 22 nt, Human
ugcagaaguauuccaggcccca

SEQ ID NO: 934353 - RNA, 22 nt, Human
uuucuaaaauagauuuuauggu

SEQ ID NO: 934354 - RNA, 22 nt, Human
ccugaccuccaaguggcucugg

SEQ ID NO: 934355 - RNA, 22 nt, Human
ggcugcugugaccucaggugau

SEQ ID NO: 934356 - RNA, 22 nt, Human
guggguggaucaccugagguca

SEQ ID NO: 934357 - RNA, 22 nt, Human
gugauuucaaauauagagugag

SEQ ID NO: 934358 - RNA, 22 nt, Human
guuauguaucuugauugggugg

SEQ ID NO: 934359 - RNA, 22 nt, Human
uggcuucagacuucugcuacgu

SEQ ID NO: 934360 - RNA, 22 nt, Human
uggcagggugggcuucagcccc

SEQ ID NO: 934361 - RNA, 22 nt, Human
uacaguuuguuacauuguuagu

SEQ ID NO: 934362 - RNA, 22 nt, Human
uuagaaaacauaagugguaaag

SEQ ID NO: 934363 - RNA, 22 nt, Human
cagcuuugucugauuccucuuu

SEQ ID NO: 934364 - RNA, 22 nt, Human
ugaaggaagaauaggcaguguu

SEQ ID NO: 934365 - RNA, 23 nt, Human
uggcccugaaucuguccuggagg

SEQ ID NO: 934366 - RNA, 22 nt, Human
ggucccaguccucucccugcua

SEQ ID NO: 934367 - RNA, 22 nt, Human
ccugggcaggaugggcccggug

SEQ ID NO: 934368 - RNA, 22 nt, Human
ccuuucucuggcagcaggacag

SEQ ID NO: 934369 - RNA, 22 nt, Human
auaugaagucagacaaacuggg

SEQ ID NO: 934370 - RNA, 19 nt, Human
cccagagcauccugaacuu

SEQ ID NO: 934371 - RNA, 20 nt, Human
uuaggcauuuggauuggcuu

SEQ ID NO: 934372 - RNA, 22 nt, Human
caggccucaggggcucaggcug

SEQ ID NO: 934373 - RNA, 22 nt, Human
aaugauguauguauaaggcagg

SEQ ID NO: 934374 - RNA, 22 nt, Human
aagcaucucuauguggagagug

SEQ ID NO: 934375 - RNA, 22 nt, Human
ccuuuuaugaacuugagcaggu

SEQ ID NO: 934376 - RNA, 22 nt, Human
uggcucuguuuguuaacuagac

SEQ ID NO: 934377 - RNA, 20 nt, Human
cuguccccgaggucaccagg

SEQ ID NO: 934378 - RNA, 22 nt, Human
ucccaggaaggauucggcauuu

SEQ ID NO: 934379 - RNA, 17 nt, Human
ccucccacaccgcccug

SEQ ID NO: 934380 - RNA, 22 nt, Human
cacagggcagguacucucagag

SEQ ID NO: 934381 - RNA, 22 nt, Human
aaaguguaaaagcauguuaggg

SEQ ID NO: 934382 - RNA, 22 nt, Human
auccagggauaaaaguaagguu

SEQ ID NO: 934383 - RNA, 22 nt, Human
acaggggauugauuggaagucu

SEQ ID NO: 934384 - RNA, 20 nt, Human
gucaggauuaguaaacucug

SEQ ID NO: 934385 - RNA, 22 nt, Human
cugcuguggguuaagacacugu

SEQ ID NO: 934386 - RNA, 22 nt, Human
agggucuguggaugcaucuggg

SEQ ID NO: 934387 - RNA, 22 nt, Human
auuuccuaggguagaugucaca

SEQ ID NO: 934388 - RNA, 22 nt, Human
cuuagaaaucgaacucagguua

SEQ ID NO: 934389 - RNA, 22 nt, Human
cagcucugugggagcguaugug

SEQ ID NO: 934390 - RNA, 22 nt, Human
uccugugccuccaccugcuccg

SEQ ID NO: 934391 - RNA, 22 nt, Human
ccugccugcaaaaugggacaag

SEQ ID NO: 934392 - RNA, 22 nt, Human
gucaccagucccagcuccugaa

SEQ ID NO: 934393 - RNA, 22 nt, Human
agagccugcuguguaagucaca

SEQ ID NO: 934394 - RNA, 22 nt, Human
gaggcaugucuggccuguccca

SEQ ID NO: 934395 - RNA, 22 nt, Human
ggaagagggaaccacgacugua

SEQ ID NO: 934396 - RNA, 22 nt, Human
aagauaugaggucaccugcugg

SEQ ID NO: 934397 - RNA, 22 nt, Human
guuuauuauucaacuucauguu

SEQ ID NO: 934398 - RNA, 22 nt, Human
uggcccucagucuugcuccugc

SEQ ID NO: 934399 - RNA, 22 nt, Human
gcuggcagcuggaaguugggcu

SEQ ID NO: 934400 - RNA, 22 nt, Human
gcuuccucgcugggcagaggca

SEQ ID NO: 934401 - RNA, 22 nt, Human
ucuucauuuuauagcaucugug

SEQ ID NO: 934402 - RNA, 22 nt, Human
gccccagguugccugucccagg

SEQ ID NO: 934403 - RNA, 22 nt, Human
aaggacagaaacagauugcugg

SEQ ID NO: 934404 - RNA, 22 nt, Human
uauuuucuguggaggaccagau

SEQ ID NO: 934405 - RNA, 22 nt, Human
aagcagaguccccuucccaugg

SEQ ID NO: 934406 - RNA, 22 nt, Human
ugggcugcccaagguggccaug

SEQ ID NO: 934407 - RNA, 23 nt, Human
acacaaggguaacugccagccau

SEQ ID NO: 934408 - RNA, 22 nt, Human
ccugggagcuguggaaaggcug

SEQ ID NO: 934409 - RNA, 22 nt, Human
gcaggaugaaggcagaggcuga

SEQ ID NO: 934410 - RNA, 20 nt, Human
cucaggauacugcaaaguug

SEQ ID NO: 934411 - RNA, 22 nt, Human
gggugaggagcugccagucaug

SEQ ID NO: 934412 - RNA, 22 nt, Human
aaacagucaugguugcuguuca

SEQ ID NO: 934413 - RNA, 22 nt, Human
uuucacaaguuucaggauucug

SEQ ID NO: 934414 - RNA, 20 nt, Human
caccaggcgcucugagaaca

SEQ ID NO: 934415 - RNA, 22 nt, Human
cucuucuuauggccguggcuga

SEQ ID NO: 934416 - RNA, 22 nt, Human
gcccauggcagaacugugagca

SEQ ID NO: 934417 - RNA, 22 nt, Human
ggagagagaugccgccuugcuc

SEQ ID NO: 934418 - RNA, 22 nt, Human
acaaacagcuaacauauguuaa

SEQ ID NO: 934419 - RNA, 22 nt, Human
ugccuggauucgguuguuguca

SEQ ID NO: 934420 - RNA, 22 nt, Human
gcucccagcaauugaggcagcc

SEQ ID NO: 934421 - RNA, 22 nt, Human
uauuucugauugcucaugaggc

SEQ ID NO: 934422 - RNA, 22 nt, Human
gugaccaucagagaauaacaaa

SEQ ID NO: 934423 - RNA, 18 nt, Human
aggcaggcuggagugacu

SEQ ID NO: 934424 - RNA, 22 nt, Human
uggcagcagcuaacuuaggcag

SEQ ID NO: 934425 - RNA, 22 nt, Human
ucgugcuccuggugaggcucug

SEQ ID NO: 934426 - RNA, 22 nt, Human
guaagcaucugucucuucugca

SEQ ID NO: 934427 - RNA, 22 nt, Human
ucagagaugcagugccaccuac

SEQ ID NO: 934428 - RNA, 22 nt, Human
ugagcccaggaguuggagaccg

SEQ ID NO: 934429 - RNA, 22 nt, Human
ggccugagcagacagcaugaug

SEQ ID NO: 934430 - RNA, 22 nt, Human
ucaggaugagcucauaacuaug

SEQ ID NO: 934431 - RNA, 22 nt, Human
uuugcaaagugacuauuauaug

SEQ ID NO: 934432 - RNA, 22 nt, Human
gagagcugucagcguagcaccg

SEQ ID NO: 934433 - RNA, 22 nt, Human
cagcccugcacgcugccuccgc

SEQ ID NO: 934434 - RNA, 22 nt, Human
gacacagagauaggccuguguu

SEQ ID NO: 934435 - RNA, 22 nt, Human
cagcagaggaaagcaaaucuaa

SEQ ID NO: 934436 - RNA, 22 nt, Human
uuuaaucaggcaaagcauaaua

SEQ ID NO: 934437 - RNA, 20 nt, Human
uaagaacaagacuaggaagc

SEQ ID NO: 934438 - RNA, 22 nt, Human
agcaugcacaugacuggcuuaa

SEQ ID NO: 934439 - RNA, 22 nt, Human
uccaggaggacugagggggcug

SEQ ID NO: 934440 - RNA, 22 nt, Human
cccugccucugaagcugcucag

SEQ ID NO: 934441 - RNA, 22 nt, Human
aauguauuccucaugcaagagu

SEQ ID NO: 934442 - RNA, 22 nt, Human
aagcagaaaaacugagcuccaa

SEQ ID NO: 934443 - RNA, 22 nt, Human
uccuucagggcugaccacaggc

SEQ ID NO: 934444 - RNA, 22 nt, Human
cugcugugcauauuuaucuagg

SEQ ID NO: 934445 - RNA, 22 nt, Human
gauuucuuugcaagcuguguuc

SEQ ID NO: 934446 - RNA, 22 nt, Human
cucaggauucucgacacucaca

SEQ ID NO: 934447 - RNA, 22 nt, Human
gagggugguggcuuaaggugcu

SEQ ID NO: 934448 - RNA, 22 nt, Human
gcaagcugcuuaagcucauugu

SEQ ID NO: 934449 - RNA, 22 nt, Human
augaguaagaccauaauuuuug

SEQ ID NO: 934450 - RNA, 22 nt, Human
cuacccaggcuggagugcagua

SEQ ID NO: 934451 - RNA, 22 nt, Human
cagaggcaggauaagaacugcg

SEQ ID NO: 934452 - RNA, 22 nt, Human
cuggccugugggcugucuccgg

SEQ ID NO: 934453 - RNA, 16 nt, Human
gcccaggacgggaggc

SEQ ID NO: 934454 - RNA, 22 nt, Human
ugcucucucaggccuggcccac

SEQ ID NO: 934455 - RNA, 22 nt, Human
gccccagcucugccacaacuag

SEQ ID NO: 934456 - RNA, 23 nt, Human
uggcucugagcuuccugguggcc

SEQ ID NO: 934457 - RNA, 22 nt, Human
aucauucugauggucaaugcua

SEQ ID NO: 934458 - RNA, 22 nt, Human
ucccagagacagagccuccucc

SEQ ID NO: 934459 - RNA, 22 nt, Human
uacuuuguggagauuaaaaaua

SEQ ID NO: 934460 - RNA, 22 nt, Human
acuggccagguucaaaauacag

SEQ ID NO: 934461 - RNA, 23 nt, Human
aagcugccagucugaagccuggg

SEQ ID NO: 934462 - RNA, 22 nt, Human
caaggagaaaacggcuucugaa

SEQ ID NO: 934463 - RNA, 22 nt, Human
guaacaaaguuucuaggugcug

SEQ ID NO: 934464 - RNA, 19 nt, Human
ucuguucacauuguuucgc

SEQ ID NO: 934465 - RNA, 22 nt, Human
agggccuggugaccuggguccu

SEQ ID NO: 934466 - RNA, 22 nt, Human
caaaagcaguucuaucugaguu

SEQ ID NO: 934467 - RNA, 20 nt, Human
aguaccuuuuguauguuacc

SEQ ID NO: 934468 - RNA, 22 nt, Human
ucauuucuauugcuacugucug

SEQ ID NO: 934469 - RNA, 22 nt, Human
aacaaguaaguuuauauauauu

SEQ ID NO: 934470 - RNA, 22 nt, Human
aauguggaaucauggacuuuau

SEQ ID NO: 934471 - RNA, 22 nt, Human
cuuuauauccagauguuuggug

SEQ ID NO: 934472 - RNA, 22 nt, Human
gggacaggcugagacuugagcu

SEQ ID NO: 934473 - RNA, 22 nt, Human
cuccugggcucauaucauucag

SEQ ID NO: 934474 - RNA, 22 nt, Human
auaaggcauauagucacuuuuu

SEQ ID NO: 934475 - RNA, 22 nt, Human
gccugccugcugugugcaaguu

SEQ ID NO: 934476 - RNA, 22 nt, Human
agccaaggagugcagguggcuu

SEQ ID NO: 934477 - RNA, 22 nt, Human
uccuucaaagcuccuagugagc

SEQ ID NO: 934478 - RNA, 22 nt, Human
aaguucaagcucugccuaaaau

SEQ ID NO: 934479 - RNA, 19 nt, Human
gcugggagcagacccuccc

SEQ ID NO: 934480 - RNA, 22 nt, Human
ccugcucugguuuagucagucu

SEQ ID NO: 934481 - RNA, 22 nt, Human
ugcauuuguuaccuuauugcag

SEQ ID NO: 934482 - RNA, 22 nt, Human
gcucuggaagcaucugagagga

SEQ ID NO: 934483 - RNA, 22 nt, Human
aaugcacagcguuccaugcuug

SEQ ID NO: 934484 - RNA, 19 nt, Human
aguagcagaaagugcagug

SEQ ID NO: 934485 - RNA, 19 nt, Human
gcucagcagacccagugcu

SEQ ID NO: 934486 - RNA, 22 nt, Human
caaggagauaaaauguugagcu

SEQ ID NO: 934487 - RNA, 22 nt, Human
gagcucaggagcaucagaagaa

SEQ ID NO: 934488 - RNA, 22 nt, Human
ucuuuccuguaacugcuguuca

SEQ ID NO: 934489 - RNA, 22 nt, Human
uagacagauuuaaaggaaugga

SEQ ID NO: 934490 - RNA, 22 nt, Human
gauuuucaugauaaacuuguga

SEQ ID NO: 934491 - RNA, 22 nt, Human
uaaaugcuaucgcauaaaaccu

SEQ ID NO: 934492 - RNA, 22 nt, Human
ucagggaaauuuccauguguuu

SEQ ID NO: 934493 - RNA, 22 nt, Human
gaggcacuggaggaaaggagaa

SEQ ID NO: 934494 - RNA, 22 nt, Human
cucuggacacuggcaugggguc

SEQ ID NO: 934495 - RNA, 22 nt, Human
ccugggagugcacagguuucgu

SEQ ID NO: 934496 - RNA, 20 nt, Human
caguagcaauaauuagaagc

SEQ ID NO: 934497 - RNA, 22 nt, Human
augucacauggucaccucuagc

SEQ ID NO: 934498 - RNA, 22 nt, Human
gauuucaagcccccagagauuc

SEQ ID NO: 934499 - RNA, 22 nt, Human
ccuggagccccucuggccagcc

SEQ ID NO: 934500 - RNA, 22 nt, Human
cccagccucuguuugcuccucu

SEQ ID NO: 934501 - RNA, 22 nt, Human
cucaggaaaggccaugcaaggg

SEQ ID NO: 934502 - RNA, 22 nt, Human
gagucacaaagccuuucuuauu

SEQ ID NO: 934503 - RNA, 22 nt, Human
ucauccaguaccauggaaggca

SEQ ID NO: 934504 - RNA, 22 nt, Human
ugucucugccagcuagcagaau

SEQ ID NO: 934505 - RNA, 22 nt, Human
agaggcaggaagagcugauuuu

SEQ ID NO: 934506 - RNA, 22 nt, Human
caugcuuucuguccaaauguua

SEQ ID NO: 934507 - RNA, 22 nt, Human
ccuggcaggccccuccuggauu

SEQ ID NO: 934508 - RNA, 22 nt, Human
gccuggaguuguggugaagcca

SEQ ID NO: 934509 - RNA, 22 nt, Human
gagugguaggcaguguuaggaa

SEQ ID NO: 934510 - RNA, 20 nt, Human
aggcagcuggccaggcaggu

SEQ ID NO: 934511 - RNA, 22 nt, Human
uuccaggggcagcagugauggu

SEQ ID NO: 934512 - RNA, 22 nt, Human
cagaaauguacugacaugcagu

SEQ ID NO: 934513 - RNA, 22 nt, Human
ugcuugggaauguggagucaga

SEQ ID NO: 934514 - RNA, 22 nt, Human
cagaaauguucuaaugauucag

SEQ ID NO: 934515 - RNA, 22 nt, Human
uugcuuuguggugguucuucca

SEQ ID NO: 934516 - RNA, 22 nt, Human
gccuggaggggccaggguggua

SEQ ID NO: 934517 - RNA, 22 nt, Human
gugauacaaauaaacauaugcu

SEQ ID NO: 934518 - RNA, 22 nt, Human
uggcccugaggacccagugugg

SEQ ID NO: 934519 - RNA, 22 nt, Human
guuugucuuaauuaggcaucga

SEQ ID NO: 934520 - RNA, 22 nt, Human
cccuggcaaaacacucucuuga

SEQ ID NO: 934521 - RNA, 22 nt, Human
cucagaauuacaucccauuuua

SEQ ID NO: 934522 - RNA, 22 nt, Human
aauacaaucaaauucacuagca

SEQ ID NO: 934523 - RNA, 22 nt, Human
ccagccaguccagcauuggugu

SEQ ID NO: 934524 - RNA, 22 nt, Human
cagugggugaugaguccugggg

SEQ ID NO: 934525 - RNA, 22 nt, Human
gaggccagcgcgcagcacuuuu

SEQ ID NO: 934526 - RNA, 22 nt, Human
ugcuucucccaaccagggccug

SEQ ID NO: 934527 - RNA, 22 nt, Human
gcagcugggccccagccucucc

SEQ ID NO: 934528 - RNA, 22 nt, Human
aucuuguuauaagagauaaugg

SEQ ID NO: 934529 - RNA, 22 nt, Human
cucuucuugucucugguuagaa

SEQ ID NO: 934530 - RNA, 22 nt, Human
cccaggucugugccagcucuga

SEQ ID NO: 934531 - RNA, 22 nt, Human
uguaaauaaugcauguaaauca

SEQ ID NO: 934532 - RNA, 22 nt, Human
ggcucuggagacauguggagag

SEQ ID NO: 934533 - RNA, 22 nt, Human
ucucuucuaacacuagaaauuc

SEQ ID NO: 934534 - RNA, 22 nt, Human
ccucuggcuguaccacuggcac

SEQ ID NO: 934535 - RNA, 22 nt, Human
aaaggucaagcuggacucaggu

SEQ ID NO: 934536 - RNA, 22 nt, Human
ggugaggggagagugaaagaaa

SEQ ID NO: 934537 - RNA, 22 nt, Human
uccaaagggaagcgcuuucugu

SEQ ID NO: 934538 - RNA, 22 nt, Human
gcuguucagggcacucaugggc

SEQ ID NO: 934539 - RNA, 20 nt, Human
ccucaguguccuggacuggg

SEQ ID NO: 934540 - RNA, 22 nt, Human
ggggcagagcauagcuccaauu

SEQ ID NO: 934541 - RNA, 22 nt, Human
ucauugcaagcucauuuaucug

SEQ ID NO: 934542 - RNA, 21 nt, Human
gugguucuagagaaacagaau

SEQ ID NO: 934543 - RNA, 22 nt, Human
gaugccuccaaaugagggcaga

SEQ ID NO: 934544 - RNA, 22 nt, Human
uaagaacaguagaacaguaggu

SEQ ID NO: 934545 - RNA, 22 nt, Human
auuuggcaaauaauuugagggu

SEQ ID NO: 934546 - RNA, 22 nt, Human
cagccaucaguaaagacagcuu

SEQ ID NO: 934547 - RNA, 22 nt, Human
ccaggccugauugggaaucuug

SEQ ID NO: 934548 - RNA, 22 nt, Human
gagcgauguggguauguagaag

SEQ ID NO: 934549 - RNA, 21 nt, Human
cagggcacacagaggauggua

SEQ ID NO: 934550 - RNA, 22 nt, Human
uugagucaguaauuccauuucu

SEQ ID NO: 934551 - RNA, 22 nt, Human
gcugagucuugagcacugagca

SEQ ID NO: 934552 - RNA, 22 nt, Human
gcggagggcgagcccgcggagc

SEQ ID NO: 934553 - RNA, 22 nt, Human
auuuauuaugggauuuggcaca

SEQ ID NO: 934554 - RNA, 22 nt, Human
aaaaaucuaugacugcuucucc

SEQ ID NO: 934555 - RNA, 22 nt, Human
uuauuccauuauuucacuuagg

SEQ ID NO: 934556 - RNA, 22 nt, Human
uuuuuccuaagcaguggagcug

SEQ ID NO: 934557 - RNA, 22 nt, Human
agggaagaaaauccaucgcugc

SEQ ID NO: 934558 - RNA, 22 nt, Human
ucuuugcaggccaaauuguuaa

SEQ ID NO: 934559 - RNA, 22 nt, Human
uugcaccauuucacuuccauua

SEQ ID NO: 934560 - RNA, 22 nt, Human
auugaaagauaggcuacugugg

SEQ ID NO: 934561 - RNA, 22 nt, Human
agccagcuggagaccacuguuu

SEQ ID NO: 934562 - RNA, 22 nt, Human
aggcacugugcuucuuauaugu

SEQ ID NO: 934563 - RNA, 22 nt, Human
ucagcugcucaaauuuauguca

SEQ ID NO: 934564 - RNA, 22 nt, Human
agacaucagcuugugugcaggg

SEQ ID NO: 934565 - RNA, 22 nt, Human
ucuuggcaauuugaucucaguu

SEQ ID NO: 934566 - RNA, 22 nt, Human
ccagggccucguguucugagug

SEQ ID NO: 934567 - RNA, 23 nt, Human
aaacuugcuauggcugaaaucau

SEQ ID NO: 934568 - RNA, 22 nt, Human
agcuucuugggcuuuacacaaa

SEQ ID NO: 934569 - RNA, 22 nt, Human
agaggggaaggaugugauguga

SEQ ID NO: 934570 - RNA, 22 nt, Human
uggcacugggacagaugcucuc

SEQ ID NO: 934571 - RNA, 22 nt, Human
ucccaggcuaggccucugcguu

SEQ ID NO: 934572 - RNA, 22 nt, Human
ugcagggcuaagucagagccug

SEQ ID NO: 934573 - RNA, 22 nt, Human
ggccucugaggacagccuuggc

SEQ ID NO: 934574 - RNA, 22 nt, Human
gcuggccugaccagccacaggc

SEQ ID NO: 934575 - RNA, 22 nt, Human
gagggaggcaucaugaauccag

SEQ ID NO: 934576 - RNA, 23 nt, Human
ccagcuccgugagccucgggcuc

SEQ ID NO: 934577 - RNA, 22 nt, Human
cuggcaggcggcagagcccagg

SEQ ID NO: 934578 - RNA, 19 nt, Human
agcagagcccugaagaucc

SEQ ID NO: 934579 - RNA, 22 nt, Human
gcuucccacagcuggacugggg

SEQ ID NO: 934580 - RNA, 22 nt, Human
ucagagcuuuggagaccaggaa

SEQ ID NO: 934581 - RNA, 22 nt, Human
aacaucuuguccuuagauuaaa

SEQ ID NO: 934582 - RNA, 22 nt, Human
gugucccacucuggaggugaag

SEQ ID NO: 934583 - RNA, 22 nt, Human
auguaaggcugccuaugacacu

SEQ ID NO: 934584 - RNA, 22 nt, Human
uuguaacagcugcuuaauagag

SEQ ID NO: 934585 - RNA, 22 nt, Human
gggaguggguuuggccuaggcc

SEQ ID NO: 934586 - RNA, 22 nt, Human
aaagauguuuuauaaguuaugg

SEQ ID NO: 934587 - RNA, 22 nt, Human
ugaagcaguuacuggguguuaa

SEQ ID NO: 934588 - RNA, 22 nt, Human
cuggaugcuuccucucugcuag

SEQ ID NO: 934589 - RNA, 22 nt, Human
uuuaucuuuaggacuuugcaga

SEQ ID NO: 934590 - RNA, 22 nt, Human
cagaaugagauaacccagauug

SEQ ID NO: 934591 - RNA, 22 nt, Human
agcugguaugaacaggauagga

SEQ ID NO: 934592 - RNA, 22 nt, Human
uccuggagggaggcggugcuac

SEQ ID NO: 934593 - RNA, 20 nt, Human
ucauuucuugggguuccaag

SEQ ID NO: 934594 - RNA, 22 nt, Human
gcaggggcaggagaucucaggc

SEQ ID NO: 934595 - RNA, 22 nt, Human
cucaggcacgggucagugagcg

SEQ ID NO: 934596 - RNA, 22 nt, Human
uggcuucugcuuucaguggagg

SEQ ID NO: 934597 - RNA, 22 nt, Human
augcuguggccagaguucaacu

SEQ ID NO: 934598 - RNA, 22 nt, Human
caaauguaaauucuuuugaagc

SEQ ID NO: 934599 - RNA, 19 nt, Human
acaggcagaauugggugug

SEQ ID NO: 934600 - RNA, 22 nt, Human
aggcugggaagguaaaguugua

SEQ ID NO: 934601 - RNA, 22 nt, Human
gggccaugagagguucaucaac

SEQ ID NO: 934602 - RNA, 19 nt, Human
uguuuuguuaaagcagucc

SEQ ID NO: 934603 - RNA, 22 nt, Human
ugccagcccaccuuggggccuc

SEQ ID NO: 934604 - RNA, 22 nt, Human
ucagcuuggacagcuugguuga

SEQ ID NO: 934605 - RNA, 22 nt, Human
guguggcugugggagauguuca

SEQ ID NO: 934606 - RNA, 22 nt, Human
auacaucuaugccuuucugaca

SEQ ID NO: 934607 - RNA, 22 nt, Human
aagagagggguugcauggaaau

SEQ ID NO: 934608 - RNA, 23 nt, Human
cuccucguaacucuguggugggu

SEQ ID NO: 934609 - RNA, 23 nt, Human
uuuauauuccuaaugucuugagc

SEQ ID NO: 934610 - RNA, 22 nt, Human
uggagacugugcuaagggaguu

SEQ ID NO: 934611 - RNA, 22 nt, Human
acuccagggcugaacgaggccc

SEQ ID NO: 934612 - RNA, 22 nt, Human
ccuggcugggccugauuucuca

SEQ ID NO: 934613 - RNA, 22 nt, Human
auauguguacgugcaguauaua

SEQ ID NO: 934614 - RNA, 22 nt, Human
ugggccuggcccuguggaggag

SEQ ID NO: 934615 - RNA, 22 nt, Human
ggaggccacgguuuagcaccga

SEQ ID NO: 934616 - RNA, 22 nt, Human
caggggaagaugccaagggaga

SEQ ID NO: 934617 - RNA, 22 nt, Human
gcuggccaaaguguaccuggag

SEQ ID NO: 934618 - RNA, 22 nt, Human
uaggagcuaaaauauuuuauau

SEQ ID NO: 934619 - RNA, 20 nt, Human
gaugggaaucggagcuggua

SEQ ID NO: 934620 - RNA, 22 nt, Human
cagcgucucguugugggccucg

SEQ ID NO: 934621 - RNA, 22 nt, Human
uucucagauccaucagaagucc

SEQ ID NO: 934622 - RNA, 22 nt, Human
cccaagcagggugcagaggcau

SEQ ID NO: 934623 - RNA, 22 nt, Human
uucaauucuaaacuaauauucu

SEQ ID NO: 934624 - RNA, 22 nt, Human
gcuuccuaaaugcacagggcag

SEQ ID NO: 934625 - RNA, 22 nt, Human
ugaaagcucugucaucauuccu

SEQ ID NO: 934626 - RNA, 22 nt, Human
ugugugucagagucuccauggu

SEQ ID NO: 934627 - RNA, 22 nt, Human
uguggccucaaggcugcccuca

SEQ ID NO: 934628 - RNA, 21 nt, Human
ccaggcagagcugugaguucu

SEQ ID NO: 934629 - RNA, 22 nt, Human
ggcuguggggccggguacagug

SEQ ID NO: 934630 - RNA, 22 nt, Human
uguacacugcaggaugcauugc

SEQ ID NO: 934631 - RNA, 21 nt, Human
gacaggacuagaccagagcuc

SEQ ID NO: 934632 - RNA, 22 nt, Human
agcuggccuccgggugccuggg

SEQ ID NO: 934633 - RNA, 22 nt, Human
ucugggagguacugggaggugu

SEQ ID NO: 934634 - RNA, 22 nt, Human
acagccauagaugcuuauguaa

SEQ ID NO: 934635 - RNA, 22 nt, Human
gacauacagcauggucuaugaa

SEQ ID NO: 934636 - RNA, 22 nt, Human
uguagcacagagcuuugacacu

SEQ ID NO: 934637 - RNA, 22 nt, Human
ccugccugucccucaguccaca

SEQ ID NO: 934638 - RNA, 22 nt, Human
aacucugcagugacuuauaaag

SEQ ID NO: 934639 - RNA, 22 nt, Human
ccagggcagcgccccuccacgc

SEQ ID NO: 934640 - RNA, 22 nt, Human
ccagcccuguaaggaugaggca

SEQ ID NO: 934641 - RNA, 22 nt, Human
cuggcacacaaguauuuccuuu

SEQ ID NO: 934642 - RNA, 19 nt, Human
uggccagguacugucugcu

SEQ ID NO: 934643 - RNA, 22 nt, Human
guuagaaagugucugcuugggu

SEQ ID NO: 934644 - RNA, 22 nt, Human
ccuguucaagguauuaauuauc

SEQ ID NO: 934645 - RNA, 22 nt, Human
gccuucaggaaaucaguccuug

SEQ ID NO: 934646 - RNA, 22 nt, Human
ucugccugaaauucacauguaa

SEQ ID NO: 934647 - RNA, 22 nt, Human
uuuagaaauucaucuauggccu

SEQ ID NO: 934648 - RNA, 22 nt, Human
gagcaccucaauuugcuauuug

SEQ ID NO: 934649 - RNA, 19 nt, Human
uacuuuuucaggacagagu

SEQ ID NO: 934650 - RNA, 22 nt, Human
cccagccucugggcucacccaa

SEQ ID NO: 934651 - RNA, 22 nt, Human
ugaaagggguugaguuacagcu

SEQ ID NO: 934652 - RNA, 22 nt, Human
aucuaagaguuaacaucaagaa

SEQ ID NO: 934653 - RNA, 22 nt, Human
ucucugguggcuccaucaguag

SEQ ID NO: 934654 - RNA, 21 nt, Human
gcucagaguauugcacuguuu

SEQ ID NO: 934655 - RNA, 18 nt, Human
ggcugugcguggaggcug

SEQ ID NO: 934656 - RNA, 22 nt, Human
aaaucucaauuugaauuguagc

SEQ ID NO: 934657 - RNA, 22 nt, Human
uuagugauaggaagccagauug

SEQ ID NO: 934658 - RNA, 22 nt, Human
auucuuggagcagucaaagaag

SEQ ID NO: 934659 - RNA, 18 nt, Human
gaggcagcuagcaauuuu

SEQ ID NO: 934660 - RNA, 22 nt, Human
ucccugggcaucacguugcuuc

SEQ ID NO: 934661 - RNA, 22 nt, Human
agaggcagccguauuucaaagg

SEQ ID NO: 934662 - RNA, 22 nt, Human
uagaauguaaauuccaagggca

SEQ ID NO: 934663 - RNA, 22 nt, Human
uagccucuggaauccuuucucu

SEQ ID NO: 934664 - RNA, 19 nt, Human
aggcugugagggaggacuc

SEQ ID NO: 934665 - RNA, 22 nt, Human
ggcugcuguacugaugucaguu

SEQ ID NO: 934666 - RNA, 22 nt, Human
caaggcaggaagccugucuuau

SEQ ID NO: 934667 - RNA, 22 nt, Human
uaaguuuaaauguacaugaagc

SEQ ID NO: 934668 - RNA, 22 nt, Human
ugcauauuguccuugauauuau

SEQ ID NO: 934669 - RNA, 22 nt, Human
caaagaugcugauguuggauca

SEQ ID NO: 934670 - RNA, 22 nt, Human
cagguggggcagcugugggagc

SEQ ID NO: 934671 - RNA, 22 nt, Human
gcuguucacggaggaggauggg

SEQ ID NO: 934672 - RNA, 22 nt, Human
gcugugcuugggaagaaucucu

SEQ ID NO: 934673 - RNA, 22 nt, Human
uguguauagguugugcuaauag

SEQ ID NO: 934674 - RNA, 22 nt, Human
aggcacugggggaugagcaagg

SEQ ID NO: 934675 - RNA, 22 nt, Human
uguacauugucacucaucaagu

SEQ ID NO: 934676 - RNA, 22 nt, Human
augggaggcaggcucagaaccg

SEQ ID NO: 934677 - RNA, 22 nt, Human
agcagugggugacagagcugag

SEQ ID NO: 934678 - RNA, 22 nt, Human
cuggcgcaacagaaaaucugga

SEQ ID NO: 934679 - RNA, 22 nt, Human
ggaggccaggaaggcucggaga

SEQ ID NO: 934680 - RNA, 19 nt, Human
ucauaaggagagaggaaau

SEQ ID NO: 934681 - RNA, 22 nt, Human
caauaugcaagcuauuaaguau

SEQ ID NO: 934682 - RNA, 22 nt, Human
uguagaaagaauauguuucaua

SEQ ID NO: 934683 - RNA, 22 nt, Human
acagcuggaggucugugagcac

SEQ ID NO: 934684 - RNA, 22 nt, Human
aagaacaacugcuuuaaaagca

SEQ ID NO: 934685 - RNA, 21 nt, Human
uucuccccagcgaauccucgg

SEQ ID NO: 934686 - RNA, 22 nt, Human
agcugucuaccugcagaguccu

SEQ ID NO: 934687 - RNA, 22 nt, Human
gucuccugagacugcagucacc

SEQ ID NO: 934688 - RNA, 22 nt, Human
uuagcucagaaaauuuaaacuu

SEQ ID NO: 934689 - RNA, 22 nt, Human
aaggcagccuuuugaguugauu

SEQ ID NO: 934690 - RNA, 22 nt, Human
auguuguagcauaugaaauaua

SEQ ID NO: 934691 - RNA, 22 nt, Human
accugccuaguugguucugccc

SEQ ID NO: 934692 - RNA, 17 nt, Human
agaaagaggauccacag

SEQ ID NO: 934693 - RNA, 22 nt, Human
acuuugcagagccagaagagaa

SEQ ID NO: 934694 - RNA, 22 nt, Human
gaaaggccagcucacagaugag

SEQ ID NO: 934695 - RNA, 22 nt, Human
gaggagcuugugagaagauguc

SEQ ID NO: 934696 - RNA, 22 nt, Human
uucuguuuuagaaauaaguagu

SEQ ID NO: 934697 - RNA, 22 nt, Human
uaaggcacccgugagcugccag

SEQ ID NO: 934698 - RNA, 22 nt, Human
ggauggagaugaccauggugac

SEQ ID NO: 934699 - RNA, 22 nt, Human
ccuggccuccuggccuucucau

SEQ ID NO: 934700 - RNA, 22 nt, Human
ggugaggcagguggcugcugag

SEQ ID NO: 934701 - RNA, 22 nt, Human
cagcugccugcaacacaagcuu

SEQ ID NO: 934702 - RNA, 22 nt, Human
agcagggggaguuagacuagau

SEQ ID NO: 934703 - RNA, 22 nt, Human
gucuucuuguuuugaaggaaau

SEQ ID NO: 934704 - RNA, 22 nt, Human
uuccauaaugagauucccagcc

SEQ ID NO: 934705 - RNA, 22 nt, Human
ccacucugauuuuggcuccacu

SEQ ID NO: 934706 - RNA, 20 nt, Human
uugauucaagggcugaugga

SEQ ID NO: 934707 - RNA, 22 nt, Human
aggcacuggucuaccccuuagu

SEQ ID NO: 934708 - RNA, 22 nt, Human
cuucuggaggacacuggcccca

SEQ ID NO: 934709 - RNA, 17 nt, Human
gauuuccugaaguucuu

SEQ ID NO: 934710 - RNA, 22 nt, Human
uaugcacauucacacaaaaaug

SEQ ID NO: 934711 - RNA, 22 nt, Human
guguugacucuuggacuucaag

SEQ ID NO: 934712 - RNA, 22 nt, Human
uuucuguagggauuucacaguu

SEQ ID NO: 934713 - RNA, 22 nt, Human
ugcagaagugagucaugaggaa

SEQ ID NO: 934714 - RNA, 22 nt, Human
cuccugagcucugaggaagcuu

SEQ ID NO: 934715 - RNA, 22 nt, Human
cuggacagaaagggcugcugug

SEQ ID NO: 934716 - RNA, 22 nt, Human
uggaggcauuuuagguugucac

SEQ ID NO: 934717 - RNA, 22 nt, Human
uggcagugccccuugaccagug

SEQ ID NO: 934718 - RNA, 22 nt, Human
aaaguuugaaugauauauuagu

SEQ ID NO: 934719 - RNA, 18 nt, Human
cccucuccugcuaguggg

SEQ ID NO: 934720 - RNA, 22 nt, Human
guucacaaaauucuggccagug

SEQ ID NO: 934721 - RNA, 22 nt, Human
gcagggaccugccacugcuguc

SEQ ID NO: 934722 - RNA, 22 nt, Human
aagcgccaugguuccugcgcag

SEQ ID NO: 934723 - RNA, 22 nt, Human
gagccaggucgggccgcggcga

SEQ ID NO: 934724 - RNA, 22 nt, Human
ucauugcaguugaguuguguua

SEQ ID NO: 934725 - RNA, 22 nt, Human
aaaguuugagugauuugacaca

SEQ ID NO: 934726 - RNA, 22 nt, Human
ucccagccugacagugcaucaa

SEQ ID NO: 934727 - RNA, 22 nt, Human
acauuucuuuucaucucuauau

SEQ ID NO: 934728 - RNA, 22 nt, Human
uccucugcucagcauuccucac

SEQ ID NO: 934729 - RNA, 22 nt, Human
ucagggcaggacaguguaggcc

SEQ ID NO: 934730 - RNA, 22 nt, Human
aaauugugcucacacugauauu

SEQ ID NO: 934731 - RNA, 22 nt, Human
aagaacauucgaacuauuuucu

SEQ ID NO: 934732 - RNA, 22 nt, Human
cuuaggaugaguuuuugcguuu

SEQ ID NO: 934733 - RNA, 22 nt, Human
uuccaugaaagugaaauggagc

SEQ ID NO: 934734 - RNA, 22 nt, Human
uacauaguauucacauuguuuu

SEQ ID NO: 934735 - RNA, 22 nt, Human
ccugucacgaugacugcacucu

SEQ ID NO: 934736 - RNA, 22 nt, Human
augaguugaagcuacaagaggc

SEQ ID NO: 934737 - RNA, 22 nt, Human
auggcaggcccagguguucauu

SEQ ID NO: 934738 - RNA, 22 nt, Human
uuccuggcgccacggagccggu

SEQ ID NO: 934739 - RNA, 22 nt, Human
ucccacacagcccgcucaccgg

SEQ ID NO: 934740 - RNA, 22 nt, Human
uggagcccagggugagaaggag

SEQ ID NO: 934741 - RNA, 22 nt, Human
uaaagcacgucuauuuaaugau

SEQ ID NO: 934742 - RNA, 19 nt, Human
gcuggccacgccccaguug

SEQ ID NO: 934743 - RNA, 22 nt, Human
aaaggaagaugccaggacucug

SEQ ID NO: 934744 - RNA, 22 nt, Human
auacaacuuuacaugcaauucc

SEQ ID NO: 934745 - RNA, 22 nt, Human
accauuuaauaaguauuuccau

SEQ ID NO: 934746 - RNA, 22 nt, Human
uagcugccaaaagggugggcua

SEQ ID NO: 934747 - RNA, 22 nt, Human
agaggcugaaugaugucaucau

SEQ ID NO: 934748 - RNA, 22 nt, Human
aaaaugaggucaauauccuuuu

SEQ ID NO: 934749 - RNA, 17 nt, Human
ucuccuggcucuaucag

SEQ ID NO: 934750 - RNA, 22 nt, Human
cugggagcaccauacuuguuuc

SEQ ID NO: 934751 - RNA, 22 nt, Human
accuguuuguguccauuaguga

SEQ ID NO: 934752 - RNA, 22 nt, Human
gugcaagguacauccuugaugu

SEQ ID NO: 934753 - RNA, 22 nt, Human
gccuugccucagccauggaaac

SEQ ID NO: 934754 - RNA, 22 nt, Human
uuccucagagggcgcuggggaa

SEQ ID NO: 934755 - RNA, 21 nt, Human
aaacugaccuugccugagaca

SEQ ID NO: 934756 - RNA, 22 nt, Human
uuaaacaguguuucaugugggg

SEQ ID NO: 934757 - RNA, 22 nt, Human
cagacacaccaggcccauucug

SEQ ID NO: 934758 - RNA, 21 nt, Human
aaucauacaaaacaugucagg

SEQ ID NO: 934759 - RNA, 22 nt, Human
gcugucugcugggucgcucagg

SEQ ID NO: 934760 - RNA, 22 nt, Human
uuucuguuaggcaucauuuuaa

SEQ ID NO: 934761 - RNA, 22 nt, Human
cucagaaucugccaaguucagg

SEQ ID NO: 934762 - RNA, 22 nt, Human
gcucagagggaacaaggggcug

SEQ ID NO: 934763 - RNA, 22 nt, Human
cuucuucaauagcaagcgcaua

SEQ ID NO: 934764 - RNA, 19 nt, Human
gaucuuugccaauuuaagc

SEQ ID NO: 934765 - RNA, 22 nt, Human
guaggcagguggaggagugaag

SEQ ID NO: 934766 - RNA, 21 nt, Human
ggugucaguuuuggucauuag

SEQ ID NO: 934767 - RNA, 21 nt, Human
uagggcaggcauuggaagaga

SEQ ID NO: 934768 - RNA, 22 nt, Human
aaggcugauuagacugauagcu

SEQ ID NO: 934769 - RNA, 22 nt, Human
uucuugauuucaugcaguuaag

SEQ ID NO: 934770 - RNA, 22 nt, Human
ugaggggagaagcagcagccug

SEQ ID NO: 934771 - RNA, 18 nt, Human
auccuugaugagaggucu

SEQ ID NO: 934772 - RNA, 22 nt, Human
ucucucagggggaaggcugaag

SEQ ID NO: 934773 - RNA, 22 nt, Human
ucucauucauacccuacaugcu

SEQ ID NO: 934774 - RNA, 22 nt, Human
caggccugucugcacaugaggc

SEQ ID NO: 934775 - RNA, 22 nt, Human
gcagcuggggaggucgugggga

SEQ ID NO: 934776 - RNA, 22 nt, Human
gccucugcaugcucagcaccca

SEQ ID NO: 934777 - RNA, 22 nt, Human
caggggaguuuuaugcaacaga

SEQ ID NO: 934778 - RNA, 22 nt, Human
uuugaagucaggcuuucuaccc

SEQ ID NO: 934779 - RNA, 22 nt, Human
aagauuauuuaagacaggaacc

SEQ ID NO: 934780 - RNA, 22 nt, Human
ugccuggguccaggccaagccu

SEQ ID NO: 934781 - RNA, 22 nt, Human
ugaagcuuuccuguggucagga

SEQ ID NO: 934782 - RNA, 22 nt, Human
gcugccugucccaggaugagga

SEQ ID NO: 934783 - RNA, 22 nt, Human
uuccauaaaggugauaguauac

SEQ ID NO: 934784 - RNA, 22 nt, Human
gagccugaauuugaccugcuua

SEQ ID NO: 934785 - RNA, 22 nt, Human
ucuugggauugcccugcaguuc

SEQ ID NO: 934786 - RNA, 22 nt, Human
uauuucuguaacucagggucug

SEQ ID NO: 934787 - RNA, 20 nt, Human
ggcagcaggaguuuccucuu

SEQ ID NO: 934788 - RNA, 22 nt, Human
uauuacugagguuuuauggagu

SEQ ID NO: 934789 - RNA, 22 nt, Human
aggcccuggcacugccugggag

SEQ ID NO: 934790 - RNA, 22 nt, Human
cuuaacagauacaucugugguu

SEQ ID NO: 934791 - RNA, 22 nt, Human
ugggcccaagagagucuccaac

SEQ ID NO: 934792 - RNA, 22 nt, Human
cagggagaagucuggucagucc

SEQ ID NO: 934793 - RNA, 22 nt, Human
cugcucugcaaggcacagugau

SEQ ID NO: 934794 - RNA, 22 nt, Human
auaagcauguuagaauauuuga

SEQ ID NO: 934795 - RNA, 22 nt, Human
ugaagcagcaccauuuuagagc

SEQ ID NO: 934796 - RNA, 22 nt, Human
auaaacaucuguuucucuucug

SEQ ID NO: 934797 - RNA, 22 nt, Human
uugaggagcaggaugggaggcu

SEQ ID NO: 934798 - RNA, 22 nt, Human
ucuuagcauuucauaacaacug

SEQ ID NO: 934799 - RNA, 22 nt, Human
uguguuaaguauuugauacacu

SEQ ID NO: 934800 - RNA, 22 nt, Human
uuucacagguacaaacacuccu

SEQ ID NO: 934801 - RNA, 22 nt, Human
gcccucagaugggaaaggaggg

SEQ ID NO: 934802 - RNA, 19 nt, Human
uuacuuggcaaagucaguc

SEQ ID NO: 934803 - RNA, 22 nt, Human
gggagcugagggaccucugugg

SEQ ID NO: 934804 - RNA, 22 nt, Human
ggcucaggccagaccacgacuc

SEQ ID NO: 934805 - RNA, 22 nt, Human
ccaugagacagcaacugaaagu

SEQ ID NO: 934806 - RNA, 22 nt, Human
aaauuucaagcaaaguagcuau

SEQ ID NO: 934807 - RNA, 22 nt, Human
cuuguggcccauggcuuccugc

SEQ ID NO: 934808 - RNA, 22 nt, Human
cucccaagggguaagggagcug

SEQ ID NO: 934809 - RNA, 22 nt, Human
aaggccagcuuguagggcuggu

SEQ ID NO: 934810 - RNA, 22 nt, Human
agccccuuccaguucucagauc

SEQ ID NO: 934811 - RNA, 22 nt, Human
ggcaggagauaaaauauuaguu

SEQ ID NO: 934812 - RNA, 22 nt, Human
agaacuuaggaacaacagcuua

SEQ ID NO: 934813 - RNA, 22 nt, Human
uaguaucuauuaguaacaagag

SEQ ID NO: 934814 - RNA, 22 nt, Human
uaucuguucaauggaagaugac

SEQ ID NO: 934815 - RNA, 22 nt, Human
gaacagcccuguuaagucuguu

SEQ ID NO: 934816 - RNA, 22 nt, Human
gcuuuauguaaguccaaaggca

SEQ ID NO: 934817 - RNA, 22 nt, Human
cugggccuuggauugacacugu

SEQ ID NO: 934818 - RNA, 21 nt, Human
ccagaggccucucuuggccac

SEQ ID NO: 934819 - RNA, 22 nt, Human
ggcugaaguguaguggcucacu

SEQ ID NO: 934820 - RNA, 22 nt, Human
accaucagagcacaguccgugc

SEQ ID NO: 934821 - RNA, 22 nt, Human
agccacagcaacaagugcaauu

SEQ ID NO: 934822 - RNA, 21 nt, Human
uugaaggaucacuucuguacc

SEQ ID NO: 934823 - RNA, 21 nt, Human
ucucuacacuuucacuaggcu

SEQ ID NO: 934824 - RNA, 22 nt, Human
acaguguuuuaugagaauuguu

SEQ ID NO: 934825 - RNA, 22 nt, Human
ggucaugcugugaaucagugcu

SEQ ID NO: 934826 - RNA, 22 nt, Human
cugggcacauuuugacuagugu

SEQ ID NO: 934827 - RNA, 22 nt, Human
uauuuccagcaguaagaagaca

SEQ ID NO: 934828 - RNA, 20 nt, Human
aggcucagagcaguaguaca

SEQ ID NO: 934829 - RNA, 22 nt, Human
uaaaguucuggugagagguaag

SEQ ID NO: 934830 - RNA, 22 nt, Human
agggcagagaaauguaguugag

SEQ ID NO: 934831 - RNA, 22 nt, Human
uggcagagaauaaaucuugacu

SEQ ID NO: 934832 - RNA, 22 nt, Human
acuuucauuuguaauaaacuuc

SEQ ID NO: 934833 - RNA, 22 nt, Human
ugcagaggagucagccugggca

SEQ ID NO: 934834 - RNA, 18 nt, Human
ucaagacaucaugaaaua

SEQ ID NO: 934835 - RNA, 22 nt, Human
agguaaagacagugaaagaggg

SEQ ID NO: 934836 - RNA, 22 nt, Human
ccagggcauccucacaucgcag

SEQ ID NO: 934837 - RNA, 22 nt, Human
ucacuuauaaaaugcaagaucu

SEQ ID NO: 934838 - RNA, 22 nt, Human
aaguuaugaaauuuggacagcu

SEQ ID NO: 934839 - RNA, 22 nt, Human
gaagcagcaaaucugcaguauc

SEQ ID NO: 934840 - RNA, 22 nt, Human
guaauuuuggaguauaaccugg

SEQ ID NO: 934841 - RNA, 22 nt, Human
aagccaggcaugcuuggacagu

SEQ ID NO: 934842 - RNA, 22 nt, Human
ucaggcagaugcagggauggau

SEQ ID NO: 934843 - RNA, 22 nt, Human
augugaaacugaagcauccaua

SEQ ID NO: 934844 - RNA, 20 nt, Human
acaggagaucugaggaaagg

SEQ ID NO: 934845 - RNA, 22 nt, Human
gcucugcugcuuacuagauggu

SEQ ID NO: 934846 - RNA, 22 nt, Human
gcagggugaaggucacauagaa

SEQ ID NO: 934847 - RNA, 20 nt, Human
cagcugccuggcucugggau

SEQ ID NO: 934848 - RNA, 22 nt, Human
aagcugcccucauucccagugc

SEQ ID NO: 934849 - RNA, 22 nt, Human
cugccuguuuucugauagauuu

SEQ ID NO: 934850 - RNA, 22 nt, Human
agauacauugaguuuccuccug

SEQ ID NO: 934851 - RNA, 19 nt, Human
agcauuuggaauucuacac

SEQ ID NO: 934852 - RNA, 23 nt, Human
acaaaugcccauacaucuaguuc

SEQ ID NO: 934853 - RNA, 22 nt, Human
ucauugaacgaagagcuccauu

SEQ ID NO: 934854 - RNA, 22 nt, Human
uauggcauaucugggagacucu

SEQ ID NO: 934855 - RNA, 22 nt, Human
ccucugggagacugcuacugag

SEQ ID NO: 934856 - RNA, 22 nt, Human
ucugggcucuuaguguacccuc

SEQ ID NO: 934857 - RNA, 22 nt, Human
agugugugcaugcauucgugca

SEQ ID NO: 934858 - RNA, 22 nt, Human
uggcugaauaauauucuguugu

SEQ ID NO: 934859 - RNA, 22 nt, Human
cuucugagcagaccuccugggg

SEQ ID NO: 934860 - RNA, 19 nt, Human
guucaaacacugauucagc

SEQ ID NO: 934861 - RNA, 22 nt, Human
auguaucaauuaucugucugca

SEQ ID NO: 934862 - RNA, 23 nt, Human
aaccuagacuacuuacuaugugg

SEQ ID NO: 934863 - RNA, 22 nt, Human
cauuuacagugagaguuuuuac

SEQ ID NO: 934864 - RNA, 22 nt, Human
aaagugacaaccauuuauuaag

SEQ ID NO: 934865 - RNA, 22 nt, Human
ggccuggaagaggacagagaaa

SEQ ID NO: 934866 - RNA, 22 nt, Human
ugcugcacgauaaauaauuucu

SEQ ID NO: 934867 - RNA, 22 nt, Human
cucccacuccuggcucaccaca

SEQ ID NO: 934868 - RNA, 22 nt, Human
guuauugcaguauagaggucua

SEQ ID NO: 934869 - RNA, 22 nt, Human
agcaguggagcgagauguuuaa

SEQ ID NO: 934870 - RNA, 22 nt, Human
ugcaguggugguaaagaugcuc

SEQ ID NO: 934871 - RNA, 22 nt, Human
aauguguacuuuuucaugcuca

SEQ ID NO: 934872 - RNA, 20 nt, Human
gggaguggugguagccugug

SEQ ID NO: 934873 - RNA, 22 nt, Human
cuuuaagacucugcucuuggug

SEQ ID NO: 934874 - RNA, 22 nt, Human
cagacagacagccguggccacc

SEQ ID NO: 934875 - RNA, 22 nt, Human
uauuccaaaaucccaaacugcc

SEQ ID NO: 934876 - RNA, 19 nt, Human
aguguguacugaaagcacu

SEQ ID NO: 934877 - RNA, 22 nt, Human
auuuaaugucgagcuauuguag

SEQ ID NO: 934878 - RNA, 22 nt, Human
augugucuuucaagguauagaa

SEQ ID NO: 934879 - RNA, 22 nt, Human
ggcuggcucagggcuugagaga

SEQ ID NO: 934880 - RNA, 22 nt, Human
cugcccaggaaccagaggggca

SEQ ID NO: 934881 - RNA, 22 nt, Human
uucacaggauauaugugcaggg

SEQ ID NO: 934882 - RNA, 22 nt, Human
uuugaaagcaggugugggaggg

SEQ ID NO: 934883 - RNA, 22 nt, Human
ggaggagguggguuaaguugua

SEQ ID NO: 934884 - RNA, 22 nt, Human
ucaguuuuuaaaugauauaauu

SEQ ID NO: 934885 - RNA, 22 nt, Human
ucuccuggaagaauaccacacu

SEQ ID NO: 934886 - RNA, 22 nt, Human
aaguucaaggaagccuccaguu

SEQ ID NO: 934887 - RNA, 22 nt, Human
cacagggcagaggguccguggc

SEQ ID NO: 934888 - RNA, 22 nt, Human
aggucagaagugccagggaauu

SEQ ID NO: 934889 - RNA, 22 nt, Human
ugaguucucacccauucuucuu

SEQ ID NO: 934890 - RNA, 20 nt, Human
aucagcaacugccacucagu

SEQ ID NO: 934891 - RNA, 22 nt, Human
gccuggguccacugaucaugcu

SEQ ID NO: 934892 - RNA, 22 nt, Human
uuuaagagcuaguaugucauuu

SEQ ID NO: 934893 - RNA, 23 nt, Human
ucaggauauugugugccaaggug

SEQ ID NO: 934894 - RNA, 19 nt, Human
ccagagcccgccagauggg

SEQ ID NO: 934895 - RNA, 22 nt, Human
guuuacaaauauuuuaaauggu

SEQ ID NO: 934896 - RNA, 22 nt, Human
ugggcugcccugaugguccuca

SEQ ID NO: 934897 - RNA, 22 nt, Human
ccagucagccaagcugcagcgg

SEQ ID NO: 934898 - RNA, 22 nt, Human
ggcugcugaguuggccaggaga

SEQ ID NO: 934899 - RNA, 22 nt, Human
acucucugguauuggcaaguuu

SEQ ID NO: 934900 - RNA, 22 nt, Human
gcccaggaagugacucagaugu

SEQ ID NO: 934901 - RNA, 22 nt, Human
aaggagaguacaggaguuggua

SEQ ID NO: 934902 - RNA, 18 nt, Human
agucuucugauccauuuu

SEQ ID NO: 934903 - RNA, 22 nt, Human
uguccucagauaugucuacucu

SEQ ID NO: 934904 - RNA, 22 nt, Human
uggcucagcuuacuuuugaggg

SEQ ID NO: 934905 - RNA, 22 nt, Human
uugcauguagaauacucaacuu

SEQ ID NO: 934906 - RNA, 22 nt, Human
gaaggaggugucaguuggacug

SEQ ID NO: 934907 - RNA, 22 nt, Human
uuugaaguggaaaaggauuuaa

SEQ ID NO: 934908 - RNA, 20 nt, Human
agcauuugaaauaugacuau

SEQ ID NO: 934909 - RNA, 22 nt, Human
caaaaguaauugcaguuuuugc

SEQ ID NO: 934910 - RNA, 22 nt, Human
ccugugucagccccugccucca

SEQ ID NO: 934911 - RNA, 23 nt, Human
uccaggagcaugcuggcuggcga

SEQ ID NO: 934912 - RNA, 22 nt, Human
ugcaggugaaaauuaugaggau

SEQ ID NO: 934913 - RNA, 22 nt, Human
gccugggaacucugaucuccug

SEQ ID NO: 934914 - RNA, 22 nt, Human
gcugccugaucauacaccaggg

SEQ ID NO: 934915 - RNA, 18 nt, Human
auggucucauacugggag

SEQ ID NO: 934916 - RNA, 22 nt, Human
uuggccuuguuaaggaggcccu

SEQ ID NO: 934917 - RNA, 22 nt, Human
aauucaugaguagaaucuauau

SEQ ID NO: 934918 - RNA, 18 nt, Human
auuuugaacaaugcugua

SEQ ID NO: 934919 - RNA, 22 nt, Human
ugggcugcagggguugagagcu

SEQ ID NO: 934920 - RNA, 22 nt, Human
uggcucaggccacuucuuuuau

SEQ ID NO: 934921 - RNA, 21 nt, Human
ccugagggugguugugaagau

SEQ ID NO: 934922 - RNA, 22 nt, Human
uauguuuuucaagugcacacua

SEQ ID NO: 934923 - RNA, 22 nt, Human
ggaggcucugcuccguguguuc

SEQ ID NO: 934924 - RNA, 22 nt, Human
guuguuuugcaggauccuuaca

SEQ ID NO: 934925 - RNA, 22 nt, Human
ggccaggagaggagggcacuga

SEQ ID NO: 934926 - RNA, 22 nt, Human
ugcuggaggggccugaccagga

SEQ ID NO: 934927 - RNA, 22 nt, Human
cugugccaucugcacucucguc

SEQ ID NO: 934928 - RNA, 22 nt, Human
guguggcugccagccaagaggc

SEQ ID NO: 934929 - RNA, 22 nt, Human
gggcuggagccagcuguggcug

SEQ ID NO: 934930 - RNA, 22 nt, Human
cccugaggcaaaggcuagaguu

SEQ ID NO: 934931 - RNA, 22 nt, Human
ccucauggaccucagacugucc

SEQ ID NO: 934932 - RNA, 22 nt, Human
auucacaaauaacaggugcaga

SEQ ID NO: 934933 - RNA, 22 nt, Human
aaggcacucauucaaggagaua

SEQ ID NO: 934934 - RNA, 22 nt, Human
cagcugaguuuccaagucugcc

SEQ ID NO: 934935 - RNA, 22 nt, Human
uucauagugauuguucagauag

SEQ ID NO: 934936 - RNA, 22 nt, Human
aagcccagcugaaagcauuuuu

SEQ ID NO: 934937 - RNA, 22 nt, Human
uuugaaaaaggccuuugguaug

SEQ ID NO: 934938 - RNA, 22 nt, Human
auauaguuggguuucauucuac

SEQ ID NO: 934939 - RNA, 22 nt, Human
ugcaccuuguugcuuuuacgaa

SEQ ID NO: 934940 - RNA, 22 nt, Human
ggagccuggccuggcucugugu

SEQ ID NO: 934941 - RNA, 22 nt, Human
ccucaggggcuuuucguuguug

SEQ ID NO: 934942 - RNA, 17 nt, Human
cagacaggcugucaccc

SEQ ID NO: 934943 - RNA, 22 nt, Human
agcagccagaaauccagaggug

SEQ ID NO: 934944 - RNA, 22 nt, Human
cacagcuucuccuugauaucgc

SEQ ID NO: 934945 - RNA, 22 nt, Human
cuuuuuccagcuucaggguggg

SEQ ID NO: 934946 - RNA, 22 nt, Human
uggaaagacauucagccgcugg

SEQ ID NO: 934947 - RNA, 20 nt, Human
ucacucugaugcuagggugg

SEQ ID NO: 934948 - RNA, 22 nt, Human
gcccaggagaggccagggcuga

SEQ ID NO: 934949 - RNA, 22 nt, Human
ggcucugcccagaugaagagga

SEQ ID NO: 934950 - RNA, 22 nt, Human
uggcuccuaucaaggagugggu

SEQ ID NO: 934951 - RNA, 22 nt, Human
caugagcugcugggagccuguc

SEQ ID NO: 934952 - RNA, 22 nt, Human
gagcacugaggaaagcugguua

SEQ ID NO: 934953 - RNA, 22 nt, Human
cugccuggggaaugugaggauu

SEQ ID NO: 934954 - RNA, 22 nt, Human
gcugagugauugauauuuuagu

SEQ ID NO: 934955 - RNA, 22 nt, Human
ugucccaggccucauguugcca

SEQ ID NO: 934956 - RNA, 22 nt, Human
aagcugccacacggugaguacu

SEQ ID NO: 934957 - RNA, 22 nt, Human
ccuggauucaagucuuucuuuc

SEQ ID NO: 934958 - RNA, 22 nt, Human
gaauacaugauacaugaacugc

SEQ ID NO: 934959 - RNA, 22 nt, Human
aaaugguaagacaacacauuau

SEQ ID NO: 934960 - RNA, 22 nt, Human
ugccucugugggccuuccuggc

SEQ ID NO: 934961 - RNA, 22 nt, Human
acaaagucucuaauaaucuucu

SEQ ID NO: 934962 - RNA, 23 nt, Human
auuucuaggggauuuucuggugc

SEQ ID NO: 934963 - RNA, 17 nt, Human
uguagcuucuccuucuc

SEQ ID NO: 934964 - RNA, 22 nt, Human
ccaggaggcagagguuacagug

SEQ ID NO: 934965 - RNA, 22 nt, Human
ugacagcauaacacuggucuug

SEQ ID NO: 934966 - RNA, 22 nt, Human
aucaguuuaacugucaagagcc

SEQ ID NO: 934967 - RNA, 22 nt, Human
gcagcauauuguacuggccugc

SEQ ID NO: 934968 - RNA, 22 nt, Human
ucacaagaauuuguagaugaaa

SEQ ID NO: 934969 - RNA, 22 nt, Human
uggcuuccugcacagugucugc

SEQ ID NO: 934970 - RNA, 20 nt, Human
uaugaguauuacuuucagga

SEQ ID NO: 934971 - RNA, 22 nt, Human
gagggucccgagcccugucaga

SEQ ID NO: 934972 - RNA, 22 nt, Human
cacauuuaauccuuuauaagua

SEQ ID NO: 934973 - RNA, 20 nt, Human
ggcagagcuaugucuguugc

SEQ ID NO: 934974 - RNA, 17 nt, Human
gguggccugcaguggcu

SEQ ID NO: 934975 - RNA, 22 nt, Human
uuuugugagcccauaaaugcca

SEQ ID NO: 934976 - RNA, 22 nt, Human
gagagcccugcuccuaucccag

SEQ ID NO: 934977 - RNA, 22 nt, Human
ucuucagacuccaaauguuuua

SEQ ID NO: 934978 - RNA, 22 nt, Human
uuuaagaugguauuuuauaaag

SEQ ID NO: 934979 - RNA, 21 nt, Human
agggagcuuuagguagaaguu

SEQ ID NO: 934980 - RNA, 22 nt, Human
uugcucagcacuggagccagcu

SEQ ID NO: 934981 - RNA, 22 nt, Human
agagccugcaucaggcuugggg

SEQ ID NO: 934982 - RNA, 22 nt, Human
cauuuguauguuccuccuuagg

SEQ ID NO: 934983 - RNA, 22 nt, Human
uaaggccauuauggugggcccg

SEQ ID NO: 934984 - RNA, 22 nt, Human
aagaacaguugggaggugagcc

SEQ ID NO: 934985 - RNA, 22 nt, Human
caagggugguauugggagcaua

SEQ ID NO: 934986 - RNA, 22 nt, Human
uuaaaagagcagcccagcauau

SEQ ID NO: 934987 - RNA, 22 nt, Human
ccagcuggcaggagagucaggg

SEQ ID NO: 934988 - RNA, 22 nt, Human
auucacauguugaagcccuaac

SEQ ID NO: 934989 - RNA, 22 nt, Human
aggccucacauugggcuucaag

SEQ ID NO: 934990 - RNA, 22 nt, Human
aagccaggcugcacuugcuggg

SEQ ID NO: 934991 - RNA, 19 nt, Human
guggccugcgcugggugcg

SEQ ID NO: 934992 - RNA, 22 nt, Human
auucaucaacugauagccauag

SEQ ID NO: 934993 - RNA, 22 nt, Human
uggggcuccuccuggcaggagg

SEQ ID NO: 934994 - RNA, 20 nt, Human
cccucccagaugcuucccaa

SEQ ID NO: 934995 - RNA, 22 nt, Human
uggccaggggaguuccccucca

SEQ ID NO: 934996 - RNA, 22 nt, Human
caggagugaaaugaggcccagg

SEQ ID NO: 934997 - RNA, 22 nt, Human
agaccagcugccucccagggcc

SEQ ID NO: 934998 - RNA, 20 nt, Human
uggcuccugcgguggaacca

SEQ ID NO: 934999 - RNA, 22 nt, Human
agggcugcuauguugauucaga

SEQ ID NO: 935000 - RNA, 22 nt, Human
agaugauggccauguccucucc

SEQ ID NO: 935001 - RNA, 23 nt, Human
aacuccugaaucgugagccaucu

SEQ ID NO: 935002 - RNA, 22 nt, Human
uuguuuaaaauguagcaagaaa

SEQ ID NO: 935003 - RNA, 22 nt, Human
gcaggagcuggaaagugauguu

SEQ ID NO: 935004 - RNA, 22 nt, Human
ugcuucugggcaaaugugugug

SEQ ID NO: 935005 - RNA, 22 nt, Human
agggaggucuuugaggggcuua

SEQ ID NO: 935006 - RNA, 22 nt, Human
cagaaauggaauuuuccaucac

SEQ ID NO: 935007 - RNA, 22 nt, Human
ugucucaguauacgaaacacuu

SEQ ID NO: 935008 - RNA, 21 nt, Human
cuggacugaggagacagucgc

SEQ ID NO: 935009 - RNA, 22 nt, Human
ugggauggagccugaguauagu

SEQ ID NO: 935010 - RNA, 22 nt, Human
auggcacuaagagggagcugga

SEQ ID NO: 935011 - RNA, 22 nt, Human
auaauuuuuguuugauguccaa

SEQ ID NO: 935012 - RNA, 20 nt, Human
agggucaguagcacagagcu

SEQ ID NO: 935013 - RNA, 22 nt, Human
gggcuggucuggcuuagucagg

SEQ ID NO: 935014 - RNA, 22 nt, Human
accccagcccugcuucugggag

SEQ ID NO: 935015 - RNA, 22 nt, Human
cuaaaugcccuacaaugacugg

SEQ ID NO: 935016 - RNA, 22 nt, Human
ccagugugggcccggccuccuc

SEQ ID NO: 935017 - RNA, 22 nt, Human
gggcuggaggagauccagaggc

SEQ ID NO: 935018 - RNA, 22 nt, Human
acaccuuugugaagugaugaug

SEQ ID NO: 935019 - RNA, 20 nt, Human
cugagagucugugcuuaguc

SEQ ID NO: 935020 - RNA, 19 nt, Human
agcaaauauaauaguguuc

SEQ ID NO: 935021 - RNA, 22 nt, Human
aucaaaguuucccagaaguugu

SEQ ID NO: 935022 - RNA, 22 nt, Human
aagcacuuagaagagugccugc

SEQ ID NO: 935023 - RNA, 22 nt, Human
caggaaaaaugccaggagucag

SEQ ID NO: 935024 - RNA, 22 nt, Human
uggaagcacuuggguuuuguug

SEQ ID NO: 935025 - RNA, 22 nt, Human
ggcugccuacuuucccagaguu

SEQ ID NO: 935026 - RNA, 22 nt, Human
cuggagcugcuguccuugggug

SEQ ID NO: 935027 - RNA, 22 nt, Human
cagaguucaaagccugcuggga

SEQ ID NO: 935028 - RNA, 22 nt, Human
ugcagcucauugguguccuggu

SEQ ID NO: 935029 - RNA, 22 nt, Human
ggcacagggagccgcaguugca

SEQ ID NO: 935030 - RNA, 17 nt, Human
augugucugaguguccu

SEQ ID NO: 935031 - RNA, 22 nt, Human
gcuggcagucccaucagcuggg

SEQ ID NO: 935032 - RNA, 22 nt, Human
gaacccaaaccuggaccucccu

SEQ ID NO: 935033 - RNA, 22 nt, Human
guauuaggaaauaugaagaaag

SEQ ID NO: 935034 - RNA, 20 nt, Human
caagcccucuuuagccugcc

SEQ ID NO: 935035 - RNA, 22 nt, Human
cagauccacccuuguagugaca

SEQ ID NO: 935036 - RNA, 22 nt, Human
ugggcagacauugaguuuguuc

SEQ ID NO: 935037 - RNA, 22 nt, Human
ucagugcagaauagugaugcau

SEQ ID NO: 935038 - RNA, 22 nt, Human
cuuugaauuccaguacaauaac

SEQ ID NO: 935039 - RNA, 22 nt, Human
uguauguguauguacauaugca

SEQ ID NO: 935040 - RNA, 22 nt, Human
ucccuggguucccguggaagug

SEQ ID NO: 935041 - RNA, 22 nt, Human
uuccgcuggggccgccuggcgg

SEQ ID NO: 935042 - RNA, 22 nt, Human
cuaauacucauuucuguaacuc

SEQ ID NO: 935043 - RNA, 22 nt, Human
gggcugcuuuuaagggucucag

SEQ ID NO: 935044 - RNA, 22 nt, Human
cagauggcagggcagcucugca

SEQ ID NO: 935045 - RNA, 21 nt, Human
cuguuucuugugaagugacac

SEQ ID NO: 935046 - RNA, 22 nt, Human
gaauuacaaagugagacaagcu

SEQ ID NO: 935047 - RNA, 21 nt, Human
agcagaggcugccuggugacu

SEQ ID NO: 935048 - RNA, 22 nt, Human
gccuccuggccuuugcuccuca

SEQ ID NO: 935049 - RNA, 22 nt, Human
ccuggagcuuggucacgcugcg

SEQ ID NO: 935050 - RNA, 22 nt, Human
cuggggugagcagaaacagggg

SEQ ID NO: 935051 - RNA, 22 nt, Human
cuugcacacauguacaugugua

SEQ ID NO: 935052 - RNA, 22 nt, Human
gccuggcugggcaccaggggag

SEQ ID NO: 935053 - RNA, 22 nt, Human
guuugauucaagaacaaagagu

SEQ ID NO: 935054 - RNA, 23 nt, Human
uggcucugagagguucagaugcu

SEQ ID NO: 935055 - RNA, 22 nt, Human
cagcagaggugguucacauugu

SEQ ID NO: 935056 - RNA, 22 nt, Human
ugcuuccuugagcucuccaauc

SEQ ID NO: 935057 - RNA, 22 nt, Human
agcugagagguggcaagcugua

SEQ ID NO: 935058 - RNA, 22 nt, Human
ggagccuguggcugcuugaagc

SEQ ID NO: 935059 - RNA, 22 nt, Human
ggcuccuguccccucagcugcu

SEQ ID NO: 935060 - RNA, 22 nt, Human
cagaggcagugggguugcuccu

SEQ ID NO: 935061 - RNA, 22 nt, Human
ggcaggagggcggacaaugacc

SEQ ID NO: 935062 - RNA, 23 nt, Human
cuugcagggcuggaggcuuagaa

SEQ ID NO: 935063 - RNA, 20 nt, Human
gagccugggaagucuaaggu

SEQ ID NO: 935064 - RNA, 22 nt, Human
aggagcugcauggauaccuggu

SEQ ID NO: 935065 - RNA, 22 nt, Human
uagacacaucaaguauaguuaa

SEQ ID NO: 935066 - RNA, 22 nt, Human
uuucaucuucccagagaccuug

SEQ ID NO: 935067 - RNA, 22 nt, Human
gaugggaggaaccugggucccu

SEQ ID NO: 935068 - RNA, 22 nt, Human
ucaaaaaguugaagaguugggg

SEQ ID NO: 935069 - RNA, 22 nt, Human
acacccagagcgccagugccga

SEQ ID NO: 935070 - RNA, 22 nt, Human
uuucacaagacagcuacuguug

SEQ ID NO: 935071 - RNA, 22 nt, Human
uugaauaguguuuucaguauac

SEQ ID NO: 935072 - RNA, 22 nt, Human
ggcagcagggcugucucccuac

SEQ ID NO: 935073 - RNA, 22 nt, Human
gugaaggacuagcauggagggc

SEQ ID NO: 935074 - RNA, 22 nt, Human
aacuucuugguccugagcuguu

SEQ ID NO: 935075 - RNA, 22 nt, Human
caggguacagaguuuucuaaac

SEQ ID NO: 935076 - RNA, 22 nt, Human
ggcuugcuucuuguccaggaau

SEQ ID NO: 935077 - RNA, 22 nt, Human
uauccaaacauauagucucucu

SEQ ID NO: 935078 - RNA, 22 nt, Human
uuugcauugcagugguuuacag

SEQ ID NO: 935079 - RNA, 22 nt, Human
agcaagcuaccuagauagucua

SEQ ID NO: 935080 - RNA, 22 nt, Human
gauacaaauucaugucugaauu

SEQ ID NO: 935081 - RNA, 22 nt, Human
ggccaggagcugcacagggcuc

SEQ ID NO: 935082 - RNA, 22 nt, Human
uucagagcaucucuaaagccag

SEQ ID NO: 935083 - RNA, 22 nt, Human
auguuuuauuaccaacuuguac

SEQ ID NO: 935084 - RNA, 22 nt, Human
uuaggauaugaaacaguauaag

SEQ ID NO: 935085 - RNA, 22 nt, Human
gugcucaggaagcuguuccugc

SEQ ID NO: 935086 - RNA, 22 nt, Human
cccucugccucugaguaggaca

SEQ ID NO: 935087 - RNA, 22 nt, Human
ggaggagacaguaaaaagcacg

SEQ ID NO: 935088 - RNA, 22 nt, Human
ggagugaaucacuagaugcaga

SEQ ID NO: 935089 - RNA, 22 nt, Human
aucauuucccuuuagaucacaa

SEQ ID NO: 935090 - RNA, 22 nt, Human
aaauaauguuaggccuuugcuc

SEQ ID NO: 935091 - RNA, 22 nt, Human
cauuuccacuucugaaaacugg

SEQ ID NO: 935092 - RNA, 22 nt, Human
auucuucacauaagugcuguac

SEQ ID NO: 935093 - RNA, 22 nt, Human
uggaaggagacugggaagugug

SEQ ID NO: 935094 - RNA, 22 nt, Human
uggcccugugugcaggcugcac

SEQ ID NO: 935095 - RNA, 22 nt, Human
aggucauuggggacuaucuccg

SEQ ID NO: 935096 - RNA, 22 nt, Human
agcaccugcuuaaugugcagug

SEQ ID NO: 935097 - RNA, 22 nt, Human
ugccgcagugcggggagggccc

SEQ ID NO: 935098 - RNA, 22 nt, Human
uagcuuuccuuguugccugugc

SEQ ID NO: 935099 - RNA, 22 nt, Human
ucccagagccaagcuauggaug

SEQ ID NO: 935100 - RNA, 22 nt, Human
cuccuggcccugagcucccagg

SEQ ID NO: 935101 - RNA, 22 nt, Human
ccuggugccacuagagaauguc

SEQ ID NO: 935102 - RNA, 22 nt, Human
uguuugaacugaauaacauagu

SEQ ID NO: 935103 - RNA, 20 nt, Human
gauuucaaagcagaguggcc

SEQ ID NO: 935104 - RNA, 20 nt, Human
uauuuagauucaaguaugga

SEQ ID NO: 935105 - RNA, 22 nt, Human
uuuuucaagacaaccugcaugu

SEQ ID NO: 935106 - RNA, 22 nt, Human
ugaagcccugugucagcuucca

SEQ ID NO: 935107 - RNA, 22 nt, Human
agauacauagcugugagcacac

SEQ ID NO: 935108 - RNA, 22 nt, Human
ugaggcaggacauggacaacug

SEQ ID NO: 935109 - RNA, 22 nt, Human
cccaggagaccuagaucuguuu

SEQ ID NO: 935110 - RNA, 22 nt, Human
aacucugcuuauaguuugucca

SEQ ID NO: 935111 - RNA, 22 nt, Human
cugugucuaaucuuauacauca

SEQ ID NO: 935112 - RNA, 22 nt, Human
caggggcuguggcacauggugu

SEQ ID NO: 935113 - RNA, 22 nt, Human
ugcuguguucuccugacucacc

SEQ ID NO: 935114 - RNA, 22 nt, Human
cugccuccucacguccacagug

SEQ ID NO: 935115 - RNA, 22 nt, Human
cccaggcuggagugcaauggca

SEQ ID NO: 935116 - RNA, 20 nt, Human
agacaggagcccccauucag

SEQ ID NO: 935117 - RNA, 22 nt, Human
aauauccacacugugucccugc

SEQ ID NO: 935118 - RNA, 22 nt, Human
uaacagaagaaaacauauugga

SEQ ID NO: 935119 - RNA, 22 nt, Human
uccauguggccagacacuggca

SEQ ID NO: 935120 - RNA, 22 nt, Human
ugcaggcuguaaucugaggcua

SEQ ID NO: 935121 - RNA, 22 nt, Human
agcaggugggaucaagcuggca

SEQ ID NO: 935122 - RNA, 22 nt, Human
uucaagaugcacaguggcauuc

SEQ ID NO: 935123 - RNA, 19 nt, Human
gcucagagggcccugugcu

SEQ ID NO: 935124 - RNA, 22 nt, Human
accagagauggggcuucucugu

SEQ ID NO: 935125 - RNA, 17 nt, Human
gcugagugcagggaguc

SEQ ID NO: 935126 - RNA, 22 nt, Human
ucacagacauggugagguaaca

SEQ ID NO: 935127 - RNA, 22 nt, Human
acuuguuuuaucugucaauaga

SEQ ID NO: 935128 - RNA, 22 nt, Human
ucuuuccucugagcuccuguag

SEQ ID NO: 935129 - RNA, 21 nt, Human
cagaaguaaggguaacuucuc

SEQ ID NO: 935130 - RNA, 22 nt, Human
aaggcagccaugugcuuugggu

SEQ ID NO: 935131 - RNA, 22 nt, Human
guguacaugagaaaucaacuuu

SEQ ID NO: 935132 - RNA, 22 nt, Human
guggcugcagcccagcggcacg

SEQ ID NO: 935133 - RNA, 22 nt, Human
gugggagcuuuggcaucaggcu

SEQ ID NO: 935134 - RNA, 22 nt, Human
cagaguccuggacacagagaca

SEQ ID NO: 935135 - RNA, 22 nt, Human
cagggccacuguagaugaggag

SEQ ID NO: 935136 - RNA, 22 nt, Human
uaauaucuacuucauagaguuu

SEQ ID NO: 935137 - RNA, 22 nt, Human
ugaguucuaguggcugcagauu

SEQ ID NO: 935138 - RNA, 23 nt, Human
aucauucuccaaucuggagcagg

SEQ ID NO: 935139 - RNA, 22 nt, Human
ccagagagauugcuucuaaaga

SEQ ID NO: 935140 - RNA, 22 nt, Human
uucauucugcaguucucagcuc

SEQ ID NO: 935141 - RNA, 22 nt, Human
aaggcaguaggaucuuccacag

SEQ ID NO: 935142 - RNA, 22 nt, Human
ugaagccaucccucagauggcc

SEQ ID NO: 935143 - RNA, 22 nt, Human
guagcuuauuagggauaauagu

SEQ ID NO: 935144 - RNA, 22 nt, Human
caugaguuuuuuaguucaugca

SEQ ID NO: 935145 - RNA, 22 nt, Human
agguacaguagacagacaguua

SEQ ID NO: 935146 - RNA, 22 nt, Human
ugaggcaggagguugagaacug

SEQ ID NO: 935147 - RNA, 23 nt, Human
uggcaccaggcauucuaggggua

SEQ ID NO: 935148 - RNA, 22 nt, Human
gcuguucauagaaauggucuca

SEQ ID NO: 935149 - RNA, 22 nt, Human
uuagaaaggagcuuauuucuuu

SEQ ID NO: 935150 - RNA, 22 nt, Human
aaggucauugguucugaauucu

SEQ ID NO: 935151 - RNA, 22 nt, Human
caccaggcugaaccagagggga

SEQ ID NO: 935152 - RNA, 22 nt, Human
cugggcugugguguggcccaaa

SEQ ID NO: 935153 - RNA, 22 nt, Human
gccuggagacaaggacaaaggg

SEQ ID NO: 935154 - RNA, 22 nt, Human
gguagcagggcugugagucaga

SEQ ID NO: 935155 - RNA, 22 nt, Human
gcacagagggcagugagccucu

SEQ ID NO: 935156 - RNA, 22 nt, Human
cuaccuuucugacucuugggau

SEQ ID NO: 935157 - RNA, 22 nt, Human
uaauuauuaugacaacaauugc

SEQ ID NO: 935158 - RNA, 22 nt, Human
auucauaacggcaaaugucacc

SEQ ID NO: 935159 - RNA, 22 nt, Human
gcaguggggaaugcuggggaga

SEQ ID NO: 935160 - RNA, 22 nt, Human
agcgggugcugugucagcccuc

SEQ ID NO: 935161 - RNA, 22 nt, Human
ccuggcagcauugguagagauu

SEQ ID NO: 935162 - RNA, 22 nt, Human
ggcccacuugaaauggagcuca

SEQ ID NO: 935163 - RNA, 22 nt, Human
caggguccaucuuucaucacug

SEQ ID NO: 935164 - RNA, 22 nt, Human
uuucuagggcucuugucuucug

SEQ ID NO: 935165 - RNA, 22 nt, Human
auuuuucucuccacuccauuaa

SEQ ID NO: 935166 - RNA, 22 nt, Human
aaggucauggcaaauuacuuuu

SEQ ID NO: 935167 - RNA, 22 nt, Human
cccacaggcuagggguagggca

SEQ ID NO: 935168 - RNA, 22 nt, Human
uauugacagagggucagaagag

SEQ ID NO: 935169 - RNA, 22 nt, Human
gugcugucaauugcuuucagua

SEQ ID NO: 935170 - RNA, 22 nt, Human
cacagaauuaagggagaaauau

SEQ ID NO: 935171 - RNA, 22 nt, Human
acagcaugucuaguuaaauacu

SEQ ID NO: 935172 - RNA, 19 nt, Human
uucaggauugacccuacug

SEQ ID NO: 935173 - RNA, 22 nt, Human
aguucucaggucagcugagucu

SEQ ID NO: 935174 - RNA, 22 nt, Human
cugccugggccggccacccucu

SEQ ID NO: 935175 - RNA, 22 nt, Human
cugagccuguguuucucuggca

SEQ ID NO: 935176 - RNA, 22 nt, Human
aaaggccaccaacaugaagcau

SEQ ID NO: 935177 - RNA, 21 nt, Human
acagucuccccagaucucucc

SEQ ID NO: 935178 - RNA, 22 nt, Human
gugcauuucucauacacuaaau

SEQ ID NO: 935179 - RNA, 19 nt, Human
ucucacaucagcuccuagc

SEQ ID NO: 935180 - RNA, 18 nt, Human
uaggagagaauuuauuua

SEQ ID NO: 935181 - RNA, 22 nt, Human
cacugcagaucagaggcugaga

SEQ ID NO: 935182 - RNA, 22 nt, Human
uagagaaauaagcuuugccuug

SEQ ID NO: 935183 - RNA, 22 nt, Human
cugugcccuggccaggccucuc

SEQ ID NO: 935184 - RNA, 22 nt, Human
aggcucugaucagguggcugug

SEQ ID NO: 935185 - RNA, 22 nt, Human
gggcugugcugaguaggaggug

SEQ ID NO: 935186 - RNA, 22 nt, Human
ccaggagcaggagcuggacaga

SEQ ID NO: 935187 - RNA, 22 nt, Human
cccucccaggaguggccagaga

SEQ ID NO: 935188 - RNA, 22 nt, Human
ucuguucauacagaguauagua

SEQ ID NO: 935189 - RNA, 22 nt, Human
uguuccuguguggaaaagggcc

SEQ ID NO: 935190 - RNA, 22 nt, Human
uggggcuggggaucuugagccu

SEQ ID NO: 935191 - RNA, 22 nt, Human
gaaaagcuaggccaguucagcu

SEQ ID NO: 935192 - RNA, 22 nt, Human
auuucuguaguccacauucuuu

SEQ ID NO: 935193 - RNA, 22 nt, Human
cuucagagugcagaagauuggg

SEQ ID NO: 935194 - RNA, 22 nt, Human
ggggccuuuucugaauguggaa

SEQ ID NO: 935195 - RNA, 22 nt, Human
gagcugccugaacaagcagcag

SEQ ID NO: 935196 - RNA, 22 nt, Human
cugagauggccacugggucuca

SEQ ID NO: 935197 - RNA, 22 nt, Human
uccagggaugccagccauguug

SEQ ID NO: 935198 - RNA, 22 nt, Human
ucagcuggagaugagaaccgaa

SEQ ID NO: 935199 - RNA, 22 nt, Human
caagagcugugaccucauucac

SEQ ID NO: 935200 - RNA, 22 nt, Human
gagggcagugaauuuugaagcu

SEQ ID NO: 935201 - RNA, 22 nt, Human
ccaggcagccaagugugugugu

SEQ ID NO: 935202 - RNA, 22 nt, Human
agcuugccucuuaaucaccuca

SEQ ID NO: 935203 - RNA, 20 nt, Human
cugcugugauucccuccucc

SEQ ID NO: 935204 - RNA, 22 nt, Human
aaagcucuuuuccaaguauuga

SEQ ID NO: 935205 - RNA, 22 nt, Human
uggcugugaacaaagagaauaa

SEQ ID NO: 935206 - RNA, 22 nt, Human
uaggauuuggcuuuagucaggu

SEQ ID NO: 935207 - RNA, 22 nt, Human
auucagaaaguugucauauuug

SEQ ID NO: 935208 - RNA, 22 nt, Human
ucucccaggcugcccuguggac

SEQ ID NO: 935209 - RNA, 22 nt, Human
gcugcucucagagcucaugcug

SEQ ID NO: 935210 - RNA, 22 nt, Human
uuuuuccaccguacuuccugag

SEQ ID NO: 935211 - RNA, 22 nt, Human
aggcccugcuuuccagagcuca

SEQ ID NO: 935212 - RNA, 22 nt, Human
aauuuggcagugucuugaagua

SEQ ID NO: 935213 - RNA, 22 nt, Human
gcugccagccaacuugcugugc

SEQ ID NO: 935214 - RNA, 20 nt, Human
ggcagagggccugggagaag

SEQ ID NO: 935215 - RNA, 22 nt, Human
cucuguccuaugcuugauagaa

SEQ ID NO: 935216 - RNA, 22 nt, Human
ugccugucuuaauaucuggaaa

SEQ ID NO: 935217 - RNA, 22 nt, Human
uuauauguuucuguuuggaggc

SEQ ID NO: 935218 - RNA, 22 nt, Human
ccugagccuggcucaugcacuc

SEQ ID NO: 935219 - RNA, 22 nt, Human
acagccugcugccugcuucuug

SEQ ID NO: 935220 - RNA, 22 nt, Human
uaagaacagugucugucucaca

SEQ ID NO: 935221 - RNA, 22 nt, Human
aucugcagaggacaggcgagga

SEQ ID NO: 935222 - RNA, 20 nt, Human
aggaggcauagucuggaaag

SEQ ID NO: 935223 - RNA, 23 nt, Human
cccaggagccugaguccucucug

SEQ ID NO: 935224 - RNA, 21 nt, Human
gccagagcaguacaaugaggu

SEQ ID NO: 935225 - RNA, 22 nt, Human
cucucuggaagggggagcugau

SEQ ID NO: 935226 - RNA, 22 nt, Human
auagucacucuguuagguguuu

SEQ ID NO: 935227 - RNA, 22 nt, Human
ugcugccaccccucaccagagc

SEQ ID NO: 935228 - RNA, 19 nt, Human
uuuggcacucugaaguguu

SEQ ID NO: 935229 - RNA, 22 nt, Human
ccaccagcuucagcagccgcgg

SEQ ID NO: 935230 - RNA, 23 nt, Human
ccagcucccaggucugaggacug

SEQ ID NO: 935231 - RNA, 19 nt, Human
agugucaucagcuacucag

SEQ ID NO: 935232 - RNA, 22 nt, Human
uuuugaaagaguccugcuacag

SEQ ID NO: 935233 - RNA, 22 nt, Human
cuggcuugcagcucaucauaaa

SEQ ID NO: 935234 - RNA, 22 nt, Human
gccaccagccccaugcgcugug

SEQ ID NO: 935235 - RNA, 22 nt, Human
uagaaaucuacuuagacuuucu

SEQ ID NO: 935236 - RNA, 22 nt, Human
ugucuuaauuuggaugauguuu

SEQ ID NO: 935237 - RNA, 22 nt, Human
agucccagugagaugaaccagg

SEQ ID NO: 935238 - RNA, 22 nt, Human
ccuggccugcucggcucuuaag

SEQ ID NO: 935239 - RNA, 22 nt, Human
gcagaagucagaccaucugaau

SEQ ID NO: 935240 - RNA, 22 nt, Human
uuuucuuauggugaagcacaaa

SEQ ID NO: 935241 - RNA, 22 nt, Human
ugucccagaucacaggagggga

SEQ ID NO: 935242 - RNA, 22 nt, Human
agcuauguauuuguguguuaaa

SEQ ID NO: 935243 - RNA, 22 nt, Human
cagcucucacacccuccuccca

SEQ ID NO: 935244 - RNA, 22 nt, Human
ggccauggaccccgagcugacc

SEQ ID NO: 935245 - RNA, 22 nt, Human
uacauauacugagugauuugcu

SEQ ID NO: 935246 - RNA, 22 nt, Human
ugacagaaagaauaugucaauc

SEQ ID NO: 935247 - RNA, 22 nt, Human
acuuccuguguuggucuugcug

SEQ ID NO: 935248 - RNA, 22 nt, Human
caaagcaaggcucaguuugaac

SEQ ID NO: 935249 - RNA, 22 nt, Human
agggcugcugcuccgggcccag

SEQ ID NO: 935250 - RNA, 22 nt, Human
ugaggcagaguaagauacauga

SEQ ID NO: 935251 - RNA, 23 nt, Human
aggcacugaaugugucagugagu

SEQ ID NO: 935252 - RNA, 22 nt, Human
ccugucugaggaggugcucuuu

SEQ ID NO: 935253 - RNA, 22 nt, Human
aguguccaacucagcuugucaa

SEQ ID NO: 935254 - RNA, 22 nt, Human
gaugauggacaaagcauuggug

SEQ ID NO: 935255 - RNA, 22 nt, Human
agaugcuucaguguuuaauuua

SEQ ID NO: 935256 - RNA, 22 nt, Human
augaaaaguucgaucuagaagg

SEQ ID NO: 935257 - RNA, 22 nt, Human
uugggagcuuggacuuagugug

SEQ ID NO: 935258 - RNA, 22 nt, Human
ccugacucuggccaggccagcu

SEQ ID NO: 935259 - RNA, 22 nt, Human
gacccaggaagcuacuucuggu

SEQ ID NO: 935260 - RNA, 22 nt, Human
gcuguucaaaagccacaguuac

SEQ ID NO: 935261 - RNA, 22 nt, Human
caggcagccugagggaucuggg

SEQ ID NO: 935262 - RNA, 22 nt, Human
ccuggaaggugaugguacagca

SEQ ID NO: 935263 - RNA, 22 nt, Human
gaggcaggcccugaaugaguca

SEQ ID NO: 935264 - RNA, 22 nt, Human
ccagccuccauguagauagcug

SEQ ID NO: 935265 - RNA, 22 nt, Human
aguccaggaguugggugacauu

SEQ ID NO: 935266 - RNA, 22 nt, Human
ccugcagaccacacucaguccu

SEQ ID NO: 935267 - RNA, 22 nt, Human
cacauuugaaggaauuagcauu

SEQ ID NO: 935268 - RNA, 23 nt, Human
acucagcuuugggagaugacuca

SEQ ID NO: 935269 - RNA, 23 nt, Human
uugcuucugugcaauucaguacu

SEQ ID NO: 935270 - RNA, 22 nt, Human
aaagauuuaagaauaauuugug

SEQ ID NO: 935271 - RNA, 22 nt, Human
gcugccacuuggucaugucaug

SEQ ID NO: 935272 - RNA, 22 nt, Human
uggaggccagagguacugggac

SEQ ID NO: 935273 - RNA, 22 nt, Human
ucaggaguccugccugcagccu

SEQ ID NO: 935274 - RNA, 22 nt, Human
aggaaagggguagguguggacg

SEQ ID NO: 935275 - RNA, 22 nt, Human
gugcauuugacgaauacucacu

SEQ ID NO: 935276 - RNA, 22 nt, Human
gggagcuguaguccagauaccg

SEQ ID NO: 935277 - RNA, 22 nt, Human
auacaagacucagcacagacgg

SEQ ID NO: 935278 - RNA, 22 nt, Human
agccuucauaaucuugggcuuu

SEQ ID NO: 935279 - RNA, 22 nt, Human
aaaugcaauuguauguacucca

SEQ ID NO: 935280 - RNA, 22 nt, Human
aucuggcuuggguguggguagc

SEQ ID NO: 935281 - RNA, 22 nt, Human
aguggcagagguugacugcagu

SEQ ID NO: 935282 - RNA, 22 nt, Human
gcucugagccgggggccugucc

SEQ ID NO: 935283 - RNA, 19 nt, Human
acuuucuccaggaccuguu

SEQ ID NO: 935284 - RNA, 22 nt, Human
uucuauaagacucauauuucuu

SEQ ID NO: 935285 - RNA, 22 nt, Human
cugagccaguagucagggacaa

SEQ ID NO: 935286 - RNA, 22 nt, Human
ccagagcccgggaccuggacuu

SEQ ID NO: 935287 - RNA, 22 nt, Human
ugguaaaguguacugaauauga

SEQ ID NO: 935288 - RNA, 22 nt, Human
ccucugcucugguccaugugcu

SEQ ID NO: 935289 - RNA, 22 nt, Human
agagccuggacuuuucugagcc

SEQ ID NO: 935290 - RNA, 22 nt, Human
uccaugaggcagggaggcuggc

SEQ ID NO: 935291 - RNA, 21 nt, Human
agagcugggacuugccugaga

SEQ ID NO: 935292 - RNA, 22 nt, Human
agaaauguacgauguuaugcag

SEQ ID NO: 935293 - RNA, 22 nt, Human
cuggccaguugccuuccugggu

SEQ ID NO: 935294 - RNA, 22 nt, Human
ccucccacauccuagcucugcu

SEQ ID NO: 935295 - RNA, 22 nt, Human
uauuuuguuuuguauccacugu

SEQ ID NO: 935296 - RNA, 22 nt, Human
ucugagaggauuccugucccga

SEQ ID NO: 935297 - RNA, 22 nt, Human
ucuggcucuuugggugauugua

SEQ ID NO: 935298 - RNA, 22 nt, Human
ggcugccucaaagcucaagcuc

SEQ ID NO: 935299 - RNA, 22 nt, Human
ccaggagagcauugcacagagg

SEQ ID NO: 935300 - RNA, 22 nt, Human
ccagggugggguccaggaacca

SEQ ID NO: 935301 - RNA, 22 nt, Human
cucuggaguggguggccgggag

SEQ ID NO: 935302 - RNA, 22 nt, Human
ugauuuccacagucaggggugc

SEQ ID NO: 935303 - RNA, 22 nt, Human
ugagggaguuggguguauagga

SEQ ID NO: 935304 - RNA, 22 nt, Human
gguucacauauugagaguauuc

SEQ ID NO: 935305 - RNA, 22 nt, Human
aaauguaguauguugcauguau

SEQ ID NO: 935306 - RNA, 22 nt, Human
agagccugaggccaggaaaaug

SEQ ID NO: 935307 - RNA, 22 nt, Human
ucauacauaacuuguacaguga

SEQ ID NO: 935308 - RNA, 22 nt, Human
ucacauuuguuccucugcacuu

SEQ ID NO: 935309 - RNA, 22 nt, Human
cacuggugacuucugagcugga

SEQ ID NO: 935310 - RNA, 22 nt, Human
guguugaugacauuuuagaaac

SEQ ID NO: 935311 - RNA, 22 nt, Human
acauugaucagccucccaugca

SEQ ID NO: 935312 - RNA, 22 nt, Human
aagauacauaaagguagagucu

SEQ ID NO: 935313 - RNA, 22 nt, Human
aagacuguacauuuuccagucu

SEQ ID NO: 935314 - RNA, 22 nt, Human
uccauguguuuuccuguccaca

SEQ ID NO: 935315 - RNA, 22 nt, Human
cuuucucuguguuucacaugcu

SEQ ID NO: 935316 - RNA, 22 nt, Human
uagggauggcagcauguagcuu

SEQ ID NO: 935317 - RNA, 22 nt, Human
uggcacugaaaaaggagagguu

SEQ ID NO: 935318 - RNA, 23 nt, Human
uggacgccgacuuuggaggcgcu

SEQ ID NO: 935319 - RNA, 22 nt, Human
aauccaggguguggccuuucca

SEQ ID NO: 935320 - RNA, 22 nt, Human
gcccuggccuucaucucagaca

SEQ ID NO: 935321 - RNA, 22 nt, Human
aguccaugguucugacucaucu

SEQ ID NO: 935322 - RNA, 22 nt, Human
uggcagcuaucuuuaaugagau

SEQ ID NO: 935323 - RNA, 22 nt, Human
guggccugccagcagauggcgc

SEQ ID NO: 935324 - RNA, 22 nt, Human
ucaaugauagacaagaucuaag

SEQ ID NO: 935325 - RNA, 22 nt, Human
ugagguguguccccagggaggu

SEQ ID NO: 935326 - RNA, 22 nt, Human
aacauuuaugauugagguaaau

SEQ ID NO: 935327 - RNA, 22 nt, Human
gcaugugucuccccaguggagg

SEQ ID NO: 935328 - RNA, 22 nt, Human
acacauauauacauauuugugc

SEQ ID NO: 935329 - RNA, 22 nt, Human
ugcuuuuaagaacaaugcugcu

SEQ ID NO: 935330 - RNA, 22 nt, Human
ggaugcacgaaggcgccucgga

SEQ ID NO: 935331 - RNA, 22 nt, Human
gcuggcaggagccuuucccuuu

SEQ ID NO: 935332 - RNA, 18 nt, Human
gcugagguggugucagag

SEQ ID NO: 935333 - RNA, 22 nt, Human
uugcauguguaauuuuucuaaa

SEQ ID NO: 935334 - RNA, 22 nt, Human
cagagccucagaauccugugga

SEQ ID NO: 935335 - RNA, 22 nt, Human
uccucaggcggugaggaggggc

SEQ ID NO: 935336 - RNA, 22 nt, Human
aaucauaauucaaauaagcuua

SEQ ID NO: 935337 - RNA, 21 nt, Human
agguggggcugcaccucugcu

SEQ ID NO: 935338 - RNA, 22 nt, Human
gccugagcuacuagggagucug

SEQ ID NO: 935339 - RNA, 22 nt, Human
ucuuuacaucacaauuguaugg

SEQ ID NO: 935340 - RNA, 22 nt, Human
agucuucacucuucacuacuau

SEQ ID NO: 935341 - RNA, 22 nt, Human
ucaguguagcagacuuguagcc

SEQ ID NO: 935342 - RNA, 22 nt, Human
cuccagggaggucugcaggacu

SEQ ID NO: 935343 - RNA, 22 nt, Human
uauuucagguauggugugaaau

SEQ ID NO: 935344 - RNA, 22 nt, Human
ucauuucaaguucugacagcua

SEQ ID NO: 935345 - RNA, 22 nt, Human
uggcccugcacccagagcaguu

SEQ ID NO: 935346 - RNA, 22 nt, Human
guggccugaugccagcccugug

SEQ ID NO: 935347 - RNA, 22 nt, Human
ccagagcccagggucaugcagg

SEQ ID NO: 935348 - RNA, 22 nt, Human
caaauauuccagguacaucccu

SEQ ID NO: 935349 - RNA, 22 nt, Human
uggcacaaaucuagucccuggu

SEQ ID NO: 935350 - RNA, 22 nt, Human
caguagcaggcaggugcuuuug

SEQ ID NO: 935351 - RNA, 22 nt, Human
accugccuaucagcugccugcu

SEQ ID NO: 935352 - RNA, 22 nt, Human
caguagcacucugucagugaag

SEQ ID NO: 935353 - RNA, 22 nt, Human
cugcagaggucuugcugauggu

SEQ ID NO: 935354 - RNA, 22 nt, Human
agggcugcuccuccuucaggcc

SEQ ID NO: 935355 - RNA, 22 nt, Human
cugcagcuuuggaaaccuguuu

SEQ ID NO: 935356 - RNA, 22 nt, Human
aaacauucucagcccugcuugc

SEQ ID NO: 935357 - RNA, 22 nt, Human
ucugaaagaagggcagucuuuu

SEQ ID NO: 935358 - RNA, 22 nt, Human
agaaacugaauuauuucugagg

SEQ ID NO: 935359 - RNA, 22 nt, Human
agucaguguagaaagcccaggc

SEQ ID NO: 935360 - RNA, 22 nt, Human
uaagauaugguaggaaguuugg

SEQ ID NO: 935361 - RNA, 22 nt, Human
ugcucccaggcauucucuguug

SEQ ID NO: 935362 - RNA, 22 nt, Human
cugcagcugucucuacugggca

SEQ ID NO: 935363 - RNA, 22 nt, Human
uugcugaauugaauccuuuggu

SEQ ID NO: 935364 - RNA, 22 nt, Human
caggugggccgggguuuguucu

SEQ ID NO: 935365 - RNA, 22 nt, Human
gcuccuggauguucaagucggc

SEQ ID NO: 935366 - RNA, 22 nt, Human
uuauuaguguugauauuaggau

SEQ ID NO: 935367 - RNA, 22 nt, Human
aaugcuguaaagaugcuaucug

SEQ ID NO: 935368 - RNA, 22 nt, Human
cacaguggauugggugaugccc

SEQ ID NO: 935369 - RNA, 22 nt, Human
uggccucucuaccaggcagccu

SEQ ID NO: 935370 - RNA, 22 nt, Human
guuccaggcaagugggauagga

SEQ ID NO: 935371 - RNA, 22 nt, Human
ucccuggacagccuugccuggg

SEQ ID NO: 935372 - RNA, 22 nt, Human
gugcugugugauccaugcuggc

SEQ ID NO: 935373 - RNA, 22 nt, Human
ugaauggucacugagcaucugu

SEQ ID NO: 935374 - RNA, 22 nt, Human
guggcugcucgggcuccggccc

SEQ ID NO: 935375 - RNA, 22 nt, Human
agucucugucguagaucagcgu

SEQ ID NO: 935376 - RNA, 22 nt, Human
ugaaccaggaggcagccagcac

SEQ ID NO: 935377 - RNA, 20 nt, Human
agaauucuuacccuuugaug

SEQ ID NO: 935378 - RNA, 21 nt, Human
gggugggaggacacagcaggc

SEQ ID NO: 935379 - RNA, 22 nt, Human
gggagguucuguucgcacuuga

SEQ ID NO: 935380 - RNA, 22 nt, Human
uccuggagaauccugccaccug

SEQ ID NO: 935381 - RNA, 22 nt, Human
ugaacaacugcaaaaaucucca

SEQ ID NO: 935382 - RNA, 19 nt, Human
acucaagucuaaugaaauc

SEQ ID NO: 935383 - RNA, 22 nt, Human
ccagcugcugugcagggaggcu

SEQ ID NO: 935384 - RNA, 22 nt, Human
ugaaggccuaacuuccagugcu

SEQ ID NO: 935385 - RNA, 22 nt, Human
cugugucucauccgccucuggc

SEQ ID NO: 935386 - RNA, 20 nt, Human
acuccugguaacuuuuguga

SEQ ID NO: 935387 - RNA, 19 nt, Human
uggagacugagagugagca

SEQ ID NO: 935388 - RNA, 22 nt, Human
ugagagugauugguucgaaugu

SEQ ID NO: 935389 - RNA, 22 nt, Human
guuugcauuccaauuuagggga

SEQ ID NO: 935390 - RNA, 22 nt, Human
uccuggaggggacagcaugggc

SEQ ID NO: 935391 - RNA, 22 nt, Human
uucucuagguuuuagaugaaga

SEQ ID NO: 935392 - RNA, 22 nt, Human
agcuuccaauuucuccaagaga

SEQ ID NO: 935393 - RNA, 22 nt, Human
agcagccacccagcugcucauu

SEQ ID NO: 935394 - RNA, 22 nt, Human
acauuucuucccuuuagcagaa

SEQ ID NO: 935395 - RNA, 22 nt, Human
caggcagcugcgacaagagagc

SEQ ID NO: 935396 - RNA, 22 nt, Human
uguggcccagaugagugugcua

SEQ ID NO: 935397 - RNA, 22 nt, Human
gcuucuggaggagcugggcuga

SEQ ID NO: 935398 - RNA, 22 nt, Human
ucacuguaucauguugcacuua

SEQ ID NO: 935399 - RNA, 22 nt, Human
aggcucagcugguggugaucgc

SEQ ID NO: 935400 - RNA, 21 nt, Human
ggagauggguaucgccugggc

SEQ ID NO: 935401 - RNA, 22 nt, Human
cuuguagaauugaaauggucuc

SEQ ID NO: 935402 - RNA, 22 nt, Human
uugaaaggugacauuguuagag

SEQ ID NO: 935403 - RNA, 22 nt, Human
uacaggaggauuaucaaaggau

SEQ ID NO: 935404 - RNA, 22 nt, Human
gcccucuggcagccuuggcugg

SEQ ID NO: 935405 - RNA, 22 nt, Human
ccaggcugggcuacaaguugag

SEQ ID NO: 935406 - RNA, 22 nt, Human
aaaugcauugguuucuacuugu

SEQ ID NO: 935407 - RNA, 22 nt, Human
uucaaauacauucuuugccacu

SEQ ID NO: 935408 - RNA, 22 nt, Human
aaacaccagcacuguuuacaaa

SEQ ID NO: 935409 - RNA, 22 nt, Human
uccaggagguugagugaguucc

SEQ ID NO: 935410 - RNA, 22 nt, Human
aggccaaagcaagacccuguaa

SEQ ID NO: 935411 - RNA, 22 nt, Human
ugcagaagaauguaggcauaag

SEQ ID NO: 935412 - RNA, 22 nt, Human
ugaacucgggaggaggcugcag

SEQ ID NO: 935413 - RNA, 22 nt, Human
gaccugccugagcugccucugc

SEQ ID NO: 935414 - RNA, 22 nt, Human
gccaggcagcaggaagccagug

SEQ ID NO: 935415 - RNA, 22 nt, Human
aguuauuacucuuuaacauauu

SEQ ID NO: 935416 - RNA, 22 nt, Human
uaaaauugcggugaauauuucc

SEQ ID NO: 935417 - RNA, 22 nt, Human
uucucuuuugugaugugagaug

SEQ ID NO: 935418 - RNA, 22 nt, Human
uuccagauuucuacacaagacc

SEQ ID NO: 935419 - RNA, 22 nt, Human
cggccaagccggggccccgaag

SEQ ID NO: 935420 - RNA, 22 nt, Human
augucuuuggcuuugacauggc

SEQ ID NO: 935421 - RNA, 20 nt, Human
aucagacuugcauuucagga

SEQ ID NO: 935422 - RNA, 22 nt, Human
gagaaagcuucuuucccacagg

SEQ ID NO: 935423 - RNA, 22 nt, Human
cauguguaugcauucauacaua

SEQ ID NO: 935424 - RNA, 22 nt, Human
ggcucuggagcacagacgucug

SEQ ID NO: 935425 - RNA, 22 nt, Human
cagccugcccuggaagcccagc

SEQ ID NO: 935426 - RNA, 22 nt, Human
ugcugcauuuaucuucucaaac

SEQ ID NO: 935427 - RNA, 22 nt, Human
aaaucaguucacguucugaggu

SEQ ID NO: 935428 - RNA, 22 nt, Human
cccaggucuaugccagcucuga

SEQ ID NO: 935429 - RNA, 22 nt, Human
auucauuuagguauucacuuac

SEQ ID NO: 935430 - RNA, 22 nt, Human
agagaggcgaguuaccugugcu

SEQ ID NO: 935431 - RNA, 22 nt, Human
cagagagcuuagugugcugcau

SEQ ID NO: 935432 - RNA, 22 nt, Human
gaggaacccagcugggguugcc

SEQ ID NO: 935433 - RNA, 20 nt, Human
gggugagauguaggagaggg

SEQ ID NO: 935434 - RNA, 19 nt, Human
ccuuggaguuccaggugga

SEQ ID NO: 935435 - RNA, 22 nt, Human
aggccaaagcucaccugcagcu

SEQ ID NO: 935436 - RNA, 22 nt, Human
cagggccuuauccugccauuga

SEQ ID NO: 935437 - RNA, 22 nt, Human
aaagauuugaaauuaggcauca

SEQ ID NO: 935438 - RNA, 22 nt, Human
ccugaggcccuggcugugcuga

SEQ ID NO: 935439 - RNA, 22 nt, Human
gagccaggguuugaaacuagac

SEQ ID NO: 935440 - RNA, 22 nt, Human
agagguagagguugcagugagc

SEQ ID NO: 935441 - RNA, 22 nt, Human
cuagccaugggcauuaaaggua

SEQ ID NO: 935442 - RNA, 22 nt, Human
cacugccuggaaggagagacau

SEQ ID NO: 935443 - RNA, 22 nt, Human
aucuucucauguguaaugaggu

SEQ ID NO: 935444 - RNA, 22 nt, Human
cugaggccuaagacaugaauga

SEQ ID NO: 935445 - RNA, 22 nt, Human
gagaaagauguaggcugggagg

SEQ ID NO: 935446 - RNA, 22 nt, Human
gccagagacacuuggagguaga

SEQ ID NO: 935447 - RNA, 22 nt, Human
ggucccaggauugguugcgcag

SEQ ID NO: 935448 - RNA, 22 nt, Human
cuucugugauuugguuaggaua

SEQ ID NO: 935449 - RNA, 22 nt, Human
acaagcaugggcuuugacauca

SEQ ID NO: 935450 - RNA, 22 nt, Human
aggcuggggaauugaauuugcu

SEQ ID NO: 935451 - RNA, 22 nt, Human
guucacaagaugugguggggag

SEQ ID NO: 935452 - RNA, 20 nt, Human
ccugccuguguuugugauga

SEQ ID NO: 935453 - RNA, 22 nt, Human
cagcugccacaggacuuucuga

SEQ ID NO: 935454 - RNA, 22 nt, Human
ggcaggcagaggcugagacagg

SEQ ID NO: 935455 - RNA, 22 nt, Human
uuagauaacaguagaauaucaa

SEQ ID NO: 935456 - RNA, 22 nt, Human
gcccaggccggagagcagugcu

SEQ ID NO: 935457 - RNA, 22 nt, Human
uggcaacaccuggaagacaugg

SEQ ID NO: 935458 - RNA, 22 nt, Human
ccuugcaggggaacaggcagug

SEQ ID NO: 935459 - RNA, 22 nt, Human
gcuggccauggggagugaggag

SEQ ID NO: 935460 - RNA, 22 nt, Human
uuauguaccugaauuaguaaag

SEQ ID NO: 935461 - RNA, 22 nt, Human
agcccaggugagggguucgaaa

SEQ ID NO: 935462 - RNA, 22 nt, Human
gcuugggagaggguccccagga

SEQ ID NO: 935463 - RNA, 22 nt, Human
uuuauguaauuucauaggugug

SEQ ID NO: 935464 - RNA, 22 nt, Human
gggcucuguccauuccuucaua

SEQ ID NO: 935465 - RNA, 22 nt, Human
gagcucugggaaacaaagugua

SEQ ID NO: 935466 - RNA, 22 nt, Human
ugauacagucagcucacaauug

SEQ ID NO: 935467 - RNA, 22 nt, Human
uggagcugaacuuugaggccag

SEQ ID NO: 935468 - RNA, 22 nt, Human
uaugcacauugguuuccucauu

SEQ ID NO: 935469 - RNA, 22 nt, Human
acaguaauaaguguuggugagg

SEQ ID NO: 935470 - RNA, 22 nt, Human
uugcccagaguccacagcguac

SEQ ID NO: 935471 - RNA, 22 nt, Human
accaggaggccuugguucugag

SEQ ID NO: 935472 - RNA, 22 nt, Human
ccaggaggcagaaguugcagug

SEQ ID NO: 935473 - RNA, 22 nt, Human
caaaaguucucacccagacaug

SEQ ID NO: 935474 - RNA, 22 nt, Human
agcagccaggaaucugcagagc

SEQ ID NO: 935475 - RNA, 22 nt, Human
ggcaaggccugcagcucagugu

SEQ ID NO: 935476 - RNA, 23 nt, Human
uccugagaugagacagugcugcc

SEQ ID NO: 935477 - RNA, 21 nt, Human
auuauuauuucuguguccagc

SEQ ID NO: 935478 - RNA, 19 nt, Human
aguggcagaucuggaagua

SEQ ID NO: 935479 - RNA, 22 nt, Human
uuuccucugagugagcugggag

SEQ ID NO: 935480 - RNA, 22 nt, Human
ucuggcucuaacuaggcaucag

SEQ ID NO: 935481 - RNA, 22 nt, Human
uugaccauaccuccaggcaguu

SEQ ID NO: 935482 - RNA, 22 nt, Human
auuagguugugcuuuguggaca

SEQ ID NO: 935483 - RNA, 22 nt, Human
aggaggcacucacucucagggu

SEQ ID NO: 935484 - RNA, 22 nt, Human
aaaggccacacugcucuuucuc

SEQ ID NO: 935485 - RNA, 22 nt, Human
ccugguggacagcagccagcag

SEQ ID NO: 935486 - RNA, 17 nt, Human
gcuuccugugcugggga

SEQ ID NO: 935487 - RNA, 21 nt, Human
ccacaggggcuccccugucag

SEQ ID NO: 935488 - RNA, 22 nt, Human
agccaaggcagcuagagcucug

SEQ ID NO: 935489 - RNA, 22 nt, Human
ggcuggcuggcugguagacaag

SEQ ID NO: 935490 - RNA, 22 nt, Human
ggcugccauaacagaguaccac

SEQ ID NO: 935491 - RNA, 22 nt, Human
aaaaucugcuuccuuuuacaga

SEQ ID NO: 935492 - RNA, 22 nt, Human
uugaaauaucaaguuauuagug

SEQ ID NO: 935493 - RNA, 22 nt, Human
cagcaggcguugggagaaagac

SEQ ID NO: 935494 - RNA, 22 nt, Human
gcaauaaauaacauggaagaca

SEQ ID NO: 935495 - RNA, 22 nt, Human
accaaggagaaggugcaagcuu

SEQ ID NO: 935496 - RNA, 22 nt, Human
uagauuucucauucauagauug

SEQ ID NO: 935497 - RNA, 22 nt, Human
ggcagagguagcuggaaccagg

SEQ ID NO: 935498 - RNA, 22 nt, Human
ugucagggcaugcgguccagcc

SEQ ID NO: 935499 - RNA, 20 nt, Human
ucagggcaugggacagcccc

SEQ ID NO: 935500 - RNA, 22 nt, Human
aauaaaauggucaguuuucuca

SEQ ID NO: 935501 - RNA, 22 nt, Human
gcagagcugucuaagucacuuc

SEQ ID NO: 935502 - RNA, 22 nt, Human
uucugaggcacuggcucuccca

SEQ ID NO: 935503 - RNA, 22 nt, Human
agggcagcagcccauggcucug

SEQ ID NO: 935504 - RNA, 22 nt, Human
acacauuucuaaauuuuuaccg

SEQ ID NO: 935505 - RNA, 19 nt, Human
agccagggugagaaggagc

SEQ ID NO: 935506 - RNA, 22 nt, Human
cuuauguaaacuacagauaaua

SEQ ID NO: 935507 - RNA, 22 nt, Human
gcagccacugggagugcuuaua

SEQ ID NO: 935508 - RNA, 22 nt, Human
uuucuauaacuggacuggauug

SEQ ID NO: 935509 - RNA, 17 nt, Human
ugcugccaagucccaac

SEQ ID NO: 935510 - RNA, 22 nt, Human
cugagggugcuauucuugccuu

SEQ ID NO: 935511 - RNA, 20 nt, Human
aggcagagcgcacuuuuaga

SEQ ID NO: 935512 - RNA, 22 nt, Human
agcagcuguacuuucaucuguu

SEQ ID NO: 935513 - RNA, 22 nt, Human
gccucugcggggcccgagcccg

SEQ ID NO: 935514 - RNA, 22 nt, Human
aguaaaucagaccucauuaugu

SEQ ID NO: 935515 - RNA, 22 nt, Human
uugaaagugccaaguccuagug

SEQ ID NO: 935516 - RNA, 17 nt, Human
aagacagaagccaugag

SEQ ID NO: 935517 - RNA, 22 nt, Human
cagcugccccuccagggcuggg

SEQ ID NO: 935518 - RNA, 22 nt, Human
acaauacaggcuucuggacuua

SEQ ID NO: 935519 - RNA, 22 nt, Human
uucugagcugcaacacuaacau

SEQ ID NO: 935520 - RNA, 22 nt, Human
caggcagcaucagucugcugua

SEQ ID NO: 935521 - RNA, 22 nt, Human
gcugccuggagcucagccugcc

SEQ ID NO: 935522 - RNA, 22 nt, Human
gccuggcucugagggagcuccu

SEQ ID NO: 935523 - RNA, 22 nt, Human
ccagggugggaggcugaaggcg

SEQ ID NO: 935524 - RNA, 20 nt, Human
acaggggcagcacaauaaug

SEQ ID NO: 935525 - RNA, 22 nt, Human
agugcuuugugcucucacugca

SEQ ID NO: 935526 - RNA, 22 nt, Human
gggcuucucuuaugcuaacugg

SEQ ID NO: 935527 - RNA, 23 nt, Human
gugagucuugccuuugcugugga

SEQ ID NO: 935528 - RNA, 22 nt, Human
ggcaugggccgaggugccuccu

SEQ ID NO: 935529 - RNA, 22 nt, Human
gaggcccuccagcugucagcug

SEQ ID NO: 935530 - RNA, 22 nt, Human
cucuggaguucuucaagcuacu

SEQ ID NO: 935531 - RNA, 22 nt, Human
cagggcuguggcuuugugcugu

SEQ ID NO: 935532 - RNA, 22 nt, Human
aucuggcucacuuagucuagga

SEQ ID NO: 935533 - RNA, 22 nt, Human
aacugcuggggaggccaaacuc

SEQ ID NO: 935534 - RNA, 22 nt, Human
uguacaaugccagggaacacca

SEQ ID NO: 935535 - RNA, 22 nt, Human
ugugggcucccccucacucugu

SEQ ID NO: 935536 - RNA, 22 nt, Human
caaugauggcuaggcagcugcu

SEQ ID NO: 935537 - RNA, 22 nt, Human
gaagagcugcaguuuccugggc

SEQ ID NO: 935538 - RNA, 22 nt, Human
ggggagugacgcagggccauag

SEQ ID NO: 935539 - RNA, 22 nt, Human
uggcucagcugacucggcuucu

SEQ ID NO: 935540 - RNA, 22 nt, Human
gauuucaauccagcuuucuucu

SEQ ID NO: 935541 - RNA, 22 nt, Human
aagcugccuuccaugugaggaa

SEQ ID NO: 935542 - RNA, 22 nt, Human
gagccucguggcggccacugcg

SEQ ID NO: 935543 - RNA, 22 nt, Human
guguccaucagcagccacugug

SEQ ID NO: 935544 - RNA, 22 nt, Human
gccaggagaaaaggcgaaugau

SEQ ID NO: 935545 - RNA, 19 nt, Human
ccuggaggugaagguucuc

SEQ ID NO: 935546 - RNA, 22 nt, Human
ucagggcacaggccuguggguu

SEQ ID NO: 935547 - RNA, 22 nt, Human
gucacuggggccacaugcagaa

SEQ ID NO: 935548 - RNA, 22 nt, Human
cccagcagaccgcugugauggc

SEQ ID NO: 935549 - RNA, 22 nt, Human
caggcagcagaggaguguggga

SEQ ID NO: 935550 - RNA, 22 nt, Human
accuuauuuugaaauagauugu

SEQ ID NO: 935551 - RNA, 22 nt, Human
acugucaccaucagagcgggaa

SEQ ID NO: 935552 - RNA, 22 nt, Human
uauuccagguuucuuguuguau

SEQ ID NO: 935553 - RNA, 22 nt, Human
auguacaguggaaacuaacaaa

SEQ ID NO: 935554 - RNA, 22 nt, Human
uuaugcuaguauaguccuuaga

SEQ ID NO: 935555 - RNA, 22 nt, Human
uuuccucuccggggccuccagg

SEQ ID NO: 935556 - RNA, 22 nt, Human
aggugaaguugaggaggcagaa

SEQ ID NO: 935557 - RNA, 22 nt, Human
ggaaaaggccacagggacacau

SEQ ID NO: 935558 - RNA, 22 nt, Human
cacaggagcuguggggcagugu

SEQ ID NO: 935559 - RNA, 22 nt, Human
gaggcagcaaaauauaucauaa

SEQ ID NO: 935560 - RNA, 22 nt, Human
cagacacagcaauucuguguug

SEQ ID NO: 935561 - RNA, 22 nt, Human
cugccucuugacagaucguggc

SEQ ID NO: 935562 - RNA, 22 nt, Human
cccuggagcuagucugagcaga

SEQ ID NO: 935563 - RNA, 22 nt, Human
gagagugaaggcuucccagcaa

SEQ ID NO: 935564 - RNA, 22 nt, Human
gaggagaggcuggacgcgguga

SEQ ID NO: 935565 - RNA, 22 nt, Human
cuggcagcucugagucccuucu

SEQ ID NO: 935566 - RNA, 22 nt, Human
aguuucauauuaccaugucacc

SEQ ID NO: 935567 - RNA, 22 nt, Human
cccaggagagaggggauaaagc

SEQ ID NO: 935568 - RNA, 20 nt, Human
cagagccaagagcagcaucu

SEQ ID NO: 935569 - RNA, 22 nt, Human
ucacuggggccuuuggucagga

SEQ ID NO: 935570 - RNA, 22 nt, Human
cucuccagccacagaagcugcu

SEQ ID NO: 935571 - RNA, 22 nt, Human
gagccuggccuccugccucagc

SEQ ID NO: 935572 - RNA, 22 nt, Human
gagugcaguuggggugagggga

SEQ ID NO: 935573 - RNA, 22 nt, Human
aacuagaacgucuaguugcugg

SEQ ID NO: 935574 - RNA, 22 nt, Human
aguucucaagacaauuaccugu

SEQ ID NO: 935575 - RNA, 22 nt, Human
cuguaugaggaucagacuggac

SEQ ID NO: 935576 - RNA, 22 nt, Human
auacaaagacaaaucucaaucu

SEQ ID NO: 935577 - RNA, 22 nt, Human
ucuugauuacaaauaacaucau

SEQ ID NO: 935578 - RNA, 22 nt, Human
gggcagcuggcuuauagguuug

SEQ ID NO: 935579 - RNA, 22 nt, Human
uauaaagaaguguaaacaggaa

SEQ ID NO: 935580 - RNA, 22 nt, Human
uucccaggcugugcuaccagag

SEQ ID NO: 935581 - RNA, 23 nt, Human
acagaggcuuaaaugaguggcag

SEQ ID NO: 935582 - RNA, 22 nt, Human
caaaugcagucccuuuguugcu

SEQ ID NO: 935583 - RNA, 22 nt, Human
gaggagaggccaucguuguuau

SEQ ID NO: 935584 - RNA, 22 nt, Human
gucuucuuuaaccuacuaaagc

SEQ ID NO: 935585 - RNA, 22 nt, Human
acagagcaauaacagggagagg

SEQ ID NO: 935586 - RNA, 22 nt, Human
auaaguucagguaaagaaauca

SEQ ID NO: 935587 - RNA, 22 nt, Human
ugccaggaggaggugggacaga

SEQ ID NO: 935588 - RNA, 22 nt, Human
cugggagaugacucagagcagg

SEQ ID NO: 935589 - RNA, 22 nt, Human
aaaucacuaaguuauagugugg

SEQ ID NO: 935590 - RNA, 22 nt, Human
gccuucagcggccgcucgcugc

SEQ ID NO: 935591 - RNA, 22 nt, Human
caaauucucuuacuguuugaca

SEQ ID NO: 935592 - RNA, 22 nt, Human
acagaccaaaaaaggauauugg

SEQ ID NO: 935593 - RNA, 22 nt, Human
uucugucacuuaggaggucaua

SEQ ID NO: 935594 - RNA, 22 nt, Human
ggcagcuuucucacccaugacc

SEQ ID NO: 935595 - RNA, 22 nt, Human
gacagggcgagacucagucuca

SEQ ID NO: 935596 - RNA, 22 nt, Human
cccaggaauuggaggcugcagu

SEQ ID NO: 935597 - RNA, 22 nt, Human
uccugccuucauacugcuguau

SEQ ID NO: 935598 - RNA, 22 nt, Human
gcagacauuuugaaucuaggcu

SEQ ID NO: 935599 - RNA, 22 nt, Human
gcagccacucucauuccacgug

SEQ ID NO: 935600 - RNA, 22 nt, Human
uccauuuuagagaugaagaaac

SEQ ID NO: 935601 - RNA, 22 nt, Human
agaggaugguugaggaagaccu

SEQ ID NO: 935602 - RNA, 22 nt, Human
gugggagcugcuaccuccuucc

SEQ ID NO: 935603 - RNA, 22 nt, Human
gagcagaugugugccaggaugc

SEQ ID NO: 935604 - RNA, 22 nt, Human
gcucaagagagaugcaguucuu

SEQ ID NO: 935605 - RNA, 22 nt, Human
gcaggcucuucuuucugcccag

SEQ ID NO: 935606 - RNA, 19 nt, Human
cagucccaaauucuuguca

SEQ ID NO: 935607 - RNA, 22 nt, Human
aaugaacacagcccucuacuuu

SEQ ID NO: 935608 - RNA, 22 nt, Human
uucuaugccauguucagcuacu

SEQ ID NO: 935609 - RNA, 22 nt, Human
gucaucuuaucauuguugcugu

SEQ ID NO: 935610 - RNA, 22 nt, Human
ggcagcuuguccuggaggaugg

SEQ ID NO: 935611 - RNA, 22 nt, Human
caugggcucuucuggacugcac

SEQ ID NO: 935612 - RNA, 22 nt, Human
agucucagaguaccugagggac

SEQ ID NO: 935613 - RNA, 22 nt, Human
auacuguagaggcauagcuagu

SEQ ID NO: 935614 - RNA, 22 nt, Human
agugcugucccgacaacugagg

SEQ ID NO: 935615 - RNA, 22 nt, Human
aaggugucacugggacaggaaa

SEQ ID NO: 935616 - RNA, 22 nt, Human
uccagucaggcugaauucaagg

SEQ ID NO: 935617 - RNA, 22 nt, Human
auugacaagcaguaugucuuag

SEQ ID NO: 935618 - RNA, 20 nt, Human
aggcucugcauuucugagug

SEQ ID NO: 935619 - RNA, 22 nt, Human
ucugucaggagauuggcagcug

SEQ ID NO: 935620 - RNA, 22 nt, Human
ucagggacugcagagggaagcu

SEQ ID NO: 935621 - RNA, 22 nt, Human
gacuccugccuccucuguuugc

SEQ ID NO: 935622 - RNA, 22 nt, Human
cagguggcaugacugccuacaa

SEQ ID NO: 935623 - RNA, 22 nt, Human
ucuuuuggaaaugaugugcagg

SEQ ID NO: 935624 - RNA, 22 nt, Human
ucaaggugcugugcugugcuag

SEQ ID NO: 935625 - RNA, 22 nt, Human
uaccuauagguacaauuacaag

SEQ ID NO: 935626 - RNA, 22 nt, Human
acugugugggccgcucacuggg

SEQ ID NO: 935627 - RNA, 22 nt, Human
ucucuggaguauaaccagggau

SEQ ID NO: 935628 - RNA, 21 nt, Human
ugcugccauagaccugaggga

SEQ ID NO: 935629 - RNA, 22 nt, Human
aguguuugagacacauuucacu

SEQ ID NO: 935630 - RNA, 22 nt, Human
gugugccaacaaaagacagugc

SEQ ID NO: 935631 - RNA, 22 nt, Human
ggaggacacuggcucugccuuc

SEQ ID NO: 935632 - RNA, 22 nt, Human
uacugccuggagcauuggugcu

SEQ ID NO: 935633 - RNA, 22 nt, Human
acagaaggcggggacaaggcgg

SEQ ID NO: 935634 - RNA, 22 nt, Human
agcagcucaaagccugcaagga

SEQ ID NO: 935635 - RNA, 20 nt, Human
gcagagcuguucugugggga

SEQ ID NO: 935636 - RNA, 22 nt, Human
agagccacugggagacagagca

SEQ ID NO: 935637 - RNA, 22 nt, Human
gaggaggaaacccuguuccucu

SEQ ID NO: 935638 - RNA, 22 nt, Human
aguccaaggagagacagcauuu

SEQ ID NO: 935639 - RNA, 22 nt, Human
ggaggggagucucccaaagccg

SEQ ID NO: 935640 - RNA, 22 nt, Human
uagcacaucuucuuggccugca

SEQ ID NO: 935641 - RNA, 22 nt, Human
cugucuuuuacuaucauuuacu

SEQ ID NO: 935642 - RNA, 22 nt, Human
cagccagggagcaaagaguuga

SEQ ID NO: 935643 - RNA, 22 nt, Human
gcuccuggcucucugagggcug

SEQ ID NO: 935644 - RNA, 19 nt, Human
ccaggagcaguggugagcu

SEQ ID NO: 935645 - RNA, 22 nt, Human
gcaggagagccagcaggcuucc

SEQ ID NO: 935646 - RNA, 22 nt, Human
ucacaaauauuuuaacaguagg

SEQ ID NO: 935647 - RNA, 22 nt, Human
agcugcugcgccucacccuggc

SEQ ID NO: 935648 - RNA, 22 nt, Human
aggauccuguauggagaagcug

SEQ ID NO: 935649 - RNA, 22 nt, Human
cagcaggguuaagugacucacc

SEQ ID NO: 935650 - RNA, 21 nt, Human
aggagcuguguuagcuggucg

SEQ ID NO: 935651 - RNA, 22 nt, Human
cuggcaggaaguuagaugguaa

SEQ ID NO: 935652 - RNA, 22 nt, Human
gagugucugaauuagagcacaa

SEQ ID NO: 935653 - RNA, 22 nt, Human
uugaaaggguuaaagugguaaa

SEQ ID NO: 935654 - RNA, 22 nt, Human
gaggggcuggguagggcaaccc

SEQ ID NO: 935655 - RNA, 22 nt, Human
uucauguguauggaacauuuuu

SEQ ID NO: 935656 - RNA, 22 nt, Human
uaggcagccagcaucaguuggg

SEQ ID NO: 935657 - RNA, 22 nt, Human
agcuucucaggagucugaggca

SEQ ID NO: 935658 - RNA, 22 nt, Human
ucccaggaggugcuuccuagga

SEQ ID NO: 935659 - RNA, 22 nt, Human
uaacauuagguagacauaagcc

SEQ ID NO: 935660 - RNA, 22 nt, Human
uccaggagacacccuugugugu

SEQ ID NO: 935661 - RNA, 22 nt, Human
gcuggcuguguuucaucucuga

SEQ ID NO: 935662 - RNA, 22 nt, Human
uggcagcacuagguacugagcu

SEQ ID NO: 935663 - RNA, 22 nt, Human
gcccaugcucucaggcgggccu

SEQ ID NO: 935664 - RNA, 22 nt, Human
acuuguuuacaagcaguucuga

SEQ ID NO: 935665 - RNA, 22 nt, Human
agauuucaauggauauugcaag

SEQ ID NO: 935666 - RNA, 22 nt, Human
uuagccauuaauguccugugca

SEQ ID NO: 935667 - RNA, 22 nt, Human
ggaaaaggccauuguuucucug

SEQ ID NO: 935668 - RNA, 22 nt, Human
cugcaggcucgaagacacggau

SEQ ID NO: 935669 - RNA, 23 nt, Human
uuugaaguugacugccuuccaga

SEQ ID NO: 935670 - RNA, 20 nt, Human
cagaaggucuaagcuuuaga

SEQ ID NO: 935671 - RNA, 22 nt, Human
ccagaggcuggggaaggauaca

SEQ ID NO: 935672 - RNA, 22 nt, Human
ggcuggaaguccaagaucaaga

SEQ ID NO: 935673 - RNA, 19 nt, Human
uccccagcaccucugaguc

SEQ ID NO: 935674 - RNA, 22 nt, Human
aaggcaggaugggaaaagauuu

SEQ ID NO: 935675 - RNA, 22 nt, Human
gcagacaucaagcacaggccca

SEQ ID NO: 935676 - RNA, 22 nt, Human
uuauuuacaacucuucucuucc

SEQ ID NO: 935677 - RNA, 22 nt, Human
aucagcaagauguaauuucuau

SEQ ID NO: 935678 - RNA, 22 nt, Human
uuaugggagcaauuggggaggu

SEQ ID NO: 935679 - RNA, 22 nt, Human
ggccugagucccaccuggcugu

SEQ ID NO: 935680 - RNA, 22 nt, Human
cuggccaauccauuaauuuguu

SEQ ID NO: 935681 - RNA, 22 nt, Human
ccucagggaaugggaggcuggg

SEQ ID NO: 935682 - RNA, 22 nt, Human
gcuguauuccugcacuguauag

SEQ ID NO: 935683 - RNA, 22 nt, Human
aagcagagcaagcguauuuauu

SEQ ID NO: 935684 - RNA, 22 nt, Human
uucaucaauguguuuaauaaug

SEQ ID NO: 935685 - RNA, 22 nt, Human
auagaacagaaacagaugcaca

SEQ ID NO: 935686 - RNA, 22 nt, Human
auacuuucugaccaauuaauug

SEQ ID NO: 935687 - RNA, 22 nt, Human
agggcuggagccacagcuggga

SEQ ID NO: 935688 - RNA, 22 nt, Human
acagguggcauaggcaguuuga

SEQ ID NO: 935689 - RNA, 22 nt, Human
gggaggucagggugccugcugg

SEQ ID NO: 935690 - RNA, 22 nt, Human
ggugaggcccagugaucugugu

SEQ ID NO: 935691 - RNA, 22 nt, Human
uguuggcagauugucuaggguu

SEQ ID NO: 935692 - RNA, 22 nt, Human
aauucacaugcaugucugugca

SEQ ID NO: 935693 - RNA, 22 nt, Human
ugucaucuucaucauaaguaaa

SEQ ID NO: 935694 - RNA, 22 nt, Human
ugaagcagauggucuggucauu

SEQ ID NO: 935695 - RNA, 22 nt, Human
ggcuggcuuucucuccgcaccu

SEQ ID NO: 935696 - RNA, 22 nt, Human
cuggccaguuguccuggcuugg

SEQ ID NO: 935697 - RNA, 22 nt, Human
cagagcuguccaaacccugaca

SEQ ID NO: 935698 - RNA, 22 nt, Human
gcccaggaagccaccgggaagu

SEQ ID NO: 935699 - RNA, 22 nt, Human
ggauggcagucugcaugagaaa

SEQ ID NO: 935700 - RNA, 22 nt, Human
ggagcugcuuugaucugaagaa

SEQ ID NO: 935701 - RNA, 22 nt, Human
ugcauugauagaaaaacaugga

SEQ ID NO: 935702 - RNA, 22 nt, Human
uggcugcuuguuuuagugaggc

SEQ ID NO: 935703 - RNA, 21 nt, Human
acagacagggccagugucccc

SEQ ID NO: 935704 - RNA, 22 nt, Human
ccacagugguucucaaccaggg

SEQ ID NO: 935705 - RNA, 22 nt, Human
cugagccagggccacacaugga

SEQ ID NO: 935706 - RNA, 22 nt, Human
agccuggaagaaccugaagucu

SEQ ID NO: 935707 - RNA, 22 nt, Human
aacaauaauugcgguucucuau

SEQ ID NO: 935708 - RNA, 22 nt, Human
ugucucugguauuaggugaaaa

SEQ ID NO: 935709 - RNA, 21 nt, Human
cagaggccucaugcucugugc

SEQ ID NO: 935710 - RNA, 22 nt, Human
uccucaggaugugggguagaau

SEQ ID NO: 935711 - RNA, 22 nt, Human
cuccaggccagggaaguggaca

SEQ ID NO: 935712 - RNA, 18 nt, Human
caggaugagugaugggga

SEQ ID NO: 935713 - RNA, 22 nt, Human
ucaaagucauggcuaguaauga

SEQ ID NO: 935714 - RNA, 19 nt, Human
cccagcuugaccaccugcu

SEQ ID NO: 935715 - RNA, 22 nt, Human
aagggagguaaagcuauuuaaa

SEQ ID NO: 935716 - RNA, 22 nt, Human
ugaaggccagcagagugaaggc

SEQ ID NO: 935717 - RNA, 22 nt, Human
uaucuguuaugggcugaauugc

SEQ ID NO: 935718 - RNA, 22 nt, Human
uugaaaggugaacaugaugcac

SEQ ID NO: 935719 - RNA, 22 nt, Human
uagccgggugugguggaacucc

SEQ ID NO: 935720 - RNA, 22 nt, Human
uaacuccaucucugugucugcu

SEQ ID NO: 935721 - RNA, 22 nt, Human
gauggcagucaaccaggugagg

SEQ ID NO: 935722 - RNA, 22 nt, Human
aggaaaaucgagucuggaggca

SEQ ID NO: 935723 - RNA, 22 nt, Human
uacaaaugaccauagccacuua

SEQ ID NO: 935724 - RNA, 22 nt, Human
auuuagaaguuggagggcaaga

SEQ ID NO: 935725 - RNA, 22 nt, Human
gcugcuggcaucuagggggugg

SEQ ID NO: 935726 - RNA, 22 nt, Human
uggcagcagccauggaaggccc

SEQ ID NO: 935727 - RNA, 22 nt, Human
aaggcugagagucacaguccua

SEQ ID NO: 935728 - RNA, 22 nt, Human
ugcaaaugaguugcagaucagg

SEQ ID NO: 935729 - RNA, 22 nt, Human
ucucuucugaaaccugucuuua

SEQ ID NO: 935730 - RNA, 22 nt, Human
auuuguaacacgugacagguug

SEQ ID NO: 935731 - RNA, 22 nt, Human
agggccagaggcaccuugcagc

SEQ ID NO: 935732 - RNA, 22 nt, Human
cuggugugauugagcccaggug

SEQ ID NO: 935733 - RNA, 22 nt, Human
ggccucugguucguggugaccu

SEQ ID NO: 935734 - RNA, 19 nt, Human
auaaggcaggaggaaauuu

SEQ ID NO: 935735 - RNA, 22 nt, Human
ccugcagcuccggauuucuggg

SEQ ID NO: 935736 - RNA, 22 nt, Human
cagucucucagcuuucagcugu

SEQ ID NO: 935737 - RNA, 22 nt, Human
aggagggugauccgggcugguc

SEQ ID NO: 935738 - RNA, 22 nt, Human
cagcugagcaucacuagucugg

SEQ ID NO: 935739 - RNA, 22 nt, Human
aggcucaguuugguuuccauug

SEQ ID NO: 935740 - RNA, 22 nt, Human
cagggagcuggcuggcgugagu

SEQ ID NO: 935741 - RNA, 19 nt, Human
ggaggccuggguauuugcc

SEQ ID NO: 935742 - RNA, 22 nt, Human
uggcucaguuucugcccagcug

SEQ ID NO: 935743 - RNA, 22 nt, Human
cugccugcuuaccaugcaucag

SEQ ID NO: 935744 - RNA, 22 nt, Human
uuuguaugugauaagacuauuc

SEQ ID NO: 935745 - RNA, 22 nt, Human
cagcacuggggggauucggagc

SEQ ID NO: 935746 - RNA, 20 nt, Human
cugagccaacucucuucuug

SEQ ID NO: 935747 - RNA, 22 nt, Human
uucuucuuuaucucaguauccu

SEQ ID NO: 935748 - RNA, 22 nt, Human
aagcuccccgaaacccaccucu

SEQ ID NO: 935749 - RNA, 22 nt, Human
agcagagguguuuauuauggga

SEQ ID NO: 935750 - RNA, 22 nt, Human
ggaagagccuggggugucaggc

SEQ ID NO: 935751 - RNA, 22 nt, Human
ggcagggugccuggcuccuguu

SEQ ID NO: 935752 - RNA, 22 nt, Human
auaaaaccaaagcagcaguguu

SEQ ID NO: 935753 - RNA, 22 nt, Human
ugucauuuaguccucugugugu

SEQ ID NO: 935754 - RNA, 22 nt, Human
cugugauuguuaguuccuauac

SEQ ID NO: 935755 - RNA, 22 nt, Human
aaagccuuggucaucugguucc

SEQ ID NO: 935756 - RNA, 22 nt, Human
gucugucucccugugacugaga

SEQ ID NO: 935757 - RNA, 22 nt, Human
cugcagugaaaucaggaagcaa

SEQ ID NO: 935758 - RNA, 22 nt, Human
aaauguagaccuauagggaccu

SEQ ID NO: 935759 - RNA, 22 nt, Human
aggcucagagaugaguaagcac

SEQ ID NO: 935760 - RNA, 22 nt, Human
ccauggcauuuuaugugucuua

SEQ ID NO: 935761 - RNA, 22 nt, Human
aaaccgcaauuacuuuugcguc

SEQ ID NO: 935762 - RNA, 22 nt, Human
aagucauuaucucuucuaaucu

SEQ ID NO: 935763 - RNA, 22 nt, Human
cagcuccccucuguggggcagu

SEQ ID NO: 935764 - RNA, 22 nt, Human
gcuaggagauugagcucugaag

SEQ ID NO: 935765 - RNA, 22 nt, Human
ugaaaguuacaggaaaacagau

SEQ ID NO: 935766 - RNA, 22 nt, Human
aacucaguuacauauuagaaua

SEQ ID NO: 935767 - RNA, 22 nt, Human
cuaaaugccuuuccuaccuaac

SEQ ID NO: 935768 - RNA, 22 nt, Human
gccugaugagcuuccagcugag

SEQ ID NO: 935769 - RNA, 22 nt, Human
agugaaaugauaguguaaauac

SEQ ID NO: 935770 - RNA, 22 nt, Human
agccagggacgcugcaggcuac

SEQ ID NO: 935771 - RNA, 22 nt, Human
caguagcacuagauaugugugg

SEQ ID NO: 935772 - RNA, 23 nt, Human
agccucuuuucuccugcccugca

SEQ ID NO: 935773 - RNA, 22 nt, Human
aaaacuaaauacgcuuugccuc

SEQ ID NO: 935774 - RNA, 22 nt, Human
gucaaauauacuaagagguaaa

SEQ ID NO: 935775 - RNA, 22 nt, Human
uaucuuuagaggaagagaaucu

SEQ ID NO: 935776 - RNA, 22 nt, Human
aacaaaccuucccuauacgucu

SEQ ID NO: 935777 - RNA, 22 nt, Human
cugaagccaugugcucacuggu

SEQ ID NO: 935778 - RNA, 22 nt, Human
gcacagaacuucucuuaguagg

SEQ ID NO: 935779 - RNA, 22 nt, Human
ccucuguccuggggaguggagc

SEQ ID NO: 935780 - RNA, 22 nt, Human
gaggaggcuuccgggaggcacg

SEQ ID NO: 935781 - RNA, 22 nt, Human
uuggccaaccagaacggagguc

SEQ ID NO: 935782 - RNA, 19 nt, Human
gaaggagagcugaguuagg

SEQ ID NO: 935783 - RNA, 22 nt, Human
acauccauguuguaauguuccu

SEQ ID NO: 935784 - RNA, 22 nt, Human
ggccuuggugccauggccaguu

SEQ ID NO: 935785 - RNA, 22 nt, Human
uagagcaguuggcagcuguauu

SEQ ID NO: 935786 - RNA, 22 nt, Human
gcccucucggcauagcaggggc

SEQ ID NO: 935787 - RNA, 20 nt, Human
ccucaagcagacugacagcu

SEQ ID NO: 935788 - RNA, 21 nt, Human
ccaggaaggacugagcucccu

SEQ ID NO: 935789 - RNA, 22 nt, Human
ucccagaagugaaauuucuaga

SEQ ID NO: 935790 - RNA, 16 nt, Human
ggagagugucugcaaa

SEQ ID NO: 935791 - RNA, 22 nt, Human
cccuggggcugagggauggccg

SEQ ID NO: 935792 - RNA, 22 nt, Human
agcugcccccagggcugugcuu

SEQ ID NO: 935793 - RNA, 22 nt, Human
caggagaucuuaggaauucuua

SEQ ID NO: 935794 - RNA, 22 nt, Human
uaauuucuaauucauuuucagu

SEQ ID NO: 935795 - RNA, 22 nt, Human
gagcaggccagcaauggaaggg

SEQ ID NO: 935796 - RNA, 22 nt, Human
uggccuuggacagagcgcuccu

SEQ ID NO: 935797 - RNA, 22 nt, Human
ggcucugcuucagaaggcucau

SEQ ID NO: 935798 - RNA, 22 nt, Human
cugugccaggcccagcugacuu

SEQ ID NO: 935799 - RNA, 22 nt, Human
caucagcacuaugauuaaagua

SEQ ID NO: 935800 - RNA, 22 nt, Human
cuuuccuagauggccaucuuuc

SEQ ID NO: 935801 - RNA, 22 nt, Human
uuugaaauaugaggcauuauga

SEQ ID NO: 935802 - RNA, 22 nt, Human
gcucuguguugucagaggcacc

SEQ ID NO: 935803 - RNA, 22 nt, Human
cugugugugucugcagcauacu

SEQ ID NO: 935804 - RNA, 22 nt, Human
ccacagaggacaacugccuggc

SEQ ID NO: 935805 - RNA, 19 nt, Human
cauuaggauuagagacaag

SEQ ID NO: 935806 - RNA, 23 nt, Human
gucagggcuggggucagagugac

SEQ ID NO: 935807 - RNA, 22 nt, Human
gaaauaguacagcauaguucuu

SEQ ID NO: 935808 - RNA, 22 nt, Human
cagcuugcuaauuuugacuuca

SEQ ID NO: 935809 - RNA, 22 nt, Human
gaggggcuugaggcccugaugg

SEQ ID NO: 935810 - RNA, 22 nt, Human
ugugccagccucuggcuguguc

SEQ ID NO: 935811 - RNA, 19 nt, Human
agaguauugaauuugcccu

SEQ ID NO: 935812 - RNA, 22 nt, Human
ugcaggagaaaguacggagcgu

SEQ ID NO: 935813 - RNA, 22 nt, Human
gcagaggccaggccaccagcaa

SEQ ID NO: 935814 - RNA, 22 nt, Human
cugggagcaagaggcugcaaau

SEQ ID NO: 935815 - RNA, 22 nt, Human
uaggaggguuagagggaaauau

SEQ ID NO: 935816 - RNA, 22 nt, Human
aagagcuguaugccauaugauu

SEQ ID NO: 935817 - RNA, 20 nt, Human
aagagcauaguacaggaaga

SEQ ID NO: 935818 - RNA, 22 nt, Human
gucagcagugucagcucugggg

SEQ ID NO: 935819 - RNA, 22 nt, Human
auacaucuuccuuuuaaaaugc

SEQ ID NO: 935820 - RNA, 23 nt, Human
ggcagcucucaucugaugacuga

SEQ ID NO: 935821 - RNA, 22 nt, Human
cuuuuuaucucuuaaugauguu

SEQ ID NO: 935822 - RNA, 22 nt, Human
agcaugcugguguucauggcag

SEQ ID NO: 935823 - RNA, 22 nt, Human
aaauuauuacaagcuaguuggc

SEQ ID NO: 935824 - RNA, 22 nt, Human
aagcugcccuguguuagaguuc

SEQ ID NO: 935825 - RNA, 22 nt, Human
agacagaacagaauaauuguug

SEQ ID NO: 935826 - RNA, 22 nt, Human
aacuucugggcuguccaaaacu

SEQ ID NO: 935827 - RNA, 22 nt, Human
agacagcaugauacaugaugcu

SEQ ID NO: 935828 - RNA, 22 nt, Human
ucuccucaccaccagcagcaga

SEQ ID NO: 935829 - RNA, 22 nt, Human
gcauggcagccaguacauggug

SEQ ID NO: 935830 - RNA, 19 nt, Human
gcagcugcuugaaaagaaa

SEQ ID NO: 935831 - RNA, 22 nt, Human
cacaaugcguacauauaucaaa

SEQ ID NO: 935832 - RNA, 22 nt, Human
cugugucuuuccuacuuugugg

SEQ ID NO: 935833 - RNA, 22 nt, Human
auuaggauguguauauuguguu

SEQ ID NO: 935834 - RNA, 22 nt, Human
ugaggcaguauuuuagugacuu

SEQ ID NO: 935835 - RNA, 22 nt, Human
gagcucagauucuggugucaga

SEQ ID NO: 935836 - RNA, 22 nt, Human
gcuggcagggugguugagagag

SEQ ID NO: 935837 - RNA, 22 nt, Human
gauccuugcacuugacuuggca

SEQ ID NO: 935838 - RNA, 22 nt, Human
ucaggaucggccuuuuuuuaag

SEQ ID NO: 935839 - RNA, 22 nt, Human
uucuuuccaaccagauauuggu

SEQ ID NO: 935840 - RNA, 22 nt, Human
caugugugacaaacugccugca

SEQ ID NO: 935841 - RNA, 22 nt, Human
uaaagcaggccacauaugugau

SEQ ID NO: 935842 - RNA, 22 nt, Human
ugugccaggcacuugcccaggc

SEQ ID NO: 935843 - RNA, 22 nt, Human
acagggaacaggaauauacaaa

SEQ ID NO: 935844 - RNA, 22 nt, Human
ucaucacucauuggacaacaga

SEQ ID NO: 935845 - RNA, 22 nt, Human
cugggaggauucauugagguga

SEQ ID NO: 935846 - RNA, 22 nt, Human
ggucugaguggugcugacucag

SEQ ID NO: 935847 - RNA, 23 nt, Human
ggcacugaagcuacaauggugag

SEQ ID NO: 935848 - RNA, 22 nt, Human
augauucagcaauuuuauaucu

SEQ ID NO: 935849 - RNA, 22 nt, Human
ucuuugaacuuggcugaucucu

SEQ ID NO: 935850 - RNA, 22 nt, Human
agcagggcucuguggagggugg

SEQ ID NO: 935851 - RNA, 22 nt, Human
uuagaaaggaaucuucauuuca

SEQ ID NO: 935852 - RNA, 22 nt, Human
cccuggagggacagcugcucua

SEQ ID NO: 935853 - RNA, 20 nt, Human
cagcucugggaaagaggcca

SEQ ID NO: 935854 - RNA, 22 nt, Human
aaagauuauggcauugaaauac

SEQ ID NO: 935855 - RNA, 22 nt, Human
cuuacauugugugcaugagggg

SEQ ID NO: 935856 - RNA, 22 nt, Human
aaaguauuuuugacaggcauua

SEQ ID NO: 935857 - RNA, 22 nt, Human
cugccucaugcugccugcagcc

SEQ ID NO: 935858 - RNA, 22 nt, Human
aaauaguuacuucugcugucuu

SEQ ID NO: 935859 - RNA, 22 nt, Human
uggcagaguaggauggcccugu

SEQ ID NO: 935860 - RNA, 22 nt, Human
uuugaauguuuuagguacuuaa

SEQ ID NO: 935861 - RNA, 22 nt, Human
ugaaaaacuuuaauccauaaag

SEQ ID NO: 935862 - RNA, 22 nt, Human
agcagccagugggagugauaca

SEQ ID NO: 935863 - RNA, 22 nt, Human
ggagaugguggaagcuggugca

SEQ ID NO: 935864 - RNA, 21 nt, Human
ugcagaggcacaaacaagccc

SEQ ID NO: 935865 - RNA, 19 nt, Human
uccucagugacaaccucag

SEQ ID NO: 935866 - RNA, 22 nt, Human
aagauaaacucuugauuucuga

SEQ ID NO: 935867 - RNA, 20 nt, Human
caggccucugggggcccugg

SEQ ID NO: 935868 - RNA, 19 nt, Human
uccugggcugggccagguc

SEQ ID NO: 935869 - RNA, 22 nt, Human
uacaccuuaaucauaugugucu

SEQ ID NO: 935870 - RNA, 22 nt, Human
gcacacaguauaugcucauuaa

SEQ ID NO: 935871 - RNA, 22 nt, Human
ucccugggguaacauuagaggg

SEQ ID NO: 935872 - RNA, 22 nt, Human
augcugugguagacagcauucc

SEQ ID NO: 935873 - RNA, 22 nt, Human
uaggcagcagugcuaugauucu

SEQ ID NO: 935874 - RNA, 22 nt, Human
uaaggccaaggggccauagucu

SEQ ID NO: 935875 - RNA, 22 nt, Human
gggcuacagacaugcucuaagc

SEQ ID NO: 935876 - RNA, 22 nt, Human
uugaagcaggaaaauuucuauu

SEQ ID NO: 935877 - RNA, 22 nt, Human
caggaucuuuuaaugucuccag

SEQ ID NO: 935878 - RNA, 22 nt, Human
uggggccuggucagagcugcac

SEQ ID NO: 935879 - RNA, 22 nt, Human
ggaaagagcuaaaagggugaga

SEQ ID NO: 935880 - RNA, 18 nt, Human
ucauuagggauugcaaag

SEQ ID NO: 935881 - RNA, 22 nt, Human
aaaacuccugaaauuguuuccc

SEQ ID NO: 935882 - RNA, 22 nt, Human
gugggugauguacuggaggcca

SEQ ID NO: 935883 - RNA, 22 nt, Human
aaagacuagcauuuauauguac

SEQ ID NO: 935884 - RNA, 22 nt, Human
caggcagccugcggucugcaca

SEQ ID NO: 935885 - RNA, 22 nt, Human
gcucaggaaacagcagggcuug

SEQ ID NO: 935886 - RNA, 22 nt, Human
gggauggggucaacauguaccu

SEQ ID NO: 935887 - RNA, 22 nt, Human
gaggcugcuuugaugacaggag

SEQ ID NO: 935888 - RNA, 18 nt, Human
aaguaugccuauguuauu

SEQ ID NO: 935889 - RNA, 22 nt, Human
aaggagagagcuuugcuggaac

SEQ ID NO: 935890 - RNA, 21 nt, Human
aagcaggacauaugaugcccu

SEQ ID NO: 935891 - RNA, 22 nt, Human
uagcuuuguguaugaugucugu

SEQ ID NO: 935892 - RNA, 22 nt, Human
ucauuuguucucauucucuacu

SEQ ID NO: 935893 - RNA, 22 nt, Human
uaaacauggauucugaucacag

SEQ ID NO: 935894 - RNA, 22 nt, Human
cuguggaaauaaacaaugcuaa

SEQ ID NO: 935895 - RNA, 22 nt, Human
uggcucagcagguuagaaacua

SEQ ID NO: 935896 - RNA, 22 nt, Human
cuccucuggaaauuccucugcc

SEQ ID NO: 935897 - RNA, 22 nt, Human
ccaggggcuggugcugagcugg

SEQ ID NO: 935898 - RNA, 18 nt, Human
augggaggggccaagaga

SEQ ID NO: 935899 - RNA, 22 nt, Human
gcuggagauaguaggauccaua

SEQ ID NO: 935900 - RNA, 22 nt, Human
acacauuuaaaaaggaacauau

SEQ ID NO: 935901 - RNA, 22 nt, Human
acaagaauuuacauguagugga

SEQ ID NO: 935902 - RNA, 22 nt, Human
ucugugccuccguaacacacca

SEQ ID NO: 935903 - RNA, 22 nt, Human
uaaggcacacaguugcugcaug

SEQ ID NO: 935904 - RNA, 22 nt, Human
uagacacaagagaaggguauaa

SEQ ID NO: 935905 - RNA, 22 nt, Human
uacauucuggaaaggcacagac

SEQ ID NO: 935906 - RNA, 19 nt, Human
gcagcugugggaagagcca

SEQ ID NO: 935907 - RNA, 22 nt, Human
aagucuguagaaaaacaguuua

SEQ ID NO: 935908 - RNA, 21 nt, Human
ugcaggagucugugagucagg

SEQ ID NO: 935909 - RNA, 22 nt, Human
cagcagcugcgugcccaggccg

SEQ ID NO: 935910 - RNA, 22 nt, Human
cuggugcuggagccuagucccu

SEQ ID NO: 935911 - RNA, 19 nt, Human
acagaaauuaguuauuuuc

SEQ ID NO: 935912 - RNA, 22 nt, Human
uguaugcagggcuuguaugcag

SEQ ID NO: 935913 - RNA, 22 nt, Human
gaagccaagugcaaaugccuua

SEQ ID NO: 935914 - RNA, 23 nt, Human
ucugagagaacaaugccuccuau

SEQ ID NO: 935915 - RNA, 22 nt, Human
aacuuucagaauccuaugcauu

SEQ ID NO: 935916 - RNA, 22 nt, Human
ugcccaagcagaggagugauuc

SEQ ID NO: 935917 - RNA, 22 nt, Human
gcugugugcucacguaguggaa

SEQ ID NO: 935918 - RNA, 22 nt, Human
ccaggagccacucaggcccaca

SEQ ID NO: 935919 - RNA, 22 nt, Human
ggguccaggucuucaggcagag

SEQ ID NO: 935920 - RNA, 22 nt, Human
cagaagaggacuggguagcuca

SEQ ID NO: 935921 - RNA, 22 nt, Human
ggagugaguacuggaguagcug

SEQ ID NO: 935922 - RNA, 22 nt, Human
cugcuguguugccagugucacc

SEQ ID NO: 935923 - RNA, 22 nt, Human
ucucacugggucacagcagagg

SEQ ID NO: 935924 - RNA, 23 nt, Human
ugagcugguauuguccaucucca

SEQ ID NO: 935925 - RNA, 22 nt, Human
ccugucauacuaacguaguggg

SEQ ID NO: 935926 - RNA, 22 nt, Human
caggcagcugggucaccguccc

SEQ ID NO: 935927 - RNA, 22 nt, Human
aauuuccagaucagaugacuca

SEQ ID NO: 935928 - RNA, 22 nt, Human
ucauaaaacacaccagguaguu

SEQ ID NO: 935929 - RNA, 22 nt, Human
gugcuuucugcaugguuccuac

SEQ ID NO: 935930 - RNA, 22 nt, Human
uccuggccucgcuguccaccuu

SEQ ID NO: 935931 - RNA, 22 nt, Human
caguucucuuuccacuggaggc

SEQ ID NO: 935932 - RNA, 22 nt, Human
ucagaggguggcugggagcauc

SEQ ID NO: 935933 - RNA, 23 nt, Human
aguuuguaaagaaauauuugcac

SEQ ID NO: 935934 - RNA, 21 nt, Human
gccauuguuuucuaccuggag

SEQ ID NO: 935935 - RNA, 22 nt, Human
gcacacccucucaccagcacug

SEQ ID NO: 935936 - RNA, 22 nt, Human
uuccaggaagauucaacaaaag

SEQ ID NO: 935937 - RNA, 22 nt, Human
guuuaagaggguuucauuccca

SEQ ID NO: 935938 - RNA, 18 nt, Human
uccauuguucuacuguga

SEQ ID NO: 935939 - RNA, 22 nt, Human
agaaaagggcaggagggauaca

SEQ ID NO: 935940 - RNA, 22 nt, Human
gcugcccaggagagguggggcu

SEQ ID NO: 935941 - RNA, 22 nt, Human
gcugccugccuaguuccacagu

SEQ ID NO: 935942 - RNA, 22 nt, Human
uagaaacugauagucuugugcu

SEQ ID NO: 935943 - RNA, 22 nt, Human
uguguacagcaggauuucucaa

SEQ ID NO: 935944 - RNA, 19 nt, Human
caugagcugcucacuuccc

SEQ ID NO: 935945 - RNA, 22 nt, Human
ucucagagcuucagaaagcacc

SEQ ID NO: 935946 - RNA, 22 nt, Human
caguugcuacaguucaagugug

SEQ ID NO: 935947 - RNA, 22 nt, Human
auuauguaacugugguucagca

SEQ ID NO: 935948 - RNA, 22 nt, Human
aagccucuggggccucaucugu

SEQ ID NO: 935949 - RNA, 22 nt, Human
ugggcacuauggcucugugcac

SEQ ID NO: 935950 - RNA, 22 nt, Human
aaagucauacauggugcuuacu

SEQ ID NO: 935951 - RNA, 22 nt, Human
cugaggucucuuuccauaguga

SEQ ID NO: 935952 - RNA, 22 nt, Human
cagaguguaucuguguaagcau

SEQ ID NO: 935953 - RNA, 22 nt, Human
uucagcaaauggacuguucagg

SEQ ID NO: 935954 - RNA, 22 nt, Human
uugcagagaucagcagguuuga

SEQ ID NO: 935955 - RNA, 22 nt, Human
aucagcaagcauuuauugagug

SEQ ID NO: 935956 - RNA, 22 nt, Human
cuggcagguuuggugucuggug

SEQ ID NO: 935957 - RNA, 22 nt, Human
gccuucagcccugacuggccag

SEQ ID NO: 935958 - RNA, 22 nt, Human
acuuguucauugaguacauaug

SEQ ID NO: 935959 - RNA, 22 nt, Human
uggcucucaggccugcugcguu

SEQ ID NO: 935960 - RNA, 22 nt, Human
uuucagaugcaauuaauuuuca

SEQ ID NO: 935961 - RNA, 22 nt, Human
ugcaaacaggagaguaaguaua

SEQ ID NO: 935962 - RNA, 22 nt, Human
acucccagguugccuggcaggc

SEQ ID NO: 935963 - RNA, 22 nt, Human
cugcagcuauauuuucccacag

SEQ ID NO: 935964 - RNA, 22 nt, Human
caggggcugugggcggagccuc

SEQ ID NO: 935965 - RNA, 22 nt, Human
uuucuaaaugguggcugcauug

SEQ ID NO: 935966 - RNA, 22 nt, Human
uuugcauuuguucaaguauuga

SEQ ID NO: 935967 - RNA, 19 nt, Human
gguaaaagugagcuucagg

SEQ ID NO: 935968 - RNA, 22 nt, Human
uuagaaaaaggcuguggucuua

SEQ ID NO: 935969 - RNA, 22 nt, Human
gaggcagcugaagcuucaaaga

SEQ ID NO: 935970 - RNA, 22 nt, Human
acugccuugucucuugccuguu

SEQ ID NO: 935971 - RNA, 22 nt, Human
cccagccaaggugcugguguug

SEQ ID NO: 935972 - RNA, 20 nt, Human
gcuuuuucuaauagcagucc

SEQ ID NO: 935973 - RNA, 22 nt, Human
uccuuccuggggucucugcugc

SEQ ID NO: 935974 - RNA, 22 nt, Human
acaguaccugcucucaagcaaa

SEQ ID NO: 935975 - RNA, 22 nt, Human
cacuggggugggccugguagag

SEQ ID NO: 935976 - RNA, 22 nt, Human
uugcuauuuugagagucauagu

SEQ ID NO: 935977 - RNA, 22 nt, Human
aaugauguauuaguacaacaca

SEQ ID NO: 935978 - RNA, 22 nt, Human
ccacagccauuccagggaggcu

SEQ ID NO: 935979 - RNA, 19 nt, Human
gucaucuuuuaauaaugug

SEQ ID NO: 935980 - RNA, 22 nt, Human
cugcucugaguauuaacggagg

SEQ ID NO: 935981 - RNA, 19 nt, Human
cucuggagcagacacugga

SEQ ID NO: 935982 - RNA, 22 nt, Human
aggguagguguaagauagcccu

SEQ ID NO: 935983 - RNA, 22 nt, Human
uuacaguauuguuaaacucuuu

SEQ ID NO: 935984 - RNA, 22 nt, Human
cuuggcagcuuuuggaggagcc

SEQ ID NO: 935985 - RNA, 22 nt, Human
cugaggcuggggaagggaagug

SEQ ID NO: 935986 - RNA, 22 nt, Human
agaggggaguccuaaucugauu

SEQ ID NO: 935987 - RNA, 22 nt, Human
cugugcuucgcaacuccaaggu

SEQ ID NO: 935988 - RNA, 22 nt, Human
uccugccuaccuugcggaggug

SEQ ID NO: 935989 - RNA, 22 nt, Human
uugaggaguguuuagggugagg

SEQ ID NO: 935990 - RNA, 22 nt, Human
agaaggccuaacuugggggcaa

SEQ ID NO: 935991 - RNA, 22 nt, Human
cagagcuggagcuugaauggag

SEQ ID NO: 935992 - RNA, 22 nt, Human
cuggaaugccucccugucagag

SEQ ID NO: 935993 - RNA, 22 nt, Human
cagaaauucccauuucagauuc

SEQ ID NO: 935994 - RNA, 22 nt, Human
aaagauuuaugaaguucaauua

SEQ ID NO: 935995 - RNA, 22 nt, Human
ggcagcuggguuggccagaaac

SEQ ID NO: 935996 - RNA, 22 nt, Human
gcuccuggccagcacagggccc

SEQ ID NO: 935997 - RNA, 22 nt, Human
cagcucuguaaauuccuucauc

SEQ ID NO: 935998 - RNA, 22 nt, Human
gcugcaggcauuuuccugggca

SEQ ID NO: 935999 - RNA, 23 nt, Human
cauguacacacagcuguacagug

SEQ ID NO: 936000 - RNA, 22 nt, Human
auuagcugaccucuaaggagcc

SEQ ID NO: 936001 - RNA, 22 nt, Human
cagcugccacaccucuuucucu

SEQ ID NO: 936002 - RNA, 22 nt, Human
agcugcucuuugaaggacacuu

SEQ ID NO: 936003 - RNA, 22 nt, Human
cccaagaucuuucgugcacuaa

SEQ ID NO: 936004 - RNA, 22 nt, Human
ugacacagaaauuaagcuguca

SEQ ID NO: 936005 - RNA, 22 nt, Human
gcucuggacccuggaguggcug

SEQ ID NO: 936006 - RNA, 22 nt, Human
gagcagugacuggagcaugaga

SEQ ID NO: 936007 - RNA, 22 nt, Human
cuucucagaggccagaagcuau

SEQ ID NO: 936008 - RNA, 22 nt, Human
cccacagguccccaugaacucg

SEQ ID NO: 936009 - RNA, 22 nt, Human
auuuccaguccuaaugaucugg

SEQ ID NO: 936010 - RNA, 22 nt, Human
uuccucuccucccaccagguga

SEQ ID NO: 936011 - RNA, 23 nt, Human
uacuuaggaauggggacggcaag

SEQ ID NO: 936012 - RNA, 22 nt, Human
uucaagauggccccagugagcc

SEQ ID NO: 936013 - RNA, 22 nt, Human
uaaggccaccguuauagaacca

SEQ ID NO: 936014 - RNA, 22 nt, Human
agauuucagguuggggcagaag

SEQ ID NO: 936015 - RNA, 19 nt, Human
aucuuacagagcagaguac

SEQ ID NO: 936016 - RNA, 23 nt, Human
uucauuugucuacuucacuuguu

SEQ ID NO: 936017 - RNA, 22 nt, Human
ggugaaggcacaagagggcaag

SEQ ID NO: 936018 - RNA, 22 nt, Human
aaaguguggagauugaacuaaa

SEQ ID NO: 936019 - RNA, 22 nt, Human
ucuggccagcaugagaccuggu

SEQ ID NO: 936020 - RNA, 22 nt, Human
ugauuucaaguagugacaugcu

SEQ ID NO: 936021 - RNA, 21 nt, Human
aggcaucuaaagagaguagac

SEQ ID NO: 936022 - RNA, 22 nt, Human
gaccaaggaagaggggagccag

SEQ ID NO: 936023 - RNA, 22 nt, Human
uuguaacacuuuucuauuaaua

SEQ ID NO: 936024 - RNA, 21 nt, Human
aggggacagaguagcuccagg

SEQ ID NO: 936025 - RNA, 22 nt, Human
aggccagcagcaugacggcauc

SEQ ID NO: 936026 - RNA, 22 nt, Human
ugggcagagucauacaggagac

SEQ ID NO: 936027 - RNA, 22 nt, Human
uggccuuguguuuuagagaaag

SEQ ID NO: 936028 - RNA, 22 nt, Human
ugucccauggacacaacuucuu

SEQ ID NO: 936029 - RNA, 22 nt, Human
agaggcuccuucacucuggcac

SEQ ID NO: 936030 - RNA, 22 nt, Human
aggccagcgcugcuagcucccg

SEQ ID NO: 936031 - RNA, 22 nt, Human
cacaaauggccguguucaaaga

SEQ ID NO: 936032 - RNA, 22 nt, Human
cugccagucuaugcugcucggc

SEQ ID NO: 936033 - RNA, 22 nt, Human
uaaauucccaacucugcucuuc

SEQ ID NO: 936034 - RNA, 22 nt, Human
aaugcacagcuaaagugguucc

SEQ ID NO: 936035 - RNA, 22 nt, Human
ucucugggauaaacugggccag

SEQ ID NO: 936036 - RNA, 20 nt, Human
uugauucccucuaaacucgc

SEQ ID NO: 936037 - RNA, 22 nt, Human
auuuaaauuuucugauggagag

SEQ ID NO: 936038 - RNA, 22 nt, Human
cuggcugcaggaaggagugggc

SEQ ID NO: 936039 - RNA, 23 nt, Human
agaggccaacuucuugccccucc

SEQ ID NO: 936040 - RNA, 18 nt, Human
uucagcagcagacacacu

SEQ ID NO: 936041 - RNA, 22 nt, Human
ugugucccuuggaaccucagcu

SEQ ID NO: 936042 - RNA, 18 nt, Human
uggagcagguaggcauga

SEQ ID NO: 936043 - RNA, 22 nt, Human
ccuugcugcgugcuagcacaga

SEQ ID NO: 936044 - RNA, 22 nt, Human
uuggcuuccaggaucucagcag

SEQ ID NO: 936045 - RNA, 17 nt, Human
aucuggcugcuucuaga

SEQ ID NO: 936046 - RNA, 22 nt, Human
gaauauuaguaucaguuauacc

SEQ ID NO: 936047 - RNA, 21 nt, Human
ucccagggccaggugccauca

SEQ ID NO: 936048 - RNA, 22 nt, Human
aaacacagggauauauauucca

SEQ ID NO: 936049 - RNA, 22 nt, Human
ugauuuccaugaagcugaaggc

SEQ ID NO: 936050 - RNA, 22 nt, Human
cugagcugguggaagcaugcag

SEQ ID NO: 936051 - RNA, 22 nt, Human
aggacuucaucaccuguauaaa

SEQ ID NO: 936052 - RNA, 22 nt, Human
aacuagaaccacuuguauuucc

SEQ ID NO: 936053 - RNA, 22 nt, Human
caccaucagcagcaggugucaa

SEQ ID NO: 936054 - RNA, 22 nt, Human
gccaggcuguggggaacuugaa

SEQ ID NO: 936055 - RNA, 20 nt, Human
ccugggcuccaggagccccg

SEQ ID NO: 936056 - RNA, 22 nt, Human
ggcugcucuucuuggcgaccuc

SEQ ID NO: 936057 - RNA, 22 nt, Human
caggagagauaugaguccccac

SEQ ID NO: 936058 - RNA, 21 nt, Human
auggagggaccagggaagcag

SEQ ID NO: 936059 - RNA, 22 nt, Human
ccaaggcuucccagagaugcuc

SEQ ID NO: 936060 - RNA, 22 nt, Human
ucccagagcucuggagguugga

SEQ ID NO: 936061 - RNA, 22 nt, Human
gaaaugugugacaaguuucaau

SEQ ID NO: 936062 - RNA, 22 nt, Human
ggugcagaggagccagcugggg

SEQ ID NO: 936063 - RNA, 21 nt, Human
ugcucaugcaaugcaugucca

SEQ ID NO: 936064 - RNA, 22 nt, Human
aagucuuacagacaagcugaag

SEQ ID NO: 936065 - RNA, 22 nt, Human
gggacagcuguagugcuuggcu

SEQ ID NO: 936066 - RNA, 22 nt, Human
gcaguggcuaggagucuggcgu

SEQ ID NO: 936067 - RNA, 23 nt, Human
cccagcagauuguaaagugucca

SEQ ID NO: 936068 - RNA, 21 nt, Human
agcagcugcaguuucuaucug

SEQ ID NO: 936069 - RNA, 22 nt, Human
cagaagaguagcugaacaaguu

SEQ ID NO: 936070 - RNA, 22 nt, Human
caguacuuauuucuauuuaggg

SEQ ID NO: 936071 - RNA, 22 nt, Human
uggcucugucaaacugcacaca

SEQ ID NO: 936072 - RNA, 22 nt, Human
uuugcauuuugauaagaucacu

SEQ ID NO: 936073 - RNA, 22 nt, Human
aguuucuaccgguacauucagg

SEQ ID NO: 936074 - RNA, 20 nt, Human
cagcccuccaguggaggcag

SEQ ID NO: 936075 - RNA, 22 nt, Human
agcccuagagcuggaggucagu

SEQ ID NO: 936076 - RNA, 22 nt, Human
agcccccaaaagugcuuaugau

SEQ ID NO: 936077 - RNA, 22 nt, Human
gagccagccuucuucugagguc

SEQ ID NO: 936078 - RNA, 22 nt, Human
aacagacauauuuuuaauaugc

SEQ ID NO: 936079 - RNA, 22 nt, Human
ugggagcagccaacauggccuu

SEQ ID NO: 936080 - RNA, 22 nt, Human
ggcugccuccugcugggcugga

SEQ ID NO: 936081 - RNA, 22 nt, Human
aaaaguauuuauggcuauguaa

SEQ ID NO: 936082 - RNA, 22 nt, Human
gcucagaggagcaucauaagga

SEQ ID NO: 936083 - RNA, 22 nt, Human
ugcauuauuugcaugugccugu

SEQ ID NO: 936084 - RNA, 22 nt, Human
gcagcugccuauucagggcuug

SEQ ID NO: 936085 - RNA, 22 nt, Human
gcacaauuauuuaugcaguaug

SEQ ID NO: 936086 - RNA, 22 nt, Human
ugaaaucaauugcaauguuuau

SEQ ID NO: 936087 - RNA, 22 nt, Human
uuggccaaggucacugggugag

SEQ ID NO: 936088 - RNA, 22 nt, Human
aggcugucugaccccagagccc

SEQ ID NO: 936089 - RNA, 22 nt, Human
cagagccugccucuggcugugg

SEQ ID NO: 936090 - RNA, 22 nt, Human
caaagucccagcugcuuagaga

SEQ ID NO: 936091 - RNA, 22 nt, Human
cuggccaggcuugggacagaca

SEQ ID NO: 936092 - RNA, 22 nt, Human
ucaggagacuuaugucacagug

SEQ ID NO: 936093 - RNA, 22 nt, Human
uuucauaauacuguacaugaaa

SEQ ID NO: 936094 - RNA, 18 nt, Human
acauuucuaugcuucugg

SEQ ID NO: 936095 - RNA, 22 nt, Human
aggcagugcaugcaaaggucgg

SEQ ID NO: 936096 - RNA, 22 nt, Human
cugcugugccuuaaaaugcaag

SEQ ID NO: 936097 - RNA, 22 nt, Human
ugcugccacaaauucagcugcc

SEQ ID NO: 936098 - RNA, 22 nt, Human
cuacagacccaccuuggaagaa

SEQ ID NO: 936099 - RNA, 22 nt, Human
uauacagaaccgccugaagucu

SEQ ID NO: 936100 - RNA, 22 nt, Human
uuuuccucugagcuuugaauaa

SEQ ID NO: 936101 - RNA, 22 nt, Human
uggcuccuucauucuccugcca

SEQ ID NO: 936102 - RNA, 22 nt, Human
aggagggagcuuaagccaggca

SEQ ID NO: 936103 - RNA, 23 nt, Human
auguauuuaaauuucagugauga

SEQ ID NO: 936104 - RNA, 22 nt, Human
agagcugagaauguggcuuccu

SEQ ID NO: 936105 - RNA, 22 nt, Human
gcccucagaguuccccacagug

SEQ ID NO: 936106 - RNA, 22 nt, Human
uuuggacuuagccugcagaauu

SEQ ID NO: 936107 - RNA, 22 nt, Human
auaaaaacugacccauccuuug

SEQ ID NO: 936108 - RNA, 22 nt, Human
uaguuuaaaaguuagggaugau

SEQ ID NO: 936109 - RNA, 22 nt, Human
auugacaauuagcccuuaggug

SEQ ID NO: 936110 - RNA, 19 nt, Human
ugaggccaaggucacagau

SEQ ID NO: 936111 - RNA, 22 nt, Human
gcagcugcuguggcaucaagcu

SEQ ID NO: 936112 - RNA, 22 nt, Human
agggccaggaacaccugaaggg

SEQ ID NO: 936113 - RNA, 22 nt, Human
cuuguccuuuacuugagacuca

SEQ ID NO: 936114 - RNA, 22 nt, Human
gaggccaaguuggagaccaggu

SEQ ID NO: 936115 - RNA, 22 nt, Human
aaaaccaggcguuuccuauuau

SEQ ID NO: 936116 - RNA, 22 nt, Human
ugggcaggaugcguugauucuu

SEQ ID NO: 936117 - RNA, 22 nt, Human
cauucuuauauuuacucauuca

SEQ ID NO: 936118 - RNA, 22 nt, Human
aauuaaauugguuuagagagga

SEQ ID NO: 936119 - RNA, 22 nt, Human
ucgagucauguucucccauuaa

SEQ ID NO: 936120 - RNA, 17 nt, Human
ggccuugggcugcucuu

SEQ ID NO: 936121 - RNA, 22 nt, Human
ugaacauauucaccucuaaaua

SEQ ID NO: 936122 - RNA, 22 nt, Human
ugcugagaaucacagguuauaa

SEQ ID NO: 936123 - RNA, 22 nt, Human
aucacauuguuagcauagacug

SEQ ID NO: 936124 - RNA, 22 nt, Human
cagggccaguucucgcagcagu

SEQ ID NO: 936125 - RNA, 22 nt, Human
uugcaaauguuucauaacagua

SEQ ID NO: 936126 - RNA, 22 nt, Human
ucuguaaauccugcucagcaac

SEQ ID NO: 936127 - RNA, 22 nt, Human
cugggcacuugcucacagcucu

SEQ ID NO: 936128 - RNA, 22 nt, Human
gccucugcccauccaccaucag

SEQ ID NO: 936129 - RNA, 20 nt, Human
uaucaaucagaaagaagacu

SEQ ID NO: 936130 - RNA, 22 nt, Human
uuggagcccugaggaucuggau

SEQ ID NO: 936131 - RNA, 22 nt, Human
aaaauaguuaacguucagagua

SEQ ID NO: 936132 - RNA, 22 nt, Human
auaaggaaugauguaucaguuu

SEQ ID NO: 936133 - RNA, 22 nt, Human
augcaccugaacuccaucagcu

SEQ ID NO: 936134 - RNA, 22 nt, Human
ucacauuuuccuugguaucugu

SEQ ID NO: 936135 - RNA, 20 nt, Human
acuggcagccugccugcugu

SEQ ID NO: 936136 - RNA, 22 nt, Human
uuuaagaaguuauguuauaaau

SEQ ID NO: 936137 - RNA, 22 nt, Human
ugucaaaaugacuuuacuacag

SEQ ID NO: 936138 - RNA, 18 nt, Human
cucugcuaaugggcagcu

SEQ ID NO: 936139 - RNA, 20 nt, Human
ucacaucuggcagcugauga

SEQ ID NO: 936140 - RNA, 22 nt, Human
cacuggcccauuccugucuggc

SEQ ID NO: 936141 - RNA, 21 nt, Human
agccagcuaucacacagcauu

SEQ ID NO: 936142 - RNA, 22 nt, Human
ucccacugugaauccaaggccu

SEQ ID NO: 936143 - RNA, 22 nt, Human
gccuggagccucagcaaggagg

SEQ ID NO: 936144 - RNA, 22 nt, Human
ugagugaggaagcgguggagga

SEQ ID NO: 936145 - RNA, 20 nt, Human
uauuugaaauggccaagugu

SEQ ID NO: 936146 - RNA, 23 nt, Human
ucaugcccaggcuccagauguca

SEQ ID NO: 936147 - RNA, 22 nt, Human
ucuuugaauccuuuacaucuga

SEQ ID NO: 936148 - RNA, 22 nt, Human
cuacauuuuucaccgagccucu

SEQ ID NO: 936149 - RNA, 22 nt, Human
uuuucauuuacauuagggaaga

SEQ ID NO: 936150 - RNA, 21 nt, Human
agcuggugucagagcucuggg

SEQ ID NO: 936151 - RNA, 22 nt, Human
gucuucaacaauaacuaccacu

SEQ ID NO: 936152 - RNA, 21 nt, Human
uuuauuaacaacuguggacgu

SEQ ID NO: 936153 - RNA, 22 nt, Human
aggacagcagugcuggcacuug

SEQ ID NO: 936154 - RNA, 22 nt, Human
uacaacauuguguugcuucaua

SEQ ID NO: 936155 - RNA, 22 nt, Human
acauucaaggccuucugacaca

SEQ ID NO: 936156 - RNA, 22 nt, Human
gagcugggcacacgccacuuga

SEQ ID NO: 936157 - RNA, 22 nt, Human
cagggccagccgcagcauccac

SEQ ID NO: 936158 - RNA, 22 nt, Human
gcuggcuugauaguuucugcuu

SEQ ID NO: 936159 - RNA, 22 nt, Human
ucaguggagcuaagcaugagau

SEQ ID NO: 936160 - RNA, 22 nt, Human
caccagcagaagacugagggug

SEQ ID NO: 936161 - RNA, 22 nt, Human
uuuuuguagucauuagaagagg

SEQ ID NO: 936162 - RNA, 20 nt, Human
auacacuugcccagcuugug

SEQ ID NO: 936163 - RNA, 22 nt, Human
ggugacugguuuaucuggcagu

SEQ ID NO: 936164 - RNA, 22 nt, Human
aacaugucuggguauucacaag

SEQ ID NO: 936165 - RNA, 22 nt, Human
gcugagagugagcacuggauau

SEQ ID NO: 936166 - RNA, 22 nt, Human
uggcagcagggccccuggagga

SEQ ID NO: 936167 - RNA, 22 nt, Human
uaaaauguuugcaagagaccag

SEQ ID NO: 936168 - RNA, 22 nt, Human
gcacagcaauuucuauaagcuc

SEQ ID NO: 936169 - RNA, 22 nt, Human
aacuuucuuggaugucucaaca

SEQ ID NO: 936170 - RNA, 22 nt, Human
caggcagcucuaauggaaagug

SEQ ID NO: 936171 - RNA, 22 nt, Human
caggguggcaggcaccauggcc

SEQ ID NO: 936172 - RNA, 22 nt, Human
cucugagcuccuggaagcgugc

SEQ ID NO: 936173 - RNA, 22 nt, Human
ggcaggcugggugucauggagu

SEQ ID NO: 936174 - RNA, 22 nt, Human
aggccaaguagcuagcauugaa

SEQ ID NO: 936175 - RNA, 23 nt, Human
gagagcugacugucaagacuguu

SEQ ID NO: 936176 - RNA, 22 nt, Human
auuauguagguuaggugguugu

SEQ ID NO: 936177 - RNA, 23 nt, Human
cacugggcccaggguguggaggc

SEQ ID NO: 936178 - RNA, 22 nt, Human
uucaggauuguguuuuuccuga

SEQ ID NO: 936179 - RNA, 22 nt, Human
cacagcauaaugaaauauacuu

SEQ ID NO: 936180 - RNA, 22 nt, Human
agagggauggccccguaacuca

SEQ ID NO: 936181 - RNA, 22 nt, Human
aggauaguugugaagauaggcu

SEQ ID NO: 936182 - RNA, 22 nt, Human
cagaaggcuggcagauugagau

SEQ ID NO: 936183 - RNA, 22 nt, Human
uggcuucuugggaugggucauu

SEQ ID NO: 936184 - RNA, 22 nt, Human
ugugacagaucuuuaaauaaug

SEQ ID NO: 936185 - RNA, 22 nt, Human
uggcagcuagauaguguguuua

SEQ ID NO: 936186 - RNA, 22 nt, Human
guggauggauugaggcaguggg

SEQ ID NO: 936187 - RNA, 22 nt, Human
gaggcaucugggcacagaagug

SEQ ID NO: 936188 - RNA, 22 nt, Human
gccaggcagcugggagggugcc

SEQ ID NO: 936189 - RNA, 22 nt, Human
gagccaggggucagcuccgagg

SEQ ID NO: 936190 - RNA, 22 nt, Human
agcauugccugccuauugcuaa

SEQ ID NO: 936191 - RNA, 22 nt, Human
aggccuagaggaauggccaggg

SEQ ID NO: 936192 - RNA, 22 nt, Human
aggcucugacccaugggaccca

SEQ ID NO: 936193 - RNA, 22 nt, Human
gcaggcugugaggcucagaugg

SEQ ID NO: 936194 - RNA, 22 nt, Human
cuggcugggagcgagcugcuca

SEQ ID NO: 936195 - RNA, 22 nt, Human
gccaggaguguguggcuauguu

SEQ ID NO: 936196 - RNA, 22 nt, Human
ucagggcagaauccaaagaauu

SEQ ID NO: 936197 - RNA, 22 nt, Human
ugagagggcccagagcacacca

SEQ ID NO: 936198 - RNA, 22 nt, Human
agaaauaugcugauuagaugaa

SEQ ID NO: 936199 - RNA, 22 nt, Human
guggaggacaaaagaagccuuu

SEQ ID NO: 936200 - RNA, 22 nt, Human
agccuccuggaguuucugggau

SEQ ID NO: 936201 - RNA, 22 nt, Human
aagcaagacagaaguuacugcc

SEQ ID NO: 936202 - RNA, 21 nt, Human
aaguuuguucuuguauagucu

SEQ ID NO: 936203 - RNA, 22 nt, Human
gugcagugacccuggagagcug

SEQ ID NO: 936204 - RNA, 22 nt, Human
ucccagcgcggggggaggaucc

SEQ ID NO: 936205 - RNA, 22 nt, Human
acucugacuggagugagagagg

SEQ ID NO: 936206 - RNA, 22 nt, Human
aggggugauuugggacaggaca

SEQ ID NO: 936207 - RNA, 22 nt, Human
ccuguucaaguugcagggcugg

SEQ ID NO: 936208 - RNA, 22 nt, Human
uuguuacagcagugauuucaga

SEQ ID NO: 936209 - RNA, 19 nt, Human
uuuaggauaaagucuggac

SEQ ID NO: 936210 - RNA, 22 nt, Human
uggcucaggagggaucuuugcu

SEQ ID NO: 936211 - RNA, 22 nt, Human
acaacaggguaaggcaggccau

SEQ ID NO: 936212 - RNA, 22 nt, Human
ugaacagauggcccagcagagg

SEQ ID NO: 936213 - RNA, 22 nt, Human
agaauucucuuccauugaaaca

SEQ ID NO: 936214 - RNA, 21 nt, Human
ugauccuuucccccauguugc

SEQ ID NO: 936215 - RNA, 22 nt, Human
gacauucacaguuuccgauggu

SEQ ID NO: 936216 - RNA, 22 nt, Human
gagcagaacuacucacauaucg

SEQ ID NO: 936217 - RNA, 22 nt, Human
agcuauguaacagugccaugga

SEQ ID NO: 936218 - RNA, 22 nt, Human
uggcaccagcaccuagaugggg

SEQ ID NO: 936219 - RNA, 22 nt, Human
caaagccucugauuucacuugu

SEQ ID NO: 936220 - RNA, 22 nt, Human
uuuggaauguaguuuaaucauc

SEQ ID NO: 936221 - RNA, 22 nt, Human
aagaacagguucuagaaccauu

SEQ ID NO: 936222 - RNA, 22 nt, Human
uagauuuuacuucugucauuac

SEQ ID NO: 936223 - RNA, 22 nt, Human
ucauuuguugcuguuaccugag

SEQ ID NO: 936224 - RNA, 22 nt, Human
uguguuccuucgucuucccuuc

SEQ ID NO: 936225 - RNA, 22 nt, Human
cugggguggauggguccaaguu

SEQ ID NO: 936226 - RNA, 22 nt, Human
uggaaagaugaagauguuuaag

SEQ ID NO: 936227 - RNA, 22 nt, Human
uucucagguagugcugaugcug

SEQ ID NO: 936228 - RNA, 22 nt, Human
ucaaagucucugcuucuguaac

SEQ ID NO: 936229 - RNA, 22 nt, Human
gcugccagcucacucuccugag

SEQ ID NO: 936230 - RNA, 22 nt, Human
aagcucugcucagcagacuagg

SEQ ID NO: 936231 - RNA, 22 nt, Human
ugaacuccaaauacugcugauu

SEQ ID NO: 936232 - RNA, 22 nt, Human
aguggcaguagaugagcugguu

SEQ ID NO: 936233 - RNA, 22 nt, Human
guaggaagcucugaggcuaguu

SEQ ID NO: 936234 - RNA, 22 nt, Human
aggaccagccuccaggucucuu

SEQ ID NO: 936235 - RNA, 22 nt, Human
agcagcaggcuguguggacuga

SEQ ID NO: 936236 - RNA, 22 nt, Human
cccaggaaaucaggcuuucuag

SEQ ID NO: 936237 - RNA, 19 nt, Human
uucauucucuuauuguugu

SEQ ID NO: 936238 - RNA, 22 nt, Human
ggauaagaaaauuguaauaacu

SEQ ID NO: 936239 - RNA, 22 nt, Human
agccuucagcaguucaggugcc

SEQ ID NO: 936240 - RNA, 18 nt, Human
gccugggaggaggaaaug

SEQ ID NO: 936241 - RNA, 22 nt, Human
ucuuuccaaggacucuguagca

SEQ ID NO: 936242 - RNA, 21 nt, Human
ugcagcagaguaagcagggga

SEQ ID NO: 936243 - RNA, 22 nt, Human
aaaaagauguccugaaguuuag

SEQ ID NO: 936244 - RNA, 21 nt, Human
agcagccauuucacagagacu

SEQ ID NO: 936245 - RNA, 22 nt, Human
ggagauggaauagauucugacu

SEQ ID NO: 936246 - RNA, 22 nt, Human
gcugagcuagcuaucucagucu

SEQ ID NO: 936247 - RNA, 22 nt, Human
aaguucaaggcagguccugagg

SEQ ID NO: 936248 - RNA, 22 nt, Human
ccagcuggucugugcucauguu

SEQ ID NO: 936249 - RNA, 22 nt, Human
uguaucaaggguuuauguaagc

SEQ ID NO: 936250 - RNA, 22 nt, Human
ccuggaagauucaccacuacca

SEQ ID NO: 936251 - RNA, 22 nt, Human
aagagcuggucacagguccauu

SEQ ID NO: 936252 - RNA, 22 nt, Human
aauguguguauuucuaggcgag

SEQ ID NO: 936253 - RNA, 22 nt, Human
gggaaggagguggcuugaagug

SEQ ID NO: 936254 - RNA, 22 nt, Human
ggcccugggaugcucagcagug

SEQ ID NO: 936255 - RNA, 22 nt, Human
ugagagugaaaugucacauguc

SEQ ID NO: 936256 - RNA, 22 nt, Human
ugagaggccccagcucuuggcc

SEQ ID NO: 936257 - RNA, 22 nt, Human
ggcagccaugcacgcugccugg

SEQ ID NO: 936258 - RNA, 22 nt, Human
ugaaucugauuucccuggaggc

SEQ ID NO: 936259 - RNA, 22 nt, Human
ucugucaccgagggcauccaaa

SEQ ID NO: 936260 - RNA, 22 nt, Human
cagaauuugaaguaauauucca

SEQ ID NO: 936261 - RNA, 17 nt, Human
uuaagguggaucagcac

SEQ ID NO: 936262 - RNA, 22 nt, Human
uugcugugaaaccaugggaagu

SEQ ID NO: 936263 - RNA, 22 nt, Human
auuaggaaacugaaugucagaa

SEQ ID NO: 936264 - RNA, 18 nt, Human
augugucuuucuuguuug

SEQ ID NO: 936265 - RNA, 19 nt, Human
cugguccugacugaggggu

SEQ ID NO: 936266 - RNA, 22 nt, Human
agagugucugguagcugcucug

SEQ ID NO: 936267 - RNA, 22 nt, Human
uugcauguuauuuaaucuguau

SEQ ID NO: 936268 - RNA, 18 nt, Human
uagaauauaggucauucu

SEQ ID NO: 936269 - RNA, 22 nt, Human
aagaggaggacgguucccagaa

SEQ ID NO: 936270 - RNA, 22 nt, Human
ggugggugagcccugggagcug

SEQ ID NO: 936271 - RNA, 22 nt, Human
uuugcauuuguuuagaaccuga

SEQ ID NO: 936272 - RNA, 22 nt, Human
cugccagguuggcgcucgcucu

SEQ ID NO: 936273 - RNA, 22 nt, Human
auccaaaccuggacaugagugg

SEQ ID NO: 936274 - RNA, 22 nt, Human
gagcugcccugagcuuugcaug

SEQ ID NO: 936275 - RNA, 22 nt, Human
gggcagaggggcgcuucccucu

SEQ ID NO: 936276 - RNA, 22 nt, Human
uccaggaccucccaggcuagag

SEQ ID NO: 936277 - RNA, 22 nt, Human
ggccucuggucaagacaagcau

SEQ ID NO: 936278 - RNA, 22 nt, Human
ggaggggagguccagcugaucu

SEQ ID NO: 936279 - RNA, 22 nt, Human
ugccuggcaacuguggugggcu

SEQ ID NO: 936280 - RNA, 17 nt, Human
acucaggaucugggagu

SEQ ID NO: 936281 - RNA, 22 nt, Human
uggcagaggcucugugauguug

SEQ ID NO: 936282 - RNA, 22 nt, Human
ugggccugggagggcagacgcu

SEQ ID NO: 936283 - RNA, 22 nt, Human
guucaaagcuccugguacagua

SEQ ID NO: 936284 - RNA, 22 nt, Human
ucugccuggguguggagcagag

SEQ ID NO: 936285 - RNA, 22 nt, Human
aaggcccuggcaggaagcagga

SEQ ID NO: 936286 - RNA, 22 nt, Human
aaacauuugcaacucgguuugg

SEQ ID NO: 936287 - RNA, 22 nt, Human
uccugucugcucacagagcugg

SEQ ID NO: 936288 - RNA, 22 nt, Human
ggaaagaccugagauaggaaua

SEQ ID NO: 936289 - RNA, 22 nt, Human
aggccagaaaugucagggagug

SEQ ID NO: 936290 - RNA, 23 nt, Human
uagagcagggaaaucugucagag

SEQ ID NO: 936291 - RNA, 22 nt, Human
agagcuggacgucugagcccua

SEQ ID NO: 936292 - RNA, 22 nt, Human
ugaagccuuguguggccucucu

SEQ ID NO: 936293 - RNA, 22 nt, Human
uucagcaaacacgaugcuuguu

SEQ ID NO: 936294 - RNA, 22 nt, Human
gcuggucacucugggagcugcu

SEQ ID NO: 936295 - RNA, 22 nt, Human
gguucacacuaagcuuaagugg

SEQ ID NO: 936296 - RNA, 22 nt, Human
acccugagggguauagcagaag

SEQ ID NO: 936297 - RNA, 22 nt, Human
gagcagcuccagccgcaugacu

SEQ ID NO: 936298 - RNA, 22 nt, Human
cccugggacccgcugcagaggc

SEQ ID NO: 936299 - RNA, 22 nt, Human
agcagggcaaagucaggcuaac

SEQ ID NO: 936300 - RNA, 22 nt, Human
uguaucaaaccaaauuaauucu

SEQ ID NO: 936301 - RNA, 17 nt, Human
aaaauucuguaaagagg

SEQ ID NO: 936302 - RNA, 18 nt, Human
uccuggccacacuaccuu

SEQ ID NO: 936303 - RNA, 18 nt, Human
gccugcaggcacgggggu

SEQ ID NO: 936304 - RNA, 22 nt, Human
ucucccaggugggugccuggag

SEQ ID NO: 936305 - RNA, 22 nt, Human
aacaucagaauauccauguugg

SEQ ID NO: 936306 - RNA, 22 nt, Human
cagguccccuccccuaccaggc

SEQ ID NO: 936307 - RNA, 22 nt, Human
aggcucugacgucacacguggc

SEQ ID NO: 936308 - RNA, 22 nt, Human
cuguggaauugaugcuuagugu

SEQ ID NO: 936309 - RNA, 22 nt, Human
gcuggggagggcgucaaggcca

SEQ ID NO: 936310 - RNA, 22 nt, Human
agggucugacaaugugacuuag

SEQ ID NO: 936311 - RNA, 22 nt, Human
gcccaggaaaugccccguggug

SEQ ID NO: 936312 - RNA, 22 nt, Human
cucaguuucuucauauuguagg

SEQ ID NO: 936313 - RNA, 22 nt, Human
aauauuuguuaguguuuuaaug

SEQ ID NO: 936314 - RNA, 22 nt, Human
cugaggugcuagggucccugcu

SEQ ID NO: 936315 - RNA, 22 nt, Human
uggcucuggauuaaucuaggaa

SEQ ID NO: 936316 - RNA, 22 nt, Human
agauggcagggguaccuggaag

SEQ ID NO: 936317 - RNA, 22 nt, Human
aauucacauauacauuauuccu

SEQ ID NO: 936318 - RNA, 22 nt, Human
uccuggucuacacugcauuggg

SEQ ID NO: 936319 - RNA, 21 nt, Human
ggccuuggcgggggccgaauu

SEQ ID NO: 936320 - RNA, 22 nt, Human
gcuggccuccugcuagauggaa

SEQ ID NO: 936321 - RNA, 22 nt, Human
agaggcggagguugcagugagc

SEQ ID NO: 936322 - RNA, 22 nt, Human
ugggagcaggaagcaggaagua

SEQ ID NO: 936323 - RNA, 22 nt, Human
uugaaaugcagauuccaaucca

SEQ ID NO: 936324 - RNA, 22 nt, Human
ggcagcuccaaaaggaaacacu

SEQ ID NO: 936325 - RNA, 22 nt, Human
ggcuggguuauuuauggccaag

SEQ ID NO: 936326 - RNA, 21 nt, Human
acucugcugcgggcuuggccu

SEQ ID NO: 936327 - RNA, 22 nt, Human
ggcagggagagcaugcugauaa

SEQ ID NO: 936328 - RNA, 23 nt, Human
ggccacaaauagucuccccuggc

SEQ ID NO: 936329 - RNA, 21 nt, Human
uucugagcacucaucacuguc

SEQ ID NO: 936330 - RNA, 22 nt, Human
uacuuuggauccuuacaauagc

SEQ ID NO: 936331 - RNA, 22 nt, Human
ucuggcuccaccuccuuuacua

SEQ ID NO: 936332 - RNA, 22 nt, Human
uuuacaaccucauauucugaug

SEQ ID NO: 936333 - RNA, 22 nt, Human
cuuggcugucuauaggaaagag

SEQ ID NO: 936334 - RNA, 22 nt, Human
uggugaagucagcggagcccgg

SEQ ID NO: 936335 - RNA, 22 nt, Human
aaacagcuaauggccaggaaua

SEQ ID NO: 936336 - RNA, 22 nt, Human
gguggcagaggugcaucagccc

SEQ ID NO: 936337 - RNA, 22 nt, Human
aggguagggccguagggccaug

SEQ ID NO: 936338 - RNA, 22 nt, Human
ugagccaaugauuugaauagag

SEQ ID NO: 936339 - RNA, 22 nt, Human
uuuuucauauuccccucucugg

SEQ ID NO: 936340 - RNA, 22 nt, Human
uggcagccacaucucguggauu

SEQ ID NO: 936341 - RNA, 22 nt, Human
aggcuggaguacaguggcuauu

SEQ ID NO: 936342 - RNA, 22 nt, Human
cugccuugaggagguuguggga

SEQ ID NO: 936343 - RNA, 19 nt, Human
auuagcaugcuugaggaug

SEQ ID NO: 936344 - RNA, 22 nt, Human
aauaugcauuaacuguguacau

SEQ ID NO: 936345 - RNA, 22 nt, Human
cccaugagaccugguuuaaggc

SEQ ID NO: 936346 - RNA, 22 nt, Human
agucaauuaucucuaggucauc

SEQ ID NO: 936347 - RNA, 22 nt, Human
uauuccaguccuauccucuuuu

SEQ ID NO: 936348 - RNA, 20 nt, Human
uauaacaguguugggugugu

SEQ ID NO: 936349 - RNA, 22 nt, Human
gcacugugacccagagcaggug

SEQ ID NO: 936350 - RNA, 21 nt, Human
uggaaagauucaaagaccagg

SEQ ID NO: 936351 - RNA, 22 nt, Human
ucuugccucuuccccuuuccau

SEQ ID NO: 936352 - RNA, 22 nt, Human
cccaggaggcagaaguugcagu

SEQ ID NO: 936353 - RNA, 22 nt, Human
cugccugugugugccugcagaa

SEQ ID NO: 936354 - RNA, 20 nt, Human
cuccucaguuccaugggagg

SEQ ID NO: 936355 - RNA, 22 nt, Human
ucccagaggcaguugguaacuu

SEQ ID NO: 936356 - RNA, 22 nt, Human
ucuccuggagcaggaagguggg

SEQ ID NO: 936357 - RNA, 22 nt, Human
uagauuuuaggagauuuuacug

SEQ ID NO: 936358 - RNA, 22 nt, Human
uaaaacugaauacauacugagg

SEQ ID NO: 936359 - RNA, 22 nt, Human
gaaaucugaaucuucuguuggu

SEQ ID NO: 936360 - RNA, 22 nt, Human
aggcaagcauuuaaccacucau

SEQ ID NO: 936361 - RNA, 22 nt, Human
ggugggcaacauuuggccugag

SEQ ID NO: 936362 - RNA, 22 nt, Human
gcaagcugcucuuauguggagg

SEQ ID NO: 936363 - RNA, 22 nt, Human
ucccagagugagccaggggcag

SEQ ID NO: 936364 - RNA, 22 nt, Human
cagcauugaucccaggcugugg

SEQ ID NO: 936365 - RNA, 20 nt, Human
ucauuguguugccaauuccc

SEQ ID NO: 936366 - RNA, 22 nt, Human
cuguuacacggaccuucaaauc

SEQ ID NO: 936367 - RNA, 22 nt, Human
ucucaccauggugcuugcuuau

SEQ ID NO: 936368 - RNA, 22 nt, Human
uauugacaauuugugaaacuau

SEQ ID NO: 936369 - RNA, 20 nt, Human
agaguaacuggcacauaggg

SEQ ID NO: 936370 - RNA, 22 nt, Human
ugaugggaggugcugcaggacc

SEQ ID NO: 936371 - RNA, 22 nt, Human
uuuauuauguacaggcacuaua

SEQ ID NO: 936372 - RNA, 19 nt, Human
ggcagcuggacgcuguuca

SEQ ID NO: 936373 - RNA, 22 nt, Human
gccuaggagacaagcgugaaag

SEQ ID NO: 936374 - RNA, 22 nt, Human
cagagguagaaggcaugcagug

SEQ ID NO: 936375 - RNA, 22 nt, Human
acagauauaugauuguguaaau

SEQ ID NO: 936376 - RNA, 22 nt, Human
gccccuggcuggccagcuccuc

SEQ ID NO: 936377 - RNA, 19 nt, Human
acacagggaucagaggguu

SEQ ID NO: 936378 - RNA, 22 nt, Human
augaccccuaaaauuuacuguc

SEQ ID NO: 936379 - RNA, 22 nt, Human
aggagaggucucccuuccccag

SEQ ID NO: 936380 - RNA, 22 nt, Human
cacauacaaugguguuauuugg

SEQ ID NO: 936381 - RNA, 22 nt, Human
cugagcucuaaugucagccuug

SEQ ID NO: 936382 - RNA, 20 nt, Human
uucacagaggacucagguca

SEQ ID NO: 936383 - RNA, 22 nt, Human
ccugucuggaacauggccuguu

SEQ ID NO: 936384 - RNA, 22 nt, Human
aaauuuaagaagugugugcgug

SEQ ID NO: 936385 - RNA, 20 nt, Human
ucagagucaucaaagauggu

SEQ ID NO: 936386 - RNA, 22 nt, Human
auauaaagagcuuaguauagug

SEQ ID NO: 936387 - RNA, 21 nt, Human
ggauggauagggaagagauuu

SEQ ID NO: 936388 - RNA, 22 nt, Human
ugucaaauuuuuauugcaguau

SEQ ID NO: 936389 - RNA, 22 nt, Human
ggcuuccuggggccuccugcaa

SEQ ID NO: 936390 - RNA, 22 nt, Human
uagcccagaagagggaagcaac

SEQ ID NO: 936391 - RNA, 22 nt, Human
cagagguaccagcagccucugg

SEQ ID NO: 936392 - RNA, 22 nt, Human
uccugagcuucaaaacacuuug

SEQ ID NO: 936393 - RNA, 22 nt, Human
ccucaggguggcaucagaucuu

SEQ ID NO: 936394 - RNA, 19 nt, Human
ccaguagagacagcugcag

SEQ ID NO: 936395 - RNA, 22 nt, Human
guuugcauuuauuagucuucug

SEQ ID NO: 936396 - RNA, 22 nt, Human
uuuccaagagcuuauuucugaa

SEQ ID NO: 936397 - RNA, 22 nt, Human
guauucuugguuaucaaaauac

SEQ ID NO: 936398 - RNA, 22 nt, Human
aaaauguaaagcuugaguguag

SEQ ID NO: 936399 - RNA, 22 nt, Human
ccagaggcuggcagccagcuga

SEQ ID NO: 936400 - RNA, 22 nt, Human
ggcucuggugaggguaggagau

SEQ ID NO: 936401 - RNA, 17 nt, Human
aggccagaugaggcaag

SEQ ID NO: 936402 - RNA, 22 nt, Human
aguggcagaagucacuggguag

SEQ ID NO: 936403 - RNA, 22 nt, Human
ucaggggagguugaaucgucuc

SEQ ID NO: 936404 - RNA, 22 nt, Human
gcaggcagagagggguuuccag

SEQ ID NO: 936405 - RNA, 22 nt, Human
uuguccuuaccucaaucuggaa

SEQ ID NO: 936406 - RNA, 22 nt, Human
ccaguugguuucaaugggacag

SEQ ID NO: 936407 - RNA, 19 nt, Human
accaggcuuauggucagug

SEQ ID NO: 936408 - RNA, 22 nt, Human
cccucugccugcgcccuggugu

SEQ ID NO: 936409 - RNA, 22 nt, Human
ggcugggcuccgggagcaugcg

SEQ ID NO: 936410 - RNA, 22 nt, Human
cagugcagccaaggacaggcac

SEQ ID NO: 936411 - RNA, 22 nt, Human
ugggagcagcuuugcgagggag

SEQ ID NO: 936412 - RNA, 21 nt, Human
aucauucuggaaaauucaagc

SEQ ID NO: 936413 - RNA, 20 nt, Human
cucaggauugucuagccccu

SEQ ID NO: 936414 - RNA, 22 nt, Human
ugaggggauacgguacacauug

SEQ ID NO: 936415 - RNA, 22 nt, Human
ucucagagaacaguuggugcuu

SEQ ID NO: 936416 - RNA, 22 nt, Human
auggggugaccaugagcauuua

SEQ ID NO: 936417 - RNA, 22 nt, Human
gcugggcuugguuucccugcuu

SEQ ID NO: 936418 - RNA, 22 nt, Human
gugguaaucggauucuuaccgg

SEQ ID NO: 936419 - RNA, 22 nt, Human
auacacauauguguguauaugu

SEQ ID NO: 936420 - RNA, 22 nt, Human
uccuggaggcaaaugaagacuc

SEQ ID NO: 936421 - RNA, 22 nt, Human
gcaggugguccccguggagugg

SEQ ID NO: 936422 - RNA, 22 nt, Human
ugcugggcuugaaagcugcuaa

SEQ ID NO: 936423 - RNA, 22 nt, Human
aaaagggacuacucucagcucc

SEQ ID NO: 936424 - RNA, 22 nt, Human
uaguuuaauggucaacuaauga

SEQ ID NO: 936425 - RNA, 22 nt, Human
auuucacucuuaauugcuuccu

SEQ ID NO: 936426 - RNA, 22 nt, Human
cuggcugugcugcaggcuuugg

SEQ ID NO: 936427 - RNA, 22 nt, Human
ccuucuucuguguggcccaaga

SEQ ID NO: 936428 - RNA, 22 nt, Human
uggccuggcucacagugagauu

SEQ ID NO: 936429 - RNA, 22 nt, Human
cccuguacagucucuguggcac

SEQ ID NO: 936430 - RNA, 22 nt, Human
caguggccaugguggcaggggu

SEQ ID NO: 936431 - RNA, 22 nt, Human
uacauaguuccauuuacaggaa

SEQ ID NO: 936432 - RNA, 22 nt, Human
guggagccaggaucuccgcaca

SEQ ID NO: 936433 - RNA, 22 nt, Human
guguguuucagaagccaggugu

SEQ ID NO: 936434 - RNA, 22 nt, Human
uuugucagucaugucugcuuuu

SEQ ID NO: 936435 - RNA, 22 nt, Human
accacuguaucuccagcacauu

SEQ ID NO: 936436 - RNA, 22 nt, Human
acuuugcaauacuuaauacaaa

SEQ ID NO: 936437 - RNA, 22 nt, Human
aacacauaggcagagcaugaca

SEQ ID NO: 936438 - RNA, 23 nt, Human
acagagguccaaacaguauaagc

SEQ ID NO: 936439 - RNA, 22 nt, Human
ugccagcuccgaggagcugcag

SEQ ID NO: 936440 - RNA, 22 nt, Human
aaucuggcauuugagaguagga

SEQ ID NO: 936441 - RNA, 21 nt, Human
gcagccacugccuucaacaau

SEQ ID NO: 936442 - RNA, 22 nt, Human
gcugugcuggaaggggaccugc

SEQ ID NO: 936443 - RNA, 22 nt, Human
uauuucuggcuuugagggugau

SEQ ID NO: 936444 - RNA, 22 nt, Human
uggaggaugagugugggcucug

SEQ ID NO: 936445 - RNA, 22 nt, Human
ugggcagaauugugguaguuaa

SEQ ID NO: 936446 - RNA, 22 nt, Human
cagcagugcuucagugugagau

SEQ ID NO: 936447 - RNA, 22 nt, Human
auguguccacaggugugagaga

SEQ ID NO: 936448 - RNA, 22 nt, Human
gagguagcgaguggacagugca

SEQ ID NO: 936449 - RNA, 22 nt, Human
acauuucuauagugcaucuguu

SEQ ID NO: 936450 - RNA, 22 nt, Human
agguaaaauagauaguauuucu

SEQ ID NO: 936451 - RNA, 19 nt, Human
gcugcucugggucucaucu

SEQ ID NO: 936452 - RNA, 22 nt, Human
gcccagcaggacagagugguuu

SEQ ID NO: 936453 - RNA, 22 nt, Human
gggccucugugcagaggggccu

SEQ ID NO: 936454 - RNA, 21 nt, Human
ucagggcagugggagguuccu

SEQ ID NO: 936455 - RNA, 22 nt, Human
gauggcagguaguggucucauc

SEQ ID NO: 936456 - RNA, 22 nt, Human
uuucagugcuucuguuuaccgg

SEQ ID NO: 936457 - RNA, 22 nt, Human
gcucagagauggggaaugaaaa

SEQ ID NO: 936458 - RNA, 22 nt, Human
caaaugcuaacuucuuuccaaa

SEQ ID NO: 936459 - RNA, 22 nt, Human
agcaggugacagggcuguggug

SEQ ID NO: 936460 - RNA, 22 nt, Human
acauauauuacuaguaaagaca

SEQ ID NO: 936461 - RNA, 22 nt, Human
agccugcaggaugggcagcacc

SEQ ID NO: 936462 - RNA, 22 nt, Human
ggcugcuucucacucauuugca

SEQ ID NO: 936463 - RNA, 22 nt, Human
aauugacagaaaguuuacgagg

SEQ ID NO: 936464 - RNA, 22 nt, Human
uccugccuagcaggugaccuau

SEQ ID NO: 936465 - RNA, 22 nt, Human
ucugagccaaaauaaacagcau

SEQ ID NO: 936466 - RNA, 22 nt, Human
ucaguuuuaagguuugagaauu

SEQ ID NO: 936467 - RNA, 22 nt, Human
ccccagcacuuggaguggggag

SEQ ID NO: 936468 - RNA, 22 nt, Human
uguuuuuacugugauccagaaa

SEQ ID NO: 936469 - RNA, 19 nt, Human
uacauuuguguacacuugu

SEQ ID NO: 936470 - RNA, 22 nt, Human
cugcugugggcaggguagcugg

SEQ ID NO: 936471 - RNA, 22 nt, Human
aggagccaagauggggcaagua

SEQ ID NO: 936472 - RNA, 22 nt, Human
cagggcuggcucaugaaaaguu

SEQ ID NO: 936473 - RNA, 22 nt, Human
ucuggcucaggucagacaggga

SEQ ID NO: 936474 - RNA, 22 nt, Human
aagauuuaccacuuuauucaag

SEQ ID NO: 936475 - RNA, 22 nt, Human
uuaggaaucaccugcagaucuu

SEQ ID NO: 936476 - RNA, 22 nt, Human
gcucccaggaagagaagggcca

SEQ ID NO: 936477 - RNA, 19 nt, Human
aacuagaaagguuuugaga

SEQ ID NO: 936478 - RNA, 22 nt, Human
ggcuuccuaauacucccuacac

SEQ ID NO: 936479 - RNA, 18 nt, Human
caguuuuuauaucuggca

SEQ ID NO: 936480 - RNA, 22 nt, Human
ucagcagggccuccuugugcag

SEQ ID NO: 936481 - RNA, 20 nt, Human
gccagcccugacacaggagc

SEQ ID NO: 936482 - RNA, 17 nt, Human
ucaggcugggugcagug

SEQ ID NO: 936483 - RNA, 22 nt, Human
cucagaagaacaaaggcucuac

SEQ ID NO: 936484 - RNA, 22 nt, Human
uuuaauuaggaaaugggcaggg

SEQ ID NO: 936485 - RNA, 22 nt, Human
ggcucaggcuggagugcagugg

SEQ ID NO: 936486 - RNA, 22 nt, Human
caggcaccccaggugagcacug

SEQ ID NO: 936487 - RNA, 22 nt, Human
uguuuaaauagaacauacugca

SEQ ID NO: 936488 - RNA, 22 nt, Human
auagaaauggcagcuggugcua

SEQ ID NO: 936489 - RNA, 22 nt, Human
caggggcaggugugagaucauc

SEQ ID NO: 936490 - RNA, 22 nt, Human
cagguggaucucuaaggacuga

SEQ ID NO: 936491 - RNA, 22 nt, Human
aagauggagcacgagcagaagc

SEQ ID NO: 936492 - RNA, 22 nt, Human
gcuguccucugaucucuggagg

SEQ ID NO: 936493 - RNA, 22 nt, Human
ggccuugguaaagggaugcaug

SEQ ID NO: 936494 - RNA, 22 nt, Human
ccugccagggccuuggaagaaa

SEQ ID NO: 936495 - RNA, 22 nt, Human
ucugcaggcuuauaggaugggu

SEQ ID NO: 936496 - RNA, 22 nt, Human
uugcuguguaacuccuggccug

SEQ ID NO: 936497 - RNA, 17 nt, Human
gcuguaguuugauaaga

SEQ ID NO: 936498 - RNA, 22 nt, Human
uucaggaucacuaaacccucca

SEQ ID NO: 936499 - RNA, 22 nt, Human
gaaggccacaaaaaaugucaua

SEQ ID NO: 936500 - RNA, 22 nt, Human
uccaguggguugcugagggagg

SEQ ID NO: 936501 - RNA, 22 nt, Human
uccucagggggccaacccagcc

SEQ ID NO: 936502 - RNA, 22 nt, Human
uuauacuaaaacgcauugaauu

SEQ ID NO: 936503 - RNA, 23 nt, Human
cugcagccgcguggggacgugga

SEQ ID NO: 936504 - RNA, 17 nt, Human
agccccucagcgucacc

SEQ ID NO: 936505 - RNA, 22 nt, Human
cagggcagggccacacccccug

SEQ ID NO: 936506 - RNA, 22 nt, Human
gccugccuguuggcugaggugc

SEQ ID NO: 936507 - RNA, 22 nt, Human
cagaggaggccaccgcauaggc

SEQ ID NO: 936508 - RNA, 22 nt, Human
guggagacuucuacuagagacc

SEQ ID NO: 936509 - RNA, 22 nt, Human
uucaggauggcggauguugggg

SEQ ID NO: 936510 - RNA, 22 nt, Human
gcugaagcccacguggcuugua

SEQ ID NO: 936511 - RNA, 22 nt, Human
uugcauuugaucuuggguucuc

SEQ ID NO: 936512 - RNA, 22 nt, Human
agagcugugaaaaugagguuug

SEQ ID NO: 936513 - RNA, 22 nt, Human
gcccaggacucagggugucgcg

SEQ ID NO: 936514 - RNA, 22 nt, Human
guggccaacucaauguuuuuca

SEQ ID NO: 936515 - RNA, 22 nt, Human
ucaggagaaucagggcuguccu

SEQ ID NO: 936516 - RNA, 22 nt, Human
uuggccaagacucauguccuau

SEQ ID NO: 936517 - RNA, 22 nt, Human
uaagaaauuuaguuauagaaug

SEQ ID NO: 936518 - RNA, 21 nt, Human
agccuguugguuuacugcuca

SEQ ID NO: 936519 - RNA, 22 nt, Human
guccucugggcagcugccccac

SEQ ID NO: 936520 - RNA, 22 nt, Human
ggggcagagagaaggaagcuug

SEQ ID NO: 936521 - RNA, 22 nt, Human
guaggcagugguuggaagagaa

SEQ ID NO: 936522 - RNA, 22 nt, Human
cuagagggauguuaggauagca

SEQ ID NO: 936523 - RNA, 22 nt, Human
ccagguggcuucugcccgaugu

SEQ ID NO: 936524 - RNA, 22 nt, Human
aguggugcugcgcgcggagcuc

SEQ ID NO: 936525 - RNA, 23 nt, Human
cccuggccuuggggcacaggcug

SEQ ID NO: 936526 - RNA, 18 nt, Human
ccgggcuuuggugacaca

SEQ ID NO: 936527 - RNA, 22 nt, Human
cagggacagccuugggguggcg

SEQ ID NO: 936528 - RNA, 22 nt, Human
uuuuuauaugaaggauagugcg

SEQ ID NO: 936529 - RNA, 22 nt, Human
ugcugcucaaugagaugccauc

SEQ ID NO: 936530 - RNA, 22 nt, Human
agagucuuccaggcagccugag

SEQ ID NO: 936531 - RNA, 22 nt, Human
auguaucaacaaauuguacagu

SEQ ID NO: 936532 - RNA, 22 nt, Human
cuugcuuuguccagaaauucag

SEQ ID NO: 936533 - RNA, 22 nt, Human
cugaaggagcauagucaguuuu

SEQ ID NO: 936534 - RNA, 17 nt, Human
uccaugagacaugaaga

SEQ ID NO: 936535 - RNA, 20 nt, Human
ccagagcagccacugaaguu

SEQ ID NO: 936536 - RNA, 22 nt, Human
ucuggccuauuucugucagauc

SEQ ID NO: 936537 - RNA, 22 nt, Human
gggccugugcacaguucuguua

SEQ ID NO: 936538 - RNA, 22 nt, Human
uccucaggcugccuggaagacu

SEQ ID NO: 936539 - RNA, 22 nt, Human
guccucugcuucaugcccugau

SEQ ID NO: 936540 - RNA, 22 nt, Human
ugaggcaggaggauugcaggau

SEQ ID NO: 936541 - RNA, 22 nt, Human
auguauguaguguacauauaca

SEQ ID NO: 936542 - RNA, 22 nt, Human
ucaaaguaaaaguauagaguuu

SEQ ID NO: 936543 - RNA, 18 nt, Human
ccucagggagagagacgc

SEQ ID NO: 936544 - RNA, 22 nt, Human
acuguucauuuguccuguaucu

SEQ ID NO: 936545 - RNA, 22 nt, Human
aggcaccuugcgguccagugaa

SEQ ID NO: 936546 - RNA, 22 nt, Human
ugccagugggugugcagagacu

SEQ ID NO: 936547 - RNA, 22 nt, Human
ucuccuggcaugugggucaucu

SEQ ID NO: 936548 - RNA, 21 nt, Human
ggagcugcaggagccgaaggc

SEQ ID NO: 936549 - RNA, 22 nt, Human
auuccaguucuccucucuaaag

SEQ ID NO: 936550 - RNA, 22 nt, Human
cagcacugcugcuguacacaca

SEQ ID NO: 936551 - RNA, 22 nt, Human
cuucacauguuggaguccuuug

SEQ ID NO: 936552 - RNA, 22 nt, Human
acuggccaggcacagcuguggg

SEQ ID NO: 936553 - RNA, 22 nt, Human
ugggcuggagcuuguugcuucc

SEQ ID NO: 936554 - RNA, 22 nt, Human
gaggcagugucgguggcaggau

SEQ ID NO: 936555 - RNA, 22 nt, Human
uuuaaauaggacuccugggggu

SEQ ID NO: 936556 - RNA, 22 nt, Human
ugagaguauuuuggcauuauca

SEQ ID NO: 936557 - RNA, 22 nt, Human
cagcugaauucuucagacucca

SEQ ID NO: 936558 - RNA, 22 nt, Human
cauuagaagaacaguuauauua

SEQ ID NO: 936559 - RNA, 22 nt, Human
agagccugugauugucaucacc

SEQ ID NO: 936560 - RNA, 22 nt, Human
gcccagcagaucucagugucuc

SEQ ID NO: 936561 - RNA, 22 nt, Human
uuuauuauucucuggagaaugu

SEQ ID NO: 936562 - RNA, 21 nt, Human
cacucaggguaugugccaggc

SEQ ID NO: 936563 - RNA, 22 nt, Human
cagggacaauggcagagccuga

SEQ ID NO: 936564 - RNA, 22 nt, Human
cagagaaaaaauccugcucuca

SEQ ID NO: 936565 - RNA, 23 nt, Human
gccugccugaccugugcaaaguc

SEQ ID NO: 936566 - RNA, 22 nt, Human
ccauaagguuuggggccaugca

SEQ ID NO: 936567 - RNA, 22 nt, Human
uuccaugaaggagacugagaag

SEQ ID NO: 936568 - RNA, 21 nt, Human
uggccaaacuggagcauuuga

SEQ ID NO: 936569 - RNA, 22 nt, Human
gugcucacugugagacguccug

SEQ ID NO: 936570 - RNA, 22 nt, Human
cagaccugagguugaguaccag

SEQ ID NO: 936571 - RNA, 22 nt, Human
ucaauaaaauuguuuuccuauc

SEQ ID NO: 936572 - RNA, 22 nt, Human
caaauguauucucacuucaggg

SEQ ID NO: 936573 - RNA, 22 nt, Human
gcccugggauuggguggaggcu

SEQ ID NO: 936574 - RNA, 22 nt, Human
cugaaggaagcagaagcgaggu

SEQ ID NO: 936575 - RNA, 22 nt, Human
gcaggccuuggcaaugagccug

SEQ ID NO: 936576 - RNA, 22 nt, Human
ucuucagaggaagucagucuuu

SEQ ID NO: 936577 - RNA, 22 nt, Human
ucuuuacaaucuaagcauaguu

SEQ ID NO: 936578 - RNA, 23 nt, Human
uggccaagauaaucucaguuuuc

SEQ ID NO: 936579 - RNA, 22 nt, Human
ccugcuucagggaugauggcac

SEQ ID NO: 936580 - RNA, 22 nt, Human
cucagccugugaagagcagagg

SEQ ID NO: 936581 - RNA, 22 nt, Human
gucccaggcagagucaggaggg

SEQ ID NO: 936582 - RNA, 16 nt, Human
agaggccuugaggaag

SEQ ID NO: 936583 - RNA, 22 nt, Human
aaacuccugggcucaagcaguu

SEQ ID NO: 936584 - RNA, 23 nt, Human
ccagucucuuuccaaaaucacau

SEQ ID NO: 936585 - RNA, 22 nt, Human
uggagaggaaagugcaguuuug

SEQ ID NO: 936586 - RNA, 22 nt, Human
cagcccagccgagggccuggcu

SEQ ID NO: 936587 - RNA, 22 nt, Human
aggccugaggaccagauaaaug

SEQ ID NO: 936588 - RNA, 22 nt, Human
gcugagagcggccagcugggaa

SEQ ID NO: 936589 - RNA, 22 nt, Human
gagcagaacaggccggguggga

SEQ ID NO: 936590 - RNA, 22 nt, Human
ucaggaucaggggccuuuccuu

SEQ ID NO: 936591 - RNA, 18 nt, Human
acaggccucaguccugca

SEQ ID NO: 936592 - RNA, 22 nt, Human
gcuuccugagaaacaaucugau

SEQ ID NO: 936593 - RNA, 22 nt, Human
acaauauuguacccagaaguuu

SEQ ID NO: 936594 - RNA, 22 nt, Human
agccaaggacacggagccuccu

SEQ ID NO: 936595 - RNA, 19 nt, Human
ggccuggauuuagggcucc

SEQ ID NO: 936596 - RNA, 22 nt, Human
caggagacuauggcccaaggcc

SEQ ID NO: 936597 - RNA, 22 nt, Human
cccaggcugaguuagagguguc

SEQ ID NO: 936598 - RNA, 22 nt, Human
ggagguggcagagggacauucu

SEQ ID NO: 936599 - RNA, 22 nt, Human
agucuuaugguuaaauagaugc

SEQ ID NO: 936600 - RNA, 22 nt, Human
gauguuucaugcuagcaugugu

SEQ ID NO: 936601 - RNA, 22 nt, Human
uauauuaguggaaugauaugaa

SEQ ID NO: 936602 - RNA, 22 nt, Human
agcuccugcucuuugucccuaa

SEQ ID NO: 936603 - RNA, 22 nt, Human
gcagugcugaucccauggcaga

SEQ ID NO: 936604 - RNA, 18 nt, Human
uuaaggauaagcagacua

SEQ ID NO: 936605 - RNA, 22 nt, Human
uccaggaggcucugguugacgu

SEQ ID NO: 936606 - RNA, 22 nt, Human
auuuccaggagaaaggauuuua

SEQ ID NO: 936607 - RNA, 18 nt, Human
agcugcagaccaggaggu

SEQ ID NO: 936608 - RNA, 22 nt, Human
uacagggguaacaguggggaau

SEQ ID NO: 936609 - RNA, 22 nt, Human
gccugaaguuucaugccucuau

SEQ ID NO: 936610 - RNA, 22 nt, Human
ucuugggaccauuuacacauac

SEQ ID NO: 936611 - RNA, 22 nt, Human
cagucucucugaaguauuaaga

SEQ ID NO: 936612 - RNA, 22 nt, Human
uaggaugacacagcaaguauag

SEQ ID NO: 936613 - RNA, 22 nt, Human
cucccugggcagauguggcucu

SEQ ID NO: 936614 - RNA, 22 nt, Human
cuugcaggccuuucuagcucua

SEQ ID NO: 936615 - RNA, 22 nt, Human
cagugcaugaaacaauaugcag

SEQ ID NO: 936616 - RNA, 22 nt, Human
auuuguaagcuagagccaugau

SEQ ID NO: 936617 - RNA, 22 nt, Human
gaccauuucuaggaaucagacu

SEQ ID NO: 936618 - RNA, 22 nt, Human
ucuccugggugcuuuaucagaa

SEQ ID NO: 936619 - RNA, 22 nt, Human
cugccuggaccggcagcccucc

SEQ ID NO: 936620 - RNA, 22 nt, Human
auguacauuuagaucauuucug

SEQ ID NO: 936621 - RNA, 22 nt, Human
cucuccagaucugcugagccag

SEQ ID NO: 936622 - RNA, 22 nt, Human
ggagcagccuguguagacgggg

SEQ ID NO: 936623 - RNA, 22 nt, Human
aagcagcugauuucacagcuca

SEQ ID NO: 936624 - RNA, 22 nt, Human
agugaaauuccuggucuuuguu

SEQ ID NO: 936625 - RNA, 22 nt, Human
gccuggagcucaugugggcauu

SEQ ID NO: 936626 - RNA, 22 nt, Human
ccuguggcucucuuuggagguc

SEQ ID NO: 936627 - RNA, 22 nt, Human
uuucaucuaacacuacauaggg

SEQ ID NO: 936628 - RNA, 22 nt, Human
aucugcuuccuccuuagggaaa

SEQ ID NO: 936629 - RNA, 22 nt, Human
ggaggccaaggcgggcggauca

SEQ ID NO: 936630 - RNA, 22 nt, Human
ugagccuguccugugcauguga

SEQ ID NO: 936631 - RNA, 22 nt, Human
cagagccagcuguccuuggcau

SEQ ID NO: 936632 - RNA, 22 nt, Human
uagaauaugauuaauuuucuua

SEQ ID NO: 936633 - RNA, 22 nt, Human
ggcagcugggucacaccgaucu

SEQ ID NO: 936634 - RNA, 21 nt, Human
ugucauuaaucgcuauagaag

SEQ ID NO: 936635 - RNA, 22 nt, Human
ucagagguaagggcugagagga

SEQ ID NO: 936636 - RNA, 22 nt, Human
uguccauggauagagcugcucg

SEQ ID NO: 936637 - RNA, 23 nt, Human
accaggagaaaagcuuugcggga

SEQ ID NO: 936638 - RNA, 22 nt, Human
uugacaauugggagauauaaag

SEQ ID NO: 936639 - RNA, 22 nt, Human
agcugccaccucugccuuuggg

SEQ ID NO: 936640 - RNA, 22 nt, Human
cauuuguaguaucuguuuauau

SEQ ID NO: 936641 - RNA, 22 nt, Human
ugaggcagggagaguggauaug

SEQ ID NO: 936642 - RNA, 22 nt, Human
caagggaccugagauggucucu

SEQ ID NO: 936643 - RNA, 22 nt, Human
ggagccagagggaugcaguuga

SEQ ID NO: 936644 - RNA, 22 nt, Human
aauuaggaauaaaugaguacuu

SEQ ID NO: 936645 - RNA, 22 nt, Human
uguuuaauugggccaacagcgg

SEQ ID NO: 936646 - RNA, 22 nt, Human
aagagcugcaucuaagccauga

SEQ ID NO: 936647 - RNA, 22 nt, Human
ccuggcagacagcacugaagcu

SEQ ID NO: 936648 - RNA, 18 nt, Human
agugugugcccuuucagg

SEQ ID NO: 936649 - RNA, 22 nt, Human
aaaggccacuugaaggauuuuu

SEQ ID NO: 936650 - RNA, 22 nt, Human
uucuuaggacuaguauagcaug

SEQ ID NO: 936651 - RNA, 22 nt, Human
guuuacauauuuuaauugguga

SEQ ID NO: 936652 - RNA, 19 nt, Human
auuccucaaggacagaaau

SEQ ID NO: 936653 - RNA, 22 nt, Human
uauugaguuacagaaaauacuu

SEQ ID NO: 936654 - RNA, 22 nt, Human
agaacagaggccuuauguuuca

SEQ ID NO: 936655 - RNA, 20 nt, Human
cuuagaaauuuuuacccugg

SEQ ID NO: 936656 - RNA, 22 nt, Human
ucucagagaccugaacucccug

SEQ ID NO: 936657 - RNA, 22 nt, Human
auucuucauguugaagcuguca

SEQ ID NO: 936658 - RNA, 22 nt, Human
cacagcugccauggcugcacuu

SEQ ID NO: 936659 - RNA, 22 nt, Human
caggguggaagcuguagagugg

SEQ ID NO: 936660 - RNA, 22 nt, Human
aggagagagaacacuugggucc

SEQ ID NO: 936661 - RNA, 22 nt, Human
uuagaaaucugcugccaugcaa

SEQ ID NO: 936662 - RNA, 22 nt, Human
guucacaucacuucacugaacc

SEQ ID NO: 936663 - RNA, 22 nt, Human
auaugugugaugcauggacuaa

SEQ ID NO: 936664 - RNA, 22 nt, Human
uuuuauagcugaauaguauucc

SEQ ID NO: 936665 - RNA, 22 nt, Human
cagcaguguggaagcugagggg

SEQ ID NO: 936666 - RNA, 22 nt, Human
ucugggaaccagugcggcuggg

SEQ ID NO: 936667 - RNA, 22 nt, Human
cuggcucuucagugcuugguuc

SEQ ID NO: 936668 - RNA, 22 nt, Human
ggagauuuauagcacacuucag

SEQ ID NO: 936669 - RNA, 22 nt, Human
ugaggaugacgauggcaauggc

SEQ ID NO: 936670 - RNA, 22 nt, Human
aagccagcauuuucccauuccu

SEQ ID NO: 936671 - RNA, 22 nt, Human
acccaggagccgugagagguua

SEQ ID NO: 936672 - RNA, 22 nt, Human
uucacagucacccuucuccaug

SEQ ID NO: 936673 - RNA, 22 nt, Human
uaaagugcugggauuauaggcc

SEQ ID NO: 936674 - RNA, 22 nt, Human
uccuggagauaauugcagugaa

SEQ ID NO: 936675 - RNA, 22 nt, Human
ggcagugguuagaaacaugagc

SEQ ID NO: 936676 - RNA, 20 nt, Human
agcaagaguaaggacagcga

SEQ ID NO: 936677 - RNA, 22 nt, Human
uggcccugaggggcugugcccc

SEQ ID NO: 936678 - RNA, 22 nt, Human
cugcagagcaaguaacauccuc

SEQ ID NO: 936679 - RNA, 22 nt, Human
ggcaggcuggcuuuguuccagg

SEQ ID NO: 936680 - RNA, 22 nt, Human
accacaggaauugcucuguggu

SEQ ID NO: 936681 - RNA, 22 nt, Human
auugcuguggaaauauaagaug

SEQ ID NO: 936682 - RNA, 22 nt, Human
ggggacccucaggacugcgucu

SEQ ID NO: 936683 - RNA, 22 nt, Human
ucauugcagugauguuguaugu

SEQ ID NO: 936684 - RNA, 18 nt, Human
ucuuuggacaacuacugg

SEQ ID NO: 936685 - RNA, 22 nt, Human
augauacaucuucaugucagug

SEQ ID NO: 936686 - RNA, 22 nt, Human
cuccugugggucaccaauaggc

SEQ ID NO: 936687 - RNA, 22 nt, Human
auucuucaucagagaugcacua

SEQ ID NO: 936688 - RNA, 22 nt, Human
ggcagcaugagccuggugaauu

SEQ ID NO: 936689 - RNA, 22 nt, Human
caugcugugugguuagaacugu

SEQ ID NO: 936690 - RNA, 22 nt, Human
acagggcaaccucugggagacu

SEQ ID NO: 936691 - RNA, 22 nt, Human
cucacagguaccagcacccucc

SEQ ID NO: 936692 - RNA, 22 nt, Human
ucucacugcaaauauuauguau

SEQ ID NO: 936693 - RNA, 22 nt, Human
guucuucagaggggaaagaacc

SEQ ID NO: 936694 - RNA, 19 nt, Human
agugaaauggaguauucaa

SEQ ID NO: 936695 - RNA, 22 nt, Human
ucuccuggccgggcuguccccu

SEQ ID NO: 936696 - RNA, 22 nt, Human
gcuggugcauuagcugcaguuc

SEQ ID NO: 936697 - RNA, 22 nt, Human
agaggccggccgagcccauggg

SEQ ID NO: 936698 - RNA, 22 nt, Human
ggccugggcccacugucaagag

SEQ ID NO: 936699 - RNA, 22 nt, Human
gggcugggauggcuugaagauu

SEQ ID NO: 936700 - RNA, 22 nt, Human
cugggagcuuuuagaaaugcag

SEQ ID NO: 936701 - RNA, 22 nt, Human
uauuucagacacugaucuugca

SEQ ID NO: 936702 - RNA, 22 nt, Human
ggcuccugggaugggacugagc

SEQ ID NO: 936703 - RNA, 22 nt, Human
ugcuuaauauugugauguaaua

SEQ ID NO: 936704 - RNA, 22 nt, Human
ggcuggcacugaggagagcucu

SEQ ID NO: 936705 - RNA, 22 nt, Human
acuaugcucauuguuaauauuu

SEQ ID NO: 936706 - RNA, 22 nt, Human
ugcacauucacuuagguauugu

SEQ ID NO: 936707 - RNA, 22 nt, Human
gagguacaugaggauacacagg

SEQ ID NO: 936708 - RNA, 22 nt, Human
gcagagaacccagcagauuggc

SEQ ID NO: 936709 - RNA, 22 nt, Human
gccacccccaaguagguggucu

SEQ ID NO: 936710 - RNA, 22 nt, Human
cacacaggagagugcuggaggu

SEQ ID NO: 936711 - RNA, 22 nt, Human
cacugugucaguuugguuagac

SEQ ID NO: 936712 - RNA, 19 nt, Human
ggcugggucuggcagguuc

SEQ ID NO: 936713 - RNA, 22 nt, Human
cccagcacaggcaauuccauac

SEQ ID NO: 936714 - RNA, 22 nt, Human
uacugcaugguggaguggagcu

SEQ ID NO: 936715 - RNA, 22 nt, Human
agccacagcuccuugguggaga

SEQ ID NO: 936716 - RNA, 22 nt, Human
gcaggagcucguuuccaggcug

SEQ ID NO: 936717 - RNA, 22 nt, Human
ccuuuuucccuggagggacagc

SEQ ID NO: 936718 - RNA, 22 nt, Human
aaauuauuaugccccucuauaa

SEQ ID NO: 936719 - RNA, 22 nt, Human
ucuggcucccagccugcucuca

SEQ ID NO: 936720 - RNA, 22 nt, Human
gcucaggaccgaggggugggaa

SEQ ID NO: 936721 - RNA, 22 nt, Human
aaacuguauauuuauggcaugu

SEQ ID NO: 936722 - RNA, 21 nt, Human
cagagcuguccaaacccugac

SEQ ID NO: 936723 - RNA, 22 nt, Human
acagcaagccagcuugucacug

SEQ ID NO: 936724 - RNA, 22 nt, Human
aggaguggaauuacuggguucu

SEQ ID NO: 936725 - RNA, 22 nt, Human
cagagccauuauggagacuugc

SEQ ID NO: 936726 - RNA, 22 nt, Human
cuggaagguuccucccagcucc

SEQ ID NO: 936727 - RNA, 22 nt, Human
cuacugaguccuucagcugcca

SEQ ID NO: 936728 - RNA, 22 nt, Human
ugagccagauaagggcucacgc

SEQ ID NO: 936729 - RNA, 20 nt, Human
caucaucacaugagccaauu

SEQ ID NO: 936730 - RNA, 22 nt, Human
aagcaaaagguuacacuucugg

SEQ ID NO: 936731 - RNA, 22 nt, Human
uggagccaaggccaguucucag

SEQ ID NO: 936732 - RNA, 22 nt, Human
uggugcaagucucugaggaggg

SEQ ID NO: 936733 - RNA, 22 nt, Human
ugugaaaugaagauaauucuug

SEQ ID NO: 936734 - RNA, 18 nt, Human
uccagcgugcuccagggc

SEQ ID NO: 936735 - RNA, 22 nt, Human
aggcccuggucaggucuggcug

SEQ ID NO: 936736 - RNA, 22 nt, Human
accagccugucugagucguggg

SEQ ID NO: 936737 - RNA, 22 nt, Human
uccauggguagcccugguugag

SEQ ID NO: 936738 - RNA, 22 nt, Human
gcagcugagcgugaggaagagu

SEQ ID NO: 936739 - RNA, 22 nt, Human
acaggcagcacuaaucucuggu

SEQ ID NO: 936740 - RNA, 22 nt, Human
cccugagagugagugccaccuu

SEQ ID NO: 936741 - RNA, 22 nt, Human
uucauacaguggcugcacucca

SEQ ID NO: 936742 - RNA, 22 nt, Human
uucagcaagugucucuacuguc

SEQ ID NO: 936743 - RNA, 22 nt, Human
gcugagguaggagguugcagug

SEQ ID NO: 936744 - RNA, 22 nt, Human
ucucaggaucuaauacauggua

SEQ ID NO: 936745 - RNA, 22 nt, Human
cagccagguucaaguccuuaua

SEQ ID NO: 936746 - RNA, 22 nt, Human
cccuggagcugcuugcauguug

SEQ ID NO: 936747 - RNA, 17 nt, Human
uauguaguacuuauaaa

SEQ ID NO: 936748 - RNA, 22 nt, Human
gaaaaagugaccuugguagcua

SEQ ID NO: 936749 - RNA, 22 nt, Human
ucucucugccaacucacagcca

SEQ ID NO: 936750 - RNA, 20 nt, Human
accuuucaaaugauucagca

SEQ ID NO: 936751 - RNA, 22 nt, Human
auggggcugggauucuccucgg

SEQ ID NO: 936752 - RNA, 22 nt, Human
agccuggagcuugaguuaugag

SEQ ID NO: 936753 - RNA, 22 nt, Human
gcccaugcacuuucugugaugg

SEQ ID NO: 936754 - RNA, 22 nt, Human
acauuugagaugccuuuuaggu

SEQ ID NO: 936755 - RNA, 22 nt, Human
ccaggccugcaucugcugcgca

SEQ ID NO: 936756 - RNA, 22 nt, Human
gcugcugugccuggcguccugu

SEQ ID NO: 936757 - RNA, 22 nt, Human
ugguaaauauguccauucucuu

SEQ ID NO: 936758 - RNA, 22 nt, Human
ccuguucaauauucuuccuugu

SEQ ID NO: 936759 - RNA, 18 nt, Human
gggcucugauccuucacc

SEQ ID NO: 936760 - RNA, 22 nt, Human
auaguuugugaaacacagcagu

SEQ ID NO: 936761 - RNA, 22 nt, Human
agaguguuucagucuuccuaga

SEQ ID NO: 936762 - RNA, 22 nt, Human
gcucuguacgcaggaugagggg

SEQ ID NO: 936763 - RNA, 22 nt, Human
ucuucaauuagauuuaccaauu

SEQ ID NO: 936764 - RNA, 22 nt, Human
gugcccugaguggguaggagag

SEQ ID NO: 936765 - RNA, 22 nt, Human
uccugagauaaaucucauguga

SEQ ID NO: 936766 - RNA, 22 nt, Human
acuggcagccacaacuggcagg

SEQ ID NO: 936767 - RNA, 18 nt, Human
uugauaaacaauuucauu

SEQ ID NO: 936768 - RNA, 22 nt, Human
gcagggagguuugcugaccugg

SEQ ID NO: 936769 - RNA, 22 nt, Human
auugacaagugagcugggcugc

SEQ ID NO: 936770 - RNA, 22 nt, Human
aaguaugugauacauguuaauu

SEQ ID NO: 936771 - RNA, 22 nt, Human
cagggcagggauguugcggcag

SEQ ID NO: 936772 - RNA, 22 nt, Human
ugaagaugucagcagggguggu

SEQ ID NO: 936773 - RNA, 22 nt, Human
ggaggaccugcuggcccugcaa

SEQ ID NO: 936774 - RNA, 22 nt, Human
ucugagcuggagcccaucaccu

SEQ ID NO: 936775 - RNA, 22 nt, Human
gccaggcugaggcucuggaaga

SEQ ID NO: 936776 - RNA, 22 nt, Human
uguaauauuguagugacaguac

SEQ ID NO: 936777 - RNA, 22 nt, Human
ccuggccucgugcucacggcuc

SEQ ID NO: 936778 - RNA, 22 nt, Human
uuuaugagcaccuuggcccaga

SEQ ID NO: 936779 - RNA, 20 nt, Human
cugggcugcccagcuauggg

SEQ ID NO: 936780 - RNA, 18 nt, Human
aaggcuucaaagaguaga

SEQ ID NO: 936781 - RNA, 22 nt, Human
cuucagaaugggacuguguuug

SEQ ID NO: 936782 - RNA, 22 nt, Human
cagggagaaaucuccaggaggu

SEQ ID NO: 936783 - RNA, 22 nt, Human
gagccuccuccuggugugccga

SEQ ID NO: 936784 - RNA, 21 nt, Human
aaggccugcuuacugcuaguu

SEQ ID NO: 936785 - RNA, 22 nt, Human
aacucugcaaccuauguagacc

SEQ ID NO: 936786 - RNA, 22 nt, Human
cugccuuugcccuugacacugu

SEQ ID NO: 936787 - RNA, 22 nt, Human
agcuguucccucacugcaguca

SEQ ID NO: 936788 - RNA, 22 nt, Human
uuuauuugucuugccauuuagu

SEQ ID NO: 936789 - RNA, 22 nt, Human
ggccucuguuuggagccaggau

SEQ ID NO: 936790 - RNA, 22 nt, Human
cugcuguguuucugcuagaaaa

SEQ ID NO: 936791 - RNA, 22 nt, Human
augcucugggcaggagcccugg

SEQ ID NO: 936792 - RNA, 22 nt, Human
aacaaauguaaaaugcagaugc

SEQ ID NO: 936793 - RNA, 22 nt, Human
aggauuuugacuuauucaggga

SEQ ID NO: 936794 - RNA, 22 nt, Human
uacauuguucaugcaugagaaa

SEQ ID NO: 936795 - RNA, 22 nt, Human
agccagacauggcuccugcucc

SEQ ID NO: 936796 - RNA, 23 nt, Human
ugaguucucaucuuggcuucuau

SEQ ID NO: 936797 - RNA, 18 nt, Human
aaaaugcaggcgacaugg

SEQ ID NO: 936798 - RNA, 22 nt, Human
ugagcuguagcagaugcuguug

SEQ ID NO: 936799 - RNA, 22 nt, Human
gcauucuuuuuaggagguuccu

SEQ ID NO: 936800 - RNA, 22 nt, Human
gcuagaaaucgacuucagaauu

SEQ ID NO: 936801 - RNA, 22 nt, Human
ugaauauguuccucacaaguuc

SEQ ID NO: 936802 - RNA, 21 nt, Human
uccuucaguucugcacuuucu

SEQ ID NO: 936803 - RNA, 22 nt, Human
cccagggauuauaaaggugaaa

SEQ ID NO: 936804 - RNA, 22 nt, Human
cugaaggaagcagguggccugu

SEQ ID NO: 936805 - RNA, 22 nt, Human
ggcucaggacacagugguuuag

SEQ ID NO: 936806 - RNA, 22 nt, Human
gugugcagaagacacaagacau

SEQ ID NO: 936807 - RNA, 22 nt, Human
auaaggcagucacuggaauguu

SEQ ID NO: 936808 - RNA, 22 nt, Human
cuggcagcgcagcaugaagucg

SEQ ID NO: 936809 - RNA, 22 nt, Human
ugugcccauuccacuugaguac

SEQ ID NO: 936810 - RNA, 22 nt, Human
uguggcucucaugcacucccag

SEQ ID NO: 936811 - RNA, 22 nt, Human
ucagggcauacucuucaagguc

SEQ ID NO: 936812 - RNA, 22 nt, Human
ucuucuuccuccacagggccca

SEQ ID NO: 936813 - RNA, 22 nt, Human
ugcuuggcuuucugagcuucug

SEQ ID NO: 936814 - RNA, 22 nt, Human
auauauaagcugaugagccaca

SEQ ID NO: 936815 - RNA, 22 nt, Human
cagggcagagggaaacuccuuu

SEQ ID NO: 936816 - RNA, 22 nt, Human
aggagacaucuaacuguagguu

SEQ ID NO: 936817 - RNA, 22 nt, Human
uggccucuuaggacauccucua

SEQ ID NO: 936818 - RNA, 22 nt, Human
accccagcucugagccacacca

SEQ ID NO: 936819 - RNA, 20 nt, Human
auccaugagagucuggauuc

SEQ ID NO: 936820 - RNA, 22 nt, Human
cccaagagguggagguugcagu

SEQ ID NO: 936821 - RNA, 22 nt, Human
ucugagccaccugccagugcug

SEQ ID NO: 936822 - RNA, 22 nt, Human
guaagagcacugucuccugcug

SEQ ID NO: 936823 - RNA, 19 nt, Human
ugaagcaauaccauuuuug

SEQ ID NO: 936824 - RNA, 22 nt, Human
gaaaagagaacaucugaggauc

SEQ ID NO: 936825 - RNA, 22 nt, Human
auacuaaaguauagaacuuagu

SEQ ID NO: 936826 - RNA, 21 nt, Human
ugcuggaaaaagugguucuag

SEQ ID NO: 936827 - RNA, 22 nt, Human
aaucauucuuauuucacagcaa

SEQ ID NO: 936828 - RNA, 22 nt, Human
cagggcaguaacgggaacaucu

SEQ ID NO: 936829 - RNA, 22 nt, Human
accacugggcgggcagccugcu

SEQ ID NO: 936830 - RNA, 22 nt, Human
uaaaugcaaugugcuuuaccag

SEQ ID NO: 936831 - RNA, 22 nt, Human
gggcuacauugugagagaaguu

SEQ ID NO: 936832 - RNA, 22 nt, Human
uggcagagguauauugggagga

SEQ ID NO: 936833 - RNA, 22 nt, Human
ggaggccaaggcagguggaucg

SEQ ID NO: 936834 - RNA, 22 nt, Human
ugcugaaauuagaacauugagg

SEQ ID NO: 936835 - RNA, 22 nt, Human
aagacagaccacgugacagggc

SEQ ID NO: 936836 - RNA, 22 nt, Human
uuggccaagucacugguuaaug

SEQ ID NO: 936837 - RNA, 22 nt, Human
acccaggguagagugcaguggc

SEQ ID NO: 936838 - RNA, 22 nt, Human
gcugagguggagauugcaguga

SEQ ID NO: 936839 - RNA, 22 nt, Human
aggugccagaugcacagcugaa

SEQ ID NO: 936840 - RNA, 22 nt, Human
uccugccucuccaugcuaacua

SEQ ID NO: 936841 - RNA, 22 nt, Human
ccuggccucagacagagggugg

SEQ ID NO: 936842 - RNA, 22 nt, Human
cuacccagagugaaucucuuaa

SEQ ID NO: 936843 - RNA, 22 nt, Human
uuuauugcauacacaaauguca

SEQ ID NO: 936844 - RNA, 22 nt, Human
ccuccuggugacaaggcaaagc

SEQ ID NO: 936845 - RNA, 22 nt, Human
aggcugaggcagguggaucauu

SEQ ID NO: 936846 - RNA, 19 nt, Human
gccugcagaaaaggcaggg

SEQ ID NO: 936847 - RNA, 22 nt, Human
cugcuucuccaaaguaggacuu

SEQ ID NO: 936848 - RNA, 21 nt, Human
uucaaugaaaacaaagugagg

SEQ ID NO: 936849 - RNA, 22 nt, Human
uaugaacucuggagucugagug

SEQ ID NO: 936850 - RNA, 22 nt, Human
ccagcccucacugaggccucuc

SEQ ID NO: 936851 - RNA, 21 nt, Human
agggagcuauuuauaguaagc

SEQ ID NO: 936852 - RNA, 22 nt, Human
cagagccaggucuaggagucuc

SEQ ID NO: 936853 - RNA, 22 nt, Human
cucucugagugagggacaagcu

SEQ ID NO: 936854 - RNA, 18 nt, Human
uccagagcuacuguggug

SEQ ID NO: 936855 - RNA, 22 nt, Human
acagaacugggaaaugcacaua

SEQ ID NO: 936856 - RNA, 22 nt, Human
acuggcagagacccugauggcc

SEQ ID NO: 936857 - RNA, 22 nt, Human
gagacaaaaguuggagugcaag

SEQ ID NO: 936858 - RNA, 22 nt, Human
ggaggugguggcagugacaauu

SEQ ID NO: 936859 - RNA, 22 nt, Human
cuugggaaugcuaacagaugac

SEQ ID NO: 936860 - RNA, 22 nt, Human
uagaaacacagaucugguguca

SEQ ID NO: 936861 - RNA, 22 nt, Human
cagccuuuuaggacuauuugug

SEQ ID NO: 936862 - RNA, 22 nt, Human
agagccuggaccugagcuacaa

SEQ ID NO: 936863 - RNA, 19 nt, Human
ucccuuccugucgggcucc

SEQ ID NO: 936864 - RNA, 22 nt, Human
ccucugagagaaggccuucagc

SEQ ID NO: 936865 - RNA, 22 nt, Human
acuugggaugguggccagagcg

SEQ ID NO: 936866 - RNA, 22 nt, Human
cacugcuucuggaggaauuugg

SEQ ID NO: 936867 - RNA, 22 nt, Human
caagaaauuucuuaagaacuaa

SEQ ID NO: 936868 - RNA, 20 nt, Human
gacaggagaguuagguaggu

SEQ ID NO: 936869 - RNA, 22 nt, Human
ugucaccaguuccaggaaauaa

SEQ ID NO: 936870 - RNA, 22 nt, Human
caaggaaaacagaugaucaaca

SEQ ID NO: 936871 - RNA, 22 nt, Human
uuugaaaggugucgagaugugu

SEQ ID NO: 936872 - RNA, 22 nt, Human
cuuugaauugccguuucaucug

SEQ ID NO: 936873 - RNA, 22 nt, Human
cagcugccacuugcucucggcu

SEQ ID NO: 936874 - RNA, 17 nt, Human
agcugaccagauggacu

SEQ ID NO: 936875 - RNA, 22 nt, Human
auauuaauuauuuacacaugag

SEQ ID NO: 936876 - RNA, 22 nt, Human
aggagcagaacuguuguggagg

SEQ ID NO: 936877 - RNA, 22 nt, Human
acuguucacagauuagucgaug

SEQ ID NO: 936878 - RNA, 21 nt, Human
ucuguucaaggaacuacggau

SEQ ID NO: 936879 - RNA, 22 nt, Human
caaauaguaugagcaaugauuc

SEQ ID NO: 936880 - RNA, 17 nt, Human
auuuccucagggcugag

SEQ ID NO: 936881 - RNA, 20 nt, Human
cccugcagccaugggagugg

SEQ ID NO: 936882 - RNA, 22 nt, Human
caguucuuaauaccaugugguu

SEQ ID NO: 936883 - RNA, 20 nt, Human
gcaaauggaucccacaagcc

SEQ ID NO: 936884 - RNA, 22 nt, Human
ucuggcucccuggagcuccaca

SEQ ID NO: 936885 - RNA, 22 nt, Human
agucucaggcagaggaaggcua

SEQ ID NO: 936886 - RNA, 22 nt, Human
gaggggcugggguugacuccaa

SEQ ID NO: 936887 - RNA, 22 nt, Human
caaguaugagaaagcuauuacc

SEQ ID NO: 936888 - RNA, 22 nt, Human
agcugccaggccccugagaacc

SEQ ID NO: 936889 - RNA, 22 nt, Human
aggcuucccagcugagcucagc

SEQ ID NO: 936890 - RNA, 22 nt, Human
cccagacucaucccugggagcu

SEQ ID NO: 936891 - RNA, 22 nt, Human
uuucagaucauuuuuuaaguac

SEQ ID NO: 936892 - RNA, 22 nt, Human
aggcagaaaauagucauccaaa

SEQ ID NO: 936893 - RNA, 22 nt, Human
ggucccagcuggucacugucag

SEQ ID NO: 936894 - RNA, 22 nt, Human
agcauuuaauuacaguuuaauu

SEQ ID NO: 936895 - RNA, 22 nt, Human
aggaguggugcaggaccugcca

SEQ ID NO: 936896 - RNA, 22 nt, Human
augcugugauuguagaaauauu

SEQ ID NO: 936897 - RNA, 22 nt, Human
uuucucaguuacuagcuguggu

SEQ ID NO: 936898 - RNA, 19 nt, Human
gcuuuuuguugucaaaggu

SEQ ID NO: 936899 - RNA, 22 nt, Human
uucuccagagggcucugcagga

SEQ ID NO: 936900 - RNA, 22 nt, Human
ucccagagucuucuccuguaau

SEQ ID NO: 936901 - RNA, 22 nt, Human
gccaccucggcuuucucugcuc

SEQ ID NO: 936902 - RNA, 22 nt, Human
ucccuggacaacagacuucacu

SEQ ID NO: 936903 - RNA, 22 nt, Human
gccugcuggaggagccucaggg

SEQ ID NO: 936904 - RNA, 22 nt, Human
cucacuguccaacaggcuuuac

SEQ ID NO: 936905 - RNA, 22 nt, Human
gguaaaaugcagauucuuagcc

SEQ ID NO: 936906 - RNA, 21 nt, Human
uagcacuucgcuguaauuggg

SEQ ID NO: 936907 - RNA, 22 nt, Human
caggaaugaggucguaaguguc

SEQ ID NO: 936908 - RNA, 22 nt, Human
auugaaagaguuuucugcugca

SEQ ID NO: 936909 - RNA, 22 nt, Human
gauuucaaggaguuuucacagu

SEQ ID NO: 936910 - RNA, 22 nt, Human
gcucucuuuuuccagugguggu

SEQ ID NO: 936911 - RNA, 22 nt, Human
gaaggucaccuccccucucugg

SEQ ID NO: 936912 - RNA, 22 nt, Human
uuuguaagcaaguuaacauuuu

SEQ ID NO: 936913 - RNA, 22 nt, Human
acagagcacauagauuggaguu

SEQ ID NO: 936914 - RNA, 22 nt, Human
aaucucuugggaggaaugaauu

SEQ ID NO: 936915 - RNA, 22 nt, Human
aucuucaaagcacaucguuugu

SEQ ID NO: 936916 - RNA, 22 nt, Human
cuggagccagccagggcccucu

SEQ ID NO: 936917 - RNA, 22 nt, Human
ucccuggcagcuaagggugguc

SEQ ID NO: 936918 - RNA, 22 nt, Human
cugucucuguugccuguaggug

SEQ ID NO: 936919 - RNA, 22 nt, Human
gagagucuagugcaccuaguuu

SEQ ID NO: 936920 - RNA, 22 nt, Human
gcacacagccagcugagggcua

SEQ ID NO: 936921 - RNA, 21 nt, Human
gcaaauguucaggaaaaaaga

SEQ ID NO: 936922 - RNA, 22 nt, Human
gcuuuguguagaaggaggaugg

SEQ ID NO: 936923 - RNA, 22 nt, Human
gccaggaggggagaguguguca

SEQ ID NO: 936924 - RNA, 22 nt, Human
cacagggccuggggcagcugcu

SEQ ID NO: 936925 - RNA, 22 nt, Human
ucuuagaaugucaacugauguu

SEQ ID NO: 936926 - RNA, 22 nt, Human
cauaagaaauuuaacagaacuu

SEQ ID NO: 936927 - RNA, 22 nt, Human
agcuggaggauaacucacuucu

SEQ ID NO: 936928 - RNA, 22 nt, Human
aauuaggaaauucagccauuuu

SEQ ID NO: 936929 - RNA, 22 nt, Human
uugcugaagugaagguauguuu

SEQ ID NO: 936930 - RNA, 22 nt, Human
uggaaagaauuccuaugguuca

SEQ ID NO: 936931 - RNA, 22 nt, Human
ucuacugugguccuuguaacca

SEQ ID NO: 936932 - RNA, 22 nt, Human
cuggagccccagacagggagag

SEQ ID NO: 936933 - RNA, 23 nt, Human
cauggcagcaagagcucauggcc

SEQ ID NO: 936934 - RNA, 22 nt, Human
uggcagacacugucgaagccua

SEQ ID NO: 936935 - RNA, 22 nt, Human
ugggcagaguugugaugaacug

SEQ ID NO: 936936 - RNA, 22 nt, Human
uuuccucugucaugacagcuga

SEQ ID NO: 936937 - RNA, 22 nt, Human
uuuauuagauuaucaaagaggu

SEQ ID NO: 936938 - RNA, 22 nt, Human
gcagcugcaggcaggcuugcug

SEQ ID NO: 936939 - RNA, 22 nt, Human
ucaauuaugccauugcaauauu

SEQ ID NO: 936940 - RNA, 22 nt, Human
ccauuguaaagaguauacuuug

SEQ ID NO: 936941 - RNA, 22 nt, Human
uaaccuuuguucaauguaagau

SEQ ID NO: 936942 - RNA, 22 nt, Human
uuucaguguaagguuuccagga

SEQ ID NO: 936943 - RNA, 22 nt, Human
cccaaacaguuccugugguacu

SEQ ID NO: 936944 - RNA, 22 nt, Human
augguguagcaugugauaugac

SEQ ID NO: 936945 - RNA, 22 nt, Human
ugagccuguggggugacaacca

SEQ ID NO: 936946 - RNA, 22 nt, Human
uccagccaccaccuugauugcc

SEQ ID NO: 936947 - RNA, 22 nt, Human
gaaaauguuuguccggagcuga

SEQ ID NO: 936948 - RNA, 22 nt, Human
ggcugcagcagagggacucacg

SEQ ID NO: 936949 - RNA, 23 nt, Human
cccagcuuucccacugccgagag

SEQ ID NO: 936950 - RNA, 22 nt, Human
guaaaucccauccuuucucugg

SEQ ID NO: 936951 - RNA, 22 nt, Human
ucucagaguuuuuuuccaggac

SEQ ID NO: 936952 - RNA, 22 nt, Human
gcuggggucugugaggagggcu

SEQ ID NO: 936953 - RNA, 22 nt, Human
ugaagccaucaggaagccagca

SEQ ID NO: 936954 - RNA, 22 nt, Human
cugcucugugguccaugagaca

SEQ ID NO: 936955 - RNA, 22 nt, Human
ugaaacacuuucaauuacauau

SEQ ID NO: 936956 - RNA, 22 nt, Human
aucuggcucgcuaggcucuggg

SEQ ID NO: 936957 - RNA, 22 nt, Human
uagaacagaguuccagugauca

SEQ ID NO: 936958 - RNA, 22 nt, Human
guuauguaaucuaacacucagu

SEQ ID NO: 936959 - RNA, 19 nt, Human
ugcaggaggacugagcaga

SEQ ID NO: 936960 - RNA, 22 nt, Human
cucagagucugcauuucuguca

SEQ ID NO: 936961 - RNA, 22 nt, Human
cauuuuaagaugaccugguuuc

SEQ ID NO: 936962 - RNA, 22 nt, Human
uggacagguugaguaggaggag

SEQ ID NO: 936963 - RNA, 22 nt, Human
augucagauguuuaucugauuu

SEQ ID NO: 936964 - RNA, 22 nt, Human
uccaugucuucaugugucuaac

SEQ ID NO: 936965 - RNA, 22 nt, Human
acaugcauucucuaaaagcaaa

SEQ ID NO: 936966 - RNA, 22 nt, Human
uggggugccgacagggagggca

SEQ ID NO: 936967 - RNA, 22 nt, Human
uccuggguccauggcagccgaa

SEQ ID NO: 936968 - RNA, 19 nt, Human
ucauuguugguuugucggg

SEQ ID NO: 936969 - RNA, 22 nt, Human
gucuuaaaaucagaggauauag

SEQ ID NO: 936970 - RNA, 20 nt, Human
agcuucuucugucuaauuuu

SEQ ID NO: 936971 - RNA, 22 nt, Human
uagcuauuuagcccagauaagu

SEQ ID NO: 936972 - RNA, 22 nt, Human
cucuccucagaacaggcccucu

SEQ ID NO: 936973 - RNA, 22 nt, Human
ugcugaaacaauaacauacugg

SEQ ID NO: 936974 - RNA, 22 nt, Human
accuuucauuaaagucuguagu

SEQ ID NO: 936975 - RNA, 22 nt, Human
gggagggaggugcugguucacg

SEQ ID NO: 936976 - RNA, 22 nt, Human
aguguguguuugggcgguuuau

SEQ ID NO: 936977 - RNA, 22 nt, Human
gugggagcugcggaggccuggg

SEQ ID NO: 936978 - RNA, 22 nt, Human
ucagaggaaaggucagauggcu

SEQ ID NO: 936979 - RNA, 22 nt, Human
agcaacuguuacaagaacaaca

SEQ ID NO: 936980 - RNA, 22 nt, Human
cagcaaaauuugaggauugccu

SEQ ID NO: 936981 - RNA, 22 nt, Human
uacuuucuuguuccuuucauaa

SEQ ID NO: 936982 - RNA, 22 nt, Human
uucuuuuccuacacagcgauuu

SEQ ID NO: 936983 - RNA, 22 nt, Human
uucccaugccuggccccuaucc

SEQ ID NO: 936984 - RNA, 22 nt, Human
acuguucacuagugaggguuga

SEQ ID NO: 936985 - RNA, 20 nt, Human
ucagaggcugccagcugggg

SEQ ID NO: 936986 - RNA, 22 nt, Human
ugggcuccagcaccugugcucu

SEQ ID NO: 936987 - RNA, 17 nt, Human
aaauaugaccucaaagu

SEQ ID NO: 936988 - RNA, 22 nt, Human
gguggcuggaggagcugaugga

SEQ ID NO: 936989 - RNA, 22 nt, Human
gugcuaggauuacaggcauggg

SEQ ID NO: 936990 - RNA, 22 nt, Human
uggcugcugagaaggcagcugu

SEQ ID NO: 936991 - RNA, 20 nt, Human
gcucccugguagaaauguuu

SEQ ID NO: 936992 - RNA, 21 nt, Human
cucucugcuuaugaauaguga

SEQ ID NO: 936993 - RNA, 22 nt, Human
cagcuuuuuagaaucuagggca

SEQ ID NO: 936994 - RNA, 19 nt, Human
caggaaggggcgaaucugg

SEQ ID NO: 936995 - RNA, 22 nt, Human
cagcagggaagcugugcuguuu

SEQ ID NO: 936996 - RNA, 22 nt, Human
aggagcagcccacuccuguccu

SEQ ID NO: 936997 - RNA, 22 nt, Human
agcccaggucucaaaguacagg

SEQ ID NO: 936998 - RNA, 22 nt, Human
agccacagagagggagcugcaa

SEQ ID NO: 936999 - RNA, 22 nt, Human
aagcugccugccacgcuagaua

SEQ ID NO: 937000 - RNA, 22 nt, Human
ggucccaggagaauaggugcaa

SEQ ID NO: 937001 - RNA, 20 nt, Human
cccuccagcaaccaggacuu

SEQ ID NO: 937002 - RNA, 22 nt, Human
cccuggcagaaugucucugggc

SEQ ID NO: 937003 - RNA, 22 nt, Human
gaauuguagagggaacagaagc

SEQ ID NO: 937004 - RNA, 20 nt, Human
uacuugaauguugcagcagu

SEQ ID NO: 937005 - RNA, 21 nt, Human
uguaaguuucaucugaauugg

SEQ ID NO: 937006 - RNA, 22 nt, Human
ccuggguggcagagguugcagu

SEQ ID NO: 937007 - RNA, 22 nt, Human
cauuuccagcuccugcaucaug

SEQ ID NO: 937008 - RNA, 22 nt, Human
uggacaggaucugagacugaga

SEQ ID NO: 937009 - RNA, 22 nt, Human
aaguucaaggugauaguggcag

SEQ ID NO: 937010 - RNA, 22 nt, Human
uggugcugacaguucugagugc

SEQ ID NO: 937011 - RNA, 22 nt, Human
gcucugugggugaguagaaucu

SEQ ID NO: 937012 - RNA, 22 nt, Human
ucagcagaggggaaggcaucug

SEQ ID NO: 937013 - RNA, 19 nt, Human
uagcagcugccaaaggaga

SEQ ID NO: 937014 - RNA, 23 nt, Human
uuugaaaguaucaacucgccuga

SEQ ID NO: 937015 - RNA, 22 nt, Human
aaauguguauaugaaacaugau

SEQ ID NO: 937016 - RNA, 22 nt, Human
ugcugcugaucauuuauagucu

SEQ ID NO: 937017 - RNA, 22 nt, Human
uuccuguccgcaauggccuggg

SEQ ID NO: 937018 - RNA, 22 nt, Human
caggguuucaccauguuagcag

SEQ ID NO: 937019 - RNA, 22 nt, Human
gcaaauucuuaacuggacugug

SEQ ID NO: 937020 - RNA, 22 nt, Human
uucagaaugugaccuuauuugg

SEQ ID NO: 937021 - RNA, 22 nt, Human
ugggaauggaugcuaagugcua

SEQ ID NO: 937022 - RNA, 22 nt, Human
cauggccucaaaggacugcaga

SEQ ID NO: 937023 - RNA, 22 nt, Human
gagugugggcacgggggccuug

SEQ ID NO: 937024 - RNA, 22 nt, Human
uggcucagagagggagugugga

SEQ ID NO: 937025 - RNA, 22 nt, Human
cacagguguaugaauaugucca

SEQ ID NO: 937026 - RNA, 22 nt, Human
ggaagagagggcugggccucaa

SEQ ID NO: 937027 - RNA, 22 nt, Human
cagcugcccauccugggaaaug

SEQ ID NO: 937028 - RNA, 22 nt, Human
uggcucagcgguggcagcagac

SEQ ID NO: 937029 - RNA, 20 nt, Human
ucugccacuuuuucugucac

SEQ ID NO: 937030 - RNA, 22 nt, Human
gagggcagagucuaaugaugca

SEQ ID NO: 937031 - RNA, 22 nt, Human
ucagugcacagagauuuuuguu

SEQ ID NO: 937032 - RNA, 21 nt, Human
agcagcagaucuggugagggc

SEQ ID NO: 937033 - RNA, 22 nt, Human
gccuggaguggacuuggccccu

SEQ ID NO: 937034 - RNA, 22 nt, Human
aaaugauugucaaaguucuguu

SEQ ID NO: 937035 - RNA, 22 nt, Human
auguacaguuucuagacucaaa

SEQ ID NO: 937036 - RNA, 22 nt, Human
uuguggcucgugagauguuagg

SEQ ID NO: 937037 - RNA, 22 nt, Human
ggcucugcgcgguaaagugacu

SEQ ID NO: 937038 - RNA, 22 nt, Human
uccugagcugccgcaucagcag

SEQ ID NO: 937039 - RNA, 22 nt, Human
caucuucagguucauggucaua

SEQ ID NO: 937040 - RNA, 22 nt, Human
ggcaugcugcguacagaugaac

SEQ ID NO: 937041 - RNA, 22 nt, Human
uuuaaauuuagaagaaacacug

SEQ ID NO: 937042 - RNA, 22 nt, Human
agcugggaugauaaccucaguc

SEQ ID NO: 937043 - RNA, 22 nt, Human
guuaaauucgaugauggauaaa

SEQ ID NO: 937044 - RNA, 22 nt, Human
acagggcagaaauguugcaucu

SEQ ID NO: 937045 - RNA, 20 nt, Human
gcccacucuaauccacuguc

SEQ ID NO: 937046 - RNA, 22 nt, Human
uuggccaauuuagaacguguug

SEQ ID NO: 937047 - RNA, 22 nt, Human
accuuggggugaugcugaaaga

SEQ ID NO: 937048 - RNA, 22 nt, Human
cagcagcaaaucuagaagagga

SEQ ID NO: 937049 - RNA, 22 nt, Human
auuggucaggacuggcaugugg

SEQ ID NO: 937050 - RNA, 22 nt, Human
ggguaauuggggccuugcagug

SEQ ID NO: 937051 - RNA, 22 nt, Human
caggagcucuuaaggaugugau

SEQ ID NO: 937052 - RNA, 22 nt, Human
agggcagcucucaccucuggcc

SEQ ID NO: 937053 - RNA, 22 nt, Human
gcccagccuccaagcuccaagg

SEQ ID NO: 937054 - RNA, 22 nt, Human
cuccuggcuuucccagaccagg

SEQ ID NO: 937055 - RNA, 22 nt, Human
uuugaaguguuauuucuaucac

SEQ ID NO: 937056 - RNA, 22 nt, Human
cuccugaggggacaggacucau

SEQ ID NO: 937057 - RNA, 22 nt, Human
cagcagguauguuuguucagca

SEQ ID NO: 937058 - RNA, 22 nt, Human
aaagcagaggugauaugacuua

SEQ ID NO: 937059 - RNA, 22 nt, Human
uguguucaagauuaguucuagu

SEQ ID NO: 937060 - RNA, 22 nt, Human
cugcugugauugggagaaaccg

SEQ ID NO: 937061 - RNA, 22 nt, Human
gcagugguccaguucacaccca

SEQ ID NO: 937062 - RNA, 22 nt, Human
agcagggcuucugugccugugc

SEQ ID NO: 937063 - RNA, 22 nt, Human
cagccugcagggcugccuguug

SEQ ID NO: 937064 - RNA, 22 nt, Human
cugcucugacccuuucaccuuc

SEQ ID NO: 937065 - RNA, 22 nt, Human
uagugcuuaacacaaagugauu

SEQ ID NO: 937066 - RNA, 21 nt, Human
cccuugccugcacuccucggc

SEQ ID NO: 937067 - RNA, 22 nt, Human
augcugugagugugccgcagag

SEQ ID NO: 937068 - RNA, 22 nt, Human
uugaagcagcucaggaggcuua

SEQ ID NO: 937069 - RNA, 22 nt, Human
cccuugcaucccauguguggcc

SEQ ID NO: 937070 - RNA, 22 nt, Human
ugggcuggcugaggcauucacu

SEQ ID NO: 937071 - RNA, 18 nt, Human
aggcuucuuggcucaguc

SEQ ID NO: 937072 - RNA, 22 nt, Human
ucuguucauaguaguguauaug

SEQ ID NO: 937073 - RNA, 21 nt, Human
cuccugggcuaagauauagug

SEQ ID NO: 937074 - RNA, 22 nt, Human
aaguguuaaaagauuaaaugcu

SEQ ID NO: 937075 - RNA, 22 nt, Human
cauggcccucuucuggagcaau

SEQ ID NO: 937076 - RNA, 22 nt, Human
cagagcugucauuugccaguga

SEQ ID NO: 937077 - RNA, 22 nt, Human
uugcagggaccugcagaaagcu

SEQ ID NO: 937078 - RNA, 22 nt, Human
gccugcaguucugugcuaggca

SEQ ID NO: 937079 - RNA, 22 nt, Human
uaaaucuuguggcaaugcuucu

SEQ ID NO: 937080 - RNA, 22 nt, Human
uguuuuuaaauaaugauagaaa

SEQ ID NO: 937081 - RNA, 22 nt, Human
ucuccucucuuaccugguacaa

SEQ ID NO: 937082 - RNA, 17 nt, Human
auuucacuuagcaugag

SEQ ID NO: 937083 - RNA, 22 nt, Human
ucagggaacaauguuauggcuu

SEQ ID NO: 937084 - RNA, 22 nt, Human
ccaggcucugcgcuggacaugg

SEQ ID NO: 937085 - RNA, 22 nt, Human
cagagaccccgcugcccuucug

SEQ ID NO: 937086 - RNA, 23 nt, Human
ccugggcauuggcugcagcuucu

SEQ ID NO: 937087 - RNA, 22 nt, Human
uccaggagaccagauguaggcc

SEQ ID NO: 937088 - RNA, 22 nt, Human
gggccccuuguaucucuggcuc

SEQ ID NO: 937089 - RNA, 22 nt, Human
uggccugggugcugcugacauc

SEQ ID NO: 937090 - RNA, 22 nt, Human
aaaguguggcacaagucacauc

SEQ ID NO: 937091 - RNA, 22 nt, Human
cacucaggguacaauggagggc

SEQ ID NO: 937092 - RNA, 22 nt, Human
gcuguguuuuauguuagguuaa

SEQ ID NO: 937093 - RNA, 22 nt, Human
ccugugggagggagcggcugga

SEQ ID NO: 937094 - RNA, 20 nt, Human
uccagcugggaacagcugau

SEQ ID NO: 937095 - RNA, 22 nt, Human
cauggacucugguuuggggagc

SEQ ID NO: 937096 - RNA, 22 nt, Human
aaguucaauggaaaagcuuuag

SEQ ID NO: 937097 - RNA, 22 nt, Human
cuguguggccucaagccagccu

SEQ ID NO: 937098 - RNA, 20 nt, Human
uguacacaguacuuuacaau

SEQ ID NO: 937099 - RNA, 22 nt, Human
acauucuauuucaucaugucua

SEQ ID NO: 937100 - RNA, 22 nt, Human
aaguucaaguaguguuacaugg

SEQ ID NO: 937101 - RNA, 22 nt, Human
ucucucuucaacccuuaacuag

SEQ ID NO: 937102 - RNA, 22 nt, Human
caagcccaggauuccccaguua

SEQ ID NO: 937103 - RNA, 22 nt, Human
guguggcuaccucagaggagca

SEQ ID NO: 937104 - RNA, 22 nt, Human
ucuuuccuagaggcugaugagu

SEQ ID NO: 937105 - RNA, 22 nt, Human
uauuucugggaguucagaaauu

SEQ ID NO: 937106 - RNA, 22 nt, Human
aagcaauagcaacaacuuuaca

SEQ ID NO: 937107 - RNA, 22 nt, Human
acguuuucagugacugugcuuc

SEQ ID NO: 937108 - RNA, 22 nt, Human
gccauuuucugucuuguuuauu

SEQ ID NO: 937109 - RNA, 22 nt, Human
ggccucaguuucuccauggguu

SEQ ID NO: 937110 - RNA, 22 nt, Human
uugggcaaaguguuucuggagc

SEQ ID NO: 937111 - RNA, 22 nt, Human
aaaaucugguaauuugaaugug

SEQ ID NO: 937112 - RNA, 22 nt, Human
aguuuagaguucaaauuaguuc

SEQ ID NO: 937113 - RNA, 22 nt, Human
uuaaacagagucugaaauguaa

SEQ ID NO: 937114 - RNA, 22 nt, Human
cccaaggacacgggcagggaca

SEQ ID NO: 937115 - RNA, 22 nt, Human
uggccauagcucagcuccuuca

SEQ ID NO: 937116 - RNA, 22 nt, Human
cugagccaccggcagggacauc

SEQ ID NO: 937117 - RNA, 22 nt, Human
uugcugugucauuuguuuaauc

SEQ ID NO: 937118 - RNA, 22 nt, Human
gagcaggcuugcagagaagggg

SEQ ID NO: 937119 - RNA, 20 nt, Human
agagccuugaggaagaugau

SEQ ID NO: 937120 - RNA, 22 nt, Human
cacagcugaaguagccaugugg

SEQ ID NO: 937121 - RNA, 22 nt, Human
gccucugcacuguggcacacca

SEQ ID NO: 937122 - RNA, 22 nt, Human
acagaaauaacuuuuuauguuu

SEQ ID NO: 937123 - RNA, 20 nt, Human
augcuuucuugugugcugcu

SEQ ID NO: 937124 - RNA, 22 nt, Human
uuccaguuaaggaagcuauucu

SEQ ID NO: 937125 - RNA, 22 nt, Human
acaggggaauuuacugucauua

SEQ ID NO: 937126 - RNA, 22 nt, Human
caggauccuggcugcauggacg

SEQ ID NO: 937127 - RNA, 22 nt, Human
cuaagccacucaaaucuugugg

SEQ ID NO: 937128 - RNA, 22 nt, Human
cuuuugauaguugcugagcagg

SEQ ID NO: 937129 - RNA, 22 nt, Human
cucaggaugaaagucaugguga

SEQ ID NO: 937130 - RNA, 22 nt, Human
gcugggagcaaguacucaucuu

SEQ ID NO: 937131 - RNA, 22 nt, Human
gaagcagcagcuggggacaguu

SEQ ID NO: 937132 - RNA, 22 nt, Human
acuguugucaggcugcuuugga

SEQ ID NO: 937133 - RNA, 22 nt, Human
uuugcuauuuuucugugcagcu

SEQ ID NO: 937134 - RNA, 22 nt, Human
uucugagcuacauaguacuggg

SEQ ID NO: 937135 - RNA, 22 nt, Human
ccagugcuucuuugcuagcugg

SEQ ID NO: 937136 - RNA, 22 nt, Human
acucugcuugcccaauggaaac

SEQ ID NO: 937137 - RNA, 22 nt, Human
aagagguugucugugaugaguu

SEQ ID NO: 937138 - RNA, 20 nt, Human
gagccuuccccucaccacug

SEQ ID NO: 937139 - RNA, 22 nt, Human
acagggaauggagggaucagua

SEQ ID NO: 937140 - RNA, 22 nt, Human
guuugcauaaaguggaugcagg

SEQ ID NO: 937141 - RNA, 22 nt, Human
auguggcacagcacaguaagag

SEQ ID NO: 937142 - RNA, 22 nt, Human
agagcuguggauaguccuggau

SEQ ID NO: 937143 - RNA, 22 nt, Human
ccagccuggguguuagaagaca

SEQ ID NO: 937144 - RNA, 17 nt, Human
cagugcagagcccuuuc

SEQ ID NO: 937145 - RNA, 22 nt, Human
aagaauguuaguuucugauaca

SEQ ID NO: 937146 - RNA, 22 nt, Human
ggccagagagccgcuguuagga

SEQ ID NO: 937147 - RNA, 22 nt, Human
agcaucuggucaugagugagaa

SEQ ID NO: 937148 - RNA, 22 nt, Human
cugggagaucuccugagggcag

SEQ ID NO: 937149 - RNA, 22 nt, Human
ccucccaccauuuagagagagc

SEQ ID NO: 937150 - RNA, 22 nt, Human
aaguuugacagaaguuucuaau

SEQ ID NO: 937151 - RNA, 20 nt, Human
ugucaugcauuagaugaaga

SEQ ID NO: 937152 - RNA, 22 nt, Human
caugcacaaagguaagaugcgu

SEQ ID NO: 937153 - RNA, 22 nt, Human
aagguacagaaauuaacaagga

SEQ ID NO: 937154 - RNA, 22 nt, Human
ugugggcaggcccgggucugag

SEQ ID NO: 937155 - RNA, 22 nt, Human
ccuguguguaggccaggggagu

SEQ ID NO: 937156 - RNA, 22 nt, Human
agccccucuguggcucugccuc

SEQ ID NO: 937157 - RNA, 23 nt, Human
agucaguguaaguuuggaaugca

SEQ ID NO: 937158 - RNA, 22 nt, Human
caggggccggcuguccgugccc

SEQ ID NO: 937159 - RNA, 22 nt, Human
cccacucuggcucccuucuagu

SEQ ID NO: 937160 - RNA, 22 nt, Human
cagcagagcuuauguuggguca

SEQ ID NO: 937161 - RNA, 18 nt, Human
agagaugguguagaguuu

SEQ ID NO: 937162 - RNA, 22 nt, Human
uuauuagguuauucucuguacu

SEQ ID NO: 937163 - RNA, 22 nt, Human
aaagguuugcauggaauuuacc

SEQ ID NO: 937164 - RNA, 22 nt, Human
aagaauguucauuaaacuguug

SEQ ID NO: 937165 - RNA, 22 nt, Human
aucauaaagugcuaucugauug

SEQ ID NO: 937166 - RNA, 22 nt, Human
caguuucuacgacuuaagcaca

SEQ ID NO: 937167 - RNA, 22 nt, Human
ucagcaauccucccacaggugg

SEQ ID NO: 937168 - RNA, 22 nt, Human
uggaggaaucagggcuuaggcu

SEQ ID NO: 937169 - RNA, 22 nt, Human
agaggucauaucucagaagaga

SEQ ID NO: 937170 - RNA, 22 nt, Human
gccucccuggcccacagcagcg

SEQ ID NO: 937171 - RNA, 22 nt, Human
aaauuucaguuaccuuuacguu

SEQ ID NO: 937172 - RNA, 22 nt, Human
cuggggcugcgguggaggagcc

SEQ ID NO: 937173 - RNA, 22 nt, Human
gccugccuagaauugcagcuuu

SEQ ID NO: 937174 - RNA, 19 nt, Human
gccucugcuggggacaggc

SEQ ID NO: 937175 - RNA, 22 nt, Human
aucuacaggcugaggugggagg

SEQ ID NO: 937176 - RNA, 22 nt, Human
accuacccuuagaucacaaggg

SEQ ID NO: 937177 - RNA, 22 nt, Human
ccuguggcacaugcagggauuc

SEQ ID NO: 937178 - RNA, 22 nt, Human
auuuuuccaauuaggauaaaga

SEQ ID NO: 937179 - RNA, 22 nt, Human
cagcagagcugggcuuugaauu

SEQ ID NO: 937180 - RNA, 22 nt, Human
gugauugcccagcaccauuguu

SEQ ID NO: 937181 - RNA, 22 nt, Human
uggcugccuuucaccucaucuc

SEQ ID NO: 937182 - RNA, 22 nt, Human
guaacugaggcagcuuuuaaga

SEQ ID NO: 937183 - RNA, 23 nt, Human
cccagagcacagccuccagaugc

SEQ ID NO: 937184 - RNA, 22 nt, Human
cccaggaaaguggaggcggcug

SEQ ID NO: 937185 - RNA, 22 nt, Human
agcugccaucagccuuuggaug

SEQ ID NO: 937186 - RNA, 22 nt, Human
uggggugguaauacaccguucu

SEQ ID NO: 937187 - RNA, 22 nt, Human
uaccuugggcuauuaucuuuga

SEQ ID NO: 937188 - RNA, 22 nt, Human
acaaacuaccuacagauguuca

SEQ ID NO: 937189 - RNA, 22 nt, Human
uagcacaucuggcgcuuauagg

SEQ ID NO: 937190 - RNA, 22 nt, Human
agcugucuccagauacaggauu

SEQ ID NO: 937191 - RNA, 22 nt, Human
cccagcaguaaccaguggaaau

SEQ ID NO: 937192 - RNA, 22 nt, Human
caggagaggaggcuacuucuua

SEQ ID NO: 937193 - RNA, 22 nt, Human
aauauaauuuuauuccuagagu

SEQ ID NO: 937194 - RNA, 22 nt, Human
aaguccaucucugccccacaca

SEQ ID NO: 937195 - RNA, 22 nt, Human
cuuuggcaaggguuuuaauugu

SEQ ID NO: 937196 - RNA, 22 nt, Human
caaugugugcuuacaggccagu

SEQ ID NO: 937197 - RNA, 22 nt, Human
caguacuuggucaaggaagcag

SEQ ID NO: 937198 - RNA, 22 nt, Human
agcaggugcauggcgagcgcgg

SEQ ID NO: 937199 - RNA, 22 nt, Human
aagagggaggugcgggugcaga

SEQ ID NO: 937200 - RNA, 22 nt, Human
ucucuucuagcuucuugugguu

SEQ ID NO: 937201 - RNA, 22 nt, Human
uauucacaaaaugagguccuca

SEQ ID NO: 937202 - RNA, 22 nt, Human
gguggccaggccagcucuggcc

SEQ ID NO: 937203 - RNA, 22 nt, Human
acguuuucuagagaauaugcag

SEQ ID NO: 937204 - RNA, 22 nt, Human
gaugaaaaaagacgagcauaua

SEQ ID NO: 937205 - RNA, 22 nt, Human
caugggcuacagaagcaugcug

SEQ ID NO: 937206 - RNA, 22 nt, Human
ggugaaggaggaagcugaugga

SEQ ID NO: 937207 - RNA, 22 nt, Human
ugagccuggccugcagagacca

SEQ ID NO: 937208 - RNA, 22 nt, Human
uaggcacugaguacauauuggu

SEQ ID NO: 937209 - RNA, 22 nt, Human
ucugucuccucugaggugccag

SEQ ID NO: 937210 - RNA, 22 nt, Human
cugcccaaauccuucuuccucu

SEQ ID NO: 937211 - RNA, 22 nt, Human
agcugcaggcccaugcucaguc

SEQ ID NO: 937212 - RNA, 22 nt, Human
ucuuggagacucuuguauauuu

SEQ ID NO: 937213 - RNA, 22 nt, Human
aguugacauccagagacauucu

SEQ ID NO: 937214 - RNA, 22 nt, Human
acagaggccucggccugcccag

SEQ ID NO: 937215 - RNA, 22 nt, Human
gcugccaauccagcugugggag

SEQ ID NO: 937216 - RNA, 22 nt, Human
gaggcagcuuggggcugugggu

SEQ ID NO: 937217 - RNA, 22 nt, Human
uaacauuccucaaaguuuucag

SEQ ID NO: 937218 - RNA, 22 nt, Human
gggagggaaggaccuuaugaau

SEQ ID NO: 937219 - RNA, 22 nt, Human
gagagaagaauguuccgaggcc

SEQ ID NO: 937220 - RNA, 22 nt, Human
cauauucuuuaagcaaugcucu

SEQ ID NO: 937221 - RNA, 22 nt, Human
cuguagcaaguuauucaauaaa

SEQ ID NO: 937222 - RNA, 22 nt, Human
auggacaggaacucccuuggca

SEQ ID NO: 937223 - RNA, 22 nt, Human
agcugcucugauaaaccuacuu

SEQ ID NO: 937224 - RNA, 22 nt, Human
uccaagggaauuuaaaguugcu

SEQ ID NO: 937225 - RNA, 22 nt, Human
ccuuuucaacuaagauucugca

SEQ ID NO: 937226 - RNA, 23 nt, Human
ccucccaccuauuucacuuucuu

SEQ ID NO: 937227 - RNA, 22 nt, Human
cauguuuacuaccaggagaaug

SEQ ID NO: 937228 - RNA, 22 nt, Human
ucugcagcuuuuugguggggug

SEQ ID NO: 937229 - RNA, 22 nt, Human
agauggagaaugacaauuaagg

SEQ ID NO: 937230 - RNA, 22 nt, Human
cuucagggugacgcaggcugca

SEQ ID NO: 937231 - RNA, 22 nt, Human
agagcuguagcuuccuagagcc

SEQ ID NO: 937232 - RNA, 22 nt, Human
ugccugggggacuaaggccaaa

SEQ ID NO: 937233 - RNA, 22 nt, Human
uuguuuucuccacugcaucuua

SEQ ID NO: 937234 - RNA, 22 nt, Human
ccugucaggguuugccucagaa

SEQ ID NO: 937235 - RNA, 20 nt, Human
ugaaggccauuuguuccaga

SEQ ID NO: 937236 - RNA, 22 nt, Human
ccacagggcacagacaggaagc

SEQ ID NO: 937237 - RNA, 22 nt, Human
aaagaaauagauggcauuuaaa

SEQ ID NO: 937238 - RNA, 22 nt, Human
cuuauuagaaagaaaagacaug

SEQ ID NO: 937239 - RNA, 17 nt, Human
gcagugaaaagagauca

SEQ ID NO: 937240 - RNA, 22 nt, Human
uuugaaaggaaguuaauacuuu

SEQ ID NO: 937241 - RNA, 22 nt, Human
uaaugugugucaucaguagagu

SEQ ID NO: 937242 - RNA, 22 nt, Human
ccuguucagagcuaagcaucau

SEQ ID NO: 937243 - RNA, 20 nt, Human
uucuuucaucuacacguugu

SEQ ID NO: 937244 - RNA, 19 nt, Human
ggucucagugcagcugcag

SEQ ID NO: 937245 - RNA, 22 nt, Human
ccaggagagcaggcgugcagcu

SEQ ID NO: 937246 - RNA, 23 nt, Human
ugcugggguaguuuguggcacag

SEQ ID NO: 937247 - RNA, 22 nt, Human
ccagguggugaaagugggcccu

SEQ ID NO: 937248 - RNA, 22 nt, Human
aagcugccagcugagcugaggc

SEQ ID NO: 937249 - RNA, 22 nt, Human
aagaaucauccugcaagagucu

SEQ ID NO: 937250 - RNA, 22 nt, Human
ccagggucucugcugccugaga

SEQ ID NO: 937251 - RNA, 22 nt, Human
uugaggagcacuagucagguau

SEQ ID NO: 937252 - RNA, 22 nt, Human
uaaccuuuggugaaauauuaac

SEQ ID NO: 937253 - RNA, 22 nt, Human
gaaguacaguuuuaucuagcca

SEQ ID NO: 937254 - RNA, 22 nt, Human
gugucccaggccucuggaauua

SEQ ID NO: 937255 - RNA, 22 nt, Human
cacugucuuuugugaagacaau

SEQ ID NO: 937256 - RNA, 22 nt, Human
agagccugaggcccugagaggg

SEQ ID NO: 937257 - RNA, 22 nt, Human
ucucaggcuaccuugcacaagg

SEQ ID NO: 937258 - RNA, 22 nt, Human
cccaggaagaaauucugauuug

SEQ ID NO: 937259 - RNA, 22 nt, Human
uagcucuucaaucacugucucc

SEQ ID NO: 937260 - RNA, 22 nt, Human
agucagugaaaacuagaauguu

SEQ ID NO: 937261 - RNA, 22 nt, Human
ggcagcucugaugaugcucugg

SEQ ID NO: 937262 - RNA, 22 nt, Human
agcucccaggcagucaugagga

SEQ ID NO: 937263 - RNA, 22 nt, Human
aggcaagcugcagagaguccuu

SEQ ID NO: 937264 - RNA, 22 nt, Human
cggcagagacggcgcuuugaac

SEQ ID NO: 937265 - RNA, 20 nt, Human
ugcugucguguuuucugcuu

SEQ ID NO: 937266 - RNA, 22 nt, Human
uaggccaguggcagguugugug

SEQ ID NO: 937267 - RNA, 22 nt, Human
ggaugcuggggaccaaucucug

SEQ ID NO: 937268 - RNA, 22 nt, Human
uuauccaagcagaagcugcaca

SEQ ID NO: 937269 - RNA, 22 nt, Human
ugauuuccucuacuagcaauua

SEQ ID NO: 937270 - RNA, 22 nt, Human
ucacugggagaugugggaaggg

SEQ ID NO: 937271 - RNA, 22 nt, Human
ccuggccaggcucucagcacug

SEQ ID NO: 937272 - RNA, 22 nt, Human
ucccagagacaucauuucuccg

SEQ ID NO: 937273 - RNA, 22 nt, Human
ucccuuaaaacucauguguugu

SEQ ID NO: 937274 - RNA, 22 nt, Human
aaguuacaggagaaagagauca

SEQ ID NO: 937275 - RNA, 22 nt, Human
ucucugggugauggcagggcac

SEQ ID NO: 937276 - RNA, 22 nt, Human
gagaaggaguagcugaccuggg

SEQ ID NO: 937277 - RNA, 22 nt, Human
auguaucaugcaggguccauga

SEQ ID NO: 937278 - RNA, 22 nt, Human
cauugguagaguuuguuuuaua

SEQ ID NO: 937279 - RNA, 22 nt, Human
uugcagcagggugaauucacuc

SEQ ID NO: 937280 - RNA, 22 nt, Human
agugguaacuaaguccugcuua

SEQ ID NO: 937281 - RNA, 20 nt, Human
guguuucaugugauacaaug

SEQ ID NO: 937282 - RNA, 22 nt, Human
ugucucaguacacuccgauguu

SEQ ID NO: 937283 - RNA, 22 nt, Human
ggccagcucugcacagcagcug

SEQ ID NO: 937284 - RNA, 22 nt, Human
cuggcaggaagaggaaagguca

SEQ ID NO: 937285 - RNA, 22 nt, Human
ucauuucucccggccaaaaacu

SEQ ID NO: 937286 - RNA, 22 nt, Human
uugaaaggcacaggcaccuggg

SEQ ID NO: 937287 - RNA, 22 nt, Human
auaauuuaaauuaguaugugau

SEQ ID NO: 937288 - RNA, 22 nt, Human
gcucccacugcagcccugagcc

SEQ ID NO: 937289 - RNA, 22 nt, Human
ucuggcuccacaccucacugca

SEQ ID NO: 937290 - RNA, 22 nt, Human
ucuccuuuaagauuuccucagg

SEQ ID NO: 937291 - RNA, 22 nt, Human
gcugccagcuuuccuuggcuga

SEQ ID NO: 937292 - RNA, 22 nt, Human
ugugcucuggaguugccuucac

SEQ ID NO: 937293 - RNA, 22 nt, Human
augcagaaugaguucacgaucu

SEQ ID NO: 937294 - RNA, 23 nt, Human
ccaggcaguagcuauugaaguga

SEQ ID NO: 937295 - RNA, 20 nt, Human
gcagcagacagacaggggac

SEQ ID NO: 937296 - RNA, 21 nt, Human
uccaggaguucuaauaggugu

SEQ ID NO: 937297 - RNA, 22 nt, Human
guggccucaugucuauaaagag

SEQ ID NO: 937298 - RNA, 22 nt, Human
uuguuucaugaguguaaaggga

SEQ ID NO: 937299 - RNA, 22 nt, Human
gccucugccaagggggcugcgg

SEQ ID NO: 937300 - RNA, 22 nt, Human
auucaguuaaaaacuguacuuc

SEQ ID NO: 937301 - RNA, 22 nt, Human
augcuguguuuuaaauggaaau

SEQ ID NO: 937302 - RNA, 22 nt, Human
agauuccagaucccaaaaauga

SEQ ID NO: 937303 - RNA, 22 nt, Human
ugucuuauggcauguccacugg

SEQ ID NO: 937304 - RNA, 22 nt, Human
ggccagcugggccaccaggugc

SEQ ID NO: 937305 - RNA, 22 nt, Human
uccucagacuucccuuugugua

SEQ ID NO: 937306 - RNA, 22 nt, Human
gcugugagccgcugcugagcau

SEQ ID NO: 937307 - RNA, 22 nt, Human
uuuguuuucaaugugucauuca

SEQ ID NO: 937308 - RNA, 20 nt, Human
ccugggguacacuggcaugu

SEQ ID NO: 937309 - RNA, 22 nt, Human
uacaaagugagcaaccucuuuu

SEQ ID NO: 937310 - RNA, 22 nt, Human
uucagcaauuuuuuaagcuaau

SEQ ID NO: 937311 - RNA, 22 nt, Human
acacugaauauacaaugaauau

SEQ ID NO: 937312 - RNA, 22 nt, Human
uggacaggugagugacucaggg

SEQ ID NO: 937313 - RNA, 22 nt, Human
ucaaaagucugcauucuucaca

SEQ ID NO: 937314 - RNA, 22 nt, Human
agccuguggaucccugcacugg

SEQ ID NO: 937315 - RNA, 22 nt, Human
aggagaggcaucaagaaaaucg

SEQ ID NO: 937316 - RNA, 22 nt, Human
augccaggccccacgcugggca

SEQ ID NO: 937317 - RNA, 22 nt, Human
aaugcacaugccacauguggua

SEQ ID NO: 937318 - RNA, 22 nt, Human
ggaggccaugaggcucuaggug

SEQ ID NO: 937319 - RNA, 22 nt, Human
acuuucugcaguguuggaaaug

SEQ ID NO: 937320 - RNA, 22 nt, Human
cacagcuaggaggaaagcagag

SEQ ID NO: 937321 - RNA, 22 nt, Human
acagcagcuaaccccugggcca

SEQ ID NO: 937322 - RNA, 22 nt, Human
aaugccaguguguugauuccag

SEQ ID NO: 937323 - RNA, 22 nt, Human
auuggcagaaacagcagggcca

SEQ ID NO: 937324 - RNA, 22 nt, Human
auuauuauauagggaaaguccc

SEQ ID NO: 937325 - RNA, 22 nt, Human
ugggagcaaaugacugggagau

SEQ ID NO: 937326 - RNA, 18 nt, Human
aggccugggaagcugagg

SEQ ID NO: 937327 - RNA, 22 nt, Human
aaagacauugaagaaggacuua

SEQ ID NO: 937328 - RNA, 22 nt, Human
uaaaugagggcugacaugauug

SEQ ID NO: 937329 - RNA, 22 nt, Human
cacccuggaaagaaggucuggg

SEQ ID NO: 937330 - RNA, 22 nt, Human
auaugcuuaugaugucucaagu

SEQ ID NO: 937331 - RNA, 22 nt, Human
ugucuuauuccuucuguucagc

SEQ ID NO: 937332 - RNA, 22 nt, Human
uccuggcccucugcaaacgcca

SEQ ID NO: 937333 - RNA, 22 nt, Human
cugccuggagcauucugaaggu

SEQ ID NO: 937334 - RNA, 22 nt, Human
uaaggccaaguucauauacaac

SEQ ID NO: 937335 - RNA, 22 nt, Human
ggagccagugcccucuggugga

SEQ ID NO: 937336 - RNA, 22 nt, Human
ugaggcagugugagauaauaaa

SEQ ID NO: 937337 - RNA, 22 nt, Human
ucuguuccauguuuuguuccau

SEQ ID NO: 937338 - RNA, 22 nt, Human
guuuccaaccccaccaaagugc

SEQ ID NO: 937339 - RNA, 18 nt, Human
uggagcugagugcugugc

SEQ ID NO: 937340 - RNA, 22 nt, Human
acaguaauauugaugcucguca

SEQ ID NO: 937341 - RNA, 22 nt, Human
aacagcaauagcacuauucauu

SEQ ID NO: 937342 - RNA, 22 nt, Human
uggccugggucacaccaggguc

SEQ ID NO: 937343 - RNA, 22 nt, Human
aaaggccaauaaagacaagcug

SEQ ID NO: 937344 - RNA, 22 nt, Human
ugaaaucugcaugcaaaguccu

SEQ ID NO: 937345 - RNA, 22 nt, Human
acaaaguccugguguauggcca

SEQ ID NO: 937346 - RNA, 23 nt, Human
cacuccuguuucuaagccagcau

SEQ ID NO: 937347 - RNA, 22 nt, Human
ugggcucugcaucagugcccau

SEQ ID NO: 937348 - RNA, 22 nt, Human
ggcagggucuggacugaaagcu

SEQ ID NO: 937349 - RNA, 22 nt, Human
uccagucaagcuugagaauuuc

SEQ ID NO: 937350 - RNA, 22 nt, Human
guuuuuccugcugacuuggguc

SEQ ID NO: 937351 - RNA, 22 nt, Human
uuucauugcagagucugugugc

SEQ ID NO: 937352 - RNA, 20 nt, Human
aggaacuggaagggaggaaa

SEQ ID NO: 937353 - RNA, 22 nt, Human
uacaaaaaauugauacugacga

SEQ ID NO: 937354 - RNA, 22 nt, Human
gagugcagaugccagccccagu

SEQ ID NO: 937355 - RNA, 22 nt, Human
gggcccuggacguggcggcaga

SEQ ID NO: 937356 - RNA, 22 nt, Human
cuucuuuacuuucuagaaauaa

SEQ ID NO: 937357 - RNA, 22 nt, Human
gccuggagacagcagaggcggc

SEQ ID NO: 937358 - RNA, 22 nt, Human
uagacagauuucuuguuagaca

SEQ ID NO: 937359 - RNA, 22 nt, Human
uauuggaugauucacuuggcag

SEQ ID NO: 937360 - RNA, 22 nt, Human
ggugcuucugggcauagcagga

SEQ ID NO: 937361 - RNA, 22 nt, Human
accacugcccauggugaaaacu

SEQ ID NO: 937362 - RNA, 22 nt, Human
cugggccuagcaacagaggagu

SEQ ID NO: 937363 - RNA, 22 nt, Human
uacuuugucaugcuaagaguga

SEQ ID NO: 937364 - RNA, 20 nt, Human
uuucacagucccuguuuccu

SEQ ID NO: 937365 - RNA, 22 nt, Human
uuagaaaucaccucugaagauc

SEQ ID NO: 937366 - RNA, 22 nt, Human
ccauuuguucgcccagcuccaa

SEQ ID NO: 937367 - RNA, 22 nt, Human
cccaggaugaucgagaguggga

SEQ ID NO: 937368 - RNA, 22 nt, Human
auuguguaauuuucagcucaua

SEQ ID NO: 937369 - RNA, 22 nt, Human
ccuggggagaagagcuuccccc

SEQ ID NO: 937370 - RNA, 22 nt, Human
cacauuucuaggaaauuaaaug

SEQ ID NO: 937371 - RNA, 22 nt, Human
aguguuucuggcaaaugaaagu

SEQ ID NO: 937372 - RNA, 22 nt, Human
uucccucuccuacucaggaaag

SEQ ID NO: 937373 - RNA, 21 nt, Human
auucugaguugucagucuuca

SEQ ID NO: 937374 - RNA, 22 nt, Human
cccagggcccuggacagcuaca

SEQ ID NO: 937375 - RNA, 22 nt, Human
uuguuaaagaugcagauuccau

SEQ ID NO: 937376 - RNA, 20 nt, Human
ccaggcacugucccaugcag

SEQ ID NO: 937377 - RNA, 22 nt, Human
uuccuggccucucucugagcag

SEQ ID NO: 937378 - RNA, 22 nt, Human
cagagcagucuggagauccagc

SEQ ID NO: 937379 - RNA, 22 nt, Human
cagaggugcauacaggucauua

SEQ ID NO: 937380 - RNA, 22 nt, Human
uggcagagcuggcugcggauga

SEQ ID NO: 937381 - RNA, 22 nt, Human
aucuggcugagcgaggcccaca

SEQ ID NO: 937382 - RNA, 22 nt, Human
cugucccuucauuauucacuac

SEQ ID NO: 937383 - RNA, 22 nt, Human
cagggccugagggcugcucugc

SEQ ID NO: 937384 - RNA, 22 nt, Human
ugauaauauuuugaaucauaag

SEQ ID NO: 937385 - RNA, 22 nt, Human
agauacaucuugaacuucuaga

SEQ ID NO: 937386 - RNA, 22 nt, Human
gggcugcacguauucugcucac

SEQ ID NO: 937387 - RNA, 22 nt, Human
gcagcugcagacccucagugcu

SEQ ID NO: 937388 - RNA, 19 nt, Human
uggcauugguccagauaaa

SEQ ID NO: 937389 - RNA, 22 nt, Human
uuuaguaaguucacugcaaagc

SEQ ID NO: 937390 - RNA, 22 nt, Human
ucauccagaaaaaugucuuagc

SEQ ID NO: 937391 - RNA, 22 nt, Human
acagggcagagaggcaggcuug

SEQ ID NO: 937392 - RNA, 22 nt, Human
gagcagugagugaauguugccu

SEQ ID NO: 937393 - RNA, 22 nt, Human
ugggcccugacuucaagcaucc

SEQ ID NO: 937394 - RNA, 22 nt, Human
gcagggcugcagagggcacugu

SEQ ID NO: 937395 - RNA, 22 nt, Human
ccugucucccuggcauggcuca

SEQ ID NO: 937396 - RNA, 22 nt, Human
agaccauagggaccucagguug

SEQ ID NO: 937397 - RNA, 22 nt, Human
ggccacuccgcugcuacuggaa

SEQ ID NO: 937398 - RNA, 22 nt, Human
ugccugcucuuaccacucuccc

SEQ ID NO: 937399 - RNA, 22 nt, Human
ucagccagugccuugaucuugc

SEQ ID NO: 937400 - RNA, 22 nt, Human
ugggagcaagcuggugcuggag

SEQ ID NO: 937401 - RNA, 22 nt, Human
aaauacaguguguguucuuuga

SEQ ID NO: 937402 - RNA, 22 nt, Human
cugagccaaccacagcaggagc

SEQ ID NO: 937403 - RNA, 22 nt, Human
agucugcacucagguggagguc

SEQ ID NO: 937404 - RNA, 22 nt, Human
agggcagagacaugcuuccuga

SEQ ID NO: 937405 - RNA, 22 nt, Human
gcuuuccuggcccugucccugc

SEQ ID NO: 937406 - RNA, 22 nt, Human
aaagaaggaccuggaggaggau

SEQ ID NO: 937407 - RNA, 22 nt, Human
guggcaggucccauuggagcag

SEQ ID NO: 937408 - RNA, 22 nt, Human
ugaaagcacucacuucugcucu

SEQ ID NO: 937409 - RNA, 20 nt, Human
ugggagcuggugaggucuca

SEQ ID NO: 937410 - RNA, 22 nt, Human
acauccagaucucagcauggcu

SEQ ID NO: 937411 - RNA, 22 nt, Human
uauuucugucagccagauaugg

SEQ ID NO: 937412 - RNA, 22 nt, Human
agcagccagagaaugaugcagu

SEQ ID NO: 937413 - RNA, 22 nt, Human
uacucugcaaguugaagguggc

SEQ ID NO: 937414 - RNA, 22 nt, Human
cauggcaggugugggguuuuau

SEQ ID NO: 937415 - RNA, 22 nt, Human
uuacaaagcguugagacaagua

SEQ ID NO: 937416 - RNA, 21 nt, Human
ccugagccuguuuauccagaa

SEQ ID NO: 937417 - RNA, 22 nt, Human
uauuucuuucagguauguguug

SEQ ID NO: 937418 - RNA, 22 nt, Human
gccugggagagggauagugcag

SEQ ID NO: 937419 - RNA, 20 nt, Human
ucagccagcuaacaugggga

SEQ ID NO: 937420 - RNA, 22 nt, Human
uuugggaaacuuaggggucaga

SEQ ID NO: 937421 - RNA, 22 nt, Human
agggcagagagaugaaugggau

SEQ ID NO: 937422 - RNA, 22 nt, Human
ccaugagcuuccuauauagggu

SEQ ID NO: 937423 - RNA, 22 nt, Human
guacauuucucuuguucuuauu

SEQ ID NO: 937424 - RNA, 22 nt, Human
uuuauuaaaacuguuggcucug

SEQ ID NO: 937425 - RNA, 22 nt, Human
uccagggauguccuguagcacu

SEQ ID NO: 937426 - RNA, 22 nt, Human
gaggcagagucacaaagagucu

SEQ ID NO: 937427 - RNA, 22 nt, Human
gauuucaaaaguagauccauca

SEQ ID NO: 937428 - RNA, 22 nt, Human
cagucacauugcccugcauuua

SEQ ID NO: 937429 - RNA, 22 nt, Human
aaaggugacacucugccagcug

SEQ ID NO: 937430 - RNA, 22 nt, Human
cugggcugcgggcgccccucca

SEQ ID NO: 937431 - RNA, 22 nt, Human
uuacaaagagaaguuguagaau

SEQ ID NO: 937432 - RNA, 22 nt, Human
agggggcaggagagaccugcug

SEQ ID NO: 937433 - RNA, 22 nt, Human
gccuggagaggaagccggugga

SEQ ID NO: 937434 - RNA, 23 nt, Human
uggaggaaacacaucagaagacc

SEQ ID NO: 937435 - RNA, 22 nt, Human
acugccugugucccuucagugc

SEQ ID NO: 937436 - RNA, 19 nt, Human
cucugccucccuccugggu

SEQ ID NO: 937437 - RNA, 19 nt, Human
gaagaagcuugagaaguag

SEQ ID NO: 937438 - RNA, 22 nt, Human
uccugggcugugugccacucug

SEQ ID NO: 937439 - RNA, 22 nt, Human
caggccugugaguugaggcccc

SEQ ID NO: 937440 - RNA, 22 nt, Human
cacauguuuggcaugucaccaa

SEQ ID NO: 937441 - RNA, 19 nt, Human
uguagcaguuuaaaacaac

SEQ ID NO: 937442 - RNA, 22 nt, Human
gcauuucuuccuggugugagcc

SEQ ID NO: 937443 - RNA, 22 nt, Human
caagugucuauaucagugcuug

SEQ ID NO: 937444 - RNA, 22 nt, Human
acucaggaauggggcugggacu

SEQ ID NO: 937445 - RNA, 21 nt, Human
cauugucgacauuuuccccuc

SEQ ID NO: 937446 - RNA, 22 nt, Human
aagcuguucucuaaguuucaug

SEQ ID NO: 937447 - RNA, 22 nt, Human
ggaggaggcggcagaaguuccu

SEQ ID NO: 937448 - RNA, 22 nt, Human
guugaaagaucauguggcugcc

SEQ ID NO: 937449 - RNA, 22 nt, Human
auggcugggaugggguagagaa

SEQ ID NO: 937450 - RNA, 22 nt, Human
uuccuauuuccaugaaacacaa

SEQ ID NO: 937451 - RNA, 22 nt, Human
aacugccuggccaggcugcaac

SEQ ID NO: 937452 - RNA, 18 nt, Human
gaugggagcaagagaaga

SEQ ID NO: 937453 - RNA, 22 nt, Human
gaaggccacaagagaaguuaag

SEQ ID NO: 937454 - RNA, 22 nt, Human
acaggcuuuuuuagaaugacau

SEQ ID NO: 937455 - RNA, 20 nt, Human
agggccugcucugugguguc

SEQ ID NO: 937456 - RNA, 22 nt, Human
gugccugggguugagcuaugaa

SEQ ID NO: 937457 - RNA, 22 nt, Human
cagagugagggccugcaccugc

SEQ ID NO: 937458 - RNA, 22 nt, Human
cccugcugucaggugcugggag

SEQ ID NO: 937459 - RNA, 22 nt, Human
ucauucuugaucacuaguuagu

SEQ ID NO: 937460 - RNA, 22 nt, Human
ccucugagaccagcucugcacc

SEQ ID NO: 937461 - RNA, 20 nt, Human
gccugagcuccgccuccugu

SEQ ID NO: 937462 - RNA, 22 nt, Human
uuucuguauuuaaaagaucugg

SEQ ID NO: 937463 - RNA, 22 nt, Human
uuaaaauagccagugccccucu

SEQ ID NO: 937464 - RNA, 22 nt, Human
guuaauaaagguauagaaucag

SEQ ID NO: 937465 - RNA, 23 nt, Human
ggagugcaauggcgccaucucgg

SEQ ID NO: 937466 - RNA, 22 nt, Human
uuucaaagaguuguaaauuacu

SEQ ID NO: 937467 - RNA, 22 nt, Human
agaaagcacucugucuuuuacc

SEQ ID NO: 937468 - RNA, 22 nt, Human
agcuggggcugcagagaacagg

SEQ ID NO: 937469 - RNA, 22 nt, Human
acccaggagagagcuauaaaau

SEQ ID NO: 937470 - RNA, 21 nt, Human
gcugcaucaaucuacccaggg

SEQ ID NO: 937471 - RNA, 22 nt, Human
gcaggggaguggaugauggauu

SEQ ID NO: 937472 - RNA, 22 nt, Human
uuccaugaagggcagccucuca

SEQ ID NO: 937473 - RNA, 22 nt, Human
agcagacaacccagaugaccca

SEQ ID NO: 937474 - RNA, 22 nt, Human
gugccaggugcuaagcugugcu

SEQ ID NO: 937475 - RNA, 22 nt, Human
cccagcauuucugggcugcacu

SEQ ID NO: 937476 - RNA, 23 nt, Human
ucuccagugucucuucauugagu

SEQ ID NO: 937477 - RNA, 23 nt, Human
uugcuuucaucaugagaugcucc

SEQ ID NO: 937478 - RNA, 22 nt, Human
ccucacugaagaggugacauuu

SEQ ID NO: 937479 - RNA, 22 nt, Human
gcucccaggcauggagguaauu

SEQ ID NO: 937480 - RNA, 22 nt, Human
auccugggaagcugacauugaa

SEQ ID NO: 937481 - RNA, 22 nt, Human
uccucugccccagaugaaauuu

SEQ ID NO: 937482 - RNA, 22 nt, Human
ggcugugauugguggaugugaa

SEQ ID NO: 937483 - RNA, 22 nt, Human
ucacaggacccugaggguggcg

SEQ ID NO: 937484 - RNA, 22 nt, Human
auuucagauucagaaauguagg

SEQ ID NO: 937485 - RNA, 22 nt, Human
cugcugggaaggucugcucagu

SEQ ID NO: 937486 - RNA, 22 nt, Human
aggccaaaccggauggaaaagg

SEQ ID NO: 937487 - RNA, 22 nt, Human
ugcaccauuaauuuaugugaga

SEQ ID NO: 937488 - RNA, 22 nt, Human
ggguagcaugugucagaguuug

SEQ ID NO: 937489 - RNA, 22 nt, Human
cuacauuucccagcugccuucc

SEQ ID NO: 937490 - RNA, 22 nt, Human
auguguacaaccaagcacuaaa

SEQ ID NO: 937491 - RNA, 22 nt, Human
cacaggaggaggugcccgggcc

SEQ ID NO: 937492 - RNA, 22 nt, Human
gugucacaagagcccaggaaac

SEQ ID NO: 937493 - RNA, 22 nt, Human
aggcaguggagcuggaauaggc

SEQ ID NO: 937494 - RNA, 22 nt, Human
cuuccucccccacacacucacu

SEQ ID NO: 937495 - RNA, 21 nt, Human
aggcucagagaucaaacagua

SEQ ID NO: 937496 - RNA, 22 nt, Human
uaagaacagauaaaguuucccc

SEQ ID NO: 937497 - RNA, 22 nt, Human
cccgggaggaggaaguugcagu

SEQ ID NO: 937498 - RNA, 22 nt, Human
acagaaagaagguguauuugag

SEQ ID NO: 937499 - RNA, 22 nt, Human
ggcagcugucucugaguuagca

SEQ ID NO: 937500 - RNA, 23 nt, Human
agggcccaagccuggacagcagg

SEQ ID NO: 937501 - RNA, 22 nt, Human
gcugucuggguugagggcccug

SEQ ID NO: 937502 - RNA, 22 nt, Human
ugcaacauuauuaaacuaagca

SEQ ID NO: 937503 - RNA, 22 nt, Human
gagagucuaggaaccucauaua

SEQ ID NO: 937504 - RNA, 22 nt, Human
cuguguccugcgucaagccaau

SEQ ID NO: 937505 - RNA, 22 nt, Human
cuguuucaagugaagucagaca

SEQ ID NO: 937506 - RNA, 22 nt, Human
ggcacugagaggcucuuccuaa

SEQ ID NO: 937507 - RNA, 20 nt, Human
ugcagggcugccucccagcu

SEQ ID NO: 937508 - RNA, 22 nt, Human
uaugcugaauuugguuugcuau

SEQ ID NO: 937509 - RNA, 19 nt, Human
uuucaauggcuuagagaaa

SEQ ID NO: 937510 - RNA, 22 nt, Human
uagacacauccguggaagcuuc

SEQ ID NO: 937511 - RNA, 22 nt, Human
uucuugcaggucacucacugag

SEQ ID NO: 937512 - RNA, 22 nt, Human
gcaggcugauagaggauuccau

SEQ ID NO: 937513 - RNA, 23 nt, Human
uggcucagcuaguuuuccauuuc

SEQ ID NO: 937514 - RNA, 22 nt, Human
uguucuugggaaucuuacaguu

SEQ ID NO: 937515 - RNA, 19 nt, Human
ccaggagagcuuggagaag

SEQ ID NO: 937516 - RNA, 22 nt, Human
ccugggcaaaugccagagacaa

SEQ ID NO: 937517 - RNA, 22 nt, Human
agucuucucauuucacaugcuu

SEQ ID NO: 937518 - RNA, 22 nt, Human
cagagccccccuucugaucaca

SEQ ID NO: 937519 - RNA, 22 nt, Human
agugcuuuaccuagauaauguu

SEQ ID NO: 937520 - RNA, 22 nt, Human
ggagcuguugcgcaugcgcucg

SEQ ID NO: 937521 - RNA, 22 nt, Human
aggcaagcgcagaagcggagga

SEQ ID NO: 937522 - RNA, 22 nt, Human
uuggccaaauaaucuugcagau

SEQ ID NO: 937523 - RNA, 22 nt, Human
aggccuggguguucaccagaag

SEQ ID NO: 937524 - RNA, 22 nt, Human
gagucuuaggcaaaaauaaugg

SEQ ID NO: 937525 - RNA, 22 nt, Human
cauaaguuggguaauauaauga

SEQ ID NO: 937526 - RNA, 22 nt, Human
cagaggccaccuguggccacug

SEQ ID NO: 937527 - RNA, 22 nt, Human
gcuggcugggucccugagaggc

SEQ ID NO: 937528 - RNA, 22 nt, Human
cagggcaggacagauacauuac

SEQ ID NO: 937529 - RNA, 22 nt, Human
cugucuccagggcaggugcagg

SEQ ID NO: 937530 - RNA, 22 nt, Human
acccugagucagacagccugac

SEQ ID NO: 937531 - RNA, 20 nt, Human
gcccaagguccagaaggggg

SEQ ID NO: 937532 - RNA, 22 nt, Human
uaauacuuaccuugcagagucu

SEQ ID NO: 937533 - RNA, 22 nt, Human
agacagcuaauaaaugagugug

SEQ ID NO: 937534 - RNA, 22 nt, Human
gugucccaauguucaggacggc

SEQ ID NO: 937535 - RNA, 22 nt, Human
ccucuugccaaucagcuacaga

SEQ ID NO: 937536 - RNA, 22 nt, Human
gcccacagcucguuccucuccu

SEQ ID NO: 937537 - RNA, 22 nt, Human
cauugcccaguaggaucaccag

SEQ ID NO: 937538 - RNA, 22 nt, Human
agagcuuagaauuucagaugau

SEQ ID NO: 937539 - RNA, 22 nt, Human
agcagugaugcaugacagccua

SEQ ID NO: 937540 - RNA, 22 nt, Human
auguauuucuauguagugaaga

SEQ ID NO: 937541 - RNA, 22 nt, Human
uguucaauccccagguccugaa

SEQ ID NO: 937542 - RNA, 22 nt, Human
ugcagccaucuuucuuggagga

SEQ ID NO: 937543 - RNA, 21 nt, Human
ggacagcugcgcgcagggcuc

SEQ ID NO: 937544 - RNA, 22 nt, Human
cccaggagacugagcuguaacc

SEQ ID NO: 937545 - RNA, 22 nt, Human
aagacauuacuggaaucugacu

SEQ ID NO: 937546 - RNA, 22 nt, Human
auggagggugucagagagcgaa

SEQ ID NO: 937547 - RNA, 22 nt, Human
auuauauugaguauaaccagag

SEQ ID NO: 937548 - RNA, 22 nt, Human
gccaggcuguuuuuauuacugu

SEQ ID NO: 937549 - RNA, 22 nt, Human
guugaaaguagaugcuauuugg

SEQ ID NO: 937550 - RNA, 22 nt, Human
aggcagcuggcagcacccaggg

SEQ ID NO: 937551 - RNA, 23 nt, Human
gacagagugagaccuugucuuac

SEQ ID NO: 937552 - RNA, 22 nt, Human
gucagcucucuuauccaugagg

SEQ ID NO: 937553 - RNA, 22 nt, Human
cuguccugcaguugggggcagg

SEQ ID NO: 937554 - RNA, 22 nt, Human
cacaguuucuauaggucagaau

SEQ ID NO: 937555 - RNA, 22 nt, Human
uaugcuuuacuuuucauuguga

SEQ ID NO: 937556 - RNA, 22 nt, Human
uugcaccaaaugaguuaaaauu

SEQ ID NO: 937557 - RNA, 22 nt, Human
agggcugguauguccaugaaag

SEQ ID NO: 937558 - RNA, 19 nt, Human
cauuccuuugucugccaaa

SEQ ID NO: 937559 - RNA, 22 nt, Human
ccagggcaauaggaacacuuuu

SEQ ID NO: 937560 - RNA, 22 nt, Human
ccacagggcucuaggcgcuucc

SEQ ID NO: 937561 - RNA, 22 nt, Human
acccugccgugggcugcuugug

SEQ ID NO: 937562 - RNA, 22 nt, Human
cauucauuagaauagauaugua

SEQ ID NO: 937563 - RNA, 22 nt, Human
ggcaggugcucugugggccugg

SEQ ID NO: 937564 - RNA, 22 nt, Human
gaaauuauugcuagagacugca

SEQ ID NO: 937565 - RNA, 22 nt, Human
cugagguguugaugaccuaugc

SEQ ID NO: 937566 - RNA, 21 nt, Human
cucuggaggcaagggagagug

SEQ ID NO: 937567 - RNA, 22 nt, Human
gucaaguuaagauaaggucaug

SEQ ID NO: 937568 - RNA, 22 nt, Human
ugauuuccuggcuuuggaguuc

SEQ ID NO: 937569 - RNA, 20 nt, Human
agucccagaucaaauuucug

SEQ ID NO: 937570 - RNA, 22 nt, Human
agcugcccagauaggaggaggc

SEQ ID NO: 937571 - RNA, 22 nt, Human
ccacugucugcaggccucagca

SEQ ID NO: 937572 - RNA, 23 nt, Human
uucuucucaauuaguugauucag

SEQ ID NO: 937573 - RNA, 22 nt, Human
aaucuucuuucuuaacaguaca

SEQ ID NO: 937574 - RNA, 22 nt, Human
ggccagugugcaggucagagau

SEQ ID NO: 937575 - RNA, 22 nt, Human
auugaaagguuuugagcagaua

SEQ ID NO: 937576 - RNA, 16 nt, Human
gagccaggugccuuga

SEQ ID NO: 937577 - RNA, 22 nt, Human
agggaaugcuccguauaaaucu

SEQ ID NO: 937578 - RNA, 22 nt, Human
ggcuucuccagguacugagcau

SEQ ID NO: 937579 - RNA, 22 nt, Human
caaaguauauuggauugaaugg

SEQ ID NO: 937580 - RNA, 22 nt, Human
cacacaugaaucccuaguaccu

SEQ ID NO: 937581 - RNA, 22 nt, Human
gaggaagcagggcuuggcugag

SEQ ID NO: 937582 - RNA, 22 nt, Human
aagcaccuggguuauaucuuag

SEQ ID NO: 937583 - RNA, 22 nt, Human
augugucuaauuccaggagcac

SEQ ID NO: 937584 - RNA, 22 nt, Human
agugugucgagggaggguccag

SEQ ID NO: 937585 - RNA, 22 nt, Human
gauggacagccuggaaggaaag

SEQ ID NO: 937586 - RNA, 22 nt, Human
agccagcaugaagacagaggcc

SEQ ID NO: 937587 - RNA, 21 nt, Human
uacagaaugcgcuucagucug

SEQ ID NO: 937588 - RNA, 22 nt, Human
ggaggguuagcaaaggcacaga

SEQ ID NO: 937589 - RNA, 22 nt, Human
gaggggaaagugugaggcugcg

SEQ ID NO: 937590 - RNA, 22 nt, Human
cccaggaaguggagguugcagu

SEQ ID NO: 937591 - RNA, 22 nt, Human
auacauguaacugcauuguaau

SEQ ID NO: 937592 - RNA, 22 nt, Human
auugaauagaugcauuauacua

SEQ ID NO: 937593 - RNA, 22 nt, Human
augcuguagaucuuagccucua

SEQ ID NO: 937594 - RNA, 22 nt, Human
uccucacauggugagccacaca

SEQ ID NO: 937595 - RNA, 22 nt, Human
cuucucucugcauaggcauggg

SEQ ID NO: 937596 - RNA, 22 nt, Human
uacaguagacaauguuaguaug

SEQ ID NO: 937597 - RNA, 22 nt, Human
gugucaugggguuuguuauaca

SEQ ID NO: 937598 - RNA, 22 nt, Human
ucagcaauaugauaggcuuugu

SEQ ID NO: 937599 - RNA, 18 nt, Human
acugugguuuauguguag

SEQ ID NO: 937600 - RNA, 22 nt, Human
uuggccaaacagaguucaacag

SEQ ID NO: 937601 - RNA, 22 nt, Human
gcugcagccaaauucauuguca

SEQ ID NO: 937602 - RNA, 22 nt, Human
uccagcagguccgagacaaguu

SEQ ID NO: 937603 - RNA, 22 nt, Human
uaaauguaccuucugccuuacu

SEQ ID NO: 937604 - RNA, 22 nt, Human
gagcacagccaaaguaagaagg

SEQ ID NO: 937605 - RNA, 22 nt, Human
cagcuggguuuaguggggugug

SEQ ID NO: 937606 - RNA, 22 nt, Human
ggacuucuaagugccagacacu

SEQ ID NO: 937607 - RNA, 22 nt, Human
agauggguaacuggagucugcu

SEQ ID NO: 937608 - RNA, 22 nt, Human
auguacaaaaugccacugaauu

SEQ ID NO: 937609 - RNA, 22 nt, Human
gucuaauuccugcucuuacuca

SEQ ID NO: 937610 - RNA, 22 nt, Human
cagguggagcugacugagggca

SEQ ID NO: 937611 - RNA, 22 nt, Human
aggcuuauuuuaggucucucuu

SEQ ID NO: 937612 - RNA, 22 nt, Human
guggcagcugguaugcagacag

SEQ ID NO: 937613 - RNA, 22 nt, Human
uaauuucaauagcuugcauaau

SEQ ID NO: 937614 - RNA, 22 nt, Human
cugggagucuggccucuggucc

SEQ ID NO: 937615 - RNA, 22 nt, Human
gcuuccuagaucugugguacuc

SEQ ID NO: 937616 - RNA, 22 nt, Human
uggagcaagcuggagagaacau

SEQ ID NO: 937617 - RNA, 22 nt, Human
ggcucagguuuaaagugcuuua

SEQ ID NO: 937618 - RNA, 22 nt, Human
ucugcagguguuggaaggguca

SEQ ID NO: 937619 - RNA, 22 nt, Human
agguggggccaaaugcuacagu

SEQ ID NO: 937620 - RNA, 22 nt, Human
caguagccacuagacacaugua

SEQ ID NO: 937621 - RNA, 22 nt, Human
cgcagaagagguugucuagucc

SEQ ID NO: 937622 - RNA, 22 nt, Human
aaacaugaauagauauuaaaca

SEQ ID NO: 937623 - RNA, 22 nt, Human
aggccaaauguguauaaaacau

SEQ ID NO: 937624 - RNA, 22 nt, Human
cugucaggggcggguggagcgg

SEQ ID NO: 937625 - RNA, 22 nt, Human
gggaggugauggcaagcagcgg

SEQ ID NO: 937626 - RNA, 22 nt, Human
caguuuaaaugagugacugcag

SEQ ID NO: 937627 - RNA, 22 nt, Human
uagcuaucuguguccagaucca

SEQ ID NO: 937628 - RNA, 22 nt, Human
gucaggauuuuaaaaucccagu

SEQ ID NO: 937629 - RNA, 22 nt, Human
uggccuggugcucaggcaguag

SEQ ID NO: 937630 - RNA, 22 nt, Human
aggcacugaaagguggccagag

SEQ ID NO: 937631 - RNA, 22 nt, Human
uuacaaaguucugaguucaaac

SEQ ID NO: 937632 - RNA, 22 nt, Human
cugcugugcaggugccuaugau

SEQ ID NO: 937633 - RNA, 22 nt, Human
uguauauucugccuaaaagcuu

SEQ ID NO: 937634 - RNA, 22 nt, Human
cucaggacccgguccagguggg

SEQ ID NO: 937635 - RNA, 20 nt, Human
agucucuguagugccugaga

SEQ ID NO: 937636 - RNA, 22 nt, Human
ucccaggacccaggcauucaca

SEQ ID NO: 937637 - RNA, 22 nt, Human
gucucugcucuagagucuguga

SEQ ID NO: 937638 - RNA, 22 nt, Human
gcuguggguccggaccccacgg

SEQ ID NO: 937639 - RNA, 22 nt, Human
cucaggaggaggaaguucauug

SEQ ID NO: 937640 - RNA, 22 nt, Human
gcagggcucaacaggacacccc

SEQ ID NO: 937641 - RNA, 22 nt, Human
ucuuuccauggccacacagucu

SEQ ID NO: 937642 - RNA, 22 nt, Human
augaugguggguaauguguaaa

SEQ ID NO: 937643 - RNA, 20 nt, Human
uucuucucuaguuaucuuca

SEQ ID NO: 937644 - RNA, 22 nt, Human
uaaaugaaaggguuuaauuuau

SEQ ID NO: 937645 - RNA, 22 nt, Human
gcucuggacuggggccugagaa

SEQ ID NO: 937646 - RNA, 22 nt, Human
agaagccagcuucagcugcccg

SEQ ID NO: 937647 - RNA, 22 nt, Human
aagagcauauuaauaguggaga

SEQ ID NO: 937648 - RNA, 21 nt, Human
ggcauggcaccucugggcagg

SEQ ID NO: 937649 - RNA, 22 nt, Human
auguuuuucauaccaguguugg

SEQ ID NO: 937650 - RNA, 22 nt, Human
ggcugccugccuccaagccggg

SEQ ID NO: 937651 - RNA, 22 nt, Human
ccugugaggucaucugugguaa

SEQ ID NO: 937652 - RNA, 22 nt, Human
gagagcugcagccgagaggggg

SEQ ID NO: 937653 - RNA, 21 nt, Human
ggcuccugcuuugugaggggc

SEQ ID NO: 937654 - RNA, 19 nt, Human
ggaccagguccugggcagc

SEQ ID NO: 937655 - RNA, 22 nt, Human
uggcagagucaucacaucugga

SEQ ID NO: 937656 - RNA, 22 nt, Human
ccuccaggaacuugagagacac

SEQ ID NO: 937657 - RNA, 22 nt, Human
uuucaguuuccagcuuugucau

SEQ ID NO: 937658 - RNA, 22 nt, Human
gaggccuggagccgccuaggcg

SEQ ID NO: 937659 - RNA, 22 nt, Human
uauuuaguuaucuuucauaaaa

SEQ ID NO: 937660 - RNA, 22 nt, Human
cucugggcaccaaagagcagcu

SEQ ID NO: 937661 - RNA, 22 nt, Human
agcagggcugcagugugucuuu

SEQ ID NO: 937662 - RNA, 22 nt, Human
uggagugaaguaaagaggacaa

SEQ ID NO: 937663 - RNA, 22 nt, Human
uagggauggaaacuaggaaucu

SEQ ID NO: 937664 - RNA, 22 nt, Human
uauuccuauuucuaaacauaug

SEQ ID NO: 937665 - RNA, 22 nt, Human
cagagguacaagcuaaguuggg

SEQ ID NO: 937666 - RNA, 22 nt, Human
auagucuuagaucagauaaagu

SEQ ID NO: 937667 - RNA, 22 nt, Human
ugaagucuauuaacugauuucu

SEQ ID NO: 937668 - RNA, 18 nt, Human
gugacagcugcuagcuca

SEQ ID NO: 937669 - RNA, 22 nt, Human
cugggacagagcagcagugggg

SEQ ID NO: 937670 - RNA, 22 nt, Human
auguuacauaguccuuauuugu

SEQ ID NO: 937671 - RNA, 22 nt, Human
gaaaggcaguacagcugagccu

SEQ ID NO: 937672 - RNA, 22 nt, Human
aaguuuuccuguguccaagaug

SEQ ID NO: 937673 - RNA, 22 nt, Human
cauugcacuccagcuugggcaa

SEQ ID NO: 937674 - RNA, 22 nt, Human
ucaggcagaggauggggagcgu

SEQ ID NO: 937675 - RNA, 22 nt, Human
guggccuuuccugaagaaauga

SEQ ID NO: 937676 - RNA, 22 nt, Human
aaaggucaaaaucgugacauug

SEQ ID NO: 937677 - RNA, 22 nt, Human
agcaggcuccuuccuucucugg

SEQ ID NO: 937678 - RNA, 22 nt, Human
cagcugccaagaaucuuuucua

SEQ ID NO: 937679 - RNA, 22 nt, Human
ucucaggaguagugggauccau

SEQ ID NO: 937680 - RNA, 22 nt, Human
agaaauguuacaguuguuauuu

SEQ ID NO: 937681 - RNA, 22 nt, Human
agcagcauucucugguaugggg

SEQ ID NO: 937682 - RNA, 22 nt, Human
auauucuugugauuauaaagua

SEQ ID NO: 937683 - RNA, 22 nt, Human
gaggcaggcagauugcuugagg

SEQ ID NO: 937684 - RNA, 23 nt, Human
ucccagggaaggugagcgaggcu

SEQ ID NO: 937685 - RNA, 22 nt, Human
uucagcaaugacagccuauaua

SEQ ID NO: 937686 - RNA, 22 nt, Human
ccaccuccaccuauugccagcc

SEQ ID NO: 937687 - RNA, 22 nt, Human
ucagaaguugagauauucaggg

SEQ ID NO: 937688 - RNA, 22 nt, Human
ugauuuccacgugcacccaggu

SEQ ID NO: 937689 - RNA, 22 nt, Human
ggucaggggcugcucuacagag

SEQ ID NO: 937690 - RNA, 22 nt, Human
auggccuggccagagcucugcu

SEQ ID NO: 937691 - RNA, 22 nt, Human
guuuuauaggcuguugcuauau

SEQ ID NO: 937692 - RNA, 22 nt, Human
ggccaccuuccaguugccugca

SEQ ID NO: 937693 - RNA, 22 nt, Human
ucaccacugaacagaccuuugg

SEQ ID NO: 937694 - RNA, 22 nt, Human
ggaguucacugugcaggcucug

SEQ ID NO: 937695 - RNA, 22 nt, Human
uaugugcauaugcauacacaca

SEQ ID NO: 937696 - RNA, 22 nt, Human
uuaggcauuggaaggucagcuu

SEQ ID NO: 937697 - RNA, 22 nt, Human
ucuucagagugaaagucuguga

SEQ ID NO: 937698 - RNA, 22 nt, Human
ccuggccacagggcucugcauu

SEQ ID NO: 937699 - RNA, 22 nt, Human
cuggccugaggccgccuucaga

SEQ ID NO: 937700 - RNA, 22 nt, Human
aggaagcugccugggaugggaa

SEQ ID NO: 937701 - RNA, 23 nt, Human
uugcaaauuucaguuaguucaug

SEQ ID NO: 937702 - RNA, 22 nt, Human
uuacaguaugaucaacuuuuca

SEQ ID NO: 937703 - RNA, 22 nt, Human
agacaaaggauuaaugaugaug

SEQ ID NO: 937704 - RNA, 22 nt, Human
uuuuauuaucuuugaaugggac

SEQ ID NO: 937705 - RNA, 22 nt, Human
ugguggccaauucacagggcuc

SEQ ID NO: 937706 - RNA, 22 nt, Human
ccugagggcgccgagcucccag

SEQ ID NO: 937707 - RNA, 22 nt, Human
caggcagagugagguggucuaa

SEQ ID NO: 937708 - RNA, 22 nt, Human
gugcagggcuggcaccggaggc

SEQ ID NO: 937709 - RNA, 22 nt, Human
ccaagggcugcugaggugucca

SEQ ID NO: 937710 - RNA, 22 nt, Human
ucaugcuuaaaagacacuugag

SEQ ID NO: 937711 - RNA, 20 nt, Human
aggauuugagaaggcgucuu

SEQ ID NO: 937712 - RNA, 22 nt, Human
aagcuggcaugucaccugagaa

SEQ ID NO: 937713 - RNA, 22 nt, Human
ugaacagaucaauagaacugac

SEQ ID NO: 937714 - RNA, 22 nt, Human
ucauuucccuccuacaaagagg

SEQ ID NO: 937715 - RNA, 22 nt, Human
ugcuuuguguuugaauagauaa

SEQ ID NO: 937716 - RNA, 19 nt, Human
ggcucucuuaaagcuguuu

SEQ ID NO: 937717 - RNA, 22 nt, Human
uuggcuucuggcagucuggacg

SEQ ID NO: 937718 - RNA, 22 nt, Human
gcucugcuggaaguucucugga

SEQ ID NO: 937719 - RNA, 22 nt, Human
ucauugaaugcucugcagguug

SEQ ID NO: 937720 - RNA, 22 nt, Human
aauaagauugacacaaguaccu

SEQ ID NO: 937721 - RNA, 22 nt, Human
aaucaguauugguauagaauga

SEQ ID NO: 937722 - RNA, 22 nt, Human
uccaaggcauagacacagugcc

SEQ ID NO: 937723 - RNA, 22 nt, Human
aaauuagucgguuuaggaauuu

SEQ ID NO: 937724 - RNA, 22 nt, Human
agcaauauaaauguuggguaga

SEQ ID NO: 937725 - RNA, 22 nt, Human
gcccugugccagucacgcugug

SEQ ID NO: 937726 - RNA, 22 nt, Human
aucuggcugacuuugugggaca

SEQ ID NO: 937727 - RNA, 22 nt, Human
aggcaguuuaggcagcgauuua

SEQ ID NO: 937728 - RNA, 22 nt, Human
agcagccaauuggaggaugaag

SEQ ID NO: 937729 - RNA, 22 nt, Human
ugcuuuggccacuagaauucag

SEQ ID NO: 937730 - RNA, 22 nt, Human
uccuuguaaaggagcucuaaca

SEQ ID NO: 937731 - RNA, 22 nt, Human
aggcuagcuuuggcucaguaaa

SEQ ID NO: 937732 - RNA, 22 nt, Human
ccagggcagcagaauuggggca

SEQ ID NO: 937733 - RNA, 22 nt, Human
ugacagaaugugacucucagau

SEQ ID NO: 937734 - RNA, 22 nt, Human
guugaaaugagggauuaaucag

SEQ ID NO: 937735 - RNA, 22 nt, Human
ucugcaggccucgacaaggcca

SEQ ID NO: 937736 - RNA, 22 nt, Human
guccugggccugcugaggcuga

SEQ ID NO: 937737 - RNA, 22 nt, Human
gcagagcccuggggguauggug

SEQ ID NO: 937738 - RNA, 22 nt, Human
agguggagaagagaugggcagu

SEQ ID NO: 937739 - RNA, 22 nt, Human
aggcucugugacaaucaagcug

SEQ ID NO: 937740 - RNA, 22 nt, Human
auguaacuguuauauuuuguug

SEQ ID NO: 937741 - RNA, 22 nt, Human
auucuucacaaauauauagaag

SEQ ID NO: 937742 - RNA, 22 nt, Human
ucugggagccaugccuuggagu

SEQ ID NO: 937743 - RNA, 22 nt, Human
ucuaaagaagaggguucugcgg

SEQ ID NO: 937744 - RNA, 22 nt, Human
cagaagaauggugucugagcuc

SEQ ID NO: 937745 - RNA, 22 nt, Human
uucagucagugacuaagcaguu

SEQ ID NO: 937746 - RNA, 22 nt, Human
aggaaaggccuuugcauuuggu

SEQ ID NO: 937747 - RNA, 22 nt, Human
agugcuuugaacgaaaggcuga

SEQ ID NO: 937748 - RNA, 22 nt, Human
uccagcagcccgaaggcccauc

SEQ ID NO: 937749 - RNA, 22 nt, Human
caggaacacaaugagucucaaa

SEQ ID NO: 937750 - RNA, 22 nt, Human
agcagcuauuucuuccagagag

SEQ ID NO: 937751 - RNA, 22 nt, Human
cucucuggcacuucauugcugu

SEQ ID NO: 937752 - RNA, 22 nt, Human
gcuguccugggaacaggcacua

SEQ ID NO: 937753 - RNA, 20 nt, Human
gucagugucuucaguaguga

SEQ ID NO: 937754 - RNA, 22 nt, Human
caggugggagccacagcguaca

SEQ ID NO: 937755 - RNA, 22 nt, Human
uuugcauuguuucaaaagugaa

SEQ ID NO: 937756 - RNA, 22 nt, Human
uucaggagcuggcugcgaagga

SEQ ID NO: 937757 - RNA, 22 nt, Human
cugagaggugacagcgugcugg

SEQ ID NO: 937758 - RNA, 22 nt, Human
uguaaucauuacaguacaugga

SEQ ID NO: 937759 - RNA, 22 nt, Human
uucuucuucaagugcugcauuc

SEQ ID NO: 937760 - RNA, 22 nt, Human
cuucaagagaaugcagggaugu

SEQ ID NO: 937761 - RNA, 22 nt, Human
uucaaaggcaggauagcagcug

SEQ ID NO: 937762 - RNA, 22 nt, Human
uccucagaugcucuuggacgcc

SEQ ID NO: 937763 - RNA, 22 nt, Human
uaaaugcaguuaguacuugcca

SEQ ID NO: 937764 - RNA, 22 nt, Human
caggccucccggugcacacuga

SEQ ID NO: 937765 - RNA, 22 nt, Human
ucugucacccgagcaggcgaga

SEQ ID NO: 937766 - RNA, 22 nt, Human
aggagccaguuccaccccagga

SEQ ID NO: 937767 - RNA, 22 nt, Human
uucacaaaacacuauuuucugg

SEQ ID NO: 937768 - RNA, 22 nt, Human
uagagcuauuuagagcauuuua

SEQ ID NO: 937769 - RNA, 22 nt, Human
gaggaaccacucugagaagcca

SEQ ID NO: 937770 - RNA, 22 nt, Human
uuaauuuuuauguauagugugu

SEQ ID NO: 937771 - RNA, 22 nt, Human
caggagugaguuggggucuaca

SEQ ID NO: 937772 - RNA, 22 nt, Human
uuauugagcacauaguaugugg

SEQ ID NO: 937773 - RNA, 22 nt, Human
gcucccaccuuugcuaucagua

SEQ ID NO: 937774 - RNA, 22 nt, Human
augagcugugggauuccagagg

SEQ ID NO: 937775 - RNA, 22 nt, Human
ggcuagaauaauugacuucauu

SEQ ID NO: 937776 - RNA, 22 nt, Human
gccugggagugcacagugaggu

SEQ ID NO: 937777 - RNA, 22 nt, Human
uacauauagacaguuacucuag

SEQ ID NO: 937778 - RNA, 23 nt, Human
gcuguuagauuuaauaagcauuu

SEQ ID NO: 937779 - RNA, 22 nt, Human
aggcacuguggguguggccgga

SEQ ID NO: 937780 - RNA, 22 nt, Human
aagggaaaucauauggugcagu

SEQ ID NO: 937781 - RNA, 22 nt, Human
cuuuggcaacacaugugggaca

SEQ ID NO: 937782 - RNA, 22 nt, Human
acacugaaugcuguuuagaaau

SEQ ID NO: 937783 - RNA, 22 nt, Human
acuuuguauaagacaauaaaga

SEQ ID NO: 937784 - RNA, 22 nt, Human
auaucuuuuagagcaagcuugu

SEQ ID NO: 937785 - RNA, 22 nt, Human
uccuucagauuccugcuucugg

SEQ ID NO: 937786 - RNA, 22 nt, Human
gcccagcuccucugcagacccu

SEQ ID NO: 937787 - RNA, 22 nt, Human
uuucuaggcacagugucuuccc

SEQ ID NO: 937788 - RNA, 22 nt, Human
uggaguucucaggugagggcuu

SEQ ID NO: 937789 - RNA, 22 nt, Human
caggaugguggcaugaucagaa

SEQ ID NO: 937790 - RNA, 18 nt, Human
cagcugccagcucaugga

SEQ ID NO: 937791 - RNA, 22 nt, Human
cacccaggcagguggcugagaa

SEQ ID NO: 937792 - RNA, 22 nt, Human
aucaggauagugguuaccuggg

SEQ ID NO: 937793 - RNA, 21 nt, Human
cagagcagcguucugcugugg

SEQ ID NO: 937794 - RNA, 22 nt, Human
cuggagccacuuuuuauccuuu

SEQ ID NO: 937795 - RNA, 22 nt, Human
gugcauauaugcacauaugugu

SEQ ID NO: 937796 - RNA, 22 nt, Human
ucuggcucucaacaaauauuua

SEQ ID NO: 937797 - RNA, 22 nt, Human
auguguuuguaccuuuaaauau

SEQ ID NO: 937798 - RNA, 22 nt, Human
ucuuuucuggacucugcaugga

SEQ ID NO: 937799 - RNA, 22 nt, Human
augaggcauuccacucaaacuc

SEQ ID NO: 937800 - RNA, 22 nt, Human
ucugugccucaucugguucagg

SEQ ID NO: 937801 - RNA, 22 nt, Human
uagugauuaaaggcagaauguu

SEQ ID NO: 937802 - RNA, 22 nt, Human
agccuggauccauguggcuacc

SEQ ID NO: 937803 - RNA, 22 nt, Human
ccacagcugaccgcaggugagc

SEQ ID NO: 937804 - RNA, 22 nt, Human
cacaggaauuagcagccuaaaa

SEQ ID NO: 937805 - RNA, 22 nt, Human
ucccaggaauccguccucuaga

SEQ ID NO: 937806 - RNA, 22 nt, Human
guggggggacguuggucacuuu

SEQ ID NO: 937807 - RNA, 16 nt, Human
gagggcagaggcggaa

SEQ ID NO: 937808 - RNA, 22 nt, Human
gagguggucgaggagggguacc

SEQ ID NO: 937809 - RNA, 22 nt, Human
aaagcagagcagggcacuuaug

SEQ ID NO: 937810 - RNA, 22 nt, Human
agcugcuguccuaggcacugua

SEQ ID NO: 937811 - RNA, 22 nt, Human
uauacuuuccugcaacuuugau

SEQ ID NO: 937812 - RNA, 22 nt, Human
augugucuugagggggauggag

SEQ ID NO: 937813 - RNA, 22 nt, Human
caguaugagaguugaaucaagg

SEQ ID NO: 937814 - RNA, 22 nt, Human
agccucucuuuauucccagcua

SEQ ID NO: 937815 - RNA, 22 nt, Human
uccuugaaugaauguucucucc

SEQ ID NO: 937816 - RNA, 22 nt, Human
uccuuccugcaggccaaguccu

SEQ ID NO: 937817 - RNA, 22 nt, Human
gagacugcauuguccaaggguu

SEQ ID NO: 937818 - RNA, 22 nt, Human
aacaacugaaaagcuuuuucug

SEQ ID NO: 937819 - RNA, 22 nt, Human
gccaggcuggcaaaaggaaacc

SEQ ID NO: 937820 - RNA, 22 nt, Human
uuauccuggauuauauauguga

SEQ ID NO: 937821 - RNA, 21 nt, Human
acaugcauagagagauuucug

SEQ ID NO: 937822 - RNA, 23 nt, Human
agcacacuuguacaaugcccuag

SEQ ID NO: 937823 - RNA, 22 nt, Human
agcucccagaagccagagucgg

SEQ ID NO: 937824 - RNA, 22 nt, Human
uugcauuuccuguacuguuuga

SEQ ID NO: 937825 - RNA, 22 nt, Human
ugaggcagcaauugauuauuca

SEQ ID NO: 937826 - RNA, 22 nt, Human
ucuggcucagggcucugaggga

SEQ ID NO: 937827 - RNA, 22 nt, Human
ugacaauacagagagagcaaaa

SEQ ID NO: 937828 - RNA, 22 nt, Human
caggaugaagggcaaaggcaag

SEQ ID NO: 937829 - RNA, 22 nt, Human
agagcuggaaucagaccucagg

SEQ ID NO: 937830 - RNA, 22 nt, Human
acaggugugagaacaugccuug

SEQ ID NO: 937831 - RNA, 22 nt, Human
uaaaaguaggaaugaaacgcau

SEQ ID NO: 937832 - RNA, 22 nt, Human
aucauucuauuguugagcugcc

SEQ ID NO: 937833 - RNA, 22 nt, Human
ccaguccagugccaugcauggc

SEQ ID NO: 937834 - RNA, 22 nt, Human
cccagcucugcagaccugcccu

SEQ ID NO: 937835 - RNA, 22 nt, Human
agcccuucaaccugccuacucc

SEQ ID NO: 937836 - RNA, 22 nt, Human
gugcagggagcccagaaggucc

SEQ ID NO: 937837 - RNA, 22 nt, Human
caccagggacaaugcuaggggu

SEQ ID NO: 937838 - RNA, 22 nt, Human
gcagagcauguccucaggacag

SEQ ID NO: 937839 - RNA, 22 nt, Human
cugggacuuuacccuguggccc

SEQ ID NO: 937840 - RNA, 23 nt, Human
cugcccugaucuugaucuauugu

SEQ ID NO: 937841 - RNA, 22 nt, Human
augaugugugcugaucaagcuu

SEQ ID NO: 937842 - RNA, 21 nt, Human
ucagggcagcugcucuucaga

SEQ ID NO: 937843 - RNA, 22 nt, Human
ggcuggaaaagacaaagcuauu

SEQ ID NO: 937844 - RNA, 22 nt, Human
uggccugacugucaggcuguau

SEQ ID NO: 937845 - RNA, 20 nt, Human
ugugggcccuuggcuggcaa

SEQ ID NO: 937846 - RNA, 22 nt, Human
cuucacaauucuaacagggcaa

SEQ ID NO: 937847 - RNA, 22 nt, Human
uuucaguuacugcuauaucauu

SEQ ID NO: 937848 - RNA, 22 nt, Human
agaagugccauacuguggucca

SEQ ID NO: 937849 - RNA, 22 nt, Human
uugaaagucacaauggcauuaa

SEQ ID NO: 937850 - RNA, 22 nt, Human
uucugugauugacauguggcuu

SEQ ID NO: 937851 - RNA, 22 nt, Human
aggccucagugaucaucaucag

SEQ ID NO: 937852 - RNA, 22 nt, Human
uuuagaaguucacacauuuaaa

SEQ ID NO: 937853 - RNA, 22 nt, Human
aggcagugcugugcccugaacc

SEQ ID NO: 937854 - RNA, 22 nt, Human
ucugggcacugcugagccugua

SEQ ID NO: 937855 - RNA, 22 nt, Human
auuguucaaagugcuuugcaug

SEQ ID NO: 937856 - RNA, 22 nt, Human
uuaaagagucuacugcacaucc

SEQ ID NO: 937857 - RNA, 22 nt, Human
cuggccuggcaggggaccucua

SEQ ID NO: 937858 - RNA, 22 nt, Human
cauugcacagcccuguggugau

SEQ ID NO: 937859 - RNA, 22 nt, Human
ugcagaagcagagaguugccaa

SEQ ID NO: 937860 - RNA, 22 nt, Human
uacucugccccagccaauaaug

SEQ ID NO: 937861 - RNA, 22 nt, Human
uaaaagcucuucuguugaguua

SEQ ID NO: 937862 - RNA, 22 nt, Human
ggcagucagugugguucauaaa

SEQ ID NO: 937863 - RNA, 22 nt, Human
gcagcguggggacaggagcuca

SEQ ID NO: 937864 - RNA, 22 nt, Human
ggcaagaaggcuucagguagcu

SEQ ID NO: 937865 - RNA, 22 nt, Human
cauacuuuugcccugacauucu

SEQ ID NO: 937866 - RNA, 22 nt, Human
acagauguacacucauauauaa

SEQ ID NO: 937867 - RNA, 22 nt, Human
uugacacaguuuucucauuaag

SEQ ID NO: 937868 - RNA, 22 nt, Human
aauggcucugauguuguuguga

SEQ ID NO: 937869 - RNA, 22 nt, Human
uguuacacagcagaauagcaag

SEQ ID NO: 937870 - RNA, 22 nt, Human
uggccugucuuguugugcuaga

SEQ ID NO: 937871 - RNA, 21 nt, Human
agagaagggacucuuccaguc

SEQ ID NO: 937872 - RNA, 22 nt, Human
ucccugggccuccugcuaugca

SEQ ID NO: 937873 - RNA, 22 nt, Human
cuggagccacugggucuuguau

SEQ ID NO: 937874 - RNA, 22 nt, Human
gcugugaguggaggaggcugag

SEQ ID NO: 937875 - RNA, 22 nt, Human
augcaguacauacaaacacuga

SEQ ID NO: 937876 - RNA, 22 nt, Human
aagacagagacucugcaacagg

SEQ ID NO: 937877 - RNA, 20 nt, Human
gcccaggaauuugcauuucu

SEQ ID NO: 937878 - RNA, 22 nt, Human
gcuggcagaagagcugguucaa

SEQ ID NO: 937879 - RNA, 22 nt, Human
uucucuuauucuggauaugcag

SEQ ID NO: 937880 - RNA, 22 nt, Human
agugacugacaccuguaauccc

SEQ ID NO: 937881 - RNA, 17 nt, Human
ucagagggaugagcagg

SEQ ID NO: 937882 - RNA, 22 nt, Human
uucaagaugccagggacgcggc

SEQ ID NO: 937883 - RNA, 22 nt, Human
cggaggggauacauuuucugaa

SEQ ID NO: 937884 - RNA, 22 nt, Human
cuggggggagcugcguccagca

SEQ ID NO: 937885 - RNA, 22 nt, Human
ggcugaguugagaggauuacuu

SEQ ID NO: 937886 - RNA, 22 nt, Human
uuguaacagcuguuuauauagu

SEQ ID NO: 937887 - RNA, 22 nt, Human
guugaaugaaucauucuaugua

SEQ ID NO: 937888 - RNA, 22 nt, Human
uacaaaugaaccaacuuugaug

SEQ ID NO: 937889 - RNA, 22 nt, Human
gaagagcugcucagaacaugau

SEQ ID NO: 937890 - RNA, 22 nt, Human
uuucacaaagcauagcacuuua

SEQ ID NO: 937891 - RNA, 22 nt, Human
gcucugcugggugggcaguuau

SEQ ID NO: 937892 - RNA, 22 nt, Human
uucaaugagcccggggccauag

SEQ ID NO: 937893 - RNA, 22 nt, Human
agcagaggaggauuuaguuagg

SEQ ID NO: 937894 - RNA, 22 nt, Human
agucucagaaaauaugcuuuuu

SEQ ID NO: 937895 - RNA, 22 nt, Human
ucauuuguucaucugcucuucu

SEQ ID NO: 937896 - RNA, 22 nt, Human
uucaauucugcucugaucuuag

SEQ ID NO: 937897 - RNA, 19 nt, Human
gcaggcaguggcauucgga

SEQ ID NO: 937898 - RNA, 18 nt, Human
caugucugcgccacaagg

SEQ ID NO: 937899 - RNA, 22 nt, Human
uguuucagucccuguguucaau

SEQ ID NO: 937900 - RNA, 22 nt, Human
cagcugagucugagguucuuug

SEQ ID NO: 937901 - RNA, 22 nt, Human
aggcagcugaggucuggcgccc

SEQ ID NO: 937902 - RNA, 21 nt, Human
ugcaggcaggcagagaugcug

SEQ ID NO: 937903 - RNA, 22 nt, Human
aaguaugacauuuaagacaauu

SEQ ID NO: 937904 - RNA, 22 nt, Human
aacaggagaguaaauauaugau

SEQ ID NO: 937905 - RNA, 22 nt, Human
cuggcagcugcccgagaugccc

SEQ ID NO: 937906 - RNA, 22 nt, Human
gcagccacuuugcaaccaagag

SEQ ID NO: 937907 - RNA, 22 nt, Human
accaggaguaacagugaguggu

SEQ ID NO: 937908 - RNA, 19 nt, Human
ccuggccagacuucugccc

SEQ ID NO: 937909 - RNA, 21 nt, Human
cauauuaaaucggugccuuua

SEQ ID NO: 937910 - RNA, 22 nt, Human
gccuggcccagggcucuuguug

SEQ ID NO: 937911 - RNA, 22 nt, Human
cagcccagcagggucuggcccu

SEQ ID NO: 937912 - RNA, 22 nt, Human
aauccugugugacucuggggag

SEQ ID NO: 937913 - RNA, 22 nt, Human
ucagacuucaguuuuuaguugu

SEQ ID NO: 937914 - RNA, 22 nt, Human
ggggacaguuaaagaccaagac

SEQ ID NO: 937915 - RNA, 20 nt, Human
caccacagaauuggggacag

SEQ ID NO: 937916 - RNA, 19 nt, Human
uugcauuguaguuggacug

SEQ ID NO: 937917 - RNA, 22 nt, Human
uuacaagcagcuacauaucaca

SEQ ID NO: 937918 - RNA, 22 nt, Human
ggaccuggcaauuugcaucucu

SEQ ID NO: 937919 - RNA, 22 nt, Human
auggccaagcaugccuguggcc

SEQ ID NO: 937920 - RNA, 18 nt, Human
uggacaggguggagaaaa

SEQ ID NO: 937921 - RNA, 22 nt, Human
acugucugcuggccccugguua

SEQ ID NO: 937922 - RNA, 21 nt, Human
ugccagcauguaggcuaguug

SEQ ID NO: 937923 - RNA, 22 nt, Human
gagggccagcagccucagcaug

SEQ ID NO: 937924 - RNA, 19 nt, Human
ucuggagcugaugcaggug

SEQ ID NO: 937925 - RNA, 23 nt, Human
aaguucaagucacagccugucuu

SEQ ID NO: 937926 - RNA, 22 nt, Human
ucuuaaagagcgcaauuugagg

SEQ ID NO: 937927 - RNA, 22 nt, Human
ucuuucaaugagcauucuuucc

SEQ ID NO: 937928 - RNA, 22 nt, Human
cagaagcagugagagaugugca

SEQ ID NO: 937929 - RNA, 22 nt, Human
ccagcgcuucccaucagggagg

SEQ ID NO: 937930 - RNA, 22 nt, Human
cugaggcaugaaugugggcuuu

SEQ ID NO: 937931 - RNA, 22 nt, Human
auuaaggaauguaggcaagaag

SEQ ID NO: 937932 - RNA, 22 nt, Human
auaugagagaggaaagauuuua

SEQ ID NO: 937933 - RNA, 22 nt, Human
ggagcagagcauuucacagccu

SEQ ID NO: 937934 - RNA, 22 nt, Human
augggaggcagcagagcccagc

SEQ ID NO: 937935 - RNA, 22 nt, Human
gucuugaucuccugaccuugug

SEQ ID NO: 937936 - RNA, 22 nt, Human
gaaaguuucuucauuaagaugu

SEQ ID NO: 937937 - RNA, 22 nt, Human
cccaggaggcgcagguugcggu

SEQ ID NO: 937938 - RNA, 22 nt, Human
ccccggaggcggagguugcagu

SEQ ID NO: 937939 - RNA, 22 nt, Human
gccugagcccaggugugcagag

SEQ ID NO: 937940 - RNA, 22 nt, Human
gacagcagccacagggagaggg

SEQ ID NO: 937941 - RNA, 22 nt, Human
aauuuccagaccccauccacag

SEQ ID NO: 937942 - RNA, 22 nt, Human
ucugagcauugaauuuucuucc

SEQ ID NO: 937943 - RNA, 19 nt, Human
agggaaggauucugucauu

SEQ ID NO: 937944 - RNA, 22 nt, Human
ugucccaguuggguauugaauu

SEQ ID NO: 937945 - RNA, 22 nt, Human
agggaggauaguagucaguuua

SEQ ID NO: 937946 - RNA, 19 nt, Human
ugcuuccucaccaucuccc

SEQ ID NO: 937947 - RNA, 22 nt, Human
uagcugucaccagaaauggcca

SEQ ID NO: 937948 - RNA, 21 nt, Human
cccacggaaugaugaggcacu

SEQ ID NO: 937949 - RNA, 22 nt, Human
ugcagggcuacaggacuacaac

SEQ ID NO: 937950 - RNA, 22 nt, Human
aggcuccuugcucacaggcuca

SEQ ID NO: 937951 - RNA, 20 nt, Human
gggagucuggaugaaagaug

SEQ ID NO: 937952 - RNA, 22 nt, Human
ugcagugguguccagguguacu

SEQ ID NO: 937953 - RNA, 22 nt, Human
auuuccagugcacugaauagaa

SEQ ID NO: 937954 - RNA, 22 nt, Human
ucugucucaaguucuugcacuc

SEQ ID NO: 937955 - RNA, 22 nt, Human
guccucagucaguuuggugggg

SEQ ID NO: 937956 - RNA, 22 nt, Human
aggauccugcgcuuugggggag

SEQ ID NO: 937957 - RNA, 22 nt, Human
ucugcuguugccaugaguaaua

SEQ ID NO: 937958 - RNA, 22 nt, Human
gcaccuuuuucuaggagaaugu

SEQ ID NO: 937959 - RNA, 22 nt, Human
ggcugcagcggauuggggauug

SEQ ID NO: 937960 - RNA, 22 nt, Human
guccucaggaaagcagauaaca

SEQ ID NO: 937961 - RNA, 22 nt, Human
uaggcaggugugcacugcccac

SEQ ID NO: 937962 - RNA, 22 nt, Human
caggcaggugcagauuccucuu

SEQ ID NO: 937963 - RNA, 22 nt, Human
gcugugcagucuuuggugugcc

SEQ ID NO: 937964 - RNA, 22 nt, Human
ggcuagaacuuuacacuuugca

SEQ ID NO: 937965 - RNA, 22 nt, Human
ucacugcaaggaggcuucucaa

SEQ ID NO: 937966 - RNA, 22 nt, Human
cagaguggcacucugcuggaug

SEQ ID NO: 937967 - RNA, 22 nt, Human
aucaggaucagggcuagcagag

SEQ ID NO: 937968 - RNA, 17 nt, Human
cauguguaugugggagu

SEQ ID NO: 937969 - RNA, 22 nt, Human
aaaugaguuuccucaauguccu

SEQ ID NO: 937970 - RNA, 22 nt, Human
ccugccagugaagcugacgggc

SEQ ID NO: 937971 - RNA, 20 nt, Human
gagauggacagaugaagggg

SEQ ID NO: 937972 - RNA, 19 nt, Human
aagcagcccuggcaagagc

SEQ ID NO: 937973 - RNA, 22 nt, Human
gaauuguacgcuuuacauaggu

SEQ ID NO: 937974 - RNA, 22 nt, Human
agugcacaccuuaguacaaagu

SEQ ID NO: 937975 - RNA, 22 nt, Human
ggagcggagggagggccacugu

SEQ ID NO: 937976 - RNA, 22 nt, Human
aaaagacaucuauuucaggcag

SEQ ID NO: 937977 - RNA, 22 nt, Human
ucugcugugggucuauauuuua

SEQ ID NO: 937978 - RNA, 19 nt, Human
uucauucuuucuacuuacc

SEQ ID NO: 937979 - RNA, 22 nt, Human
auuguauuuccagcuugaaugu

SEQ ID NO: 937980 - RNA, 22 nt, Human
uggcucucagcucccagcagcc

SEQ ID NO: 937981 - RNA, 22 nt, Human
ucuggaguccagauccauuugg

SEQ ID NO: 937982 - RNA, 22 nt, Human
ucaguauccacaaaugcucaaa

SEQ ID NO: 937983 - RNA, 22 nt, Human
augcaguagauaggcacuuuua

SEQ ID NO: 937984 - RNA, 22 nt, Human
uccagugguacauggagacacu

SEQ ID NO: 937985 - RNA, 22 nt, Human
aagagggcagcacagguggguc

SEQ ID NO: 937986 - RNA, 22 nt, Human
uuuuauucuaaguaugauggga

SEQ ID NO: 937987 - RNA, 22 nt, Human
caaugguggugucagaagagau

SEQ ID NO: 937988 - RNA, 20 nt, Human
uaugcuuuuuauaagauuga

SEQ ID NO: 937989 - RNA, 22 nt, Human
ugcucccaaacgaccuacugug

SEQ ID NO: 937990 - RNA, 21 nt, Human
gucagcagauccagcacuugu

SEQ ID NO: 937991 - RNA, 22 nt, Human
agauggggcagaauggagccau

SEQ ID NO: 937992 - RNA, 22 nt, Human
uuuuuugucuugaagaaauggu

SEQ ID NO: 937993 - RNA, 22 nt, Human
agggagccagaguugggagcuc

SEQ ID NO: 937994 - RNA, 22 nt, Human
auuuaugacuggugaauagaac

SEQ ID NO: 937995 - RNA, 22 nt, Human
cagccacguagcccuuggccgu

SEQ ID NO: 937996 - RNA, 22 nt, Human
uuuuuaagagauucuccagucu

SEQ ID NO: 937997 - RNA, 17 nt, Human
cucuccuuccucugagg

SEQ ID NO: 937998 - RNA, 22 nt, Human
ugccuguguccccuucuuggca

SEQ ID NO: 937999 - RNA, 22 nt, Human
ugccuugcacauaauauacauu

SEQ ID NO: 938000 - RNA, 22 nt, Human
gagcucauccccaugguccguc

SEQ ID NO: 938001 - RNA, 22 nt, Human
uuuucacacaaggugauaaguu

SEQ ID NO: 938002 - RNA, 22 nt, Human
ggcugagggccagggcuagucu

SEQ ID NO: 938003 - RNA, 22 nt, Human
gcagagccugacgggauuuuuc

SEQ ID NO: 938004 - RNA, 22 nt, Human
uccuuccucggggacccagauc

SEQ ID NO: 938005 - RNA, 22 nt, Human
gcaaggcugagcacauuugcau

SEQ ID NO: 938006 - RNA, 22 nt, Human
cugagcugggaguagagacucu

SEQ ID NO: 938007 - RNA, 22 nt, Human
ccugggcaacauagugagaccu

SEQ ID NO: 938008 - RNA, 22 nt, Human
gggcuggugaggcugcccugca

SEQ ID NO: 938009 - RNA, 22 nt, Human
uaagaacauuuucggaaagaua

SEQ ID NO: 938010 - RNA, 19 nt, Human
cagaacagaggucauggcc

SEQ ID NO: 938011 - RNA, 22 nt, Human
uuccuggcauagagagggcaca

SEQ ID NO: 938012 - RNA, 22 nt, Human
ugcaagcacucaaugcaaacag

SEQ ID NO: 938013 - RNA, 22 nt, Human
ugggcugccggcaggcucugcc

SEQ ID NO: 938014 - RNA, 23 nt, Human
ccacuagcaccuguucaacuucu

SEQ ID NO: 938015 - RNA, 22 nt, Human
ugccuugcgggcguuucuguug

SEQ ID NO: 938016 - RNA, 21 nt, Human
agaaauguaucauucuuuucc

SEQ ID NO: 938017 - RNA, 22 nt, Human
aucuggguucaccaugcuccug

SEQ ID NO: 938018 - RNA, 22 nt, Human
agcccaagcuaugaggugaccu

SEQ ID NO: 938019 - RNA, 22 nt, Human
uccaggcaggguuaaggguccu

SEQ ID NO: 938020 - RNA, 22 nt, Human
acuuucauuugugaagacugua

SEQ ID NO: 938021 - RNA, 21 nt, Human
ucacuuauaauguauuugcug

SEQ ID NO: 938022 - RNA, 22 nt, Human
uccauuuacuauucucauaucg

SEQ ID NO: 938023 - RNA, 22 nt, Human
cuccucugucuaccacgagggu

SEQ ID NO: 938024 - RNA, 19 nt, Human
agacagagcucaguggguu

SEQ ID NO: 938025 - RNA, 22 nt, Human
cuccaggagcugugucuuucuu

SEQ ID NO: 938026 - RNA, 22 nt, Human
aggagccaugagugacaucaca

SEQ ID NO: 938027 - RNA, 22 nt, Human
acaugaaaccugagucuaacuc

SEQ ID NO: 938028 - RNA, 21 nt, Human
cgcagagcgaacuugcggcgc

SEQ ID NO: 938029 - RNA, 22 nt, Human
ucugccuuggcaaccacagcuu

SEQ ID NO: 938030 - RNA, 22 nt, Human
cugagauggaguuuugcucuug

SEQ ID NO: 938031 - RNA, 22 nt, Human
ggucccugcugaagccuuggug

SEQ ID NO: 938032 - RNA, 22 nt, Human
cuggagagggagcccuggcagu

SEQ ID NO: 938033 - RNA, 22 nt, Human
cuggcucacaggugagaugcau

SEQ ID NO: 938034 - RNA, 22 nt, Human
gcucccagacugaccagaggug

SEQ ID NO: 938035 - RNA, 22 nt, Human
gcauccagagguagccacugug

SEQ ID NO: 938036 - RNA, 22 nt, Human
acuucucuucauagguggcaau

SEQ ID NO: 938037 - RNA, 23 nt, Human
uccagcagagccuuccaggaggg

SEQ ID NO: 938038 - RNA, 22 nt, Human
gcccagcugucuggcagggaug

SEQ ID NO: 938039 - RNA, 22 nt, Human
ggcuggagauaugucuggaaca

SEQ ID NO: 938040 - RNA, 22 nt, Human
ggcucugcccagguggacagca

SEQ ID NO: 938041 - RNA, 22 nt, Human
aggaaagguagcgugccagcag

SEQ ID NO: 938042 - RNA, 22 nt, Human
agcaggagagcagugcgugguc

SEQ ID NO: 938043 - RNA, 22 nt, Human
aaaagguaguugccaaauaagg

SEQ ID NO: 938044 - RNA, 22 nt, Human
cuagaaaugcucaagagaaagu

SEQ ID NO: 938045 - RNA, 23 nt, Human
ucugucaccuauggcugcucuuc

SEQ ID NO: 938046 - RNA, 22 nt, Human
caucugcuguuccuuggacuca

SEQ ID NO: 938047 - RNA, 22 nt, Human
uaucuacaggugucagguaaga

SEQ ID NO: 938048 - RNA, 22 nt, Human
aaugaugguauugaugagcuaa

SEQ ID NO: 938049 - RNA, 22 nt, Human
uggugagcgaugcugcauguuc

SEQ ID NO: 938050 - RNA, 22 nt, Human
gugauuccuauuaguacaugca

SEQ ID NO: 938051 - RNA, 22 nt, Human
acucagaaugacugaugcugug

SEQ ID NO: 938052 - RNA, 22 nt, Human
ggugggcagcucuuggcaggca

SEQ ID NO: 938053 - RNA, 22 nt, Human
uuauggcauauuccucauugua

SEQ ID NO: 938054 - RNA, 19 nt, Human
augauggucccauucaccu

SEQ ID NO: 938055 - RNA, 22 nt, Human
uccucugcuccaucuuuacugu

SEQ ID NO: 938056 - RNA, 22 nt, Human
aaaccauggaguaaguucacau

SEQ ID NO: 938057 - RNA, 22 nt, Human
aggcggcuccgggagugugggc

SEQ ID NO: 938058 - RNA, 22 nt, Human
uucuucaaaauccagcaugauu

SEQ ID NO: 938059 - RNA, 22 nt, Human
uggcucugugucucccagcagc

SEQ ID NO: 938060 - RNA, 22 nt, Human
uaauuauuugaagacauuagag

SEQ ID NO: 938061 - RNA, 22 nt, Human
agcugcugagagucugccgggc

SEQ ID NO: 938062 - RNA, 22 nt, Human
cagccucuaagcacagccucuc

SEQ ID NO: 938063 - RNA, 22 nt, Human
uucuccagaccuugugacuaug

SEQ ID NO: 938064 - RNA, 22 nt, Human
cgagcaugaugacggcuguggc

SEQ ID NO: 938065 - RNA, 22 nt, Human
uccugggcccaggcugccaggg

SEQ ID NO: 938066 - RNA, 19 nt, Human
ugaguucugugguucucaa

SEQ ID NO: 938067 - RNA, 22 nt, Human
cuucucaaaguugugaaucagg

SEQ ID NO: 938068 - RNA, 22 nt, Human
uuccauaaucaccuuauucuuu

SEQ ID NO: 938069 - RNA, 22 nt, Human
gcugccucccccauggcuggaa

SEQ ID NO: 938070 - RNA, 22 nt, Human
ccaaaguccauaguuuacauaa

SEQ ID NO: 938071 - RNA, 22 nt, Human
cagaggaguucaguacacagcc

SEQ ID NO: 938072 - RNA, 22 nt, Human
aggcaggcccucuggaaaggua

SEQ ID NO: 938073 - RNA, 22 nt, Human
cacagcuuccauuagaaugaga

SEQ ID NO: 938074 - RNA, 21 nt, Human
ugccagcauuaaacagucauu

SEQ ID NO: 938075 - RNA, 22 nt, Human
ugcuuuauuuauaaaauagcaa

SEQ ID NO: 938076 - RNA, 22 nt, Human
gcucccugcagcugagaguucc

SEQ ID NO: 938077 - RNA, 22 nt, Human
auuguaauuuuagagaaagugg

SEQ ID NO: 938078 - RNA, 22 nt, Human
aagccaggggcugcuuaggaga

SEQ ID NO: 938079 - RNA, 22 nt, Human
uggggacaggagacuuacagcu

SEQ ID NO: 938080 - RNA, 21 nt, Human
auuuggauauugcuggcaaau

SEQ ID NO: 938081 - RNA, 22 nt, Human
gcagguggcagaggugggaucu

SEQ ID NO: 938082 - RNA, 22 nt, Human
acacacaacucauuguguaaua

SEQ ID NO: 938083 - RNA, 22 nt, Human
uuuuauugucaaugaagacaga

SEQ ID NO: 938084 - RNA, 22 nt, Human
uccuggaguauuucuguggugu

SEQ ID NO: 938085 - RNA, 22 nt, Human
ucaugucaguuucuucuauaaa

SEQ ID NO: 938086 - RNA, 22 nt, Human
cugccaucugagccaaaagugc

SEQ ID NO: 938087 - RNA, 22 nt, Human
uggucaaaaaggccuagacaca

SEQ ID NO: 938088 - RNA, 22 nt, Human
auuuucuagauagaugaugcau

SEQ ID NO: 938089 - RNA, 22 nt, Human
uuccuucucagcccucgaggau

SEQ ID NO: 938090 - RNA, 22 nt, Human
caagaacauugugaucacuuca

SEQ ID NO: 938091 - RNA, 22 nt, Human
aggagucacucagggcuucauc

SEQ ID NO: 938092 - RNA, 22 nt, Human
auagacauuuugcauucaagca

SEQ ID NO: 938093 - RNA, 22 nt, Human
gcuguauuuaacaacuggcuca

SEQ ID NO: 938094 - RNA, 22 nt, Human
agagccaggaugucuucugggg

SEQ ID NO: 938095 - RNA, 22 nt, Human
uuuguuaauucuuauguuagag

SEQ ID NO: 938096 - RNA, 22 nt, Human
uggcaggguuggccaccuuacc

SEQ ID NO: 938097 - RNA, 22 nt, Human
ugggcuguccagcaccugggcu

SEQ ID NO: 938098 - RNA, 21 nt, Human
agcuuccugcagugggagguc

SEQ ID NO: 938099 - RNA, 22 nt, Human
auaaagaggauguauuuacagc

SEQ ID NO: 938100 - RNA, 15 nt, Human
cuccaugauuuugca

SEQ ID NO: 938101 - RNA, 17 nt, Human
cccacggaggugugaaa

SEQ ID NO: 938102 - RNA, 22 nt, Human
uucuucaaagaugucuguugga

SEQ ID NO: 938103 - RNA, 23 nt, Human
gaggcacucaggaaaugugagug

SEQ ID NO: 938104 - RNA, 22 nt, Human
aguuuguaucaauuugcuuuau

SEQ ID NO: 938105 - RNA, 20 nt, Human
gcagcugaaaguaugacacc

SEQ ID NO: 938106 - RNA, 22 nt, Human
uucuucuugucugcccucacau

SEQ ID NO: 938107 - RNA, 22 nt, Human
gaugugggguugagggaccagc

SEQ ID NO: 938108 - RNA, 22 nt, Human
gccaccagggggcuccagugag

SEQ ID NO: 938109 - RNA, 19 nt, Human
ggaugagggucaggcauag

SEQ ID NO: 938110 - RNA, 22 nt, Human
uccugccuuagagcaaggaaaa

SEQ ID NO: 938111 - RNA, 21 nt, Human
ccagcagcucaaggaucucuu

SEQ ID NO: 938112 - RNA, 22 nt, Human
uuuaaauuuguguuuagagggu

SEQ ID NO: 938113 - RNA, 22 nt, Human
uuucuucugagaucagggagaa

SEQ ID NO: 938114 - RNA, 22 nt, Human
ugaaguccuagaacuccuggua

SEQ ID NO: 938115 - RNA, 22 nt, Human
aaggccagacaggaccacaucu

SEQ ID NO: 938116 - RNA, 22 nt, Human
ccagccagcugcccuuggggcc

SEQ ID NO: 938117 - RNA, 22 nt, Human
agagagccugaguggcagcuau

SEQ ID NO: 938118 - RNA, 22 nt, Human
acauguguauagccuguauaga

SEQ ID NO: 938119 - RNA, 22 nt, Human
uauuucuaagagauaucuguac

SEQ ID NO: 938120 - RNA, 22 nt, Human
ggcaaaaaccgcaauaacuucu

SEQ ID NO: 938121 - RNA, 22 nt, Human
gcugcaggagcuggagcugugg

SEQ ID NO: 938122 - RNA, 17 nt, Human
ccugggaggaguuauga

SEQ ID NO: 938123 - RNA, 22 nt, Human
ugaggcagcuuuuucugugugu

SEQ ID NO: 938124 - RNA, 22 nt, Human
cagguaaaaauaaauuugugag

SEQ ID NO: 938125 - RNA, 22 nt, Human
gagagcuguguucauucuacca

SEQ ID NO: 938126 - RNA, 21 nt, Human
ccuucucuugcuucagcuuca

SEQ ID NO: 938127 - RNA, 22 nt, Human
cuguuuauaaauagaggggagu

SEQ ID NO: 938128 - RNA, 20 nt, Human
uggagccaaggugugucugg

SEQ ID NO: 938129 - RNA, 19 nt, Human
uauucaggaugauggcaca

SEQ ID NO: 938130 - RNA, 22 nt, Human
aguaaacauaauuuaccuguag

SEQ ID NO: 938131 - RNA, 21 nt, Human
ccagagccugcugagcccccu

SEQ ID NO: 938132 - RNA, 22 nt, Human
uaaccuuucaggcauguagguu

SEQ ID NO: 938133 - RNA, 22 nt, Human
agaggggcucaagcaguggucu

SEQ ID NO: 938134 - RNA, 22 nt, Human
uaaccauauuuuccauuaaguu

SEQ ID NO: 938135 - RNA, 22 nt, Human
aagaacugugcuccaggcucca

SEQ ID NO: 938136 - RNA, 22 nt, Human
ccagggcacguugggacaguac

SEQ ID NO: 938137 - RNA, 22 nt, Human
aauguuaaaaccuucagugcuu

SEQ ID NO: 938138 - RNA, 22 nt, Human
acacaaugcauauuuuuccaga

SEQ ID NO: 938139 - RNA, 22 nt, Human
uucauuccugagcccauauuua

SEQ ID NO: 938140 - RNA, 22 nt, Human
uuccaggagacuuccagaaaua

SEQ ID NO: 938141 - RNA, 22 nt, Human
uaggcagcuuagguuagaagug

SEQ ID NO: 938142 - RNA, 22 nt, Human
ggcuggcaggcacaguaugcaa

SEQ ID NO: 938143 - RNA, 22 nt, Human
ggcuggcagaggggagucugug

SEQ ID NO: 938144 - RNA, 22 nt, Human
cugcugugugaccauggacagg

SEQ ID NO: 938145 - RNA, 22 nt, Human
ugugccaugaggcucugauaug

SEQ ID NO: 938146 - RNA, 19 nt, Human
acagagcucucugcuucug

SEQ ID NO: 938147 - RNA, 22 nt, Human
ugaguaauaaacugucuugcuc

SEQ ID NO: 938148 - RNA, 22 nt, Human
aggcaugugacccuggacucag

SEQ ID NO: 938149 - RNA, 22 nt, Human
gcucaggaucagccaccucuuu

SEQ ID NO: 938150 - RNA, 20 nt, Human
accucugcaucaauccuuug

SEQ ID NO: 938151 - RNA, 22 nt, Human
auacauguucguguacauguuc

SEQ ID NO: 938152 - RNA, 22 nt, Human
ggagaggguguggaaaguuauc

SEQ ID NO: 938153 - RNA, 22 nt, Human
uuuuagaaauacugauuuagug

SEQ ID NO: 938154 - RNA, 22 nt, Human
acuccugguuuguguccuggcu

SEQ ID NO: 938155 - RNA, 22 nt, Human
uacccagggcuuuucugaugca

SEQ ID NO: 938156 - RNA, 22 nt, Human
ccugccugcaccuucucugggg

SEQ ID NO: 938157 - RNA, 22 nt, Human
ugaaucauggauaaauagcuua

SEQ ID NO: 938158 - RNA, 22 nt, Human
uucuuaacucaaauauauaucc

SEQ ID NO: 938159 - RNA, 22 nt, Human
gccugucugcgucacgcuuauu

SEQ ID NO: 938160 - RNA, 22 nt, Human
caggugccucaggaugagacaa

SEQ ID NO: 938161 - RNA, 22 nt, Human
cugcuuugcauagcugccagag

SEQ ID NO: 938162 - RNA, 22 nt, Human
guaagggauuugaacauagguu

SEQ ID NO: 938163 - RNA, 22 nt, Human
uugggagcuuggccgagaugua

SEQ ID NO: 938164 - RNA, 22 nt, Human
cugcagggcagggccuccuggc

SEQ ID NO: 938165 - RNA, 22 nt, Human
ccagggccaagagaccucgagg

SEQ ID NO: 938166 - RNA, 22 nt, Human
aaaaaugcuuggacuuaauaaa

SEQ ID NO: 938167 - RNA, 22 nt, Human
gaggcccugaagacagcugggg

SEQ ID NO: 938168 - RNA, 22 nt, Human
gcagcucccagcuugaaagguc

SEQ ID NO: 938169 - RNA, 22 nt, Human
uggcucugggcaccguguccac

SEQ ID NO: 938170 - RNA, 22 nt, Human
aaagcuauuugugaguuauaga

SEQ ID NO: 938171 - RNA, 22 nt, Human
aaaaugugaucuacaaaugcaa

SEQ ID NO: 938172 - RNA, 18 nt, Human
caggagcaggaguugaac

SEQ ID NO: 938173 - RNA, 22 nt, Human
uugaaauggaagugaaaauucu

SEQ ID NO: 938174 - RNA, 22 nt, Human
aaugcaguuucauuuguagaau

SEQ ID NO: 938175 - RNA, 19 nt, Human
gcuguauuaaagauacaug

SEQ ID NO: 938176 - RNA, 22 nt, Human
agagaaggucacuaaggaccca

SEQ ID NO: 938177 - RNA, 22 nt, Human
aacuaacagucauuaaaagaac

SEQ ID NO: 938178 - RNA, 22 nt, Human
uggaagggagugacagucagag

SEQ ID NO: 938179 - RNA, 22 nt, Human
gcucucugccauaugaggauac

SEQ ID NO: 938180 - RNA, 22 nt, Human
aggagcugagggagcgcccuug

SEQ ID NO: 938181 - RNA, 22 nt, Human
ggggcacuuccaggcugaggcu

SEQ ID NO: 938182 - RNA, 23 nt, Human
aaguaacagggauaauagcaguu

SEQ ID NO: 938183 - RNA, 22 nt, Human
ugcugaugaguccuucuaucgc

SEQ ID NO: 938184 - RNA, 22 nt, Human
uggcagccaucugagggugggg

SEQ ID NO: 938185 - RNA, 22 nt, Human
uucucugaguacguuucagugu

SEQ ID NO: 938186 - RNA, 22 nt, Human
ccuccagggcagacggggagca

SEQ ID NO: 938187 - RNA, 22 nt, Human
uggccugauuuugcuaagagaa

SEQ ID NO: 938188 - RNA, 22 nt, Human
cauuaagucuguuaacuggaga

SEQ ID NO: 938189 - RNA, 22 nt, Human
aaggcacucagccuugggacag

SEQ ID NO: 938190 - RNA, 22 nt, Human
augcccugaggaaugucacgcu

SEQ ID NO: 938191 - RNA, 22 nt, Human
ucacugcaaccucugccuuccg

SEQ ID NO: 938192 - RNA, 22 nt, Human
ccugcugugaccggggagcagg

SEQ ID NO: 938193 - RNA, 22 nt, Human
aaaucucaggccucuauuuacu

SEQ ID NO: 938194 - RNA, 19 nt, Human
gcuggggccugaccagaca

SEQ ID NO: 938195 - RNA, 22 nt, Human
cgggcuggcugcagcugcugga

SEQ ID NO: 938196 - RNA, 22 nt, Human
aauauaguucugguauuguuaa

SEQ ID NO: 938197 - RNA, 22 nt, Human
agagcagauggccagggggccu

SEQ ID NO: 938198 - RNA, 17 nt, Human
ugagcaguagaagaugc

SEQ ID NO: 938199 - RNA, 22 nt, Human
cauggcagggcugugggcaggu

SEQ ID NO: 938200 - RNA, 22 nt, Human
gccucugcucggacuuugccuc

SEQ ID NO: 938201 - RNA, 22 nt, Human
caaauucucaagguuuauccca

SEQ ID NO: 938202 - RNA, 22 nt, Human
uuguguccugauuugacacaau

SEQ ID NO: 938203 - RNA, 22 nt, Human
ucugaggcauaaccuguucugc

SEQ ID NO: 938204 - RNA, 22 nt, Human
aaaguuacuaucacaaugaaau

SEQ ID NO: 938205 - RNA, 22 nt, Human
acugggccuugccauggcagcc

SEQ ID NO: 938206 - RNA, 20 nt, Human
ucauugcacauaauggaagc

SEQ ID NO: 938207 - RNA, 19 nt, Human
gcagccaggugcucuaccu

SEQ ID NO: 938208 - RNA, 22 nt, Human
ccagccagucccgcaugaccgc

SEQ ID NO: 938209 - RNA, 22 nt, Human
cugcaggaauucaaagugagcu

SEQ ID NO: 938210 - RNA, 22 nt, Human
uguuuauuuucaggauggauug

SEQ ID NO: 938211 - RNA, 22 nt, Human
augaggcaguacacacaaagcc

SEQ ID NO: 938212 - RNA, 22 nt, Human
uguucaaaugaucuucuuaaau

SEQ ID NO: 938213 - RNA, 22 nt, Human
ccagagccucgcccggagccuc

SEQ ID NO: 938214 - RNA, 22 nt, Human
uaacccaauaauugguggccuu

SEQ ID NO: 938215 - RNA, 22 nt, Human
cagguaagagacggauuggccc

SEQ ID NO: 938216 - RNA, 22 nt, Human
cugcugugaguuuggaggucua

SEQ ID NO: 938217 - RNA, 22 nt, Human
caggaugagaggcccagggaag

SEQ ID NO: 938218 - RNA, 22 nt, Human
gccugggugucgaucacuagug

SEQ ID NO: 938219 - RNA, 22 nt, Human
cugcgcagcaaucagagaggag

SEQ ID NO: 938220 - RNA, 22 nt, Human
cagacagggaccucgcuccaga

SEQ ID NO: 938221 - RNA, 22 nt, Human
cugggagguggagguugcauug

SEQ ID NO: 938222 - RNA, 22 nt, Human
gucucagauaacauguauucua

SEQ ID NO: 938223 - RNA, 22 nt, Human
caguguuccaggcggcagugaa

SEQ ID NO: 938224 - RNA, 22 nt, Human
uaugaagaaguucugugaaaug

SEQ ID NO: 938225 - RNA, 22 nt, Human
uuuuagauugggaaauguaaag

SEQ ID NO: 938226 - RNA, 22 nt, Human
gccuggagaaaggaagguggga

SEQ ID NO: 938227 - RNA, 22 nt, Human
gucuggggaagucagggcauca

SEQ ID NO: 938228 - RNA, 22 nt, Human
ucccagcagcauagcucagaau

SEQ ID NO: 938229 - RNA, 19 nt, Human
caggagagcaugcacuuug

SEQ ID NO: 938230 - RNA, 22 nt, Human
uucuacagacuauaacugugau

SEQ ID NO: 938231 - RNA, 22 nt, Human
aggcugaggcagguggaucacu

SEQ ID NO: 938232 - RNA, 22 nt, Human
cagcugucuaaguugagcagga

SEQ ID NO: 938233 - RNA, 22 nt, Human
ugaggcagggaguuuaauuguc

SEQ ID NO: 938234 - RNA, 22 nt, Human
ccugggccugaaaacauuucuc

SEQ ID NO: 938235 - RNA, 22 nt, Human
acuuaguauuuuucagcuuuga

SEQ ID NO: 938236 - RNA, 22 nt, Human
uggcucugaccagguagaggag

SEQ ID NO: 938237 - RNA, 22 nt, Human
gcccaggaguucaaggcugcag

SEQ ID NO: 938238 - RNA, 22 nt, Human
ucauuuguugaacuuuagugcg

SEQ ID NO: 938239 - RNA, 22 nt, Human
cugcugccggcgagccucccuu

SEQ ID NO: 938240 - RNA, 19 nt, Human
ugucccagacuccgugucu

SEQ ID NO: 938241 - RNA, 22 nt, Human
aggcagcaugggcccagagucc

SEQ ID NO: 938242 - RNA, 22 nt, Human
uggaguucauccaugacagcuu

SEQ ID NO: 938243 - RNA, 22 nt, Human
gaacagcugcuagagaucugug

SEQ ID NO: 938244 - RNA, 22 nt, Human
uggccugcuuucauuugaugcu

SEQ ID NO: 938245 - RNA, 22 nt, Human
agccuccaguagcugaagagac

SEQ ID NO: 938246 - RNA, 22 nt, Human
cauugacaguucuuuaaguugc

SEQ ID NO: 938247 - RNA, 19 nt, Human
cagagcagugguuccugaa

SEQ ID NO: 938248 - RNA, 22 nt, Human
cugggcagugguggcaucuuug

SEQ ID NO: 938249 - RNA, 22 nt, Human
uggcagaggaggcucagauuga

SEQ ID NO: 938250 - RNA, 22 nt, Human
ugcugccaggucuugcugucca

SEQ ID NO: 938251 - RNA, 22 nt, Human
cagcccagcacuaaguagauuu

SEQ ID NO: 938252 - RNA, 22 nt, Human
gggcacugaaugccaagcuagg

SEQ ID NO: 938253 - RNA, 20 nt, Human
uccugagccuccaccauguc

SEQ ID NO: 938254 - RNA, 22 nt, Human
agcugcccugggucuugcugcu

SEQ ID NO: 938255 - RNA, 22 nt, Human
caggggacaguaugguggauga

SEQ ID NO: 938256 - RNA, 22 nt, Human
uacauacacaaauauacuguuu

SEQ ID NO: 938257 - RNA, 22 nt, Human
cacagggccacuuucccaguaa

SEQ ID NO: 938258 - RNA, 22 nt, Human
cagaggcucaccagccuuucac

SEQ ID NO: 938259 - RNA, 22 nt, Human
aguaacucauguaaaccucaca

SEQ ID NO: 938260 - RNA, 22 nt, Human
auuaaagugaaguucucagaug

SEQ ID NO: 938261 - RNA, 22 nt, Human
gcauuauuaauagcugcaugag

SEQ ID NO: 938262 - RNA, 22 nt, Human
ucauucagguugggcaaguguc

SEQ ID NO: 938263 - RNA, 22 nt, Human
ucuguuuugcauaauguucuuu

SEQ ID NO: 938264 - RNA, 22 nt, Human
auguaguauuuggaaauguaaa

SEQ ID NO: 938265 - RNA, 22 nt, Human
ucacucugggccagcgcaggua

SEQ ID NO: 938266 - RNA, 22 nt, Human
agccagggagguggagguugca

SEQ ID NO: 938267 - RNA, 22 nt, Human
uggcagaguucgcuccuauuca

SEQ ID NO: 938268 - RNA, 22 nt, Human
aaaauaucagcaaagggugaca

SEQ ID NO: 938269 - RNA, 21 nt, Human
ucaggcaggcgcagagggaag

SEQ ID NO: 938270 - RNA, 19 nt, Human
ggucacagggguuacaagg

SEQ ID NO: 938271 - RNA, 22 nt, Human
caagaaaugggauuugacugcc

SEQ ID NO: 938272 - RNA, 22 nt, Human
aggaggccgggauucuggagau

SEQ ID NO: 938273 - RNA, 22 nt, Human
gcaaagguagccaaggagcuca

SEQ ID NO: 938274 - RNA, 22 nt, Human
gagggagagugauggaccauug

SEQ ID NO: 938275 - RNA, 22 nt, Human
cacacagaugguaagggaggga

SEQ ID NO: 938276 - RNA, 22 nt, Human
uagagcuggaauuugcagcaag

SEQ ID NO: 938277 - RNA, 22 nt, Human
aguaauaauuuauauuagggag

SEQ ID NO: 938278 - RNA, 22 nt, Human
aauaguaaaagauacagcuaau

SEQ ID NO: 938279 - RNA, 22 nt, Human
cuccuggaggauagugacuggg

SEQ ID NO: 938280 - RNA, 22 nt, Human
uccuggccugucuggaguagcu

SEQ ID NO: 938281 - RNA, 22 nt, Human
uagaagcaguaauagaaauagg

SEQ ID NO: 938282 - RNA, 22 nt, Human
uccucuggauauaagccucacc

SEQ ID NO: 938283 - RNA, 20 nt, Human
gcccaggaucucugaggcau

SEQ ID NO: 938284 - RNA, 22 nt, Human
auguagcaucuauccugauaaa

SEQ ID NO: 938285 - RNA, 22 nt, Human
ccuugggauuucucaugccaau

SEQ ID NO: 938286 - RNA, 22 nt, Human
ugaaggaaugaguauacuguuu

SEQ ID NO: 938287 - RNA, 22 nt, Human
uccugggcaaaaguaucuguga

SEQ ID NO: 938288 - RNA, 22 nt, Human
gagcccuggcagucugggaugg

SEQ ID NO: 938289 - RNA, 22 nt, Human
uaugaaacauucauacaaauaa

SEQ ID NO: 938290 - RNA, 22 nt, Human
augaaacacacacgcgcauacu

SEQ ID NO: 938291 - RNA, 22 nt, Human
agcugcagucaagcugggccac

SEQ ID NO: 938292 - RNA, 22 nt, Human
cugggagcaagucaggaaaggu

SEQ ID NO: 938293 - RNA, 22 nt, Human
cugagcugggcucucuugaggg

SEQ ID NO: 938294 - RNA, 22 nt, Human
cagggcugagaauuuagagaca

SEQ ID NO: 938295 - RNA, 22 nt, Human
uuccaugaaauguguuaugcuu

SEQ ID NO: 938296 - RNA, 22 nt, Human
guccucaguaagagggccucug

SEQ ID NO: 938297 - RNA, 22 nt, Human
uggcgcaacucauucauggugu

SEQ ID NO: 938298 - RNA, 22 nt, Human
ucuccuuugaaaguuaggacug

SEQ ID NO: 938299 - RNA, 22 nt, Human
cuguguuggcuuuucucuugua

SEQ ID NO: 938300 - RNA, 22 nt, Human
ucccuggaacagagagacaacg

SEQ ID NO: 938301 - RNA, 22 nt, Human
cuucaggauuuaggaagaugaa

SEQ ID NO: 938302 - RNA, 22 nt, Human
agagugauucuaguuagggaau

SEQ ID NO: 938303 - RNA, 22 nt, Human
ccagccugguucagaauuggcu

SEQ ID NO: 938304 - RNA, 22 nt, Human
cauggcauugcauaacggggcu

SEQ ID NO: 938305 - RNA, 19 nt, Human
gaggagcuaucggagacag

SEQ ID NO: 938306 - RNA, 22 nt, Human
guauuuucaagagcaguaguau

SEQ ID NO: 938307 - RNA, 22 nt, Human
ucaacacucuuuggcacaguua

SEQ ID NO: 938308 - RNA, 22 nt, Human
cugggccacaagccugugugau

SEQ ID NO: 938309 - RNA, 22 nt, Human
ucuucacaccgggcagcaggaa

SEQ ID NO: 938310 - RNA, 22 nt, Human
agggucugcauuccaacuuggg

SEQ ID NO: 938311 - RNA, 22 nt, Human
ggcagggaagcuggcaucacgg

SEQ ID NO: 938312 - RNA, 22 nt, Human
gugugcccuggcuccagcacca

SEQ ID NO: 938313 - RNA, 22 nt, Human
gaagcuucguggcucuucaaau

SEQ ID NO: 938314 - RNA, 23 nt, Human
cugaggccugcugcguucagguu

SEQ ID NO: 938315 - RNA, 22 nt, Human
uugucugugaaauggaaauagu

SEQ ID NO: 938316 - RNA, 22 nt, Human
uguuuguucccucucuuuccug

SEQ ID NO: 938317 - RNA, 22 nt, Human
aggcaggugggucacuugaguc

SEQ ID NO: 938318 - RNA, 22 nt, Human
aaugcugcucucauaauuauag

SEQ ID NO: 938319 - RNA, 22 nt, Human
ugccugcuaggcccugcugggu

SEQ ID NO: 938320 - RNA, 22 nt, Human
agugugucugaucacuugugag

SEQ ID NO: 938321 - RNA, 22 nt, Human
cagccuuuuccauguauuguug

SEQ ID NO: 938322 - RNA, 20 nt, Human
uggcccuguuuucuccaggc

SEQ ID NO: 938323 - RNA, 22 nt, Human
gagagcacaugaacauggagga

SEQ ID NO: 938324 - RNA, 21 nt, Human
ggcagccugacccccagagag

SEQ ID NO: 938325 - RNA, 22 nt, Human
agucaguggcuccgagccuggu

SEQ ID NO: 938326 - RNA, 20 nt, Human
uugcaaauaucuauugauug

SEQ ID NO: 938327 - RNA, 22 nt, Human
auucuucagaauaucuggcacu

SEQ ID NO: 938328 - RNA, 22 nt, Human
gaaagaggaaggagauguauua

SEQ ID NO: 938329 - RNA, 22 nt, Human
ugcugcucuguaaagugaugag

SEQ ID NO: 938330 - RNA, 22 nt, Human
cuggggcugcagcgaucuucau

SEQ ID NO: 938331 - RNA, 22 nt, Human
gcugcucuugaggggcucacug

SEQ ID NO: 938332 - RNA, 22 nt, Human
gugggagcuucaucaagcaguu

SEQ ID NO: 938333 - RNA, 22 nt, Human
uagggagcucuggcagaaggaa

SEQ ID NO: 938334 - RNA, 22 nt, Human
uugcaggauuuuagagaugaca

SEQ ID NO: 938335 - RNA, 22 nt, Human
ugguaaagaaggcuagaucuga

SEQ ID NO: 938336 - RNA, 22 nt, Human
uggcucagagccuugagagcug

SEQ ID NO: 938337 - RNA, 22 nt, Human
gggagagagagcucauguugaa

SEQ ID NO: 938338 - RNA, 22 nt, Human
aagcagugcgcucaucuaaggg

SEQ ID NO: 938339 - RNA, 22 nt, Human
uccaggagcucauccacgucaa

SEQ ID NO: 938340 - RNA, 22 nt, Human
aagagagagcauucuucuguua

SEQ ID NO: 938341 - RNA, 22 nt, Human
ucucuggguuuuuguccuguac

SEQ ID NO: 938342 - RNA, 22 nt, Human
uauguagaagcugcucaaagaa

SEQ ID NO: 938343 - RNA, 22 nt, Human
gcagcccagagcgcaggacccc

SEQ ID NO: 938344 - RNA, 22 nt, Human
aucuggcuuucuuaaugacuua

SEQ ID NO: 938345 - RNA, 22 nt, Human
ggcagggguccugguguugacu

SEQ ID NO: 938346 - RNA, 22 nt, Human
auaauaaaccaggaugggucug

SEQ ID NO: 938347 - RNA, 22 nt, Human
ggccagaggccacagcuguguc

SEQ ID NO: 938348 - RNA, 22 nt, Human
cuguccuugcuggccagguaug

SEQ ID NO: 938349 - RNA, 22 nt, Human
aucaggauguuuggcugucaua

SEQ ID NO: 938350 - RNA, 22 nt, Human
cuugaaagucacaugcagcccu

SEQ ID NO: 938351 - RNA, 22 nt, Human
cugggggcaauggucagagugu

SEQ ID NO: 938352 - RNA, 22 nt, Human
aaaugcacagguuuuaaauccu

SEQ ID NO: 938353 - RNA, 22 nt, Human
cagaguacugggagaacagaag

SEQ ID NO: 938354 - RNA, 22 nt, Human
cugggagccuggcaguugcuga

SEQ ID NO: 938355 - RNA, 21 nt, Human
uuucuuaggcucuaaaaugac

SEQ ID NO: 938356 - RNA, 22 nt, Human
ucuccugugcacccucccugug

SEQ ID NO: 938357 - RNA, 22 nt, Human
ccacaucucgguccccucuuug

SEQ ID NO: 938358 - RNA, 22 nt, Human
gugcugugucuaucaggaauaa

SEQ ID NO: 938359 - RNA, 22 nt, Human
uuuguaaaagcccaagcuguag

SEQ ID NO: 938360 - RNA, 22 nt, Human
gcucccacgcaauucuuuucag

SEQ ID NO: 938361 - RNA, 19 nt, Human
gugcuuuuuaagagcucag

SEQ ID NO: 938362 - RNA, 22 nt, Human
gcacagggaggcuggccuggcc

SEQ ID NO: 938363 - RNA, 22 nt, Human
gaggaggccaguggaaggaagc

SEQ ID NO: 938364 - RNA, 23 nt, Human
agaaaagcuuggacacauggccu

SEQ ID NO: 938365 - RNA, 22 nt, Human
uagggaugagccaguggguagu

SEQ ID NO: 938366 - RNA, 22 nt, Human
uucaacacaggaacaugauaua

SEQ ID NO: 938367 - RNA, 17 nt, Human
gagacagcaggagcccc

SEQ ID NO: 938368 - RNA, 18 nt, Human
aguaaagcuuauuacaug

SEQ ID NO: 938369 - RNA, 22 nt, Human
ccucuccaguuuuaacgugacc

SEQ ID NO: 938370 - RNA, 18 nt, Human
uaaaugcauguuaauaac

SEQ ID NO: 938371 - RNA, 22 nt, Human
ggcugugggccagcuagacccu

SEQ ID NO: 938372 - RNA, 22 nt, Human
uucaggauucugugucugacaa

SEQ ID NO: 938373 - RNA, 22 nt, Human
uugcaaauauguucuccuauuc

SEQ ID NO: 938374 - RNA, 22 nt, Human
gcugccuguccugaggaguccg

SEQ ID NO: 938375 - RNA, 22 nt, Human
auggccuccgacccaugacgug

SEQ ID NO: 938376 - RNA, 21 nt, Human
agagagggagaugaaacaucc

SEQ ID NO: 938377 - RNA, 21 nt, Human
agcagaggcagaauguaugca

SEQ ID NO: 938378 - RNA, 22 nt, Human
ccaguuuuuccagugcuuucug

SEQ ID NO: 938379 - RNA, 22 nt, Human
cagggccuucguaaguguccgg

SEQ ID NO: 938380 - RNA, 22 nt, Human
caggccuggcccccggcacacc

SEQ ID NO: 938381 - RNA, 19 nt, Human
ugcauaaauuauauacuuu

SEQ ID NO: 938382 - RNA, 22 nt, Human
aagacccacaaggcugaauguu

SEQ ID NO: 938383 - RNA, 22 nt, Human
ggccagaggugguacauagcuu

SEQ ID NO: 938384 - RNA, 22 nt, Human
aaugauuuccccuacacagaag

SEQ ID NO: 938385 - RNA, 22 nt, Human
aaaaguaauugcaauuuuguag

SEQ ID NO: 938386 - RNA, 22 nt, Human
cuagaaauacaggcacgugcca

SEQ ID NO: 938387 - RNA, 22 nt, Human
ugucaugccauuuaaaauguuu

SEQ ID NO: 938388 - RNA, 22 nt, Human
uauuccuauggccacugcuacu

SEQ ID NO: 938389 - RNA, 22 nt, Human
cuggcccagagagcagagcuua

SEQ ID NO: 938390 - RNA, 22 nt, Human
ucuucuccagugcuucugcaca

SEQ ID NO: 938391 - RNA, 22 nt, Human
ccagcccuugcugaaggguggc

SEQ ID NO: 938392 - RNA, 22 nt, Human
uaacagaaauuuuaguuagggg

SEQ ID NO: 938393 - RNA, 22 nt, Human
uugcaggggaaggagcagagcu

SEQ ID NO: 938394 - RNA, 22 nt, Human
aucauuuaaaacaagucucuau

SEQ ID NO: 938395 - RNA, 17 nt, Human
cccagcuggcagugccg

SEQ ID NO: 938396 - RNA, 22 nt, Human
uuugacaucuaagaauucuuac

SEQ ID NO: 938397 - RNA, 22 nt, Human
ucagaacaauugggaaccauua

SEQ ID NO: 938398 - RNA, 22 nt, Human
uucuuauagaagcaaccauugu

SEQ ID NO: 938399 - RNA, 22 nt, Human
gucauuccuuauguugauucag

SEQ ID NO: 938400 - RNA, 22 nt, Human
uagggcagcugcaucaggcacu

SEQ ID NO: 938401 - RNA, 22 nt, Human
uggcagaggagaauuaagauua

SEQ ID NO: 938402 - RNA, 21 nt, Human
aggugccaaggagaagcaggc

SEQ ID NO: 938403 - RNA, 22 nt, Human
uuugaaaucuaaucaaggaaca

SEQ ID NO: 938404 - RNA, 22 nt, Human
ccuggcuuccuggagcucacaa

SEQ ID NO: 938405 - RNA, 22 nt, Human
cuuaugcugagaaugaaagaau

SEQ ID NO: 938406 - RNA, 19 nt, Human
cgcaggagccgaggugacc

SEQ ID NO: 938407 - RNA, 22 nt, Human
ggcugcugguagggguaggaag

SEQ ID NO: 938408 - RNA, 22 nt, Human
uuuuaauacugcuauuguagga

SEQ ID NO: 938409 - RNA, 22 nt, Human
gugucaugcacacucaguguug

SEQ ID NO: 938410 - RNA, 22 nt, Human
gagccagcgccuugccucuggg

SEQ ID NO: 938411 - RNA, 22 nt, Human
ccagagccugcugagccccauu

SEQ ID NO: 938412 - RNA, 22 nt, Human
cagggcucaucugugugaccag

SEQ ID NO: 938413 - RNA, 22 nt, Human
agucucugggcaugguugugac

SEQ ID NO: 938414 - RNA, 22 nt, Human
cuucagaagaaaagcagugugu

SEQ ID NO: 938415 - RNA, 22 nt, Human
aggcacuguacuagguacaggg

SEQ ID NO: 938416 - RNA, 22 nt, Human
cauuucauaguugucacaauaa

SEQ ID NO: 938417 - RNA, 22 nt, Human
gccagcuggagacuggcagggg

SEQ ID NO: 938418 - RNA, 22 nt, Human
caguggguccuaaguacaguuc

SEQ ID NO: 938419 - RNA, 22 nt, Human
uaaguucaagucuuggauauaa

SEQ ID NO: 938420 - RNA, 22 nt, Human
uuuggaauuggcauucuauucu

SEQ ID NO: 938421 - RNA, 22 nt, Human
cagaccagaaggaagccgacaa

SEQ ID NO: 938422 - RNA, 22 nt, Human
agaggcaguauacaauccgagc

SEQ ID NO: 938423 - RNA, 22 nt, Human
aguggggagguccaggccaccc

SEQ ID NO: 938424 - RNA, 22 nt, Human
uugguuuagagagugugguuac

SEQ ID NO: 938425 - RNA, 22 nt, Human
uggaggggcaauggagcgcgga

SEQ ID NO: 938426 - RNA, 18 nt, Human
ccuggagcuccacagcaa

SEQ ID NO: 938427 - RNA, 22 nt, Human
acagaauuaaugaaaauuacaa

SEQ ID NO: 938428 - RNA, 22 nt, Human
uggcagaggaaaaagucacugg

SEQ ID NO: 938429 - RNA, 22 nt, Human
uggcacauagcagguacucagu

SEQ ID NO: 938430 - RNA, 22 nt, Human
ugaaaaggguagaucccuaagu

SEQ ID NO: 938431 - RNA, 22 nt, Human
aggcagcaugcucugcuucuac

SEQ ID NO: 938432 - RNA, 22 nt, Human
uggcucuggggacaguaagucc

SEQ ID NO: 938433 - RNA, 22 nt, Human
augacaguucuacacuuaaucu

SEQ ID NO: 938434 - RNA, 22 nt, Human
gcaagcugaugugauagugaaa

SEQ ID NO: 938435 - RNA, 22 nt, Human
ggccuggcauggggacuaaggg

SEQ ID NO: 938436 - RNA, 22 nt, Human
uugcaguugucuuuccuaauuu

SEQ ID NO: 938437 - RNA, 22 nt, Human
uuugaauagaggccccucagaa

SEQ ID NO: 938438 - RNA, 22 nt, Human
ucaggagagaguuggguaggcu

SEQ ID NO: 938439 - RNA, 22 nt, Human
guuaucaugcuucaucaucacu

SEQ ID NO: 938440 - RNA, 22 nt, Human
acaaaauuguguuaaacuuuau

SEQ ID NO: 938441 - RNA, 22 nt, Human
cagcaggaggugaguagcaggu

SEQ ID NO: 938442 - RNA, 22 nt, Human
cagggcuguaaauuagugcuga

SEQ ID NO: 938443 - RNA, 22 nt, Human
cucaccaggaacagcugcggag

SEQ ID NO: 938444 - RNA, 22 nt, Human
agcacauucugccuugcuuugc

SEQ ID NO: 938445 - RNA, 22 nt, Human
cuggcuggcaaguagaacacaa

SEQ ID NO: 938446 - RNA, 22 nt, Human
cagcugcccugccuugcccuua

SEQ ID NO: 938447 - RNA, 22 nt, Human
ggaggccaaggaggagcuugcc

SEQ ID NO: 938448 - RNA, 22 nt, Human
uagaaagugaagguuaauuaau

SEQ ID NO: 938449 - RNA, 22 nt, Human
cuguaugguccacgugggugcc

SEQ ID NO: 938450 - RNA, 22 nt, Human
uaaauucuacaacuucaaagau

SEQ ID NO: 938451 - RNA, 22 nt, Human
gguggccugcccugaucccugg

SEQ ID NO: 938452 - RNA, 22 nt, Human
cagucccagacccagaaggugg

SEQ ID NO: 938453 - RNA, 21 nt, Human
ugcuuuaugggaaaaauguca

SEQ ID NO: 938454 - RNA, 22 nt, Human
agagcuuauaucuuggccaucc

SEQ ID NO: 938455 - RNA, 22 nt, Human
uaagaacaguguuucaucucua

SEQ ID NO: 938456 - RNA, 22 nt, Human
uugcugaaaacaguggguauug

SEQ ID NO: 938457 - RNA, 22 nt, Human
aguauguauuuuauacuuacag

SEQ ID NO: 938458 - RNA, 22 nt, Human
aagggcaggcacccacccucac

SEQ ID NO: 938459 - RNA, 22 nt, Human
aggagccccucuucaguccugg

SEQ ID NO: 938460 - RNA, 22 nt, Human
gugccugugcggacucagggaa

SEQ ID NO: 938461 - RNA, 22 nt, Human
aaagaugucauacacauuaaga

SEQ ID NO: 938462 - RNA, 22 nt, Human
ucaaucacguguuccauguucu

SEQ ID NO: 938463 - RNA, 22 nt, Human
uuucauguuuucuuaaauggca

SEQ ID NO: 938464 - RNA, 22 nt, Human
aaggagaaaugguagaugugca

SEQ ID NO: 938465 - RNA, 22 nt, Human
agcuucuuggcucagcacuugg

SEQ ID NO: 938466 - RNA, 22 nt, Human
auaauuaauuucaguaaucucc

SEQ ID NO: 938467 - RNA, 17 nt, Human
aagauuucauuagcuga

SEQ ID NO: 938468 - RNA, 20 nt, Human
gagggcaggcacccauuuca

SEQ ID NO: 938469 - RNA, 22 nt, Human
ucagggcagccuaaggcaccuc

SEQ ID NO: 938470 - RNA, 22 nt, Human
agcaggaggguuuuguagaguc

SEQ ID NO: 938471 - RNA, 22 nt, Human
ggcaaaaacagcaaugacuuuu

SEQ ID NO: 938472 - RNA, 22 nt, Human
cagagcugguguuacaagucca

SEQ ID NO: 938473 - RNA, 22 nt, Human
uggagcaggugggaugucguga

SEQ ID NO: 938474 - RNA, 22 nt, Human
agcagcuuacauguggccuauc

SEQ ID NO: 938475 - RNA, 20 nt, Human
gccugcagguuggaugggau

SEQ ID NO: 938476 - RNA, 22 nt, Human
acuguacacgugucauuuacag

SEQ ID NO: 938477 - RNA, 22 nt, Human
uucauucuuugaaucugaggua

SEQ ID NO: 938478 - RNA, 22 nt, Human
uuaaguccuugguaauuuucuu

SEQ ID NO: 938479 - RNA, 20 nt, Human
uuccagagaucugcauuuua

SEQ ID NO: 938480 - RNA, 22 nt, Human
cacagaggacuguagcggggag

SEQ ID NO: 938481 - RNA, 22 nt, Human
auugucugaauccaaagcucug

SEQ ID NO: 938482 - RNA, 22 nt, Human
gagcucuguguagccugagggu

SEQ ID NO: 938483 - RNA, 18 nt, Human
ugaacagaugaguugaag

SEQ ID NO: 938484 - RNA, 22 nt, Human
gggagcugguuccugcccucca

SEQ ID NO: 938485 - RNA, 22 nt, Human
ccagagucuuuauauuccugaa

SEQ ID NO: 938486 - RNA, 22 nt, Human
ggaggccuugaggccaggagcu

SEQ ID NO: 938487 - RNA, 22 nt, Human
gauuucaaggauguuagaggug

SEQ ID NO: 938488 - RNA, 22 nt, Human
ggugaagguggaacgcagagca

SEQ ID NO: 938489 - RNA, 22 nt, Human
ucugggaaguccucugucaugc

SEQ ID NO: 938490 - RNA, 22 nt, Human
uccagcagguuggucaggugca

SEQ ID NO: 938491 - RNA, 22 nt, Human
uacuuucuguccuucuguuaaa

SEQ ID NO: 938492 - RNA, 21 nt, Human
cuugaaagguagagucuacag

SEQ ID NO: 938493 - RNA, 22 nt, Human
acccagaggcggagguugcagu

SEQ ID NO: 938494 - RNA, 22 nt, Human
ugcagugccucggcagugcagc

SEQ ID NO: 938495 - RNA, 23 nt, Human
gcucagagguuuuucucuggaug

SEQ ID NO: 938496 - RNA, 22 nt, Human
acaggagaauuaucuggaacaa

SEQ ID NO: 938497 - RNA, 22 nt, Human
agcugggccugagcuggaagcu

SEQ ID NO: 938498 - RNA, 22 nt, Human
aaguugaaugcguacgugacau

SEQ ID NO: 938499 - RNA, 22 nt, Human
ccugaagagcacucuagaguug

SEQ ID NO: 938500 - RNA, 22 nt, Human
gugggagcauggucccagugcc

SEQ ID NO: 938501 - RNA, 22 nt, Human
agggagugguuaagaaggugca

SEQ ID NO: 938502 - RNA, 22 nt, Human
gaggagagaagcuaacggugcu

SEQ ID NO: 938503 - RNA, 22 nt, Human
uggggcuguccuuagucugaga

SEQ ID NO: 938504 - RNA, 22 nt, Human
aguggcagagugcacucaggca

SEQ ID NO: 938505 - RNA, 22 nt, Human
cacauaaguggguuccauugca

SEQ ID NO: 938506 - RNA, 22 nt, Human
ggagaccagaaggaagcuucga

SEQ ID NO: 938507 - RNA, 22 nt, Human
ugagggcugcuuccagagcuag

SEQ ID NO: 938508 - RNA, 22 nt, Human
ucuggagccuuggaugggaaag

SEQ ID NO: 938509 - RNA, 21 nt, Human
ucuccaguauccuucucugag

SEQ ID NO: 938510 - RNA, 22 nt, Human
aagggcugccagggggugccag

SEQ ID NO: 938511 - RNA, 19 nt, Human
gcagccaccgcggcggccg

SEQ ID NO: 938512 - RNA, 22 nt, Human
acuugaauuauauuucuagaga

SEQ ID NO: 938513 - RNA, 22 nt, Human
gaugcacugcaguauauacugu

SEQ ID NO: 938514 - RNA, 22 nt, Human
auccuugaaugacucugcccuc

SEQ ID NO: 938515 - RNA, 22 nt, Human
gugagcagaacagguggcuucu

SEQ ID NO: 938516 - RNA, 22 nt, Human
caggaaccuaaagagacauuac

SEQ ID NO: 938517 - RNA, 22 nt, Human
agaauaugaggaaacugugaau

SEQ ID NO: 938518 - RNA, 22 nt, Human
gaggcugcugagagcccuguuu

SEQ ID NO: 938519 - RNA, 22 nt, Human
caggcagcccugcaccaagugu

SEQ ID NO: 938520 - RNA, 16 nt, Human
ccacagggcaaggggc

SEQ ID NO: 938521 - RNA, 19 nt, Human
uguuggugcggauguggag

SEQ ID NO: 938522 - RNA, 22 nt, Human
cugggagcugucaggagcgugu

SEQ ID NO: 938523 - RNA, 21 nt, Human
acagagccgggcacaaagcug

SEQ ID NO: 938524 - RNA, 22 nt, Human
cugggcuguucugccccugggu

SEQ ID NO: 938525 - RNA, 19 nt, Human
uugaaagauuagcuuucua

SEQ ID NO: 938526 - RNA, 22 nt, Human
aaacugaauucccaagggcaug

SEQ ID NO: 938527 - RNA, 22 nt, Human
ggagccugugggaugagaugug

SEQ ID NO: 938528 - RNA, 22 nt, Human
ccauuugucaccucugcacucc

SEQ ID NO: 938529 - RNA, 22 nt, Human
auuguaucuugucauuaugcau

SEQ ID NO: 938530 - RNA, 23 nt, Human
ggccuguguuuugucugaaguac

SEQ ID NO: 938531 - RNA, 22 nt, Human
ggguuggggcccagcagucugc

SEQ ID NO: 938532 - RNA, 22 nt, Human
gccagagcugagugagguucuu

SEQ ID NO: 938533 - RNA, 22 nt, Human
ucuuaaaaguaugccaauugga

SEQ ID NO: 938534 - RNA, 22 nt, Human
aauccagguggcggagguugug

SEQ ID NO: 938535 - RNA, 22 nt, Human
cuccccagguucaggagguggg

SEQ ID NO: 938536 - RNA, 22 nt, Human
ccuggccagaggcgugccugug

SEQ ID NO: 938537 - RNA, 22 nt, Human
augcaguaaauguucuaguuug

SEQ ID NO: 938538 - RNA, 21 nt, Human
augucaaaugcuuuauuuuau

SEQ ID NO: 938539 - RNA, 23 nt, Human
aggaacugaggccuagggaggua

SEQ ID NO: 938540 - RNA, 22 nt, Human
ucucuggggauggaccugggag

SEQ ID NO: 938541 - RNA, 22 nt, Human
cgcugccaggucaccaggggua

SEQ ID NO: 938542 - RNA, 22 nt, Human
cucaggaugucggugacuauug

SEQ ID NO: 938543 - RNA, 22 nt, Human
acacagggaggaggugcugugc

SEQ ID NO: 938544 - RNA, 22 nt, Human
agagccagcauuugggcccugc

SEQ ID NO: 938545 - RNA, 22 nt, Human
cauccagggcagccauggccug

SEQ ID NO: 938546 - RNA, 22 nt, Human
gcagcagaguuugggagauggu

SEQ ID NO: 938547 - RNA, 22 nt, Human
gcagcaugagcuauacaaagua

SEQ ID NO: 938548 - RNA, 22 nt, Human
cacagaauaaauugguaucaga

SEQ ID NO: 938549 - RNA, 22 nt, Human
aagccagggucaggggccuccu

SEQ ID NO: 938550 - RNA, 22 nt, Human
accagcucagaagccagaaaga

SEQ ID NO: 938551 - RNA, 22 nt, Human
cagggcugguuugucgaagaaa

SEQ ID NO: 938552 - RNA, 22 nt, Human
cacagcugcccuacuccaugug

SEQ ID NO: 938553 - RNA, 22 nt, Human
aggccugggacgggagccguga

SEQ ID NO: 938554 - RNA, 20 nt, Human
ccagucccugagcaccaggg

SEQ ID NO: 938555 - RNA, 22 nt, Human
caaaaguaccuugugugcuuug

SEQ ID NO: 938556 - RNA, 22 nt, Human
ugggcagaguagcucagaagaa

SEQ ID NO: 938557 - RNA, 22 nt, Human
caguccagcucaucaguggcac

SEQ ID NO: 938558 - RNA, 22 nt, Human
agaugaaagauuuuuauagaga

SEQ ID NO: 938559 - RNA, 22 nt, Human
ugaggggagcuagcaugccuug

SEQ ID NO: 938560 - RNA, 22 nt, Human
ccucaggggugcccacagcugc

SEQ ID NO: 938561 - RNA, 22 nt, Human
agccccugggaguagcugcugc

SEQ ID NO: 938562 - RNA, 22 nt, Human
gcagccccaggagacgcccagg

SEQ ID NO: 938563 - RNA, 22 nt, Human
agggacagaugaaugacugagu

SEQ ID NO: 938564 - RNA, 22 nt, Human
uucuuuugggaauuacguaugc

SEQ ID NO: 938565 - RNA, 22 nt, Human
aaguuuuaacaaguacuuacua

SEQ ID NO: 938566 - RNA, 22 nt, Human
cagcaucuaaucuucaugccgg

SEQ ID NO: 938567 - RNA, 22 nt, Human
gaggcaguuccugagugacaag

SEQ ID NO: 938568 - RNA, 22 nt, Human
ccugccaggcuuugggcuucug

SEQ ID NO: 938569 - RNA, 19 nt, Human
agaggccucagcagcuggc

SEQ ID NO: 938570 - RNA, 21 nt, Human
ccugcagcaccagaaggagau

SEQ ID NO: 938571 - RNA, 21 nt, Human
aaugaaguggcuauuuugagg

SEQ ID NO: 938572 - RNA, 22 nt, Human
uauuagagaaaagauggaugug

SEQ ID NO: 938573 - RNA, 22 nt, Human
ugccuggcaagaggggcuggcu

SEQ ID NO: 938574 - RNA, 22 nt, Human
ucacucuggaguccgcuaccag

SEQ ID NO: 938575 - RNA, 22 nt, Human
gagagaggccuccauguacuga

SEQ ID NO: 938576 - RNA, 22 nt, Human
agagucugaggcagcugcagcc

SEQ ID NO: 938577 - RNA, 22 nt, Human
gcagcauacagggagaguacuc

SEQ ID NO: 938578 - RNA, 22 nt, Human
cccuguggaggaggagagcagu

SEQ ID NO: 938579 - RNA, 22 nt, Human
gcccagaaguugaggcugcagu

SEQ ID NO: 938580 - RNA, 22 nt, Human
ugguuuauuucucugaaagguu

SEQ ID NO: 938581 - RNA, 22 nt, Human
cugaggcucccucgggucugcu

SEQ ID NO: 938582 - RNA, 22 nt, Human
aaggcugccucugccagaggag

SEQ ID NO: 938583 - RNA, 22 nt, Human
gauggggaugagaagugagcag

SEQ ID NO: 938584 - RNA, 22 nt, Human
ucuguucaugaaauaucuuuuu

SEQ ID NO: 938585 - RNA, 18 nt, Human
ugcuggguaacuguaugg

SEQ ID NO: 938586 - RNA, 22 nt, Human
uuucagcugguaaaggaguagc

SEQ ID NO: 938587 - RNA, 22 nt, Human
ucagggacauuuagacacugau

SEQ ID NO: 938588 - RNA, 19 nt, Human
uuggaaggagccagagugg

SEQ ID NO: 938589 - RNA, 22 nt, Human
uauuaugagguauuuggacuuu

SEQ ID NO: 938590 - RNA, 22 nt, Human
ccuggccucagccuagggcuga

SEQ ID NO: 938591 - RNA, 22 nt, Human
acauaaaguacugagagacucu

SEQ ID NO: 938592 - RNA, 22 nt, Human
agcugccauggccugaauuuac

SEQ ID NO: 938593 - RNA, 22 nt, Human
gcucugcucccucaaaugacau

SEQ ID NO: 938594 - RNA, 22 nt, Human
agagaugucgccuugcccaggg

SEQ ID NO: 938595 - RNA, 20 nt, Human
ugcagcuucaccugugucau

SEQ ID NO: 938596 - RNA, 22 nt, Human
gccuggaggaauguagcugagg

SEQ ID NO: 938597 - RNA, 22 nt, Human
ucagagagccucaggcacugcc

SEQ ID NO: 938598 - RNA, 22 nt, Human
agcugcugugugcucaggcagg

SEQ ID NO: 938599 - RNA, 19 nt, Human
ggcagucucaagcagcaca

SEQ ID NO: 938600 - RNA, 22 nt, Human
uagugcuuggcccuaccagaua

SEQ ID NO: 938601 - RNA, 22 nt, Human
cugccucugguuuuggucccug

SEQ ID NO: 938602 - RNA, 22 nt, Human
uaagauuuuuaaaauguccuca

SEQ ID NO: 938603 - RNA, 22 nt, Human
uuuuaugauugagcuggcuaca

SEQ ID NO: 938604 - RNA, 22 nt, Human
auggggcucugcggcugcuccc

SEQ ID NO: 938605 - RNA, 22 nt, Human
uugaagcauuucuuugagcuuc

SEQ ID NO: 938606 - RNA, 22 nt, Human
aggcaucugaguuugcaagcuu

SEQ ID NO: 938607 - RNA, 22 nt, Human
guccugggcccaggggcugccu

SEQ ID NO: 938608 - RNA, 22 nt, Human
cucaggauagauuguccucuca

SEQ ID NO: 938609 - RNA, 22 nt, Human
acaaauguggacauggauaaug

SEQ ID NO: 938610 - RNA, 22 nt, Human
ucaagaaagggcuucaccagga

SEQ ID NO: 938611 - RNA, 22 nt, Human
uaaaugugcacuuuacuuuuca

SEQ ID NO: 938612 - RNA, 19 nt, Human
gggcuucugggaucaagag

SEQ ID NO: 938613 - RNA, 22 nt, Human
uccugggccuguacuccauccg

SEQ ID NO: 938614 - RNA, 22 nt, Human
gccucugcugcaagccugguug

SEQ ID NO: 938615 - RNA, 22 nt, Human
auacaucuugucagauucaugu

SEQ ID NO: 938616 - RNA, 20 nt, Human
acuugcugggcuuuguuacc

SEQ ID NO: 938617 - RNA, 22 nt, Human
agguggguccuggcucugccau

SEQ ID NO: 938618 - RNA, 22 nt, Human
uuugacaucaauacccuagaau

SEQ ID NO: 938619 - RNA, 22 nt, Human
aagugguagacaaagauaauug

SEQ ID NO: 938620 - RNA, 22 nt, Human
agcaguggcuggauggugugcu

SEQ ID NO: 938621 - RNA, 21 nt, Human
uggcagacuagaguauagaug

SEQ ID NO: 938622 - RNA, 22 nt, Human
aaauuagucauguuguauuacu

SEQ ID NO: 938623 - RNA, 22 nt, Human
gcagggugccgacuucagggau

SEQ ID NO: 938624 - RNA, 22 nt, Human
cugcauuagucaugcuuugcag

SEQ ID NO: 938625 - RNA, 21 nt, Human
uuugcauuuuacaugugggga

SEQ ID NO: 938626 - RNA, 22 nt, Human
ugccaggccucaggagucucca

SEQ ID NO: 938627 - RNA, 22 nt, Human
ggcaggcaggagcgugcuuggg

SEQ ID NO: 938628 - RNA, 21 nt, Human
aaagaacaggcagauguucuu

SEQ ID NO: 938629 - RNA, 22 nt, Human
uagaaguuaaaggaauacagaa

SEQ ID NO: 938630 - RNA, 22 nt, Human
aucacauugccagugauuaccc

SEQ ID NO: 938631 - RNA, 22 nt, Human
ucaggcagcuccaggaauggua

SEQ ID NO: 938632 - RNA, 22 nt, Human
cuuaagaaauugcauucuaauc

SEQ ID NO: 938633 - RNA, 22 nt, Human
gacugucauucuagugcccaug

SEQ ID NO: 938634 - RNA, 22 nt, Human
uucuuaagcaguuuggcauguu

SEQ ID NO: 938635 - RNA, 22 nt, Human
auggaaaggcuguggaaacuua

SEQ ID NO: 938636 - RNA, 22 nt, Human
ucccaggaucugagggcagaga

SEQ ID NO: 938637 - RNA, 22 nt, Human
uuucuagaggcuccaggggagu

SEQ ID NO: 938638 - RNA, 23 nt, Human
uccugaggguuucccagccuugg

SEQ ID NO: 938639 - RNA, 22 nt, Human
aaguuucauguggagguagacu

SEQ ID NO: 938640 - RNA, 17 nt, Human
ugaagaugcauggcagc

SEQ ID NO: 938641 - RNA, 22 nt, Human
aucaguuugauaauaaggcuug

SEQ ID NO: 938642 - RNA, 22 nt, Human
cauaacauccuugcuacuuuga

SEQ ID NO: 938643 - RNA, 22 nt, Human
aaaugauggaaaugaggcugaa

SEQ ID NO: 938644 - RNA, 21 nt, Human
cugcuuuacuucagaggaucu

SEQ ID NO: 938645 - RNA, 22 nt, Human
agccagcaggugagugcagccu

SEQ ID NO: 938646 - RNA, 22 nt, Human
ugcagaccucccauggcugccu

SEQ ID NO: 938647 - RNA, 22 nt, Human
aguauguagugcaaucagucag

SEQ ID NO: 938648 - RNA, 17 nt, Human
caagagagaugacugga

SEQ ID NO: 938649 - RNA, 22 nt, Human
cagucuuagaggugacugugga

SEQ ID NO: 938650 - RNA, 22 nt, Human
augcacuugcguguuugcaaau

SEQ ID NO: 938651 - RNA, 22 nt, Human
aaguuugagaagcuuauagaua

SEQ ID NO: 938652 - RNA, 22 nt, Human
ugagccaggcuccaugccaccu

SEQ ID NO: 938653 - RNA, 22 nt, Human
aggcucagagagcuguguccau

SEQ ID NO: 938654 - RNA, 22 nt, Human
uggcagagcccagaacugagca

SEQ ID NO: 938655 - RNA, 22 nt, Human
gcugcucuacccaugcaucugu

SEQ ID NO: 938656 - RNA, 22 nt, Human
gccagagcugagacacgagucc

SEQ ID NO: 938657 - RNA, 22 nt, Human
gucccagggaugcagacaugag

SEQ ID NO: 938658 - RNA, 22 nt, Human
gccuuggcugaugugcgaauga

SEQ ID NO: 938659 - RNA, 21 nt, Human
aggcagcucaggcccagagag

SEQ ID NO: 938660 - RNA, 22 nt, Human
uucagcagucguccaggaaaag

SEQ ID NO: 938661 - RNA, 19 nt, Human
ccuggcccugcugcgcggg

SEQ ID NO: 938662 - RNA, 22 nt, Human
gcagcaggcuuuucauaccuug

SEQ ID NO: 938663 - RNA, 22 nt, Human
agcugcucucacuggacgccug

SEQ ID NO: 938664 - RNA, 22 nt, Human
gucucagagagcuacucucuua

SEQ ID NO: 938665 - RNA, 16 nt, Human
cuuccucuucacuggc

SEQ ID NO: 938666 - RNA, 22 nt, Human
acuaagugauucuaagcaucuu

SEQ ID NO: 938667 - RNA, 22 nt, Human
acuuauuucauggaucauaaug

SEQ ID NO: 938668 - RNA, 22 nt, Human
cugcugcucgaccagucccagg

SEQ ID NO: 938669 - RNA, 22 nt, Human
cucucuucccgugaguguugca

SEQ ID NO: 938670 - RNA, 22 nt, Human
uuauuagguuuacauaaagguu

SEQ ID NO: 938671 - RNA, 22 nt, Human
ugggugcuucgucagcucugag

SEQ ID NO: 938672 - RNA, 21 nt, Human
ggucuuccaaauaaggagaaa

SEQ ID NO: 938673 - RNA, 22 nt, Human
cuugucugugucggauaaaacu

SEQ ID NO: 938674 - RNA, 22 nt, Human
ccagcuggugggucuuucucug

SEQ ID NO: 938675 - RNA, 22 nt, Human
aaacaaugaaauucauucuuca

SEQ ID NO: 938676 - RNA, 22 nt, Human
auguccuuccauuuugaucugu

SEQ ID NO: 938677 - RNA, 22 nt, Human
ucacugcucucuaagcaucgcc

SEQ ID NO: 938678 - RNA, 22 nt, Human
aguuuaauauccuucaacuuuc

SEQ ID NO: 938679 - RNA, 19 nt, Human
agaaguuagacauugcaau

SEQ ID NO: 938680 - RNA, 22 nt, Human
ucauuucuccgaccugcugucc

SEQ ID NO: 938681 - RNA, 22 nt, Human
aaaugcuguaacugauauucug

SEQ ID NO: 938682 - RNA, 22 nt, Human
accagagcuuacaugcuagaaa

SEQ ID NO: 938683 - RNA, 22 nt, Human
ccagcugcaggggagcagugga

SEQ ID NO: 938684 - RNA, 21 nt, Human
gccaggaguagauuacauuua

SEQ ID NO: 938685 - RNA, 22 nt, Human
ugcaggaaauuccaggguggcc

SEQ ID NO: 938686 - RNA, 22 nt, Human
uggagccaggagccugggaguc

SEQ ID NO: 938687 - RNA, 22 nt, Human
cagucccacuagugccaauacc

SEQ ID NO: 938688 - RNA, 22 nt, Human
aacagaauaguugauguacagu

SEQ ID NO: 938689 - RNA, 22 nt, Human
uuggaaggugagucccuggguu

SEQ ID NO: 938690 - RNA, 22 nt, Human
uuuugaaagccagguuuguaug

SEQ ID NO: 938691 - RNA, 22 nt, Human
uugaauucauuucucauugagu

SEQ ID NO: 938692 - RNA, 22 nt, Human
gggucuggacggcugcaggaag

SEQ ID NO: 938693 - RNA, 22 nt, Human
ggagaagggacagacucagcuu

SEQ ID NO: 938694 - RNA, 22 nt, Human
ggcacagggaggcccuggugug

SEQ ID NO: 938695 - RNA, 22 nt, Human
gcaggcagagaaggaacauuua

SEQ ID NO: 938696 - RNA, 19 nt, Human
uugaggggccaggggagau

SEQ ID NO: 938697 - RNA, 22 nt, Human
cacugaaggcuaggauuagaug

SEQ ID NO: 938698 - RNA, 22 nt, Human
cuggccaaugccuggggaauag

SEQ ID NO: 938699 - RNA, 22 nt, Human
cugccuuccaaccccagacucc

SEQ ID NO: 938700 - RNA, 22 nt, Human
ccugccugaaggucagccaccc

SEQ ID NO: 938701 - RNA, 22 nt, Human
cuugggagacacaagaagacau

SEQ ID NO: 938702 - RNA, 20 nt, Human
uuucuguaaggcauuaaucu

SEQ ID NO: 938703 - RNA, 22 nt, Human
ucagaaauuuucucaguaguuc

SEQ ID NO: 938704 - RNA, 22 nt, Human
gcugcagcagcugcaggguugu

SEQ ID NO: 938705 - RNA, 22 nt, Human
gugccucagcaccgccugcagc

SEQ ID NO: 938706 - RNA, 22 nt, Human
gcacagccacugagugagaacc

SEQ ID NO: 938707 - RNA, 22 nt, Human
ucuugggaucaccuccuggcuu

SEQ ID NO: 938708 - RNA, 22 nt, Human
auucuuuucccaacugcuuuaa

SEQ ID NO: 938709 - RNA, 22 nt, Human
cagagcagggugcaccuugggc

SEQ ID NO: 938710 - RNA, 22 nt, Human
ccaucuccacugucccugucaa

SEQ ID NO: 938711 - RNA, 18 nt, Human
ccauuucaugauuauuac

SEQ ID NO: 938712 - RNA, 22 nt, Human
gaggaaccaaucugugauauuc

SEQ ID NO: 938713 - RNA, 22 nt, Human
guuuucuuccugcaauuggcau

SEQ ID NO: 938714 - RNA, 20 nt, Human
uccagggcuagggagcucau

SEQ ID NO: 938715 - RNA, 22 nt, Human
cuggcugcuuguagacucgacu

SEQ ID NO: 938716 - RNA, 23 nt, Human
acugagccagggccugggucagc

SEQ ID NO: 938717 - RNA, 22 nt, Human
acaggcagggaccuuggcuaag

SEQ ID NO: 938718 - RNA, 22 nt, Human
gaugguuugguaaaaguauguu

SEQ ID NO: 938719 - RNA, 22 nt, Human
gcagugccuugcuucucugucu

SEQ ID NO: 938720 - RNA, 22 nt, Human
uucuuaagaggaacauuuuugu

SEQ ID NO: 938721 - RNA, 22 nt, Human
uacaguaaccagucuacuuaga

SEQ ID NO: 938722 - RNA, 22 nt, Human
cugucuguuucugauucaaccu

SEQ ID NO: 938723 - RNA, 22 nt, Human
uccuugaagaaugauucuugga

SEQ ID NO: 938724 - RNA, 22 nt, Human
cuggcagcaguuaugaaacaau

SEQ ID NO: 938725 - RNA, 22 nt, Human
aaauacauaaagguuguaccag

SEQ ID NO: 938726 - RNA, 22 nt, Human
uggcucuguuuuaugaguacca

SEQ ID NO: 938727 - RNA, 22 nt, Human
gugcauuugugcaugcacaugu

SEQ ID NO: 938728 - RNA, 22 nt, Human
ggcagcauuuagagcacagugu

SEQ ID NO: 938729 - RNA, 22 nt, Human
cagcuccccaugguuccugaag

SEQ ID NO: 938730 - RNA, 22 nt, Human
gaccauuuguugaaaagauuau

SEQ ID NO: 938731 - RNA, 22 nt, Human
aggggcugcuggguccgccccu

SEQ ID NO: 938732 - RNA, 22 nt, Human
uacagaaaaacuggcauugaag

SEQ ID NO: 938733 - RNA, 22 nt, Human
cuuuggaagugaccacaauccu

SEQ ID NO: 938734 - RNA, 22 nt, Human
acuccugggugcauuucugauu

SEQ ID NO: 938735 - RNA, 22 nt, Human
uuugcaaaaugucuuguguuag

SEQ ID NO: 938736 - RNA, 22 nt, Human
caagccucagaaucuucuccau

SEQ ID NO: 938737 - RNA, 22 nt, Human
ucccacugcuuugcucugcuca

SEQ ID NO: 938738 - RNA, 22 nt, Human
ugggacugcucuugcugggguc

SEQ ID NO: 938739 - RNA, 22 nt, Human
aggcugcagaacagucaggugc

SEQ ID NO: 938740 - RNA, 22 nt, Human
cauagagugauguaagguaugu

SEQ ID NO: 938741 - RNA, 22 nt, Human
augccuggacugacaugcacug

SEQ ID NO: 938742 - RNA, 18 nt, Human
gccugccuagagcuugcc

SEQ ID NO: 938743 - RNA, 21 nt, Human
auuucagagcacacaaguaaa

SEQ ID NO: 938744 - RNA, 22 nt, Human
auggcacugaccucccuuguaa

SEQ ID NO: 938745 - RNA, 22 nt, Human
acccugggucauauacagugug

SEQ ID NO: 938746 - RNA, 22 nt, Human
ccuucauugcaucuuuaagaga

SEQ ID NO: 938747 - RNA, 22 nt, Human
acagagguguguguaggacagu

SEQ ID NO: 938748 - RNA, 20 nt, Human
aggcagacaaggagucuguu

SEQ ID NO: 938749 - RNA, 22 nt, Human
ugccuguccugaggaugagggu

SEQ ID NO: 938750 - RNA, 22 nt, Human
agaggcagaaguguucaaaccc

SEQ ID NO: 938751 - RNA, 22 nt, Human
gugcucuggcuggucucccggu

SEQ ID NO: 938752 - RNA, 22 nt, Human
cuuccaaacccaggguaugggc

SEQ ID NO: 938753 - RNA, 22 nt, Human
uaugaguacaaggacucugucu

SEQ ID NO: 938754 - RNA, 22 nt, Human
uccuucuuucccccuagucauu

SEQ ID NO: 938755 - RNA, 22 nt, Human
gagcagcugagcuggaaugaga

SEQ ID NO: 938756 - RNA, 22 nt, Human
acauugaugaaaagguaucauu

SEQ ID NO: 938757 - RNA, 22 nt, Human
ggugguggagccagcugggagu

SEQ ID NO: 938758 - RNA, 22 nt, Human
gcuggagcugcagccugggccu

SEQ ID NO: 938759 - RNA, 20 nt, Human
cugggaggucuuccaaauca

SEQ ID NO: 938760 - RNA, 22 nt, Human
agggcagcuaaggugcugacug

SEQ ID NO: 938761 - RNA, 22 nt, Human
uacuuucuagcucuccccaguu

SEQ ID NO: 938762 - RNA, 22 nt, Human
ccagggcaggggcuggaguuca

SEQ ID NO: 938763 - RNA, 22 nt, Human
guugaguggguuaggaugcuga

SEQ ID NO: 938764 - RNA, 22 nt, Human
aagggcuggcccugggaagagu

SEQ ID NO: 938765 - RNA, 22 nt, Human
uuccugagggacuuuugagauu

SEQ ID NO: 938766 - RNA, 22 nt, Human
accuuuuauguaaauauauguu

SEQ ID NO: 938767 - RNA, 22 nt, Human
caguauguacucuuaucaugua

SEQ ID NO: 938768 - RNA, 22 nt, Human
uugugucuaaauaaggagaccu

SEQ ID NO: 938769 - RNA, 22 nt, Human
uccuuuccaugcuucuagaggc

SEQ ID NO: 938770 - RNA, 22 nt, Human
gcaggggaguggcaggcccgga

SEQ ID NO: 938771 - RNA, 22 nt, Human
ucucaggguuuguacaagugua

SEQ ID NO: 938772 - RNA, 18 nt, Human
caggucagccuggccuca

SEQ ID NO: 938773 - RNA, 22 nt, Human
aauguguagggugccuguuuuu

SEQ ID NO: 938774 - RNA, 19 nt, Human
ugcauccaaagccccacca

SEQ ID NO: 938775 - RNA, 22 nt, Human
ggccaaaugaaggcaaugggac

SEQ ID NO: 938776 - RNA, 21 nt, Human
ugcugccaucaugcagagaug

SEQ ID NO: 938777 - RNA, 22 nt, Human
aaggccaugcacauccuaggca

SEQ ID NO: 938778 - RNA, 22 nt, Human
cagcccugagagaaccaucuau

SEQ ID NO: 938779 - RNA, 22 nt, Human
acauuucucagguaagucauuu

SEQ ID NO: 938780 - RNA, 22 nt, Human
gacagaagaggaacuuggacag

SEQ ID NO: 938781 - RNA, 22 nt, Human
cuggaggcacccuuagagaggc

SEQ ID NO: 938782 - RNA, 22 nt, Human
agcacagguacggagaugcuac

SEQ ID NO: 938783 - RNA, 22 nt, Human
uucaaagugcauguuccucaga

SEQ ID NO: 938784 - RNA, 22 nt, Human
cugcccugucuuuuucugauga

SEQ ID NO: 938785 - RNA, 22 nt, Human
uaaauacuuuuacuccacugau

SEQ ID NO: 938786 - RNA, 22 nt, Human
gugccagcucuccccacaucug

SEQ ID NO: 938787 - RNA, 22 nt, Human
cacagaagaaucaugcuguguu

SEQ ID NO: 938788 - RNA, 22 nt, Human
aagucuuagcaacuaucgcuuu

SEQ ID NO: 938789 - RNA, 22 nt, Human
guggaggagaggcgccuugcgg

SEQ ID NO: 938790 - RNA, 22 nt, Human
ugcugaggucaccuugcugcua

SEQ ID NO: 938791 - RNA, 22 nt, Human
ugcauuauacuuuuagaaauuu

SEQ ID NO: 938792 - RNA, 22 nt, Human
uauugaggauugaggaaagcac

SEQ ID NO: 938793 - RNA, 22 nt, Human
caacccaagguuaguuggucuu

SEQ ID NO: 938794 - RNA, 21 nt, Human
uuuauuuauauaggacacaug

SEQ ID NO: 938795 - RNA, 22 nt, Human
uuauuuagucuagaugaauuuu

SEQ ID NO: 938796 - RNA, 22 nt, Human
aggccugaggaccuucuggagg

SEQ ID NO: 938797 - RNA, 22 nt, Human
ugcuggggauccguaccaaccc

SEQ ID NO: 938798 - RNA, 22 nt, Human
uggcccugacacgugguacugg

SEQ ID NO: 938799 - RNA, 22 nt, Human
cuggggcugcggacgggagccc

SEQ ID NO: 938800 - RNA, 22 nt, Human
ucaugcacaugugucaccauca

SEQ ID NO: 938801 - RNA, 22 nt, Human
uucagagaugacaccugguguu

SEQ ID NO: 938802 - RNA, 22 nt, Human
aggcuucuuagauuggcuggag

SEQ ID NO: 938803 - RNA, 22 nt, Human
caggaaccuaaugaaggcucac

SEQ ID NO: 938804 - RNA, 22 nt, Human
uuuccagagcaugucugcucag

SEQ ID NO: 938805 - RNA, 22 nt, Human
ccaggcugugguuuagauagag

SEQ ID NO: 938806 - RNA, 22 nt, Human
gagaaccucuccacaagucugg

SEQ ID NO: 938807 - RNA, 20 nt, Human
uggucuggagccagugagga

SEQ ID NO: 938808 - RNA, 19 nt, Human
auaaauaaaaagugggaga

SEQ ID NO: 938809 - RNA, 22 nt, Human
uggggcugucccgguuuggcga

SEQ ID NO: 938810 - RNA, 22 nt, Human
ucucagagggaaaggccaauuu

SEQ ID NO: 938811 - RNA, 22 nt, Human
aucaggaugacuauaaggcugc

SEQ ID NO: 938812 - RNA, 22 nt, Human
uaacccaaaggcaaugucucga

SEQ ID NO: 938813 - RNA, 22 nt, Human
aucaguuuggaacauucaggcc

SEQ ID NO: 938814 - RNA, 22 nt, Human
gcugcagcuuuaggauccagug

SEQ ID NO: 938815 - RNA, 22 nt, Human
ucaggagauguaaccuuagcug

SEQ ID NO: 938816 - RNA, 22 nt, Human
ggccugcuucucagugagcuug

SEQ ID NO: 938817 - RNA, 22 nt, Human
cugcucugcagcuuggacuccc

SEQ ID NO: 938818 - RNA, 22 nt, Human
auuauuaggugcucucugacaa

SEQ ID NO: 938819 - RNA, 22 nt, Human
acucugcuauugcagugcaaaa

SEQ ID NO: 938820 - RNA, 22 nt, Human
uugcauugcuuggucuucaaga

SEQ ID NO: 938821 - RNA, 22 nt, Human
cauuuauuggcauguaguaggu

SEQ ID NO: 938822 - RNA, 22 nt, Human
caggcacugugccucgcucccu

SEQ ID NO: 938823 - RNA, 22 nt, Human
guguuuuaagaaagaagcucag

SEQ ID NO: 938824 - RNA, 20 nt, Human
auguaaaauuauaaggcuga

SEQ ID NO: 938825 - RNA, 22 nt, Human
ugaggugaagaguggagcucag

SEQ ID NO: 938826 - RNA, 22 nt, Human
ggagcagacauaaccuuacaga

SEQ ID NO: 938827 - RNA, 22 nt, Human
ggcugccugaacuuuggggaaa

SEQ ID NO: 938828 - RNA, 22 nt, Human
ugaagcaggaucguuugcuuca

SEQ ID NO: 938829 - RNA, 22 nt, Human
aggcagcuuucuguaggggugu

SEQ ID NO: 938830 - RNA, 22 nt, Human
ugugucaugugugaggcucccu

SEQ ID NO: 938831 - RNA, 22 nt, Human
uaaaguuuggcagacaauaaca

SEQ ID NO: 938832 - RNA, 22 nt, Human
uuauuauuggugaguuaaggaa

SEQ ID NO: 938833 - RNA, 21 nt, Human
cuguggaagggaacuagaggg

SEQ ID NO: 938834 - RNA, 22 nt, Human
cuucagaauccagaaucagaau

SEQ ID NO: 938835 - RNA, 22 nt, Human
cuguggagcuuguggcaguggg

SEQ ID NO: 938836 - RNA, 22 nt, Human
ucugucacucccugaugaugaa

SEQ ID NO: 938837 - RNA, 22 nt, Human
uggcuagcccuuguggggagag

SEQ ID NO: 938838 - RNA, 22 nt, Human
uggcucaguggcagccgcagcu

SEQ ID NO: 938839 - RNA, 22 nt, Human
caguuauuaugaggucauuagg

SEQ ID NO: 938840 - RNA, 16 nt, Human
ccaccugcagcucuca

SEQ ID NO: 938841 - RNA, 22 nt, Human
agaaaugcucuuccugaccaga

SEQ ID NO: 938842 - RNA, 18 nt, Human
gagaggagccagaauuuu

SEQ ID NO: 938843 - RNA, 19 nt, Human
ucaaaacacaaaugguuga

SEQ ID NO: 938844 - RNA, 22 nt, Human
acuuugcaaugggcagaaccca

SEQ ID NO: 938845 - RNA, 17 nt, Human
gugcagggaugaaggau

SEQ ID NO: 938846 - RNA, 22 nt, Human
ugggccuguugggguugaguua

SEQ ID NO: 938847 - RNA, 22 nt, Human
ugcuggggucauggggcgcccg

SEQ ID NO: 938848 - RNA, 22 nt, Human
caggguggggaaauagcgcccu

SEQ ID NO: 938849 - RNA, 22 nt, Human
ugaggggagacagaguggacuc

SEQ ID NO: 938850 - RNA, 22 nt, Human
cccaaggcugcagugagcauga

SEQ ID NO: 938851 - RNA, 20 nt, Human
ggcucuggaaucuggugggc

SEQ ID NO: 938852 - RNA, 21 nt, Human
ucugucugguuuuagaguggc

SEQ ID NO: 938853 - RNA, 22 nt, Human
agggcuggcaucucuaaugcug

SEQ ID NO: 938854 - RNA, 22 nt, Human
accuuguuaaaaugaggauucu

SEQ ID NO: 938855 - RNA, 22 nt, Human
ccugucagcugauggcuaugua

SEQ ID NO: 938856 - RNA, 22 nt, Human
aagggaggggauguaagccugg

SEQ ID NO: 938857 - RNA, 22 nt, Human
gggaggagggugcuggcuaaac

SEQ ID NO: 938858 - RNA, 22 nt, Human
uccaagggaaugugggcaaugc

SEQ ID NO: 938859 - RNA, 22 nt, Human
aaauguguuuagaugguuuauu

SEQ ID NO: 938860 - RNA, 22 nt, Human
aauaauuuccagccaacuggaa

SEQ ID NO: 938861 - RNA, 22 nt, Human
uccucagacacccugcuggcuu

SEQ ID NO: 938862 - RNA, 22 nt, Human
gcuggcagggacagcugcgugu

SEQ ID NO: 938863 - RNA, 22 nt, Human
ugaggggagguuggggcacauc

SEQ ID NO: 938864 - RNA, 22 nt, Human
ucuggcuccacuuucuucauuu

SEQ ID NO: 938865 - RNA, 22 nt, Human
gcucagagaugucugcugccuu

SEQ ID NO: 938866 - RNA, 22 nt, Human
cugccagugaaauugugucagu

SEQ ID NO: 938867 - RNA, 22 nt, Human
uccuuuuugguccaaggugacc

SEQ ID NO: 938868 - RNA, 22 nt, Human
gaguuguucaacgugugugaaa

SEQ ID NO: 938869 - RNA, 22 nt, Human
caggagcugggucuggaagcag

SEQ ID NO: 938870 - RNA, 22 nt, Human
aggaaaaauaaggcagcagggc

SEQ ID NO: 938871 - RNA, 22 nt, Human
aucaauucuuaggaaaauagcu

SEQ ID NO: 938872 - RNA, 22 nt, Human
cugugcauugucuugucuguag

SEQ ID NO: 938873 - RNA, 22 nt, Human
acaucucaugaaugauaaauca

SEQ ID NO: 938874 - RNA, 22 nt, Human
gcacugaaaauguuggauucca

SEQ ID NO: 938875 - RNA, 21 nt, Human
guggcccugguguggcugcac

SEQ ID NO: 938876 - RNA, 23 nt, Human
auauuagggagauuagcccucua

SEQ ID NO: 938877 - RNA, 22 nt, Human
guccaugauucuguguaguaga

SEQ ID NO: 938878 - RNA, 22 nt, Human
agcuucccaagguuggaagguu

SEQ ID NO: 938879 - RNA, 22 nt, Human
cugggccagucucggccgcucu

SEQ ID NO: 938880 - RNA, 22 nt, Human
acagggccucagccagggcaga

SEQ ID NO: 938881 - RNA, 22 nt, Human
ccaggaaugaaauguagauaaa

SEQ ID NO: 938882 - RNA, 22 nt, Human
gucccuggaucugggacagcug

SEQ ID NO: 938883 - RNA, 22 nt, Human
uccugggcugcagggaagagca

SEQ ID NO: 938884 - RNA, 22 nt, Human
acucuggcccuccugcugccag

SEQ ID NO: 938885 - RNA, 22 nt, Human
uccuuuccagccucaccucagc

SEQ ID NO: 938886 - RNA, 22 nt, Human
aagcugccuagaguugaauguc

SEQ ID NO: 938887 - RNA, 22 nt, Human
uuaaaaugcagauucugauuca

SEQ ID NO: 938888 - RNA, 22 nt, Human
acagaggccaugagcugccacc

SEQ ID NO: 938889 - RNA, 22 nt, Human
agcaggguuuggggauuggcac

SEQ ID NO: 938890 - RNA, 22 nt, Human
gaaauauugggacucagagcuu

SEQ ID NO: 938891 - RNA, 20 nt, Human
agccugccagcuggcccaga

SEQ ID NO: 938892 - RNA, 22 nt, Human
cagggcccaggccacuggguug

SEQ ID NO: 938893 - RNA, 22 nt, Human
ccagagcugcauccagcagguu

SEQ ID NO: 938894 - RNA, 22 nt, Human
ugaagcaggaaacuucuuguuu

SEQ ID NO: 938895 - RNA, 22 nt, Human
gccaggagaaugcuagcagagg

SEQ ID NO: 938896 - RNA, 22 nt, Human
gccagagcagaauagaguggcc

SEQ ID NO: 938897 - RNA, 22 nt, Human
aucaguuuuguucacuacuaua

SEQ ID NO: 938898 - RNA, 22 nt, Human
ccuccuuuccuguuuuccugag

SEQ ID NO: 938899 - RNA, 22 nt, Human
cugcuuuggcucagugacauca

SEQ ID NO: 938900 - RNA, 19 nt, Human
gcucugcuacuauuaccac

SEQ ID NO: 938901 - RNA, 22 nt, Human
uggccugggccugccggugcaa

SEQ ID NO: 938902 - RNA, 22 nt, Human
uauuucugaauccaaaagguca

SEQ ID NO: 938903 - RNA, 22 nt, Human
cugugucugccugggauccauu

SEQ ID NO: 938904 - RNA, 22 nt, Human
aaugagcuagaccugcuuccuc

SEQ ID NO: 938905 - RNA, 22 nt, Human
cucugcuuggaacuggacagaa

SEQ ID NO: 938906 - RNA, 22 nt, Human
uuaaaaugaauauugauuagca

SEQ ID NO: 938907 - RNA, 22 nt, Human
aaugcugcaagaggugaaaaga

SEQ ID NO: 938908 - RNA, 22 nt, Human
aagcuaugggggaguuucaacc

SEQ ID NO: 938909 - RNA, 22 nt, Human
aaaacagacagccaguguagag

SEQ ID NO: 938910 - RNA, 22 nt, Human
acaggcucuggggcaggauggc

SEQ ID NO: 938911 - RNA, 23 nt, Human
cugucuccugggcuagguggaau

SEQ ID NO: 938912 - RNA, 22 nt, Human
cuugaaagucagcagaguggau

SEQ ID NO: 938913 - RNA, 22 nt, Human
aaauguguguauguacauauau

SEQ ID NO: 938914 - RNA, 22 nt, Human
caggaaggcccaccuguccugu

SEQ ID NO: 938915 - RNA, 21 nt, Human
acagggcaugcagcuggcugu

SEQ ID NO: 938916 - RNA, 22 nt, Human
cuuaaauuuucaucuacaagaa

SEQ ID NO: 938917 - RNA, 22 nt, Human
gcugccuucaguucugauucau

SEQ ID NO: 938918 - RNA, 22 nt, Human
aagagcuggagcugcuacagga

SEQ ID NO: 938919 - RNA, 22 nt, Human
augagcuguaagguggcuuccu

SEQ ID NO: 938920 - RNA, 22 nt, Human
cuuuuacugugaaaagaaacug

SEQ ID NO: 938921 - RNA, 22 nt, Human
aacaaaugauaccaguucucaa

SEQ ID NO: 938922 - RNA, 22 nt, Human
uggaagggggaagacagcucug

SEQ ID NO: 938923 - RNA, 22 nt, Human
ucauaaaaugcuccugauauug

SEQ ID NO: 938924 - RNA, 22 nt, Human
gagggcaggggucuugcacggu

SEQ ID NO: 938925 - RNA, 22 nt, Human
aaaucuggccccuugccuauuu

SEQ ID NO: 938926 - RNA, 22 nt, Human
ucaucuaagagucuuacauuua

SEQ ID NO: 938927 - RNA, 22 nt, Human
gaaggccacuuuguguugagaa

SEQ ID NO: 938928 - RNA, 22 nt, Human
ugcaggagcagagauggcugga

SEQ ID NO: 938929 - RNA, 22 nt, Human
ucuggcagggguucugcacuug

SEQ ID NO: 938930 - RNA, 22 nt, Human
aauacaguaauuuugaugaguu

SEQ ID NO: 938931 - RNA, 22 nt, Human
caggugggcuugggagaacacu

SEQ ID NO: 938932 - RNA, 22 nt, Human
aggcacugacaauucuggacug

SEQ ID NO: 938933 - RNA, 22 nt, Human
ggacagcauaucagcagggcag

SEQ ID NO: 938934 - RNA, 22 nt, Human
ucaaaacaacacucagguguaa

SEQ ID NO: 938935 - RNA, 22 nt, Human
ccagagccuggcaucugcauaa

SEQ ID NO: 938936 - RNA, 22 nt, Human
cugggagcuggaaugggagaag

SEQ ID NO: 938937 - RNA, 22 nt, Human
gccugagaaggauaggaagcga

SEQ ID NO: 938938 - RNA, 22 nt, Human
acagggcagguggcuacugguc

SEQ ID NO: 938939 - RNA, 22 nt, Human
cagggugccucccgcucgccgg

SEQ ID NO: 938940 - RNA, 22 nt, Human
gucccaggugggcuccaccucu

SEQ ID NO: 938941 - RNA, 22 nt, Human
ccugccagauccccugagcuga

SEQ ID NO: 938942 - RNA, 22 nt, Human
gucugagaaucuugcauaucau

SEQ ID NO: 938943 - RNA, 22 nt, Human
acccagagccagggucaggagc

SEQ ID NO: 938944 - RNA, 22 nt, Human
acagagcacugcccugugccgc

SEQ ID NO: 938945 - RNA, 22 nt, Human
cggcagcaaaggaagccagguc

SEQ ID NO: 938946 - RNA, 23 nt, Human
aaaugcagggucgcagguuacag

SEQ ID NO: 938947 - RNA, 22 nt, Human
gcaggcuccaggccggccccuu

SEQ ID NO: 938948 - RNA, 22 nt, Human
agaugagggguagaaaggacuu

SEQ ID NO: 938949 - RNA, 22 nt, Human
ucaccugggagggcugugguag

SEQ ID NO: 938950 - RNA, 22 nt, Human
cugucacacugauaucaggcuu

SEQ ID NO: 938951 - RNA, 22 nt, Human
ucacagacaauuguuuuggugu

SEQ ID NO: 938952 - RNA, 22 nt, Human
cgcagggauuucaaggggccuu

SEQ ID NO: 938953 - RNA, 22 nt, Human
acccaggaggcaagguugcagu

SEQ ID NO: 938954 - RNA, 22 nt, Human
ccugagacaugaaccaggcucc

SEQ ID NO: 938955 - RNA, 17 nt, Human
agagggaaaaugcgguu

SEQ ID NO: 938956 - RNA, 22 nt, Human
ccagaagaccccguccaccucc

SEQ ID NO: 938957 - RNA, 22 nt, Human
aaaaguaauugaugcaaucgua

SEQ ID NO: 938958 - RNA, 22 nt, Human
uauuggauagcuugugcagaau

SEQ ID NO: 938959 - RNA, 22 nt, Human
ccuggaaggcaggcauggauug

SEQ ID NO: 938960 - RNA, 22 nt, Human
cagcugccaugacauguccugc

SEQ ID NO: 938961 - RNA, 22 nt, Human
ggccagcagucacagggucaga

SEQ ID NO: 938962 - RNA, 22 nt, Human
ugcuagugcaggguuuucaguu

SEQ ID NO: 938963 - RNA, 22 nt, Human
uccuucagggggccgccugcac

SEQ ID NO: 938964 - RNA, 22 nt, Human
agagggcauuaacucugucuug

SEQ ID NO: 938965 - RNA, 22 nt, Human
ggccugcucugcagccucuaca

SEQ ID NO: 938966 - RNA, 22 nt, Human
aaggcuaugaucuuuuucauga

SEQ ID NO: 938967 - RNA, 22 nt, Human
gaggccuguagucauggaugua

SEQ ID NO: 938968 - RNA, 22 nt, Human
caggggcuuuuccucuauaagg

SEQ ID NO: 938969 - RNA, 22 nt, Human
uccaggagggguaggcaguaug

SEQ ID NO: 938970 - RNA, 22 nt, Human
gaugcugaagugaagugaucuu

SEQ ID NO: 938971 - RNA, 22 nt, Human
ggggcugggauuugaacccagg

SEQ ID NO: 938972 - RNA, 22 nt, Human
cugcagaguggagccucggcug

SEQ ID NO: 938973 - RNA, 22 nt, Human
aaggcagcucagcucauggcag

SEQ ID NO: 938974 - RNA, 22 nt, Human
cugcccaggcugaaggaacauc

SEQ ID NO: 938975 - RNA, 22 nt, Human
gcaccuuuggaaugaaaaguug

SEQ ID NO: 938976 - RNA, 22 nt, Human
augauuuccaguuguugcuaag

SEQ ID NO: 938977 - RNA, 22 nt, Human
uucuucaguuugguaaauguaa

SEQ ID NO: 938978 - RNA, 22 nt, Human
ucuguucagaagaggugaaagu

SEQ ID NO: 938979 - RNA, 22 nt, Human
cagauaaaggcuuacuaguagu

SEQ ID NO: 938980 - RNA, 22 nt, Human
gggucccaggaaggagcagugu

SEQ ID NO: 938981 - RNA, 22 nt, Human
agagcugaaaaagcugacccgg

SEQ ID NO: 938982 - RNA, 22 nt, Human
ccaaaaagcucagagauauguu

SEQ ID NO: 938983 - RNA, 22 nt, Human
ucagaagcauguggggagccug

SEQ ID NO: 938984 - RNA, 18 nt, Human
cucucuggucuggauccc

SEQ ID NO: 938985 - RNA, 22 nt, Human
ucuggcaaaggcaaccacaguu

SEQ ID NO: 938986 - RNA, 22 nt, Human
cagcuuggcuuccgcuuuacug

SEQ ID NO: 938987 - RNA, 22 nt, Human
ugcugccuuagcagccaggcaa

SEQ ID NO: 938988 - RNA, 22 nt, Human
agaaguuaccacauacuucucu

SEQ ID NO: 938989 - RNA, 22 nt, Human
cucuggcuucuaccuugcaguu

SEQ ID NO: 938990 - RNA, 22 nt, Human
gacagagaggcugagcaguaca

SEQ ID NO: 938991 - RNA, 19 nt, Human
ugggcagcucccucugucc

SEQ ID NO: 938992 - RNA, 22 nt, Human
ggaggccaaagugugggcggcu

SEQ ID NO: 938993 - RNA, 22 nt, Human
acucugcuuccacuuuugcuaa

SEQ ID NO: 938994 - RNA, 22 nt, Human
uggcacugaccccaggccugug

SEQ ID NO: 938995 - RNA, 22 nt, Human
aggccagcaagaaagagagucu

SEQ ID NO: 938996 - RNA, 22 nt, Human
ucucucuuuuuaaucauguaau

SEQ ID NO: 938997 - RNA, 22 nt, Human
ucagggauugcaaaauucaucc

SEQ ID NO: 938998 - RNA, 22 nt, Human
ucagagaacacagaggugaugu

SEQ ID NO: 938999 - RNA, 22 nt, Human
agggaagcccuggcugagaccc

SEQ ID NO: 939000 - RNA, 22 nt, Human
auugcaccuuggguuuugaaag

SEQ ID NO: 939001 - RNA, 20 nt, Human
uuggcagcaguuccaaguga

SEQ ID NO: 939002 - RNA, 19 nt, Human
cucugccucuggcuguggc

SEQ ID NO: 939003 - RNA, 22 nt, Human
ugauuuccccagucuugcugcu

SEQ ID NO: 939004 - RNA, 22 nt, Human
agaggucagaacaggaaagugu

SEQ ID NO: 939005 - RNA, 18 nt, Human
ucuauauggacauagaga

SEQ ID NO: 939006 - RNA, 17 nt, Human
gcugacccuggagaagu

SEQ ID NO: 939007 - RNA, 22 nt, Human
cuggagccgcauggagcaggga

SEQ ID NO: 939008 - RNA, 22 nt, Human
ggcugccugaggcagugagaga

SEQ ID NO: 939009 - RNA, 22 nt, Human
uuucuauuuuaaaggcauaugg

SEQ ID NO: 939010 - RNA, 23 nt, Human
uugcacauuggagcuggucuucu

SEQ ID NO: 939011 - RNA, 21 nt, Human
agcaggaggcagucacagcuc

SEQ ID NO: 939012 - RNA, 22 nt, Human
ccuggccaaucuagggcuguua

SEQ ID NO: 939013 - RNA, 23 nt, Human
cagcugaagcagccugggcugga

SEQ ID NO: 939014 - RNA, 22 nt, Human
cuccucacacccacugcaacca

SEQ ID NO: 939015 - RNA, 22 nt, Human
acucugcaauguggcaagaaca

SEQ ID NO: 939016 - RNA, 19 nt, Human
uccugggcugcgucuugcc

SEQ ID NO: 939017 - RNA, 22 nt, Human
aacuuuguguguuuaauauggc

SEQ ID NO: 939018 - RNA, 22 nt, Human
cagagcuggagaaguggauuua

SEQ ID NO: 939019 - RNA, 22 nt, Human
auacauguuguaccauauguuu

SEQ ID NO: 939020 - RNA, 22 nt, Human
uuuucagugggcaaugauguga

SEQ ID NO: 939021 - RNA, 23 nt, Human
acagggcauugcuggccucgagg

SEQ ID NO: 939022 - RNA, 22 nt, Human
uguguccuucugggagucccag

SEQ ID NO: 939023 - RNA, 22 nt, Human
ucauaaaaauagacucuaaagu

SEQ ID NO: 939024 - RNA, 22 nt, Human
ggacuggacucucaggcucaca

SEQ ID NO: 939025 - RNA, 22 nt, Human
ugcucuguugugcaugugggau

SEQ ID NO: 939026 - RNA, 17 nt, Human
cccagagaugcugccuu

SEQ ID NO: 939027 - RNA, 22 nt, Human
aggcccuggcccccagagauuc

SEQ ID NO: 939028 - RNA, 22 nt, Human
uggaaggaagccaaggaagguu

SEQ ID NO: 939029 - RNA, 20 nt, Human
ucugucucugagcuagacuu

SEQ ID NO: 939030 - RNA, 22 nt, Human
gauuucuugauaaguaguguga

SEQ ID NO: 939031 - RNA, 19 nt, Human
auaaggcagugacuuuuuu

SEQ ID NO: 939032 - RNA, 22 nt, Human
ccagucugugugccagccugcg

SEQ ID NO: 939033 - RNA, 22 nt, Human
uugcuucaguagcucuuuaaag

SEQ ID NO: 939034 - RNA, 22 nt, Human
cagcugggagcuccauuagaua

SEQ ID NO: 939035 - RNA, 22 nt, Human
uguguguauaugcauuuaucua

SEQ ID NO: 939036 - RNA, 22 nt, Human
agcuuccuguugagagagggag

SEQ ID NO: 939037 - RNA, 22 nt, Human
gacccaggguauccagagcugc

SEQ ID NO: 939038 - RNA, 22 nt, Human
ccugcccuagagaugacacaau

SEQ ID NO: 939039 - RNA, 22 nt, Human
caggcagcuagauuuauaacaa

SEQ ID NO: 939040 - RNA, 23 nt, Human
acugcuuuauucaugaggcucuc

SEQ ID NO: 939041 - RNA, 22 nt, Human
ucacaaagggagggauagcugg

SEQ ID NO: 939042 - RNA, 22 nt, Human
uagaguguuguaauugaaaagg

SEQ ID NO: 939043 - RNA, 22 nt, Human
cucagggucugguccuuagauu

SEQ ID NO: 939044 - RNA, 22 nt, Human
uacuuuuagccuauuugauucu

SEQ ID NO: 939045 - RNA, 22 nt, Human
aaaagcucuuucugcuguagau

SEQ ID NO: 939046 - RNA, 22 nt, Human
ugcuggggcucugaccacucca

SEQ ID NO: 939047 - RNA, 22 nt, Human
ugucacauugaauaugauuuau

SEQ ID NO: 939048 - RNA, 22 nt, Human
ccggggacuuaaagugaaggaa

SEQ ID NO: 939049 - RNA, 22 nt, Human
gcgcaggagccgcggagggccg

SEQ ID NO: 939050 - RNA, 22 nt, Human
ccagguggaggugugagguccu

SEQ ID NO: 939051 - RNA, 21 nt, Human
gcagccagacgggauucaguu

SEQ ID NO: 939052 - RNA, 22 nt, Human
agggugccuggaagccacucac

SEQ ID NO: 939053 - RNA, 22 nt, Human
ccugaggacacacgcugcagga

SEQ ID NO: 939054 - RNA, 22 nt, Human
aguccuucaagaaaucuggaaa

SEQ ID NO: 939055 - RNA, 22 nt, Human
aucaggaucugcaucauaagaa

SEQ ID NO: 939056 - RNA, 21 nt, Human
agggccugugcucuccagguc

SEQ ID NO: 939057 - RNA, 22 nt, Human
ggacagagcccugguggccuaa

SEQ ID NO: 939058 - RNA, 22 nt, Human
ggcagcucugugucugggaagc

SEQ ID NO: 939059 - RNA, 22 nt, Human
ugcugcucucagccaccaggaa

SEQ ID NO: 939060 - RNA, 20 nt, Human
gcugucuggauuagaagccu

SEQ ID NO: 939061 - RNA, 22 nt, Human
ccuggccagcagccccuuccuc

SEQ ID NO: 939062 - RNA, 22 nt, Human
ucacauuuucuacuacuguacg

SEQ ID NO: 939063 - RNA, 22 nt, Human
acagcuguggccacuugcaucc

SEQ ID NO: 939064 - RNA, 17 nt, Human
uucugagccacuuccuu

SEQ ID NO: 939065 - RNA, 22 nt, Human
uaaugucagcauaguuuauuuu

SEQ ID NO: 939066 - RNA, 22 nt, Human
uaaaaugaucucucauguucuu

SEQ ID NO: 939067 - RNA, 22 nt, Human
agaguguuauuugcucuguauu

SEQ ID NO: 939068 - RNA, 22 nt, Human
gcagcugccccgacugugaguc

SEQ ID NO: 939069 - RNA, 22 nt, Human
gggaguggauuauguggaccca

SEQ ID NO: 939070 - RNA, 22 nt, Human
gccagcagggcccaaaugcugg

SEQ ID NO: 939071 - RNA, 22 nt, Human
cuggagccggaccagggacggu

SEQ ID NO: 939072 - RNA, 22 nt, Human
gagagcuggguucaaguagcug

SEQ ID NO: 939073 - RNA, 22 nt, Human
ucugccuuccccauaaucugau

SEQ ID NO: 939074 - RNA, 22 nt, Human
aucuacccacugaacacaauau

SEQ ID NO: 939075 - RNA, 22 nt, Human
cacaggugcuccucggggagcu

SEQ ID NO: 939076 - RNA, 22 nt, Human
gcagagccagaauggccaggac

SEQ ID NO: 939077 - RNA, 22 nt, Human
uuagauauguuuuugcuaaugc

SEQ ID NO: 939078 - RNA, 22 nt, Human
cuuccagagauagggccucaag

SEQ ID NO: 939079 - RNA, 22 nt, Human
augaaggauggcuggcugcccu

SEQ ID NO: 939080 - RNA, 22 nt, Human
uguucuugagccuuuagaccua

SEQ ID NO: 939081 - RNA, 22 nt, Human
uggagccaugccuggccuuucc

SEQ ID NO: 939082 - RNA, 22 nt, Human
cucugguguccuuuagaauuua

SEQ ID NO: 939083 - RNA, 22 nt, Human
ucacuugccuagcccaguucag

SEQ ID NO: 939084 - RNA, 22 nt, Human
ucuccugcagucagcagucuca

SEQ ID NO: 939085 - RNA, 22 nt, Human
agggcugcugaggaagccuugc

SEQ ID NO: 939086 - RNA, 22 nt, Human
gccugcagggugaugggcugcc

SEQ ID NO: 939087 - RNA, 22 nt, Human
uuauuccaauuucuccuacaaa

SEQ ID NO: 939088 - RNA, 22 nt, Human
cuggcagcgguuugcagccugg

SEQ ID NO: 939089 - RNA, 22 nt, Human
uuuggaaaguugucacuuuaga

SEQ ID NO: 939090 - RNA, 22 nt, Human
cccaggagguuggggcuacagu

SEQ ID NO: 939091 - RNA, 19 nt, Human
aggcucugagcuccuggag

SEQ ID NO: 939092 - RNA, 18 nt, Human
cucaccauucugcccaau

SEQ ID NO: 939093 - RNA, 22 nt, Human
acaggccugagauuuugcauuu

SEQ ID NO: 939094 - RNA, 22 nt, Human
gagaugaauguaaacaaaggca

SEQ ID NO: 939095 - RNA, 22 nt, Human
acucugcuaaauguguaggcuc

SEQ ID NO: 939096 - RNA, 22 nt, Human
cagcuuccaucuccacugcccu

SEQ ID NO: 939097 - RNA, 22 nt, Human
guuauuaguaagacucgcacau

SEQ ID NO: 939098 - RNA, 22 nt, Human
uaacacugguauuucauuuagu

SEQ ID NO: 939099 - RNA, 22 nt, Human
ccaggcuggagugcaauggugc

SEQ ID NO: 939100 - RNA, 22 nt, Human
aggaccuguaccucagcaucua

SEQ ID NO: 939101 - RNA, 22 nt, Human
gagccuggagcuggaacgaagc

SEQ ID NO: 939102 - RNA, 22 nt, Human
cauuguuaauugguaucuuaca

SEQ ID NO: 939103 - RNA, 22 nt, Human
ccuguucacugcacaguuuccg

SEQ ID NO: 939104 - RNA, 22 nt, Human
aggguggcuggaggaaucagaa

SEQ ID NO: 939105 - RNA, 22 nt, Human
cugugagcuggguggccaggac

SEQ ID NO: 939106 - RNA, 23 nt, Human
uccagggauuaaugaagucaguc

SEQ ID NO: 939107 - RNA, 23 nt, Human
gggagaauaugaggaugauggug

SEQ ID NO: 939108 - RNA, 19 nt, Human
aaaaacuuaguccagaaag

SEQ ID NO: 939109 - RNA, 22 nt, Human
aauguacaauaagacaaagagg

SEQ ID NO: 939110 - RNA, 22 nt, Human
aaugucaaaggcuauacauuca

SEQ ID NO: 939111 - RNA, 21 nt, Human
ucucugggcccuccugugggg

SEQ ID NO: 939112 - RNA, 22 nt, Human
gaaaaaugagcugaugucaggg

SEQ ID NO: 939113 - RNA, 22 nt, Human
ugcaccccauuuuacauuuaca

SEQ ID NO: 939114 - RNA, 22 nt, Human
uggccaagaaugauaugugaag

SEQ ID NO: 939115 - RNA, 22 nt, Human
guaauugacucagcucuguuca

SEQ ID NO: 939116 - RNA, 22 nt, Human
gcaggagccaggccgagcuggu

SEQ ID NO: 939117 - RNA, 18 nt, Human
gcugccugcauuccucac

SEQ ID NO: 939118 - RNA, 22 nt, Human
cugcugucauagccaucccucc

SEQ ID NO: 939119 - RNA, 17 nt, Human
ugagacagggcaggccc

SEQ ID NO: 939120 - RNA, 22 nt, Human
ucaaauaccagcuuuuccagaa

SEQ ID NO: 939121 - RNA, 22 nt, Human
aggugagugugacugcaagaga

SEQ ID NO: 939122 - RNA, 18 nt, Human
acauuucuaggugaaagc

SEQ ID NO: 939123 - RNA, 22 nt, Human
cccagcucuuuuagcggcaucu

SEQ ID NO: 939124 - RNA, 22 nt, Human
acuucaugcagaagagagcugu

SEQ ID NO: 939125 - RNA, 22 nt, Human
uguggaaaauuggaacguuccu

SEQ ID NO: 939126 - RNA, 22 nt, Human
ggcagcuuccuaggagagggca

SEQ ID NO: 939127 - RNA, 22 nt, Human
cagcugccuucugcgggaaguc

SEQ ID NO: 939128 - RNA, 22 nt, Human
ccagcucuggcuucuugcuggg

SEQ ID NO: 939129 - RNA, 22 nt, Human
agcagcugcagagggcuccccc

SEQ ID NO: 939130 - RNA, 18 nt, Human
uggcagcuagguaaagaa

SEQ ID NO: 939131 - RNA, 22 nt, Human
gcagggacugugaucucacaga

SEQ ID NO: 939132 - RNA, 22 nt, Human
gcuugaaaauucauagguauuu

SEQ ID NO: 939133 - RNA, 22 nt, Human
uauuuccaccuauuauuuucug

SEQ ID NO: 939134 - RNA, 20 nt, Human
ucacaggggaccaggagcag

SEQ ID NO: 939135 - RNA, 22 nt, Human
gagcagugggaaggaacagggu

SEQ ID NO: 939136 - RNA, 21 nt, Human
ugggaugggucugggaccagc

SEQ ID NO: 939137 - RNA, 22 nt, Human
cuggggacuugcagacacaauu

SEQ ID NO: 939138 - RNA, 22 nt, Human
ccagcagcgauagggugagugc

SEQ ID NO: 939139 - RNA, 22 nt, Human
ucuuaaagcagcuuguaaaaug

SEQ ID NO: 939140 - RNA, 22 nt, Human
aagggcagagggaaucccacau

SEQ ID NO: 939141 - RNA, 22 nt, Human
ucuaggagcaugaagggaaggc

SEQ ID NO: 939142 - RNA, 21 nt, Human
gcucccugcucagcuccuggg

SEQ ID NO: 939143 - RNA, 23 nt, Human
ucaaacauauugugagacacagg

SEQ ID NO: 939144 - RNA, 22 nt, Human
aguuuauagcccagauucaugg

SEQ ID NO: 939145 - RNA, 22 nt, Human
aggccagcacgacagccgcagg

SEQ ID NO: 939146 - RNA, 22 nt, Human
gggggcuguccugugcauugua

SEQ ID NO: 939147 - RNA, 22 nt, Human
aggccagggucccacacucgca

SEQ ID NO: 939148 - RNA, 22 nt, Human
accugccucagugcagcuggau

SEQ ID NO: 939149 - RNA, 22 nt, Human
gauguagagggaagauuuuaaa

SEQ ID NO: 939150 - RNA, 22 nt, Human
ccagguggaaggucugugcucu

SEQ ID NO: 939151 - RNA, 22 nt, Human
acugucuccucaucaugccugg

SEQ ID NO: 939152 - RNA, 22 nt, Human
aagauucagccaaauuguucau

SEQ ID NO: 939153 - RNA, 22 nt, Human
ggcagcugaccuagcaccaucc

SEQ ID NO: 939154 - RNA, 22 nt, Human
acaaugcaccagcaucuucacc

SEQ ID NO: 939155 - RNA, 22 nt, Human
ugugugaaggaauauauacuca

SEQ ID NO: 939156 - RNA, 17 nt, Human
acagggcagaaacagcu

SEQ ID NO: 939157 - RNA, 18 nt, Human
gguggcucagucaugggg

SEQ ID NO: 939158 - RNA, 22 nt, Human
uguuccaauaaggaguugaaau

SEQ ID NO: 939159 - RNA, 22 nt, Human
ucagcuggcaguucagaggcug

SEQ ID NO: 939160 - RNA, 22 nt, Human
ugcugccagggcucugcccaca

SEQ ID NO: 939161 - RNA, 22 nt, Human
aauguguacaugacagauagaa

SEQ ID NO: 939162 - RNA, 17 nt, Human
uggcuucccugggccac

SEQ ID NO: 939163 - RNA, 20 nt, Human
ugucauuguuucuaggaccu

SEQ ID NO: 939164 - RNA, 22 nt, Human
cagcaauaagccagguuagaca

SEQ ID NO: 939165 - RNA, 18 nt, Human
agaggggagguaagucug

SEQ ID NO: 939166 - RNA, 22 nt, Human
cugggccuggcguuccaggcug

SEQ ID NO: 939167 - RNA, 22 nt, Human
ucugagaggcaucugcacuucu

SEQ ID NO: 939168 - RNA, 22 nt, Human
aaugcacacauuugguacugaa

SEQ ID NO: 939169 - RNA, 22 nt, Human
gccuucugugcuccuggccuuu

SEQ ID NO: 939170 - RNA, 22 nt, Human
ucucagagcaucauuuucuuag

SEQ ID NO: 939171 - RNA, 23 nt, Human
ugccucugccucccuagucugca

SEQ ID NO: 939172 - RNA, 20 nt, Human
aggcugccaggucucacauc

SEQ ID NO: 939173 - RNA, 18 nt, Human
ccugagcccugcuuacuu

SEQ ID NO: 939174 - RNA, 18 nt, Human
acagacaaaauggaaaug

SEQ ID NO: 939175 - RNA, 23 nt, Human
aaucuggcugauguuuuuucucu

SEQ ID NO: 939176 - RNA, 22 nt, Human
cagaggccccauuggcugugcg

SEQ ID NO: 939177 - RNA, 22 nt, Human
acacagggauauuucagguggu

SEQ ID NO: 939178 - RNA, 22 nt, Human
acagaccucuagauuacauuug

SEQ ID NO: 939179 - RNA, 22 nt, Human
ucagagccaaucauggugcauu

SEQ ID NO: 939180 - RNA, 22 nt, Human
gaaaugcagauucugauucugu

SEQ ID NO: 939181 - RNA, 22 nt, Human
ugucccucauugacgcugugcc

SEQ ID NO: 939182 - RNA, 22 nt, Human
uacaucuagccuuacaauuauu

SEQ ID NO: 939183 - RNA, 22 nt, Human
agugcugucaguuuuauagaua

SEQ ID NO: 939184 - RNA, 22 nt, Human
uuguauucauugcuuacccaau

SEQ ID NO: 939185 - RNA, 21 nt, Human
auguaggaguuauuggaacag

SEQ ID NO: 939186 - RNA, 22 nt, Human
agcaggaguguccccuggcugu

SEQ ID NO: 939187 - RNA, 22 nt, Human
ccuggagcgcgggucaagcugg

SEQ ID NO: 939188 - RNA, 19 nt, Human
auuugaaagcugugcuugc

SEQ ID NO: 939189 - RNA, 22 nt, Human
uucuucucagggucccacaugg

SEQ ID NO: 939190 - RNA, 20 nt, Human
ggaccagguggggcgguggc

SEQ ID NO: 939191 - RNA, 22 nt, Human
cugaagcaaaugaaacagcucu

SEQ ID NO: 939192 - RNA, 22 nt, Human
guuugcauauuugcacaggaau

SEQ ID NO: 939193 - RNA, 22 nt, Human
ucauuuguggaagugauugugg

SEQ ID NO: 939194 - RNA, 21 nt, Human
agcagaggggacauguuugau

SEQ ID NO: 939195 - RNA, 22 nt, Human
cuuggggcugucacucuggcau

SEQ ID NO: 939196 - RNA, 22 nt, Human
gcucugcuguggaauccucucc

SEQ ID NO: 939197 - RNA, 18 nt, Human
ugagagugugugcucuug

SEQ ID NO: 939198 - RNA, 22 nt, Human
cugguccuccuugccuucagau

SEQ ID NO: 939199 - RNA, 22 nt, Human
agauguguuucuaguuccugca

SEQ ID NO: 939200 - RNA, 22 nt, Human
agggaggagaauggacuccuuc

SEQ ID NO: 939201 - RNA, 22 nt, Human
uauuuuguauuuaugcaagaaa

SEQ ID NO: 939202 - RNA, 22 nt, Human
gagcugucuggggacucugggu

SEQ ID NO: 939203 - RNA, 22 nt, Human
aaaauacuguggaguguugaaa

SEQ ID NO: 939204 - RNA, 21 nt, Human
uuacuuuugcagcaaccuaau

SEQ ID NO: 939205 - RNA, 22 nt, Human
ggcugcagagcugggugggccu

SEQ ID NO: 939206 - RNA, 22 nt, Human
ugagauuuucagcaucacuuca

SEQ ID NO: 939207 - RNA, 22 nt, Human
ugcagagguguugcugagauaa

SEQ ID NO: 939208 - RNA, 17 nt, Human
ggugagaccucccacuc

SEQ ID NO: 939209 - RNA, 22 nt, Human
aaauauaguaaaugcauaguuc

SEQ ID NO: 939210 - RNA, 21 nt, Human
gccaccccuggcacaggugcu

SEQ ID NO: 939211 - RNA, 22 nt, Human
caaguaaagaaucacauuucuu

SEQ ID NO: 939212 - RNA, 22 nt, Human
uccaggagagguagaggguucc

SEQ ID NO: 939213 - RNA, 22 nt, Human
cugggaguugacgaggcuugua

SEQ ID NO: 939214 - RNA, 22 nt, Human
cuggggcuucaaugcuucggug

SEQ ID NO: 939215 - RNA, 22 nt, Human
ugaggcagugauguuuaagcac

SEQ ID NO: 939216 - RNA, 22 nt, Human
ucagggcauucaagaggccugg

SEQ ID NO: 939217 - RNA, 22 nt, Human
uuuuuccuagcgauuugucagc

SEQ ID NO: 939218 - RNA, 22 nt, Human
aggggcuggaguucgagguuac

SEQ ID NO: 939219 - RNA, 21 nt, Human
gccagccuguuuaccuguggu

SEQ ID NO: 939220 - RNA, 22 nt, Human
cagaauuuagcacaauguaugg

SEQ ID NO: 939221 - RNA, 21 nt, Human
gcaugccugcaucuuaguguu

SEQ ID NO: 939222 - RNA, 22 nt, Human
augaaggcuguguagauggaug

SEQ ID NO: 939223 - RNA, 22 nt, Human
cucucugggggccaugccaaga

SEQ ID NO: 939224 - RNA, 19 nt, Human
cagagcugcuggccucguc

SEQ ID NO: 939225 - RNA, 22 nt, Human
aaaucugggucaagguggagug

SEQ ID NO: 939226 - RNA, 22 nt, Human
ugaaaugagagcacagaauaaa

SEQ ID NO: 939227 - RNA, 22 nt, Human
agcucccagagcucgagaguaa

SEQ ID NO: 939228 - RNA, 22 nt, Human
uucuucuucauuucugacgaug

SEQ ID NO: 939229 - RNA, 22 nt, Human
ccuguuuagugaggugaggagu

SEQ ID NO: 939230 - RNA, 22 nt, Human
acucugcucaaaguccugaggc

SEQ ID NO: 939231 - RNA, 21 nt, Human
aauaaaacaguuggugucaau

SEQ ID NO: 939232 - RNA, 22 nt, Human
ucugagaguagagcugccucuu

SEQ ID NO: 939233 - RNA, 22 nt, Human
ucaguuuucucauuuaugagau

SEQ ID NO: 939234 - RNA, 22 nt, Human
cagcaguggccaucuguguggu

SEQ ID NO: 939235 - RNA, 22 nt, Human
ccugccuguacuagagacccag

SEQ ID NO: 939236 - RNA, 22 nt, Human
aggcagcagggccacuggcuga

SEQ ID NO: 939237 - RNA, 22 nt, Human
caacagaagguguacuacugaa

SEQ ID NO: 939238 - RNA, 22 nt, Human
augcaguaaaauaggagguaau

SEQ ID NO: 939239 - RNA, 22 nt, Human
ucuguggccuguguccaagugc

SEQ ID NO: 939240 - RNA, 22 nt, Human
uacuuagagcgauaauuuauac

SEQ ID NO: 939241 - RNA, 22 nt, Human
uggggcucaccuaggcuggaag

SEQ ID NO: 939242 - RNA, 22 nt, Human
uuugugaagggaacagaagugu

SEQ ID NO: 939243 - RNA, 22 nt, Human
ucugauuagagcauucuugagu

SEQ ID NO: 939244 - RNA, 22 nt, Human
cagagcagagugauuguucugg

SEQ ID NO: 939245 - RNA, 22 nt, Human
agccuggcccugcugaacucug

SEQ ID NO: 939246 - RNA, 22 nt, Human
auguggaggaaaugaguguaca

SEQ ID NO: 939247 - RNA, 22 nt, Human
agugugcuauugcaccaucaua

SEQ ID NO: 939248 - RNA, 22 nt, Human
ccucccacuucuugcugagguc

SEQ ID NO: 939249 - RNA, 18 nt, Human
gcccagaggucugggccc

SEQ ID NO: 939250 - RNA, 22 nt, Human
gcagugggaagguuggcacaug

SEQ ID NO: 939251 - RNA, 22 nt, Human
uuucauuacguguuugacuugu

SEQ ID NO: 939252 - RNA, 22 nt, Human
gugucauguagaaauugaugaa

SEQ ID NO: 939253 - RNA, 22 nt, Human
agccuggccugggcaggcacau

SEQ ID NO: 939254 - RNA, 22 nt, Human
gaggcugcggggaggagccugc

SEQ ID NO: 939255 - RNA, 22 nt, Human
gggcuugcugauuugggcagga

SEQ ID NO: 939256 - RNA, 22 nt, Human
gggacuucauagcuaggcacuu

SEQ ID NO: 939257 - RNA, 22 nt, Human
ugagcaguaggucugaauagug

SEQ ID NO: 939258 - RNA, 22 nt, Human
aauugugcuaugauuaugaaag

SEQ ID NO: 939259 - RNA, 18 nt, Human
ugggauggagaguaacug

SEQ ID NO: 939260 - RNA, 21 nt, Human
agucccaggggugagugaugu

SEQ ID NO: 939261 - RNA, 22 nt, Human
aggcaguuguugcugagcagcu

SEQ ID NO: 939262 - RNA, 22 nt, Human
aaguuuguguaguuuagcaucc

SEQ ID NO: 939263 - RNA, 22 nt, Human
aagaauucacugguagagucaa

SEQ ID NO: 939264 - RNA, 18 nt, Human
gcagcugacacuggaguu

SEQ ID NO: 939265 - RNA, 22 nt, Human
uggcacccugaaguuggucacu

SEQ ID NO: 939266 - RNA, 22 nt, Human
aggcacugauucucagaguuac

SEQ ID NO: 939267 - RNA, 22 nt, Human
cuccuugguguaguacugagca

SEQ ID NO: 939268 - RNA, 22 nt, Human
acacauuauaggcaaucaaaag

SEQ ID NO: 939269 - RNA, 18 nt, Human
ugggcacaaugaacagca

SEQ ID NO: 939270 - RNA, 20 nt, Human
ucuguucaaaucuuaguucc

SEQ ID NO: 939271 - RNA, 22 nt, Human
caggguccggcugccuggcugu

SEQ ID NO: 939272 - RNA, 22 nt, Human
agggccugcaucaggagcuugg

SEQ ID NO: 939273 - RNA, 21 nt, Human
ggugggcacaggagagcagag

SEQ ID NO: 939274 - RNA, 22 nt, Human
aggcugccaaagcuucugucuc

SEQ ID NO: 939275 - RNA, 22 nt, Human
cacaugcauaaggauaauuacu

SEQ ID NO: 939276 - RNA, 22 nt, Human
gaacccaggcuuuugaggcugu

SEQ ID NO: 939277 - RNA, 22 nt, Human
ucagaguggugguuuugccuuc

SEQ ID NO: 939278 - RNA, 22 nt, Human
ccuuaaauucuccauuugaaag

SEQ ID NO: 939279 - RNA, 22 nt, Human
cuggccugcugggugagguccu

SEQ ID NO: 939280 - RNA, 22 nt, Human
ugggccuguugccugaguccau

SEQ ID NO: 939281 - RNA, 22 nt, Human
ggagcugugcagugacuacaga

SEQ ID NO: 939282 - RNA, 22 nt, Human
ccuccugggagagcacggaggg

SEQ ID NO: 939283 - RNA, 19 nt, Human
agcuuccauauucucuagu

SEQ ID NO: 939284 - RNA, 22 nt, Human
uggaggaugccauccaggauac

SEQ ID NO: 939285 - RNA, 22 nt, Human
cuguggcuaggaagcuguggga

SEQ ID NO: 939286 - RNA, 18 nt, Human
cugcuugggagacgucag

SEQ ID NO: 939287 - RNA, 22 nt, Human
ugaaaucuuagccauucugccu

SEQ ID NO: 939288 - RNA, 22 nt, Human
uucacagacauugcagacugaa

SEQ ID NO: 939289 - RNA, 22 nt, Human
gcagugggcaacaagagcugga

SEQ ID NO: 939290 - RNA, 22 nt, Human
gccucuggggcagcugagucau

SEQ ID NO: 939291 - RNA, 22 nt, Human
cagcagagaaauuaaacuucug

SEQ ID NO: 939292 - RNA, 22 nt, Human
ccacacagggggaugaguuauu

SEQ ID NO: 939293 - RNA, 22 nt, Human
uucaugaauggaaucaaugcuc

SEQ ID NO: 939294 - RNA, 22 nt, Human
guucucucugcuuccaagaugg

SEQ ID NO: 939295 - RNA, 22 nt, Human
acauuucuuagccuaguuccag

SEQ ID NO: 939296 - RNA, 22 nt, Human
cagucuuuguucccauuacuga

SEQ ID NO: 939297 - RNA, 22 nt, Human
gcuggagccaagcugcucuugg

SEQ ID NO: 939298 - RNA, 22 nt, Human
cauuuucagcacccaucugaaa

SEQ ID NO: 939299 - RNA, 22 nt, Human
ccagggcauguccaagacuuag

SEQ ID NO: 939300 - RNA, 21 nt, Human
uggcccuggccacggcugcca

SEQ ID NO: 939301 - RNA, 22 nt, Human
cagcugacgccagaguggaauu

SEQ ID NO: 939302 - RNA, 22 nt, Human
uuugaagucagacacugcuuug

SEQ ID NO: 939303 - RNA, 22 nt, Human
gaaaguuuauagguuauauaau

SEQ ID NO: 939304 - RNA, 22 nt, Human
cccuccccacaaagcuucacac

SEQ ID NO: 939305 - RNA, 22 nt, Human
cccaucacagacacuggguuau

SEQ ID NO: 939306 - RNA, 22 nt, Human
ucacaggcuccagggccuggau

SEQ ID NO: 939307 - RNA, 22 nt, Human
guuaggauauggugaaauggag

SEQ ID NO: 939308 - RNA, 22 nt, Human
aaagaggaaccaagagcacgug

SEQ ID NO: 939309 - RNA, 22 nt, Human
gcacugcaucuacuggcaagua

SEQ ID NO: 939310 - RNA, 22 nt, Human
gcauuuauuucuuuacugcauc

SEQ ID NO: 939311 - RNA, 22 nt, Human
gacaucauagggugggaggaaa

SEQ ID NO: 939312 - RNA, 22 nt, Human
uggcagggugccaguugcgagu

SEQ ID NO: 939313 - RNA, 22 nt, Human
ucuucaaaaaauauccaucagu

SEQ ID NO: 939314 - RNA, 22 nt, Human
uggcccugcagaacuagccugg

SEQ ID NO: 939315 - RNA, 22 nt, Human
gagaaaugcaugcaugucauca

SEQ ID NO: 939316 - RNA, 22 nt, Human
gagaagcaauuuccaacugugc

SEQ ID NO: 939317 - RNA, 22 nt, Human
gccaggcagccacccucugcga

SEQ ID NO: 939318 - RNA, 22 nt, Human
acaaagguggaccauguggcuu

SEQ ID NO: 939319 - RNA, 22 nt, Human
auucacaacugauccuugcuca

SEQ ID NO: 939320 - RNA, 22 nt, Human
uucucuuagcuguaaagucaau

SEQ ID NO: 939321 - RNA, 22 nt, Human
agcacuuuccuggcaaaugugg

SEQ ID NO: 939322 - RNA, 22 nt, Human
cagaggccuauccaguguccau

SEQ ID NO: 939323 - RNA, 22 nt, Human
agcagccacagucugggacagg

SEQ ID NO: 939324 - RNA, 22 nt, Human
ucagccagguaauguggagaug

SEQ ID NO: 939325 - RNA, 18 nt, Human
agcagcugucagaaugcc

SEQ ID NO: 939326 - RNA, 22 nt, Human
augugucuugcggcaguuggua

SEQ ID NO: 939327 - RNA, 22 nt, Human
cuggguggcagagccugcagug

SEQ ID NO: 939328 - RNA, 22 nt, Human
uccauuuucaucucauguauaa

SEQ ID NO: 939329 - RNA, 22 nt, Human
aagcagcuuaaauuagagccug

SEQ ID NO: 939330 - RNA, 22 nt, Human
cagguggggcgcccucaggcag

SEQ ID NO: 939331 - RNA, 18 nt, Human
uggcucugcagccagaug

SEQ ID NO: 939332 - RNA, 22 nt, Human
agggcugcaucugccuggugaa

SEQ ID NO: 939333 - RNA, 22 nt, Human
gacagugcauuuccuggcaugg

SEQ ID NO: 939334 - RNA, 19 nt, Human
guugaaaguaggugagggu

SEQ ID NO: 939335 - RNA, 22 nt, Human
augggugugaaaauggucaucu

SEQ ID NO: 939336 - RNA, 22 nt, Human
aucaguuuggugcuuucaguga

SEQ ID NO: 939337 - RNA, 22 nt, Human
uccuugacugugaggaacuagc

SEQ ID NO: 939338 - RNA, 22 nt, Human
uagggauguggugagaacugag

SEQ ID NO: 939339 - RNA, 22 nt, Human
cacauguaguaagcaggcaaug

SEQ ID NO: 939340 - RNA, 22 nt, Human
gggcuuggcacaugggcucagc

SEQ ID NO: 939341 - RNA, 22 nt, Human
gaaggaggcguuagcccuagga

SEQ ID NO: 939342 - RNA, 22 nt, Human
cacugugggguuuggcuggaac

SEQ ID NO: 939343 - RNA, 22 nt, Human
agaggagguccuuuucugaugu

SEQ ID NO: 939344 - RNA, 22 nt, Human
ugccugucuccucugcagggug

SEQ ID NO: 939345 - RNA, 22 nt, Human
uccaggucuggccugcuaggca

SEQ ID NO: 939346 - RNA, 22 nt, Human
cagucccaugagcccagaacau

SEQ ID NO: 939347 - RNA, 22 nt, Human
ccagagccggauugugaagugc

SEQ ID NO: 939348 - RNA, 22 nt, Human
cuguccuguggaccugaggacg

SEQ ID NO: 939349 - RNA, 22 nt, Human
agucugucugucacuucugcag

SEQ ID NO: 939350 - RNA, 22 nt, Human
ccaguggguaggccauggugag

SEQ ID NO: 939351 - RNA, 22 nt, Human
cucagggcuugaguguccagga

SEQ ID NO: 939352 - RNA, 22 nt, Human
uuauuuaaaagugguaagauuc

SEQ ID NO: 939353 - RNA, 20 nt, Human
uccucagaagacauuugggg

SEQ ID NO: 939354 - RNA, 22 nt, Human
uggcagcagaacaugaaaccca

SEQ ID NO: 939355 - RNA, 22 nt, Human
uaaaucaguuucucuuauuggu

SEQ ID NO: 939356 - RNA, 22 nt, Human
cuggccacaugugugcugagca

SEQ ID NO: 939357 - RNA, 22 nt, Human
uaaggccaauuacauauguuca

SEQ ID NO: 939358 - RNA, 22 nt, Human
agccucuguagaaagcagugug

SEQ ID NO: 939359 - RNA, 23 nt, Human
gcagacagagcagacuaagacaa

SEQ ID NO: 939360 - RNA, 22 nt, Human
augcuuccaaggcuaagacaag

SEQ ID NO: 939361 - RNA, 22 nt, Human
agagcuggggccagagucaagg

SEQ ID NO: 939362 - RNA, 21 nt, Human
gcaggcuggucaaaccucagu

SEQ ID NO: 939363 - RNA, 22 nt, Human
cugggcacacagugacucugca

SEQ ID NO: 939364 - RNA, 22 nt, Human
cugggccaucagaggggcugga

SEQ ID NO: 939365 - RNA, 22 nt, Human
aaggccugggaggccucucuuc

SEQ ID NO: 939366 - RNA, 22 nt, Human
gugcaugucggggugcauguca

SEQ ID NO: 939367 - RNA, 22 nt, Human
auacaugucaucauauguuugu

SEQ ID NO: 939368 - RNA, 20 nt, Human
acauguacuaaugaauacag

SEQ ID NO: 939369 - RNA, 22 nt, Human
caguacuuugaagauauuuuag

SEQ ID NO: 939370 - RNA, 22 nt, Human
ggucccagaauugguuagcaca

SEQ ID NO: 939371 - RNA, 22 nt, Human
uugcaauagccuuauuuccaaa

SEQ ID NO: 939372 - RNA, 22 nt, Human
aucuggcuuuuacugaauugcu

SEQ ID NO: 939373 - RNA, 22 nt, Human
ucugggaacugagcuccccuag

SEQ ID NO: 939374 - RNA, 22 nt, Human
aagggagacaguugugugagga

SEQ ID NO: 939375 - RNA, 22 nt, Human
cucuuucaguucugauagucuc

SEQ ID NO: 939376 - RNA, 22 nt, Human
uagcugcugcagcacagggagg

SEQ ID NO: 939377 - RNA, 22 nt, Human
aagcugccugggaggaagggcu

SEQ ID NO: 939378 - RNA, 22 nt, Human
cauggcaggugcagauucugug

SEQ ID NO: 939379 - RNA, 22 nt, Human
gaggcagcagaacauggaagag

SEQ ID NO: 939380 - RNA, 22 nt, Human
ggagccagcagggugacacuga

SEQ ID NO: 939381 - RNA, 22 nt, Human
cucuucuugccugaugaggcag

SEQ ID NO: 939382 - RNA, 22 nt, Human
cagauggccagaggcagcugca

SEQ ID NO: 939383 - RNA, 22 nt, Human
cuuccugaacaaugccaucaau

SEQ ID NO: 939384 - RNA, 22 nt, Human
cccagcucucgcacuuacuagc

SEQ ID NO: 939385 - RNA, 22 nt, Human
auucuucacuguuucagaauga

SEQ ID NO: 939386 - RNA, 22 nt, Human
cugggaggcacuauucaggagg

SEQ ID NO: 939387 - RNA, 22 nt, Human
ggagugucagaaacaguguccu

SEQ ID NO: 939388 - RNA, 21 nt, Human
ucuccuggguccaacccaugc

SEQ ID NO: 939389 - RNA, 22 nt, Human
cucagcagugacaagagaguau

SEQ ID NO: 939390 - RNA, 22 nt, Human
ccucccuggccagagcagcagc

SEQ ID NO: 939391 - RNA, 22 nt, Human
cagaggcaggaagaugggcagu

SEQ ID NO: 939392 - RNA, 22 nt, Human
uaugcauagguaucuauacuca

SEQ ID NO: 939393 - RNA, 22 nt, Human
gugucauggaaaauugcaaugg

SEQ ID NO: 939394 - RNA, 21 nt, Human
aagagcuggaucaaggauaag

SEQ ID NO: 939395 - RNA, 22 nt, Human
cuguccccgcgaguccagagcu

SEQ ID NO: 939396 - RNA, 22 nt, Human
gggagcuggagcuggaagacuc

SEQ ID NO: 939397 - RNA, 22 nt, Human
cacaggagagcugggaggugcc

SEQ ID NO: 939398 - RNA, 20 nt, Human
gcuguucacauuauuaguag

SEQ ID NO: 939399 - RNA, 22 nt, Human
uuuucagaggccuaagagguuu

SEQ ID NO: 939400 - RNA, 22 nt, Human
ucccagaggcuccagucucuau

SEQ ID NO: 939401 - RNA, 20 nt, Human
gaacauuuggccauacugag

SEQ ID NO: 939402 - RNA, 22 nt, Human
ggccugcucaguccucuuucuu

SEQ ID NO: 939403 - RNA, 22 nt, Human
aauguucaaaagcaucagugaa

SEQ ID NO: 939404 - RNA, 22 nt, Human
gcccaggaguucaagucuagug

SEQ ID NO: 939405 - RNA, 22 nt, Human
cuggcucaauuuguacugcugu

SEQ ID NO: 939406 - RNA, 22 nt, Human
ucucugggaaugggccugggua

SEQ ID NO: 939407 - RNA, 22 nt, Human
gcacugaaugccaaaguguagg

SEQ ID NO: 939408 - RNA, 22 nt, Human
ucccagccuuucuuuucugcug

SEQ ID NO: 939409 - RNA, 22 nt, Human
ucaagcaggguagcaagcuggu

SEQ ID NO: 939410 - RNA, 22 nt, Human
gauuuccuagacauggggcaga

SEQ ID NO: 939411 - RNA, 22 nt, Human
aucagcaaguccuguuaauucu

SEQ ID NO: 939412 - RNA, 22 nt, Human
cuggcucaugugaugagggcaa

SEQ ID NO: 939413 - RNA, 22 nt, Human
aggugagguuugggagguguca

SEQ ID NO: 939414 - RNA, 22 nt, Human
ucucccacagucucccauggcu

SEQ ID NO: 939415 - RNA, 22 nt, Human
gggaccaggugggugcauuccg

SEQ ID NO: 939416 - RNA, 22 nt, Human
ggccagaaaguuaagcuguggc

SEQ ID NO: 939417 - RNA, 21 nt, Human
ugaaacacucuuuccaugaga

SEQ ID NO: 939418 - RNA, 22 nt, Human
guacaugucaaaaaaugcauaa

SEQ ID NO: 939419 - RNA, 22 nt, Human
cuuauguauaauguuccacaua

SEQ ID NO: 939420 - RNA, 23 nt, Human
ccaggccucucagagggugugcc

SEQ ID NO: 939421 - RNA, 19 nt, Human
caguggagauuggaggagg

SEQ ID NO: 939422 - RNA, 22 nt, Human
aaaggugacugcagcagcuauu

SEQ ID NO: 939423 - RNA, 22 nt, Human
gcuuccuucuaccacaucaugc

SEQ ID NO: 939424 - RNA, 22 nt, Human
ccuggccauagggcccaggaaa

SEQ ID NO: 939425 - RNA, 22 nt, Human
auuaaauuggaucugcauaguu

SEQ ID NO: 939426 - RNA, 22 nt, Human
uugcucaggcuuagagcuacua

SEQ ID NO: 939427 - RNA, 23 nt, Human
ucugucacuuucugcuguggagu

SEQ ID NO: 939428 - RNA, 18 nt, Human
ccagaggcccgggcaggc

SEQ ID NO: 939429 - RNA, 22 nt, Human
uaaaucagggagucaucugcga

SEQ ID NO: 939430 - RNA, 22 nt, Human
ucaggagucugugcaguuccac

SEQ ID NO: 939431 - RNA, 22 nt, Human
uauucacauuaauaagucuuca

SEQ ID NO: 939432 - RNA, 22 nt, Human
gccugguguccagaggcgagug

SEQ ID NO: 939433 - RNA, 22 nt, Human
cuggagcuaauaauccaucuga

SEQ ID NO: 939434 - RNA, 22 nt, Human
guggccuggauagacuccaucu

SEQ ID NO: 939435 - RNA, 22 nt, Human
cccuugggccccagcucagggc

SEQ ID NO: 939436 - RNA, 22 nt, Human
ugucucugagaugacucccacc

SEQ ID NO: 939437 - RNA, 22 nt, Human
aaaugcuacauacacaucaggg

SEQ ID NO: 939438 - RNA, 22 nt, Human
caaaugugguuucucagcauuc

SEQ ID NO: 939439 - RNA, 22 nt, Human
ucugucacaauuugcuuacucu

SEQ ID NO: 939440 - RNA, 22 nt, Human
cucucugaggaaggagcaucug

SEQ ID NO: 939441 - RNA, 22 nt, Human
cugcugagcaucagggcugccc

SEQ ID NO: 939442 - RNA, 22 nt, Human
cugccuuggaaaaugugguaau

SEQ ID NO: 939443 - RNA, 22 nt, Human
cagggcaguuuuacuucucucu

SEQ ID NO: 939444 - RNA, 22 nt, Human
ugaaauguaaauaggacuagaa

SEQ ID NO: 939445 - RNA, 23 nt, Human
ccagucucacguauacaggauuu

SEQ ID NO: 939446 - RNA, 22 nt, Human
aucaggaugcugucaguuacca

SEQ ID NO: 939447 - RNA, 22 nt, Human
gccuugcuuugcuucuggacag

SEQ ID NO: 939448 - RNA, 22 nt, Human
gugccugcagcaauccauggca

SEQ ID NO: 939449 - RNA, 22 nt, Human
ugcaggccucacaccuggcacc

SEQ ID NO: 939450 - RNA, 22 nt, Human
caggugggaccaugauagggca

SEQ ID NO: 939451 - RNA, 19 nt, Human
ugaaauggcaguugcuaaa

SEQ ID NO: 939452 - RNA, 22 nt, Human
cuggccuuuaaaaugaccuuau

SEQ ID NO: 939453 - RNA, 22 nt, Human
ugagccagguuaagacaggagc

SEQ ID NO: 939454 - RNA, 22 nt, Human
aaaaugcucaucagcgauggcu

SEQ ID NO: 939455 - RNA, 22 nt, Human
aggguggcugaguagauggaag

SEQ ID NO: 939456 - RNA, 20 nt, Human
augauuuugcacuaacuuca

SEQ ID NO: 939457 - RNA, 22 nt, Human
uggcuggggccacaguuuuccu

SEQ ID NO: 939458 - RNA, 22 nt, Human
cagggaggaugggcuguuuugc

SEQ ID NO: 939459 - RNA, 22 nt, Human
auuuagaaauuccaaaaguauu

SEQ ID NO: 939460 - RNA, 22 nt, Human
aagaugauaggacuugcuuaag

SEQ ID NO: 939461 - RNA, 22 nt, Human
acaaagucacaauaauuaaccu

SEQ ID NO: 939462 - RNA, 22 nt, Human
ugcagaggaccauuguccugga

SEQ ID NO: 939463 - RNA, 22 nt, Human
ugucuguacaaauuuucugugu

SEQ ID NO: 939464 - RNA, 22 nt, Human
ccuguucaccauggucacgugc

SEQ ID NO: 939465 - RNA, 22 nt, Human
aaauugcauuuuaaagguagau

SEQ ID NO: 939466 - RNA, 22 nt, Human
cugagggccuuggcuccugccc

SEQ ID NO: 939467 - RNA, 22 nt, Human
caggugcccagcuccugcugug

SEQ ID NO: 939468 - RNA, 22 nt, Human
accaggagaggcacuugcaaug

SEQ ID NO: 939469 - RNA, 20 nt, Human
gagauggcuaagugcugaac

SEQ ID NO: 939470 - RNA, 22 nt, Human
caaauaguuuuucauguauuau

SEQ ID NO: 939471 - RNA, 22 nt, Human
uuuccucacuucaugagaguuu

SEQ ID NO: 939472 - RNA, 20 nt, Human
cagagcuguuauggaugaug

SEQ ID NO: 939473 - RNA, 22 nt, Human
ugcagcucugaacagucaugaa

SEQ ID NO: 939474 - RNA, 22 nt, Human
uuccuccacgugacaggagcca

SEQ ID NO: 939475 - RNA, 22 nt, Human
ugcccaggguggagugcagcgg

SEQ ID NO: 939476 - RNA, 22 nt, Human
uuagagucaaaauggcauguua

SEQ ID NO: 939477 - RNA, 22 nt, Human
gaagcagcuuucuggugaggag

SEQ ID NO: 939478 - RNA, 22 nt, Human
cucuuuaaaguaaaauuugucu

SEQ ID NO: 939479 - RNA, 22 nt, Human
cuaauuuucccaaggccuucua

SEQ ID NO: 939480 - RNA, 22 nt, Human
aacaaauggggccuuguaugaa

SEQ ID NO: 939481 - RNA, 23 nt, Human
aggcagagccaaggucaaaaccc

SEQ ID NO: 939482 - RNA, 21 nt, Human
ucagaguggaagacaguuuga

SEQ ID NO: 939483 - RNA, 22 nt, Human
uugggugcugucauggggcacg

SEQ ID NO: 939484 - RNA, 22 nt, Human
acacugaauguuuaagaacuug

SEQ ID NO: 939485 - RNA, 22 nt, Human
aaaaaugaaacggcugguuggc

SEQ ID NO: 939486 - RNA, 22 nt, Human
ucagaagccggaagugcuccuc

SEQ ID NO: 939487 - RNA, 22 nt, Human
ggccugcugcuaugacuuccug

SEQ ID NO: 939488 - RNA, 22 nt, Human
gagcugagccuggguggaccgc

SEQ ID NO: 939489 - RNA, 20 nt, Human
auacaaagagauugauguau

SEQ ID NO: 939490 - RNA, 22 nt, Human
uuauuuauggcacuguuggugg

SEQ ID NO: 939491 - RNA, 22 nt, Human
aauucuugguccuaguguauaa

SEQ ID NO: 939492 - RNA, 22 nt, Human
agcuggcagucauccuagugag

SEQ ID NO: 939493 - RNA, 22 nt, Human
cagugcugggcagaggagagcg

SEQ ID NO: 939494 - RNA, 22 nt, Human
gaaaucugcggugaggccugag

SEQ ID NO: 939495 - RNA, 22 nt, Human
auaaggcagucccuuaacaagg

SEQ ID NO: 939496 - RNA, 22 nt, Human
gugcugucguggaacugggcug

SEQ ID NO: 939497 - RNA, 22 nt, Human
guccucagggaauguggcgggu

SEQ ID NO: 939498 - RNA, 22 nt, Human
augugcauuaaaugucaauguu

SEQ ID NO: 939499 - RNA, 22 nt, Human
caaaguuuaaaguagauuucag

SEQ ID NO: 939500 - RNA, 22 nt, Human
cucuggcuuugcucaugcaucc

SEQ ID NO: 939501 - RNA, 22 nt, Human
ucucagagcuucaguuauuuuc

SEQ ID NO: 939502 - RNA, 22 nt, Human
gccaggcucagcagucaaccug

SEQ ID NO: 939503 - RNA, 22 nt, Human
agcuggagaucaugcugauacu

SEQ ID NO: 939504 - RNA, 22 nt, Human
gccugcugaaccucaugcaguc

SEQ ID NO: 939505 - RNA, 22 nt, Human
uaaguauguuagaaaaucaagu

SEQ ID NO: 939506 - RNA, 22 nt, Human
uugaaaggugcugugugcugau

SEQ ID NO: 939507 - RNA, 22 nt, Human
cacagcuuguuuagugacucac

SEQ ID NO: 939508 - RNA, 21 nt, Human
agggagcuggccacacagccu

SEQ ID NO: 939509 - RNA, 22 nt, Human
gucauugcaguggcaaaucaca

SEQ ID NO: 939510 - RNA, 20 nt, Human
agcccaggccugugugaguc

SEQ ID NO: 939511 - RNA, 22 nt, Human
cagggcaggaugcugugauuau

SEQ ID NO: 939512 - RNA, 22 nt, Human
ggacacagauaaucacacagau

SEQ ID NO: 939513 - RNA, 22 nt, Human
ucuggcucucauacucgccagu

SEQ ID NO: 939514 - RNA, 18 nt, Human
ucagcuggggcugcagcc

SEQ ID NO: 939515 - RNA, 22 nt, Human
ccaugagccaggcugaggaagc

SEQ ID NO: 939516 - RNA, 22 nt, Human
ucagagucucccccaguuuggg

SEQ ID NO: 939517 - RNA, 22 nt, Human
aacuagucagugauucucagaa

SEQ ID NO: 939518 - RNA, 22 nt, Human
gucucagaccacccucuuuggc

SEQ ID NO: 939519 - RNA, 22 nt, Human
agcuuuauuugucauucacggc

SEQ ID NO: 939520 - RNA, 22 nt, Human
augugaggaagaaagagguaag

SEQ ID NO: 939521 - RNA, 22 nt, Human
gauuaggacauggauguauguu

SEQ ID NO: 939522 - RNA, 22 nt, Human
caggauggucuucauuuggcuc

SEQ ID NO: 939523 - RNA, 22 nt, Human
uggggcacuuaugaugugccac

SEQ ID NO: 939524 - RNA, 22 nt, Human
ugcaggaacugggagggauagu

SEQ ID NO: 939525 - RNA, 22 nt, Human
ugcugccagagagacagggacu

SEQ ID NO: 939526 - RNA, 22 nt, Human
ucugccacuuuugcuuacuggg

SEQ ID NO: 939527 - RNA, 22 nt, Human
gcagaggacagggauuuagauu

SEQ ID NO: 939528 - RNA, 22 nt, Human
ccaggacagugaacauguaaga

SEQ ID NO: 939529 - RNA, 22 nt, Human
uuccagaagccuccauauuacu

SEQ ID NO: 939530 - RNA, 22 nt, Human
aggacugggugcagagggcauc

SEQ ID NO: 939531 - RNA, 22 nt, Human
ucaguucugcuagaaaaacagu

SEQ ID NO: 939532 - RNA, 22 nt, Human
ugacacaggcagcucccagcac

SEQ ID NO: 939533 - RNA, 22 nt, Human
cagcuggcagaaccugcaucca

SEQ ID NO: 939534 - RNA, 22 nt, Human
uuucaacaggaugauaauaggc

SEQ ID NO: 939535 - RNA, 22 nt, Human
uccucugcuggaagggcaagag

SEQ ID NO: 939536 - RNA, 22 nt, Human
gaagagcugacagugucauccu

SEQ ID NO: 939537 - RNA, 22 nt, Human
ccagcugguuaaaauagagaaa

SEQ ID NO: 939538 - RNA, 21 nt, Human
gggcuggacaugguggcucau

SEQ ID NO: 939539 - RNA, 22 nt, Human
guuauuagaagugaaggauugu

SEQ ID NO: 939540 - RNA, 22 nt, Human
gggcagcagaggaucccuuaau

SEQ ID NO: 939541 - RNA, 22 nt, Human
ucagucucaucaacucuauucc

SEQ ID NO: 939542 - RNA, 22 nt, Human
uuuauguuugacaaugaucugg

SEQ ID NO: 939543 - RNA, 23 nt, Human
agucuuaauacagcucuuuucua

SEQ ID NO: 939544 - RNA, 22 nt, Human
uggccugcagcucucagggaag

SEQ ID NO: 939545 - RNA, 22 nt, Human
gggcacugugcuaggugcugag

SEQ ID NO: 939546 - RNA, 22 nt, Human
cauggcugcgagaagagugggu

SEQ ID NO: 939547 - RNA, 22 nt, Human
acagccagggcauugucgccga

SEQ ID NO: 939548 - RNA, 22 nt, Human
uggcagaguucgcugugccuuu

SEQ ID NO: 939549 - RNA, 22 nt, Human
cagggcccauggcucagguagg

SEQ ID NO: 939550 - RNA, 22 nt, Human
ccuuggagcggucagcacuggu

SEQ ID NO: 939551 - RNA, 22 nt, Human
acauuucugagcagggagcugu

SEQ ID NO: 939552 - RNA, 22 nt, Human
uggccugguuguugcugccguu

SEQ ID NO: 939553 - RNA, 22 nt, Human
cacccaggcuagagugcagugg

SEQ ID NO: 939554 - RNA, 22 nt, Human
ugggccugggucuuugcugcca

SEQ ID NO: 939555 - RNA, 22 nt, Human
uagcaggguaaauguagaugga

SEQ ID NO: 939556 - RNA, 22 nt, Human
gggcuggaggugagcaggacag

SEQ ID NO: 939557 - RNA, 22 nt, Human
ugcucauuggcgaucugaggga

SEQ ID NO: 939558 - RNA, 22 nt, Human
gccuuugcaccaucagugcaau

SEQ ID NO: 939559 - RNA, 22 nt, Human
auggcccaggccuccuguggcu

SEQ ID NO: 939560 - RNA, 22 nt, Human
gaaggccauuuuuagguagaau

SEQ ID NO: 939561 - RNA, 22 nt, Human
ugucucaggcccaagccaguaa

SEQ ID NO: 939562 - RNA, 22 nt, Human
agaggccaguggcugugcuguc

SEQ ID NO: 939563 - RNA, 22 nt, Human
cuucaagauccauagauauugc

SEQ ID NO: 939564 - RNA, 22 nt, Human
ugggacaguuguccuccacucu

SEQ ID NO: 939565 - RNA, 22 nt, Human
aggcuccaugcaaaggcuguuu

SEQ ID NO: 939566 - RNA, 22 nt, Human
augugucaauuuucaaaugcuu

SEQ ID NO: 939567 - RNA, 22 nt, Human
uagcagaagaaauucagaguug

SEQ ID NO: 939568 - RNA, 22 nt, Human
uuggcacacaguaagcccuaag

SEQ ID NO: 939569 - RNA, 22 nt, Human
agagaacaaauuaaaggugguu

SEQ ID NO: 939570 - RNA, 22 nt, Human
aaaagagucuuaggcagucaua

SEQ ID NO: 939571 - RNA, 22 nt, Human
uuacauuuuaguuaaccuguga

SEQ ID NO: 939572 - RNA, 22 nt, Human
ugaugauguuuaucuugguauu

SEQ ID NO: 939573 - RNA, 22 nt, Human
cagaaugcaaauuuuauaauau

SEQ ID NO: 939574 - RNA, 22 nt, Human
caaaguuaugaaugauaagauu

SEQ ID NO: 939575 - RNA, 22 nt, Human
uuguguuucuggccaagaugga

SEQ ID NO: 939576 - RNA, 21 nt, Human
acagcagacaggcuuaggacc

SEQ ID NO: 939577 - RNA, 22 nt, Human
ugaugaauaaacuugagaguca

SEQ ID NO: 939578 - RNA, 22 nt, Human
aagugagugguaaggagcaugg

SEQ ID NO: 939579 - RNA, 22 nt, Human
caggcagcauuuacucugauga

SEQ ID NO: 939580 - RNA, 22 nt, Human
acuggcaguggcagcagaaaga

SEQ ID NO: 939581 - RNA, 22 nt, Human
ugagcccagagcccuuguaggg

SEQ ID NO: 939582 - RNA, 22 nt, Human
ugugccugaguuggcugaguac

SEQ ID NO: 939583 - RNA, 22 nt, Human
aaaugcagauugucauucagga

SEQ ID NO: 939584 - RNA, 22 nt, Human
acaaaguuaacaguuggauagu

SEQ ID NO: 939585 - RNA, 19 nt, Human
uuagccauccacagugaaa

SEQ ID NO: 939586 - RNA, 21 nt, Human
aggucagcccagcucuggaag

SEQ ID NO: 939587 - RNA, 22 nt, Human
gugauuucagguuuuucauacu

SEQ ID NO: 939588 - RNA, 23 nt, Human
cuggcucuguagguggcauccuu

SEQ ID NO: 939589 - RNA, 22 nt, Human
aucuauuaugcugagaaacugu

SEQ ID NO: 939590 - RNA, 22 nt, Human
ggccacaagugguccugagucc

SEQ ID NO: 939591 - RNA, 22 nt, Human
uggccuggcagagcaaggccug

SEQ ID NO: 939592 - RNA, 18 nt, Human
ugucucugaauuccagug

SEQ ID NO: 939593 - RNA, 22 nt, Human
gccuggccugaacuaggaggug

SEQ ID NO: 939594 - RNA, 22 nt, Human
gcacagcucgagcucaggaggg

SEQ ID NO: 939595 - RNA, 22 nt, Human
ugagagagccugaaucucuuac

SEQ ID NO: 939596 - RNA, 22 nt, Human
aagcccagcaucccugcaccag

SEQ ID NO: 939597 - RNA, 21 nt, Human
cagaggggcuagccuggcugc

SEQ ID NO: 939598 - RNA, 22 nt, Human
aggcaguguguagcuggaagag

SEQ ID NO: 939599 - RNA, 20 nt, Human
cuucaggacccauccucccc

SEQ ID NO: 939600 - RNA, 22 nt, Human
ugaaaugaaacagaacauauca

SEQ ID NO: 939601 - RNA, 19 nt, Human
gcacccugaggucauggcc

SEQ ID NO: 939602 - RNA, 22 nt, Human
auuuugaaaagcauuugaguaa

SEQ ID NO: 939603 - RNA, 22 nt, Human
gcuggccauggccugcgccauc

SEQ ID NO: 939604 - RNA, 22 nt, Human
guuagaaacacauucuuauuga

SEQ ID NO: 939605 - RNA, 22 nt, Human
uuaggaaauuaugguuucagau

SEQ ID NO: 939606 - RNA, 22 nt, Human
ucacaugcagucacugagcagg

SEQ ID NO: 939607 - RNA, 22 nt, Human
aaccauuugcaguuacugagac

SEQ ID NO: 939608 - RNA, 21 nt, Human
cccaggaguccuauuuaaaug

SEQ ID NO: 939609 - RNA, 22 nt, Human
gccaggcugcuccagggaggcc

SEQ ID NO: 939610 - RNA, 22 nt, Human
ugggaaauguguuucuggacca

SEQ ID NO: 939611 - RNA, 22 nt, Human
auccaguucucagugcuuacag

SEQ ID NO: 939612 - RNA, 22 nt, Human
cagcacuggggccacuggaguu

SEQ ID NO: 939613 - RNA, 22 nt, Human
aaaugcagguucuugagccaag

SEQ ID NO: 939614 - RNA, 22 nt, Human
uggcccugcuaugauccugcaa

SEQ ID NO: 939615 - RNA, 22 nt, Human
cugccugcugccuguggagggu

SEQ ID NO: 939616 - RNA, 22 nt, Human
cuggagcauccaugcccagggu

SEQ ID NO: 939617 - RNA, 22 nt, Human
ccuccuggagcauuggugagga

SEQ ID NO: 939618 - RNA, 22 nt, Human
uuucacauguggaaugccaggu

SEQ ID NO: 939619 - RNA, 22 nt, Human
ugaugaaaauaugauucugagg

SEQ ID NO: 939620 - RNA, 19 nt, Human
gaggcgaggcgugcaggag

SEQ ID NO: 939621 - RNA, 22 nt, Human
guagccauuggcaaugaagccu

SEQ ID NO: 939622 - RNA, 22 nt, Human
caccagggcucugagcucugaa

SEQ ID NO: 939623 - RNA, 18 nt, Human
ucacagugcucuugccua

SEQ ID NO: 939624 - RNA, 22 nt, Human
uucaugcuuuuaccgcuguuaa

SEQ ID NO: 939625 - RNA, 22 nt, Human
gcagauggcucagacacugggg

SEQ ID NO: 939626 - RNA, 22 nt, Human
acucugccaucccaggugcugu

SEQ ID NO: 939627 - RNA, 22 nt, Human
gcuuccugauauucauacuguu

SEQ ID NO: 939628 - RNA, 22 nt, Human
ccucacuggccagccaggggug

SEQ ID NO: 939629 - RNA, 20 nt, Human
ggggcugcaugcagagaaga

SEQ ID NO: 939630 - RNA, 22 nt, Human
agauuucagaugcucggcaguu

SEQ ID NO: 939631 - RNA, 22 nt, Human
gagagugaggccugggaaucua

SEQ ID NO: 939632 - RNA, 22 nt, Human
aagaugauagaucugucaaugu

SEQ ID NO: 939633 - RNA, 23 nt, Human
caguacuuaguguagcguuaauu

SEQ ID NO: 939634 - RNA, 22 nt, Human
ucacaacuugaagcugauuuaa

SEQ ID NO: 939635 - RNA, 22 nt, Human
cugggacacccagagcugcaga

SEQ ID NO: 939636 - RNA, 22 nt, Human
ggcagcaucucuggcagcagcu

SEQ ID NO: 939637 - RNA, 23 nt, Human
agacccagagacuggcucugcuc

SEQ ID NO: 939638 - RNA, 22 nt, Human
agucucugcaugaugcagcaca

SEQ ID NO: 939639 - RNA, 22 nt, Human
guacauuucauuuaaaugaugu

SEQ ID NO: 939640 - RNA, 22 nt, Human
ccugucugaaggcagggggaug

SEQ ID NO: 939641 - RNA, 22 nt, Human
aguaggaggcgggagcaugaag

SEQ ID NO: 939642 - RNA, 18 nt, Human
ucuuggcagcaucuggca

SEQ ID NO: 939643 - RNA, 22 nt, Human
ggcugccaggagggaggccagu

SEQ ID NO: 939644 - RNA, 22 nt, Human
uuccaguucccaugaggauuaa

SEQ ID NO: 939645 - RNA, 22 nt, Human
ugaaggccagggauuugcagcc

SEQ ID NO: 939646 - RNA, 22 nt, Human
agagggaucacccuguuucugg

SEQ ID NO: 939647 - RNA, 22 nt, Human
ucuaaccuuugaaacugcuuuc

SEQ ID NO: 939648 - RNA, 22 nt, Human
gggaagcaggugcagcucgccu

SEQ ID NO: 939649 - RNA, 22 nt, Human
cuccaggccauggcugcggagg

SEQ ID NO: 939650 - RNA, 22 nt, Human
cugggccaucuccuuugugugg

SEQ ID NO: 939651 - RNA, 22 nt, Human
aaaugugcuugugaucagcugu

SEQ ID NO: 939652 - RNA, 22 nt, Human
aucaggauucaccccagagcug

SEQ ID NO: 939653 - RNA, 22 nt, Human
ggcugagcacuuuaggcaggag

SEQ ID NO: 939654 - RNA, 22 nt, Human
uagagcugcuggacuguaacag

SEQ ID NO: 939655 - RNA, 22 nt, Human
acuccugguucccaguugagau

SEQ ID NO: 939656 - RNA, 22 nt, Human
gggcaagcucuucagaagcucu

SEQ ID NO: 939657 - RNA, 22 nt, Human
gcaggagaaaugaagauugggu

SEQ ID NO: 939658 - RNA, 22 nt, Human
aaaacucugcaguuaguuucua

SEQ ID NO: 939659 - RNA, 23 nt, Human
aaaguguagccagguuaagaacc

SEQ ID NO: 939660 - RNA, 22 nt, Human
uggccuggggaccugugagacc

SEQ ID NO: 939661 - RNA, 23 nt, Human
ucaguuuuggcuguucaguguug

SEQ ID NO: 939662 - RNA, 22 nt, Human
guccugucccccaaggcugugg

SEQ ID NO: 939663 - RNA, 22 nt, Human
auucuucacauggauaggaucu

SEQ ID NO: 939664 - RNA, 22 nt, Human
gggcagcuggauaguuuuaaau

SEQ ID NO: 939665 - RNA, 22 nt, Human
cuuucacagcugugcuuaugau

SEQ ID NO: 939666 - RNA, 22 nt, Human
acuuugaaggggaacauuuuaa

SEQ ID NO: 939667 - RNA, 20 nt, Human
uggagcuguaaucuugucug

SEQ ID NO: 939668 - RNA, 22 nt, Human
uggagucugugaugcucugggu

SEQ ID NO: 939669 - RNA, 22 nt, Human
aucuauuucugcuaauaacaau

SEQ ID NO: 939670 - RNA, 22 nt, Human
ugggcagauguggcucuccuug

SEQ ID NO: 939671 - RNA, 22 nt, Human
ugaaggcccuaucuccauauac

SEQ ID NO: 939672 - RNA, 22 nt, Human
aacucuggagcacgcccuggcc

SEQ ID NO: 939673 - RNA, 22 nt, Human
aaauauguauggaguucaugaa

SEQ ID NO: 939674 - RNA, 22 nt, Human
agaggacaaaaugagaagugcu

SEQ ID NO: 939675 - RNA, 22 nt, Human
cuggcucauagagcagcuccaa

SEQ ID NO: 939676 - RNA, 22 nt, Human
gcugcuccgucugagcucuggu

SEQ ID NO: 939677 - RNA, 22 nt, Human
cagaguguuucuuugggugggu

SEQ ID NO: 939678 - RNA, 22 nt, Human
ggccccugcggacugccuagag

SEQ ID NO: 939679 - RNA, 22 nt, Human
gcagaugguggggcaggaaaau

SEQ ID NO: 939680 - RNA, 22 nt, Human
ccuuagagaguacugggcugcc

SEQ ID NO: 939681 - RNA, 22 nt, Human
uccaucagauucccuccugaga

SEQ ID NO: 939682 - RNA, 21 nt, Human
ugugugcauaugcauguacau

SEQ ID NO: 939683 - RNA, 22 nt, Human
uuucuucucgacaccuuauccc

SEQ ID NO: 939684 - RNA, 22 nt, Human
auauuagggucucuaaauucua

SEQ ID NO: 939685 - RNA, 22 nt, Human
ugcugaaaacucaaccauugug

SEQ ID NO: 939686 - RNA, 22 nt, Human
cucuggacagcaggugcugugg

SEQ ID NO: 939687 - RNA, 22 nt, Human
ccucagaugucuuaaggcacug

SEQ ID NO: 939688 - RNA, 22 nt, Human
cugggcacaggggagcagaguc

SEQ ID NO: 939689 - RNA, 22 nt, Human
ggcagcaguccauggcccaagg

SEQ ID NO: 939690 - RNA, 22 nt, Human
ggagugggaacaaugacauggu

SEQ ID NO: 939691 - RNA, 21 nt, Human
ccccugggagcccugucagua

SEQ ID NO: 939692 - RNA, 22 nt, Human
cacauuucugugagucaauauu

SEQ ID NO: 939693 - RNA, 22 nt, Human
ggggcacacuuuugguagauau

SEQ ID NO: 939694 - RNA, 22 nt, Human
uuacaggggacauuggggacau

SEQ ID NO: 939695 - RNA, 19 nt, Human
cccuggcaggcaagccugg

SEQ ID NO: 939696 - RNA, 19 nt, Human
gucucugcuccagggucuc

SEQ ID NO: 939697 - RNA, 22 nt, Human
uugaacugguaguuggaaaucu

SEQ ID NO: 939698 - RNA, 22 nt, Human
uaguuaaaauaauggagauguu

SEQ ID NO: 939699 - RNA, 22 nt, Human
augugagguaucuaggucuucg

SEQ ID NO: 939700 - RNA, 22 nt, Human
ugugcaggugcaggaagggggc

SEQ ID NO: 939701 - RNA, 21 nt, Human
cugcaucucauagaacauguc

SEQ ID NO: 939702 - RNA, 22 nt, Human
cagccuuuaagcuuggauaggu

SEQ ID NO: 939703 - RNA, 22 nt, Human
caucagcagucacaugaugcug

SEQ ID NO: 939704 - RNA, 22 nt, Human
agcugccacugagggugcacag

SEQ ID NO: 939705 - RNA, 20 nt, Human
uccuggccucccuggggcuc

SEQ ID NO: 939706 - RNA, 22 nt, Human
gaggggcucuugggcaugaagg

SEQ ID NO: 939707 - RNA, 22 nt, Human
auggccaagcuuacucuguugu

SEQ ID NO: 939708 - RNA, 22 nt, Human
cagagccaacgccaccugccca

SEQ ID NO: 939709 - RNA, 20 nt, Human
uccugcaguuccuaggaggg

SEQ ID NO: 939710 - RNA, 22 nt, Human
uuccucucgcucuccggggccc

SEQ ID NO: 939711 - RNA, 22 nt, Human
acugagcucuugacugggaguu

SEQ ID NO: 939712 - RNA, 22 nt, Human
ccaggagacaaagaugacugcu

SEQ ID NO: 939713 - RNA, 22 nt, Human
aggcugagauagguggaucauu

SEQ ID NO: 939714 - RNA, 22 nt, Human
gggagcugaauggcaauggaga

SEQ ID NO: 939715 - RNA, 22 nt, Human
cauuuguuaauuacuauuaucu

SEQ ID NO: 939716 - RNA, 18 nt, Human
cugcccagagcauuucau

SEQ ID NO: 939717 - RNA, 22 nt, Human
gggcagggguagcauuccaagu

SEQ ID NO: 939718 - RNA, 21 nt, Human
gcagacugcccugcugucccc

SEQ ID NO: 939719 - RNA, 22 nt, Human
cauuaaaauaucucaugguguu

SEQ ID NO: 939720 - RNA, 22 nt, Human
uccauggggcccaggaugagag

SEQ ID NO: 939721 - RNA, 22 nt, Human
ccucaggggucacugugaggag

SEQ ID NO: 939722 - RNA, 22 nt, Human
gcaugguggccuuaggguagcc

SEQ ID NO: 939723 - RNA, 22 nt, Human
ggcaguggaggacccugugucu

SEQ ID NO: 939724 - RNA, 22 nt, Human
cuccagggagcuguggagguuu

SEQ ID NO: 939725 - RNA, 20 nt, Human
acaaaauagguacuggguag

SEQ ID NO: 939726 - RNA, 22 nt, Human
acagagccaaaaggacauagua

SEQ ID NO: 939727 - RNA, 22 nt, Human
gcucccugacucaguuccugag

SEQ ID NO: 939728 - RNA, 22 nt, Human
cuccucccucuuugccacacau

SEQ ID NO: 939729 - RNA, 22 nt, Human
aggucauuguuaagucaccaua

SEQ ID NO: 939730 - RNA, 22 nt, Human
agcugcagauucuaucuagaag

SEQ ID NO: 939731 - RNA, 22 nt, Human
acauuucuccuugcaggaguca

SEQ ID NO: 939732 - RNA, 20 nt, Human
cccuggagagaagcuccacg

SEQ ID NO: 939733 - RNA, 22 nt, Human
guacuuccagccaagugagaca

SEQ ID NO: 939734 - RNA, 22 nt, Human
gacccaggagagaggguugcau

SEQ ID NO: 939735 - RNA, 22 nt, Human
auguccuucuccucuuaccugc

SEQ ID NO: 939736 - RNA, 23 nt, Human
uuucuucagaagccuugcgaggc

SEQ ID NO: 939737 - RNA, 22 nt, Human
caguacuuugcaucauuccacu

SEQ ID NO: 939738 - RNA, 22 nt, Human
guauuugauacaugaaauggug

SEQ ID NO: 939739 - RNA, 16 nt, Human
ugggcagaugagaaga

SEQ ID NO: 939740 - RNA, 22 nt, Human
uccauugucuuugguccuagcc

SEQ ID NO: 939741 - RNA, 22 nt, Human
gggcuucucccuaaggacucug

SEQ ID NO: 939742 - RNA, 22 nt, Human
ugaggcaguauucuccauucca

SEQ ID NO: 939743 - RNA, 22 nt, Human
cauugcaccacauugcaucccu

SEQ ID NO: 939744 - RNA, 22 nt, Human
cacuccuguuccacuaaaugag

SEQ ID NO: 939745 - RNA, 22 nt, Human
aauaugcauguauacaugugua

SEQ ID NO: 939746 - RNA, 22 nt, Human
ugggccuggguuccuccugggc

SEQ ID NO: 939747 - RNA, 22 nt, Human
gcuggcucagggacuagaguuu

SEQ ID NO: 939748 - RNA, 22 nt, Human
aggucaaguuuagauagaguua

SEQ ID NO: 939749 - RNA, 22 nt, Human
cugggacagcugagacaggaga

SEQ ID NO: 939750 - RNA, 22 nt, Human
uggcugaaucugcagcaggaag

SEQ ID NO: 939751 - RNA, 22 nt, Human
ccaggagacuguacugauauuu

SEQ ID NO: 939752 - RNA, 20 nt, Human
gcugccuguuucuguaagua

SEQ ID NO: 939753 - RNA, 22 nt, Human
aggcagacugugcgggaagagu

SEQ ID NO: 939754 - RNA, 22 nt, Human
ucacagggauggaauagaaaua

SEQ ID NO: 939755 - RNA, 22 nt, Human
uccaaauucuagggccuugguu

SEQ ID NO: 939756 - RNA, 22 nt, Human
ucaugaaucguggaaugauuua

SEQ ID NO: 939757 - RNA, 22 nt, Human
ccugggcuuucaaaaccagccu

SEQ ID NO: 939758 - RNA, 20 nt, Human
ucagaugggagugagccauc

SEQ ID NO: 939759 - RNA, 20 nt, Human
cugugccuaaaccuccgggu

SEQ ID NO: 939760 - RNA, 22 nt, Human
gaaagagaaccugggccuagau

SEQ ID NO: 939761 - RNA, 22 nt, Human
auaugcauaugucaaaacuuau

SEQ ID NO: 939762 - RNA, 22 nt, Human
gcuggccucaucacugacuucu

SEQ ID NO: 939763 - RNA, 22 nt, Human
ucagugucuugggcuugaaugc

SEQ ID NO: 939764 - RNA, 22 nt, Human
ugagaaccaugaaaagcuguca

SEQ ID NO: 939765 - RNA, 22 nt, Human
accaggagccacaggaggagcc

SEQ ID NO: 939766 - RNA, 22 nt, Human
gcagagugggagcccagggcug

SEQ ID NO: 939767 - RNA, 20 nt, Human
uugaggagauauugaauacu

SEQ ID NO: 939768 - RNA, 22 nt, Human
acugucugcccugagaugccag

SEQ ID NO: 939769 - RNA, 22 nt, Human
caaauagugucacauugugagg

SEQ ID NO: 939770 - RNA, 22 nt, Human
uguaggauuuucaccagaccuu

SEQ ID NO: 939771 - RNA, 22 nt, Human
cugcccuguuuggacagcccgg

SEQ ID NO: 939772 - RNA, 22 nt, Human
cuggguggcgucuggggccagu

SEQ ID NO: 939773 - RNA, 22 nt, Human
ccuggcagacugugagggcagg

SEQ ID NO: 939774 - RNA, 23 nt, Human
ucuuuccucagcacacaccaaga

SEQ ID NO: 939775 - RNA, 22 nt, Human
uucaagauggcaccagugagug

SEQ ID NO: 939776 - RNA, 22 nt, Human
ucaucacauaugucaugauuug

SEQ ID NO: 939777 - RNA, 21 nt, Human
ggagucauuagucauuuccuu

SEQ ID NO: 939778 - RNA, 19 nt, Human
ccugggagucagcugaagg

SEQ ID NO: 939779 - RNA, 22 nt, Human
cuucuaggcuucucagggggca

SEQ ID NO: 939780 - RNA, 22 nt, Human
cccucugcugccuggcuggguc

SEQ ID NO: 939781 - RNA, 22 nt, Human
ucaggauccauagacucccaaa

SEQ ID NO: 939782 - RNA, 22 nt, Human
acugcagcaaagcccgugucuu

SEQ ID NO: 939783 - RNA, 22 nt, Human
gggacugggagauccuccuggc

SEQ ID NO: 939784 - RNA, 22 nt, Human
uuauguauggauggcugaaagu

SEQ ID NO: 939785 - RNA, 22 nt, Human
ccaggagcagauauggacauaa

SEQ ID NO: 939786 - RNA, 22 nt, Human
ucccagagccucugccacucug

SEQ ID NO: 939787 - RNA, 22 nt, Human
aaguaugcaaaucgucuuagaa

SEQ ID NO: 939788 - RNA, 20 nt, Human
aauauaauucucugaauuua

SEQ ID NO: 939789 - RNA, 22 nt, Human
ggcuccuggcaucuggugggua

SEQ ID NO: 939790 - RNA, 22 nt, Human
ccagcagaagcucccgcugggu

SEQ ID NO: 939791 - RNA, 22 nt, Human
caccagcuuugcccacugccca

SEQ ID NO: 939792 - RNA, 22 nt, Human
ccugugugcugaugacgacaga

SEQ ID NO: 939793 - RNA, 22 nt, Human
caggguagacaguaggugucug

SEQ ID NO: 939794 - RNA, 22 nt, Human
ucaaaugcacguagagaaaaua

SEQ ID NO: 939795 - RNA, 22 nt, Human
gucccuuggcucacaaacagcu

SEQ ID NO: 939796 - RNA, 22 nt, Human
auguuucagauacagaucaaau

SEQ ID NO: 939797 - RNA, 22 nt, Human
cugugcuugcggguguggagcc

SEQ ID NO: 939798 - RNA, 22 nt, Human
agaagccaacagggcaggagag

SEQ ID NO: 939799 - RNA, 22 nt, Human
agaugguguuuccccaggugga

SEQ ID NO: 939800 - RNA, 22 nt, Human
augggaggguggaaaggcucug

SEQ ID NO: 939801 - RNA, 22 nt, Human
uagaaacagcauauauuagccc

SEQ ID NO: 939802 - RNA, 17 nt, Human
uagagcugguucaggag

SEQ ID NO: 939803 - RNA, 22 nt, Human
gaggccaggaagcccaagauca

SEQ ID NO: 939804 - RNA, 22 nt, Human
auggggcuguucucugcccugc

SEQ ID NO: 939805 - RNA, 22 nt, Human
caagagcuacccugugccauau

SEQ ID NO: 939806 - RNA, 22 nt, Human
ucauugcagaaauaaaggugaa

SEQ ID NO: 939807 - RNA, 22 nt, Human
uugaagagugccuuccagacau

SEQ ID NO: 939808 - RNA, 22 nt, Human
ucaacacuauccaggcaaucuu

SEQ ID NO: 939809 - RNA, 22 nt, Human
uuucuuaguccuagagugauuu

SEQ ID NO: 939810 - RNA, 22 nt, Human
agagcccuuucuccaggcaccu

SEQ ID NO: 939811 - RNA, 22 nt, Human
gcugucugggaggccuccacuu

SEQ ID NO: 939812 - RNA, 22 nt, Human
ggaggcugagaaguccaagauc

SEQ ID NO: 939813 - RNA, 22 nt, Human
ccuggcugcauuuugcuggaug

SEQ ID NO: 939814 - RNA, 22 nt, Human
uggcuggcccugggagugcaga

SEQ ID NO: 939815 - RNA, 23 nt, Human
gccagccuugcucuccugcagcc

SEQ ID NO: 939816 - RNA, 22 nt, Human
ugcuggggagugauugaccauc

SEQ ID NO: 939817 - RNA, 22 nt, Human
uggggacacagagccaaacuau

SEQ ID NO: 939818 - RNA, 16 nt, Human
auuuccagauuaugca

SEQ ID NO: 939819 - RNA, 20 nt, Human
aacuuguucuaccuguuuca

SEQ ID NO: 939820 - RNA, 22 nt, Human
gauuaggagggagaggcaagua

SEQ ID NO: 939821 - RNA, 22 nt, Human
gggcagcucagccaccaugcag

SEQ ID NO: 939822 - RNA, 22 nt, Human
ucacaguaaaagcauggaagag

SEQ ID NO: 939823 - RNA, 22 nt, Human
aagugggaauagaaaugaaggu

SEQ ID NO: 939824 - RNA, 22 nt, Human
uuucuuguaagauguuuauuaa

SEQ ID NO: 939825 - RNA, 22 nt, Human
ugggcacuguagcuggugcugg

SEQ ID NO: 939826 - RNA, 22 nt, Human
aacaucuacuaagugccaggca

SEQ ID NO: 939827 - RNA, 22 nt, Human
cuccagggagcuuggaaagacc

SEQ ID NO: 939828 - RNA, 22 nt, Human
ggaagaggcugagccagguccc

SEQ ID NO: 939829 - RNA, 22 nt, Human
aguuacuugagacguuuaugaa

SEQ ID NO: 939830 - RNA, 22 nt, Human
agcugagcauuugauccaccuc

SEQ ID NO: 939831 - RNA, 22 nt, Human
uucugagccucauucaugaggc

SEQ ID NO: 939832 - RNA, 22 nt, Human
gagguucacaggcuaucacagu

SEQ ID NO: 939833 - RNA, 22 nt, Human
aaggcagcuuuaaaaaagaugc

SEQ ID NO: 939834 - RNA, 22 nt, Human
gccuugggccagcugcucugga

SEQ ID NO: 939835 - RNA, 22 nt, Human
aaaguggucaccuucucauuuc

SEQ ID NO: 939836 - RNA, 22 nt, Human
auucauuugcuauuguguaugg

SEQ ID NO: 939837 - RNA, 19 nt, Human
ugugaaagcuaguguucuu

SEQ ID NO: 939838 - RNA, 22 nt, Human
ugcauuucagaagaaaauucgg

SEQ ID NO: 939839 - RNA, 22 nt, Human
gugccugcugcagagucgcugu

SEQ ID NO: 939840 - RNA, 22 nt, Human
caaaugugacuuuugggcuucu

SEQ ID NO: 939841 - RNA, 22 nt, Human
uuagagaugucccaaaaugaag

SEQ ID NO: 939842 - RNA, 19 nt, Human
cuggccaggccaggggccc

SEQ ID NO: 939843 - RNA, 22 nt, Human
gcagagguggcaucugggcucu

SEQ ID NO: 939844 - RNA, 22 nt, Human
gccuggagggucccucucugga

SEQ ID NO: 939845 - RNA, 22 nt, Human
uucaagaugucuucacaauagu

SEQ ID NO: 939846 - RNA, 22 nt, Human
uuggcagugucugcaaaaugga

SEQ ID NO: 939847 - RNA, 23 nt, Human
accaggaguugucucaggaaaca

SEQ ID NO: 939848 - RNA, 22 nt, Human
ccagguaggagagagggauccu

SEQ ID NO: 939849 - RNA, 22 nt, Human
uggcuggcuuguucacugacug

SEQ ID NO: 939850 - RNA, 21 nt, Human
uuugaaagugggugauucuuu

SEQ ID NO: 939851 - RNA, 22 nt, Human
acaauucuggguauuuauauag

SEQ ID NO: 939852 - RNA, 22 nt, Human
gucuuguuugggauguggaugg

SEQ ID NO: 939853 - RNA, 22 nt, Human
auuucuucaggucagaaauaga

SEQ ID NO: 939854 - RNA, 22 nt, Human
cucucugcuguauccuuaggcu

SEQ ID NO: 939855 - RNA, 22 nt, Human
accugggagucacaccugagaa

SEQ ID NO: 939856 - RNA, 22 nt, Human
gagggaggggagcuccacccuc

SEQ ID NO: 939857 - RNA, 22 nt, Human
cagucacauggaugauggauag

SEQ ID NO: 939858 - RNA, 22 nt, Human
acugggagucaugaggaaggag

SEQ ID NO: 939859 - RNA, 22 nt, Human
ccaggagguggagauugcagug

SEQ ID NO: 939860 - RNA, 22 nt, Human
gcugccuguugaagggucugug

SEQ ID NO: 939861 - RNA, 22 nt, Human
agaaagaacgcacuugugcugc

SEQ ID NO: 939862 - RNA, 20 nt, Human
uuucugugagaaacacuguu

SEQ ID NO: 939863 - RNA, 22 nt, Human
cugagagccuccuguuggcuag

SEQ ID NO: 939864 - RNA, 22 nt, Human
agcccagcaaagggagguucag

SEQ ID NO: 939865 - RNA, 22 nt, Human
auauucguggucaaguaaggcc

SEQ ID NO: 939866 - RNA, 22 nt, Human
ucuguucaagacugaggugaca

SEQ ID NO: 939867 - RNA, 22 nt, Human
uauuuagaaugcguguacgugu

SEQ ID NO: 939868 - RNA, 22 nt, Human
auuuccauacacccauuucuga

SEQ ID NO: 939869 - RNA, 22 nt, Human
uggagcagccaugaugacagag

SEQ ID NO: 939870 - RNA, 22 nt, Human
ucuggcuccaggaccgggcaca

SEQ ID NO: 939871 - RNA, 22 nt, Human
agcucuggaauaaugaugugau

SEQ ID NO: 939872 - RNA, 22 nt, Human
gaaaccucuuagccucucuuug

SEQ ID NO: 939873 - RNA, 21 nt, Human
agcugagcccagaagacuggu

SEQ ID NO: 939874 - RNA, 22 nt, Human
ccuggcaggcuggggacagugc

SEQ ID NO: 939875 - RNA, 23 nt, Human
acucacaaagcaggaucauguug

SEQ ID NO: 939876 - RNA, 23 nt, Human
cacugcagcguggucuggcagga

SEQ ID NO: 939877 - RNA, 22 nt, Human
agggugcagaaggagccuagga

SEQ ID NO: 939878 - RNA, 22 nt, Human
cgaugguucuggcugcuuguau

SEQ ID NO: 939879 - RNA, 22 nt, Human
gccuguccuggaugcucugcaa

SEQ ID NO: 939880 - RNA, 22 nt, Human
gcacugggaaugagggcagcuu

SEQ ID NO: 939881 - RNA, 19 nt, Human
ccauggagagagaugcauu

SEQ ID NO: 939882 - RNA, 22 nt, Human
agaacagaugugggcagaccug

SEQ ID NO: 939883 - RNA, 22 nt, Human
gaagagcuaaaggcacaggcuu

SEQ ID NO: 939884 - RNA, 22 nt, Human
gcaguggggcgcugggaguugg

SEQ ID NO: 939885 - RNA, 22 nt, Human
gggcuggaggaccggccucgga

SEQ ID NO: 939886 - RNA, 22 nt, Human
uuuauuauagugguggggacug

SEQ ID NO: 939887 - RNA, 21 nt, Human
acagaguaguugaaacagaga

SEQ ID NO: 939888 - RNA, 22 nt, Human
gagggcugaagauuguggcccc

SEQ ID NO: 939889 - RNA, 22 nt, Human
ugccucagcugaggccgcucca

SEQ ID NO: 939890 - RNA, 23 nt, Human
ugcugguguuuuugggaccaggg

SEQ ID NO: 939891 - RNA, 22 nt, Human
agccuggccacucagggccuga

SEQ ID NO: 939892 - RNA, 22 nt, Human
uggcagaaguacacaagcaugc

SEQ ID NO: 939893 - RNA, 22 nt, Human
auucuccagcucacuguccaua

SEQ ID NO: 939894 - RNA, 20 nt, Human
cagaccugcacccacuucga

SEQ ID NO: 939895 - RNA, 22 nt, Human
cauugcacaucugagaagagau

SEQ ID NO: 939896 - RNA, 22 nt, Human
caugcacagugauaucugaaga

SEQ ID NO: 939897 - RNA, 22 nt, Human
augggggccugaacaggcaaaa

SEQ ID NO: 939898 - RNA, 22 nt, Human
ggagcugcucagagccaguccc

SEQ ID NO: 939899 - RNA, 22 nt, Human
uuugaacuucuaccugucauau

SEQ ID NO: 939900 - RNA, 22 nt, Human
uaggcacugaggggagcaaggu

SEQ ID NO: 939901 - RNA, 22 nt, Human
ucaggagacaaagggugcggag

SEQ ID NO: 939902 - RNA, 22 nt, Human
agcugcuccuuuccugcaggcg

SEQ ID NO: 939903 - RNA, 22 nt, Human
caggcugggacugaccccugcu

SEQ ID NO: 939904 - RNA, 17 nt, Human
guccugggaggagagag

SEQ ID NO: 939905 - RNA, 22 nt, Human
ccaaagucuggagcagcagagc

SEQ ID NO: 939906 - RNA, 22 nt, Human
gagaggggcccaagccacauag

SEQ ID NO: 939907 - RNA, 21 nt, Human
ucacaucuauguuaagcaaac

SEQ ID NO: 939908 - RNA, 22 nt, Human
cccaggaggaggaaaaagcucg

SEQ ID NO: 939909 - RNA, 22 nt, Human
acccaggacaaaauaaccaggu

SEQ ID NO: 939910 - RNA, 22 nt, Human
cugaggccucuguucaccagaa

SEQ ID NO: 939911 - RNA, 22 nt, Human
uaagccugguucauaauuugcu

SEQ ID NO: 939912 - RNA, 22 nt, Human
ggagggagcauccccuugcuga

SEQ ID NO: 939913 - RNA, 22 nt, Human
uggcuucaucugcagcacugcc

SEQ ID NO: 939914 - RNA, 22 nt, Human
acaugcaugucuaugggcaggu

SEQ ID NO: 939915 - RNA, 22 nt, Human
guggccugccgcaccccaauau

SEQ ID NO: 939916 - RNA, 22 nt, Human
gaaugcacuuccaacaucuauu

SEQ ID NO: 939917 - RNA, 22 nt, Human
gaaaugcaaauucucucucgcu

SEQ ID NO: 939918 - RNA, 22 nt, Human
acuugggauuucagaugcugug

SEQ ID NO: 939919 - RNA, 22 nt, Human
uauaugcagauuuucaucaucg

SEQ ID NO: 939920 - RNA, 22 nt, Human
uggcaccugaacuuagaggugu

SEQ ID NO: 939921 - RNA, 22 nt, Human
aggcucugguuggcaaguaaag

SEQ ID NO: 939922 - RNA, 22 nt, Human
uauauuaacuugugauccugga

SEQ ID NO: 939923 - RNA, 21 nt, Human
cagagguggccugaccucuga

SEQ ID NO: 939924 - RNA, 22 nt, Human
cuggcagcgugagcagcaucca

SEQ ID NO: 939925 - RNA, 22 nt, Human
uggaggaaguggcuggccagaa

SEQ ID NO: 939926 - RNA, 22 nt, Human
gcugcccaguucugcugcugcc

SEQ ID NO: 939927 - RNA, 22 nt, Human
ugcucugcaagcaggagcaaga

SEQ ID NO: 939928 - RNA, 22 nt, Human
cugguuuagcuguaagguuccc

SEQ ID NO: 939929 - RNA, 23 nt, Human
cccauuuucauguuaacuccugg

SEQ ID NO: 939930 - RNA, 22 nt, Human
gcccauggacacccaagugcca

SEQ ID NO: 939931 - RNA, 22 nt, Human
ucuguucagaaauggaagugcc

SEQ ID NO: 939932 - RNA, 22 nt, Human
ggcaugggguguauguggcacg

SEQ ID NO: 939933 - RNA, 22 nt, Human
cccaggauggggcugcaguuau

SEQ ID NO: 939934 - RNA, 22 nt, Human
uuuauuuaaagucguguguuaa

SEQ ID NO: 939935 - RNA, 22 nt, Human
cauggagauaaacugaaauauu

SEQ ID NO: 939936 - RNA, 22 nt, Human
cugcucugaagccaggauucug

SEQ ID NO: 939937 - RNA, 21 nt, Human
ccacucugaguguugaacaga

SEQ ID NO: 939938 - RNA, 22 nt, Human
agugaaaucagguuuugacugc

SEQ ID NO: 939939 - RNA, 22 nt, Human
cuggucugagggcucuugaggc

SEQ ID NO: 939940 - RNA, 19 nt, Human
uagaaugcccacuuaaaaa

SEQ ID NO: 939941 - RNA, 22 nt, Human
ucagagugaccuuacauggucu

SEQ ID NO: 939942 - RNA, 22 nt, Human
uucugggagagaaagggccuug

SEQ ID NO: 939943 - RNA, 22 nt, Human
uuuccucugaugcugacuugga

SEQ ID NO: 939944 - RNA, 22 nt, Human
uaguuuuacuugcgaugauaau

SEQ ID NO: 939945 - RNA, 22 nt, Human
ccuuccaggagucucugcaggu

SEQ ID NO: 939946 - RNA, 22 nt, Human
cagagccaggugguguuggggc

SEQ ID NO: 939947 - RNA, 22 nt, Human
aauuucaagucuugaagaagua

SEQ ID NO: 939948 - RNA, 22 nt, Human
cuagggaguggcagagcuggga

SEQ ID NO: 939949 - RNA, 22 nt, Human
ucuauuuacagaaagcagaauu

SEQ ID NO: 939950 - RNA, 22 nt, Human
guccuggggaauacagaagccg

SEQ ID NO: 939951 - RNA, 22 nt, Human
caggcagccaggggaccugucc

SEQ ID NO: 939952 - RNA, 22 nt, Human
aacagcaugcuggguaacauug

SEQ ID NO: 939953 - RNA, 19 nt, Human
aaaagucuauucaauuaca

SEQ ID NO: 939954 - RNA, 22 nt, Human
caggcugcagcagcaguggccc

SEQ ID NO: 939955 - RNA, 22 nt, Human
cacagguguucuugcagugaaa

SEQ ID NO: 939956 - RNA, 22 nt, Human
ccucagagguuuucauucugua

SEQ ID NO: 939957 - RNA, 22 nt, Human
gcacccagggacuuggcuggcc

SEQ ID NO: 939958 - RNA, 22 nt, Human
ggcugccugugcccaggcacac

SEQ ID NO: 939959 - RNA, 22 nt, Human
gcagagcagugcuugcccagcg

SEQ ID NO: 939960 - RNA, 21 nt, Human
uucuuuccccagaggacuaaa

SEQ ID NO: 939961 - RNA, 22 nt, Human
acagagcuguacaugugccaug

SEQ ID NO: 939962 - RNA, 22 nt, Human
gcuccugucuuggggcacuggc

SEQ ID NO: 939963 - RNA, 22 nt, Human
cuuaagauuugagauaccuaau

SEQ ID NO: 939964 - RNA, 22 nt, Human
cugucugcuagaacaucuauac

SEQ ID NO: 939965 - RNA, 22 nt, Human
gcuggagcuugagaggacaggg

SEQ ID NO: 939966 - RNA, 22 nt, Human
uauguacauaacaugaaaugca

SEQ ID NO: 939967 - RNA, 22 nt, Human
aggaaucccgcaccagcugcug

SEQ ID NO: 939968 - RNA, 22 nt, Human
guguccagggccguguugucuu

SEQ ID NO: 939969 - RNA, 22 nt, Human
gcugccuggcuuuaguccacuu

SEQ ID NO: 939970 - RNA, 22 nt, Human
gccuggagcucggcugagggcg

SEQ ID NO: 939971 - RNA, 22 nt, Human
aagauuuccuucaguagagcua

SEQ ID NO: 939972 - RNA, 22 nt, Human
uauguacauguuaaagggcaaa

SEQ ID NO: 939973 - RNA, 20 nt, Human
ugcucaggauggagaggugu

SEQ ID NO: 939974 - RNA, 22 nt, Human
ccagaagucaggaaugagucuu

SEQ ID NO: 939975 - RNA, 22 nt, Human
uuauagaaggagcauucacuua

SEQ ID NO: 939976 - RNA, 22 nt, Human
uggcacuggcgcaggauggcgg

SEQ ID NO: 939977 - RNA, 22 nt, Human
ggaaagaggauaguggguaggu

SEQ ID NO: 939978 - RNA, 22 nt, Human
agaucaaagccaugagagauuu

SEQ ID NO: 939979 - RNA, 22 nt, Human
acuuucuaggucucaguccuuu

SEQ ID NO: 939980 - RNA, 17 nt, Human
gccaaaggguuccaauc

SEQ ID NO: 939981 - RNA, 22 nt, Human
aaaauauuuuagggccaggaga

SEQ ID NO: 939982 - RNA, 22 nt, Human
agccaacuaggagauuaaggua

SEQ ID NO: 939983 - RNA, 22 nt, Human
cuggagcugucuucacaggccu

SEQ ID NO: 939984 - RNA, 22 nt, Human
agaaauuccuaagguacacaag

SEQ ID NO: 939985 - RNA, 22 nt, Human
cugucuccuccacugcauggga

SEQ ID NO: 939986 - RNA, 22 nt, Human
augcccaaugucacaauuuuug

SEQ ID NO: 939987 - RNA, 22 nt, Human
aggcagugccuggaccccagcu

SEQ ID NO: 939988 - RNA, 22 nt, Human
uaagugcaauguuuuacuuaaa

SEQ ID NO: 939989 - RNA, 22 nt, Human
ugcaccugagaggucucugagg

SEQ ID NO: 939990 - RNA, 22 nt, Human
ucuauacaaguuucacuuugac

SEQ ID NO: 939991 - RNA, 22 nt, Human
agcugucugucuccugaggaga

SEQ ID NO: 939992 - RNA, 22 nt, Human
agguggggaaaccagcgauccc

SEQ ID NO: 939993 - RNA, 22 nt, Human
uugugaguagugccgcaauaaa

SEQ ID NO: 939994 - RNA, 22 nt, Human
cccuggagucagguuggccugg

SEQ ID NO: 939995 - RNA, 22 nt, Human
auuaggacacauacauguacag

SEQ ID NO: 939996 - RNA, 22 nt, Human
ggcagcuaggggcagggaauuc

SEQ ID NO: 939997 - RNA, 22 nt, Human
ucucuccuuaucauuguguuua

SEQ ID NO: 939998 - RNA, 22 nt, Human
gcagaggcuguagggaagguug

SEQ ID NO: 939999 - RNA, 22 nt, Human
uucuuacuaguauguuucagca

SEQ ID NO: 940000 - RNA, 22 nt, Human
auaugugugccauuucagcagu

SEQ ID NO: 940001 - RNA, 22 nt, Human
acuguguggaaauuugugaggg

SEQ ID NO: 940002 - RNA, 20 nt, Human
ugucagugccugaggcacag

SEQ ID NO: 940003 - RNA, 22 nt, Human
auugaaagcauggauuuggauu

SEQ ID NO: 940004 - RNA, 22 nt, Human
gucaggauuauaauccccaugg

SEQ ID NO: 940005 - RNA, 22 nt, Human
cuauuucugccuaaugaccugu

SEQ ID NO: 940006 - RNA, 22 nt, Human
uuugaaagucaaccuuccaguu

SEQ ID NO: 940007 - RNA, 22 nt, Human
caggugggcguggcgagaaggc

SEQ ID NO: 940008 - RNA, 22 nt, Human
cagcaggauuugaaaggaagag

SEQ ID NO: 940009 - RNA, 22 nt, Human
gaaggaaaucugugauuuaugc

SEQ ID NO: 940010 - RNA, 22 nt, Human
agaagccauguuuaguaggaug

SEQ ID NO: 940011 - RNA, 23 nt, Human
caugggagugagaaugccagcuc

SEQ ID NO: 940012 - RNA, 22 nt, Human
uggagcugggguuugaaucugg

SEQ ID NO: 940013 - RNA, 19 nt, Human
uccaggagcaaagccaguu

SEQ ID NO: 940014 - RNA, 19 nt, Human
cccucaggucugagcaguc

SEQ ID NO: 940015 - RNA, 22 nt, Human
agucuucccugugccagagugu

SEQ ID NO: 940016 - RNA, 22 nt, Human
aaugucugagucucuguauccc

SEQ ID NO: 940017 - RNA, 22 nt, Human
augacacaauuuuagagcugaa

SEQ ID NO: 940018 - RNA, 22 nt, Human
cccuggaguagcacugggucgc

SEQ ID NO: 940019 - RNA, 22 nt, Human
ucagggcaccaaaaaagaugcc

SEQ ID NO: 940020 - RNA, 20 nt, Human
uacagaaacaggacuuuugg

SEQ ID NO: 940021 - RNA, 22 nt, Human
acauuucuaucauccuguaaug

SEQ ID NO: 940022 - RNA, 20 nt, Human
aguagcagugugacauugac

SEQ ID NO: 940023 - RNA, 22 nt, Human
aaagucauugcuguuaucaaug

SEQ ID NO: 940024 - RNA, 22 nt, Human
gagaggcagaggccugaaaccg

SEQ ID NO: 940025 - RNA, 22 nt, Human
ugugcuucagguugucgccacg

SEQ ID NO: 940026 - RNA, 21 nt, Human
auacuuugaauuacagccuug

SEQ ID NO: 940027 - RNA, 22 nt, Human
ucucuggagggcuccaggcggg

SEQ ID NO: 940028 - RNA, 22 nt, Human
agggcagccaugagccuucagg

SEQ ID NO: 940029 - RNA, 22 nt, Human
ggucucagacuggcaggcagug

SEQ ID NO: 940030 - RNA, 22 nt, Human
gcauccagucuuggcuccugga

SEQ ID NO: 940031 - RNA, 22 nt, Human
ucuggcccagccccugagguca

SEQ ID NO: 940032 - RNA, 22 nt, Human
aaauauagugacacuuauaguc

SEQ ID NO: 940033 - RNA, 22 nt, Human
uggggaagggcacccuggagac

SEQ ID NO: 940034 - RNA, 21 nt, Human
aggaaguggccagauugggaa

SEQ ID NO: 940035 - RNA, 22 nt, Human
auguagcagauauuugugcaca

SEQ ID NO: 940036 - RNA, 22 nt, Human
gcugucugcaucucuagagcuu

SEQ ID NO: 940037 - RNA, 22 nt, Human
ugccuggguucccaccccaaag

SEQ ID NO: 940038 - RNA, 22 nt, Human
gaggcagcugggauacaaggga

SEQ ID NO: 940039 - RNA, 22 nt, Human
gcuccugggcccugggcuaacu

SEQ ID NO: 940040 - RNA, 22 nt, Human
gagauucuguagucaggcaucu

SEQ ID NO: 940041 - RNA, 22 nt, Human
uguaagauauucagcuuauuga

SEQ ID NO: 940042 - RNA, 22 nt, Human
uaaagugcuggauuugaguaaa

SEQ ID NO: 940043 - RNA, 22 nt, Human
acagaggucauggagaguucuc

SEQ ID NO: 940044 - RNA, 22 nt, Human
ucagcugccuuucccaugcuag

SEQ ID NO: 940045 - RNA, 22 nt, Human
auacauacauguaugcacauac

SEQ ID NO: 940046 - RNA, 22 nt, Human
aaauguuuugcucccauguggu

SEQ ID NO: 940047 - RNA, 22 nt, Human
ugugauauuugaguauugucaa

SEQ ID NO: 940048 - RNA, 22 nt, Human
guccucuggaagaugaguucuu

SEQ ID NO: 940049 - RNA, 19 nt, Human
ggccaggcugacugugguc

SEQ ID NO: 940050 - RNA, 22 nt, Human
uccugaggcucacuuugaaugu

SEQ ID NO: 940051 - RNA, 22 nt, Human
ucccagggcagcuguccagaag

SEQ ID NO: 940052 - RNA, 22 nt, Human
ccugcugugaagccaggccugu

SEQ ID NO: 940053 - RNA, 22 nt, Human
uaucuguuaggaucagagcugg

SEQ ID NO: 940054 - RNA, 22 nt, Human
caaaugcauagaaagaugaaac

SEQ ID NO: 940055 - RNA, 22 nt, Human
ucauucuuuaccaaguugucac

SEQ ID NO: 940056 - RNA, 23 nt, Human
uuucucauccagagagucagucc

SEQ ID NO: 940057 - RNA, 22 nt, Human
aucuccaggcauuucaagagac

SEQ ID NO: 940058 - RNA, 22 nt, Human
cucugagaaagcugugagcuaa

SEQ ID NO: 940059 - RNA, 22 nt, Human
ucagggcaaaagggaaaccauu

SEQ ID NO: 940060 - RNA, 22 nt, Human
uuauuuuuaaaaguucacacag

SEQ ID NO: 940061 - RNA, 22 nt, Human
ucuggcuccacucugugcaugc

SEQ ID NO: 940062 - RNA, 22 nt, Human
uccugggcgguuaugugaucug

SEQ ID NO: 940063 - RNA, 22 nt, Human
aggcagcuuucagugucucuca

SEQ ID NO: 940064 - RNA, 22 nt, Human
gcugccaguguggcaugaugca

SEQ ID NO: 940065 - RNA, 22 nt, Human
ggcauguuucaucacaucaaga

SEQ ID NO: 940066 - RNA, 22 nt, Human
agggccugugcuuccugagaua

SEQ ID NO: 940067 - RNA, 22 nt, Human
uauguacaugauuucauuugcu

SEQ ID NO: 940068 - RNA, 22 nt, Human
augggaguuuucucugaugcuc

SEQ ID NO: 940069 - RNA, 22 nt, Human
cuggcucacuagcccugcccug

SEQ ID NO: 940070 - RNA, 22 nt, Human
ugaugcugcugggaguggugcu

SEQ ID NO: 940071 - RNA, 22 nt, Human
agcagcuguggaaaaguaacua

SEQ ID NO: 940072 - RNA, 19 nt, Human
ucacaggcaucuccccaga

SEQ ID NO: 940073 - RNA, 22 nt, Human
gcucccuccaugaggcagaccg

SEQ ID NO: 940074 - RNA, 22 nt, Human
caugcuuugggucagaaaugcc

SEQ ID NO: 940075 - RNA, 22 nt, Human
gaggcagcuuaggguacugacu

SEQ ID NO: 940076 - RNA, 22 nt, Human
agggccugggauguccuccuag

SEQ ID NO: 940077 - RNA, 22 nt, Human
ugugccuucucaguccugcuca

SEQ ID NO: 940078 - RNA, 22 nt, Human
caaaaguagugaaguuguacau

SEQ ID NO: 940079 - RNA, 18 nt, Human
ccagguggugacagagau

SEQ ID NO: 940080 - RNA, 21 nt, Human
ugagccaggcugacggcugug

SEQ ID NO: 940081 - RNA, 22 nt, Human
acaccauacucauguugguucc

SEQ ID NO: 940082 - RNA, 22 nt, Human
cuggagccccaggcugugcaga

SEQ ID NO: 940083 - RNA, 22 nt, Human
caggauagaaaggccauggagu

SEQ ID NO: 940084 - RNA, 22 nt, Human
uguguacucaauugagccauuu

SEQ ID NO: 940085 - RNA, 22 nt, Human
gugagggguggcugagcaguuu

SEQ ID NO: 940086 - RNA, 22 nt, Human
aagauguaucuuuccuuuaauu

SEQ ID NO: 940087 - RNA, 22 nt, Human
cugggccagauccagccucaca

SEQ ID NO: 940088 - RNA, 20 nt, Human
uguugauuggugucaucuca

SEQ ID NO: 940089 - RNA, 22 nt, Human
uuaaaucaggcaucauuucagu

SEQ ID NO: 940090 - RNA, 22 nt, Human
agaaaugacaagacugaucagg

SEQ ID NO: 940091 - RNA, 19 nt, Human
acagaaauguaagugagac

SEQ ID NO: 940092 - RNA, 23 nt, Human
ucucaagaggaagcagggcucau

SEQ ID NO: 940093 - RNA, 22 nt, Human
guacuuccguggacuaauuguu

SEQ ID NO: 940094 - RNA, 22 nt, Human
ucuggccaguagauguggguug

SEQ ID NO: 940095 - RNA, 22 nt, Human
gcuucucucucagacugcaagc

SEQ ID NO: 940096 - RNA, 22 nt, Human
ugaagcugugggcaguggagcc

SEQ ID NO: 940097 - RNA, 20 nt, Human
gccuguccugagugucaugg

SEQ ID NO: 940098 - RNA, 22 nt, Human
gcagcccagguguagcucuuug

SEQ ID NO: 940099 - RNA, 22 nt, Human
cauggcagagaaggggaacugg

SEQ ID NO: 940100 - RNA, 22 nt, Human
ugaggccagcuucagcagugga

SEQ ID NO: 940101 - RNA, 22 nt, Human
ggggcagaaguagugccccuga

SEQ ID NO: 940102 - RNA, 22 nt, Human
ggccagcucuuguccacggagg

SEQ ID NO: 940103 - RNA, 22 nt, Human
uuugcauugccucugacuuaug

SEQ ID NO: 940104 - RNA, 22 nt, Human
ucagacaguuugcagugugccu

SEQ ID NO: 940105 - RNA, 22 nt, Human
caggccugaguguggaagucuu

SEQ ID NO: 940106 - RNA, 22 nt, Human
agguaacacuacuuaguauacu

SEQ ID NO: 940107 - RNA, 22 nt, Human
caggagggcccgagacucuucc

SEQ ID NO: 940108 - RNA, 22 nt, Human
uugaacuguaagcaugucugcc

SEQ ID NO: 940109 - RNA, 20 nt, Human
cccaggaguuugcucuuacu

SEQ ID NO: 940110 - RNA, 22 nt, Human
aggcagugcagaguccucuucu

SEQ ID NO: 940111 - RNA, 22 nt, Human
cagugucuccagaugcuccaau

SEQ ID NO: 940112 - RNA, 22 nt, Human
aguuuaugaaacacagauuuga

SEQ ID NO: 940113 - RNA, 22 nt, Human
uuucacaaacugaggagacaau

SEQ ID NO: 940114 - RNA, 22 nt, Human
caggcugcagugcaguggcuau

SEQ ID NO: 940115 - RNA, 22 nt, Human
ggucauugucagagccuguacu

SEQ ID NO: 940116 - RNA, 22 nt, Human
uacaucuauacugaucuacauu

SEQ ID NO: 940117 - RNA, 22 nt, Human
ucucagaguuuagagcugagcc

SEQ ID NO: 940118 - RNA, 22 nt, Human
auauuucuggggguguguuucu

SEQ ID NO: 940119 - RNA, 22 nt, Human
aaacacuagcaggaagcacuga

SEQ ID NO: 940120 - RNA, 22 nt, Human
aauucuauguucuugaguaaga

SEQ ID NO: 940121 - RNA, 22 nt, Human
acauaaauagauuauugggagg

SEQ ID NO: 940122 - RNA, 22 nt, Human
gccuggucucuuucaugucagu

SEQ ID NO: 940123 - RNA, 22 nt, Human
uggugguuaugcgcuuuguggg

SEQ ID NO: 940124 - RNA, 22 nt, Human
ggcuauguggucauauaagaua

SEQ ID NO: 940125 - RNA, 22 nt, Human
ggguggggcccaggaaaucuau

SEQ ID NO: 940126 - RNA, 22 nt, Human
uguuauugagguuacuuauaag

SEQ ID NO: 940127 - RNA, 22 nt, Human
aauagcucacugauuucucuuu

SEQ ID NO: 940128 - RNA, 22 nt, Human
aaaucugggagcagcucggcca

SEQ ID NO: 940129 - RNA, 22 nt, Human
ggcucuggucagugaggggccu

SEQ ID NO: 940130 - RNA, 22 nt, Human
ucuucacagaugcauauacuuc

SEQ ID NO: 940131 - RNA, 22 nt, Human
gcagaagggaauaaggagcuuu

SEQ ID NO: 940132 - RNA, 22 nt, Human
accagcagaguugaggaggaca

SEQ ID NO: 940133 - RNA, 20 nt, Human
aagcagaagcugcucucagc

SEQ ID NO: 940134 - RNA, 22 nt, Human
ugagccaggaguuugaggcugu

SEQ ID NO: 940135 - RNA, 22 nt, Human
uuagcugcauuaucaaaguuau

SEQ ID NO: 940136 - RNA, 22 nt, Human
cuccuguauguugggcuucaca

SEQ ID NO: 940137 - RNA, 22 nt, Human
cucacugucuguacuagcugau

SEQ ID NO: 940138 - RNA, 22 nt, Human
ucucagagggaaacaugaguga

SEQ ID NO: 940139 - RNA, 22 nt, Human
guccuggguccccgcaggucag

SEQ ID NO: 940140 - RNA, 22 nt, Human
ggguggcacaggugcagagggu

SEQ ID NO: 940141 - RNA, 22 nt, Human
ucucagggccccaaaggcuagu

SEQ ID NO: 940142 - RNA, 22 nt, Human
uauguuuaguauccauuuucag

SEQ ID NO: 940143 - RNA, 22 nt, Human
agucuuaacuaugcaaguacua

SEQ ID NO: 940144 - RNA, 22 nt, Human
gcucaggauuucauccaugugu

SEQ ID NO: 940145 - RNA, 22 nt, Human
acagcagcacuauugacauuuu

SEQ ID NO: 940146 - RNA, 18 nt, Human
gguggcaggucagaugcc

SEQ ID NO: 940147 - RNA, 22 nt, Human
auagauuugaauuuaagacuug

SEQ ID NO: 940148 - RNA, 22 nt, Human
cccauggcuuaggagggagugu

SEQ ID NO: 940149 - RNA, 22 nt, Human
ugaaaugacagucuuaagcucu

SEQ ID NO: 940150 - RNA, 22 nt, Human
guuuuccuucucagccauugcc

SEQ ID NO: 940151 - RNA, 21 nt, Human
ucugagagcaacugcccuuua

SEQ ID NO: 940152 - RNA, 22 nt, Human
gugcugcagagucucgugccgc

SEQ ID NO: 940153 - RNA, 22 nt, Human
gaaauauuucucuugagccccu

SEQ ID NO: 940154 - RNA, 22 nt, Human
uuuuuaguagagguggguuuca

SEQ ID NO: 940155 - RNA, 22 nt, Human
ucuuuccuacuuuauugugaac

SEQ ID NO: 940156 - RNA, 22 nt, Human
aggcccuguccauggugcugaa

SEQ ID NO: 940157 - RNA, 22 nt, Human
gguagcacauugcauuaggaga

SEQ ID NO: 940158 - RNA, 22 nt, Human
agggggcaucagguccuggcuc

SEQ ID NO: 940159 - RNA, 22 nt, Human
ggaggcccagagaggugaagug

SEQ ID NO: 940160 - RNA, 22 nt, Human
gccaccagguuagauccagccu

SEQ ID NO: 940161 - RNA, 22 nt, Human
aagauucucagagugaaagaau

SEQ ID NO: 940162 - RNA, 22 nt, Human
cugggacaugauagaaacagau

SEQ ID NO: 940163 - RNA, 21 nt, Human
gcaaccagaccacagggcagu

SEQ ID NO: 940164 - RNA, 22 nt, Human
guggcccucugauagggucagg

SEQ ID NO: 940165 - RNA, 19 nt, Human
guggccucggagcgcgcgg

SEQ ID NO: 940166 - RNA, 22 nt, Human
gaaggagagagacaucgucccu

SEQ ID NO: 940167 - RNA, 22 nt, Human
gcagggcaaugaucccgagagg

SEQ ID NO: 940168 - RNA, 22 nt, Human
gaggguggguuucuugcacguc

SEQ ID NO: 940169 - RNA, 22 nt, Human
cagcuagcuaagaaggccagag

SEQ ID NO: 940170 - RNA, 22 nt, Human
uuccuggcaugaaaaauaucac

SEQ ID NO: 940171 - RNA, 22 nt, Human
aaauuccauuaugauaauuucg

SEQ ID NO: 940172 - RNA, 22 nt, Human
gagagcugcaagguagggcggg

SEQ ID NO: 940173 - RNA, 22 nt, Human
acuuggcaaguaucuauaaagu

SEQ ID NO: 940174 - RNA, 21 nt, Human
uaaggccaagucuauuucugu

SEQ ID NO: 940175 - RNA, 22 nt, Human
ugcccaggauugugaggucagg

SEQ ID NO: 940176 - RNA, 22 nt, Human
uauaacacucagaaagaaucau

SEQ ID NO: 940177 - RNA, 17 nt, Human
ucauuuguugugacuag

SEQ ID NO: 940178 - RNA, 22 nt, Human
accauuuuggguauuuucagag

SEQ ID NO: 940179 - RNA, 22 nt, Human
uucaggaucauuuguuuuaucu

SEQ ID NO: 940180 - RNA, 22 nt, Human
auucuucauuguugauucaugu

SEQ ID NO: 940181 - RNA, 22 nt, Human
cuucccagacgggguggcagcc

SEQ ID NO: 940182 - RNA, 22 nt, Human
cuggcugugcagucuuccagaa

SEQ ID NO: 940183 - RNA, 22 nt, Human
ucugcugugauuugcuaccugu

SEQ ID NO: 940184 - RNA, 22 nt, Human
cagguggcuucucccuaggcca

SEQ ID NO: 940185 - RNA, 22 nt, Human
ggagcagcacugauuagcgguu

SEQ ID NO: 940186 - RNA, 19 nt, Human
ucucacaguuuccuugccu

SEQ ID NO: 940187 - RNA, 22 nt, Human
ucccagagcugauaagccuuua

SEQ ID NO: 940188 - RNA, 22 nt, Human
cuggaggcugaguugggucucc

SEQ ID NO: 940189 - RNA, 22 nt, Human
aggccuguuccuuccugggcac

SEQ ID NO: 940190 - RNA, 22 nt, Human
agccucugcuggcccuggcacu

SEQ ID NO: 940191 - RNA, 19 nt, Human
ccugcagggaugagagguu

SEQ ID NO: 940192 - RNA, 22 nt, Human
uacauauuugucuuuguacugu

SEQ ID NO: 940193 - RNA, 22 nt, Human
gcucugcuguguuuguucagca

SEQ ID NO: 940194 - RNA, 22 nt, Human
cugaaggagaaggccacuguuc

SEQ ID NO: 940195 - RNA, 22 nt, Human
aagcugcccaagacugaagcau

SEQ ID NO: 940196 - RNA, 22 nt, Human
ucuuaaagccaagcauaaacca

SEQ ID NO: 940197 - RNA, 22 nt, Human
gcuccuggugcuguagagauuu

SEQ ID NO: 940198 - RNA, 22 nt, Human
uggccaggcagguagaacggcc

SEQ ID NO: 940199 - RNA, 22 nt, Human
ccagugcuuccaggaauacggu

SEQ ID NO: 940200 - RNA, 22 nt, Human
auaguauuuaauaguuagcuca

SEQ ID NO: 940201 - RNA, 22 nt, Human
gcacugggggcagcagugaggg

SEQ ID NO: 940202 - RNA, 22 nt, Human
aggcucugcagaccccagcugu

SEQ ID NO: 940203 - RNA, 22 nt, Human
cagagcugcaaaugccccuccg

SEQ ID NO: 940204 - RNA, 22 nt, Human
gcuccucugucaaaugagagug

SEQ ID NO: 940205 - RNA, 22 nt, Human
aaagauuucagaagccugugcc

SEQ ID NO: 940206 - RNA, 22 nt, Human
ggaugcaggggcagcagagccu

SEQ ID NO: 940207 - RNA, 22 nt, Human
uucauucuugucuuuguauagu

SEQ ID NO: 940208 - RNA, 22 nt, Human
agccagagagccccagguucua

SEQ ID NO: 940209 - RNA, 22 nt, Human
agaguguuuuucugucaaggac

SEQ ID NO: 940210 - RNA, 22 nt, Human
agaguucugcucuucucaguga

SEQ ID NO: 940211 - RNA, 22 nt, Human
aaggacuccaauucuuucaucu

SEQ ID NO: 940212 - RNA, 22 nt, Human
agcucauggugcuaucucaggg

SEQ ID NO: 940213 - RNA, 22 nt, Human
cugggcacuuuggggagccuac

SEQ ID NO: 940214 - RNA, 20 nt, Human
gcugccuuguccugcuuggu

SEQ ID NO: 940215 - RNA, 22 nt, Human
agucccagugacuuggccagaa

SEQ ID NO: 940216 - RNA, 22 nt, Human
gucuucuuuucagucugcuugu

SEQ ID NO: 940217 - RNA, 22 nt, Human
uuuccucuucuggcaggcaggg

SEQ ID NO: 940218 - RNA, 22 nt, Human
acuguauugguuuucuauugcu

SEQ ID NO: 940219 - RNA, 22 nt, Human
agcagcuggggccugugacgau

SEQ ID NO: 940220 - RNA, 22 nt, Human
aggugagggugccagugcaugg

SEQ ID NO: 940221 - RNA, 22 nt, Human
cagaaauggagcccaggaaucu

SEQ ID NO: 940222 - RNA, 22 nt, Human
gcugauccuuuuaugucuagcu

SEQ ID NO: 940223 - RNA, 22 nt, Human
agugugggugagggaggcccuc

SEQ ID NO: 940224 - RNA, 22 nt, Human
auguaacuucugugaaucugac

SEQ ID NO: 940225 - RNA, 22 nt, Human
aaaaaugaauucuucaguggca

SEQ ID NO: 940226 - RNA, 22 nt, Human
ucaguuuuguauguuguaaguc

SEQ ID NO: 940227 - RNA, 22 nt, Human
aagggcaggugggcauuucugg

SEQ ID NO: 940228 - RNA, 22 nt, Human
acugugugcccugacgccaggg

SEQ ID NO: 940229 - RNA, 22 nt, Human
gcucugcuugcaucaugacugc

SEQ ID NO: 940230 - RNA, 22 nt, Human
uucaagguaugguagcugguca

SEQ ID NO: 940231 - RNA, 22 nt, Human
ucacugcucuccaauguggagu

SEQ ID NO: 940232 - RNA, 22 nt, Human
gccuuuuuuguugcucugucac

SEQ ID NO: 940233 - RNA, 22 nt, Human
cagccccucccucaggcaggug

SEQ ID NO: 940234 - RNA, 22 nt, Human
ccucugccugcacaucauccug

SEQ ID NO: 940235 - RNA, 22 nt, Human
cagggccucauccucagagauu

SEQ ID NO: 940236 - RNA, 22 nt, Human
ucacugcugcugccaugaugga

SEQ ID NO: 940237 - RNA, 22 nt, Human
agcacaggaccaaggaagcugu

SEQ ID NO: 940238 - RNA, 22 nt, Human
uaaaugugagugaugcggugaa

SEQ ID NO: 940239 - RNA, 17 nt, Human
agaggcagauacuugga

SEQ ID NO: 940240 - RNA, 22 nt, Human
ugcagcugaggccagcuaugcc

SEQ ID NO: 940241 - RNA, 22 nt, Human
auuggcaguuagugacgaggcu

SEQ ID NO: 940242 - RNA, 22 nt, Human
gcaaaaaaugcuuguugcuuag

SEQ ID NO: 940243 - RNA, 22 nt, Human
cagggugccuguccucagcaaa

SEQ ID NO: 940244 - RNA, 22 nt, Human
auacuuuggggguuaguguaga

SEQ ID NO: 940245 - RNA, 22 nt, Human
ggaccugccagaacucaggcua

SEQ ID NO: 940246 - RNA, 22 nt, Human
aggggagcuaacaccagagccc

SEQ ID NO: 940247 - RNA, 22 nt, Human
aguacuucagaggcugcccagg

SEQ ID NO: 940248 - RNA, 22 nt, Human
agucugcuuccuggagaacuca

SEQ ID NO: 940249 - RNA, 21 nt, Human
gugucaugguugacuuuggca

SEQ ID NO: 940250 - RNA, 22 nt, Human
ccugagccucuugcacgcucag

SEQ ID NO: 940251 - RNA, 22 nt, Human
accucugcaaugcaaugucaug

SEQ ID NO: 940252 - RNA, 22 nt, Human
aggggagguggcagaaaugugc

SEQ ID NO: 940253 - RNA, 18 nt, Human
gaggccugagaaccaggu

SEQ ID NO: 940254 - RNA, 20 nt, Human
auuucaguguuugcaauuuc

SEQ ID NO: 940255 - RNA, 22 nt, Human
ucauccaguucacauggugagu

SEQ ID NO: 940256 - RNA, 22 nt, Human
uuagucaauagugaauauagag

SEQ ID NO: 940257 - RNA, 22 nt, Human
aguaucaaggaucuccagcacc

SEQ ID NO: 940258 - RNA, 22 nt, Human
ccugcuggccaguggagggcug

SEQ ID NO: 940259 - RNA, 22 nt, Human
ugcugaugcuguucuguuagga

SEQ ID NO: 940260 - RNA, 22 nt, Human
caaggaaaaagcgagcucgggg

SEQ ID NO: 940261 - RNA, 22 nt, Human
agcaggcuuguuaugucugaga

SEQ ID NO: 940262 - RNA, 22 nt, Human
cuggucaaggagagucucugca

SEQ ID NO: 940263 - RNA, 22 nt, Human
uccaguggugguuugaagggca

SEQ ID NO: 940264 - RNA, 22 nt, Human
acugcaggagacacagcugcug

SEQ ID NO: 940265 - RNA, 22 nt, Human
ccugggcuggaguacagcagug

SEQ ID NO: 940266 - RNA, 22 nt, Human
ugauuucauaguauauacauga

SEQ ID NO: 940267 - RNA, 22 nt, Human
uggggugggcaugcgcuguccu

SEQ ID NO: 940268 - RNA, 22 nt, Human
uaauaaaugaaagugcuggcau

SEQ ID NO: 940269 - RNA, 22 nt, Human
ugauucacagacuucacaaggc

SEQ ID NO: 940270 - RNA, 22 nt, Human
uugaacagcuguuacauuguua

SEQ ID NO: 940271 - RNA, 22 nt, Human
ccagccuggacugggucuugug

SEQ ID NO: 940272 - RNA, 22 nt, Human
gggcacuguacacugugcaugg

SEQ ID NO: 940273 - RNA, 22 nt, Human
agacaaagacagcaucucaggu

SEQ ID NO: 940274 - RNA, 22 nt, Human
ugcagcaggcacaggacggaag

SEQ ID NO: 940275 - RNA, 22 nt, Human
uugcaaaugaccauugccacau

SEQ ID NO: 940276 - RNA, 22 nt, Human
ugcucuguauucuauggcaguu

SEQ ID NO: 940277 - RNA, 20 nt, Human
caggaugauuggacacgaug

SEQ ID NO: 940278 - RNA, 22 nt, Human
ggcugccugcucaggugcggcg

SEQ ID NO: 940279 - RNA, 22 nt, Human
ccugccugguguaagucuaagg

SEQ ID NO: 940280 - RNA, 22 nt, Human
cuuaacagagagaaguguugcu

SEQ ID NO: 940281 - RNA, 22 nt, Human
cugugcuuccaggauggcagcu

SEQ ID NO: 940282 - RNA, 22 nt, Human
guggccaaggcagagaaagagc

SEQ ID NO: 940283 - RNA, 22 nt, Human
ucccagacaaucauuggccacc

SEQ ID NO: 940284 - RNA, 22 nt, Human
gcuccagguauuugcccuuuua

SEQ ID NO: 940285 - RNA, 22 nt, Human
ccaggccuggaccaugccaggg

SEQ ID NO: 940286 - RNA, 21 nt, Human
agagagaaggccauauggucc

SEQ ID NO: 940287 - RNA, 22 nt, Human
caggcuggagugcaguugugca

SEQ ID NO: 940288 - RNA, 22 nt, Human
agggcagcacaaggcauggacu

SEQ ID NO: 940289 - RNA, 21 nt, Human
cucaaagaccaaaaguguaga

SEQ ID NO: 940290 - RNA, 22 nt, Human
gaaggcaggcuucugauuaggu

SEQ ID NO: 940291 - RNA, 22 nt, Human
ucagggcagguuaacuugggug

SEQ ID NO: 940292 - RNA, 22 nt, Human
cagagcugagaauguugaugcu

SEQ ID NO: 940293 - RNA, 22 nt, Human
cuggagccauguauagccuaug

SEQ ID NO: 940294 - RNA, 22 nt, Human
ggcagacaccuuuaugucuaau

SEQ ID NO: 940295 - RNA, 22 nt, Human
gcccagcacagcuggaagaguc

SEQ ID NO: 940296 - RNA, 22 nt, Human
uucccucucacuuaaagcuugg

SEQ ID NO: 940297 - RNA, 22 nt, Human
uuuuagcacuaagugauaugcu

SEQ ID NO: 940298 - RNA, 22 nt, Human
aacacugcugcuggguucugug

SEQ ID NO: 940299 - RNA, 22 nt, Human
cagaagcauuccagcaaauagu

SEQ ID NO: 940300 - RNA, 22 nt, Human
ggcagggcuugucucugugaug

SEQ ID NO: 940301 - RNA, 22 nt, Human
uguguuccugccuggcucuggu

SEQ ID NO: 940302 - RNA, 22 nt, Human
uccaagggcuuuggcgugaagu

SEQ ID NO: 940303 - RNA, 22 nt, Human
acagucauuagauacaaugucu

SEQ ID NO: 940304 - RNA, 21 nt, Human
ggccugaguauaggacaggcc

SEQ ID NO: 940305 - RNA, 22 nt, Human
uagccggguguugugucaugca

SEQ ID NO: 940306 - RNA, 20 nt, Human
cacaggcuauaugagagcca

SEQ ID NO: 940307 - RNA, 22 nt, Human
uggcagcauguuauguaaggaa

SEQ ID NO: 940308 - RNA, 22 nt, Human
cuugaaagauuuggccucugug

SEQ ID NO: 940309 - RNA, 22 nt, Human
uucucugaaggccaugcucacu

SEQ ID NO: 940310 - RNA, 18 nt, Human
gcagcuagccaggggggc

SEQ ID NO: 940311 - RNA, 22 nt, Human
cuuaaagaaauugaggagagga

SEQ ID NO: 940312 - RNA, 22 nt, Human
gucuccugagccuugacugcaa

SEQ ID NO: 940313 - RNA, 22 nt, Human
agcauuuaggagaauuugagaa

SEQ ID NO: 940314 - RNA, 19 nt, Human
cuccucagucccagagguc

SEQ ID NO: 940315 - RNA, 22 nt, Human
ucucagagaucuuucugcaugu

SEQ ID NO: 940316 - RNA, 22 nt, Human
ugugaaauucuugaaaugcaca

SEQ ID NO: 940317 - RNA, 22 nt, Human
aggucauuccagccauuccccu

SEQ ID NO: 940318 - RNA, 22 nt, Human
gcuguucccauguggggcucag

SEQ ID NO: 940319 - RNA, 22 nt, Human
gcagggccagggcucaggcugu

SEQ ID NO: 940320 - RNA, 22 nt, Human
ucacauuuuaucuauuuuaagu

SEQ ID NO: 940321 - RNA, 22 nt, Human
aggcaggcucaaugcccagucu

SEQ ID NO: 940322 - RNA, 22 nt, Human
uggcugaauaaaauaugguguu

SEQ ID NO: 940323 - RNA, 22 nt, Human
ucagaaauacuaucagcuuuug

SEQ ID NO: 940324 - RNA, 22 nt, Human
ugcaauaacccaguaucuguga

SEQ ID NO: 940325 - RNA, 22 nt, Human
cuuacauuuaaucaugugucau

SEQ ID NO: 940326 - RNA, 22 nt, Human
guuauaaauaccuaauaggauu

SEQ ID NO: 940327 - RNA, 22 nt, Human
gcacugaacuuuaaucauuucu

SEQ ID NO: 940328 - RNA, 22 nt, Human
ucagagcuuaucucuugcugga

SEQ ID NO: 940329 - RNA, 23 nt, Human
uggagcugacagucagagggagg

SEQ ID NO: 940330 - RNA, 22 nt, Human
aggggugaaggcccgauaggag

SEQ ID NO: 940331 - RNA, 22 nt, Human
gaggccuggugugucucccgcu

SEQ ID NO: 940332 - RNA, 22 nt, Human
guggagcccugguagggacccc

SEQ ID NO: 940333 - RNA, 22 nt, Human
ugagcccaggaguuggaggcug

SEQ ID NO: 940334 - RNA, 22 nt, Human
uuuauuuauaagccacuugcug

SEQ ID NO: 940335 - RNA, 22 nt, Human
acaaaaguguaggaauuccuua

SEQ ID NO: 940336 - RNA, 22 nt, Human
acuguucaucucuuagaaagua

SEQ ID NO: 940337 - RNA, 22 nt, Human
ccaggcugggcggggaaccugg

SEQ ID NO: 940338 - RNA, 22 nt, Human
ccaccagcuuugccacccugcu

SEQ ID NO: 940339 - RNA, 22 nt, Human
agaggcacuccagccacugguc

SEQ ID NO: 940340 - RNA, 22 nt, Human
uuccaagaguaaauucaaauug

SEQ ID NO: 940341 - RNA, 22 nt, Human
uuugaaguucccccauaucaga

SEQ ID NO: 940342 - RNA, 22 nt, Human
uuuccuuccuugcuagccugag

SEQ ID NO: 940343 - RNA, 22 nt, Human
agccacagucuguagccagcuu

SEQ ID NO: 940344 - RNA, 22 nt, Human
gcccgcagagaucuuuaacaaa

SEQ ID NO: 940345 - RNA, 22 nt, Human
aaggcacugacugugcagggga

SEQ ID NO: 940346 - RNA, 22 nt, Human
agcucccagaaggcccugcgcc

SEQ ID NO: 940347 - RNA, 18 nt, Human
gagcugccauauuuaguu

SEQ ID NO: 940348 - RNA, 22 nt, Human
uaaaugugaccuucauuuuaua

SEQ ID NO: 940349 - RNA, 22 nt, Human
uaaggccagccagcaaaucugu

SEQ ID NO: 940350 - RNA, 22 nt, Human
ucucauguauugcccuggugug

SEQ ID NO: 940351 - RNA, 22 nt, Human
aggcagcagugauaagauagga

SEQ ID NO: 940352 - RNA, 22 nt, Human
uuugacaugcaaagcacuuuag

SEQ ID NO: 940353 - RNA, 20 nt, Human
uauauaggaaauauuguguu

SEQ ID NO: 940354 - RNA, 21 nt, Human
aagggagauaggaaucaggcc

SEQ ID NO: 940355 - RNA, 22 nt, Human
gagggauggugugagaggcuca

SEQ ID NO: 940356 - RNA, 22 nt, Human
aggcagcuucugauuagcagcg

SEQ ID NO: 940357 - RNA, 22 nt, Human
agucucugcaugccugcugugc

SEQ ID NO: 940358 - RNA, 22 nt, Human
uaaaaaguugaaaggacuuauc

SEQ ID NO: 940359 - RNA, 22 nt, Human
auauuaaugagcaaguaaguga

SEQ ID NO: 940360 - RNA, 22 nt, Human
uaacacacugaaggugagaugg

SEQ ID NO: 940361 - RNA, 18 nt, Human
gcagagugcgucucugug

SEQ ID NO: 940362 - RNA, 22 nt, Human
cccugcagaaccacagacaaac

SEQ ID NO: 940363 - RNA, 22 nt, Human
gaggagagaacauuccuccaua

SEQ ID NO: 940364 - RNA, 22 nt, Human
cugccaggcacgugcagcauca

SEQ ID NO: 940365 - RNA, 22 nt, Human
uccuggcccaaucugcccauga

SEQ ID NO: 940366 - RNA, 22 nt, Human
cucagaaguucagccuagagua

SEQ ID NO: 940367 - RNA, 22 nt, Human
ggccagggggcuucagacucca

SEQ ID NO: 940368 - RNA, 22 nt, Human
aguauacauauauuagccuucg

SEQ ID NO: 940369 - RNA, 22 nt, Human
gggcuggaucuccugcaggcag

SEQ ID NO: 940370 - RNA, 22 nt, Human
acauuucucccugcaugccugc

SEQ ID NO: 940371 - RNA, 22 nt, Human
ugcagaggagcuggaaggcugg

SEQ ID NO: 940372 - RNA, 22 nt, Human
gugcuuccccaagccacagccu

SEQ ID NO: 940373 - RNA, 22 nt, Human
acuguucaagcaaaugacauug

SEQ ID NO: 940374 - RNA, 22 nt, Human
ucccagagcccaaguuggagag

SEQ ID NO: 940375 - RNA, 22 nt, Human
gugggccuugcagggugcaggg

SEQ ID NO: 940376 - RNA, 22 nt, Human
guggccaggccgacugccaggc

SEQ ID NO: 940377 - RNA, 22 nt, Human
uggaaggggagcuggaaagggg

SEQ ID NO: 940378 - RNA, 22 nt, Human
ggucugaguagagggcuggcga

SEQ ID NO: 940379 - RNA, 22 nt, Human
uacaaaguuugggguccucaaa

SEQ ID NO: 940380 - RNA, 22 nt, Human
uaguuacagcaggcaggauaua

SEQ ID NO: 940381 - RNA, 22 nt, Human
ggcuggcaagucagugcugaug

SEQ ID NO: 940382 - RNA, 22 nt, Human
guuccaguaugauuccacccau

SEQ ID NO: 940383 - RNA, 22 nt, Human
agcugccaaguuggaguagcaa

SEQ ID NO: 940384 - RNA, 22 nt, Human
aagauuucuuacuuauugaugc

SEQ ID NO: 940385 - RNA, 22 nt, Human
ccucugcucccuggugucugag

SEQ ID NO: 940386 - RNA, 22 nt, Human
agaaaucacaggaggcagaagg

SEQ ID NO: 940387 - RNA, 20 nt, Human
cagaggcaaggagacuugga

SEQ ID NO: 940388 - RNA, 22 nt, Human
cagggcagaaggcacucuacuc

SEQ ID NO: 940389 - RNA, 22 nt, Human
aucauuacuccuguaaaauugu

SEQ ID NO: 940390 - RNA, 22 nt, Human
auuuacagaugaugcuauuuga

SEQ ID NO: 940391 - RNA, 22 nt, Human
ucuaggagaaccaucagggagg

SEQ ID NO: 940392 - RNA, 22 nt, Human
gcaggggcuacucugagcuucc

SEQ ID NO: 940393 - RNA, 22 nt, Human
agcucccagcuccuuugagaga

SEQ ID NO: 940394 - RNA, 22 nt, Human
uugaaauauggauugaccuuga

SEQ ID NO: 940395 - RNA, 22 nt, Human
ggauccuucuuugaccucacag

SEQ ID NO: 940396 - RNA, 22 nt, Human
gcagcagaggcccuacucuuug

SEQ ID NO: 940397 - RNA, 22 nt, Human
aucuggcucauucagggaacgg

SEQ ID NO: 940398 - RNA, 22 nt, Human
gccagggagucugggccacaga

SEQ ID NO: 940399 - RNA, 20 nt, Human
uguucacaguaguugcugcu

SEQ ID NO: 940400 - RNA, 22 nt, Human
uagggcuauaagagaauaagac

SEQ ID NO: 940401 - RNA, 22 nt, Human
augggcagcagcugccauucau

SEQ ID NO: 940402 - RNA, 22 nt, Human
uucuaguguccuuggacuugcu

SEQ ID NO: 940403 - RNA, 22 nt, Human
ucucaggccccugaguuucucu

SEQ ID NO: 940404 - RNA, 22 nt, Human
aucuacaggauaguuuaauauu

SEQ ID NO: 940405 - RNA, 22 nt, Human
ccaggagauuuuuccauagcac

SEQ ID NO: 940406 - RNA, 22 nt, Human
ggacagcccauacacaugucug

SEQ ID NO: 940407 - RNA, 17 nt, Human
ucaugcccaacuauuac

SEQ ID NO: 940408 - RNA, 22 nt, Human
gcucccuguucucagccaugau

SEQ ID NO: 940409 - RNA, 22 nt, Human
ucagguggcuuggagggggacg

SEQ ID NO: 940410 - RNA, 22 nt, Human
uuucuaaggccagagacugcug

SEQ ID NO: 940411 - RNA, 22 nt, Human
aggagaggcucuaacucugugu

SEQ ID NO: 940412 - RNA, 22 nt, Human
ucuucaaacugaaaauuuagaa

SEQ ID NO: 940413 - RNA, 22 nt, Human
agggccugagcuggcugaccuc

SEQ ID NO: 940414 - RNA, 22 nt, Human
ccuccuggaggcucuagggaaa

SEQ ID NO: 940415 - RNA, 20 nt, Human
gagcagcuguuugcauugca

SEQ ID NO: 940416 - RNA, 22 nt, Human
aacacaaagaagcugcaggauc

SEQ ID NO: 940417 - RNA, 18 nt, Human
uuaagagcugaaagggga

SEQ ID NO: 940418 - RNA, 19 nt, Human
ucuaacagaagugucgucc

SEQ ID NO: 940419 - RNA, 22 nt, Human
aguaccaugcuuccugacuggu

SEQ ID NO: 940420 - RNA, 22 nt, Human
guguaaggccccagguucuuua

SEQ ID NO: 940421 - RNA, 22 nt, Human
uaguccaguaaaacagcuaacg

SEQ ID NO: 940422 - RNA, 22 nt, Human
ccuggagcucacugggagccgg

SEQ ID NO: 940423 - RNA, 22 nt, Human
uucucagagcacugcugacaaa

SEQ ID NO: 940424 - RNA, 22 nt, Human
ugccaggcccugugcuggaugc

SEQ ID NO: 940425 - RNA, 22 nt, Human
acucugaggagugacuagaggu

SEQ ID NO: 940426 - RNA, 22 nt, Human
uccugggcuuaagugauccucc

SEQ ID NO: 940427 - RNA, 22 nt, Human
guggcagcaaaugccuggacua

SEQ ID NO: 940428 - RNA, 22 nt, Human
aagaugcagcaaacuacuuuuu

SEQ ID NO: 940429 - RNA, 22 nt, Human
gugacucacacaggccugggcu

SEQ ID NO: 940430 - RNA, 22 nt, Human
cugugcaagcccaagauaaaac

SEQ ID NO: 940431 - RNA, 22 nt, Human
acauuaucccuggcacaacugc

SEQ ID NO: 940432 - RNA, 21 nt, Human
ggagggcagcccagacuggcu

SEQ ID NO: 940433 - RNA, 22 nt, Human
uccaggagauucauuaggucau

SEQ ID NO: 940434 - RNA, 22 nt, Human
gcucugcucuaacauuccugac

SEQ ID NO: 940435 - RNA, 22 nt, Human
ccagcagcuguggcuuugccuc

SEQ ID NO: 940436 - RNA, 22 nt, Human
uggaggaaaaaaccaggcagag

SEQ ID NO: 940437 - RNA, 22 nt, Human
cacauggccuguguggccagac

SEQ ID NO: 940438 - RNA, 22 nt, Human
aagugacaccucuucccuuucc

SEQ ID NO: 940439 - RNA, 22 nt, Human
acuuucuccagaaaaccaagga

SEQ ID NO: 940440 - RNA, 20 nt, Human
agugcaagaaagcacagcug

SEQ ID NO: 940441 - RNA, 23 nt, Human
cauuucugggagauuuauaaaau

SEQ ID NO: 940442 - RNA, 22 nt, Human
agggguggagaguguugccagu

SEQ ID NO: 940443 - RNA, 22 nt, Human
agccccaggcccggacgccucu

SEQ ID NO: 940444 - RNA, 22 nt, Human
auacacauguguaugugcaugc

SEQ ID NO: 940445 - RNA, 22 nt, Human
ucucuguaguugggcagcugcu

SEQ ID NO: 940446 - RNA, 22 nt, Human
gcucucugucguuaugcuucau

SEQ ID NO: 940447 - RNA, 22 nt, Human
agauggagaccuuggaugaacu

SEQ ID NO: 940448 - RNA, 22 nt, Human
ggaggggucucuagcgaggaga

SEQ ID NO: 940449 - RNA, 22 nt, Human
gaugguuuaugauagaugggaa

SEQ ID NO: 940450 - RNA, 22 nt, Human
uguauuuuuagaccuuuagacc

SEQ ID NO: 940451 - RNA, 20 nt, Human
agaggcuuccuugggaggag

SEQ ID NO: 940452 - RNA, 22 nt, Human
accuuucacgguaucagacauc

SEQ ID NO: 940453 - RNA, 22 nt, Human
acacagggcugcgccugacccc

SEQ ID NO: 940454 - RNA, 22 nt, Human
ucucuucucuagugagcaacug

SEQ ID NO: 940455 - RNA, 22 nt, Human
auuuggcaacauuaauugaauc

SEQ ID NO: 940456 - RNA, 21 nt, Human
acaugucucuaaucucaguga

SEQ ID NO: 940457 - RNA, 22 nt, Human
gagaagguggaccugaaggagc

SEQ ID NO: 940458 - RNA, 23 nt, Human
cuccccaguguccucaugcaucu

SEQ ID NO: 940459 - RNA, 22 nt, Human
gacagguggggaaacuaaggua

SEQ ID NO: 940460 - RNA, 22 nt, Human
guuaggauuauauaucccauga

SEQ ID NO: 940461 - RNA, 22 nt, Human
ccuggccucuccgaguaaccug

SEQ ID NO: 940462 - RNA, 22 nt, Human
gggagagaugcugauugccaau

SEQ ID NO: 940463 - RNA, 22 nt, Human
cagagggcucuuggcugccugc

SEQ ID NO: 940464 - RNA, 22 nt, Human
aggcagcuuaagcccuggccca

SEQ ID NO: 940465 - RNA, 22 nt, Human
gcagccacccucaaggcugaau

SEQ ID NO: 940466 - RNA, 22 nt, Human
gcuguggccaacaaaccacuuu

SEQ ID NO: 940467 - RNA, 22 nt, Human
gaugcacuuucuuuucaacagu

SEQ ID NO: 940468 - RNA, 22 nt, Human
guugaaaguggagaaccugguu

SEQ ID NO: 940469 - RNA, 22 nt, Human
uucugaaagccaauucauugaa

SEQ ID NO: 940470 - RNA, 22 nt, Human
aggugcugccccgagaaggaug

SEQ ID NO: 940471 - RNA, 22 nt, Human
ggguacaaagauuucauaagau

SEQ ID NO: 940472 - RNA, 22 nt, Human
uuuuccucuguauuugaaaugc

SEQ ID NO: 940473 - RNA, 22 nt, Human
ggcugccauaacugauaccaua

SEQ ID NO: 940474 - RNA, 22 nt, Human
guguaaggugaaaucaacaaau

SEQ ID NO: 940475 - RNA, 22 nt, Human
uguuugaauuuugcuaacgugu

SEQ ID NO: 940476 - RNA, 20 nt, Human
ucuggcaggugaacgagcug

SEQ ID NO: 940477 - RNA, 22 nt, Human
uaugugcaaauuaauugcuaga

SEQ ID NO: 940478 - RNA, 18 nt, Human
gaaaugugauucuagggc

SEQ ID NO: 940479 - RNA, 22 nt, Human
ugggagcacccugaggagcuuc

SEQ ID NO: 940480 - RNA, 22 nt, Human
agaagaaacugucggggauauu

SEQ ID NO: 940481 - RNA, 22 nt, Human
caugggcuuuggaggcuggagg

SEQ ID NO: 940482 - RNA, 22 nt, Human
ucugaaggugcuagagaaagcu

SEQ ID NO: 940483 - RNA, 22 nt, Human
ccucucccacguggcagaggcu

SEQ ID NO: 940484 - RNA, 22 nt, Human
gcccucugcacagcucugagca

SEQ ID NO: 940485 - RNA, 22 nt, Human
gagcagcucugugccuggagac

SEQ ID NO: 940486 - RNA, 22 nt, Human
gguggcagucuuaagagaucuu

SEQ ID NO: 940487 - RNA, 22 nt, Human
ccaggagaauaauggcagauua

SEQ ID NO: 940488 - RNA, 16 nt, Human
gucuggccuaccugcc

SEQ ID NO: 940489 - RNA, 22 nt, Human
accgaguuagccaggauggucu

SEQ ID NO: 940490 - RNA, 22 nt, Human
gccuucaguagugucagcugua

SEQ ID NO: 940491 - RNA, 22 nt, Human
aacagugagaagguggacagga

SEQ ID NO: 940492 - RNA, 22 nt, Human
cugggcaauaugcugggccugg

SEQ ID NO: 940493 - RNA, 23 nt, Human
uggaaagcggaccuggggcagag

SEQ ID NO: 940494 - RNA, 22 nt, Human
agaaaucagaacccugaaguuc

SEQ ID NO: 940495 - RNA, 22 nt, Human
ccaggacucaguggggaaaggg

SEQ ID NO: 940496 - RNA, 22 nt, Human
uccuucuuugacaaguggcaga

SEQ ID NO: 940497 - RNA, 22 nt, Human
aucaggaucugggagccugaaa

SEQ ID NO: 940498 - RNA, 22 nt, Human
cuggagcuggcuuccuuccacu

SEQ ID NO: 940499 - RNA, 22 nt, Human
cuacccagauccaggauggcua

SEQ ID NO: 940500 - RNA, 22 nt, Human
agcuggugcugaagcucuugag

SEQ ID NO: 940501 - RNA, 22 nt, Human
gcugcccacaaugauuacaugg

SEQ ID NO: 940502 - RNA, 22 nt, Human
cuggugccuccucccugugcuu

SEQ ID NO: 940503 - RNA, 22 nt, Human
gcuggcuguaucaccuggccag

SEQ ID NO: 940504 - RNA, 22 nt, Human
guauucauauuaaacauaucaa

SEQ ID NO: 940505 - RNA, 22 nt, Human
cuguucacacacuuguacucuc

SEQ ID NO: 940506 - RNA, 20 nt, Human
aagcacauuucuacaauaau

SEQ ID NO: 940507 - RNA, 22 nt, Human
cuuacauugucuuaguuuucaa

SEQ ID NO: 940508 - RNA, 17 nt, Human
uuccccugaccaagccu

SEQ ID NO: 940509 - RNA, 22 nt, Human
ccugggagugugccaucucugu

SEQ ID NO: 940510 - RNA, 22 nt, Human
uaggauaugugaaaucauauua

SEQ ID NO: 940511 - RNA, 22 nt, Human
gcugccucuguagcuuuggacc

SEQ ID NO: 940512 - RNA, 20 nt, Human
ggcacuggaagcacacagga

SEQ ID NO: 940513 - RNA, 18 nt, Human
uccagagguguuggagcc

SEQ ID NO: 940514 - RNA, 22 nt, Human
aggcaguguauugcuagcggcu

SEQ ID NO: 940515 - RNA, 22 nt, Human
ggggcagccuccaggaaagcug

SEQ ID NO: 940516 - RNA, 22 nt, Human
gccuggugugcgccgcgcagcu

SEQ ID NO: 940517 - RNA, 19 nt, Human
cuguccuuggcugcacugu

SEQ ID NO: 940518 - RNA, 22 nt, Human
gcagaggcagggcccuccucca

SEQ ID NO: 940519 - RNA, 22 nt, Human
cuugccuucuguuccuauagaa

SEQ ID NO: 940520 - RNA, 22 nt, Human
ccugagguggcugcagcacugc

SEQ ID NO: 940521 - RNA, 22 nt, Human
uaaagguagugugacauauugu

SEQ ID NO: 940522 - RNA, 22 nt, Human
acuuccugaauggggcuaauua

SEQ ID NO: 940523 - RNA, 22 nt, Human
agaggccuaauugcuacccuuu

SEQ ID NO: 940524 - RNA, 22 nt, Human
auuuguugcuagcagcacugau

SEQ ID NO: 940525 - RNA, 22 nt, Human
gagguggguguaucacagguca

SEQ ID NO: 940526 - RNA, 22 nt, Human
uauuaggguaaauuugacaugc

SEQ ID NO: 940527 - RNA, 22 nt, Human
uugggagcaaauaggaaagagg

SEQ ID NO: 940528 - RNA, 22 nt, Human
gcucccugccuacacggaccuu

SEQ ID NO: 940529 - RNA, 22 nt, Human
cccuugggguggagguugcagu

SEQ ID NO: 940530 - RNA, 22 nt, Human
aagaaaagaaaccugaggcuuu

SEQ ID NO: 940531 - RNA, 22 nt, Human
gaucaaaagcuggguucuaaaa

SEQ ID NO: 940532 - RNA, 22 nt, Human
uuuuauguaauccuuacugucg

SEQ ID NO: 940533 - RNA, 22 nt, Human
uucaauucaauucuaaauauau

SEQ ID NO: 940534 - RNA, 22 nt, Human
acagggucauuuuaugaucugu

SEQ ID NO: 940535 - RNA, 22 nt, Human
gaugcacuugccccuccucaga

SEQ ID NO: 940536 - RNA, 22 nt, Human
gaugcacaugugaguauagaag

SEQ ID NO: 940537 - RNA, 22 nt, Human
caggccaggcugcauuugcccc

SEQ ID NO: 940538 - RNA, 22 nt, Human
guguggcugauugacaugguca

SEQ ID NO: 940539 - RNA, 22 nt, Human
aagagguaaccauagcaaccac

SEQ ID NO: 940540 - RNA, 22 nt, Human
cucaggaucgcuugcccuaggg

SEQ ID NO: 940541 - RNA, 22 nt, Human
augauugaccaucugcugggcu

SEQ ID NO: 940542 - RNA, 22 nt, Human
ggccucucuggcauggcugccc

SEQ ID NO: 940543 - RNA, 20 nt, Human
agcagcuguguuuucauccu

SEQ ID NO: 940544 - RNA, 22 nt, Human
agcaguggaccucagugcuauu

SEQ ID NO: 940545 - RNA, 22 nt, Human
augcaaaugaacauguugcuag

SEQ ID NO: 940546 - RNA, 22 nt, Human
aauaauuuuagcucagaguugu

SEQ ID NO: 940547 - RNA, 23 nt, Human
uggcaaggaaugggauggagacu

SEQ ID NO: 940548 - RNA, 22 nt, Human
ccaccagcagugugcaaggauu

SEQ ID NO: 940549 - RNA, 22 nt, Human
acagugugugcuuucccuuacg

SEQ ID NO: 940550 - RNA, 22 nt, Human
uucuuccucagcagggcugccu

SEQ ID NO: 940551 - RNA, 22 nt, Human
uugcauugggagugaggagacc

SEQ ID NO: 940552 - RNA, 22 nt, Human
aaaugucuguuagucauaucau

SEQ ID NO: 940553 - RNA, 22 nt, Human
cagaguggcgacccccucagcu

SEQ ID NO: 940554 - RNA, 22 nt, Human
agcugguucagaaauuagaugg

SEQ ID NO: 940555 - RNA, 22 nt, Human
ucagugugaggucuuccacccg

SEQ ID NO: 940556 - RNA, 22 nt, Human
cugcuuugacuguuaagaacca

SEQ ID NO: 940557 - RNA, 22 nt, Human
guuuauuauacaacaaaagcua

SEQ ID NO: 940558 - RNA, 22 nt, Human
acugagcugcuugaagugaacu

SEQ ID NO: 940559 - RNA, 21 nt, Human
gccugggauaguggccuccgg

SEQ ID NO: 940560 - RNA, 22 nt, Human
agaggccuuucuguugagugaa

SEQ ID NO: 940561 - RNA, 22 nt, Human
ugccugucagggggagugggaa

SEQ ID NO: 940562 - RNA, 22 nt, Human
aaaggccauuacuugcuuuuag

SEQ ID NO: 940563 - RNA, 22 nt, Human
ugcuuagacgucaaguacagcc

SEQ ID NO: 940564 - RNA, 22 nt, Human
acacauuucucuuuuuguaagu

SEQ ID NO: 940565 - RNA, 22 nt, Human
gcugggaagugcaagaucaagg

SEQ ID NO: 940566 - RNA, 22 nt, Human
agccuggcuguaaccucauggu

SEQ ID NO: 940567 - RNA, 22 nt, Human
gcagccacacuguuacagaaug

SEQ ID NO: 940568 - RNA, 22 nt, Human
agggaguuagaaauccaggaua

SEQ ID NO: 940569 - RNA, 22 nt, Human
ggaggugaggccguagggugug

SEQ ID NO: 940570 - RNA, 22 nt, Human
gugcauauaugugcagcaucaa

SEQ ID NO: 940571 - RNA, 22 nt, Human
uggcucuguugagguauggauu

SEQ ID NO: 940572 - RNA, 22 nt, Human
ucagugucuugaccugggugug

SEQ ID NO: 940573 - RNA, 22 nt, Human
uuugcagugucagcuucugugu

SEQ ID NO: 940574 - RNA, 22 nt, Human
uugaagauggaucgccacucuc

SEQ ID NO: 940575 - RNA, 22 nt, Human
ugucaaaaauaagagagauugu

SEQ ID NO: 940576 - RNA, 22 nt, Human
cgaggcagacaaaaguuggaag

SEQ ID NO: 940577 - RNA, 22 nt, Human
cuggcaguuggcagggcugcca

SEQ ID NO: 940578 - RNA, 22 nt, Human
aggauuuguuuauaggucuuaa

SEQ ID NO: 940579 - RNA, 22 nt, Human
acagcagcuggguucccaccau

SEQ ID NO: 940580 - RNA, 22 nt, Human
ugccucugcugcuguggcauca

SEQ ID NO: 940581 - RNA, 22 nt, Human
gcagacagggcuacagagguac

SEQ ID NO: 940582 - RNA, 22 nt, Human
uuauuaggaacucaggauuuuu

SEQ ID NO: 940583 - RNA, 22 nt, Human
ugugugaauggauuauucuauu

SEQ ID NO: 940584 - RNA, 22 nt, Human
gaggccagaaugagcugaaugc

SEQ ID NO: 940585 - RNA, 22 nt, Human
ccagagccggcucccucagcuu

SEQ ID NO: 940586 - RNA, 20 nt, Human
cucucccagcacagcuuccu

SEQ ID NO: 940587 - RNA, 18 nt, Human
aggcccuggccucgaaca

SEQ ID NO: 940588 - RNA, 22 nt, Human
uuuaguagaugcagcauuauuu

SEQ ID NO: 940589 - RNA, 23 nt, Human
cuugcaggaagcagauggcacac

SEQ ID NO: 940590 - RNA, 22 nt, Human
ccccagcucagugcagggacau

SEQ ID NO: 940591 - RNA, 22 nt, Human
cuguggaaggccuguccugaaa

SEQ ID NO: 940592 - RNA, 22 nt, Human
ggcucagguuaccagucccucc

SEQ ID NO: 940593 - RNA, 20 nt, Human
ccuggaagagcuccccaggc

SEQ ID NO: 940594 - RNA, 22 nt, Human
ugccucugguuaucugguaccu

SEQ ID NO: 940595 - RNA, 22 nt, Human
gugauuuucuccuccuagaagu

SEQ ID NO: 940596 - RNA, 22 nt, Human
ggcagggaaacagcugauccca

SEQ ID NO: 940597 - RNA, 22 nt, Human
cagcccaaagccccaggcuaga

SEQ ID NO: 940598 - RNA, 22 nt, Human
cccagcccugaccuauuggaaa

SEQ ID NO: 940599 - RNA, 22 nt, Human
cuuguccccagcagguugguuu

SEQ ID NO: 940600 - RNA, 22 nt, Human
uggccugggccggcagauauac

SEQ ID NO: 940601 - RNA, 20 nt, Human
uccugagauuuaagggguuc

SEQ ID NO: 940602 - RNA, 22 nt, Human
cuggagggugagccucaucucu

SEQ ID NO: 940603 - RNA, 22 nt, Human
uugggaaggcguggaagcagaa

SEQ ID NO: 940604 - RNA, 22 nt, Human
ggcccugagcugaaguacugug

SEQ ID NO: 940605 - RNA, 20 nt, Human
cucucuggaaggugggagcc

SEQ ID NO: 940606 - RNA, 22 nt, Human
agccugagagccaagcugugca

SEQ ID NO: 940607 - RNA, 22 nt, Human
ugggccugugaugcugggcuau

SEQ ID NO: 940608 - RNA, 22 nt, Human
agaggacagacggaaagugcca

SEQ ID NO: 940609 - RNA, 22 nt, Human
uguacaguguagucaugagguu

SEQ ID NO: 940610 - RNA, 22 nt, Human
aggccugucuggggcucagcca

SEQ ID NO: 940611 - RNA, 22 nt, Human
ggcagccuugagggaggccugg

SEQ ID NO: 940612 - RNA, 22 nt, Human
uucccaguauuaccuucaggaa

SEQ ID NO: 940613 - RNA, 22 nt, Human
acagggcaccugagguaggaag

SEQ ID NO: 940614 - RNA, 22 nt, Human
cucccuggaggcccagaccugg

SEQ ID NO: 940615 - RNA, 22 nt, Human
gcaggagcccuggcauguucuu

SEQ ID NO: 940616 - RNA, 23 nt, Human
cuggcucauccugguugcagugg

SEQ ID NO: 940617 - RNA, 21 nt, Human
acaggagaccgccuggcaguc

SEQ ID NO: 940618 - RNA, 22 nt, Human
acaaagucugaaaccugaggca

SEQ ID NO: 940619 - RNA, 22 nt, Human
acauuucugcaucucagagcua

SEQ ID NO: 940620 - RNA, 22 nt, Human
uagagcuguaucaaagagccuu

SEQ ID NO: 940621 - RNA, 19 nt, Human
gcaggcacagcccugggug

SEQ ID NO: 940622 - RNA, 22 nt, Human
auuaggauguuccuaugcacau

SEQ ID NO: 940623 - RNA, 22 nt, Human
cuggcuguauuaguuugauccu

SEQ ID NO: 940624 - RNA, 22 nt, Human
cacccaggcuggagugcagggg

SEQ ID NO: 940625 - RNA, 22 nt, Human
aaauguguuucuuugugaaugg

SEQ ID NO: 940626 - RNA, 22 nt, Human
augcaucauggaaaacucaguu

SEQ ID NO: 940627 - RNA, 19 nt, Human
cugaggcccauguaccaug

SEQ ID NO: 940628 - RNA, 22 nt, Human
gacucagugauuugacaugccu

SEQ ID NO: 940629 - RNA, 22 nt, Human
ggcagcacugcagcuuguuggg

SEQ ID NO: 940630 - RNA, 22 nt, Human
agagccagcaagugaauaguga

SEQ ID NO: 940631 - RNA, 18 nt, Human
ucagggaagagaauauga

SEQ ID NO: 940632 - RNA, 22 nt, Human
auguuucaccagcaaauuaccu

SEQ ID NO: 940633 - RNA, 22 nt, Human
ucugggcuugguuagggcuguu

SEQ ID NO: 940634 - RNA, 22 nt, Human
cagacagcugcuuucuugcugu

SEQ ID NO: 940635 - RNA, 21 nt, Human
cccagggaagccgcagucacc

SEQ ID NO: 940636 - RNA, 21 nt, Human
aagccucaagcagaagacaga

SEQ ID NO: 940637 - RNA, 22 nt, Human
cagagagagucaaaucuuugcu

SEQ ID NO: 940638 - RNA, 22 nt, Human
cuguacauauacauuuuuuucc

SEQ ID NO: 940639 - RNA, 22 nt, Human
cugaggaagacagcagcugugu

SEQ ID NO: 940640 - RNA, 22 nt, Human
cugcugucuuuauuucacugcu

SEQ ID NO: 940641 - RNA, 22 nt, Human
agauuucccacuccauguauug

SEQ ID NO: 940642 - RNA, 22 nt, Human
aggcccugcauuguacugaggg

SEQ ID NO: 940643 - RNA, 22 nt, Human
acauucaugucccacuucuagc

SEQ ID NO: 940644 - RNA, 22 nt, Human
cuuuccaagaaugcagauaccu

SEQ ID NO: 940645 - RNA, 22 nt, Human
auguuuaaaggagucagagacu

SEQ ID NO: 940646 - RNA, 23 nt, Human
aucaagauaauccagaugaccua

SEQ ID NO: 940647 - RNA, 22 nt, Human
gcacucugugaucugcagagcc

SEQ ID NO: 940648 - RNA, 22 nt, Human
gcucugcucuugacuuaccagg

SEQ ID NO: 940649 - RNA, 22 nt, Human
agaauaguggcaaugacugcac

SEQ ID NO: 940650 - RNA, 22 nt, Human
aauucacauguugaaguccuaa

SEQ ID NO: 940651 - RNA, 22 nt, Human
auguaucagauaaagcaugugg

SEQ ID NO: 940652 - RNA, 22 nt, Human
uaauccacaauagagauuaucu

SEQ ID NO: 940653 - RNA, 22 nt, Human
aggccuccugcagggaugagug

SEQ ID NO: 940654 - RNA, 22 nt, Human
ucaauucugguccucaggaacu

SEQ ID NO: 940655 - RNA, 17 nt, Human
uuuucucucuuggauuc

SEQ ID NO: 940656 - RNA, 22 nt, Human
uucuccgcuaaguucucugcag

SEQ ID NO: 940657 - RNA, 22 nt, Human
caggccuccacuccacgcagac

SEQ ID NO: 940658 - RNA, 22 nt, Human
uuguuuuaucuuucuacagacu

SEQ ID NO: 940659 - RNA, 22 nt, Human
acccaggagcucugggguccuc

SEQ ID NO: 940660 - RNA, 22 nt, Human
uccucaggucaaagcaggagaa

SEQ ID NO: 940661 - RNA, 21 nt, Human
gcaaggcuuuuguguuuccca

SEQ ID NO: 940662 - RNA, 22 nt, Human
gcuggccagggcugcucgcgga

SEQ ID NO: 940663 - RNA, 22 nt, Human
gagggucccugcucagggccag

SEQ ID NO: 940664 - RNA, 22 nt, Human
ggggcagaguagcuggggugug

SEQ ID NO: 940665 - RNA, 22 nt, Human
aggccaaauagcagguuugcua

SEQ ID NO: 940666 - RNA, 19 nt, Human
accucugcagagauguuua

SEQ ID NO: 940667 - RNA, 22 nt, Human
caaugugguggcagaugucagu

SEQ ID NO: 940668 - RNA, 22 nt, Human
ggcugcuggaagacugaacaag

SEQ ID NO: 940669 - RNA, 22 nt, Human
ucugucugcaccuaagcacagu

SEQ ID NO: 940670 - RNA, 22 nt, Human
aacaugaaaguugcuaagugca

SEQ ID NO: 940671 - RNA, 22 nt, Human
cuggagcucuccagagccccgu

SEQ ID NO: 940672 - RNA, 22 nt, Human
guguaucaaagcacagacuuca

SEQ ID NO: 940673 - RNA, 22 nt, Human
uggcagcaauuagcuagagcug

SEQ ID NO: 940674 - RNA, 18 nt, Human
gcucugcccaggcugccc

SEQ ID NO: 940675 - RNA, 22 nt, Human
cugggagggguagccaauccua

SEQ ID NO: 940676 - RNA, 22 nt, Human
aucacaaaggcugcuucaugau

SEQ ID NO: 940677 - RNA, 22 nt, Human
ugcagaagaaaacagcugugug

SEQ ID NO: 940678 - RNA, 22 nt, Human
gucauuguguggacauggagaa

SEQ ID NO: 940679 - RNA, 22 nt, Human
gaggacagcuuagggcuuccug

SEQ ID NO: 940680 - RNA, 22 nt, Human
aggacagggauucaaacuccca

SEQ ID NO: 940681 - RNA, 22 nt, Human
uggcagcuccggguaggggcug

SEQ ID NO: 940682 - RNA, 22 nt, Human
cagagcugauuggauccagaga

SEQ ID NO: 940683 - RNA, 19 nt, Human
ucaaagucugagucacuuu

SEQ ID NO: 940684 - RNA, 22 nt, Human
uugaauaggacucagcagugau

SEQ ID NO: 940685 - RNA, 22 nt, Human
ccucagagccuccagaaggaau

SEQ ID NO: 940686 - RNA, 22 nt, Human
uuauucuuuaaacauauauguu

SEQ ID NO: 940687 - RNA, 22 nt, Human
gguggguuuggaagagcaggcu

SEQ ID NO: 940688 - RNA, 22 nt, Human
ugcuucaggagaugucaccaug

SEQ ID NO: 940689 - RNA, 21 nt, Human
agaaaauggcguuuuagauuu

SEQ ID NO: 940690 - RNA, 22 nt, Human
uuccagcaggcagacaggagau

SEQ ID NO: 940691 - RNA, 22 nt, Human
aggagcugcuuaaaugguuggu

SEQ ID NO: 940692 - RNA, 22 nt, Human
uucaggauccccuugaugggcu

SEQ ID NO: 940693 - RNA, 22 nt, Human
aauucacaaaaguuagauccau

SEQ ID NO: 940694 - RNA, 22 nt, Human
uuugaaaguguuuacuugggaa

SEQ ID NO: 940695 - RNA, 22 nt, Human
ugcucacugaacucuugcuguc

SEQ ID NO: 940696 - RNA, 22 nt, Human
guuuucugauuagcaaaucuga

SEQ ID NO: 940697 - RNA, 22 nt, Human
gucagaggggcagcugccaggc

SEQ ID NO: 940698 - RNA, 22 nt, Human
aauuccugucuuaacaguucug

SEQ ID NO: 940699 - RNA, 22 nt, Human
aaaugucuaucuggcauauucc

SEQ ID NO: 940700 - RNA, 22 nt, Human
uggacaaaugauuucuaccuuu

SEQ ID NO: 940701 - RNA, 22 nt, Human
aagucaaaccuugcucacagga

SEQ ID NO: 940702 - RNA, 22 nt, Human
ugcccaaaccucuccuagcucu

SEQ ID NO: 940703 - RNA, 22 nt, Human
cauaugaaauaugaguugaaca

SEQ ID NO: 940704 - RNA, 22 nt, Human
uggacucaaguccaaguucacg

SEQ ID NO: 940705 - RNA, 22 nt, Human
uaaaccuugguagcaucuugcu

SEQ ID NO: 940706 - RNA, 22 nt, Human
aggaggccgauuucagaggucg

SEQ ID NO: 940707 - RNA, 22 nt, Human
gaggccuggaccagccacagag

SEQ ID NO: 940708 - RNA, 22 nt, Human
gcucucugguuccagucaggaa

SEQ ID NO: 940709 - RNA, 22 nt, Human
agaggcuccaccuucucugucc

SEQ ID NO: 940710 - RNA, 22 nt, Human
aggaggcccuagagcucuagag

SEQ ID NO: 940711 - RNA, 22 nt, Human
cuggcugcgucugcucugacag

SEQ ID NO: 940712 - RNA, 22 nt, Human
uuccuggugguggugacagcac

SEQ ID NO: 940713 - RNA, 22 nt, Human
uuguuuugcuaaagggucauca

SEQ ID NO: 940714 - RNA, 22 nt, Human
uuugcauuucucguaaggaaac

SEQ ID NO: 940715 - RNA, 20 nt, Human
aggcaguuagaaggagauga

SEQ ID NO: 940716 - RNA, 22 nt, Human
agcuccaggugcaagucauggu

SEQ ID NO: 940717 - RNA, 22 nt, Human
accuguuuuccuaucuagauug

SEQ ID NO: 940718 - RNA, 22 nt, Human
agcagagcggggccuccggaag

SEQ ID NO: 940719 - RNA, 22 nt, Human
ccuggagggcgccgcacagucc

SEQ ID NO: 940720 - RNA, 22 nt, Human
agucccagccuguaggauuggg

SEQ ID NO: 940721 - RNA, 22 nt, Human
aaacuacuggauuaguaacuua

SEQ ID NO: 940722 - RNA, 22 nt, Human
cugagccaugagccugcgccca

SEQ ID NO: 940723 - RNA, 22 nt, Human
uauuugaaggcauacauuuuga

SEQ ID NO: 940724 - RNA, 20 nt, Human
ugcuugucaugcacucaggc

SEQ ID NO: 940725 - RNA, 22 nt, Human
cucugggcuuguugaccugcac

SEQ ID NO: 940726 - RNA, 22 nt, Human
agacaggagagggaacugccgg

SEQ ID NO: 940727 - RNA, 22 nt, Human
acauuucugcuagaauagguga

SEQ ID NO: 940728 - RNA, 22 nt, Human
gaugcaaagcauuuuugugugu

SEQ ID NO: 940729 - RNA, 18 nt, Human
uuucacaaccuccagagg

SEQ ID NO: 940730 - RNA, 20 nt, Human
gcagcugcccccagucccug

SEQ ID NO: 940731 - RNA, 22 nt, Human
gccaccagugggggccugggca

SEQ ID NO: 940732 - RNA, 22 nt, Human
agagcugggugaagugccauca

SEQ ID NO: 940733 - RNA, 22 nt, Human
aagauuuccauuucuagcucau

SEQ ID NO: 940734 - RNA, 22 nt, Human
cuugcaggauuuugcugcugua

SEQ ID NO: 940735 - RNA, 22 nt, Human
agcuguguggugucugacagcu

SEQ ID NO: 940736 - RNA, 22 nt, Human
cuuagaaaugcagauucucagg

SEQ ID NO: 940737 - RNA, 22 nt, Human
ggguggagcuuggacaccagua

SEQ ID NO: 940738 - RNA, 22 nt, Human
acaggcugcccgcuccccaccu

SEQ ID NO: 940739 - RNA, 22 nt, Human
aaaugcaggaaauuaugcuuuu

SEQ ID NO: 940740 - RNA, 22 nt, Human
cccagcauggagugaggacuca

SEQ ID NO: 940741 - RNA, 22 nt, Human
cuucuucaucuguaaaacuugg

SEQ ID NO: 940742 - RNA, 22 nt, Human
auuagguuagugugcaagagaa

SEQ ID NO: 940743 - RNA, 22 nt, Human
gacccaggggcagggagaaagu

SEQ ID NO: 940744 - RNA, 22 nt, Human
uuguuaaaaugcauauucuggu

SEQ ID NO: 940745 - RNA, 22 nt, Human
uugcagcugcaguaaauguuca

SEQ ID NO: 940746 - RNA, 22 nt, Human
guauuugauagauuucaaagga

SEQ ID NO: 940747 - RNA, 22 nt, Human
gugucccagcagcacauuggcu

SEQ ID NO: 940748 - RNA, 22 nt, Human
ggccaaaccgcaauuauuuuug

SEQ ID NO: 940749 - RNA, 22 nt, Human
auuuccuauggauacaggcaga

SEQ ID NO: 940750 - RNA, 22 nt, Human
uccauuuuguagguaugcuaca

SEQ ID NO: 940751 - RNA, 22 nt, Human
gcagauggacuguaugaccuga

SEQ ID NO: 940752 - RNA, 22 nt, Human
cccagcucucugcucuuagccu

SEQ ID NO: 940753 - RNA, 22 nt, Human
caagauggaguccgggaaugug

SEQ ID NO: 940754 - RNA, 22 nt, Human
cagccccucacagagcuguccu

SEQ ID NO: 940755 - RNA, 22 nt, Human
gacauucacagguaaacauucc

SEQ ID NO: 940756 - RNA, 22 nt, Human
ccaggccucccuuuuccagcca

SEQ ID NO: 940757 - RNA, 19 nt, Human
cugggagguguucagagaa

SEQ ID NO: 940758 - RNA, 22 nt, Human
augaaacaguguguauagcaaa

SEQ ID NO: 940759 - RNA, 22 nt, Human
auuaggauuugguauggucaua

SEQ ID NO: 940760 - RNA, 23 nt, Human
gugauuucagggaacagaaucag

SEQ ID NO: 940761 - RNA, 22 nt, Human
gcucagagcuugaaguuccacu

SEQ ID NO: 940762 - RNA, 22 nt, Human
acagaauucucucugcagaggc

SEQ ID NO: 940763 - RNA, 22 nt, Human
uuugacauuauccuguuacugg

SEQ ID NO: 940764 - RNA, 22 nt, Human
ggagcugggaauuggaucaucu

SEQ ID NO: 940765 - RNA, 22 nt, Human
uaguuuuuucaacaaauggugc

SEQ ID NO: 940766 - RNA, 19 nt, Human
acuggcaguuucugcaugg

SEQ ID NO: 940767 - RNA, 22 nt, Human
uaggggugaggccaggcaucag

SEQ ID NO: 940768 - RNA, 22 nt, Human
agaggaggaagagcuuuaaaau

SEQ ID NO: 940769 - RNA, 23 nt, Human
aggugccaacugagagcugagag

SEQ ID NO: 940770 - RNA, 22 nt, Human
aaauucaguuuuaauaaucacu

SEQ ID NO: 940771 - RNA, 22 nt, Human
uugacagcuauuuugcuuugau

SEQ ID NO: 940772 - RNA, 22 nt, Human
ucuucacaggagccugccugcc

SEQ ID NO: 940773 - RNA, 21 nt, Human
gcugucucuggcuccugggaa

SEQ ID NO: 940774 - RNA, 22 nt, Human
uccuucagaaaaccucagucuu

SEQ ID NO: 940775 - RNA, 20 nt, Human
aagagcugacucacaguggu

SEQ ID NO: 940776 - RNA, 22 nt, Human
ccagagccucuuaugaagaucg

SEQ ID NO: 940777 - RNA, 22 nt, Human
augcaguacagauaauucuaca

SEQ ID NO: 940778 - RNA, 22 nt, Human
cugcagccucaaccuccugagc

SEQ ID NO: 940779 - RNA, 22 nt, Human
uacagcuaggcaaaaaugacau

SEQ ID NO: 940780 - RNA, 21 nt, Human
auccuugaucagaagagugcu

SEQ ID NO: 940781 - RNA, 22 nt, Human
ggcuggaaguccaagaucaagg

SEQ ID NO: 940782 - RNA, 22 nt, Human
guccucugggagccuugagccu

SEQ ID NO: 940783 - RNA, 22 nt, Human
cagggguguuuuuggccaggag

SEQ ID NO: 940784 - RNA, 22 nt, Human
ugcuugaggggaauaaaaagaa

SEQ ID NO: 940785 - RNA, 22 nt, Human
cucagagcccaggguacacccg

SEQ ID NO: 940786 - RNA, 20 nt, Human
ccaccuggccaaggcugugc

SEQ ID NO: 940787 - RNA, 22 nt, Human
gcugugagggucuagugaggug

SEQ ID NO: 940788 - RNA, 23 nt, Human
ugcuucucugcuugacaguucug

SEQ ID NO: 940789 - RNA, 22 nt, Human
ggcugcagggcagcuggugugg

SEQ ID NO: 940790 - RNA, 22 nt, Human
gccuggagggcucuagagaggc

SEQ ID NO: 940791 - RNA, 20 nt, Human
aggaagccaaaggcugucuu

SEQ ID NO: 940792 - RNA, 22 nt, Human
uuauuuaaugugaucugaagag

SEQ ID NO: 940793 - RNA, 22 nt, Human
cccucugccugggaccaagucc

SEQ ID NO: 940794 - RNA, 22 nt, Human
acccuggggguggccagugcca

SEQ ID NO: 940795 - RNA, 23 nt, Human
agcuggguggccugcgugaagcu

SEQ ID NO: 940796 - RNA, 22 nt, Human
gugcccaggcccaaggcaccac

SEQ ID NO: 940797 - RNA, 19 nt, Human
ugucacugucauggcccag

SEQ ID NO: 940798 - RNA, 22 nt, Human
uccuucaagaugccacagcuuu

SEQ ID NO: 940799 - RNA, 21 nt, Human
gaaaggucuuaacuuacagag

SEQ ID NO: 940800 - RNA, 22 nt, Human
gaauagcuuccuuuuuuccaaa

SEQ ID NO: 940801 - RNA, 22 nt, Human
aggcacaguuucauccccgggc

SEQ ID NO: 940802 - RNA, 22 nt, Human
cccugagaugccucacccuagu

SEQ ID NO: 940803 - RNA, 22 nt, Human
gugugcccuuguucagcagagu

SEQ ID NO: 940804 - RNA, 22 nt, Human
ggagaggacauggcucccacag

SEQ ID NO: 940805 - RNA, 22 nt, Human
agccagccgggggaccacagug

SEQ ID NO: 940806 - RNA, 19 nt, Human
agucccaggcccgaaagag

SEQ ID NO: 940807 - RNA, 22 nt, Human
gcuggcaccugcaccaagcagg

SEQ ID NO: 940808 - RNA, 22 nt, Human
ggcagcuuucaauaggguuaug

SEQ ID NO: 940809 - RNA, 22 nt, Human
uuugauaacagugaauaucaug

SEQ ID NO: 940810 - RNA, 22 nt, Human
gagcuuggugaugccuccuggu

SEQ ID NO: 940811 - RNA, 22 nt, Human
ggcacuguguacacacagagac

SEQ ID NO: 940812 - RNA, 22 nt, Human
agauacaucauuuauaccuuca

SEQ ID NO: 940813 - RNA, 22 nt, Human
aucauucuagcuguuguguuga

SEQ ID NO: 940814 - RNA, 22 nt, Human
agguaaagacugcaaggagaau

SEQ ID NO: 940815 - RNA, 22 nt, Human
auucuucaccugagucagucua

SEQ ID NO: 940816 - RNA, 22 nt, Human
agaaaugcauuagcacauauag

SEQ ID NO: 940817 - RNA, 22 nt, Human
ggagcugggguuggcaucuucc

SEQ ID NO: 940818 - RNA, 22 nt, Human
cauacuuugggauaagagugga

SEQ ID NO: 940819 - RNA, 22 nt, Human
ccuggccagggucugggcugcu

SEQ ID NO: 940820 - RNA, 22 nt, Human
ugcucaggaaauaaugucugug

SEQ ID NO: 940821 - RNA, 22 nt, Human
ccagagcuccagggcuacagaa

SEQ ID NO: 940822 - RNA, 22 nt, Human
uaauuuacuugcaaauaacaau

SEQ ID NO: 940823 - RNA, 22 nt, Human
gccacaugcaauugcagcacgu

SEQ ID NO: 940824 - RNA, 22 nt, Human
gaaacccaaacuaagacaguag

SEQ ID NO: 940825 - RNA, 22 nt, Human
uguguuaacacugcaugauaau

SEQ ID NO: 940826 - RNA, 22 nt, Human
uccugucuaaagaccugcaggc

SEQ ID NO: 940827 - RNA, 22 nt, Human
cacacaugagucuccccauugg

SEQ ID NO: 940828 - RNA, 22 nt, Human
gggcuuauggagggcuuuguac

SEQ ID NO: 940829 - RNA, 22 nt, Human
cucccucugucuuguccagaaa

SEQ ID NO: 940830 - RNA, 22 nt, Human
aguguauugauuggaacagccu

SEQ ID NO: 940831 - RNA, 22 nt, Human
aaguucuacuguggguaaaaug

SEQ ID NO: 940832 - RNA, 22 nt, Human
caagaugaaacuacagggagga

SEQ ID NO: 940833 - RNA, 20 nt, Human
uaacauaguccagagaacga

SEQ ID NO: 940834 - RNA, 22 nt, Human
agccaggauuggcugagccuua

SEQ ID NO: 940835 - RNA, 22 nt, Human
gucucccacuuucuggccucuu

SEQ ID NO: 940836 - RNA, 23 nt, Human
ugucacauuuaguuggcauuguu

SEQ ID NO: 940837 - RNA, 22 nt, Human
uucagagccacuucaagucuaa

SEQ ID NO: 940838 - RNA, 22 nt, Human
ccagggcaauuauuuggagggu

SEQ ID NO: 940839 - RNA, 22 nt, Human
gcugugcuauaucucugagugu

SEQ ID NO: 940840 - RNA, 22 nt, Human
aggagaguucacacuggucaga

SEQ ID NO: 940841 - RNA, 22 nt, Human
accaguccgcggagcuccgggg

SEQ ID NO: 940842 - RNA, 22 nt, Human
uuugcauuguaauauuuaguuc

SEQ ID NO: 940843 - RNA, 22 nt, Human
uaccuuuugcuuauuaugacac

SEQ ID NO: 940844 - RNA, 22 nt, Human
agcuccugcacccagccuugag

SEQ ID NO: 940845 - RNA, 22 nt, Human
auucugagaaaugcauugucag

SEQ ID NO: 940846 - RNA, 21 nt, Human
auacauucuauuaagcauuua

SEQ ID NO: 940847 - RNA, 22 nt, Human
aagacauuuauuugaaucaauu

SEQ ID NO: 940848 - RNA, 22 nt, Human
cugcuguguaucauuuuagaug

SEQ ID NO: 940849 - RNA, 22 nt, Human
uggcugggggugcuauagcugc

SEQ ID NO: 940850 - RNA, 22 nt, Human
auccaggguguggagagagcuc

SEQ ID NO: 940851 - RNA, 22 nt, Human
guuauguaugagggaaugauua

SEQ ID NO: 940852 - RNA, 22 nt, Human
gagugcaggccugagcaccauc

SEQ ID NO: 940853 - RNA, 21 nt, Human
ucauuugugaucugauuucca

SEQ ID NO: 940854 - RNA, 22 nt, Human
auauaaguuaguggucauguuu

SEQ ID NO: 940855 - RNA, 22 nt, Human
ggggcccagcaccccuccucgc

SEQ ID NO: 940856 - RNA, 22 nt, Human
uucaacuagauuuauacaauuc

SEQ ID NO: 940857 - RNA, 22 nt, Human
gcagagccugggggucugcgga

SEQ ID NO: 940858 - RNA, 22 nt, Human
aggcccuggguuagggcccacu

SEQ ID NO: 940859 - RNA, 22 nt, Human
acucucagaggguggcagcaau

SEQ ID NO: 940860 - RNA, 22 nt, Human
aagggcaggaaaagauggaugu

SEQ ID NO: 940861 - RNA, 22 nt, Human
uaaaguucagugcaugaaugug

SEQ ID NO: 940862 - RNA, 22 nt, Human
uuccuuccauagcaaaacaugc

SEQ ID NO: 940863 - RNA, 22 nt, Human
cguuggagacacuugaggacuu

SEQ ID NO: 940864 - RNA, 22 nt, Human
aucuggcugcugugcuuaagcu

SEQ ID NO: 940865 - RNA, 22 nt, Human
uggcuucuuagaccaguggccu

SEQ ID NO: 940866 - RNA, 22 nt, Human
cuugugcauuucauuccucagg

SEQ ID NO: 940867 - RNA, 22 nt, Human
ggugcagaucuuucucuucagg

SEQ ID NO: 940868 - RNA, 22 nt, Human
cagugcaguugguggcaggggu

SEQ ID NO: 940869 - RNA, 22 nt, Human
uuucaagagggaacugaacaca

SEQ ID NO: 940870 - RNA, 22 nt, Human
cuuauguauauuuggaacguac

SEQ ID NO: 940871 - RNA, 22 nt, Human
aggcugcugaggccaccacgcu

SEQ ID NO: 940872 - RNA, 20 nt, Human
uuugucuguuaaguguuucu

SEQ ID NO: 940873 - RNA, 22 nt, Human
ccagaggcuggguucaccucag

SEQ ID NO: 940874 - RNA, 22 nt, Human
gugcaugugcauccauguguac

SEQ ID NO: 940875 - RNA, 22 nt, Human
uuucuguagugugguauguagg

SEQ ID NO: 940876 - RNA, 22 nt, Human
uggcagcuggcucugcgcaggc

SEQ ID NO: 940877 - RNA, 22 nt, Human
gcuuucucuucacugauguuca

SEQ ID NO: 940878 - RNA, 22 nt, Human
aauucacagaaccauggugcuc

SEQ ID NO: 940879 - RNA, 22 nt, Human
uggaaggcaacggagugagcug

SEQ ID NO: 940880 - RNA, 20 nt, Human
ggagagcagggaagacagua

SEQ ID NO: 940881 - RNA, 22 nt, Human
acucaggaagaaagcagcuggu

SEQ ID NO: 940882 - RNA, 22 nt, Human
acccagagcugggcuuggcaaa

SEQ ID NO: 940883 - RNA, 22 nt, Human
uaaaugugggggccacgggcuu

SEQ ID NO: 940884 - RNA, 22 nt, Human
cucacaggcaucucaucaggcu

SEQ ID NO: 940885 - RNA, 22 nt, Human
gugugucuuucauuucaugagg

SEQ ID NO: 940886 - RNA, 22 nt, Human
ucccagggucaguggugaggcc

SEQ ID NO: 940887 - RNA, 22 nt, Human
uacauuaucuuguuaucuuuca

SEQ ID NO: 940888 - RNA, 22 nt, Human
caacuccuccccagcaugccaa

SEQ ID NO: 940889 - RNA, 22 nt, Human
uggcagggccugcucaucaucc

SEQ ID NO: 940890 - RNA, 22 nt, Human
ucuaaaaaagucuguucacuug

SEQ ID NO: 940891 - RNA, 20 nt, Human
accauaauguuaauuacaaa

SEQ ID NO: 940892 - RNA, 22 nt, Human
ugggggugacuaucucgggaau

SEQ ID NO: 940893 - RNA, 22 nt, Human
agcugcccuuuaugaugcugaa

SEQ ID NO: 940894 - RNA, 22 nt, Human
gcuuagucaauuauaaauaggc

SEQ ID NO: 940895 - RNA, 22 nt, Human
agggucugacuccucuggcaag

SEQ ID NO: 940896 - RNA, 22 nt, Human
cagagacauuaagugccaugau

SEQ ID NO: 940897 - RNA, 22 nt, Human
aauacugccugugagguaacuc

SEQ ID NO: 940898 - RNA, 22 nt, Human
ucaugaauauugaaugcuucau

SEQ ID NO: 940899 - RNA, 22 nt, Human
caacuccuggcuguuaggcaca

SEQ ID NO: 940900 - RNA, 19 nt, Human
gagcagcugcacccauuga

SEQ ID NO: 940901 - RNA, 21 nt, Human
gagacagacuuucguccccug

SEQ ID NO: 940902 - RNA, 19 nt, Human
agagaggcugugugaggga

SEQ ID NO: 940903 - RNA, 22 nt, Human
cccaccccuggacaggugagug

SEQ ID NO: 940904 - RNA, 22 nt, Human
guccucugggcuuugagcaguc

SEQ ID NO: 940905 - RNA, 22 nt, Human
gugugucccuccucuccugagu

SEQ ID NO: 940906 - RNA, 20 nt, Human
ucaggaugugcugagugaag

SEQ ID NO: 940907 - RNA, 22 nt, Human
cucuuaaagcuuccaguuucaa

SEQ ID NO: 940908 - RNA, 22 nt, Human
aaggcacuuuuccugagaugau

SEQ ID NO: 940909 - RNA, 22 nt, Human
ucugccaccaccuacacuagua

SEQ ID NO: 940910 - RNA, 22 nt, Human
uuucuucacaggguauugggug

SEQ ID NO: 940911 - RNA, 23 nt, Human
uugugucuacuuccuaucuaggg

SEQ ID NO: 940912 - RNA, 22 nt, Human
gcccaggagguggaggugcagu

SEQ ID NO: 940913 - RNA, 22 nt, Human
uugaaaguccuucuugaguuac

SEQ ID NO: 940914 - RNA, 22 nt, Human
gcagcagcccagggcucucaga

SEQ ID NO: 940915 - RNA, 22 nt, Human
caguuucuuggaugccaauuuc

SEQ ID NO: 940916 - RNA, 22 nt, Human
aggucauugaaguuauuuucuu

SEQ ID NO: 940917 - RNA, 21 nt, Human
ugcagccauucagcccuaugc

SEQ ID NO: 940918 - RNA, 22 nt, Human
uuauuuggguuugaguguggca

SEQ ID NO: 940919 - RNA, 22 nt, Human
ccuccuggggugaaggauggga

SEQ ID NO: 940920 - RNA, 22 nt, Human
uggcagaaguucacuaguagcu

SEQ ID NO: 940921 - RNA, 23 nt, Human
agagcuuucuaaaauguaaaucu

SEQ ID NO: 940922 - RNA, 22 nt, Human
cucagcagcagggaagagguca

SEQ ID NO: 940923 - RNA, 22 nt, Human
uaaaucacuccuaauaaucagu

SEQ ID NO: 940924 - RNA, 22 nt, Human
cucaggguaaugaaagacgaau

SEQ ID NO: 940925 - RNA, 22 nt, Human
gcugugugacugagagccuggc

SEQ ID NO: 940926 - RNA, 22 nt, Human
cugccuggucucaggcaugggg

SEQ ID NO: 940927 - RNA, 22 nt, Human
gagcuuugcuggaagccugggg

SEQ ID NO: 940928 - RNA, 22 nt, Human
ucauugucuugauaugauuguc

SEQ ID NO: 940929 - RNA, 22 nt, Human
ggucagccuuggauuugguagc

SEQ ID NO: 940930 - RNA, 22 nt, Human
gcccaggaggcagagguugugg

SEQ ID NO: 940931 - RNA, 22 nt, Human
cacucugacuggcccugcagga

SEQ ID NO: 940932 - RNA, 22 nt, Human
ucugcaggaggcuggcugcagg

SEQ ID NO: 940933 - RNA, 22 nt, Human
cacccugggcugggccuguuaa

SEQ ID NO: 940934 - RNA, 21 nt, Human
uaauaauuccacuacagagua

SEQ ID NO: 940935 - RNA, 22 nt, Human
uuggcacugugccuggcacauu

SEQ ID NO: 940936 - RNA, 21 nt, Human
agcugcuuucagcuccuagag

SEQ ID NO: 940937 - RNA, 22 nt, Human
ggccaaaugaaaucugagcaau

SEQ ID NO: 940938 - RNA, 19 nt, Human
ugagaggcuuaaggcagcu

SEQ ID NO: 940939 - RNA, 22 nt, Human
acagagcugggugcccccugga

SEQ ID NO: 940940 - RNA, 22 nt, Human
cccagguggcagaagcugcagu

SEQ ID NO: 940941 - RNA, 22 nt, Human
caguggcgugaucucugcucac

SEQ ID NO: 940942 - RNA, 21 nt, Human
ucuuugcaucaguuguuuucu

SEQ ID NO: 940943 - RNA, 22 nt, Human
uuauuccauagaagucaaggaa

SEQ ID NO: 940944 - RNA, 22 nt, Human
cugacccauauaagaguggagg

SEQ ID NO: 940945 - RNA, 22 nt, Human
ucugggagagcugcugucagag

SEQ ID NO: 940946 - RNA, 22 nt, Human
ugcuggagaucauuaauguuca

SEQ ID NO: 940947 - RNA, 22 nt, Human
ugcagucuggauguccucagau

SEQ ID NO: 940948 - RNA, 22 nt, Human
aaaguguagagacuuuggaacc

SEQ ID NO: 940949 - RNA, 22 nt, Human
aacaguaaugugguguuggguu

SEQ ID NO: 940950 - RNA, 22 nt, Human
cucacugcaaguuccaccuacc

SEQ ID NO: 940951 - RNA, 22 nt, Human
agucucugugagcucccaaugg

SEQ ID NO: 940952 - RNA, 21 nt, Human
agaggcaggcauuaaguacac

SEQ ID NO: 940953 - RNA, 22 nt, Human
caguuucuucaucaguuaagca

SEQ ID NO: 940954 - RNA, 22 nt, Human
aacaaauguguuuuguaauuaa

SEQ ID NO: 940955 - RNA, 22 nt, Human
cagcagugaugugugaggguuc

SEQ ID NO: 940956 - RNA, 22 nt, Human
cugcagaggguuugagcauccu

SEQ ID NO: 940957 - RNA, 22 nt, Human
agccaugugucuuuauucuguu

SEQ ID NO: 940958 - RNA, 22 nt, Human
ucaggagcagcaugggugagag

SEQ ID NO: 940959 - RNA, 22 nt, Human
aggcagcuggcaaauucuagag

SEQ ID NO: 940960 - RNA, 22 nt, Human
auuguacaaugccuggaacauu

SEQ ID NO: 940961 - RNA, 22 nt, Human
auauuuucacagaacuugcaaa

SEQ ID NO: 940962 - RNA, 22 nt, Human
uucagauaaacuacaaauaauu

SEQ ID NO: 940963 - RNA, 22 nt, Human
agcucucaagauaagaaagaac

SEQ ID NO: 940964 - RNA, 22 nt, Human
agucccaggcagccgagccggu

SEQ ID NO: 940965 - RNA, 22 nt, Human
ggaaagagcccagcagugcuug

SEQ ID NO: 940966 - RNA, 22 nt, Human
auguuuuaugcuucagaugagg

SEQ ID NO: 940967 - RNA, 22 nt, Human
gagucccaugaugauagccaca

SEQ ID NO: 940968 - RNA, 22 nt, Human
agugucugaaccaccggggcau

SEQ ID NO: 940969 - RNA, 22 nt, Human
cugggacccugcccuguggccu

SEQ ID NO: 940970 - RNA, 22 nt, Human
caaaaguaauugcgguuuuugc

SEQ ID NO: 940971 - RNA, 20 nt, Human
agucccuuuggucagguauu

SEQ ID NO: 940972 - RNA, 22 nt, Human
ugacagaacagguugggagcaa

SEQ ID NO: 940973 - RNA, 22 nt, Human
acagcacaaucugagucccaga

SEQ ID NO: 940974 - RNA, 22 nt, Human
gcuggccagcccucuuccucca

SEQ ID NO: 940975 - RNA, 20 nt, Human
gucagaggacccuagagcga

SEQ ID NO: 940976 - RNA, 19 nt, Human
augucuggguaacagcugc

SEQ ID NO: 940977 - RNA, 22 nt, Human
ucgagcucuggagccaaggaug

SEQ ID NO: 940978 - RNA, 22 nt, Human
acaaaguuugugguauuccaag

SEQ ID NO: 940979 - RNA, 22 nt, Human
ccaaaaaguacauuuaggugug

SEQ ID NO: 940980 - RNA, 22 nt, Human
gaggccagaguuccccgaguca

SEQ ID NO: 940981 - RNA, 22 nt, Human
aauaacaggcucaucagaugcu

SEQ ID NO: 940982 - RNA, 22 nt, Human
gggugggaucuguggagccuca

SEQ ID NO: 940983 - RNA, 22 nt, Human
gccugccugaaggcuguaccag

SEQ ID NO: 940984 - RNA, 22 nt, Human
aaaaugcaugagaaugugcucg

SEQ ID NO: 940985 - RNA, 22 nt, Human
acugugggagcgcaguggcagc

SEQ ID NO: 940986 - RNA, 22 nt, Human
guggcucuccauugacauggaa

SEQ ID NO: 940987 - RNA, 22 nt, Human
gggcaguggcucacgccuguaa

SEQ ID NO: 940988 - RNA, 22 nt, Human
cagcugacagugaggugggggc

SEQ ID NO: 940989 - RNA, 22 nt, Human
augcugugucaccuuaggauuu

SEQ ID NO: 940990 - RNA, 22 nt, Human
aaguucaagagugacauauuag

SEQ ID NO: 940991 - RNA, 22 nt, Human
guuauauaagacaaaucagagu

SEQ ID NO: 940992 - RNA, 22 nt, Human
gaggcugcccaacuggagugga

SEQ ID NO: 940993 - RNA, 22 nt, Human
aggcagcugaccacaguaugau

SEQ ID NO: 940994 - RNA, 22 nt, Human
auauauuugagaauauucauga

SEQ ID NO: 940995 - RNA, 22 nt, Human
agccacagggggugagggacaa

SEQ ID NO: 940996 - RNA, 20 nt, Human
gcuuucaagcuugucauugu

SEQ ID NO: 940997 - RNA, 23 nt, Human
ugcuguccaacagacuggccaug

SEQ ID NO: 940998 - RNA, 22 nt, Human
uggaggugagugugguacagca

SEQ ID NO: 940999 - RNA, 22 nt, Human
aguuuuucugggaggcacugcu

SEQ ID NO: 941000 - RNA, 22 nt, Human
guauuagguuggugcaaaauug

SEQ ID NO: 941001 - RNA, 18 nt, Human
acagaacucaggggcacc

SEQ ID NO: 941002 - RNA, 22 nt, Human
gggcccagcgugguuccaucug

SEQ ID NO: 941003 - RNA, 22 nt, Human
ggaagggccucgggcgugggac

SEQ ID NO: 941004 - RNA, 22 nt, Human
caaacugagcaucagaaaguuu

SEQ ID NO: 941005 - RNA, 22 nt, Human
gucccugggaugcccuucuggg

SEQ ID NO: 941006 - RNA, 22 nt, Human
aagaggagacuucagcaacuug

SEQ ID NO: 941007 - RNA, 22 nt, Human
uugaaucuauguauucagugua

SEQ ID NO: 941008 - RNA, 20 nt, Human
uaaggcuguuuuguauuccu

SEQ ID NO: 941009 - RNA, 20 nt, Human
ccagguggugccuggagagg

SEQ ID NO: 941010 - RNA, 22 nt, Human
aaaaugagauacaguuugaaag

SEQ ID NO: 941011 - RNA, 22 nt, Human
cugcccugggauggucugugcg

SEQ ID NO: 941012 - RNA, 22 nt, Human
cagggacauugguggccagguu

SEQ ID NO: 941013 - RNA, 22 nt, Human
gcugcucuggcucugcaguguc

SEQ ID NO: 941014 - RNA, 22 nt, Human
uuaagauagaacccaguagucu

SEQ ID NO: 941015 - RNA, 22 nt, Human
ugauuaacugucuauuaaucau

SEQ ID NO: 941016 - RNA, 22 nt, Human
ggcagcugugaagugccucaca

SEQ ID NO: 941017 - RNA, 22 nt, Human
cagagacccuaggcaggugaca

SEQ ID NO: 941018 - RNA, 22 nt, Human
cugagcugggacucaguagcaa

SEQ ID NO: 941019 - RNA, 22 nt, Human
gggcaugguggugcacaccugu

SEQ ID NO: 941020 - RNA, 22 nt, Human
ugggcagacgcuguuggaaggc

SEQ ID NO: 941021 - RNA, 22 nt, Human
agaggccaggcugcagagggau

SEQ ID NO: 941022 - RNA, 22 nt, Human
uucagcaagaauuuacugagcu

SEQ ID NO: 941023 - RNA, 22 nt, Human
cugugucuaaucaggucaguca

SEQ ID NO: 941024 - RNA, 22 nt, Human
ucucagucagccuugauguccc

SEQ ID NO: 941025 - RNA, 22 nt, Human
caaauucagaaaauugguagag

SEQ ID NO: 941026 - RNA, 22 nt, Human
agaagccacuggagguugagau

SEQ ID NO: 941027 - RNA, 22 nt, Human
uuagaaauacaagugagguuga

SEQ ID NO: 941028 - RNA, 22 nt, Human
uaccucacugggccucaguuuu

SEQ ID NO: 941029 - RNA, 22 nt, Human
uccuggagccacggagcuuuca

SEQ ID NO: 941030 - RNA, 22 nt, Human
auuugcaaagucguaucuguga

SEQ ID NO: 941031 - RNA, 22 nt, Human
gcaggaguuaggcgucguggau

SEQ ID NO: 941032 - RNA, 22 nt, Human
uacaaaaguaauuacgguuuuu

SEQ ID NO: 941033 - RNA, 22 nt, Human
ucuucauuuuacaggcagaccu

SEQ ID NO: 941034 - RNA, 22 nt, Human
ucccuggccauuccucuaggcc

SEQ ID NO: 941035 - RNA, 22 nt, Human
agugcucauaaaaaugugaaac

SEQ ID NO: 941036 - RNA, 22 nt, Human
aggcacaggaaugucauccagu

SEQ ID NO: 941037 - RNA, 22 nt, Human
auauguuucaguauucaaguca

SEQ ID NO: 941038 - RNA, 22 nt, Human
auggcaguuguaugggcuguau

SEQ ID NO: 941039 - RNA, 21 nt, Human
agcagaacagucgagcacugc

SEQ ID NO: 941040 - RNA, 22 nt, Human
cacauugaaaugacccaauaau

SEQ ID NO: 941041 - RNA, 23 nt, Human
ccuggcuggauucucugcauuca

SEQ ID NO: 941042 - RNA, 22 nt, Human
cuguucaugcugauucuguaug

SEQ ID NO: 941043 - RNA, 22 nt, Human
uggccuguggcuuaaggucugu

SEQ ID NO: 941044 - RNA, 22 nt, Human
cuagcaucagaugagaagcugu

SEQ ID NO: 941045 - RNA, 22 nt, Human
uuggcagggccaggcucucucu

SEQ ID NO: 941046 - RNA, 22 nt, Human
uuucuucauagaccuugucuug

SEQ ID NO: 941047 - RNA, 22 nt, Human
ugugccagaaaauaugcugagg

SEQ ID NO: 941048 - RNA, 20 nt, Human
uccagggcaacuagagugug

SEQ ID NO: 941049 - RNA, 22 nt, Human
gcugcccucccagggcaagcuu

SEQ ID NO: 941050 - RNA, 22 nt, Human
gaagagcuuagacagaaucaaa

SEQ ID NO: 941051 - RNA, 22 nt, Human
gcccaggauucuuucuuccuua

SEQ ID NO: 941052 - RNA, 22 nt, Human
ucucaagagggaggcaaucaug

SEQ ID NO: 941053 - RNA, 22 nt, Human
uggaaagucucuuuugacugua

SEQ ID NO: 941054 - RNA, 22 nt, Human
uaaauguguguagccaucugug

SEQ ID NO: 941055 - RNA, 22 nt, Human
gagugugucggucagcguggcg

SEQ ID NO: 941056 - RNA, 22 nt, Human
gaggcccaggucaagcagccac

SEQ ID NO: 941057 - RNA, 22 nt, Human
ggcagugaaugaaacagaggcu

SEQ ID NO: 941058 - RNA, 17 nt, Human
uuagcaaaauagcacuu

SEQ ID NO: 941059 - RNA, 21 nt, Human
agcagcugggcaacauggagg

SEQ ID NO: 941060 - RNA, 22 nt, Human
cugaaaugguugccuggagaau

SEQ ID NO: 941061 - RNA, 22 nt, Human
ugccaggcgugguggugcgcac

SEQ ID NO: 941062 - RNA, 22 nt, Human
ucaggacagccagggugcagac

SEQ ID NO: 941063 - RNA, 22 nt, Human
uuuccuaguucuaagaaaugua

SEQ ID NO: 941064 - RNA, 22 nt, Human
agcugccuguccuaggccauca

SEQ ID NO: 941065 - RNA, 22 nt, Human
ucacucugguccauccgagagc

SEQ ID NO: 941066 - RNA, 22 nt, Human
uauuauuauaguuauugggaag

SEQ ID NO: 941067 - RNA, 22 nt, Human
aggcagguuggugagaagacug

SEQ ID NO: 941068 - RNA, 22 nt, Human
gagguagcaugcuggaagggac

SEQ ID NO: 941069 - RNA, 22 nt, Human
agggccugacacccuugccagc

SEQ ID NO: 941070 - RNA, 22 nt, Human
uggccacaguguccagcagcag

SEQ ID NO: 941071 - RNA, 22 nt, Human
aacucagucauaaagcgaaugc

SEQ ID NO: 941072 - RNA, 22 nt, Human
cuccauugaacauccucucaga

SEQ ID NO: 941073 - RNA, 22 nt, Human
ggccauggugguuugagcaccu

SEQ ID NO: 941074 - RNA, 22 nt, Human
gacccaggcucgugggacggcu

SEQ ID NO: 941075 - RNA, 22 nt, Human
gcuucccagcagaggaaagacu

SEQ ID NO: 941076 - RNA, 22 nt, Human
uacauuugcuuugauuuucagc

SEQ ID NO: 941077 - RNA, 22 nt, Human
ucugggaacucugucauuuccc

SEQ ID NO: 941078 - RNA, 22 nt, Human
uuucuaggucuuccauacugcc

SEQ ID NO: 941079 - RNA, 22 nt, Human
aucugaagcuaucugcacuuca

SEQ ID NO: 941080 - RNA, 22 nt, Human
cucugcagaauuugagcugcuc

SEQ ID NO: 941081 - RNA, 22 nt, Human
gaggagcuugaggcuaggagcc

SEQ ID NO: 941082 - RNA, 22 nt, Human
ucuuguccuaagagcuggauuc

SEQ ID NO: 941083 - RNA, 22 nt, Human
agcagaagaaagccacaugacu

SEQ ID NO: 941084 - RNA, 22 nt, Human
guggaaugaauagauuugcauu

SEQ ID NO: 941085 - RNA, 22 nt, Human
ugggcaagucacuucugucuuu

SEQ ID NO: 941086 - RNA, 22 nt, Human
ggaagaggaggagccaggcuuu

SEQ ID NO: 941087 - RNA, 22 nt, Human
aguggggucuccuccagccccc

SEQ ID NO: 941088 - RNA, 22 nt, Human
uagaaauaaaucugcagcuggg

SEQ ID NO: 941089 - RNA, 22 nt, Human
ggcacugaaccaggacacaagc

SEQ ID NO: 941090 - RNA, 22 nt, Human
accagagcgcucaagccuuccc

SEQ ID NO: 941091 - RNA, 19 nt, Human
gcuucccaccagccagccc

SEQ ID NO: 941092 - RNA, 22 nt, Human
ugugucagaaggcaauggggau

SEQ ID NO: 941093 - RNA, 22 nt, Human
uaaggcaccauaauauauuuaa

SEQ ID NO: 941094 - RNA, 22 nt, Human
cuuaagaauauugaaguugugg

SEQ ID NO: 941095 - RNA, 22 nt, Human
ccuggcugguggcagcgacaag

SEQ ID NO: 941096 - RNA, 20 nt, Human
ugagccaaacgaugaagagc

SEQ ID NO: 941097 - RNA, 22 nt, Human
cauauaaauacaacauguguua

SEQ ID NO: 941098 - RNA, 22 nt, Human
cugaggaugguguggucuucuc

SEQ ID NO: 941099 - RNA, 22 nt, Human
gugccugugccaggggugugcu

SEQ ID NO: 941100 - RNA, 22 nt, Human
gugccagcaguuauggugauuu

SEQ ID NO: 941101 - RNA, 18 nt, Human
aggcacuggaauuaaggg

SEQ ID NO: 941102 - RNA, 22 nt, Human
gagacagcacaggccacuggga

SEQ ID NO: 941103 - RNA, 22 nt, Human
ugaggcaggagaauggcgggaa

SEQ ID NO: 941104 - RNA, 22 nt, Human
guugcacaguuccucaagcagg

SEQ ID NO: 941105 - RNA, 22 nt, Human
acugcagccuagggaccacagu

SEQ ID NO: 941106 - RNA, 22 nt, Human
gcuguccagagcaugggagcaa

SEQ ID NO: 941107 - RNA, 22 nt, Human
aacaaaugaccugauuucuucc

SEQ ID NO: 941108 - RNA, 23 nt, Human
ucuccuccuagauacagucaugg

SEQ ID NO: 941109 - RNA, 22 nt, Human
caggcuugauuauucagacaau

SEQ ID NO: 941110 - RNA, 21 nt, Human
ugcauuccuccauccaacagg

SEQ ID NO: 941111 - RNA, 22 nt, Human
accaggcugugaagugagacua

SEQ ID NO: 941112 - RNA, 22 nt, Human
gacagcugugcaggagaagggg

SEQ ID NO: 941113 - RNA, 22 nt, Human
gccacugcacuccagcccaggc

SEQ ID NO: 941114 - RNA, 22 nt, Human
aaaugcaccuugcugugagacu

SEQ ID NO: 941115 - RNA, 22 nt, Human
uccucagaauggauggcagggg

SEQ ID NO: 941116 - RNA, 22 nt, Human
ggcaggcugcuugggucauguc

SEQ ID NO: 941117 - RNA, 22 nt, Human
cagaaauguuuauauguggugu

SEQ ID NO: 941118 - RNA, 22 nt, Human
gaaauuuauuaucuacaucauu

SEQ ID NO: 941119 - RNA, 22 nt, Human
ccugcuguaaugugucuuuauu

SEQ ID NO: 941120 - RNA, 19 nt, Human
gccugccuggguuucugag

SEQ ID NO: 941121 - RNA, 22 nt, Human
gcucagccgaacuucagagcag

SEQ ID NO: 941122 - RNA, 22 nt, Human
ucccuggcuguguucaggugcg

SEQ ID NO: 941123 - RNA, 22 nt, Human
uauggcauauaguccagcauaa

SEQ ID NO: 941124 - RNA, 22 nt, Human
uccaugagggacacuggaugcu

SEQ ID NO: 941125 - RNA, 22 nt, Human
aagugacauaccuuacauaugu

SEQ ID NO: 941126 - RNA, 22 nt, Human
aacagacaacuccuguggcuca

SEQ ID NO: 941127 - RNA, 22 nt, Human
gcgaaaaauguguaaauauguu

SEQ ID NO: 941128 - RNA, 22 nt, Human
aggacagaccuaggacuggagc

SEQ ID NO: 941129 - RNA, 22 nt, Human
ugcaagggcuuagggggcugug

SEQ ID NO: 941130 - RNA, 22 nt, Human
gaggcacugcugggccccugua

SEQ ID NO: 941131 - RNA, 22 nt, Human
gcccaguaguucaagguugcag

SEQ ID NO: 941132 - RNA, 22 nt, Human
aggaaacuccccuacaucucaa

SEQ ID NO: 941133 - RNA, 22 nt, Human
gaccuuuuuacuguguacgcug

SEQ ID NO: 941134 - RNA, 22 nt, Human
caggcacagaguuauucauuua

SEQ ID NO: 941135 - RNA, 22 nt, Human
ggcugccuucagacuccagcuu

SEQ ID NO: 941136 - RNA, 20 nt, Human
agggcagcuugaggagccgg

SEQ ID NO: 941137 - RNA, 20 nt, Human
caggcacacucauuccugcu

SEQ ID NO: 941138 - RNA, 21 nt, Human
agaugcugugcuccaggagca

SEQ ID NO: 941139 - RNA, 22 nt, Human
cuguccagcugaccagagcagc

SEQ ID NO: 941140 - RNA, 22 nt, Human
ggaggugggauuaggaccuaaa

SEQ ID NO: 941141 - RNA, 22 nt, Human
agaagcagacucugaggcaagg

SEQ ID NO: 941142 - RNA, 18 nt, Human
uucacaggaaaugucuuu

SEQ ID NO: 941143 - RNA, 22 nt, Human
aaacagcuggucucaaauguuc

SEQ ID NO: 941144 - RNA, 22 nt, Human
agccuggagaagauguguauug

SEQ ID NO: 941145 - RNA, 19 nt, Human
uucacauuggaagaaguag

SEQ ID NO: 941146 - RNA, 22 nt, Human
caguauguuugggagacaugac

SEQ ID NO: 941147 - RNA, 22 nt, Human
gcucucuggguggugggcaaca

SEQ ID NO: 941148 - RNA, 22 nt, Human
acacauauucauauguacuuac

SEQ ID NO: 941149 - RNA, 22 nt, Human
ggcacugagcgggcucugagcg

SEQ ID NO: 941150 - RNA, 22 nt, Human
uuagccaugcccuagaagagga

SEQ ID NO: 941151 - RNA, 22 nt, Human
ccaggcugagcaugauuggagc

SEQ ID NO: 941152 - RNA, 22 nt, Human
gcugggagccguaccugucacg

SEQ ID NO: 941153 - RNA, 22 nt, Human
uuuauuuggcaucucugccaag

SEQ ID NO: 941154 - RNA, 22 nt, Human
uuuacagaucuguugauuuguu

SEQ ID NO: 941155 - RNA, 22 nt, Human
augguuuguguggcccagauga

SEQ ID NO: 941156 - RNA, 21 nt, Human
ugcugaugucagagaagcaag

SEQ ID NO: 941157 - RNA, 22 nt, Human
ugcauugcaguuaacucaguau

SEQ ID NO: 941158 - RNA, 20 nt, Human
gaggcugcggacugcuggac

SEQ ID NO: 941159 - RNA, 22 nt, Human
cugaaaauguuacacaggaaga

SEQ ID NO: 941160 - RNA, 22 nt, Human
aauauaugugguauugaccagc

SEQ ID NO: 941161 - RNA, 20 nt, Human
auaauuuacccugcaccacu

SEQ ID NO: 941162 - RNA, 22 nt, Human
ccaaggagcugcaggcacuugu

SEQ ID NO: 941163 - RNA, 22 nt, Human
aggcugcuuccuuacguggcug

SEQ ID NO: 941164 - RNA, 22 nt, Human
gcaggcagaucaccugucagga

SEQ ID NO: 941165 - RNA, 22 nt, Human
gaggaaaauggaguguaauuaa

SEQ ID NO: 941166 - RNA, 22 nt, Human
gcugccaugccacagcacucac

SEQ ID NO: 941167 - RNA, 20 nt, Human
ccugucuggagacaaagaga

SEQ ID NO: 941168 - RNA, 22 nt, Human
ugcucccagggacucuggcugg

SEQ ID NO: 941169 - RNA, 22 nt, Human
aauguguauacuggcaauuaag

SEQ ID NO: 941170 - RNA, 22 nt, Human
auacauuagcucauaugauuaa

SEQ ID NO: 941171 - RNA, 22 nt, Human
cagggccugcuuccuucuuguu

SEQ ID NO: 941172 - RNA, 22 nt, Human
ugugcaaaguguacaaauuaau

SEQ ID NO: 941173 - RNA, 22 nt, Human
ugugacaucgcugugucuguuu

SEQ ID NO: 941174 - RNA, 22 nt, Human
uucuucuugaaacuuuagguug

SEQ ID NO: 941175 - RNA, 22 nt, Human
caggauggugugagugugagga

SEQ ID NO: 941176 - RNA, 21 nt, Human
uccauuguuuucccaggguuu

SEQ ID NO: 941177 - RNA, 20 nt, Human
accuugaacccgccagccau

SEQ ID NO: 941178 - RNA, 20 nt, Human
aggagcugaauuagaggguu

SEQ ID NO: 941179 - RNA, 22 nt, Human
acauguguacauauauaugugc

SEQ ID NO: 941180 - RNA, 22 nt, Human
gggccacacagaaccuccuggu

SEQ ID NO: 941181 - RNA, 22 nt, Human
auuuucugguugagguuuaaca

SEQ ID NO: 941182 - RNA, 22 nt, Human
gcucccugaaaagaacaaaguc

SEQ ID NO: 941183 - RNA, 22 nt, Human
uuguacaaauaggaaccucuga

SEQ ID NO: 941184 - RNA, 22 nt, Human
aaaguaaccuaguaauaguguc

SEQ ID NO: 941185 - RNA, 22 nt, Human
acuuugcacuaaguuacucauu

SEQ ID NO: 941186 - RNA, 22 nt, Human
auauuccauugguuucccuucu

SEQ ID NO: 941187 - RNA, 22 nt, Human
caaggccauauugccuguaugu

SEQ ID NO: 941188 - RNA, 22 nt, Human
aaaagcuagucaaugauguauu

SEQ ID NO: 941189 - RNA, 22 nt, Human
auaauuuaauuuucacaguggu

SEQ ID NO: 941190 - RNA, 22 nt, Human
uuucucugaggcuggccucccu

SEQ ID NO: 941191 - RNA, 22 nt, Human
uccagggagauacuggcugcca

SEQ ID NO: 941192 - RNA, 22 nt, Human
ggcuucugguaaagaccacacc

SEQ ID NO: 941193 - RNA, 22 nt, Human
aggccugaaggaagaugagcug

SEQ ID NO: 941194 - RNA, 22 nt, Human
uaaaugcagcaguuucuguucu

SEQ ID NO: 941195 - RNA, 22 nt, Human
ccagcugacgaugccuggucuc

SEQ ID NO: 941196 - RNA, 22 nt, Human
gcccaggaaagauagggccuca

SEQ ID NO: 941197 - RNA, 22 nt, Human
uggcagggaauacagauguuua

SEQ ID NO: 941198 - RNA, 22 nt, Human
uaacuaacuaguguucaaaaua

SEQ ID NO: 941199 - RNA, 22 nt, Human
agugaaauuuguuuagauaggu

SEQ ID NO: 941200 - RNA, 22 nt, Human
gcugucaggaacaugccuuggu

SEQ ID NO: 941201 - RNA, 23 nt, Human
gccucagagaaacagcugcacac

SEQ ID NO: 941202 - RNA, 20 nt, Human
ucacuaguaaccaucugcuu

SEQ ID NO: 941203 - RNA, 22 nt, Human
aggagccuccuucucaugugca

SEQ ID NO: 941204 - RNA, 22 nt, Human
ucacucugucccccauugagau

SEQ ID NO: 941205 - RNA, 22 nt, Human
ccuguggggccaucucagucac

SEQ ID NO: 941206 - RNA, 22 nt, Human
uagggcaguuauaacauuagug

SEQ ID NO: 941207 - RNA, 22 nt, Human
uagaaacucaggauacucuucc

SEQ ID NO: 941208 - RNA, 22 nt, Human
gccugguggacacugggcauca

SEQ ID NO: 941209 - RNA, 22 nt, Human
uauguacaccggggaagguggg

SEQ ID NO: 941210 - RNA, 22 nt, Human
cagauggcaacagcucugugac

SEQ ID NO: 941211 - RNA, 22 nt, Human
ucuuagaaauuccccaguggcu

SEQ ID NO: 941212 - RNA, 22 nt, Human
aaaggucagacuuaggcugggc

SEQ ID NO: 941213 - RNA, 22 nt, Human
acauuucugucuuagggacugu

SEQ ID NO: 941214 - RNA, 22 nt, Human
aguguggguuuuauggagcccu

SEQ ID NO: 941215 - RNA, 23 nt, Human
uuccuggcagguacaacuuuuac

SEQ ID NO: 941216 - RNA, 22 nt, Human
cagccuucugaaugaacguacu

SEQ ID NO: 941217 - RNA, 22 nt, Human
aucccugcccucauggagcuua

SEQ ID NO: 941218 - RNA, 22 nt, Human
auaaggcagugacuucaucuau

SEQ ID NO: 941219 - RNA, 22 nt, Human
gauuuagagaauguuuuguaag

SEQ ID NO: 941220 - RNA, 22 nt, Human
auguucuuccaaaucuguaaca

SEQ ID NO: 941221 - RNA, 22 nt, Human
gcugccuuuuaaagccucgcuu

SEQ ID NO: 941222 - RNA, 22 nt, Human
cagagccacuuggagaugagaa

SEQ ID NO: 941223 - RNA, 22 nt, Human
gcaucuaauccaguccagcauc

SEQ ID NO: 941224 - RNA, 22 nt, Human
uaacagaauagcagaaacagaa

SEQ ID NO: 941225 - RNA, 22 nt, Human
cugccuggguucaaguccuguu

SEQ ID NO: 941226 - RNA, 22 nt, Human
uauaugcuaauggugccauucc

SEQ ID NO: 941227 - RNA, 22 nt, Human
cuguggagugcuuggcucagug

SEQ ID NO: 941228 - RNA, 22 nt, Human
agugugagcccuggaguggugc

SEQ ID NO: 941229 - RNA, 22 nt, Human
agggcagccauugagggauucu

SEQ ID NO: 941230 - RNA, 22 nt, Human
gagcagcugguaggugaaccca

SEQ ID NO: 941231 - RNA, 22 nt, Human
gagcaggcucugccuguguguc

SEQ ID NO: 941232 - RNA, 22 nt, Human
ucugucacuauuggccagaaca

SEQ ID NO: 941233 - RNA, 21 nt, Human
ucaggagagcccaucuacaaa

SEQ ID NO: 941234 - RNA, 22 nt, Human
acagccagggucucaggaggcg

SEQ ID NO: 941235 - RNA, 22 nt, Human
gccugugcuuaacugacgugag

SEQ ID NO: 941236 - RNA, 22 nt, Human
ugucuucagcaaaugccuuucu

SEQ ID NO: 941237 - RNA, 22 nt, Human
gcaggccugacuguagggggca

SEQ ID NO: 941238 - RNA, 22 nt, Human
uggcacauagaaaaggaucaau

SEQ ID NO: 941239 - RNA, 22 nt, Human
ccagcccugccucucagggccc

SEQ ID NO: 941240 - RNA, 22 nt, Human
uggacucagugcugccauuccc

SEQ ID NO: 941241 - RNA, 22 nt, Human
ucacagacacagggagaagcau

SEQ ID NO: 941242 - RNA, 22 nt, Human
uacaaagugugcccaugcugag

SEQ ID NO: 941243 - RNA, 22 nt, Human
ugguccugagcaccagccugac

SEQ ID NO: 941244 - RNA, 22 nt, Human
aaggcagcaccgccuccugaaa

SEQ ID NO: 941245 - RNA, 21 nt, Human
ccuggcuucagggugcacugg

SEQ ID NO: 941246 - RNA, 22 nt, Human
aguuucuuuagauagaaaguuc

SEQ ID NO: 941247 - RNA, 22 nt, Human
gggcuaggcuuggccagcacug

SEQ ID NO: 941248 - RNA, 22 nt, Human
ugggcuccucgucacucgcugu

SEQ ID NO: 941249 - RNA, 16 nt, Human
gggcugggggauucug

SEQ ID NO: 941250 - RNA, 19 nt, Human
cauaauacaguggaucuga

SEQ ID NO: 941251 - RNA, 22 nt, Human
accaucagucacauguagagaa

SEQ ID NO: 941252 - RNA, 20 nt, Human
gaggaaaagcugccaggccu

SEQ ID NO: 941253 - RNA, 22 nt, Human
ccaggccuuucuucuuggucug

SEQ ID NO: 941254 - RNA, 22 nt, Human
gugggacagcuggagggucccu

SEQ ID NO: 941255 - RNA, 22 nt, Human
ucccagcagucagagcuaugug

SEQ ID NO: 941256 - RNA, 22 nt, Human
uagccaggcgaggucagugucg

SEQ ID NO: 941257 - RNA, 22 nt, Human
guggguggaggcgucgagggca

SEQ ID NO: 941258 - RNA, 22 nt, Human
aaacuacuaugggaauguacuu

SEQ ID NO: 941259 - RNA, 22 nt, Human
ucccaggaaaacacucgaggac

SEQ ID NO: 941260 - RNA, 22 nt, Human
gacauuucaaucucauuauggg

SEQ ID NO: 941261 - RNA, 22 nt, Human
ugcccugugugugcaagcacug

SEQ ID NO: 941262 - RNA, 22 nt, Human
gccaggaguucagaugcauguu

SEQ ID NO: 941263 - RNA, 22 nt, Human
ggccucugccucaucugggcac

SEQ ID NO: 941264 - RNA, 22 nt, Human
gccuggagaagauggaacuagc

SEQ ID NO: 941265 - RNA, 20 nt, Human
gcugcucuccacggucugca

SEQ ID NO: 941266 - RNA, 22 nt, Human
uggccagguguggguucucaga

SEQ ID NO: 941267 - RNA, 19 nt, Human
uccaggaggcugccauuga

SEQ ID NO: 941268 - RNA, 22 nt, Human
ugugugccagccuacgaggagc

SEQ ID NO: 941269 - RNA, 22 nt, Human
cccuggaagguucucuggcuca

SEQ ID NO: 941270 - RNA, 22 nt, Human
gaggcugugugucccucuggac

SEQ ID NO: 941271 - RNA, 22 nt, Human
uggugugggcguggcaggcaag

SEQ ID NO: 941272 - RNA, 22 nt, Human
gcucugcugagauaucugggag

SEQ ID NO: 941273 - RNA, 22 nt, Human
ugcaccauacccauuccccucu

SEQ ID NO: 941274 - RNA, 22 nt, Human
cugggugguuuugaugugaauu

SEQ ID NO: 941275 - RNA, 22 nt, Human
auuucugugcaguaaaugguga

SEQ ID NO: 941276 - RNA, 21 nt, Human
uccuuccuugagguccuuucc

SEQ ID NO: 941277 - RNA, 20 nt, Human
aggaaaaauggaaacuggag

SEQ ID NO: 941278 - RNA, 19 nt, Human
uggucuaaaugugugcccc

SEQ ID NO: 941279 - RNA, 20 nt, Human
augccucuaauuuugcaaac

SEQ ID NO: 941280 - RNA, 22 nt, Human
auggacaggcugagcuuccuca

SEQ ID NO: 941281 - RNA, 22 nt, Human
ucuguucagacacuuuacaugu

SEQ ID NO: 941282 - RNA, 22 nt, Human
uccuugaaaagaaugucuccau

SEQ ID NO: 941283 - RNA, 22 nt, Human
aggccucuucagggagcaugga

SEQ ID NO: 941284 - RNA, 22 nt, Human
ccuggccacccagccuuggcca

SEQ ID NO: 941285 - RNA, 22 nt, Human
uuguuucugaguuuucauguau

SEQ ID NO: 941286 - RNA, 22 nt, Human
uuucacauuagauaugucauuu

SEQ ID NO: 941287 - RNA, 22 nt, Human
ugcacauuaguguuugagaugc

SEQ ID NO: 941288 - RNA, 22 nt, Human
cacugaguucccugacauuuca

SEQ ID NO: 941289 - RNA, 22 nt, Human
uuguaacaggcacucugugcca

SEQ ID NO: 941290 - RNA, 22 nt, Human
auuguggugucaguuauaggca

SEQ ID NO: 941291 - RNA, 22 nt, Human
ucaguuuucucaucuguaauuu

SEQ ID NO: 941292 - RNA, 22 nt, Human
uuccgcuguuuaguugaaguuu

SEQ ID NO: 941293 - RNA, 22 nt, Human
aaccaggugacucauggugagc

SEQ ID NO: 941294 - RNA, 22 nt, Human
gcagaggagaugaagauacuuu

SEQ ID NO: 941295 - RNA, 22 nt, Human
aagaggaacugggggcugaguc

SEQ ID NO: 941296 - RNA, 22 nt, Human
uauuuugacuauuaaaccaaca

SEQ ID NO: 941297 - RNA, 22 nt, Human
aggaugagccgcgcaagcugac

SEQ ID NO: 941298 - RNA, 22 nt, Human
cugagcuuggccaggaaugaau

SEQ ID NO: 941299 - RNA, 22 nt, Human
acauuucucuuagaguuggacu

SEQ ID NO: 941300 - RNA, 23 nt, Human
gccuucagcucgggaaggcuccc

SEQ ID NO: 941301 - RNA, 22 nt, Human
uuagccauggacugaauugacu

SEQ ID NO: 941302 - RNA, 22 nt, Human
cauacauaugcauguguguaua

SEQ ID NO: 941303 - RNA, 22 nt, Human
aagaugauguuguguuuucacu

SEQ ID NO: 941304 - RNA, 22 nt, Human
ucaggagacauucuuaaaguag

SEQ ID NO: 941305 - RNA, 22 nt, Human
uuuuugcaccaaccuaauagaa

SEQ ID NO: 941306 - RNA, 22 nt, Human
ucacguuuuacugagugagaua

SEQ ID NO: 941307 - RNA, 22 nt, Human
gccucugcaacuccgccuuggu

SEQ ID NO: 941308 - RNA, 22 nt, Human
cagccaggccuggugaccaaag

SEQ ID NO: 941309 - RNA, 22 nt, Human
guggcagcaaaauccugcauuc

SEQ ID NO: 941310 - RNA, 23 nt, Human
aaggucacagaacuuagcaagcc

SEQ ID NO: 941311 - RNA, 22 nt, Human
ccuggcugcuauagcagcaugu

SEQ ID NO: 941312 - RNA, 22 nt, Human
uuuaaaauuuagaccucuccac

SEQ ID NO: 941313 - RNA, 22 nt, Human
agcagagcuauucuugugcaau

SEQ ID NO: 941314 - RNA, 22 nt, Human
accaaggaagaaucuauuugag

SEQ ID NO: 941315 - RNA, 22 nt, Human
uugugaaauguuucaaaauagu

SEQ ID NO: 941316 - RNA, 22 nt, Human
cccaggaagaggggucaggugu

SEQ ID NO: 941317 - RNA, 22 nt, Human
ucugagccuauuucaaauuccu

SEQ ID NO: 941318 - RNA, 22 nt, Human
ggagccaggggaccuucacaga

SEQ ID NO: 941319 - RNA, 22 nt, Human
ucaggagggugacaggcccugg

SEQ ID NO: 941320 - RNA, 22 nt, Human
gguucacacuuucaugauuuca

SEQ ID NO: 941321 - RNA, 22 nt, Human
aauaggcaguuggauaugcaag

SEQ ID NO: 941322 - RNA, 22 nt, Human
gcagggugauagugaggcucag

SEQ ID NO: 941323 - RNA, 22 nt, Human
cuggccuguccugacccagccu

SEQ ID NO: 941324 - RNA, 19 nt, Human
cugugcaggccgggcugag

SEQ ID NO: 941325 - RNA, 19 nt, Human
uaucuguuuccugcuuguc

SEQ ID NO: 941326 - RNA, 22 nt, Human
aaaaacuguaauuacuuuugca

SEQ ID NO: 941327 - RNA, 22 nt, Human
agggagcugagcugugagcagc

SEQ ID NO: 941328 - RNA, 22 nt, Human
cccucuacagggaagcgcuuuc

SEQ ID NO: 941329 - RNA, 22 nt, Human
auuuggauucuuauuuagcacu

SEQ ID NO: 941330 - RNA, 22 nt, Human
cauaccuuucucaagcacaugu

SEQ ID NO: 941331 - RNA, 22 nt, Human
agccuguccagaggacagggcu

SEQ ID NO: 941332 - RNA, 22 nt, Human
acucuucuugcugcucauuaau

SEQ ID NO: 941333 - RNA, 17 nt, Human
aggugcuggagcaucag

SEQ ID NO: 941334 - RNA, 22 nt, Human
ggcccaucucuugcucuggguu

SEQ ID NO: 941335 - RNA, 22 nt, Human
ucagcagauggguuguguuggc

SEQ ID NO: 941336 - RNA, 23 nt, Human
ugggcaucuccucugugccaggc

SEQ ID NO: 941337 - RNA, 20 nt, Human
gaguuccccauuucuccugg

SEQ ID NO: 941338 - RNA, 22 nt, Human
ugucccucugaggcuucccugg

SEQ ID NO: 941339 - RNA, 22 nt, Human
uccaagaagucaucuaaacugu

SEQ ID NO: 941340 - RNA, 22 nt, Human
agcaccugcuugugacuaggga

SEQ ID NO: 941341 - RNA, 21 nt, Human
uccauaagagaccaucuccua

SEQ ID NO: 941342 - RNA, 22 nt, Human
uaaaugugucuauggacccgcc

SEQ ID NO: 941343 - RNA, 22 nt, Human
augaagcuaaacccugcagcca

SEQ ID NO: 941344 - RNA, 22 nt, Human
cuccugaguaguagcauuguca

SEQ ID NO: 941345 - RNA, 19 nt, Human
uuugcagugguuccuuugu

SEQ ID NO: 941346 - RNA, 22 nt, Human
cuguuuauuacacuggauagca

SEQ ID NO: 941347 - RNA, 22 nt, Human
uggguggcggccugguucugag

SEQ ID NO: 941348 - RNA, 22 nt, Human
ucagcuccucaugcaggggaua

SEQ ID NO: 941349 - RNA, 22 nt, Human
cuggcucagugccuucagaagu

SEQ ID NO: 941350 - RNA, 22 nt, Human
uucuuugaguuaguacagucca

SEQ ID NO: 941351 - RNA, 22 nt, Human
augcaguauaaaucauuucugg

SEQ ID NO: 941352 - RNA, 22 nt, Human
caccuugugauccucuugccuu

SEQ ID NO: 941353 - RNA, 22 nt, Human
cagagcugguaagugguagagg

SEQ ID NO: 941354 - RNA, 22 nt, Human
gcccugugcgacucuagagguu

SEQ ID NO: 941355 - RNA, 21 nt, Human
gcccucaggggaggauggccu

SEQ ID NO: 941356 - RNA, 22 nt, Human
gcuccacuugcagcuaggcuug

SEQ ID NO: 941357 - RNA, 22 nt, Human
ccaggagucaauaaaggaagcu

SEQ ID NO: 941358 - RNA, 22 nt, Human
accucugcaguagggcugugcc

SEQ ID NO: 941359 - RNA, 22 nt, Human
agaaaauauucauugagaggcu

SEQ ID NO: 941360 - RNA, 22 nt, Human
cagagcugacccaaggauugaa

SEQ ID NO: 941361 - RNA, 22 nt, Human
cuacuucugugaugaaacuaca

SEQ ID NO: 941362 - RNA, 22 nt, Human
gcugcagcucgccuuccggccu

SEQ ID NO: 941363 - RNA, 18 nt, Human
acaaaggucugcaagacc

SEQ ID NO: 941364 - RNA, 22 nt, Human
cauuaagauuuuuuucuacugg

SEQ ID NO: 941365 - RNA, 22 nt, Human
uaugauuuguagacauuugauu

SEQ ID NO: 941366 - RNA, 20 nt, Human
ucucccaggcucagggaaga

SEQ ID NO: 941367 - RNA, 21 nt, Human
uuucuucacuuugccccaugu

SEQ ID NO: 941368 - RNA, 17 nt, Human
ggccuuggggccucagu

SEQ ID NO: 941369 - RNA, 22 nt, Human
ugggcagagucguggggaauag

SEQ ID NO: 941370 - RNA, 22 nt, Human
aagggcagccugacucacgguc

SEQ ID NO: 941371 - RNA, 22 nt, Human
gccugucugcagggcugucauu

SEQ ID NO: 941372 - RNA, 18 nt, Human
ucuuggaguaaugaucaa

SEQ ID NO: 941373 - RNA, 18 nt, Human
cagagcagagguggagcg

SEQ ID NO: 941374 - RNA, 22 nt, Human
ucuggcucuccagugcucuuag

SEQ ID NO: 941375 - RNA, 22 nt, Human
aaaucaguucucccuuucuuca

SEQ ID NO: 941376 - RNA, 22 nt, Human
uuuuugaaggcugaugugauua

SEQ ID NO: 941377 - RNA, 22 nt, Human
ugucccuggaacuauggcucca

SEQ ID NO: 941378 - RNA, 21 nt, Human
uggccucccacacuuccaugg

SEQ ID NO: 941379 - RNA, 22 nt, Human
guucauauuacuuugagugcag

SEQ ID NO: 941380 - RNA, 22 nt, Human
agcagccauagauagcaugcaa

SEQ ID NO: 941381 - RNA, 22 nt, Human
cugucagcacucuacuacagau

SEQ ID NO: 941382 - RNA, 22 nt, Human
acagccuguuugaucuggugcu

SEQ ID NO: 941383 - RNA, 22 nt, Human
gauuuccucacuaacauccauc

SEQ ID NO: 941384 - RNA, 22 nt, Human
uugagaagaggcuuuguaggaa

SEQ ID NO: 941385 - RNA, 22 nt, Human
ucagcaguguaguuuaucauuc

SEQ ID NO: 941386 - RNA, 22 nt, Human
ucaggagauggucuuuauaggc

SEQ ID NO: 941387 - RNA, 20 nt, Human
uccuggccuucucgggcagu

SEQ ID NO: 941388 - RNA, 22 nt, Human
ugccugggaaccaauccuggcu

SEQ ID NO: 941389 - RNA, 22 nt, Human
uagcagggucucaggagucagg

SEQ ID NO: 941390 - RNA, 22 nt, Human
augcacagcagugaguucagug

SEQ ID NO: 941391 - RNA, 22 nt, Human
uacacacagaggccaugggauu

SEQ ID NO: 941392 - RNA, 22 nt, Human
aaggcagcagugcacgacugau

SEQ ID NO: 941393 - RNA, 18 nt, Human
agaguguucucagugaaa

SEQ ID NO: 941394 - RNA, 22 nt, Human
uccaggaggguuuucugccuuc

SEQ ID NO: 941395 - RNA, 22 nt, Human
uggcaucauagccaaggugcuu

SEQ ID NO: 941396 - RNA, 22 nt, Human
uuucaaagucaauaucauuacc

SEQ ID NO: 941397 - RNA, 20 nt, Human
uaggcagagcugugcagccu

SEQ ID NO: 941398 - RNA, 22 nt, Human
gcauacagagaggauguggcau

SEQ ID NO: 941399 - RNA, 20 nt, Human
uggggccuguuucugugguu

SEQ ID NO: 941400 - RNA, 22 nt, Human
augauacaagcaaaacuaauca

SEQ ID NO: 941401 - RNA, 22 nt, Human
uuccaggaagcaguuagcagcc

SEQ ID NO: 941402 - RNA, 22 nt, Human
caggguggaaaagcuaguugga

SEQ ID NO: 941403 - RNA, 22 nt, Human
ucccaggaauugaagccagugu

SEQ ID NO: 941404 - RNA, 22 nt, Human
cugggcucagcccaugcugucc

SEQ ID NO: 941405 - RNA, 20 nt, Human
gucugaggagcagugggaaa

SEQ ID NO: 941406 - RNA, 21 nt, Human
ccugggccaaauucccuggac

SEQ ID NO: 941407 - RNA, 22 nt, Human
agcaccuucacaggcucucagg

SEQ ID NO: 941408 - RNA, 18 nt, Human
aguguuaaguaaguagca

SEQ ID NO: 941409 - RNA, 22 nt, Human
ugacagggcuagaggcaaugca

SEQ ID NO: 941410 - RNA, 22 nt, Human
guggcugcuacagagcuggagg

SEQ ID NO: 941411 - RNA, 22 nt, Human
uccagccuaggggaacagcugc

SEQ ID NO: 941412 - RNA, 22 nt, Human
acuuccugcuaugagcuucugu

SEQ ID NO: 941413 - RNA, 22 nt, Human
ccacccugagccgcaagagcag

SEQ ID NO: 941414 - RNA, 22 nt, Human
cccauuuaaacacaagcuuuca

SEQ ID NO: 941415 - RNA, 17 nt, Human
ggucuggggccauuggc

SEQ ID NO: 941416 - RNA, 22 nt, Human
ucccagauuguugauggcuuaa

SEQ ID NO: 941417 - RNA, 22 nt, Human
uuacaagauaaccugaugcugu

SEQ ID NO: 941418 - RNA, 18 nt, Human
ggucuuuaggucaguguc

SEQ ID NO: 941419 - RNA, 22 nt, Human
uucuuucccagaagauauguuu

SEQ ID NO: 941420 - RNA, 22 nt, Human
aagggacuuugucagcuuucca

SEQ ID NO: 941421 - RNA, 22 nt, Human
ucaggaugaccacgagccucua

SEQ ID NO: 941422 - RNA, 22 nt, Human
acauuccugaggaaauacauuc

SEQ ID NO: 941423 - RNA, 23 nt, Human
agaugaaagcuucccaucacagu

SEQ ID NO: 941424 - RNA, 22 nt, Human
acacagccaggguaguaaggcu

SEQ ID NO: 941425 - RNA, 22 nt, Human
ugucccagggaaggcccagcac

SEQ ID NO: 941426 - RNA, 22 nt, Human
guauuaggagguggagccuuug

SEQ ID NO: 941427 - RNA, 22 nt, Human
cugccuugaaaaugaagcuuua

SEQ ID NO: 941428 - RNA, 22 nt, Human
caaggccaguucaccaagggca

SEQ ID NO: 941429 - RNA, 20 nt, Human
uuucaguugguuaauggcau

SEQ ID NO: 941430 - RNA, 22 nt, Human
cacuaaguaagcuccucuacaa

SEQ ID NO: 941431 - RNA, 22 nt, Human
uauuuccaggccccacucuaga

SEQ ID NO: 941432 - RNA, 22 nt, Human
cuuuauuagauguagacuuucu

SEQ ID NO: 941433 - RNA, 22 nt, Human
uuuauaaguacuuugucugcuu

SEQ ID NO: 941434 - RNA, 22 nt, Human
augcaagauguauagaagacuu

SEQ ID NO: 941435 - RNA, 22 nt, Human
cugagggucaacuugauuguau

SEQ ID NO: 941436 - RNA, 22 nt, Human
uagcacauacauaauagauaga

SEQ ID NO: 941437 - RNA, 22 nt, Human
aaugcuuuuugcgaaaugugca

SEQ ID NO: 941438 - RNA, 20 nt, Human
cccaggagcugugccccauc

SEQ ID NO: 941439 - RNA, 22 nt, Human
gcaggggcugagcaccagcggg

SEQ ID NO: 941440 - RNA, 22 nt, Human
augauugaaaaugacauugcca

SEQ ID NO: 941441 - RNA, 22 nt, Human
ucugucuucaucagcaugugau

SEQ ID NO: 941442 - RNA, 19 nt, Human
agcagagcagggccguggg

SEQ ID NO: 941443 - RNA, 22 nt, Human
cagcuggcccuuugguagccuu

SEQ ID NO: 941444 - RNA, 22 nt, Human
aaauauguaagauuagcacuag

SEQ ID NO: 941445 - RNA, 22 nt, Human
ugaaagcagugccaugauuaug

SEQ ID NO: 941446 - RNA, 22 nt, Human
cuuaacauccugcauuuuucuu

SEQ ID NO: 941447 - RNA, 22 nt, Human
uggagaugaauauguguaccug

SEQ ID NO: 941448 - RNA, 22 nt, Human
ccugccucaucaacuugucgug

SEQ ID NO: 941449 - RNA, 20 nt, Human
aacagggggcugcagagggc

SEQ ID NO: 941450 - RNA, 22 nt, Human
cugggaugucuauagaacacuu

SEQ ID NO: 941451 - RNA, 22 nt, Human
agcagcuggugagcaagcucag

SEQ ID NO: 941452 - RNA, 22 nt, Human
agggcagaccacgugcaaggau

SEQ ID NO: 941453 - RNA, 22 nt, Human
aaaugcauguagaauaauagag

SEQ ID NO: 941454 - RNA, 22 nt, Human
gauuauauaauggaagcucuug

SEQ ID NO: 941455 - RNA, 19 nt, Human
cagaccuguccagccugug

SEQ ID NO: 941456 - RNA, 22 nt, Human
ugggcagacuaaggucaaagcu

SEQ ID NO: 941457 - RNA, 19 nt, Human
gcuggcagauguggccgug

SEQ ID NO: 941458 - RNA, 22 nt, Human
aggcagcugugaggacuggauu

SEQ ID NO: 941459 - RNA, 22 nt, Human
caggagccccaggcugacaaua

SEQ ID NO: 941460 - RNA, 22 nt, Human
auguuuccauuuucuuguauca

SEQ ID NO: 941461 - RNA, 22 nt, Human
gugggacucuucuuuggcagug

SEQ ID NO: 941462 - RNA, 22 nt, Human
augcucuggaguacgugaaauu

SEQ ID NO: 941463 - RNA, 20 nt, Human
gaaaugugaccucuucugug

SEQ ID NO: 941464 - RNA, 17 nt, Human
cccugccaccaggaagc

SEQ ID NO: 941465 - RNA, 22 nt, Human
ugggagucagacagccugagau

SEQ ID NO: 941466 - RNA, 22 nt, Human
auucacaaaaugauauagauac

SEQ ID NO: 941467 - RNA, 19 nt, Human
uuucacaaagagagcguga

SEQ ID NO: 941468 - RNA, 22 nt, Human
cauuuacauuuaagguuaauau

SEQ ID NO: 941469 - RNA, 22 nt, Human
gagagcugggggacuguggaug

SEQ ID NO: 941470 - RNA, 22 nt, Human
ucaaaacaaucauuggaugugc

SEQ ID NO: 941471 - RNA, 22 nt, Human
aacauuucagcaccugauuccu

SEQ ID NO: 941472 - RNA, 22 nt, Human
ugggugggagcgcccugucugg

SEQ ID NO: 941473 - RNA, 23 nt, Human
ucugggcaccuuguugacaugau

SEQ ID NO: 941474 - RNA, 22 nt, Human
ucuguucauguugggcuuuucc

SEQ ID NO: 941475 - RNA, 22 nt, Human
auuuaaaugcuuaagaggguuu

SEQ ID NO: 941476 - RNA, 22 nt, Human
agggaaaguaagcauuucauua

SEQ ID NO: 941477 - RNA, 22 nt, Human
cauugcacuccacccuaggcaa

SEQ ID NO: 941478 - RNA, 22 nt, Human
uuucacaaacucagggugugug

SEQ ID NO: 941479 - RNA, 22 nt, Human
cugaaggagguagagugacaua

SEQ ID NO: 941480 - RNA, 22 nt, Human
aaaauucugucauuaaauugug

SEQ ID NO: 941481 - RNA, 18 nt, Human
uggcagggaggaaauaua

SEQ ID NO: 941482 - RNA, 22 nt, Human
auuguuuuguuucccagugacu

SEQ ID NO: 941483 - RNA, 22 nt, Human
uuaauuuucucaucugugaaau

SEQ ID NO: 941484 - RNA, 20 nt, Human
cuaucuccuggcgugccuuc

SEQ ID NO: 941485 - RNA, 22 nt, Human
gagccaggcccguacuugcugu

SEQ ID NO: 941486 - RNA, 22 nt, Human
cuguuuucaaagagagagaaug

SEQ ID NO: 941487 - RNA, 21 nt, Human
gcaggguccuuuccauuccua

SEQ ID NO: 941488 - RNA, 22 nt, Human
gaaaugugaccuacuuccuugu

SEQ ID NO: 941489 - RNA, 22 nt, Human
gguggcaggcccugagcauccc

SEQ ID NO: 941490 - RNA, 22 nt, Human
auccuugagaaaauaaaugacc

SEQ ID NO: 941491 - RNA, 22 nt, Human
agaccauggccauccuaggaaa

SEQ ID NO: 941492 - RNA, 22 nt, Human
gcugcagcaagcccuccagggg

SEQ ID NO: 941493 - RNA, 22 nt, Human
auggccaagaaauugccgacug

SEQ ID NO: 941494 - RNA, 22 nt, Human
agaauguagucuuggagauuua

SEQ ID NO: 941495 - RNA, 22 nt, Human
aagcgccacgagaagcuggacc

SEQ ID NO: 941496 - RNA, 22 nt, Human
acauucuagaagucuuugcaau

SEQ ID NO: 941497 - RNA, 22 nt, Human
agggggcccuugcaggugagcg

SEQ ID NO: 941498 - RNA, 19 nt, Human
agacacacuugauaugugu

SEQ ID NO: 941499 - RNA, 22 nt, Human
acauuucuccuacuuguuauuu

SEQ ID NO: 941500 - RNA, 22 nt, Human
gccaggcuggugcaaggauauu

SEQ ID NO: 941501 - RNA, 22 nt, Human
cuguaguugaugauuucugaua

SEQ ID NO: 941502 - RNA, 22 nt, Human
cauuuuauccucugggaagcua

SEQ ID NO: 941503 - RNA, 22 nt, Human
ugcaggggcuugucugggccug

SEQ ID NO: 941504 - RNA, 22 nt, Human
gagccuggauugaagugggugg

SEQ ID NO: 941505 - RNA, 22 nt, Human
ucaguuuuuacggucacaggga

SEQ ID NO: 941506 - RNA, 22 nt, Human
acuuucuauuguuuagauucug

SEQ ID NO: 941507 - RNA, 22 nt, Human
caggccugugacaccgugucug

SEQ ID NO: 941508 - RNA, 22 nt, Human
aaaugcagauuuugaugcagca

SEQ ID NO: 941509 - RNA, 22 nt, Human
ucagcuccagaguugcacagug

SEQ ID NO: 941510 - RNA, 22 nt, Human
uguuaugugccacacuugaggg

SEQ ID NO: 941511 - RNA, 19 nt, Human
acacagggcuagaguuaca

SEQ ID NO: 941512 - RNA, 22 nt, Human
ccuggcagaauauuaaagugca

SEQ ID NO: 941513 - RNA, 22 nt, Human
ccagggcagccaacccagaugc

SEQ ID NO: 941514 - RNA, 22 nt, Human
agaauucuggaguugggaggaa

SEQ ID NO: 941515 - RNA, 22 nt, Human
aaggagcuuguucgccuuccuc

SEQ ID NO: 941516 - RNA, 22 nt, Human
gggcuggcucccagguguugaa

SEQ ID NO: 941517 - RNA, 19 nt, Human
uggagggguuugaaugugg

SEQ ID NO: 941518 - RNA, 22 nt, Human
ggaggacaggggcugcagcaca

SEQ ID NO: 941519 - RNA, 22 nt, Human
cauacauuuugcauauuuacca

SEQ ID NO: 941520 - RNA, 22 nt, Human
gggcagcugccacuccgcuugc

SEQ ID NO: 941521 - RNA, 22 nt, Human
guaacagaaagucaugcucauu

SEQ ID NO: 941522 - RNA, 18 nt, Human
agggaguuuuagggaagg

SEQ ID NO: 941523 - RNA, 22 nt, Human
gcugaguguaaugauggcagag

SEQ ID NO: 941524 - RNA, 22 nt, Human
ggugcagugguguggcaaaggg

SEQ ID NO: 941525 - RNA, 22 nt, Human
accagagcagacuacuggaggu

SEQ ID NO: 941526 - RNA, 22 nt, Human
cugguggggaguccuggucucc

SEQ ID NO: 941527 - RNA, 22 nt, Human
cuuguacaggaauccaugguau

SEQ ID NO: 941528 - RNA, 22 nt, Human
gagcugugagggacacauugcu

SEQ ID NO: 941529 - RNA, 22 nt, Human
accuugaugccuuuccaagaug

SEQ ID NO: 941530 - RNA, 20 nt, Human
ggaagcagagaacuguuuuc

SEQ ID NO: 941531 - RNA, 22 nt, Human
uuuuccuacugauaaacaguua

SEQ ID NO: 941532 - RNA, 22 nt, Human
agauacaugucaagagacuuau

SEQ ID NO: 941533 - RNA, 22 nt, Human
uugcauuucccauugaguaaug

SEQ ID NO: 941534 - RNA, 22 nt, Human
acucaggaaaugaagacugguu

SEQ ID NO: 941535 - RNA, 21 nt, Human
aggcucagcagguguauaaag

SEQ ID NO: 941536 - RNA, 22 nt, Human
agggcagcacagcugugcuccu

SEQ ID NO: 941537 - RNA, 22 nt, Human
caggcugcggucggcucugguc

SEQ ID NO: 941538 - RNA, 20 nt, Human
cugagcugagcuccaugggu

SEQ ID NO: 941539 - RNA, 22 nt, Human
gucccagagagcacuaguccau

SEQ ID NO: 941540 - RNA, 22 nt, Human
uccagggagauggcagaggcug

SEQ ID NO: 941541 - RNA, 22 nt, Human
agggaauguagcaagaugccaa

SEQ ID NO: 941542 - RNA, 22 nt, Human
ccagagucuaugaguccucauu

SEQ ID NO: 941543 - RNA, 22 nt, Human
aucaaaguggaaguuuacuagg

SEQ ID NO: 941544 - RNA, 22 nt, Human
cucuucuuuaguccagaccauc

SEQ ID NO: 941545 - RNA, 23 nt, Human
augcaguauaugucaguaguuua

SEQ ID NO: 941546 - RNA, 22 nt, Human
cauucauuuaugaaauaucuau

SEQ ID NO: 941547 - RNA, 22 nt, Human
acagccuggacuggcucucugc

SEQ ID NO: 941548 - RNA, 22 nt, Human
ucucagagauguuagggaagag

SEQ ID NO: 941549 - RNA, 17 nt, Human
caggcuccuuccagauu

SEQ ID NO: 941550 - RNA, 20 nt, Human
aggcacuggauuucuuauau

SEQ ID NO: 941551 - RNA, 22 nt, Human
uuccuggccccaccccuggaga

SEQ ID NO: 941552 - RNA, 22 nt, Human
cagagccaucccagccuguggu

SEQ ID NO: 941553 - RNA, 22 nt, Human
aaagcagaacugagagagcugg

SEQ ID NO: 941554 - RNA, 22 nt, Human
aaauauagcaauuaugccuacu

SEQ ID NO: 941555 - RNA, 22 nt, Human
ucugggcugggagcguguggac

SEQ ID NO: 941556 - RNA, 22 nt, Human
aguucacauuccgagguacugg

SEQ ID NO: 941557 - RNA, 22 nt, Human
ggaggccaaggugggcggauca

SEQ ID NO: 941558 - RNA, 22 nt, Human
gagaggucaucucccaucagca

SEQ ID NO: 941559 - RNA, 20 nt, Human
ucccucaggucauugggcug

SEQ ID NO: 941560 - RNA, 22 nt, Human
ugccugaguuuaacccucagag

SEQ ID NO: 941561 - RNA, 22 nt, Human
cagagcucuauguucauggagg

SEQ ID NO: 941562 - RNA, 22 nt, Human
auaguggugagcugcauuuaug

SEQ ID NO: 941563 - RNA, 22 nt, Human
ugggagcaggugugcuagggaa

SEQ ID NO: 941564 - RNA, 22 nt, Human
ugcccuguuccugccuccagcu

SEQ ID NO: 941565 - RNA, 22 nt, Human
ucacaggaaccaucagagaaau

SEQ ID NO: 941566 - RNA, 22 nt, Human
ugcagugguugagagcccagac

SEQ ID NO: 941567 - RNA, 22 nt, Human
aggaagcccuugucauuucugu

SEQ ID NO: 941568 - RNA, 22 nt, Human
ugucucugaacagcuuacuaaa

SEQ ID NO: 941569 - RNA, 22 nt, Human
uucuucuccuaaggagaguccu

SEQ ID NO: 941570 - RNA, 22 nt, Human
uuugaaagacagaauauuuuug

SEQ ID NO: 941571 - RNA, 22 nt, Human
gucaucuucgcagagugauuuu

SEQ ID NO: 941572 - RNA, 22 nt, Human
ccacagggucagccacucugca

SEQ ID NO: 941573 - RNA, 19 nt, Human
cagcugccuuuucuuugca

SEQ ID NO: 941574 - RNA, 22 nt, Human
aguacauauaguaauuuagcca

SEQ ID NO: 941575 - RNA, 21 nt, Human
ugauuuccagaaaauuggccc

SEQ ID NO: 941576 - RNA, 22 nt, Human
agggacaguuacaucaucagac

SEQ ID NO: 941577 - RNA, 22 nt, Human
uucauuaaguauaaaauguggu

SEQ ID NO: 941578 - RNA, 22 nt, Human
aaugugcaggcucaaaccuugu

SEQ ID NO: 941579 - RNA, 22 nt, Human
agcaaggcagucagcuggcugg

SEQ ID NO: 941580 - RNA, 19 nt, Human
uggagaggaaaugcugcuc

SEQ ID NO: 941581 - RNA, 22 nt, Human
agaugcugugaggaagcuagga

SEQ ID NO: 941582 - RNA, 22 nt, Human
gccucugcaucaucacuccagc

SEQ ID NO: 941583 - RNA, 22 nt, Human
cuuucacauaauugaccuugaa

SEQ ID NO: 941584 - RNA, 22 nt, Human
ggggaugguagaccggugacgu

SEQ ID NO: 941585 - RNA, 22 nt, Human
agcaugaaagcauaggacaguc

SEQ ID NO: 941586 - RNA, 17 nt, Human
uccagagcacagagcuc

SEQ ID NO: 941587 - RNA, 22 nt, Human
ucagcugagcuccagcucauag

SEQ ID NO: 941588 - RNA, 22 nt, Human
uugcauugaaugcacauuuuua

SEQ ID NO: 941589 - RNA, 22 nt, Human
uuugcuaaugccucugaaauca

SEQ ID NO: 941590 - RNA, 22 nt, Human
cuaugaaaugucagauucugca

SEQ ID NO: 941591 - RNA, 23 nt, Human
ugccagaggcagucacaguggug

SEQ ID NO: 941592 - RNA, 22 nt, Human
gcagggaagggaaacagagacc

SEQ ID NO: 941593 - RNA, 22 nt, Human
ggcuggagugggcuccagaguu

SEQ ID NO: 941594 - RNA, 22 nt, Human
ugaggcaguucuuacuuguauu

SEQ ID NO: 941595 - RNA, 22 nt, Human
aauacaguagguaauaguucau

SEQ ID NO: 941596 - RNA, 22 nt, Human
guggccagaagacugcaaugcu

SEQ ID NO: 941597 - RNA, 22 nt, Human
ucaucugucauccacaaagcug

SEQ ID NO: 941598 - RNA, 22 nt, Human
aagaauguucuuguagucauga

SEQ ID NO: 941599 - RNA, 22 nt, Human
ugcccaggcuggaaugcagugg

SEQ ID NO: 941600 - RNA, 22 nt, Human
acacagaguauuuagaaggggu

SEQ ID NO: 941601 - RNA, 22 nt, Human
gggcauguagugugcauagaga

SEQ ID NO: 941602 - RNA, 18 nt, Human
agggucagugucacuggc

SEQ ID NO: 941603 - RNA, 22 nt, Human
uuucagauggagguuuaggaca

SEQ ID NO: 941604 - RNA, 22 nt, Human
cgccugggaguccacaccugcu

SEQ ID NO: 941605 - RNA, 22 nt, Human
ucaggccacggcucacugagac

SEQ ID NO: 941606 - RNA, 22 nt, Human
gaguuuaaauaacacauuucca

SEQ ID NO: 941607 - RNA, 22 nt, Human
ucacaguaucacacaaggauua

SEQ ID NO: 941608 - RNA, 22 nt, Human
uugcuuccaguccaagucuguu

SEQ ID NO: 941609 - RNA, 22 nt, Human
uuuuauuaguggcuagaugggg

SEQ ID NO: 941610 - RNA, 22 nt, Human
agugaacaaagguagugagcau

SEQ ID NO: 941611 - RNA, 22 nt, Human
ucugggagguaaccaugcugau

SEQ ID NO: 941612 - RNA, 22 nt, Human
uccuuggggacgcugacaucgu

SEQ ID NO: 941613 - RNA, 22 nt, Human
aggcuuccgaguagcugggacu

SEQ ID NO: 941614 - RNA, 21 nt, Human
aguugcauaggccagccaucc

SEQ ID NO: 941615 - RNA, 22 nt, Human
uggcaggguggcaacuuuuggu

SEQ ID NO: 941616 - RNA, 22 nt, Human
gauuuccuaauguggaucucug

SEQ ID NO: 941617 - RNA, 22 nt, Human
ccaaggcuccucagcuggucuu

SEQ ID NO: 941618 - RNA, 22 nt, Human
ucucuuuuauguacacccugac

SEQ ID NO: 941619 - RNA, 22 nt, Human
cucuggccuggggccugcuccc

SEQ ID NO: 941620 - RNA, 22 nt, Human
cugcugagguccuugcucagac

SEQ ID NO: 941621 - RNA, 22 nt, Human
auacuuacuuuucuucagacua

SEQ ID NO: 941622 - RNA, 22 nt, Human
cagacauauguuuuaacagauu

SEQ ID NO: 941623 - RNA, 22 nt, Human
gucacuguauccagguuccagc

SEQ ID NO: 941624 - RNA, 22 nt, Human
agcagccagagucugaacauua

SEQ ID NO: 941625 - RNA, 22 nt, Human
agcuggcauacuuugcuaggaa

SEQ ID NO: 941626 - RNA, 22 nt, Human
ucuccuggcucaccaggcugga

SEQ ID NO: 941627 - RNA, 22 nt, Human
cauguuaaugaauuuuugcagu

SEQ ID NO: 941628 - RNA, 22 nt, Human
auaaggcaucucucaguuagca

SEQ ID NO: 941629 - RNA, 22 nt, Human
ccgggcgggggcucucgucacc

SEQ ID NO: 941630 - RNA, 22 nt, Human
cccagccuuugcuuccugguuc

SEQ ID NO: 941631 - RNA, 19 nt, Human
cuucuucuuggcagccaag

SEQ ID NO: 941632 - RNA, 22 nt, Human
aauaauguugacgauagucuua

SEQ ID NO: 941633 - RNA, 22 nt, Human
gcuggcucccauugguccuucc

SEQ ID NO: 941634 - RNA, 22 nt, Human
aguguacacuaaaugaauacaa

SEQ ID NO: 941635 - RNA, 22 nt, Human
agggcagcauugccuuucucca

SEQ ID NO: 941636 - RNA, 22 nt, Human
cuauuucaaggcccagauauga

SEQ ID NO: 941637 - RNA, 22 nt, Human
uggcucagugacauuccuccca

SEQ ID NO: 941638 - RNA, 22 nt, Human
ugcuggguuaccuaagccuaaa

SEQ ID NO: 941639 - RNA, 22 nt, Human
uuaacaugucuugacuucaucu

SEQ ID NO: 941640 - RNA, 22 nt, Human
gcaggccucuguugagggccuu

SEQ ID NO: 941641 - RNA, 22 nt, Human
cuuccucaugugcaaugcaagc

SEQ ID NO: 941642 - RNA, 22 nt, Human
augucuuucgcaucaguagcua

SEQ ID NO: 941643 - RNA, 22 nt, Human
acuccagguuuuuucacugaag

SEQ ID NO: 941644 - RNA, 22 nt, Human
gcagacuguaucaaugucagua

SEQ ID NO: 941645 - RNA, 22 nt, Human
gauccuugcaacucugugaggu

SEQ ID NO: 941646 - RNA, 22 nt, Human
uggggccugagguggagcugca

SEQ ID NO: 941647 - RNA, 22 nt, Human
ugugccuuaugaauucuuucug

SEQ ID NO: 941648 - RNA, 22 nt, Human
aaugggagguaguaugggaggu

SEQ ID NO: 941649 - RNA, 22 nt, Human
gccaggcagcagcgaggauggu

SEQ ID NO: 941650 - RNA, 22 nt, Human
gaaaucaggaugauguuccaga

SEQ ID NO: 941651 - RNA, 22 nt, Human
cccaugccuucugacucacagg

SEQ ID NO: 941652 - RNA, 22 nt, Human
ucagcugccucucccuggaaga

SEQ ID NO: 941653 - RNA, 22 nt, Human
cugcaggggccucgagcacagg

SEQ ID NO: 941654 - RNA, 17 nt, Human
guccuacccauggucua

SEQ ID NO: 941655 - RNA, 22 nt, Human
accauguguuuuacacauggua

SEQ ID NO: 941656 - RNA, 22 nt, Human
caucucaugggcaugccaagcu

SEQ ID NO: 941657 - RNA, 22 nt, Human
aagagaggacauggugaaccug

SEQ ID NO: 941658 - RNA, 22 nt, Human
aagggcugaaagaccuugggca

SEQ ID NO: 941659 - RNA, 22 nt, Human
acugggaguucuccaugucccu

SEQ ID NO: 941660 - RNA, 22 nt, Human
acagccagucaucucagcaggg

SEQ ID NO: 941661 - RNA, 22 nt, Human
uauuccagugugaucuuuguag

SEQ ID NO: 941662 - RNA, 22 nt, Human
gcauuucugugcauacacauga

SEQ ID NO: 941663 - RNA, 22 nt, Human
gugggccucuugaggguggcua

SEQ ID NO: 941664 - RNA, 20 nt, Human
uauuuacaacuuagagccuc

SEQ ID NO: 941665 - RNA, 22 nt, Human
cacucugagccaaaacuaauuc

SEQ ID NO: 941666 - RNA, 22 nt, Human
acugcuuuucuaagauucugug

SEQ ID NO: 941667 - RNA, 22 nt, Human
accaggagccauagagucaggc

SEQ ID NO: 941668 - RNA, 22 nt, Human
uuccaggauggcaauaaugaau

SEQ ID NO: 941669 - RNA, 22 nt, Human
uugggagcauuuagaaaagacg

SEQ ID NO: 941670 - RNA, 22 nt, Human
agaugaaaagauaagcagcaau

SEQ ID NO: 941671 - RNA, 22 nt, Human
gggccuggugcuucugacuccu

SEQ ID NO: 941672 - RNA, 22 nt, Human
cugugucucccaaggaggguca

SEQ ID NO: 941673 - RNA, 22 nt, Human
uugugucuggauuucagcuuuc

SEQ ID NO: 941674 - RNA, 22 nt, Human
acacaggggcucggcugggugc

SEQ ID NO: 941675 - RNA, 19 nt, Human
uuagaaacuguugacacug

SEQ ID NO: 941676 - RNA, 22 nt, Human
gcaggaguguggugggacaucc

SEQ ID NO: 941677 - RNA, 22 nt, Human
gcaucuucacacaaagccagug

SEQ ID NO: 941678 - RNA, 22 nt, Human
aaaucagagugguuggucaucc

SEQ ID NO: 941679 - RNA, 22 nt, Human
ccucagggccaucucugucccu

SEQ ID NO: 941680 - RNA, 22 nt, Human
ggagagaaauugagguagcaag

SEQ ID NO: 941681 - RNA, 22 nt, Human
caguguguggauccucccagga

SEQ ID NO: 941682 - RNA, 21 nt, Human
agcuuguguguaucacagugu

SEQ ID NO: 941683 - RNA, 22 nt, Human
uucacauuauaaucaguucugc

SEQ ID NO: 941684 - RNA, 22 nt, Human
gcacagaaguaaaauacaaguc

SEQ ID NO: 941685 - RNA, 22 nt, Human
uucaggaugcucagaguagucu

SEQ ID NO: 941686 - RNA, 22 nt, Human
aggggacacggcuucuccaggg

SEQ ID NO: 941687 - RNA, 22 nt, Human
gagugaaaaaggaagggccaua

SEQ ID NO: 941688 - RNA, 22 nt, Human
uucuaacucuguuauguguuuc

SEQ ID NO: 941689 - RNA, 22 nt, Human
cugggagauugcuagagaugca

SEQ ID NO: 941690 - RNA, 22 nt, Human
gggcugcuguagagaacauguu

SEQ ID NO: 941691 - RNA, 22 nt, Human
gcucugcuuucuggggggaucc

SEQ ID NO: 941692 - RNA, 22 nt, Human
aggccagacagcuagaaacagg

SEQ ID NO: 941693 - RNA, 23 nt, Human
ggagaggggugugggcaucuuua

SEQ ID NO: 941694 - RNA, 22 nt, Human
augagcugggccauccagugau

SEQ ID NO: 941695 - RNA, 22 nt, Human
ucuguucaucucaugggagaau

SEQ ID NO: 941696 - RNA, 22 nt, Human
acacaugcauaagccuucccuu

SEQ ID NO: 941697 - RNA, 22 nt, Human
aucagcugaaaaacaggcagca

SEQ ID NO: 941698 - RNA, 22 nt, Human
ccuggagcaggagcugcagagg

SEQ ID NO: 941699 - RNA, 22 nt, Human
cagggaggcugucuuaugccug

SEQ ID NO: 941700 - RNA, 22 nt, Human
cugaagcaaaggaucgagcuaa

SEQ ID NO: 941701 - RNA, 22 nt, Human
cuuugcaaacgauuaccacaug

SEQ ID NO: 941702 - RNA, 22 nt, Human
aggaagcuccuggagagccagu

SEQ ID NO: 941703 - RNA, 22 nt, Human
ugagccugaguucaaggcugca

SEQ ID NO: 941704 - RNA, 23 nt, Human
cuuuuaacuugaucugagaccag

SEQ ID NO: 941705 - RNA, 22 nt, Human
acaauucugaugguuucccagu

SEQ ID NO: 941706 - RNA, 22 nt, Human
aaaucaguuguuauauuaaaga

SEQ ID NO: 941707 - RNA, 18 nt, Human
agcuggggccucuggucc

SEQ ID NO: 941708 - RNA, 22 nt, Human
uuuccuaaucccaaugacauuu

SEQ ID NO: 941709 - RNA, 22 nt, Human
guggcugcagagccagcaagcu

SEQ ID NO: 941710 - RNA, 22 nt, Human
gaaggaaaaauacucuguaagg

SEQ ID NO: 941711 - RNA, 23 nt, Human
cugcuguguuggucucgauggga

SEQ ID NO: 941712 - RNA, 21 nt, Human
gagcauggcuuacaucagcag

SEQ ID NO: 941713 - RNA, 22 nt, Human
caagaugggcaccccagcaccu

SEQ ID NO: 941714 - RNA, 17 nt, Human
cuggagccuccaacucc

SEQ ID NO: 941715 - RNA, 23 nt, Human
uggcccugugcaugcugcuuccc

SEQ ID NO: 941716 - RNA, 19 nt, Human
uggaggagaggaaaaguca

SEQ ID NO: 941717 - RNA, 22 nt, Human
cauguacaguuuuucuguccug

SEQ ID NO: 941718 - RNA, 22 nt, Human
gaugcagaaaguagacaccauc

SEQ ID NO: 941719 - RNA, 19 nt, Human
acugccugaggcucacagg

SEQ ID NO: 941720 - RNA, 22 nt, Human
gccucugcgccucagccgaccu

SEQ ID NO: 941721 - RNA, 22 nt, Human
aggcaggccccugagaauagac

SEQ ID NO: 941722 - RNA, 22 nt, Human
aucuggcuugacuuugcgacuu

SEQ ID NO: 941723 - RNA, 22 nt, Human
ugaaaugaaugugauucgauag

SEQ ID NO: 941724 - RNA, 22 nt, Human
ugcugccaaaugcgagcucugu

SEQ ID NO: 941725 - RNA, 22 nt, Human
cauguacaaaaggcaaaugccu

SEQ ID NO: 941726 - RNA, 20 nt, Human
cagcaggaaaagugccucag

SEQ ID NO: 941727 - RNA, 22 nt, Human
cuacauggagaagaaaauucuu

SEQ ID NO: 941728 - RNA, 22 nt, Human
agaggggaaguaaugaaugaua

SEQ ID NO: 941729 - RNA, 22 nt, Human
acaaaugccauauauaaauucu

SEQ ID NO: 941730 - RNA, 22 nt, Human
uaaauaaguucuucauuguuug

SEQ ID NO: 941731 - RNA, 22 nt, Human
agucccagugagaugagccacg

SEQ ID NO: 941732 - RNA, 22 nt, Human
uguguuauugccacugaagacc

SEQ ID NO: 941733 - RNA, 22 nt, Human
caacugcugacaccaucacucc

SEQ ID NO: 941734 - RNA, 22 nt, Human
uaacagaauuugcuaaacuccg

SEQ ID NO: 941735 - RNA, 22 nt, Human
gggcuccaacggugagcaugga

SEQ ID NO: 941736 - RNA, 22 nt, Human
ucugagccacagauguccuguu

SEQ ID NO: 941737 - RNA, 22 nt, Human
cuggcagucacggccaugugcu

SEQ ID NO: 941738 - RNA, 22 nt, Human
gggcagaggcucuggcccaucc

SEQ ID NO: 941739 - RNA, 22 nt, Human
auguuuuacccuuugcacaaac

SEQ ID NO: 941740 - RNA, 22 nt, Human
uggcuuccuccagagcaggagg

SEQ ID NO: 941741 - RNA, 22 nt, Human
ccaggcagcaaauuuucugaau

SEQ ID NO: 941742 - RNA, 22 nt, Human
uccuucaguucaauuaguccgu

SEQ ID NO: 941743 - RNA, 22 nt, Human
ccugcuguucuguuuagugaac

SEQ ID NO: 941744 - RNA, 22 nt, Human
ucucagucuuugcaaggaugcu

SEQ ID NO: 941745 - RNA, 20 nt, Human
ucacagaaacaaauagagaa

SEQ ID NO: 941746 - RNA, 22 nt, Human
cuggcucccguuguccuugaag

SEQ ID NO: 941747 - RNA, 22 nt, Human
gaggccugggagccuguccucc

SEQ ID NO: 941748 - RNA, 22 nt, Human
gugcaggggaucagguugcagc

SEQ ID NO: 941749 - RNA, 21 nt, Human
agagccugagaucuuccagca

SEQ ID NO: 941750 - RNA, 22 nt, Human
cguguggucccggcaaggcaag

SEQ ID NO: 941751 - RNA, 22 nt, Human
gacccaggcccaaggcugccag

SEQ ID NO: 941752 - RNA, 22 nt, Human
agccacagguguuggccagugu

SEQ ID NO: 941753 - RNA, 22 nt, Human
caggacagagcccagacugugu

SEQ ID NO: 941754 - RNA, 22 nt, Human
cauuuauucauuugcuagggcu

SEQ ID NO: 941755 - RNA, 22 nt, Human
aucuacaggauuuuacagaguu

SEQ ID NO: 941756 - RNA, 22 nt, Human
gccaggcauuuguuaggugcug

SEQ ID NO: 941757 - RNA, 22 nt, Human
cacagggcagugauuguccaca

SEQ ID NO: 941758 - RNA, 22 nt, Human
ggcugcagguugguuggcagcu

SEQ ID NO: 941759 - RNA, 20 nt, Human
cagagacccaggcuucagcu

SEQ ID NO: 941760 - RNA, 22 nt, Human
gaaaucugucuuuguuugaaua

SEQ ID NO: 941761 - RNA, 20 nt, Human
gugugaagcccucaggagga

SEQ ID NO: 941762 - RNA, 22 nt, Human
ucuagaaacaugacauugaucu

SEQ ID NO: 941763 - RNA, 22 nt, Human
gcagugggagcuuaggcagugc

SEQ ID NO: 941764 - RNA, 22 nt, Human
ucaggauggcuucugcaucaaa

SEQ ID NO: 941765 - RNA, 22 nt, Human
ucuggcucucucaucacccaau

SEQ ID NO: 941766 - RNA, 21 nt, Human
agucuguuaggaugacucuga

SEQ ID NO: 941767 - RNA, 22 nt, Human
gaagcccagggcguggccgggc

SEQ ID NO: 941768 - RNA, 22 nt, Human
gcccagcaccucucucaggguu

SEQ ID NO: 941769 - RNA, 22 nt, Human
agcagccuuugaucaucuggga

SEQ ID NO: 941770 - RNA, 22 nt, Human
aaauucuaugucaauguuuauu

SEQ ID NO: 941771 - RNA, 22 nt, Human
guucuucagucacaucacagaa

SEQ ID NO: 941772 - RNA, 22 nt, Human
cauuucugucacguucuuuuau

SEQ ID NO: 941773 - RNA, 22 nt, Human
ucaaauaaggagucaugaccau

SEQ ID NO: 941774 - RNA, 22 nt, Human
ucugagccaauuucugugucca

SEQ ID NO: 941775 - RNA, 22 nt, Human
auucaaguccagcuucucuaca

SEQ ID NO: 941776 - RNA, 22 nt, Human
ugggcucugaagucagucugcu

SEQ ID NO: 941777 - RNA, 22 nt, Human
gcucugucauuuugcagacacu

SEQ ID NO: 941778 - RNA, 22 nt, Human
ucauuugugugagugauuugac

SEQ ID NO: 941779 - RNA, 22 nt, Human
agagaacacgugcaucugcaau

SEQ ID NO: 941780 - RNA, 22 nt, Human
ugggccugggcuccuguccucu

SEQ ID NO: 941781 - RNA, 20 nt, Human
cugcugugugugccucagcc

SEQ ID NO: 941782 - RNA, 22 nt, Human
acacaugcugauaagaauauaa

SEQ ID NO: 941783 - RNA, 22 nt, Human
uuccucucucuugccagaaugu

SEQ ID NO: 941784 - RNA, 22 nt, Human
ugggcacaaacaucugccuguu

SEQ ID NO: 941785 - RNA, 22 nt, Human
cuugcugucccuugguaugaac

SEQ ID NO: 941786 - RNA, 22 nt, Human
ccuucugcuggucaucccagug

SEQ ID NO: 941787 - RNA, 22 nt, Human
augcuguguggccaccuccaug

SEQ ID NO: 941788 - RNA, 22 nt, Human
ggaagugaggaauuagguuuau

SEQ ID NO: 941789 - RNA, 22 nt, Human
cagagcaggcccacugcccucc

SEQ ID NO: 941790 - RNA, 22 nt, Human
gcuggccacacugcugauggag

SEQ ID NO: 941791 - RNA, 22 nt, Human
ucugacauuagauuaauuggaa

SEQ ID NO: 941792 - RNA, 22 nt, Human
agaaaugugaauuucauuuccu

SEQ ID NO: 941793 - RNA, 22 nt, Human
aagacugucuuuucugagugac

SEQ ID NO: 941794 - RNA, 20 nt, Human
cccuggccuguuucaugccc

SEQ ID NO: 941795 - RNA, 22 nt, Human
ccagcuggagcucgcagauagg

SEQ ID NO: 941796 - RNA, 22 nt, Human
gacuguguccaugugcuggauu

SEQ ID NO: 941797 - RNA, 22 nt, Human
uuccagaaaucuuucagcucaa

SEQ ID NO: 941798 - RNA, 21 nt, Human
aagcuucccugcucuccaggg

SEQ ID NO: 941799 - RNA, 22 nt, Human
gcuggccaggaagagucucaga

SEQ ID NO: 941800 - RNA, 22 nt, Human
uaaggcacccuucugaguagag

SEQ ID NO: 941801 - RNA, 22 nt, Human
aggagggacaccaauauauguu

SEQ ID NO: 941802 - RNA, 22 nt, Human
uccaggccuaggccaagugauu

SEQ ID NO: 941803 - RNA, 22 nt, Human
uuguguuucugugauauguaaa

SEQ ID NO: 941804 - RNA, 22 nt, Human
cucuguccacagguuugucccu

SEQ ID NO: 941805 - RNA, 22 nt, Human
agaggaugauuuuaaggacacu

SEQ ID NO: 941806 - RNA, 22 nt, Human
cuuaauaaaugguagcuguuau

SEQ ID NO: 941807 - RNA, 22 nt, Human
uuacuggcugggccugagggcu

SEQ ID NO: 941808 - RNA, 21 nt, Human
ccuucuccacagggucuccgg

SEQ ID NO: 941809 - RNA, 22 nt, Human
ugacagcugagccccaggcaag

SEQ ID NO: 941810 - RNA, 22 nt, Human
ucaucugucccaggcuuuuuuc

SEQ ID NO: 941811 - RNA, 22 nt, Human
aaaagucagucucuccuagcuc

SEQ ID NO: 941812 - RNA, 22 nt, Human
aaagauuugaguucugcuuaua

SEQ ID NO: 941813 - RNA, 22 nt, Human
ggccucucuccuuggcuugcag

SEQ ID NO: 941814 - RNA, 22 nt, Human
ccucagcugcuucccuggagcc

SEQ ID NO: 941815 - RNA, 22 nt, Human
ugaaggcccagccacagaaugg

SEQ ID NO: 941816 - RNA, 22 nt, Human
ggugcccaccugucuuccugga

SEQ ID NO: 941817 - RNA, 22 nt, Human
agccugguguggggcugcagag

SEQ ID NO: 941818 - RNA, 21 nt, Human
auccauccaucuuggccuaac

SEQ ID NO: 941819 - RNA, 22 nt, Human
cugugucuucuguuuugaaguu

SEQ ID NO: 941820 - RNA, 21 nt, Human
gagcugggcgaggcuccgggg

SEQ ID NO: 941821 - RNA, 22 nt, Human
uggcucaguuccaucaucugga

SEQ ID NO: 941822 - RNA, 22 nt, Human
uggcacugagcagccgcggcag

SEQ ID NO: 941823 - RNA, 22 nt, Human
agagcugcaggguggacccagg

SEQ ID NO: 941824 - RNA, 22 nt, Human
gugcuuucugcugcauuccucu

SEQ ID NO: 941825 - RNA, 22 nt, Human
gcuguucacauuuugggccaaa

SEQ ID NO: 941826 - RNA, 22 nt, Human
ccaggagagcgcccucccggcc

SEQ ID NO: 941827 - RNA, 22 nt, Human
uuauuucauguaaaauuuaugu

SEQ ID NO: 941828 - RNA, 23 nt, Human
ugagcccaggaggucaaggcugc

SEQ ID NO: 941829 - RNA, 22 nt, Human
aacuccagggcauugucuccug

SEQ ID NO: 941830 - RNA, 22 nt, Human
cuacuuuaauuuucugcagaga

SEQ ID NO: 941831 - RNA, 21 nt, Human
agacaguaacucuucuacucc

SEQ ID NO: 941832 - RNA, 22 nt, Human
gggaguggagagcaauggauga

SEQ ID NO: 941833 - RNA, 22 nt, Human
uuucagggagccuagaagagcu

SEQ ID NO: 941834 - RNA, 22 nt, Human
guuuucaauuauaagauggcuu

SEQ ID NO: 941835 - RNA, 22 nt, Human
uuccggaagguucucuagaauu

SEQ ID NO: 941836 - RNA, 22 nt, Human
cuccucaguugucccauggaga

SEQ ID NO: 941837 - RNA, 22 nt, Human
acgagagguccuuagaaucugu

SEQ ID NO: 941838 - RNA, 22 nt, Human
gaaucauagaacauuaauagaa

SEQ ID NO: 941839 - RNA, 22 nt, Human
aggggcugccuggcuuggcacu

SEQ ID NO: 941840 - RNA, 22 nt, Human
guguuuccuaguuuaaugaaug

SEQ ID NO: 941841 - RNA, 22 nt, Human
gggucagcugcugggggcugac

SEQ ID NO: 941842 - RNA, 22 nt, Human
uucucuuuucaccaguugcuaa

SEQ ID NO: 941843 - RNA, 18 nt, Human
uggcucuggacuugcucc

SEQ ID NO: 941844 - RNA, 18 nt, Human
gccuggcuucggagccgc

SEQ ID NO: 941845 - RNA, 22 nt, Human
guggugcaggccagcaggggcg

SEQ ID NO: 941846 - RNA, 22 nt, Human
ugaggcaggaguuaaugugcuc

SEQ ID NO: 941847 - RNA, 22 nt, Human
guucacaaauaugcacuuacga

SEQ ID NO: 941848 - RNA, 21 nt, Human
agaagccuggguggagguggg

SEQ ID NO: 941849 - RNA, 22 nt, Human
ucccagagauuuccucuccuuc

SEQ ID NO: 941850 - RNA, 22 nt, Human
cccuggagugccggaaucaaga

SEQ ID NO: 941851 - RNA, 22 nt, Human
agugagggaugaagaacugcgg

SEQ ID NO: 941852 - RNA, 22 nt, Human
cacauauuugaugaagcuuugu

SEQ ID NO: 941853 - RNA, 22 nt, Human
cagggucugaaacugaucacag

SEQ ID NO: 941854 - RNA, 22 nt, Human
ccaggacuuuaaguccagcacu

SEQ ID NO: 941855 - RNA, 22 nt, Human
agccucucuguuagucacuggg

SEQ ID NO: 941856 - RNA, 22 nt, Human
caggcacuguguuaggcacugu

SEQ ID NO: 941857 - RNA, 22 nt, Human
uuccuugguagagagaauauuu

SEQ ID NO: 941858 - RNA, 22 nt, Human
uggccacauccuuuccuuguca

SEQ ID NO: 941859 - RNA, 22 nt, Human
augauugguggucagcaguaug

SEQ ID NO: 941860 - RNA, 22 nt, Human
ccugccaggagcuggugcugca

SEQ ID NO: 941861 - RNA, 22 nt, Human
ucaggcagagcuguggagcucu

SEQ ID NO: 941862 - RNA, 22 nt, Human
ccaucagcaugggagcaugggc

SEQ ID NO: 941863 - RNA, 22 nt, Human
ccagggaguuuccaaucugaga

SEQ ID NO: 941864 - RNA, 22 nt, Human
agaauucuuggugguuagaaua

SEQ ID NO: 941865 - RNA, 22 nt, Human
gcugcccagcaggccccagggg

SEQ ID NO: 941866 - RNA, 22 nt, Human
uagugaaacaguuaucaaucug

SEQ ID NO: 941867 - RNA, 22 nt, Human
cagagggaaaaggggaguaaua

SEQ ID NO: 941868 - RNA, 20 nt, Human
agguauaagaaaugugauuu

SEQ ID NO: 941869 - RNA, 22 nt, Human
guguaauuauauaaagaucuac

SEQ ID NO: 941870 - RNA, 22 nt, Human
auagauguucaaucagauauuu

SEQ ID NO: 941871 - RNA, 19 nt, Human
cagcugcaccgugaccauc

SEQ ID NO: 941872 - RNA, 22 nt, Human
cucagcagagaccagggaggaa

SEQ ID NO: 941873 - RNA, 22 nt, Human
guuagaauaaaaggucagagag

SEQ ID NO: 941874 - RNA, 22 nt, Human
uuuaaaaaacuagucugagucu

SEQ ID NO: 941875 - RNA, 22 nt, Human
ggagagcagggaggcugcucug

SEQ ID NO: 941876 - RNA, 18 nt, Human
cacaggcucccagugagg

SEQ ID NO: 941877 - RNA, 22 nt, Human
acuugggagggugugggcagcu

SEQ ID NO: 941878 - RNA, 22 nt, Human
aggagggagaugcccauccugg

SEQ ID NO: 941879 - RNA, 22 nt, Human
ggcacugauuccauucaugaag

SEQ ID NO: 941880 - RNA, 22 nt, Human
agccauugaguuuuaugugcua

SEQ ID NO: 941881 - RNA, 23 nt, Human
uacauuguggauggaguccuggg

SEQ ID NO: 941882 - RNA, 22 nt, Human
ggagguggcagggaacauaauu

SEQ ID NO: 941883 - RNA, 22 nt, Human
aaauuguugaucuacaguaagg

SEQ ID NO: 941884 - RNA, 22 nt, Human
auuucauagauuguaaaucccu

SEQ ID NO: 941885 - RNA, 22 nt, Human
cugacagucucauugauuugcu

SEQ ID NO: 941886 - RNA, 22 nt, Human
ucucuucauagugacacccauc

SEQ ID NO: 941887 - RNA, 22 nt, Human
ccuggccacucagguguggggc

SEQ ID NO: 941888 - RNA, 22 nt, Human
uacaguagaauuuuuaguaacu

SEQ ID NO: 941889 - RNA, 21 nt, Human
auguaggguuugccuucucua

SEQ ID NO: 941890 - RNA, 22 nt, Human
ucucagagagaugaaacuucca

SEQ ID NO: 941891 - RNA, 22 nt, Human
cccagcacuuugaauaugucac

SEQ ID NO: 941892 - RNA, 22 nt, Human
uuucuauucuggaucuguggca

SEQ ID NO: 941893 - RNA, 22 nt, Human
aggaugggccugggauaugcuu

SEQ ID NO: 941894 - RNA, 22 nt, Human
cugcccugagggccuguguguu

SEQ ID NO: 941895 - RNA, 22 nt, Human
cucuuuccucagccacagucua

SEQ ID NO: 941896 - RNA, 22 nt, Human
uuguuuaauaucgugaaguacu

SEQ ID NO: 941897 - RNA, 22 nt, Human
gcacacagauuaggaaacagaa

SEQ ID NO: 941898 - RNA, 22 nt, Human
gccugugcauagcagcggacuc

SEQ ID NO: 941899 - RNA, 22 nt, Human
auggggagagaagggcugagcu

SEQ ID NO: 941900 - RNA, 22 nt, Human
gguggguauugaauacaggugu

SEQ ID NO: 941901 - RNA, 22 nt, Human
ucccuggagauaacuucuggga

SEQ ID NO: 941902 - RNA, 22 nt, Human
agagccugugggagaugcagcu

SEQ ID NO: 941903 - RNA, 22 nt, Human
auauguuuugugcuucauuggu

SEQ ID NO: 941904 - RNA, 22 nt, Human
aucuggcuauuucuggucgggg

SEQ ID NO: 941905 - RNA, 22 nt, Human
uggaaagagguagaggaucugg

SEQ ID NO: 941906 - RNA, 17 nt, Human
uccuucagggccucaca

SEQ ID NO: 941907 - RNA, 22 nt, Human
ugccuggaugugcuggccucac

SEQ ID NO: 941908 - RNA, 22 nt, Human
ccuggcagguggagguugcagu

SEQ ID NO: 941909 - RNA, 22 nt, Human
accaggaggccuggagcacaaa

SEQ ID NO: 941910 - RNA, 22 nt, Human
ucucgacagccuggcacagugg

SEQ ID NO: 941911 - RNA, 22 nt, Human
gcugagcugaggcagggcuggg

SEQ ID NO: 941912 - RNA, 22 nt, Human
caggccuggcugcagcucgccu

SEQ ID NO: 941913 - RNA, 22 nt, Human
uggucuaaauauggcucuaaau

SEQ ID NO: 941914 - RNA, 22 nt, Human
aguauugugacucaaguauucu

SEQ ID NO: 941915 - RNA, 22 nt, Human
uuaaaagaauccuguuauccuc

SEQ ID NO: 941916 - RNA, 22 nt, Human
uuauguaauuuguuugcucuuc

SEQ ID NO: 941917 - RNA, 22 nt, Human
gugccugccccacuccucagca

SEQ ID NO: 941918 - RNA, 22 nt, Human
acuggcugaaguuuacuuuuug

SEQ ID NO: 941919 - RNA, 22 nt, Human
caagaacaguuugccaaauugg

SEQ ID NO: 941920 - RNA, 22 nt, Human
ucaaauacauggucaaucaacu

SEQ ID NO: 941921 - RNA, 22 nt, Human
aucauucuaguccuuauggucu

SEQ ID NO: 941922 - RNA, 22 nt, Human
uacagaguggugagaucuuuug

SEQ ID NO: 941923 - RNA, 22 nt, Human
cuggcuggccggagcgaggcgg

SEQ ID NO: 941924 - RNA, 22 nt, Human
ugucuucaguaaaauacacuau

SEQ ID NO: 941925 - RNA, 22 nt, Human
aucaggauucaguaucuccagc

SEQ ID NO: 941926 - RNA, 22 nt, Human
gcauggcagugaggauggugcu

SEQ ID NO: 941927 - RNA, 22 nt, Human
cucuucuuggcccccaugaggg

SEQ ID NO: 941928 - RNA, 20 nt, Human
gucucagaauggauuugcau

SEQ ID NO: 941929 - RNA, 22 nt, Human
uuccaaaggaauggggagcuau

SEQ ID NO: 941930 - RNA, 22 nt, Human
gcucugcugauccgcagccauc

SEQ ID NO: 941931 - RNA, 22 nt, Human
uucuucaaaacaacacuggccu

SEQ ID NO: 941932 - RNA, 22 nt, Human
acuccuggggcugccaucacag

SEQ ID NO: 941933 - RNA, 22 nt, Human
ucagaaauagucuuuaaaauga

SEQ ID NO: 941934 - RNA, 23 nt, Human
aaugggugcaacuauccaugaca

SEQ ID NO: 941935 - RNA, 22 nt, Human
ggcaguagccagggacuggcag

SEQ ID NO: 941936 - RNA, 22 nt, Human
aaggcucuuggagugaaugcag

SEQ ID NO: 941937 - RNA, 22 nt, Human
ucucugcuugguguaugugagu

SEQ ID NO: 941938 - RNA, 22 nt, Human
ggcagcuuuuaucccugacaga

SEQ ID NO: 941939 - RNA, 22 nt, Human
uggaaggaaagguagcagagaa

SEQ ID NO: 941940 - RNA, 20 nt, Human
aggagaaauucgggacaccu

SEQ ID NO: 941941 - RNA, 22 nt, Human
agcuggaggggccagcaggugu

SEQ ID NO: 941942 - RNA, 22 nt, Human
uuuuaugugcuggacuggcagu

SEQ ID NO: 941943 - RNA, 22 nt, Human
ccugccuggaucagccauccug

SEQ ID NO: 941944 - RNA, 22 nt, Human
guccucugcccaggucaagguu

SEQ ID NO: 941945 - RNA, 22 nt, Human
agcaaagucaguggaaccaucc

SEQ ID NO: 941946 - RNA, 22 nt, Human
aagggcagaauagagaagaugg

SEQ ID NO: 941947 - RNA, 22 nt, Human
cagcaggaggugagaugugacc

SEQ ID NO: 941948 - RNA, 22 nt, Human
augggaggcagacacuaaguuc

SEQ ID NO: 941949 - RNA, 22 nt, Human
accaggcuggagugcaguggcg

SEQ ID NO: 941950 - RNA, 22 nt, Human
cauugacaucaggcuuggccaa

SEQ ID NO: 941951 - RNA, 22 nt, Human
agccuggauucgugcauccaca

SEQ ID NO: 941952 - RNA, 20 nt, Human
ugggccuguggcagaagucu

SEQ ID NO: 941953 - RNA, 22 nt, Human
cuguccuguagcuccaucaguc

SEQ ID NO: 941954 - RNA, 22 nt, Human
aggggcucaaagugugcaggga

SEQ ID NO: 941955 - RNA, 22 nt, Human
cucuggaauuaaggaagccugu

SEQ ID NO: 941956 - RNA, 22 nt, Human
cugcugcaggaugggcacucug

SEQ ID NO: 941957 - RNA, 18 nt, Human
ugaauagggguuugcaga

SEQ ID NO: 941958 - RNA, 20 nt, Human
ugaggcaggagaauggcaug

SEQ ID NO: 941959 - RNA, 22 nt, Human
uuagauaaauugcaacuugauu

SEQ ID NO: 941960 - RNA, 20 nt, Human
ucucuucuggggagauaaaa

SEQ ID NO: 941961 - RNA, 22 nt, Human
uggcagcuguguccagguagaa

SEQ ID NO: 941962 - RNA, 20 nt, Human
uauuucugggcaaccauuua

SEQ ID NO: 941963 - RNA, 22 nt, Human
acuguguggaccacucugaggc

SEQ ID NO: 941964 - RNA, 22 nt, Human
cugccuugguuucuagcagggc

SEQ ID NO: 941965 - RNA, 17 nt, Human
cacccuggcuagucuga

SEQ ID NO: 941966 - RNA, 22 nt, Human
aagcaugugcuggggcuuuuug

SEQ ID NO: 941967 - RNA, 22 nt, Human
cagagccaaaugcugugguuau

SEQ ID NO: 941968 - RNA, 22 nt, Human
gaggaaugucagcacaggccuc

SEQ ID NO: 941969 - RNA, 22 nt, Human
gugugcaugcauagacaccaca

SEQ ID NO: 941970 - RNA, 22 nt, Human
aacccuggggcagcugcuaggg

SEQ ID NO: 941971 - RNA, 22 nt, Human
aagcuggagaguuaggugaaua

SEQ ID NO: 941972 - RNA, 21 nt, Human
uacugagaccucacagugugc

SEQ ID NO: 941973 - RNA, 22 nt, Human
gucccagaaacauauugcuggu

SEQ ID NO: 941974 - RNA, 22 nt, Human
agcagcucuuaacaaagcaugg

SEQ ID NO: 941975 - RNA, 22 nt, Human
uuuauuguuguuagucauaagu

SEQ ID NO: 941976 - RNA, 23 nt, Human
gcagaggagcaagcuggacacca

SEQ ID NO: 941977 - RNA, 22 nt, Human
acagcagcgucaacuuaaaauu

SEQ ID NO: 941978 - RNA, 22 nt, Human
ugaaaugagcauuuauucuuua

SEQ ID NO: 941979 - RNA, 22 nt, Human
ggcacugacugugcagcgcacc

SEQ ID NO: 941980 - RNA, 22 nt, Human
auggcagcaaaugucuggcugg

SEQ ID NO: 941981 - RNA, 21 nt, Human
uggcagaguugaguaguuaug

SEQ ID NO: 941982 - RNA, 22 nt, Human
cuuuccaaugcauuuccaaugu

SEQ ID NO: 941983 - RNA, 22 nt, Human
ucucagagauucagggagaagu

SEQ ID NO: 941984 - RNA, 22 nt, Human
uuucugugguggguaguucaga

SEQ ID NO: 941985 - RNA, 22 nt, Human
uguuguuuucucauggagaaua

SEQ ID NO: 941986 - RNA, 22 nt, Human
ccagcuggugacauccccaacc

SEQ ID NO: 941987 - RNA, 22 nt, Human
gaggcauggccugaggcuagga

SEQ ID NO: 941988 - RNA, 23 nt, Human
acugucugauauguuuuccauca

SEQ ID NO: 941989 - RNA, 20 nt, Human
auacacauauucuugcaacu

SEQ ID NO: 941990 - RNA, 22 nt, Human
gggccucucccuucucacgcau

SEQ ID NO: 941991 - RNA, 22 nt, Human
gggugggccacugagcagcgug

SEQ ID NO: 941992 - RNA, 22 nt, Human
uggcugccuagugucugagcag

SEQ ID NO: 941993 - RNA, 22 nt, Human
uagaaauguugguauuaacauu

SEQ ID NO: 941994 - RNA, 21 nt, Human
ucuuggccuaaguucacugaa

SEQ ID NO: 941995 - RNA, 22 nt, Human
auggaaagugcauggaagucau

SEQ ID NO: 941996 - RNA, 22 nt, Human
ucagagaguuagugucuuagcu

SEQ ID NO: 941997 - RNA, 22 nt, Human
gcaaggaccuuugagcgugcca

SEQ ID NO: 941998 - RNA, 22 nt, Human
uagggaggcuacuucuuguagg

SEQ ID NO: 941999 - RNA, 22 nt, Human
cucuuaguuuaucuuugacaaa

SEQ ID NO: 942000 - RNA, 22 nt, Human
ggccgggcaggucucagccagc

SEQ ID NO: 942001 - RNA, 22 nt, Human
uaugugcaguuugcucuuaaca

SEQ ID NO: 942002 - RNA, 22 nt, Human
gcucugcugacagcugggacag

SEQ ID NO: 942003 - RNA, 22 nt, Human
gcugugcagccaagugccucug

SEQ ID NO: 942004 - RNA, 22 nt, Human
ggccagagaauaugccuuacgu

SEQ ID NO: 942005 - RNA, 23 nt, Human
ccacagagcugccaauuccugug

SEQ ID NO: 942006 - RNA, 22 nt, Human
cccagcaggaggagguugcagu

SEQ ID NO: 942007 - RNA, 21 nt, Human
uuagcaaagcaaacacaugcu

SEQ ID NO: 942008 - RNA, 22 nt, Human
agugaaaugauucugagcaaga

SEQ ID NO: 942009 - RNA, 22 nt, Human
agaauuguugggguaauaaaag

SEQ ID NO: 942010 - RNA, 22 nt, Human
ucagcagcagcucagcauguuu

SEQ ID NO: 942011 - RNA, 22 nt, Human
ucuugggaaauaaacagauuga

SEQ ID NO: 942012 - RNA, 22 nt, Human
auagugguuggauaugucagag

SEQ ID NO: 942013 - RNA, 21 nt, Human
acagaugggaugagcacacug

SEQ ID NO: 942014 - RNA, 22 nt, Human
aggcugucaucuuugcaggcag

SEQ ID NO: 942015 - RNA, 22 nt, Human
auucacaauuagaaguagauaa

SEQ ID NO: 942016 - RNA, 22 nt, Human
gcugugggugcuggcuccaccc

SEQ ID NO: 942017 - RNA, 22 nt, Human
ucuguucagguuucagagaacu

SEQ ID NO: 942018 - RNA, 22 nt, Human
cuggccagcauuuuugcuuuag

SEQ ID NO: 942019 - RNA, 22 nt, Human
uguguuuugaacucaucuacug

SEQ ID NO: 942020 - RNA, 22 nt, Human
ggugagggaguggaacgaggug

SEQ ID NO: 942021 - RNA, 22 nt, Human
ggcccucccugagccagguggg

SEQ ID NO: 942022 - RNA, 22 nt, Human
ggccucucuccagucagugcag

SEQ ID NO: 942023 - RNA, 22 nt, Human
uuaguaaauaaagucuacuuuc

SEQ ID NO: 942024 - RNA, 22 nt, Human
ugaugggaaaaugaggccuggg

SEQ ID NO: 942025 - RNA, 22 nt, Human
ucaggaugguguggaggaaaua

SEQ ID NO: 942026 - RNA, 22 nt, Human
uguggccuccuguuccugggua

SEQ ID NO: 942027 - RNA, 22 nt, Human
uaaggccagcaugaaugcagca

SEQ ID NO: 942028 - RNA, 22 nt, Human
gggcagcucggaagugggaaag

SEQ ID NO: 942029 - RNA, 22 nt, Human
caggaggaggugagguagaacu

SEQ ID NO: 942030 - RNA, 22 nt, Human
aggccagcuguuacuagagcca

SEQ ID NO: 942031 - RNA, 22 nt, Human
uagcuuuacaaagugcugcacc

SEQ ID NO: 942032 - RNA, 22 nt, Human
cccauucauccucgcuuccuuc

SEQ ID NO: 942033 - RNA, 22 nt, Human
ugagagucucagaccuccuggu

SEQ ID NO: 942034 - RNA, 22 nt, Human
auuuugaugcuaucuaaugaau

SEQ ID NO: 942035 - RNA, 22 nt, Human
auuugucucugcacuuuacuca

SEQ ID NO: 942036 - RNA, 22 nt, Human
aaagaauuuguacacccuacua

SEQ ID NO: 942037 - RNA, 22 nt, Human
agaagccaauucugugugaguc

SEQ ID NO: 942038 - RNA, 22 nt, Human
gagcuguccuaccaggaguccu

SEQ ID NO: 942039 - RNA, 22 nt, Human
gaaaugcauaaucuuaguagau

SEQ ID NO: 942040 - RNA, 22 nt, Human
uggcccugacugauguggaggg

SEQ ID NO: 942041 - RNA, 22 nt, Human
ggcucaggccuguaauccuagc

SEQ ID NO: 942042 - RNA, 23 nt, Human
uuuuaauuuggacauaagaagau

SEQ ID NO: 942043 - RNA, 18 nt, Human
uguuccaaggaaggaauc

SEQ ID NO: 942044 - RNA, 23 nt, Human
guggagccacaucacaggcuccu

SEQ ID NO: 942045 - RNA, 22 nt, Human
uuucacauaaauauuaugccua

SEQ ID NO: 942046 - RNA, 21 nt, Human
ccaccaggucuucugcucggg

SEQ ID NO: 942047 - RNA, 22 nt, Human
ggcagauggagaagcagcaggu

SEQ ID NO: 942048 - RNA, 19 nt, Human
cugaggugcaguaagaggc

SEQ ID NO: 942049 - RNA, 22 nt, Human
ggcccugggcagaggagugggc

SEQ ID NO: 942050 - RNA, 22 nt, Human
uucucauucugacucaguguag

SEQ ID NO: 942051 - RNA, 22 nt, Human
ugaggcagauauuuauuggguu

SEQ ID NO: 942052 - RNA, 22 nt, Human
aagccagguguugugguaagag

SEQ ID NO: 942053 - RNA, 22 nt, Human
ggcucaggagaggggcuaaaag

SEQ ID NO: 942054 - RNA, 19 nt, Human
gcauaaaaugucaaugugu

SEQ ID NO: 942055 - RNA, 22 nt, Human
uggcuaggcuccaagagcugga

SEQ ID NO: 942056 - RNA, 22 nt, Human
acaaaugcuuaguucaccaaaa

SEQ ID NO: 942057 - RNA, 22 nt, Human
uggccuggccacauccagcagg

SEQ ID NO: 942058 - RNA, 22 nt, Human
aggcaggcacacuuccuccagg

SEQ ID NO: 942059 - RNA, 19 nt, Human
cucuggccucuggaugcug

SEQ ID NO: 942060 - RNA, 22 nt, Human
uuuccauauucugcgucugcca

SEQ ID NO: 942061 - RNA, 22 nt, Human
caagauggacauaaggagagaa

SEQ ID NO: 942062 - RNA, 22 nt, Human
cagaccucaguccucaguagga

SEQ ID NO: 942063 - RNA, 22 nt, Human
auuuuguggguucugcugaugu

SEQ ID NO: 942064 - RNA, 22 nt, Human
gagaggagguggcuaugacagc

SEQ ID NO: 942065 - RNA, 22 nt, Human
ccagcagcagcguccaaggaga

SEQ ID NO: 942066 - RNA, 22 nt, Human
gauggccuguauuugggccaga

SEQ ID NO: 942067 - RNA, 22 nt, Human
gggcuggggcucaauaauuugu

SEQ ID NO: 942068 - RNA, 22 nt, Human
uucugaaccauugagcacugcc

SEQ ID NO: 942069 - RNA, 22 nt, Human
uuaggaguccagaugucuuggg

SEQ ID NO: 942070 - RNA, 18 nt, Human
agcagaauucuaggguuc

SEQ ID NO: 942071 - RNA, 22 nt, Human
caggggacauuaaagcuccaua

SEQ ID NO: 942072 - RNA, 22 nt, Human
gaugauuuuaugucuugucauu

SEQ ID NO: 942073 - RNA, 22 nt, Human
uaaugcuuaacagcuggcuuuu

SEQ ID NO: 942074 - RNA, 20 nt, Human
gccugcagagaaggucagag

SEQ ID NO: 942075 - RNA, 22 nt, Human
caaggccugccucuggcagaaa

SEQ ID NO: 942076 - RNA, 22 nt, Human
uagaaagcuugggguguuuaaa

SEQ ID NO: 942077 - RNA, 22 nt, Human
ucacugucugaaagaaauggcc

SEQ ID NO: 942078 - RNA, 22 nt, Human
ucugagaguacgggcugcgcgc

SEQ ID NO: 942079 - RNA, 22 nt, Human
ccacugucagaggggcugugcc

SEQ ID NO: 942080 - RNA, 22 nt, Human
cccagacauaacagcagagagg

SEQ ID NO: 942081 - RNA, 22 nt, Human
ugugccauuucuauucugcagc

SEQ ID NO: 942082 - RNA, 22 nt, Human
ugaagguggcauaggagagaug

SEQ ID NO: 942083 - RNA, 22 nt, Human
gcagguguggaguggggugagc

SEQ ID NO: 942084 - RNA, 22 nt, Human
auggccaaaucuaaacuguugg

SEQ ID NO: 942085 - RNA, 22 nt, Human
ggaaccaggaguuacacgaguu

SEQ ID NO: 942086 - RNA, 22 nt, Human
aggcagauauuggggugaugug

SEQ ID NO: 942087 - RNA, 22 nt, Human
ggcuggcagaagugugcuggcu

SEQ ID NO: 942088 - RNA, 23 nt, Human
aacugagauaauguauguaaagc

SEQ ID NO: 942089 - RNA, 22 nt, Human
caggggcucugagauugucuaa

SEQ ID NO: 942090 - RNA, 22 nt, Human
aacuuuaaggcuauaaauuaug

SEQ ID NO: 942091 - RNA, 22 nt, Human
agggcuggcuaggugcguuccc

SEQ ID NO: 942092 - RNA, 22 nt, Human
guguuuccucuagaagccaugg

SEQ ID NO: 942093 - RNA, 22 nt, Human
acugaaauacugcucuuggauu

SEQ ID NO: 942094 - RNA, 21 nt, Human
gccugcagaccccaccaggcu

SEQ ID NO: 942095 - RNA, 22 nt, Human
ucuggcuccuggcuccacugcc

SEQ ID NO: 942096 - RNA, 22 nt, Human
auaaaaguuuccaaucaugccu

SEQ ID NO: 942097 - RNA, 22 nt, Human
gugcccugguccccagcauaua

SEQ ID NO: 942098 - RNA, 22 nt, Human
ucucagagggaggauuacugcc

SEQ ID NO: 942099 - RNA, 22 nt, Human
aaugcagugagccauuaaaugg

SEQ ID NO: 942100 - RNA, 23 nt, Human
acagaaaguucugcuggacagag

SEQ ID NO: 942101 - RNA, 22 nt, Human
acagcugggugcugcucagagc

SEQ ID NO: 942102 - RNA, 22 nt, Human
uaagcauucaaugcuuagcacu

SEQ ID NO: 942103 - RNA, 22 nt, Human
auuauuagauucuuaauuguaa

SEQ ID NO: 942104 - RNA, 22 nt, Human
agacaacaccaaaugcuagugu

SEQ ID NO: 942105 - RNA, 22 nt, Human
ugaggcagguggauuacaaggu

SEQ ID NO: 942106 - RNA, 22 nt, Human
acauaccauacauggugagaug

SEQ ID NO: 942107 - RNA, 22 nt, Human
guuguauagagggcaugaaucu

SEQ ID NO: 942108 - RNA, 22 nt, Human
gcugggcaccggagagacccca

SEQ ID NO: 942109 - RNA, 22 nt, Human
aggcugggaaauguagucuucc

SEQ ID NO: 942110 - RNA, 22 nt, Human
ccagcuccugggucuuagucag

SEQ ID NO: 942111 - RNA, 22 nt, Human
agugcagugguuaggagccagg

SEQ ID NO: 942112 - RNA, 22 nt, Human
ggaaggucgagcugcaucuggc

SEQ ID NO: 942113 - RNA, 22 nt, Human
auauuucucucagacauggaag

SEQ ID NO: 942114 - RNA, 22 nt, Human
uagaaaugugauaauagcuuaa

SEQ ID NO: 942115 - RNA, 22 nt, Human
gagcagggagacaacucuggug

SEQ ID NO: 942116 - RNA, 22 nt, Human
aauggccagcaacaggagugaa

SEQ ID NO: 942117 - RNA, 19 nt, Human
ucugaggguccagaugcau

SEQ ID NO: 942118 - RNA, 22 nt, Human
augggaugcauggcuguggcca

SEQ ID NO: 942119 - RNA, 22 nt, Human
cagcaugcaaguccagaugugg

SEQ ID NO: 942120 - RNA, 22 nt, Human
guuugcauuucuugaacuauau

SEQ ID NO: 942121 - RNA, 22 nt, Human
uuaauuuuaaccuguuuguguc

SEQ ID NO: 942122 - RNA, 22 nt, Human
aucaggauuauuaaaucuggau

SEQ ID NO: 942123 - RNA, 22 nt, Human
gccuggagggauagaaugcaag

SEQ ID NO: 942124 - RNA, 22 nt, Human
cugugucuugaguaauucggug

SEQ ID NO: 942125 - RNA, 22 nt, Human
uuuauaagaagcaaugucugag

SEQ ID NO: 942126 - RNA, 22 nt, Human
cuggccucaccucagacuuacu

SEQ ID NO: 942127 - RNA, 21 nt, Human
ugcuucucuagaucaacuacu

SEQ ID NO: 942128 - RNA, 22 nt, Human
uugauuccuugaaauauccuug

SEQ ID NO: 942129 - RNA, 22 nt, Human
uuuuuaagcuccuuugauguca

SEQ ID NO: 942130 - RNA, 22 nt, Human
cacacaugucucuccaugcucu

SEQ ID NO: 942131 - RNA, 20 nt, Human
ccagacagcaccugccuggu

SEQ ID NO: 942132 - RNA, 22 nt, Human
uguguccauucaggcacugacc

SEQ ID NO: 942133 - RNA, 22 nt, Human
ucagaguguuuuacuaaacaag

SEQ ID NO: 942134 - RNA, 22 nt, Human
ugucuucaucuccaugcacaga

SEQ ID NO: 942135 - RNA, 22 nt, Human
gagcccucucuguaggcaagua

SEQ ID NO: 942136 - RNA, 22 nt, Human
cucuuaguaaugccaugaagca

SEQ ID NO: 942137 - RNA, 19 nt, Human
agcagccaucgaccaugga

SEQ ID NO: 942138 - RNA, 22 nt, Human
gcugcuucucugauggagucca

SEQ ID NO: 942139 - RNA, 22 nt, Human
uuacacaacaucuguauuauua

SEQ ID NO: 942140 - RNA, 22 nt, Human
gccaggaggcugcuguguaggc

SEQ ID NO: 942141 - RNA, 22 nt, Human
ucucagaggugcccuggcaucu

SEQ ID NO: 942142 - RNA, 22 nt, Human
cuucuucaagagaaugggagac

SEQ ID NO: 942143 - RNA, 22 nt, Human
ugcauuguugaugaguugaaua

SEQ ID NO: 942144 - RNA, 22 nt, Human
ucuccucuauuucuguauguau

SEQ ID NO: 942145 - RNA, 22 nt, Human
ucuuuucaucauuuaauaggua

SEQ ID NO: 942146 - RNA, 22 nt, Human
aaaugugucauauucaaaguca

SEQ ID NO: 942147 - RNA, 22 nt, Human
uauuagguuggugcaacaguaa

SEQ ID NO: 942148 - RNA, 22 nt, Human
uccguauuugacuauugcaccg

SEQ ID NO: 942149 - RNA, 22 nt, Human
uauauguaagcuauguaagagu

SEQ ID NO: 942150 - RNA, 22 nt, Human
ugcaccuuguccauuuuuggcc

SEQ ID NO: 942151 - RNA, 22 nt, Human
uuccaugacaccgagggaaguc

SEQ ID NO: 942152 - RNA, 22 nt, Human
ggccucaguuucuucaacugua

SEQ ID NO: 942153 - RNA, 22 nt, Human
aauaagaauuuacuugucaaga

SEQ ID NO: 942154 - RNA, 22 nt, Human
agcuuccucaccucagaggucu

SEQ ID NO: 942155 - RNA, 20 nt, Human
cagccuccacucacucagcu

SEQ ID NO: 942156 - RNA, 17 nt, Human
uuccuggaagucauucc

SEQ ID NO: 942157 - RNA, 22 nt, Human
guggccaaacaccaguuuagga

SEQ ID NO: 942158 - RNA, 22 nt, Human
gcagacuggucuucagccuugg

SEQ ID NO: 942159 - RNA, 22 nt, Human
augccagccucuaagcacuuua

SEQ ID NO: 942160 - RNA, 22 nt, Human
gaaaagggcaagagagagggca

SEQ ID NO: 942161 - RNA, 22 nt, Human
cugaggugagcuucccugggcu

SEQ ID NO: 942162 - RNA, 22 nt, Human
uccaggagugauaaggccacug

SEQ ID NO: 942163 - RNA, 22 nt, Human
ucagggcaaagggcagaguuug

SEQ ID NO: 942164 - RNA, 22 nt, Human
accccaagacaguagaagagaa

SEQ ID NO: 942165 - RNA, 22 nt, Human
uagcagggccaggcugggaacc

SEQ ID NO: 942166 - RNA, 22 nt, Human
aggcagcucuguggccucccag

SEQ ID NO: 942167 - RNA, 22 nt, Human
ugaaacauuugaugaucuuugg

SEQ ID NO: 942168 - RNA, 20 nt, Human
acugagcugcauggagagga

SEQ ID NO: 942169 - RNA, 22 nt, Human
agaauaaauguuggacuuagga

SEQ ID NO: 942170 - RNA, 22 nt, Human
ucugcagaaguggcugggccac

SEQ ID NO: 942171 - RNA, 19 nt, Human
cucucacucgccacauccu

SEQ ID NO: 942172 - RNA, 21 nt, Human
ucagcagcuuuugcagucccu

SEQ ID NO: 942173 - RNA, 18 nt, Human
ugagaggcagguagagga

SEQ ID NO: 942174 - RNA, 22 nt, Human
aggcucagaggugagcaucugc

SEQ ID NO: 942175 - RNA, 22 nt, Human
aggggaggagcuuuucuugccu

SEQ ID NO: 942176 - RNA, 22 nt, Human
guuccuauauagccuuaaggau

SEQ ID NO: 942177 - RNA, 22 nt, Human
ugaaauguguaauguggaugcc

SEQ ID NO: 942178 - RNA, 22 nt, Human
cuuugcaaacugucacacuuuc

SEQ ID NO: 942179 - RNA, 19 nt, Human
ucuggcuccugccaggcug

SEQ ID NO: 942180 - RNA, 22 nt, Human
ugaacgcagguccacauggcuc

SEQ ID NO: 942181 - RNA, 22 nt, Human
agggacuuguguccuauguaug

SEQ ID NO: 942182 - RNA, 22 nt, Human
caggggcaagaaugcugucagc

SEQ ID NO: 942183 - RNA, 23 nt, Human
gcugucugucaucucugcgggag

SEQ ID NO: 942184 - RNA, 18 nt, Human
gcagcugcaguuguagcu

SEQ ID NO: 942185 - RNA, 22 nt, Human
cuggccacaacuagcccaggac

SEQ ID NO: 942186 - RNA, 22 nt, Human
gcagcagagaacacaaugaugg

SEQ ID NO: 942187 - RNA, 21 nt, Human
uccuggcccacucuaucccca

SEQ ID NO: 942188 - RNA, 21 nt, Human
cugcucugacagugaggccag

SEQ ID NO: 942189 - RNA, 22 nt, Human
cccugaggggaguggugaggug

SEQ ID NO: 942190 - RNA, 22 nt, Human
acugugcacaauucuaaguccu

SEQ ID NO: 942191 - RNA, 22 nt, Human
ugauucuuugaccaaaaaauug

SEQ ID NO: 942192 - RNA, 17 nt, Human
uguggccuucugagcuu

SEQ ID NO: 942193 - RNA, 22 nt, Human
cugccaaggcuggggaggacaa

SEQ ID NO: 942194 - RNA, 22 nt, Human
uuuauuguuuagaagggggcug

SEQ ID NO: 942195 - RNA, 22 nt, Human
gaggcugcaggcaaugcugccc

SEQ ID NO: 942196 - RNA, 22 nt, Human
aagggcuggccacauucugggu

SEQ ID NO: 942197 - RNA, 22 nt, Human
cagggcaguaccgcccucuggc

SEQ ID NO: 942198 - RNA, 22 nt, Human
uguaccuuuuucugugcaugcu

SEQ ID NO: 942199 - RNA, 22 nt, Human
aucaguuugagugcugugucaa

SEQ ID NO: 942200 - RNA, 21 nt, Human
agauuguauggaggugagagg

SEQ ID NO: 942201 - RNA, 22 nt, Human
uauuagcgcuuacugaguugcc

SEQ ID NO: 942202 - RNA, 22 nt, Human
ucacaauuuggauacagcuaug

SEQ ID NO: 942203 - RNA, 22 nt, Human
uucaagaucuuccaaaggauac

SEQ ID NO: 942204 - RNA, 22 nt, Human
cuccuggcuucugaaaucgugg

SEQ ID NO: 942205 - RNA, 22 nt, Human
ggauggcaggacaaggacccag

SEQ ID NO: 942206 - RNA, 22 nt, Human
caugcuuuaccaaagcagugau

SEQ ID NO: 942207 - RNA, 22 nt, Human
aagccagauagaagaacucauu

SEQ ID NO: 942208 - RNA, 22 nt, Human
agcaccaucagaugcaauaucu

SEQ ID NO: 942209 - RNA, 22 nt, Human
ucuguaucuaauuuuacaguag

SEQ ID NO: 942210 - RNA, 22 nt, Human
caggcagaguuagagcaacugg

SEQ ID NO: 942211 - RNA, 22 nt, Human
cccaggaacagggcucagaccc

SEQ ID NO: 942212 - RNA, 22 nt, Human
cacuggaauauggcguugaacc

SEQ ID NO: 942213 - RNA, 22 nt, Human
guggccaauuuccaucuguaag

SEQ ID NO: 942214 - RNA, 22 nt, Human
ccagggcaggagaaagacucac

SEQ ID NO: 942215 - RNA, 22 nt, Human
guauuuauaggggaaugagagu

SEQ ID NO: 942216 - RNA, 22 nt, Human
acagugucugacacauuguagc

SEQ ID NO: 942217 - RNA, 22 nt, Human
aaacugccuccugggcaacuaa

SEQ ID NO: 942218 - RNA, 22 nt, Human
agggccagcacuccuggcagga

SEQ ID NO: 942219 - RNA, 22 nt, Human
gccaggagugucccacucauuu

SEQ ID NO: 942220 - RNA, 22 nt, Human
aagcuggaacaucuugaggaag

SEQ ID NO: 942221 - RNA, 22 nt, Human
cuggcacaaugucacuuuugcu

SEQ ID NO: 942222 - RNA, 22 nt, Human
cuuuauguuggggugucuuagu

SEQ ID NO: 942223 - RNA, 22 nt, Human
uuuccucuucuucccaugucau

SEQ ID NO: 942224 - RNA, 21 nt, Human
cagcagaguaaugcauucgua

SEQ ID NO: 942225 - RNA, 22 nt, Human
acuucuggugucauacugcauu

SEQ ID NO: 942226 - RNA, 22 nt, Human
gcucugcugaagccccuugcau

SEQ ID NO: 942227 - RNA, 22 nt, Human
uggccuggcccugaggcccugu

SEQ ID NO: 942228 - RNA, 22 nt, Human
aaaaugaugcuguaauuuggca

SEQ ID NO: 942229 - RNA, 22 nt, Human
ccagggcaucacauccaguguu

SEQ ID NO: 942230 - RNA, 22 nt, Human
accucugccacuuucuaacucu

SEQ ID NO: 942231 - RNA, 22 nt, Human
ggugggcacauucagucucugu

SEQ ID NO: 942232 - RNA, 22 nt, Human
uuucaguguaucuuccaaaagc

SEQ ID NO: 942233 - RNA, 22 nt, Human
ucacaggguuuggaagccuccu

SEQ ID NO: 942234 - RNA, 23 nt, Human
uuccagaguccacaucugccacc

SEQ ID NO: 942235 - RNA, 22 nt, Human
gccaggcacaguucuaggugcu

SEQ ID NO: 942236 - RNA, 21 nt, Human
gagacagcccagugccagggc

SEQ ID NO: 942237 - RNA, 20 nt, Human
agacaaaaugacuucaugca

SEQ ID NO: 942238 - RNA, 22 nt, Human
ugcuggaggaguuuacuguggc

SEQ ID NO: 942239 - RNA, 22 nt, Human
aaaugucuuuaucucauguaac

SEQ ID NO: 942240 - RNA, 22 nt, Human
aaaccaaacauuugcgguggug

SEQ ID NO: 942241 - RNA, 22 nt, Human
cugaggucuagacaccccaggg

SEQ ID NO: 942242 - RNA, 22 nt, Human
uccucugccaaagggaguugcc

SEQ ID NO: 942243 - RNA, 22 nt, Human
uuuaaauggcauuuucccagau

SEQ ID NO: 942244 - RNA, 22 nt, Human
ucaguuuugaaaacauugaaug

SEQ ID NO: 942245 - RNA, 22 nt, Human
cccagcuccagagccagaaaca

SEQ ID NO: 942246 - RNA, 22 nt, Human
uaauucagggccagaaucccca

SEQ ID NO: 942247 - RNA, 22 nt, Human
ucuugaaggggggcaguguuga

SEQ ID NO: 942248 - RNA, 22 nt, Human
cuggcagguccagcuggacuca

SEQ ID NO: 942249 - RNA, 22 nt, Human
cugcccagaagccagaugggca

SEQ ID NO: 942250 - RNA, 22 nt, Human
acucugcuaaauguaaguuggu

SEQ ID NO: 942251 - RNA, 23 nt, Human
cugcuguuuucuguaccugaagc

SEQ ID NO: 942252 - RNA, 22 nt, Human
aggggaugauccucccgcagcg

SEQ ID NO: 942253 - RNA, 22 nt, Human
accaggagguguuugcucaagu

SEQ ID NO: 942254 - RNA, 22 nt, Human
ggagaguggauuccagcuguau

SEQ ID NO: 942255 - RNA, 22 nt, Human
auacaguauuaccuguucagga

SEQ ID NO: 942256 - RNA, 22 nt, Human
gcagcugggacacugaggccag

SEQ ID NO: 942257 - RNA, 22 nt, Human
caaaugauaccuauuacuaggc

SEQ ID NO: 942258 - RNA, 22 nt, Human
acaggagugaaucuggcacuua

SEQ ID NO: 942259 - RNA, 22 nt, Human
acagguggcuuauuggcugauu

SEQ ID NO: 942260 - RNA, 22 nt, Human
augaggcaaucaugguccaguu

SEQ ID NO: 942261 - RNA, 22 nt, Human
cauugcuguuaauugucucuag

SEQ ID NO: 942262 - RNA, 18 nt, Human
cuuuaugugcagagcuuu

SEQ ID NO: 942263 - RNA, 22 nt, Human
gccuugggaaagugggaggaga

SEQ ID NO: 942264 - RNA, 22 nt, Human
ugagccagccuugcagcugugc

SEQ ID NO: 942265 - RNA, 19 nt, Human
ccaggaaccccuagcuacc

SEQ ID NO: 942266 - RNA, 22 nt, Human
uuuguuuagaaagagauuggug

SEQ ID NO: 942267 - RNA, 22 nt, Human
gugguaauuuaauccuacacug

SEQ ID NO: 942268 - RNA, 22 nt, Human
ucagggaaugaugcacacaguu

SEQ ID NO: 942269 - RNA, 22 nt, Human
auuaaauacugcaggcuaagca

SEQ ID NO: 942270 - RNA, 22 nt, Human
gggccuggcaugcagccccguu

SEQ ID NO: 942271 - RNA, 19 nt, Human
agcuccugggcucugggcc

SEQ ID NO: 942272 - RNA, 22 nt, Human
ucugaggcauacccaggccccc

SEQ ID NO: 942273 - RNA, 16 nt, Human
auuguuuucaauuaga

SEQ ID NO: 942274 - RNA, 22 nt, Human
ggguccagcgacagcaggcuca

SEQ ID NO: 942275 - RNA, 22 nt, Human
uccaggcuagguuuacaggaca

SEQ ID NO: 942276 - RNA, 22 nt, Human
aguguuucucagaagggccuau

SEQ ID NO: 942277 - RNA, 22 nt, Human
gcuccuggcucuggccaaggga

SEQ ID NO: 942278 - RNA, 22 nt, Human
caggccucuccuuagucuggca

SEQ ID NO: 942279 - RNA, 22 nt, Human
aaaucaguuaagaugaggccau

SEQ ID NO: 942280 - RNA, 22 nt, Human
ugcugggcuagaagcugaggcc

SEQ ID NO: 942281 - RNA, 22 nt, Human
uuuuaucaaucauuaagacauu

SEQ ID NO: 942282 - RNA, 22 nt, Human
gcagugcuaaguagcuggccca

SEQ ID NO: 942283 - RNA, 22 nt, Human
gucaggaucucccaguacauau

SEQ ID NO: 942284 - RNA, 22 nt, Human
gcagacagcauguugggcuauu

SEQ ID NO: 942285 - RNA, 22 nt, Human
uggcagucggacuucuaucuca

SEQ ID NO: 942286 - RNA, 22 nt, Human
agggccagcccauaaugccaaa

SEQ ID NO: 942287 - RNA, 19 nt, Human
uggaggcaagacauggagg

SEQ ID NO: 942288 - RNA, 17 nt, Human
aggccucccuccaggcc

SEQ ID NO: 942289 - RNA, 22 nt, Human
cagcaggcccaggugcugguga

SEQ ID NO: 942290 - RNA, 17 nt, Human
ugguggcuggagucagg

SEQ ID NO: 942291 - RNA, 22 nt, Human
gagaggauccacaaaccaggaa

SEQ ID NO: 942292 - RNA, 22 nt, Human
gaagcccuauccucuccuggga

SEQ ID NO: 942293 - RNA, 22 nt, Human
uggaagcaucacuucuugccug

SEQ ID NO: 942294 - RNA, 22 nt, Human
uucacaggugacuggggauaac

SEQ ID NO: 942295 - RNA, 22 nt, Human
gcaucuuucuguccauucagca

SEQ ID NO: 942296 - RNA, 22 nt, Human
ugucagugaguuaguugcaagu

SEQ ID NO: 942297 - RNA, 22 nt, Human
ucucagagaaaugugucaccau

SEQ ID NO: 942298 - RNA, 22 nt, Human
gcugccuuugugagccaagggg

SEQ ID NO: 942299 - RNA, 22 nt, Human
uggcagagcaaaaagauagaau

SEQ ID NO: 942300 - RNA, 22 nt, Human
gaggccugguagccgagcccca

SEQ ID NO: 942301 - RNA, 22 nt, Human
cuggacagaaaaggccacugga

SEQ ID NO: 942302 - RNA, 22 nt, Human
ugccugugucacagugauguuu

SEQ ID NO: 942303 - RNA, 21 nt, Human
agagaauugccuuagauguuc

SEQ ID NO: 942304 - RNA, 22 nt, Human
gaggcaguuugccaugccagga

SEQ ID NO: 942305 - RNA, 22 nt, Human
ugaaacacugcgauaaaauccu

SEQ ID NO: 942306 - RNA, 22 nt, Human
gcugucuguucgagcguguguu

SEQ ID NO: 942307 - RNA, 22 nt, Human
aaagcaaugaugguagacacgu

SEQ ID NO: 942308 - RNA, 22 nt, Human
cauuugaauuguucugugggaa

SEQ ID NO: 942309 - RNA, 22 nt, Human
uugggguguuggauggagcaag

SEQ ID NO: 942310 - RNA, 22 nt, Human
aaaguucagugccuucuauaca

SEQ ID NO: 942311 - RNA, 22 nt, Human
ugcucugguccucccucggcgc

SEQ ID NO: 942312 - RNA, 22 nt, Human
aaggccaggacaccaggggacu

SEQ ID NO: 942313 - RNA, 22 nt, Human
uggccacuuggcaugugugcca

SEQ ID NO: 942314 - RNA, 22 nt, Human
gcagggcucugcuguaguccua

SEQ ID NO: 942315 - RNA, 22 nt, Human
cuggcagcuggaggcuagaggc

SEQ ID NO: 942316 - RNA, 22 nt, Human
cugcuuugaggggcucuguaua

SEQ ID NO: 942317 - RNA, 22 nt, Human
gucuuugcugucuuugcucuca

SEQ ID NO: 942318 - RNA, 22 nt, Human
agcccagccggauucccaguuc

SEQ ID NO: 942319 - RNA, 22 nt, Human
uccaggagauacacugcaccag

SEQ ID NO: 942320 - RNA, 17 nt, Human
ucuguucaugcauaccu

SEQ ID NO: 942321 - RNA, 22 nt, Human
uaugcauuuuauagugcaaagc

SEQ ID NO: 942322 - RNA, 22 nt, Human
uaggcagcugcaaacuucgguc

SEQ ID NO: 942323 - RNA, 22 nt, Human
ggccugagaaccauggggccaa

SEQ ID NO: 942324 - RNA, 21 nt, Human
uucugggaaaugagcuggggc

SEQ ID NO: 942325 - RNA, 22 nt, Human
ggcccuguuagagcucccacaa

SEQ ID NO: 942326 - RNA, 22 nt, Human
uuagauaauguagagauaugag

SEQ ID NO: 942327 - RNA, 22 nt, Human
uagcacugaaucacaugcugcu

SEQ ID NO: 942328 - RNA, 22 nt, Human
aagggcagcugacagaugcuua

SEQ ID NO: 942329 - RNA, 22 nt, Human
ucucagagaugucaagagucua

SEQ ID NO: 942330 - RNA, 22 nt, Human
ccacaggaccagaggagaucac

SEQ ID NO: 942331 - RNA, 22 nt, Human
uugaaagacuucuccugugaaa

SEQ ID NO: 942332 - RNA, 22 nt, Human
gcucccagcauugcugcugaau

SEQ ID NO: 942333 - RNA, 22 nt, Human
gcaaagucugcaucuggaucag

SEQ ID NO: 942334 - RNA, 22 nt, Human
ucccagcauaacaaacugcccg

SEQ ID NO: 942335 - RNA, 22 nt, Human
agucucagcaagcauggcuagu

SEQ ID NO: 942336 - RNA, 22 nt, Human
uccaggagugugugcuaauggg

SEQ ID NO: 942337 - RNA, 20 nt, Human
agauggugaaggccagggag

SEQ ID NO: 942338 - RNA, 22 nt, Human
agaggcccucucugcucagucu

SEQ ID NO: 942339 - RNA, 22 nt, Human
ugcacacaguucucaggaaaga

SEQ ID NO: 942340 - RNA, 22 nt, Human
cagggagggaggaaaauuugcu

SEQ ID NO: 942341 - RNA, 22 nt, Human
gcugucaguuuuacccacagac

SEQ ID NO: 942342 - RNA, 22 nt, Human
ccaaggaguagagcaggaagcu

SEQ ID NO: 942343 - RNA, 22 nt, Human
aaucuauucccuuucuguaaaa

SEQ ID NO: 942344 - RNA, 22 nt, Human
cagcaauaaugucuacaaaucu

SEQ ID NO: 942345 - RNA, 22 nt, Human
aagacauugucauuuuauaauu

SEQ ID NO: 942346 - RNA, 22 nt, Human
gggcagauggggcacaggcuga

SEQ ID NO: 942347 - RNA, 22 nt, Human
ucuguucaguugauuagacaga

SEQ ID NO: 942348 - RNA, 22 nt, Human
gcucugcugucuucuugcaggc

SEQ ID NO: 942349 - RNA, 22 nt, Human
aguggcagccgagcaggagaug

SEQ ID NO: 942350 - RNA, 21 nt, Human
ucacuagugccuucugucauu

SEQ ID NO: 942351 - RNA, 22 nt, Human
cuccuuggccguuaaugucaca

SEQ ID NO: 942352 - RNA, 22 nt, Human
cuggcugcuggccugaggaugc

SEQ ID NO: 942353 - RNA, 22 nt, Human
caguggcaugguugacugcagu

SEQ ID NO: 942354 - RNA, 22 nt, Human
ggcucagaccucccagcuccag

SEQ ID NO: 942355 - RNA, 22 nt, Human
gcagcagagcuuuguccuggcu

SEQ ID NO: 942356 - RNA, 22 nt, Human
auuuaguguguauugcuauuau

SEQ ID NO: 942357 - RNA, 22 nt, Human
gcagggcugcugaaacuuguuu

SEQ ID NO: 942358 - RNA, 22 nt, Human
cccagcaucuccaggcauggcc

SEQ ID NO: 942359 - RNA, 22 nt, Human
acagugcuaaacacuucuugaa

SEQ ID NO: 942360 - RNA, 22 nt, Human
uggcagcaguggagguagaaag

SEQ ID NO: 942361 - RNA, 22 nt, Human
gcuggccacauugugccguccu

SEQ ID NO: 942362 - RNA, 21 nt, Human
gccaccucgucucggagcagc

SEQ ID NO: 942363 - RNA, 22 nt, Human
gacuuucucuccucccaggugu

SEQ ID NO: 942364 - RNA, 22 nt, Human
gccugagccgccugagcggcgg

SEQ ID NO: 942365 - RNA, 20 nt, Human
ugaaauaaggaguuguccuu

SEQ ID NO: 942366 - RNA, 22 nt, Human
uaauuuaauuucaugccagccu

SEQ ID NO: 942367 - RNA, 22 nt, Human
gauauagguucauaguguuaca

SEQ ID NO: 942368 - RNA, 22 nt, Human
gcccagcuuuuugaggcaggca

SEQ ID NO: 942369 - RNA, 22 nt, Human
agccugucugucuccaaagcug

SEQ ID NO: 942370 - RNA, 22 nt, Human
gccucugcccuccugggacugc

SEQ ID NO: 942371 - RNA, 18 nt, Human
gcaggugccacugcuguu

SEQ ID NO: 942372 - RNA, 22 nt, Human
aaauaaguuaaacuagaaugau

SEQ ID NO: 942373 - RNA, 22 nt, Human
cugcccugcccaggccuugggc

SEQ ID NO: 942374 - RNA, 22 nt, Human
gcugucagcgcccaaggagcuc

SEQ ID NO: 942375 - RNA, 22 nt, Human
ugaagcagagugaaggugaauu

SEQ ID NO: 942376 - RNA, 22 nt, Human
gauuucaaagguucugcaugcc

SEQ ID NO: 942377 - RNA, 22 nt, Human
agagccagguguagucucggag

SEQ ID NO: 942378 - RNA, 22 nt, Human
uucaagauggcugcaaauacuu

SEQ ID NO: 942379 - RNA, 22 nt, Human
gucagagagggcacgugcacac

SEQ ID NO: 942380 - RNA, 22 nt, Human
gggcugagucugcugccuguca

SEQ ID NO: 942381 - RNA, 22 nt, Human
gugcucuguguauuaggauguc

SEQ ID NO: 942382 - RNA, 22 nt, Human
aaacuuuaagacaguccucaag

SEQ ID NO: 942383 - RNA, 22 nt, Human
ucuuugcaugcauuuucccuua

SEQ ID NO: 942384 - RNA, 22 nt, Human
ccuggcagucaggggaguccuu

SEQ ID NO: 942385 - RNA, 22 nt, Human
agagccugcagcugugaagaaa

SEQ ID NO: 942386 - RNA, 22 nt, Human
aagauggaguaguguaaugguu

SEQ ID NO: 942387 - RNA, 20 nt, Human
gucucaaguaucucacaguc

SEQ ID NO: 942388 - RNA, 22 nt, Human
uauacugucgcauuacacucac

SEQ ID NO: 942389 - RNA, 22 nt, Human
aggcucagcccaagguggagag

SEQ ID NO: 942390 - RNA, 22 nt, Human
ugcugccagccaggccauggag

SEQ ID NO: 942391 - RNA, 23 nt, Human
aaauuauugcucuucaauugccu

SEQ ID NO: 942392 - RNA, 22 nt, Human
ccaggagaugggaaaguagcag

SEQ ID NO: 942393 - RNA, 22 nt, Human
uuucuagucagccauaucuagu

SEQ ID NO: 942394 - RNA, 21 nt, Human
cagaggcaggcucugugugug

SEQ ID NO: 942395 - RNA, 22 nt, Human
uuaaaaccaucagcuguaagau

SEQ ID NO: 942396 - RNA, 22 nt, Human
auuugucuuuggaccugugaga

SEQ ID NO: 942397 - RNA, 22 nt, Human
uccuggccuuauccccaaacug

SEQ ID NO: 942398 - RNA, 22 nt, Human
agaaugcaagauaaacuuuauu

SEQ ID NO: 942399 - RNA, 19 nt, Human
agucuuucccacucgucuu

SEQ ID NO: 942400 - RNA, 17 nt, Human
ucaggauguagcaguag

SEQ ID NO: 942401 - RNA, 22 nt, Human
agcuggccuuagugagcaccug

SEQ ID NO: 942402 - RNA, 22 nt, Human
auuaguaaaacauuguauaugu

SEQ ID NO: 942403 - RNA, 22 nt, Human
ccuccugguccagcaucucuuu

SEQ ID NO: 942404 - RNA, 22 nt, Human
gugcagguguuuuggcugccag

SEQ ID NO: 942405 - RNA, 22 nt, Human
cagcuggcgggcagagccgcca

SEQ ID NO: 942406 - RNA, 22 nt, Human
cacauacaaggcacacuggagg

SEQ ID NO: 942407 - RNA, 22 nt, Human
uggggcuguggauucucacgaa

SEQ ID NO: 942408 - RNA, 22 nt, Human
uccucugcuguucugguucuuu

SEQ ID NO: 942409 - RNA, 22 nt, Human
agaugaagacucaggagcaggu

SEQ ID NO: 942410 - RNA, 22 nt, Human
augcaaaaguaacugugauuuu

SEQ ID NO: 942411 - RNA, 19 nt, Human
agcagccauagacaauaug

SEQ ID NO: 942412 - RNA, 22 nt, Human
gccugccugcugucaucugccu

SEQ ID NO: 942413 - RNA, 22 nt, Human
ucaggauguuaauauagcauua

SEQ ID NO: 942414 - RNA, 22 nt, Human
ucuucauuccguagauauuuau

SEQ ID NO: 942415 - RNA, 22 nt, Human
agugacaacaaguugacuagaa

SEQ ID NO: 942416 - RNA, 22 nt, Human
guaggcagauaggagugcagcc

SEQ ID NO: 942417 - RNA, 22 nt, Human
cugcuguguggugaaacucagu

SEQ ID NO: 942418 - RNA, 22 nt, Human
caguuuuuagauuaguuggugg

SEQ ID NO: 942419 - RNA, 22 nt, Human
ugcuggccgugagcucucggga

SEQ ID NO: 942420 - RNA, 22 nt, Human
uaugagaaaauaaauaucuguu

SEQ ID NO: 942421 - RNA, 22 nt, Human
ucucagagugacaaugagaauu

SEQ ID NO: 942422 - RNA, 22 nt, Human
ggaggccauaguuugggaguca

SEQ ID NO: 942423 - RNA, 21 nt, Human
ugguggagugugcugagcaug

SEQ ID NO: 942424 - RNA, 22 nt, Human
uauucacagcugccgcacucag

SEQ ID NO: 942425 - RNA, 22 nt, Human
cucuucuugaaagaggaauuca

SEQ ID NO: 942426 - RNA, 23 nt, Human
ucagagaaguuguaggcugggga

SEQ ID NO: 942427 - RNA, 22 nt, Human
ggcaaaaaccacaauuacuuuu

SEQ ID NO: 942428 - RNA, 22 nt, Human
gccacguugccacccgggugac

SEQ ID NO: 942429 - RNA, 22 nt, Human
uuuuaucuaccuaugcucauuu

SEQ ID NO: 942430 - RNA, 22 nt, Human
gaggcugcuguuagcccugggc

SEQ ID NO: 942431 - RNA, 22 nt, Human
ggccucggcccacugcugcggu

SEQ ID NO: 942432 - RNA, 22 nt, Human
gcucaggaaauaguuuaguguu

SEQ ID NO: 942433 - RNA, 22 nt, Human
ucaaaguccuugcuuuuucugu

SEQ ID NO: 942434 - RNA, 22 nt, Human
cagaguggcagucccaggccca

SEQ ID NO: 942435 - RNA, 22 nt, Human
agagccaggacugugucucacu

SEQ ID NO: 942436 - RNA, 22 nt, Human
agcugcccuguggggaggguug

SEQ ID NO: 942437 - RNA, 22 nt, Human
caugauuuugucuuguguuaau

SEQ ID NO: 942438 - RNA, 22 nt, Human
uccagggaagagcagaggcuac

SEQ ID NO: 942439 - RNA, 22 nt, Human
acagguggagugguuagcaggc

SEQ ID NO: 942440 - RNA, 22 nt, Human
ucagacuucuacuuugcagagc

SEQ ID NO: 942441 - RNA, 22 nt, Human
gcauaauauacaugcuugaucc

SEQ ID NO: 942442 - RNA, 22 nt, Human
uaaguucagaguucucauuugu

SEQ ID NO: 942443 - RNA, 22 nt, Human
caggagaagguuuggagugcag

SEQ ID NO: 942444 - RNA, 22 nt, Human
acugaaggaaacuuuuguguuu

SEQ ID NO: 942445 - RNA, 22 nt, Human
uggccuugagagaucaaaaggu

SEQ ID NO: 942446 - RNA, 19 nt, Human
agucucaguguacagaggc

SEQ ID NO: 942447 - RNA, 22 nt, Human
cuccuuccccuacucagcaucc

SEQ ID NO: 942448 - RNA, 22 nt, Human
ggggccuuggaucugugccccg

SEQ ID NO: 942449 - RNA, 23 nt, Human
gugagcagcccacuaggaaugcc

SEQ ID NO: 942450 - RNA, 22 nt, Human
ccuggcagcagcacaugccuuc

SEQ ID NO: 942451 - RNA, 22 nt, Human
gucccagggaagaaggcagcac

SEQ ID NO: 942452 - RNA, 19 nt, Human
ucaucucacagggccuggc

SEQ ID NO: 942453 - RNA, 22 nt, Human
uuuuccucugcagagcaguuag

SEQ ID NO: 942454 - RNA, 22 nt, Human
uauuaucauugguaauaugguc

SEQ ID NO: 942455 - RNA, 22 nt, Human
agacccugucaguguuaggaaa

SEQ ID NO: 942456 - RNA, 22 nt, Human
ggccugcuuuccgagccugcag

SEQ ID NO: 942457 - RNA, 21 nt, Human
gugcucugggcagcagagggc

SEQ ID NO: 942458 - RNA, 22 nt, Human
ggaagaagggucauuggcagcc

SEQ ID NO: 942459 - RNA, 22 nt, Human
cugccacuagcuuucacaucuu

SEQ ID NO: 942460 - RNA, 22 nt, Human
gugcugugcgcuuuuucuguau

SEQ ID NO: 942461 - RNA, 21 nt, Human
uccugccuuaguccagagcag

SEQ ID NO: 942462 - RNA, 22 nt, Human
augcagcugucagggagaacau

SEQ ID NO: 942463 - RNA, 22 nt, Human
ggcucacgcaauuaucccggcc

SEQ ID NO: 942464 - RNA, 22 nt, Human
cuacucugaauugaagugauau

SEQ ID NO: 942465 - RNA, 22 nt, Human
ugacccugcuucuuggugcagg

SEQ ID NO: 942466 - RNA, 22 nt, Human
cauuuguuuagaagucuuuaua

SEQ ID NO: 942467 - RNA, 19 nt, Human
ccagcagcuuugauucucu

SEQ ID NO: 942468 - RNA, 22 nt, Human
cucuugaagcaggggccaguuc

SEQ ID NO: 942469 - RNA, 22 nt, Human
cucaggaugcaauuccaucaag

SEQ ID NO: 942470 - RNA, 22 nt, Human
cccaguuucaacuuuccagugg

SEQ ID NO: 942471 - RNA, 22 nt, Human
uaaguggaagguuauaugcuaa

SEQ ID NO: 942472 - RNA, 22 nt, Human
gaagccuugaacugcaaacccc

SEQ ID NO: 942473 - RNA, 22 nt, Human
uuguuuuggaagaacuuacucu

SEQ ID NO: 942474 - RNA, 22 nt, Human
gccagguggcugagcagcugca

SEQ ID NO: 942475 - RNA, 22 nt, Human
ucaagagacaggacguguuuca

SEQ ID NO: 942476 - RNA, 22 nt, Human
ugagcuuacuucuguacacaga

SEQ ID NO: 942477 - RNA, 22 nt, Human
gauugaaacauaggcagucgag

SEQ ID NO: 942478 - RNA, 22 nt, Human
ugucaugccaggaaauaguccc

SEQ ID NO: 942479 - RNA, 22 nt, Human
aaacacaucauucaugucguca

SEQ ID NO: 942480 - RNA, 22 nt, Human
ggcacugauaauguccucucuc

SEQ ID NO: 942481 - RNA, 22 nt, Human
acaacauucuuaaauacacuga

SEQ ID NO: 942482 - RNA, 19 nt, Human
acagaagcauagaaaagga

SEQ ID NO: 942483 - RNA, 22 nt, Human
uucuuuccacagaggggaugau

SEQ ID NO: 942484 - RNA, 22 nt, Human
ccuggcugaaccaaugaagugg

SEQ ID NO: 942485 - RNA, 22 nt, Human
uguguacuugaaagggcagguc

SEQ ID NO: 942486 - RNA, 22 nt, Human
uugcucuguaauaaucuggggu

SEQ ID NO: 942487 - RNA, 22 nt, Human
ugugaaagauacuaggcagagg

SEQ ID NO: 942488 - RNA, 23 nt, Human
gcucugagggcuuaucccuccca

SEQ ID NO: 942489 - RNA, 22 nt, Human
uucuuucacucaagaaggaucu

SEQ ID NO: 942490 - RNA, 22 nt, Human
cagcagcucccauccgcugagc

SEQ ID NO: 942491 - RNA, 22 nt, Human
uacaguaaagcugcuaugaauu

SEQ ID NO: 942492 - RNA, 22 nt, Human
uauguacaaucagcaguucaua

SEQ ID NO: 942493 - RNA, 22 nt, Human
cuucaugcugauauccucgaug

SEQ ID NO: 942494 - RNA, 22 nt, Human
gcagcuggcucagagagguggg

SEQ ID NO: 942495 - RNA, 19 nt, Human
ccugugugggguagagauc

SEQ ID NO: 942496 - RNA, 22 nt, Human
aucagcaaucucguguauuagg

SEQ ID NO: 942497 - RNA, 22 nt, Human
gagcagugguugaacagaggca

SEQ ID NO: 942498 - RNA, 22 nt, Human
cugcucagcggaaggaagagcg

SEQ ID NO: 942499 - RNA, 22 nt, Human
gaaggccauugcguccugggau

SEQ ID NO: 942500 - RNA, 22 nt, Human
agugccuggaccccaugacaua

SEQ ID NO: 942501 - RNA, 22 nt, Human
cucuuaaagaauguuccagcug

SEQ ID NO: 942502 - RNA, 22 nt, Human
caaaguuuggcucucaugacau

SEQ ID NO: 942503 - RNA, 18 nt, Human
uggcagagugucuguucu

SEQ ID NO: 942504 - RNA, 22 nt, Human
aaggcccuaauagagcacauau

SEQ ID NO: 942505 - RNA, 22 nt, Human
caguuucuuaucuucaaaauug

SEQ ID NO: 942506 - RNA, 22 nt, Human
uuuccucuuauacaguguuuau

SEQ ID NO: 942507 - RNA, 22 nt, Human
cggggcugcgcucuuccugccg

SEQ ID NO: 942508 - RNA, 22 nt, Human
ugcacagcgggugucugucagg

SEQ ID NO: 942509 - RNA, 22 nt, Human
guaucuuuugguggaaaaauaa

SEQ ID NO: 942510 - RNA, 22 nt, Human
gcagcaggagaguuuguccugc

SEQ ID NO: 942511 - RNA, 22 nt, Human
cacagggcagugcugcccacuc

SEQ ID NO: 942512 - RNA, 22 nt, Human
uccagccuaauguucuucccac

SEQ ID NO: 942513 - RNA, 22 nt, Human
ucucugcuaagauugugucuag

SEQ ID NO: 942514 - RNA, 22 nt, Human
ugcaauaaguuguguuaucacu

SEQ ID NO: 942515 - RNA, 22 nt, Human
uccaagggcucauggacacuuu

SEQ ID NO: 942516 - RNA, 22 nt, Human
ggcugaaggaugaaagcugcag

SEQ ID NO: 942517 - RNA, 22 nt, Human
uuuguguuuguacaaugcacua

SEQ ID NO: 942518 - RNA, 22 nt, Human
ugacaccacaacuagccauuga

SEQ ID NO: 942519 - RNA, 22 nt, Human
cagcuggcuccaccucugggcu

SEQ ID NO: 942520 - RNA, 22 nt, Human
aggagaggaaucauuauuacaa

SEQ ID NO: 942521 - RNA, 22 nt, Human
gacaguuuuuaauccuuucaug

SEQ ID NO: 942522 - RNA, 22 nt, Human
ccuuaaaagaacuaucucuucu

SEQ ID NO: 942523 - RNA, 22 nt, Human
gugccugggcaugagcuuguug

SEQ ID NO: 942524 - RNA, 22 nt, Human
ccagcucuuggugcacuuacau

SEQ ID NO: 942525 - RNA, 18 nt, Human
gucauugcaacauacugu

SEQ ID NO: 942526 - RNA, 17 nt, Human
cagggcugucugccuag

SEQ ID NO: 942527 - RNA, 22 nt, Human
uggcugcucaagggaggaggcu

SEQ ID NO: 942528 - RNA, 22 nt, Human
agaaguaggcagggcuguauca

SEQ ID NO: 942529 - RNA, 22 nt, Human
ggacacaagcuccggggcugca

SEQ ID NO: 942530 - RNA, 22 nt, Human
uuauucuucuucucuugccagg

SEQ ID NO: 942531 - RNA, 22 nt, Human
uccauuuuagaagaaaauccac

SEQ ID NO: 942532 - RNA, 22 nt, Human
aaaucaaaagacauguguuuua

SEQ ID NO: 942533 - RNA, 22 nt, Human
ucucuucuaauuuucccgagua

SEQ ID NO: 942534 - RNA, 22 nt, Human
ugccagaagauucucuaucaga

SEQ ID NO: 942535 - RNA, 22 nt, Human
cucagggacguuagaggacagg

SEQ ID NO: 942536 - RNA, 22 nt, Human
ggcugccugcuccuccugcacg

SEQ ID NO: 942537 - RNA, 22 nt, Human
agacaggcagaggcugcagagg

SEQ ID NO: 942538 - RNA, 19 nt, Human
uccucaggggcucacagac

SEQ ID NO: 942539 - RNA, 22 nt, Human
uagggcagagcuuguacacgau

SEQ ID NO: 942540 - RNA, 18 nt, Human
cagggccccagaauuauc

SEQ ID NO: 942541 - RNA, 22 nt, Human
ccaaggagaaaugcugugcuuu

SEQ ID NO: 942542 - RNA, 22 nt, Human
cauugcacugcagcccgggcaa

SEQ ID NO: 942543 - RNA, 21 nt, Human
aaugcauuaacauaaagcuga

SEQ ID NO: 942544 - RNA, 22 nt, Human
uuaguaggagagcuuguucauu

SEQ ID NO: 942545 - RNA, 22 nt, Human
ugagauguaagguaugcuuacu

SEQ ID NO: 942546 - RNA, 18 nt, Human
aaguaacagaagagcaca

SEQ ID NO: 942547 - RNA, 22 nt, Human
caaauacuggguaaguuaauuu

SEQ ID NO: 942548 - RNA, 21 nt, Human
agcagccauggaugguaugua

SEQ ID NO: 942549 - RNA, 22 nt, Human
gaggcuggugguuaguuccauu

SEQ ID NO: 942550 - RNA, 22 nt, Human
agacagcaggggagucugguuu

SEQ ID NO: 942551 - RNA, 22 nt, Human
ccugggaggcggagguugcagu

SEQ ID NO: 942552 - RNA, 22 nt, Human
uuccuugaaugagucauggaaa

SEQ ID NO: 942553 - RNA, 22 nt, Human
gucuuuaugguaugaaaacuga

SEQ ID NO: 942554 - RNA, 22 nt, Human
caggauggagggagggcuguua

SEQ ID NO: 942555 - RNA, 22 nt, Human
cugcuguguggauucaauggcu

SEQ ID NO: 942556 - RNA, 22 nt, Human
gcucugggauuaccagccuuag

SEQ ID NO: 942557 - RNA, 22 nt, Human
cuccugggaauuuaguugugag

SEQ ID NO: 942558 - RNA, 22 nt, Human
uugguuuaggaacuggcuugga

SEQ ID NO: 942559 - RNA, 22 nt, Human
gguggccucucaugcaagguag

SEQ ID NO: 942560 - RNA, 22 nt, Human
auuuucauggcuucugcucagu

SEQ ID NO: 942561 - RNA, 22 nt, Human
gaucuguuucauucacagucug

SEQ ID NO: 942562 - RNA, 22 nt, Human
uuucacaaguaaaguccuaagu

SEQ ID NO: 942563 - RNA, 22 nt, Human
auuuugaaaccaaguuauuucc

SEQ ID NO: 942564 - RNA, 22 nt, Human
cuacccagcaccuaggcugccu

SEQ ID NO: 942565 - RNA, 22 nt, Human
cucacaggagaaagucaugguc

SEQ ID NO: 942566 - RNA, 22 nt, Human
augcagcuucaggauuaugaug

SEQ ID NO: 942567 - RNA, 22 nt, Human
uugaaaggaauacagaggccua

SEQ ID NO: 942568 - RNA, 22 nt, Human
ggagcagggcagugaauucugg

SEQ ID NO: 942569 - RNA, 21 nt, Human
gggaaauuaggauugcucauc

SEQ ID NO: 942570 - RNA, 18 nt, Human
ugcuuggagcauuuacca

SEQ ID NO: 942571 - RNA, 22 nt, Human
cacugaagcuuucauucucuug

SEQ ID NO: 942572 - RNA, 22 nt, Human
gcugggcagccccuacagagag

SEQ ID NO: 942573 - RNA, 22 nt, Human
ccacugucuuuuccaggcugaa

SEQ ID NO: 942574 - RNA, 22 nt, Human
aagucuuacauaauaguuugga

SEQ ID NO: 942575 - RNA, 22 nt, Human
cagggccuccccggcagucuuu

SEQ ID NO: 942576 - RNA, 22 nt, Human
ccugcugugaaacuggcauaug

SEQ ID NO: 942577 - RNA, 22 nt, Human
aauauuucuccuucguuauagc

SEQ ID NO: 942578 - RNA, 22 nt, Human
uaugcacauuaucuaauccauu

SEQ ID NO: 942579 - RNA, 20 nt, Human
ucucagcauaagaacccuuc

SEQ ID NO: 942580 - RNA, 22 nt, Human
uaaaucccuacaucuguguuuu

SEQ ID NO: 942581 - RNA, 22 nt, Human
ggcagcuccuccuagucugccc

SEQ ID NO: 942582 - RNA, 21 nt, Human
acagaggcauacagcuuaagg

SEQ ID NO: 942583 - RNA, 22 nt, Human
agugcuuuagagaaauggugcu

SEQ ID NO: 942584 - RNA, 22 nt, Human
ggcauggcucggagucagaaca

SEQ ID NO: 942585 - RNA, 22 nt, Human
gcuccuggucuggagcuucaag

SEQ ID NO: 942586 - RNA, 22 nt, Human
cugggccugggaggccaggucu

SEQ ID NO: 942587 - RNA, 22 nt, Human
cauuuagagucuugcaauuuua

SEQ ID NO: 942588 - RNA, 22 nt, Human
auucggaucauguguauguguu

SEQ ID NO: 942589 - RNA, 22 nt, Human
gcugucaccaaagcaggcacug

SEQ ID NO: 942590 - RNA, 22 nt, Human
uuauuaugguauuucuuugcag

SEQ ID NO: 942591 - RNA, 22 nt, Human
uacaugaacaaaauagcagaaa

SEQ ID NO: 942592 - RNA, 22 nt, Human
gagguuagaggucagugcaguc

SEQ ID NO: 942593 - RNA, 22 nt, Human
uauucacagguucuggggauca

SEQ ID NO: 942594 - RNA, 20 nt, Human
cacugaagacuucuugcuca

SEQ ID NO: 942595 - RNA, 22 nt, Human
gccuugggggugaaagaggcua

SEQ ID NO: 942596 - RNA, 22 nt, Human
uugacacagaucaauauucaac

SEQ ID NO: 942597 - RNA, 22 nt, Human
agggaggaucugcuccuugucu

SEQ ID NO: 942598 - RNA, 22 nt, Human
ucauccagagcuucauaaguaa

SEQ ID NO: 942599 - RNA, 22 nt, Human
uuucauaugggcauuggcaaua

SEQ ID NO: 942600 - RNA, 22 nt, Human
agacauuuggaagauacacaua

SEQ ID NO: 942601 - RNA, 22 nt, Human
aggagugcaaauaguccagaga

SEQ ID NO: 942602 - RNA, 22 nt, Human
cagucccaccaggaucgcucuu

SEQ ID NO: 942603 - RNA, 22 nt, Human
acauuuaaauaugccuuauauu

SEQ ID NO: 942604 - RNA, 22 nt, Human
agagccugucugccuuucuacc

SEQ ID NO: 942605 - RNA, 22 nt, Human
aucugcuugaaugagcaacagg

SEQ ID NO: 942606 - RNA, 22 nt, Human
ccacugaaggucaacauagagc

SEQ ID NO: 942607 - RNA, 22 nt, Human
guggccucugugcuccugccua

SEQ ID NO: 942608 - RNA, 22 nt, Human
uacuccugcugauccugccagc

SEQ ID NO: 942609 - RNA, 22 nt, Human
ccagcuccccucagcagguaau

SEQ ID NO: 942610 - RNA, 17 nt, Human
agguggguggaucaccu

SEQ ID NO: 942611 - RNA, 22 nt, Human
ccuccugggcuccugucugcac

SEQ ID NO: 942612 - RNA, 22 nt, Human
gugacagaguuuuagaucucau

SEQ ID NO: 942613 - RNA, 22 nt, Human
ccugucugcaugagugagcaua

SEQ ID NO: 942614 - RNA, 21 nt, Human
ugaaaucugaugggacaaaug

SEQ ID NO: 942615 - RNA, 22 nt, Human
guggagacgggacagaagcuaa

SEQ ID NO: 942616 - RNA, 22 nt, Human
aguaaaauuaauggaucagaag

SEQ ID NO: 942617 - RNA, 22 nt, Human
caagaugaucccugaaggcagc

SEQ ID NO: 942618 - RNA, 22 nt, Human
aaaggccacacagagcagggag

SEQ ID NO: 942619 - RNA, 22 nt, Human
gggcauggugaugugcaccugu

SEQ ID NO: 942620 - RNA, 22 nt, Human
uuuccaauaaagugucauuguu

SEQ ID NO: 942621 - RNA, 21 nt, Human
uugaagcaaggguggcucuga

SEQ ID NO: 942622 - RNA, 22 nt, Human
aaaguauucuugacuguuuuuc

SEQ ID NO: 942623 - RNA, 22 nt, Human
gcuguggucugugagcuccaaa

SEQ ID NO: 942624 - RNA, 22 nt, Human
cuguguccucccgcugcaccca

SEQ ID NO: 942625 - RNA, 22 nt, Human
uccaagggcaacaauggaacac

SEQ ID NO: 942626 - RNA, 22 nt, Human
aauaagaaagagucagcuucag

SEQ ID NO: 942627 - RNA, 22 nt, Human
augcagauguuugguucauugu

SEQ ID NO: 942628 - RNA, 20 nt, Human
ucugcucagcccucaguggc

SEQ ID NO: 942629 - RNA, 19 nt, Human
acauauguggauauacaug

SEQ ID NO: 942630 - RNA, 22 nt, Human
cggggacacacuggcagcuccu

SEQ ID NO: 942631 - RNA, 22 nt, Human
ugaggcaggagaaucacaugaa

SEQ ID NO: 942632 - RNA, 22 nt, Human
ucaaacuagccugacugguauu

SEQ ID NO: 942633 - RNA, 22 nt, Human
gagcuuccugaugccgaccagu

SEQ ID NO: 942634 - RNA, 22 nt, Human
gcagcuuggauuucuguaguuu

SEQ ID NO: 942635 - RNA, 22 nt, Human
agagaugaaaaguggagacugg

SEQ ID NO: 942636 - RNA, 22 nt, Human
aaugaugguuucaucacuugaa

SEQ ID NO: 942637 - RNA, 17 nt, Human
cugagcauccgugcucu

SEQ ID NO: 942638 - RNA, 22 nt, Human
cauaauauacuacauugaugaa

SEQ ID NO: 942639 - RNA, 22 nt, Human
ugaagacacauacaagggaaug

SEQ ID NO: 942640 - RNA, 21 nt, Human
augacagaugcugcagaucgu

SEQ ID NO: 942641 - RNA, 18 nt, Human
aggaagcaggaggaaggc

SEQ ID NO: 942642 - RNA, 16 nt, Human
aggccaaaaaggggca

SEQ ID NO: 942643 - RNA, 22 nt, Human
guauuagguuggugcaaaagua

SEQ ID NO: 942644 - RNA, 22 nt, Human
ucuuugaauuucugacugucuu

SEQ ID NO: 942645 - RNA, 22 nt, Human
ugugcccaucccucuggagugu

SEQ ID NO: 942646 - RNA, 22 nt, Human
uaugcauauagaugcacacaca

SEQ ID NO: 942647 - RNA, 22 nt, Human
uuaauuuugaugagguucaguu

SEQ ID NO: 942648 - RNA, 22 nt, Human
ucagaagcugguguccuuugaa

SEQ ID NO: 942649 - RNA, 22 nt, Human
gagauauguuagaaagcuauug

SEQ ID NO: 942650 - RNA, 22 nt, Human
aggggccucgcaggaccgcucc

SEQ ID NO: 942651 - RNA, 22 nt, Human
ucagccugcgucauggugacac

SEQ ID NO: 942652 - RNA, 22 nt, Human
cuguagccaguuuggccucacc

SEQ ID NO: 942653 - RNA, 22 nt, Human
ccagacuguggaguuccuggug

SEQ ID NO: 942654 - RNA, 16 nt, Human
aggaggggaauuagga

SEQ ID NO: 942655 - RNA, 22 nt, Human
uccaggaguggggcagaggucu

SEQ ID NO: 942656 - RNA, 22 nt, Human
ucaguuuucaauuucaucagag

SEQ ID NO: 942657 - RNA, 21 nt, Human
ccugggagaucagcugccuuc

SEQ ID NO: 942658 - RNA, 23 nt, Human
uccaggagaauuccagggcccgg

SEQ ID NO: 942659 - RNA, 22 nt, Human
cuuguucaguccugacuuccug

SEQ ID NO: 942660 - RNA, 22 nt, Human
ccucccacauugaggacaugcu

SEQ ID NO: 942661 - RNA, 22 nt, Human
uuucauuauguuccuggaagag

SEQ ID NO: 942662 - RNA, 22 nt, Human
gugggaugguagguagguaaua

SEQ ID NO: 942663 - RNA, 22 nt, Human
gcagagcuccccaagacaccaa

SEQ ID NO: 942664 - RNA, 22 nt, Human
cuccaggcuucaagggccggcc

SEQ ID NO: 942665 - RNA, 22 nt, Human
ucugucugacaggguaugaacu

SEQ ID NO: 942666 - RNA, 22 nt, Human
ucuugggaaauguuugcgagcu

SEQ ID NO: 942667 - RNA, 22 nt, Human
uugacaaugcacugugcuaagu

SEQ ID NO: 942668 - RNA, 19 nt, Human
aggucuaaucauaagacaa

SEQ ID NO: 942669 - RNA, 22 nt, Human
acuuccugggcaugcagagucc

SEQ ID NO: 942670 - RNA, 22 nt, Human
auuucccagcuuugaucaguuu

SEQ ID NO: 942671 - RNA, 18 nt, Human
uacaugcauaaaugaagc

SEQ ID NO: 942672 - RNA, 22 nt, Human
ucacauuuucauauucucugag

SEQ ID NO: 942673 - RNA, 22 nt, Human
uuuaagauucaguaaggcaaac

SEQ ID NO: 942674 - RNA, 22 nt, Human
cucugcagaggcccaaggcuga

SEQ ID NO: 942675 - RNA, 22 nt, Human
ggagcugaaggggugggcucag

SEQ ID NO: 942676 - RNA, 22 nt, Human
gaauauuuuuaaagggacuaau

SEQ ID NO: 942677 - RNA, 20 nt, Human
acuggagccaucucagccua

SEQ ID NO: 942678 - RNA, 22 nt, Human
gcugccugccuugccuggagga

SEQ ID NO: 942679 - RNA, 22 nt, Human
uaucuauuccaaauaucagcgu

SEQ ID NO: 942680 - RNA, 22 nt, Human
uggcaguguauagguggcuccu

SEQ ID NO: 942681 - RNA, 22 nt, Human
aaggaggaauuucagggugaau

SEQ ID NO: 942682 - RNA, 19 nt, Human
caaggguugggucugucau

SEQ ID NO: 942683 - RNA, 22 nt, Human
gcuggcucuucaguggagauag

SEQ ID NO: 942684 - RNA, 22 nt, Human
gcucucugggugugucuagaua

SEQ ID NO: 942685 - RNA, 22 nt, Human
gccuggcaaggcccuguugacu

SEQ ID NO: 942686 - RNA, 22 nt, Human
gcauuuguguucuuccuagagc

SEQ ID NO: 942687 - RNA, 22 nt, Human
ucauacaucuuguauaucuauc

SEQ ID NO: 942688 - RNA, 22 nt, Human
aggaggcuguggagcacuccau

SEQ ID NO: 942689 - RNA, 22 nt, Human
ccauggccgccgcugcucagga

SEQ ID NO: 942690 - RNA, 22 nt, Human
agcacagaguugcagagagcgu

SEQ ID NO: 942691 - RNA, 22 nt, Human
uauauagaaaagcagauguugg

SEQ ID NO: 942692 - RNA, 22 nt, Human
ucugggagacguguguugucag

SEQ ID NO: 942693 - RNA, 22 nt, Human
aaaauaacuucuacuauuugca

SEQ ID NO: 942694 - RNA, 20 nt, Human
gaggccucagccucagcucc

SEQ ID NO: 942695 - RNA, 22 nt, Human
gccucugcaauuacauugugcc

SEQ ID NO: 942696 - RNA, 22 nt, Human
ccuccuggaaaaauucccuggc

SEQ ID NO: 942697 - RNA, 21 nt, Human
ggacuuacauagguaaggggu

SEQ ID NO: 942698 - RNA, 22 nt, Human
agcugccccaugagaggcaggu

SEQ ID NO: 942699 - RNA, 22 nt, Human
cugcucuguuaauuaaacuuug

SEQ ID NO: 942700 - RNA, 22 nt, Human
ugucucugugacuccuuccgcc

SEQ ID NO: 942701 - RNA, 22 nt, Human
cucagaguggggcucccugagg

SEQ ID NO: 942702 - RNA, 22 nt, Human
ucuguucaucaucuggacacau

SEQ ID NO: 942703 - RNA, 22 nt, Human
cuggagcagguuuaggaguccc

SEQ ID NO: 942704 - RNA, 22 nt, Human
uggcuggcuagugggcaggauu

SEQ ID NO: 942705 - RNA, 20 nt, Human
cacagcuugccuuuuaugac

SEQ ID NO: 942706 - RNA, 22 nt, Human
cagcaggagcagucagacuccu

SEQ ID NO: 942707 - RNA, 22 nt, Human
ucugagggcuugaggggaagua

SEQ ID NO: 942708 - RNA, 22 nt, Human
ggggcagauggaacagagcaca

SEQ ID NO: 942709 - RNA, 22 nt, Human
uugucuguccaggcaccccaag

SEQ ID NO: 942710 - RNA, 22 nt, Human
aaucagucauuagcucugaccu

SEQ ID NO: 942711 - RNA, 22 nt, Human
agggcugcccagugugagagcu

SEQ ID NO: 942712 - RNA, 22 nt, Human
uuuauauagagauuugugcaug

SEQ ID NO: 942713 - RNA, 22 nt, Human
gccugcagugagugcagaaggu

SEQ ID NO: 942714 - RNA, 22 nt, Human
aggcacuguucccaguuauccu

SEQ ID NO: 942715 - RNA, 22 nt, Human
acauacauauguuuaaaugcau

SEQ ID NO: 942716 - RNA, 22 nt, Human
agagccuugaagaucuggaaaa

SEQ ID NO: 942717 - RNA, 22 nt, Human
uccuugaagagugggcggucga

SEQ ID NO: 942718 - RNA, 22 nt, Human
cuugaaagcacuuaguaaauua

SEQ ID NO: 942719 - RNA, 21 nt, Human
gccacguuucagucuucucag

SEQ ID NO: 942720 - RNA, 22 nt, Human
uauauuaaagugcuuugcagug

SEQ ID NO: 942721 - RNA, 22 nt, Human
gcuguucaagacuaggaaauuu

SEQ ID NO: 942722 - RNA, 22 nt, Human
aaggcaguacuuuauguccaua

SEQ ID NO: 942723 - RNA, 22 nt, Human
uggagcagagaugggagcccaa

SEQ ID NO: 942724 - RNA, 22 nt, Human
gcuggccaggugcuuugguucu

SEQ ID NO: 942725 - RNA, 22 nt, Human
cugcuguguuagcagguuuagu

SEQ ID NO: 942726 - RNA, 22 nt, Human
aauuucuaauugaaucucucuu

SEQ ID NO: 942727 - RNA, 22 nt, Human
ugucacauaauuuaucuguagg

SEQ ID NO: 942728 - RNA, 22 nt, Human
agaaaugaagcaggaguuauua

SEQ ID NO: 942729 - RNA, 22 nt, Human
aagccagggauuccugagggag

SEQ ID NO: 942730 - RNA, 22 nt, Human
cagcccugagaaggaggaucuc

SEQ ID NO: 942731 - RNA, 22 nt, Human
ggagccuggucagguuggcucc

SEQ ID NO: 942732 - RNA, 22 nt, Human
agaccaagacuauaaugagagg

SEQ ID NO: 942733 - RNA, 16 nt, Human
aaggagggaagagaau

SEQ ID NO: 942734 - RNA, 22 nt, Human
aaauauuagggagaacagggac

SEQ ID NO: 942735 - RNA, 22 nt, Human
ccuggcagcgccgaagcuggcc

SEQ ID NO: 942736 - RNA, 21 nt, Human
aggcccagcuuuccucuugcu

SEQ ID NO: 942737 - RNA, 22 nt, Human
agcauggggcaaugcaugugcu

SEQ ID NO: 942738 - RNA, 22 nt, Human
ggcuucucgugccgaagcaaga

SEQ ID NO: 942739 - RNA, 22 nt, Human
cuauugaauagcccaaaucauu

SEQ ID NO: 942740 - RNA, 22 nt, Human
uagaacaugugaaaauauagcc

SEQ ID NO: 942741 - RNA, 17 nt, Human
uuucaucugggaccacc

SEQ ID NO: 942742 - RNA, 22 nt, Human
cugcuuuggcagaagucagcua

SEQ ID NO: 942743 - RNA, 22 nt, Human
gcaguggcaccgcuggcucugg

SEQ ID NO: 942744 - RNA, 22 nt, Human
uccuuugacuucuugcagucca

SEQ ID NO: 942745 - RNA, 22 nt, Human
auaucuuuguuuuugccaagau

SEQ ID NO: 942746 - RNA, 22 nt, Human
ggcacugagaacaggcugacuu

SEQ ID NO: 942747 - RNA, 21 nt, Human
uugcaccaugauaaauucaga

SEQ ID NO: 942748 - RNA, 22 nt, Human
acagagcaguucuggagcuggc

SEQ ID NO: 942749 - RNA, 22 nt, Human
accaucaguacuggaugcugac

SEQ ID NO: 942750 - RNA, 22 nt, Human
uucuuucccuuccagcagcucc

SEQ ID NO: 942751 - RNA, 23 nt, Human
ucuuuacauacugaugaguucuc

SEQ ID NO: 942752 - RNA, 22 nt, Human
cagggccaugaggcacaggguc

SEQ ID NO: 942753 - RNA, 22 nt, Human
ugggcagaaaucaguaucagau

SEQ ID NO: 942754 - RNA, 23 nt, Human
uugugggcagauuccauggggag

SEQ ID NO: 942755 - RNA, 22 nt, Human
aaaauugucgaacaguaguaac

SEQ ID NO: 942756 - RNA, 22 nt, Human
uucaagauccagcacaacagug

SEQ ID NO: 942757 - RNA, 22 nt, Human
ucucuucacaugcuugcuccaa

SEQ ID NO: 942758 - RNA, 22 nt, Human
agaggccuaaccaagauguccu

SEQ ID NO: 942759 - RNA, 22 nt, Human
uuuuccuaguaggccuauuaga

SEQ ID NO: 942760 - RNA, 22 nt, Human
ggccuagggaguggccaugccu

SEQ ID NO: 942761 - RNA, 22 nt, Human
cugggccagcaacugcaaugga

SEQ ID NO: 942762 - RNA, 22 nt, Human
cagcagugugcaggugugcugg

SEQ ID NO: 942763 - RNA, 22 nt, Human
agggccuggaacuggagaccac

SEQ ID NO: 942764 - RNA, 22 nt, Human
caggcucccacccuccugcagc

SEQ ID NO: 942765 - RNA, 22 nt, Human
ccuuucucauuuuaagcauuag

SEQ ID NO: 942766 - RNA, 22 nt, Human
agagcugggacuuggacucaau

SEQ ID NO: 942767 - RNA, 23 nt, Human
aguuuuucugcaugguucuguau

SEQ ID NO: 942768 - RNA, 22 nt, Human
aggcucugucaggcggagcagc

SEQ ID NO: 942769 - RNA, 22 nt, Human
gggcuggcucugucuagaaagg

SEQ ID NO: 942770 - RNA, 22 nt, Human
gccaggugggagacagacagca

SEQ ID NO: 942771 - RNA, 22 nt, Human
aaaugcuguguuuuaacauaga

SEQ ID NO: 942772 - RNA, 22 nt, Human
uuugcaaauaccaugaaacuug

SEQ ID NO: 942773 - RNA, 22 nt, Human
uggagcagggcaucacugugcg

SEQ ID NO: 942774 - RNA, 22 nt, Human
gcucaggacuggaggagcgggg

SEQ ID NO: 942775 - RNA, 23 nt, Human
aggagccaggaaccagcuucccc

SEQ ID NO: 942776 - RNA, 22 nt, Human
gucaggauuuacaaacuucagu

SEQ ID NO: 942777 - RNA, 22 nt, Human
ucuccuggcauuugguugagua

SEQ ID NO: 942778 - RNA, 22 nt, Human
uaaguucauaagcuuauucuua

SEQ ID NO: 942779 - RNA, 22 nt, Human
aaagaacaauguggaaucuccu

SEQ ID NO: 942780 - RNA, 22 nt, Human
ccagcucuuuuggcugagugag

SEQ ID NO: 942781 - RNA, 22 nt, Human
auaaggcagaaauagggaaagu

SEQ ID NO: 942782 - RNA, 22 nt, Human
uggcucaggccuacgacgccuu

SEQ ID NO: 942783 - RNA, 22 nt, Human
ucucagagauuuauggaaaacu

SEQ ID NO: 942784 - RNA, 22 nt, Human
auuucuuccucugucaguaacu

SEQ ID NO: 942785 - RNA, 22 nt, Human
gaaaggugccccauaggcagga

SEQ ID NO: 942786 - RNA, 22 nt, Human
gagggcugaugcuuacuuauuu

SEQ ID NO: 942787 - RNA, 22 nt, Human
cuggagcccaggccuggugucu

SEQ ID NO: 942788 - RNA, 22 nt, Human
auauaaaguguuuagaaagcug

SEQ ID NO: 942789 - RNA, 22 nt, Human
ccugagagagaagcgaccuggu

SEQ ID NO: 942790 - RNA, 22 nt, Human
agcccaggaaguugaggcuugc

SEQ ID NO: 942791 - RNA, 22 nt, Human
cuuugaaagcucccaggacuua

SEQ ID NO: 942792 - RNA, 22 nt, Human
uauguguauguacauacauaca

SEQ ID NO: 942793 - RNA, 22 nt, Human
acaggcuuacaggcugcaagua

SEQ ID NO: 942794 - RNA, 22 nt, Human
aguggcaggcggagauguagga

SEQ ID NO: 942795 - RNA, 22 nt, Human
cugcuguguuucacaccucugg

SEQ ID NO: 942796 - RNA, 22 nt, Human
ugggggagccuucacaguagcu

SEQ ID NO: 942797 - RNA, 22 nt, Human
uucauucccuuauauuagcauu

SEQ ID NO: 942798 - RNA, 22 nt, Human
aguuauaugugaaaacacguau

SEQ ID NO: 942799 - RNA, 22 nt, Human
uccagagggcgauggcuggggg

SEQ ID NO: 942800 - RNA, 22 nt, Human
uagaaaugaauguuuaaaaguc

SEQ ID NO: 942801 - RNA, 22 nt, Human
auauugaacccuacagacugua

SEQ ID NO: 942802 - RNA, 20 nt, Human
auguuuuauaaaagaacggg

SEQ ID NO: 942803 - RNA, 22 nt, Human
caaugauucugcaacugugugc

SEQ ID NO: 942804 - RNA, 22 nt, Human
cuguuuuugugcugugucuccc

SEQ ID NO: 942805 - RNA, 22 nt, Human
ucaggcuggaaugcaguggggc

SEQ ID NO: 942806 - RNA, 22 nt, Human
gaggacagugugaucugccagc

SEQ ID NO: 942807 - RNA, 18 nt, Human
uggugaaggguggaggag

SEQ ID NO: 942808 - RNA, 22 nt, Human
ugcuuugggucucucuaguuuc

SEQ ID NO: 942809 - RNA, 18 nt, Human
ucugagggugcgggagcu

SEQ ID NO: 942810 - RNA, 22 nt, Human
ggcuuggaaaugguaaugagcu

SEQ ID NO: 942811 - RNA, 21 nt, Human
cagcuuugucugucuucgggg

SEQ ID NO: 942812 - RNA, 22 nt, Human
caggauggucagaugcauuguc

SEQ ID NO: 942813 - RNA, 23 nt, Human
uggagcugggcucagacccuggg

SEQ ID NO: 942814 - RNA, 22 nt, Human
ucacagcaaaagugugcagagc

SEQ ID NO: 942815 - RNA, 22 nt, Human
gauuucuucauucauuagaugg

SEQ ID NO: 942816 - RNA, 20 nt, Human
aggaagcugagauguagagg

SEQ ID NO: 942817 - RNA, 22 nt, Human
guccucugaaguugugcaaugc

SEQ ID NO: 942818 - RNA, 22 nt, Human
aaaugcacagagccuuagagau

SEQ ID NO: 942819 - RNA, 22 nt, Human
aaucgguugaacccaggaagug

SEQ ID NO: 942820 - RNA, 22 nt, Human
uuaauucuuccggacugugaaa

SEQ ID NO: 942821 - RNA, 21 nt, Human
guauugcagaguuaugugcuc

SEQ ID NO: 942822 - RNA, 22 nt, Human
uaaaguguccuagcuaggaggc

SEQ ID NO: 942823 - RNA, 22 nt, Human
cagcagcuggugagacacagcc

SEQ ID NO: 942824 - RNA, 22 nt, Human
ccccaggagcuuguuuuagaga

SEQ ID NO: 942825 - RNA, 22 nt, Human
aaggcugagggcuguaccuggc

SEQ ID NO: 942826 - RNA, 22 nt, Human
cugggccaaaagaaguguucuu

SEQ ID NO: 942827 - RNA, 16 nt, Human
gccuggaguggcaggg

SEQ ID NO: 942828 - RNA, 22 nt, Human
cugggaggcaccgcgucgugcu

SEQ ID NO: 942829 - RNA, 22 nt, Human
gaggcagaaguugcagugagca

SEQ ID NO: 942830 - RNA, 22 nt, Human
aaccaggacaauuuugaaagua

SEQ ID NO: 942831 - RNA, 22 nt, Human
gaagaacacuucaugauucauu

SEQ ID NO: 942832 - RNA, 22 nt, Human
uggugucugcacucccuggcgu

SEQ ID NO: 942833 - RNA, 22 nt, Human
agggcugagacuaaggccagau

SEQ ID NO: 942834 - RNA, 22 nt, Human
ccuugcugaccaucaccuuuga

SEQ ID NO: 942835 - RNA, 22 nt, Human
acaaaugucuccucuuuuguua

SEQ ID NO: 942836 - RNA, 22 nt, Human
uccucugcuccaggcuggacuu

SEQ ID NO: 942837 - RNA, 22 nt, Human
ugucucugaggugagggucagc

SEQ ID NO: 942838 - RNA, 22 nt, Human
ugggagcccaagggagcugccg

SEQ ID NO: 942839 - RNA, 15 nt, Human
aggcacugugggacc

SEQ ID NO: 942840 - RNA, 22 nt, Human
uuuguuaaaaugcagauucugu

SEQ ID NO: 942841 - RNA, 22 nt, Human
gaguguucccacaccccaguug

SEQ ID NO: 942842 - RNA, 22 nt, Human
ucuguucauuugccucggcucu

SEQ ID NO: 942843 - RNA, 22 nt, Human
cucugggcaggaccaguggacc

SEQ ID NO: 942844 - RNA, 22 nt, Human
agaccuggauuccaauccuacc

SEQ ID NO: 942845 - RNA, 21 nt, Human
cuggccgaccccucugugcuc

SEQ ID NO: 942846 - RNA, 22 nt, Human
ugccugggguuggcaaacugcu

SEQ ID NO: 942847 - RNA, 22 nt, Human
gcaguggcaugaugugggcuca

SEQ ID NO: 942848 - RNA, 22 nt, Human
ggagugacucacagcugggaca

SEQ ID NO: 942849 - RNA, 22 nt, Human
agaggcggagcuugcagugagc

SEQ ID NO: 942850 - RNA, 22 nt, Human
uccugggcuugcuccuccagcu

SEQ ID NO: 942851 - RNA, 22 nt, Human
uaguuauuauuguuacuaucag

SEQ ID NO: 942852 - RNA, 22 nt, Human
gcuccugggcucuaccuugcua

SEQ ID NO: 942853 - RNA, 22 nt, Human
agcagagguuuguuggaaaccu

SEQ ID NO: 942854 - RNA, 22 nt, Human
caggaggggguggaguuucgcc

SEQ ID NO: 942855 - RNA, 22 nt, Human
agggggaggcugugcugcgucu

SEQ ID NO: 942856 - RNA, 22 nt, Human
ccagcucuagccccauguggcu

SEQ ID NO: 942857 - RNA, 20 nt, Human
cagcuuggaugagaggcuga

SEQ ID NO: 942858 - RNA, 22 nt, Human
uacagucaacauugaugaugau

SEQ ID NO: 942859 - RNA, 22 nt, Human
gaagcccacguuuggugaugua

SEQ ID NO: 942860 - RNA, 20 nt, Human
gcugaccccugcugucaugc

SEQ ID NO: 942861 - RNA, 18 nt, Human
gcaggagauggguggggu

SEQ ID NO: 942862 - RNA, 22 nt, Human
gcgucugaguugcgggggcuca

SEQ ID NO: 942863 - RNA, 22 nt, Human
ugcauuguuuagaacucuuugg

SEQ ID NO: 942864 - RNA, 22 nt, Human
gaugcagggcuggcaggagcuu

SEQ ID NO: 942865 - RNA, 23 nt, Human
aaacugcuuccaauuccugccau

SEQ ID NO: 942866 - RNA, 22 nt, Human
ugagccuggguggucgaggcug

SEQ ID NO: 942867 - RNA, 22 nt, Human
gagccugaaauacaggucacug

SEQ ID NO: 942868 - RNA, 22 nt, Human
gcuggccucgcaggcaggaugu

SEQ ID NO: 942869 - RNA, 22 nt, Human
cacagaguggaggcuuggccug

SEQ ID NO: 942870 - RNA, 22 nt, Human
caagauggguguugugaugguu

SEQ ID NO: 942871 - RNA, 20 nt, Human
uguuccaagcuaaugaauga

SEQ ID NO: 942872 - RNA, 21 nt, Human
ucacagacuggucagugaggc

SEQ ID NO: 942873 - RNA, 22 nt, Human
ugcuucaaguugaaauauucuu

SEQ ID NO: 942874 - RNA, 22 nt, Human
ugggcaggauaauaucucaugu

SEQ ID NO: 942875 - RNA, 22 nt, Human
aauauucaaguuauucuuucuu

SEQ ID NO: 942876 - RNA, 22 nt, Human
uggcagcuauuacaaggaaguc

SEQ ID NO: 942877 - RNA, 22 nt, Human
cugccucugcgucccacagagu

SEQ ID NO: 942878 - RNA, 22 nt, Human
cagacccucgggugaguuggcc

SEQ ID NO: 942879 - RNA, 22 nt, Human
acucugggccccagguggagcu

SEQ ID NO: 942880 - RNA, 22 nt, Human
ucuccuggcccugucgccaucu

SEQ ID NO: 942881 - RNA, 22 nt, Human
ccugucuggccuuccacggggg

SEQ ID NO: 942882 - RNA, 23 nt, Human
ggagccuggcauaugagacgcau

SEQ ID NO: 942883 - RNA, 18 nt, Human
agggaucaucacugcagc

SEQ ID NO: 942884 - RNA, 22 nt, Human
uccaggaggugaggggaccaaa

SEQ ID NO: 942885 - RNA, 22 nt, Human
auuauaggcuugagccaccgug

SEQ ID NO: 942886 - RNA, 22 nt, Human
ugucauguguucuuaaauacau

SEQ ID NO: 942887 - RNA, 22 nt, Human
aguaaaaucuuaagcacagugg

SEQ ID NO: 942888 - RNA, 22 nt, Human
gaguuauugaguauagaaugua

SEQ ID NO: 942889 - RNA, 22 nt, Human
acugucuguccugcucuccgug

SEQ ID NO: 942890 - RNA, 22 nt, Human
uuaaagggccgauuuccaggcc

SEQ ID NO: 942891 - RNA, 22 nt, Human
ugugacaugugucaucuuuucu

SEQ ID NO: 942892 - RNA, 22 nt, Human
uacauguaagacaugagacucu

SEQ ID NO: 942893 - RNA, 22 nt, Human
aguaaaauuucugcugaggaga

SEQ ID NO: 942894 - RNA, 22 nt, Human
gcagcuggagcaucuucucauc

SEQ ID NO: 942895 - RNA, 22 nt, Human
uuuauuagugcuuguaucacug

SEQ ID NO: 942896 - RNA, 22 nt, Human
acuuccugcaaucguccacucc

SEQ ID NO: 942897 - RNA, 22 nt, Human
gccuggugaaaggcagagagcg

SEQ ID NO: 942898 - RNA, 22 nt, Human
auuugcuuuaagguauaaaagg

SEQ ID NO: 942899 - RNA, 22 nt, Human
uugcauuuuuagaugcuucugu

SEQ ID NO: 942900 - RNA, 22 nt, Human
ggcugagcucaggggcagcagg

SEQ ID NO: 942901 - RNA, 22 nt, Human
ucuuggccagguguggugccuc

SEQ ID NO: 942902 - RNA, 22 nt, Human
cugaaaugacgguuuggggcaa

SEQ ID NO: 942903 - RNA, 22 nt, Human
gccagccuucuguggccugcaa

SEQ ID NO: 942904 - RNA, 22 nt, Human
ucuuugcacacaucccuucccg

SEQ ID NO: 942905 - RNA, 22 nt, Human
uugagaagaaauaguuugcaau

SEQ ID NO: 942906 - RNA, 21 nt, Human
agaaaaaccagcauguuuuca

SEQ ID NO: 942907 - RNA, 22 nt, Human
ugaggugaccgcagaugggaag

SEQ ID NO: 942908 - RNA, 22 nt, Human
uguagggaggaaggguuggaaa

SEQ ID NO: 942909 - RNA, 22 nt, Human
auuucuguauccugcugucaga

SEQ ID NO: 942910 - RNA, 22 nt, Human
acaggcagcgucauugcugcuc

SEQ ID NO: 942911 - RNA, 22 nt, Human
gccuggcuccuaagagcacaac

SEQ ID NO: 942912 - RNA, 22 nt, Human
cucagucugucuugucuguguu

SEQ ID NO: 942913 - RNA, 21 nt, Human
cgggcuggccgggcccucacc

SEQ ID NO: 942914 - RNA, 22 nt, Human
cugcagccuccugggguacaug

SEQ ID NO: 942915 - RNA, 22 nt, Human
uccuugggaaaucacuagcacu

SEQ ID NO: 942916 - RNA, 22 nt, Human
agcagcagaggucagaaaggua

SEQ ID NO: 942917 - RNA, 22 nt, Human
aagccagccagugccagucuua

SEQ ID NO: 942918 - RNA, 22 nt, Human
ugucaugcagguuuguuauaga

SEQ ID NO: 942919 - RNA, 22 nt, Human
ucacugcagacaaccucaguca

SEQ ID NO: 942920 - RNA, 20 nt, Human
ucuccuggugacaguaccca

SEQ ID NO: 942921 - RNA, 22 nt, Human
ucaggauaaaauguaauggcaa

SEQ ID NO: 942922 - RNA, 22 nt, Human
gaaaucugaacucuguauccuu

SEQ ID NO: 942923 - RNA, 22 nt, Human
uguuuaguaggaguuuaauacu

SEQ ID NO: 942924 - RNA, 19 nt, Human
uugguggugguuuugguuc

SEQ ID NO: 942925 - RNA, 22 nt, Human
acuguucacccagcacuagcag

SEQ ID NO: 942926 - RNA, 22 nt, Human
ugggcugcagagcccggccuuc

SEQ ID NO: 942927 - RNA, 22 nt, Human
agcaggugaugugagucuggaa

SEQ ID NO: 942928 - RNA, 22 nt, Human
uagagcugggcagugcucugag

SEQ ID NO: 942929 - RNA, 22 nt, Human
guaucuuucccaccaaucacaa

SEQ ID NO: 942930 - RNA, 22 nt, Human
aaaugucugagacuucugaacu

SEQ ID NO: 942931 - RNA, 22 nt, Human
gagaggaguaggcugauggugc

SEQ ID NO: 942932 - RNA, 22 nt, Human
aggccuggccugggcggcauug

SEQ ID NO: 942933 - RNA, 22 nt, Human
cccagccuggugcacugugggg

SEQ ID NO: 942934 - RNA, 22 nt, Human
uucuucuuucccccugugguac

SEQ ID NO: 942935 - RNA, 22 nt, Human
uaugaagauauaucugaucucu

SEQ ID NO: 942936 - RNA, 22 nt, Human
caggcagcucaaccuugggagc

SEQ ID NO: 942937 - RNA, 22 nt, Human
uaaguaaauuuauaaugugauu

SEQ ID NO: 942938 - RNA, 22 nt, Human
ugccugaggagucagggcaggu

SEQ ID NO: 942939 - RNA, 21 nt, Human
gcucuuggaaggggcucagcu

SEQ ID NO: 942940 - RNA, 22 nt, Human
uugcaaauuauuuuagucccuu

SEQ ID NO: 942941 - RNA, 22 nt, Human
agcagccauuuaaaaugaauug

SEQ ID NO: 942942 - RNA, 23 nt, Human
aggauccugguacaggagcagag

SEQ ID NO: 942943 - RNA, 22 nt, Human
cugugcaagacuuacuuuaaua

SEQ ID NO: 942944 - RNA, 22 nt, Human
ugucccagcacuuugggagucu

SEQ ID NO: 942945 - RNA, 22 nt, Human
aauaugugagguauguucagug

SEQ ID NO: 942946 - RNA, 22 nt, Human
uucaaaacaaucuguuugcauu

SEQ ID NO: 942947 - RNA, 22 nt, Human
ggcugcaguuugucuuuugcuu

SEQ ID NO: 942948 - RNA, 22 nt, Human
aauguguguucggggcccagag

SEQ ID NO: 942949 - RNA, 22 nt, Human
cauuuguaucauauguaucuua

SEQ ID NO: 942950 - RNA, 22 nt, Human
augaacacauguacacauuucu

SEQ ID NO: 942951 - RNA, 22 nt, Human
cugccugugcaugcagucagaa

SEQ ID NO: 942952 - RNA, 22 nt, Human
ggauggagguucucagaugcuc

SEQ ID NO: 942953 - RNA, 22 nt, Human
gcucccaccuccagccugaguu

SEQ ID NO: 942954 - RNA, 22 nt, Human
cucucuggaccucaacuauuuu

SEQ ID NO: 942955 - RNA, 20 nt, Human
aauuuacucacagaaugaau

SEQ ID NO: 942956 - RNA, 22 nt, Human
cagugguggaaugaggaauugu

SEQ ID NO: 942957 - RNA, 22 nt, Human
gucaugccuggcuucuuagaca

SEQ ID NO: 942958 - RNA, 22 nt, Human
acucagaagauauaaugacuca

SEQ ID NO: 942959 - RNA, 22 nt, Human
gucugcccucacgccagcuggg

SEQ ID NO: 942960 - RNA, 18 nt, Human
uuugcaaaggaaguaugg

SEQ ID NO: 942961 - RNA, 22 nt, Human
agagugaaguuuuugaaaguga

SEQ ID NO: 942962 - RNA, 22 nt, Human
caaggugcagcguugucaagcu

SEQ ID NO: 942963 - RNA, 22 nt, Human
cugaaauuccauuucagccaca

SEQ ID NO: 942964 - RNA, 22 nt, Human
uugauacagcagccugugaucc

SEQ ID NO: 942965 - RNA, 18 nt, Human
ggagagugagaucaaaca

SEQ ID NO: 942966 - RNA, 22 nt, Human
agaaaucaauaucuauauguug

SEQ ID NO: 942967 - RNA, 22 nt, Human
cagaagaaaguggggagacaag

SEQ ID NO: 942968 - RNA, 22 nt, Human
uucucuucaucucaguaaaugu

SEQ ID NO: 942969 - RNA, 22 nt, Human
cugggaaauggcuucgagcuca

SEQ ID NO: 942970 - RNA, 22 nt, Human
uuguuacacauaauaacauuuu

SEQ ID NO: 942971 - RNA, 22 nt, Human
uauuuaaaaagaggccagcugg

SEQ ID NO: 942972 - RNA, 22 nt, Human
cacugcuuuaaggcugaguaac

SEQ ID NO: 942973 - RNA, 22 nt, Human
aaauauuauugcuuaaggggag

SEQ ID NO: 942974 - RNA, 22 nt, Human
aggaggcugguucaggccauau

SEQ ID NO: 942975 - RNA, 22 nt, Human
caggaagagaacauggaggcug

SEQ ID NO: 942976 - RNA, 22 nt, Human
uguggccagcagguggcugugu

SEQ ID NO: 942977 - RNA, 22 nt, Human
gcugugugaaaacugggccugg

SEQ ID NO: 942978 - RNA, 22 nt, Human
auauguguauuugguuagccua

SEQ ID NO: 942979 - RNA, 22 nt, Human
uaacaguguggacuugagaucu

SEQ ID NO: 942980 - RNA, 22 nt, Human
acauuucucagggaguuuugcu

SEQ ID NO: 942981 - RNA, 22 nt, Human
aaagaacaaauuagcuguuuua

SEQ ID NO: 942982 - RNA, 22 nt, Human
caguggcugugaccagggaccu

SEQ ID NO: 942983 - RNA, 22 nt, Human
ucugucacuuauuaagauggau

SEQ ID NO: 942984 - RNA, 19 nt, Human
cuggcagccugucuguguc

SEQ ID NO: 942985 - RNA, 22 nt, Human
caaaugauagagccgauuauca

SEQ ID NO: 942986 - RNA, 23 nt, Human
cccuggaguaaauucuuggaagg

SEQ ID NO: 942987 - RNA, 21 nt, Human
gauuugcagaaacuagacagg

SEQ ID NO: 942988 - RNA, 21 nt, Human
gugguuauuuucauuagcauc

SEQ ID NO: 942989 - RNA, 22 nt, Human
aacauucuauuuugcuaaaaca

SEQ ID NO: 942990 - RNA, 22 nt, Human
agaaaaaucuuggcgcuugucu

SEQ ID NO: 942991 - RNA, 22 nt, Human
agagccaggcaggcaauguuga

SEQ ID NO: 942992 - RNA, 22 nt, Human
ccagugcacagccaggcaggug

SEQ ID NO: 942993 - RNA, 22 nt, Human
ugcugccuuugggaccuggccu

SEQ ID NO: 942994 - RNA, 22 nt, Human
cuggccugagcacagcggcugc

SEQ ID NO: 942995 - RNA, 23 nt, Human
uggcuucugccccauucucucca

SEQ ID NO: 942996 - RNA, 22 nt, Human
ccucaggaaaugaauaaauggc

SEQ ID NO: 942997 - RNA, 22 nt, Human
gcucacagccggcuggcagggg

SEQ ID NO: 942998 - RNA, 22 nt, Human
ucuuguuucuguauauaaugac

SEQ ID NO: 942999 - RNA, 22 nt, Human
ugggaggaaugucacugagcca

SEQ ID NO: 943000 - RNA, 22 nt, Human
cugggcagaauuuuaggauggc

SEQ ID NO: 943001 - RNA, 22 nt, Human
caguaaagcauguaugucuuca

SEQ ID NO: 943002 - RNA, 22 nt, Human
cccaggaaaugggcucuugccu

SEQ ID NO: 943003 - RNA, 22 nt, Human
uucucagaggagucgggagcug

SEQ ID NO: 943004 - RNA, 20 nt, Human
agugacagagacuguguggc

SEQ ID NO: 943005 - RNA, 22 nt, Human
aacauuucauuggaagcuaugu

SEQ ID NO: 943006 - RNA, 22 nt, Human
gagcugucucuauaugaaugcu

SEQ ID NO: 943007 - RNA, 22 nt, Human
ugcugccucagcuuccugggcu

SEQ ID NO: 943008 - RNA, 22 nt, Human
gcacugaaauuauaugcauuug

SEQ ID NO: 943009 - RNA, 22 nt, Human
ggcaguggguuccccaaggcac

SEQ ID NO: 943010 - RNA, 22 nt, Human
ggucucagcuggaguccuuggu

SEQ ID NO: 943011 - RNA, 22 nt, Human
aaauaugugaucagugaauaaa

SEQ ID NO: 943012 - RNA, 22 nt, Human
aaggccuggauuuagguuguga

SEQ ID NO: 943013 - RNA, 22 nt, Human
ccuggcugccgagugugcagcg

SEQ ID NO: 943014 - RNA, 22 nt, Human
uagaucugauacaauucaucug

SEQ ID NO: 943015 - RNA, 22 nt, Human
acugaaggaagcgggcaggggu

SEQ ID NO: 943016 - RNA, 20 nt, Human
guccugggagccacagcaca

SEQ ID NO: 943017 - RNA, 22 nt, Human
acauuguagacuuuucauaugu

SEQ ID NO: 943018 - RNA, 22 nt, Human
caggagauguaagacuucuguu

SEQ ID NO: 943019 - RNA, 22 nt, Human
cugccucuauaggaguccacca

SEQ ID NO: 943020 - RNA, 20 nt, Human
aggcagcugggaaaugaggg

SEQ ID NO: 943021 - RNA, 22 nt, Human
uuggcagugucacuagggagcc

SEQ ID NO: 943022 - RNA, 22 nt, Human
aagacugugucuauggcuacuc

SEQ ID NO: 943023 - RNA, 22 nt, Human
gcuggugagcaaaggagaagga

SEQ ID NO: 943024 - RNA, 22 nt, Human
cagcucucuaaggucuugcuuu

SEQ ID NO: 943025 - RNA, 22 nt, Human
cggggcugcucguccuccugug

SEQ ID NO: 943026 - RNA, 22 nt, Human
caggaaauaucuccuggcagag

SEQ ID NO: 943027 - RNA, 22 nt, Human
ucucacucauuuccuaggucuu

SEQ ID NO: 943028 - RNA, 22 nt, Human
cugggagaggaaccucgagggu

SEQ ID NO: 943029 - RNA, 22 nt, Human
uaaaugugcacagguuagaagg

SEQ ID NO: 943030 - RNA, 22 nt, Human
agugggaggcggcugacgggcg

SEQ ID NO: 943031 - RNA, 22 nt, Human
cagacaggguccuguccgucac

SEQ ID NO: 943032 - RNA, 17 nt, Human
agcagcuggguugaucu

SEQ ID NO: 943033 - RNA, 22 nt, Human
auaaaugauucagcaggaaaua

SEQ ID NO: 943034 - RNA, 22 nt, Human
agucuuaugugauuuaucuuuc

SEQ ID NO: 943035 - RNA, 21 nt, Human
agagaagaggacuuucucaca

SEQ ID NO: 943036 - RNA, 22 nt, Human
gaggagagccugcacuuugacc

SEQ ID NO: 943037 - RNA, 17 nt, Human
uucucuuccuggauagu

SEQ ID NO: 943038 - RNA, 22 nt, Human
uggcuucugggacuugugagca

SEQ ID NO: 943039 - RNA, 22 nt, Human
uuggcaguaaaagaaaaugcuu

SEQ ID NO: 943040 - RNA, 22 nt, Human
gaagcagccacggggagacaga

SEQ ID NO: 943041 - RNA, 22 nt, Human
aagagggcugcaaucuuauugc

SEQ ID NO: 943042 - RNA, 22 nt, Human
gaggagcugggucagggagaca

SEQ ID NO: 943043 - RNA, 22 nt, Human
ugaaaugaucaguuugguuacu

SEQ ID NO: 943044 - RNA, 22 nt, Human
accaggagacaugaccaaugag

SEQ ID NO: 943045 - RNA, 22 nt, Human
gggcagcugccaagugcaucgc

SEQ ID NO: 943046 - RNA, 22 nt, Human
cuucagaacuauaaaaaguacu

SEQ ID NO: 943047 - RNA, 21 nt, Human
gaacauuuggguuguuucuac

SEQ ID NO: 943048 - RNA, 22 nt, Human
uaacaucuuuagcagcucgaac

SEQ ID NO: 943049 - RNA, 22 nt, Human
cagagcagcagagcuuccaugg

SEQ ID NO: 943050 - RNA, 22 nt, Human
aucaguuucugugaagaacaca

SEQ ID NO: 943051 - RNA, 22 nt, Human
ggcacagagcccagcuuccuag

SEQ ID NO: 943052 - RNA, 22 nt, Human
uuugacaggacuaacauauggc

SEQ ID NO: 943053 - RNA, 22 nt, Human
aggcugccucgugagcucgcug

SEQ ID NO: 943054 - RNA, 22 nt, Human
cuccuggcucgcccccagcuga

SEQ ID NO: 943055 - RNA, 22 nt, Human
agagcagaggcauggccguggg

SEQ ID NO: 943056 - RNA, 22 nt, Human
cugggugguucuaacuguugau

SEQ ID NO: 943057 - RNA, 22 nt, Human
gcucuccacugaccacggggca

SEQ ID NO: 943058 - RNA, 22 nt, Human
agaaaguucugugaguuguuca

SEQ ID NO: 943059 - RNA, 20 nt, Human
ugcagagcuggcuggcuccu

SEQ ID NO: 943060 - RNA, 22 nt, Human
aagcagcuuuugaagagugagg

SEQ ID NO: 943061 - RNA, 18 nt, Human
aauuuccauaugaauugc

SEQ ID NO: 943062 - RNA, 22 nt, Human
aggcagugcucaagacagcagc

SEQ ID NO: 943063 - RNA, 22 nt, Human
ucucugauguauaucagagaac

SEQ ID NO: 943064 - RNA, 22 nt, Human
agcagaaccacagcacuguuga

SEQ ID NO: 943065 - RNA, 20 nt, Human
aucaggauucuugcuuuguu

SEQ ID NO: 943066 - RNA, 22 nt, Human
ccacagagcauuagauuucaga

SEQ ID NO: 943067 - RNA, 22 nt, Human
uguggccuugcagccuggaggu

SEQ ID NO: 943068 - RNA, 22 nt, Human
gacuucuauuaauaccucuacu

SEQ ID NO: 943069 - RNA, 22 nt, Human
gcucuggcuacuguggcuaccg

SEQ ID NO: 943070 - RNA, 22 nt, Human
gaggaaagcugguuuaaaguau

SEQ ID NO: 943071 - RNA, 22 nt, Human
aggggcucaguuacuuuggcag

SEQ ID NO: 943072 - RNA, 22 nt, Human
gugaagauaaggaugcugcagu

SEQ ID NO: 943073 - RNA, 21 nt, Human
uggcucugagccucauggcug

SEQ ID NO: 943074 - RNA, 22 nt, Human
agucccagcucugccacuuacu

SEQ ID NO: 943075 - RNA, 22 nt, Human
ccauuguaaauucuguggaagu

SEQ ID NO: 943076 - RNA, 21 nt, Human
uguucacauggagcagaaugu

SEQ ID NO: 943077 - RNA, 22 nt, Human
gauuuggccuuucgcaugguau

SEQ ID NO: 943078 - RNA, 22 nt, Human
cacccacccacugcucauuggc

SEQ ID NO: 943079 - RNA, 22 nt, Human
cccacucccugcacgccugccg

SEQ ID NO: 943080 - RNA, 22 nt, Human
cgcagcagccccgugguaggug

SEQ ID NO: 943081 - RNA, 22 nt, Human
cuuccucccggcccaugcucug

SEQ ID NO: 943082 - RNA, 22 nt, Human
ucugggaguggguccaaggaau

SEQ ID NO: 943083 - RNA, 22 nt, Human
aaggcagccagauccuuugggu

SEQ ID NO: 943084 - RNA, 22 nt, Human
aggcagguccccuggaaggcac

SEQ ID NO: 943085 - RNA, 22 nt, Human
cuucuugcugggggccucagug

SEQ ID NO: 943086 - RNA, 22 nt, Human
uuaauaaacaggugcagcugaa

SEQ ID NO: 943087 - RNA, 17 nt, Human
gcagcagagagacccuc

SEQ ID NO: 943088 - RNA, 22 nt, Human
uaugcacagaaguuugcugaau

SEQ ID NO: 943089 - RNA, 22 nt, Human
aaagccauugaacuguacuuua

SEQ ID NO: 943090 - RNA, 22 nt, Human
aaggcagccauagcaccaucca

SEQ ID NO: 943091 - RNA, 22 nt, Human
accucccagcucugagcuuggg

SEQ ID NO: 943092 - RNA, 22 nt, Human
ucuucaaaugcuaguaauauca

SEQ ID NO: 943093 - RNA, 22 nt, Human
ccugugucuuccccacuggugu

SEQ ID NO: 943094 - RNA, 22 nt, Human
agaaguuguagguuugcauauu

SEQ ID NO: 943095 - RNA, 22 nt, Human
gcagcugcagagaccggguggg

SEQ ID NO: 943096 - RNA, 22 nt, Human
uggcccugacuuggaggccuga

SEQ ID NO: 943097 - RNA, 22 nt, Human
gaggaugugucuggucugggca

SEQ ID NO: 943098 - RNA, 22 nt, Human
cacuggcaugugaggcgguggc

SEQ ID NO: 943099 - RNA, 22 nt, Human
gagcuuaggccagggacaggga

SEQ ID NO: 943100 - RNA, 22 nt, Human
agggcacaucugcugggaaugg

SEQ ID NO: 943101 - RNA, 22 nt, Human
ccuccuggcccugggccuggaa

SEQ ID NO: 943102 - RNA, 22 nt, Human
aaaugcagaucccugaaucuca

SEQ ID NO: 943103 - RNA, 22 nt, Human
aaugcucaaaauguuucaucua

SEQ ID NO: 943104 - RNA, 22 nt, Human
cccaggaggacauuccauaccc

SEQ ID NO: 943105 - RNA, 22 nt, Human
uuaaaguucauuaaaugagcca

SEQ ID NO: 943106 - RNA, 23 nt, Human
agaugaggcuucuccauguuggu

SEQ ID NO: 943107 - RNA, 22 nt, Human
uggcaacaugucgaagugcugu

SEQ ID NO: 943108 - RNA, 22 nt, Human
aagaggucauaccagauaaggg

SEQ ID NO: 943109 - RNA, 22 nt, Human
agcagcucuggcacuguagcau

SEQ ID NO: 943110 - RNA, 22 nt, Human
ggcacucagagauucaggcugu

SEQ ID NO: 943111 - RNA, 22 nt, Human
caauguguuugcauauuaaaau

SEQ ID NO: 943112 - RNA, 22 nt, Human
ccuccaggcugaauaucuagaa

SEQ ID NO: 943113 - RNA, 22 nt, Human
aucagcaaucaaauugcagagu

SEQ ID NO: 943114 - RNA, 22 nt, Human
agagcugcaauuucauguggug

SEQ ID NO: 943115 - RNA, 20 nt, Human
ugcuggggacauacagggug

SEQ ID NO: 943116 - RNA, 22 nt, Human
uguacaugugucuguauaucuu

SEQ ID NO: 943117 - RNA, 23 nt, Human
uggcuggcagaaacugaagcaug

SEQ ID NO: 943118 - RNA, 17 nt, Human
uggcucugaggcugaau

SEQ ID NO: 943119 - RNA, 22 nt, Human
cugcuuugggcagcuuuguggc

SEQ ID NO: 943120 - RNA, 21 nt, Human
aggugggagaccauguagguc

SEQ ID NO: 943121 - RNA, 22 nt, Human
uuaacagacauauauauuugua

SEQ ID NO: 943122 - RNA, 19 nt, Human
ccucugcuccaguuuccuu

SEQ ID NO: 943123 - RNA, 22 nt, Human
uaggagaggugaauggcacacu

SEQ ID NO: 943124 - RNA, 22 nt, Human
cugcagccuaggugcagcuggg

SEQ ID NO: 943125 - RNA, 22 nt, Human
uggccugccugggagcagcagg

SEQ ID NO: 943126 - RNA, 17 nt, Human
guuugcaugguguuaac

SEQ ID NO: 943127 - RNA, 22 nt, Human
uccaggagagguguggggacug

SEQ ID NO: 943128 - RNA, 21 nt, Human
uucuucuuggacuguuuuggc

SEQ ID NO: 943129 - RNA, 22 nt, Human
uuugcauuaguuuagauuucaa

SEQ ID NO: 943130 - RNA, 22 nt, Human
uauaucauggagauuaacauuc

SEQ ID NO: 943131 - RNA, 22 nt, Human
ucaaaugcucuuugcagagagg

SEQ ID NO: 943132 - RNA, 22 nt, Human
ggcuggucacaccacugcaggg

SEQ ID NO: 943133 - RNA, 22 nt, Human
auuauguagcuaaaaauugugu

SEQ ID NO: 943134 - RNA, 22 nt, Human
gaggggcucuuuaauaguaaca

SEQ ID NO: 943135 - RNA, 22 nt, Human
uuggcugaagguuaagugcugg

SEQ ID NO: 943136 - RNA, 18 nt, Human
gggaucaggcugccuagg

SEQ ID NO: 943137 - RNA, 22 nt, Human
auuguauaacagcauguauuuu

SEQ ID NO: 943138 - RNA, 23 nt, Human
uccagcagccaagaaggguagaa

SEQ ID NO: 943139 - RNA, 22 nt, Human
uagaaaugcccagauucugcua

SEQ ID NO: 943140 - RNA, 22 nt, Human
ucuguggcacgauugcacugca

SEQ ID NO: 943141 - RNA, 22 nt, Human
aaaccuauuggcaagaauaaua

SEQ ID NO: 943142 - RNA, 18 nt, Human
gugcugugggcaguggcc

SEQ ID NO: 943143 - RNA, 22 nt, Human
uggcucaggggucuggcucugu

SEQ ID NO: 943144 - RNA, 22 nt, Human
uacagccucacauuuacuuaca

SEQ ID NO: 943145 - RNA, 22 nt, Human
ucugucacuuuuauuuacugaa

SEQ ID NO: 943146 - RNA, 19 nt, Human
uaaaaugucuguggucagu

SEQ ID NO: 943147 - RNA, 22 nt, Human
ucucagggcagcaaggaagcau

SEQ ID NO: 943148 - RNA, 22 nt, Human
augugucugugggcacacacac

SEQ ID NO: 943149 - RNA, 22 nt, Human
gcuggugccuuguuguuguuac

SEQ ID NO: 943150 - RNA, 22 nt, Human
guggcugguuuccugcaugcaa

SEQ ID NO: 943151 - RNA, 22 nt, Human
ucuggagcaacagagcaggaca

SEQ ID NO: 943152 - RNA, 22 nt, Human
uuugaaaggaauuaggaugaca

SEQ ID NO: 943153 - RNA, 22 nt, Human
gagagugagauccuccugggga

SEQ ID NO: 943154 - RNA, 22 nt, Human
gagggcugcaaugagacagaga

SEQ ID NO: 943155 - RNA, 22 nt, Human
agauacauuguucuaagcauug

SEQ ID NO: 943156 - RNA, 22 nt, Human
aggcugcucaguagauggagcu

SEQ ID NO: 943157 - RNA, 22 nt, Human
aaggcagagggcuggaucagag

SEQ ID NO: 943158 - RNA, 22 nt, Human
gcagagccgugaauggauuuca

SEQ ID NO: 943159 - RNA, 18 nt, Human
ucucuuuuccccucauug

SEQ ID NO: 943160 - RNA, 22 nt, Human
ucugcucagugcuuaucucuaa

SEQ ID NO: 943161 - RNA, 20 nt, Human
cuucuucauuaacccuacug

SEQ ID NO: 943162 - RNA, 22 nt, Human
ugcccaaguguuuggcugaguc

SEQ ID NO: 943163 - RNA, 20 nt, Human
ucuccuggucugguccgugc

SEQ ID NO: 943164 - RNA, 22 nt, Human
aggagccaagcagaacuaagga

SEQ ID NO: 943165 - RNA, 22 nt, Human
auuuuuccaugauacuuaucug

SEQ ID NO: 943166 - RNA, 22 nt, Human
uguccucuuccagugcuccuuc

SEQ ID NO: 943167 - RNA, 22 nt, Human
ugggggcauggaccagccuggc

SEQ ID NO: 943168 - RNA, 22 nt, Human
uaaagucaucuuuacaucuuug

SEQ ID NO: 943169 - RNA, 22 nt, Human
agacucaagcagauaggaauua

SEQ ID NO: 943170 - RNA, 22 nt, Human
uaaaucagccuuugcuauuuua

SEQ ID NO: 943171 - RNA, 22 nt, Human
cugccuggaaugccagcuucuc

SEQ ID NO: 943172 - RNA, 22 nt, Human
cugugucuucugcuuacagucu

SEQ ID NO: 943173 - RNA, 22 nt, Human
agcuuguuagaaauguagacuc

SEQ ID NO: 943174 - RNA, 22 nt, Human
acauguuagaaaugcagaaucu

SEQ ID NO: 943175 - RNA, 22 nt, Human
auauuucuccaaauguuuucaa

SEQ ID NO: 943176 - RNA, 22 nt, Human
ccuguucaagggaugauugacc

SEQ ID NO: 943177 - RNA, 22 nt, Human
uccuucaguuaucacaguacug

SEQ ID NO: 943178 - RNA, 18 nt, Human
agcuggcccuggcugccg

SEQ ID NO: 943179 - RNA, 22 nt, Human
uguauuuuuaggaaugcgcuau

SEQ ID NO: 943180 - RNA, 22 nt, Human
acucugccuuucagcagaugaa

SEQ ID NO: 943181 - RNA, 22 nt, Human
acuugcugguggcauuuacagu

SEQ ID NO: 943182 - RNA, 22 nt, Human
agggcagagcugucuaaauggc

SEQ ID NO: 943183 - RNA, 22 nt, Human
cagcugaggucaaagaagcagg

SEQ ID NO: 943184 - RNA, 22 nt, Human
agacuuugagcucuuagagaag

SEQ ID NO: 943185 - RNA, 22 nt, Human
ucacgagaggcacagaauagag

SEQ ID NO: 943186 - RNA, 20 nt, Human
ccucucugaagaggucaucu

SEQ ID NO: 943187 - RNA, 22 nt, Human
ugguggccuugauggcaucugc

SEQ ID NO: 943188 - RNA, 22 nt, Human
cugggagcggcugucacugguu

SEQ ID NO: 943189 - RNA, 22 nt, Human
gaaaucugcuucuugcauagua

SEQ ID NO: 943190 - RNA, 15 nt, Human
uggcagcuuguuaag

SEQ ID NO: 943191 - RNA, 19 nt, Human
ugucucugaaagaugagcu

SEQ ID NO: 943192 - RNA, 22 nt, Human
ggagccuggcaaugcugcgucc

SEQ ID NO: 943193 - RNA, 17 nt, Human
agaacuguaguagcucc

SEQ ID NO: 943194 - RNA, 22 nt, Human
cucagagaagucuuugcuaaac

SEQ ID NO: 943195 - RNA, 22 nt, Human
cuuauuagaguuguguucuguu

SEQ ID NO: 943196 - RNA, 22 nt, Human
caggcugggaacgccacccgcu

SEQ ID NO: 943197 - RNA, 22 nt, Human
ggcuucaccaggugcaugcaug

SEQ ID NO: 943198 - RNA, 22 nt, Human
ucaggcugaggucaucugcauc

SEQ ID NO: 943199 - RNA, 22 nt, Human
ccaggguggcguagaugcuggg

SEQ ID NO: 943200 - RNA, 22 nt, Human
aauuucagagguagagauucua

SEQ ID NO: 943201 - RNA, 22 nt, Human
cccaggaguuugaguucagcau

SEQ ID NO: 943202 - RNA, 22 nt, Human
ugggcugcuguuacaggggcug

SEQ ID NO: 943203 - RNA, 22 nt, Human
auucugucuuuuuaaaauaaua

SEQ ID NO: 943204 - RNA, 22 nt, Human
acuggcucagaguuccuagaga

SEQ ID NO: 943205 - RNA, 22 nt, Human
acagugucaugucguguucccc

SEQ ID NO: 943206 - RNA, 22 nt, Human
gaucuguuauaaucucuuuuau

SEQ ID NO: 943207 - RNA, 22 nt, Human
agccucucuccagcuuggcaga

SEQ ID NO: 943208 - RNA, 22 nt, Human
gggguugguuuaaaugcuugag

SEQ ID NO: 943209 - RNA, 22 nt, Human
agcaccugcuaugugucaggga

SEQ ID NO: 943210 - RNA, 22 nt, Human
uugugugguagcuucauugaac

SEQ ID NO: 943211 - RNA, 22 nt, Human
cucaggauggaagccuacagga

SEQ ID NO: 943212 - RNA, 22 nt, Human
aggacccagaggcagaggacgu

SEQ ID NO: 943213 - RNA, 22 nt, Human
uggcuuccaaaggaaugggccu

SEQ ID NO: 943214 - RNA, 23 nt, Human
gggcagcuuaagcuuguuuuucu

SEQ ID NO: 943215 - RNA, 22 nt, Human
gaggcaguguuuacugcccugu

SEQ ID NO: 943216 - RNA, 22 nt, Human
gcaggaagcauagaagaaugcc

SEQ ID NO: 943217 - RNA, 22 nt, Human
agcaggaguuugaugcuuuuau

SEQ ID NO: 943218 - RNA, 22 nt, Human
cugcaggcugagcgccugccgg

SEQ ID NO: 943219 - RNA, 22 nt, Human
agagcagcacguuguccccaca

SEQ ID NO: 943220 - RNA, 22 nt, Human
ugggcagcuuccacuuaguuag

SEQ ID NO: 943221 - RNA, 23 nt, Human
acagacaacacugaugagagaaa

SEQ ID NO: 943222 - RNA, 22 nt, Human
aggcucaggcaggaauggcgga

SEQ ID NO: 943223 - RNA, 22 nt, Human
uuuuauauugagugagaguucc

SEQ ID NO: 943224 - RNA, 22 nt, Human
cacuguguaagaagaugggcuu

SEQ ID NO: 943225 - RNA, 22 nt, Human
guggccuggaguuugauguagg

SEQ ID NO: 943226 - RNA, 22 nt, Human
caggaggcuccuagggcucugu

SEQ ID NO: 943227 - RNA, 22 nt, Human
uuucagaaagcugaacauauga

SEQ ID NO: 943228 - RNA, 22 nt, Human
caagagcauuuaguuagcuggu

SEQ ID NO: 943229 - RNA, 22 nt, Human
gaggagcugggcugagaggguc

SEQ ID NO: 943230 - RNA, 22 nt, Human
aucuggcucaccuggguaaaua

SEQ ID NO: 943231 - RNA, 22 nt, Human
uaacagaaauauuuccagguga

SEQ ID NO: 943232 - RNA, 22 nt, Human
uaacagaaaagaacugaguuug

SEQ ID NO: 943233 - RNA, 22 nt, Human
uacaaaguuuucuuggauugag

SEQ ID NO: 943234 - RNA, 22 nt, Human
gccuucugcgcucgugucuccg

SEQ ID NO: 943235 - RNA, 22 nt, Human
aagucacagcuaaauagcuaag

SEQ ID NO: 943236 - RNA, 22 nt, Human
aauacauauggaauuccauguu

SEQ ID NO: 943237 - RNA, 22 nt, Human
agaaaguucacugguauauuuu

SEQ ID NO: 943238 - RNA, 22 nt, Human
uccauuuucuugcucuagguaa

SEQ ID NO: 943239 - RNA, 22 nt, Human
ugcagggcuuccucuuggaguu

SEQ ID NO: 943240 - RNA, 22 nt, Human
ucagaggucccuagcaggagug

SEQ ID NO: 943241 - RNA, 22 nt, Human
caagggcucacggucugcuggg

SEQ ID NO: 943242 - RNA, 22 nt, Human
ucccagagcagaugugcuaaag

SEQ ID NO: 943243 - RNA, 22 nt, Human
ugcuuucaaaggcuuucuagau

SEQ ID NO: 943244 - RNA, 22 nt, Human
aguguugucaaacggcucagca

SEQ ID NO: 943245 - RNA, 22 nt, Human
cuacauuuuaauaagcugcuua

SEQ ID NO: 943246 - RNA, 22 nt, Human
ugagagaugaaguuaguuguuc

SEQ ID NO: 943247 - RNA, 22 nt, Human
ucugccuucgcugcucccugaa

SEQ ID NO: 943248 - RNA, 22 nt, Human
ucacucuguuuuacucacuguu

SEQ ID NO: 943249 - RNA, 19 nt, Human
agaggcagucuccaacagg

SEQ ID NO: 943250 - RNA, 22 nt, Human
ucugcaggcuuggaguggcagc

SEQ ID NO: 943251 - RNA, 22 nt, Human
ugacuucaaaggcucuacuccu

SEQ ID NO: 943252 - RNA, 22 nt, Human
cagggcuggauccuccagacuc

SEQ ID NO: 943253 - RNA, 22 nt, Human
cccagcauccucagggagcggg

SEQ ID NO: 943254 - RNA, 22 nt, Human
ggcucaggggccaggccugucc

SEQ ID NO: 943255 - RNA, 22 nt, Human
ggcaguggcuccucucuacucc

SEQ ID NO: 943256 - RNA, 22 nt, Human
ucuggcaggcaaucggcucugg

SEQ ID NO: 943257 - RNA, 22 nt, Human
auuuaagacugacuucaccagu

SEQ ID NO: 943258 - RNA, 22 nt, Human
ccacagagacagagcccagggu

SEQ ID NO: 943259 - RNA, 22 nt, Human
guaacagaggguuugcagauau

SEQ ID NO: 943260 - RNA, 20 nt, Human
gggcaguucaaugccacucu

SEQ ID NO: 943261 - RNA, 22 nt, Human
cagcuacuccucccaugacuuc

SEQ ID NO: 943262 - RNA, 22 nt, Human
ugccagggcugcuacuggcuga

SEQ ID NO: 943263 - RNA, 22 nt, Human
gugccugguuuggggaauguuc

SEQ ID NO: 943264 - RNA, 22 nt, Human
agcaacagcccugagguucaug

SEQ ID NO: 943265 - RNA, 22 nt, Human
ucagggcauggcugcacuuggc

SEQ ID NO: 943266 - RNA, 22 nt, Human
cuaugaaaggauuuggaguugu

SEQ ID NO: 943267 - RNA, 22 nt, Human
aagauuuccuggauguaauucc

SEQ ID NO: 943268 - RNA, 22 nt, Human
aagaguuuucuauaaucuuggc

SEQ ID NO: 943269 - RNA, 22 nt, Human
cgcuggccauagccuccugugu

SEQ ID NO: 943270 - RNA, 18 nt, Human
uggagccagcucuaggau

SEQ ID NO: 943271 - RNA, 22 nt, Human
agcagagccugggcuaggggug

SEQ ID NO: 943272 - RNA, 22 nt, Human
ccuggccagcuaauugcccauc

SEQ ID NO: 943273 - RNA, 22 nt, Human
auaucuuuguaugguucagcag

SEQ ID NO: 943274 - RNA, 22 nt, Human
ugaaaaggagccuuagguaggu

SEQ ID NO: 943275 - RNA, 22 nt, Human
cugcugcugagagcucagccug

SEQ ID NO: 943276 - RNA, 22 nt, Human
caaaucuauauguugauauucu

SEQ ID NO: 943277 - RNA, 22 nt, Human
gccagccugugggggcucugug

SEQ ID NO: 943278 - RNA, 22 nt, Human
cagcagcccacgcgugcugucc

SEQ ID NO: 943279 - RNA, 22 nt, Human
agaggccaugcuagaggccugg

SEQ ID NO: 943280 - RNA, 22 nt, Human
agccaggacguugcucagcucc

SEQ ID NO: 943281 - RNA, 22 nt, Human
agcccaggagguggagguugca

SEQ ID NO: 943282 - RNA, 22 nt, Human
uugucugucccagcuugugcau

SEQ ID NO: 943283 - RNA, 22 nt, Human
auucaaguucuucugucuuugc

SEQ ID NO: 943284 - RNA, 22 nt, Human
ggcacgugccuaaggagcaggc

SEQ ID NO: 943285 - RNA, 22 nt, Human
gccugcagaggugcugcuagcu

SEQ ID NO: 943286 - RNA, 19 nt, Human
aauacaguguuauagaauu

SEQ ID NO: 943287 - RNA, 22 nt, Human
acacaguaugaaaagucuaguu

SEQ ID NO: 943288 - RNA, 17 nt, Human
cacaggugugguuugag

SEQ ID NO: 943289 - RNA, 22 nt, Human
acagaaauugggcaaauggaag

SEQ ID NO: 943290 - RNA, 22 nt, Human
aguccagaccccggcagcuggu

SEQ ID NO: 943291 - RNA, 19 nt, Human
agggcugcucuggccuggg

SEQ ID NO: 943292 - RNA, 22 nt, Human
uggcagcuuccugcucauagga

SEQ ID NO: 943293 - RNA, 22 nt, Human
uggguagaggaauugggcuacc

SEQ ID NO: 943294 - RNA, 22 nt, Human
gagcucccuggagguucagaua

SEQ ID NO: 943295 - RNA, 22 nt, Human
ggccucugggguccugagccca

SEQ ID NO: 943296 - RNA, 22 nt, Human
ucuucucucauguaggagggaa

SEQ ID NO: 943297 - RNA, 22 nt, Human
aagccaggaagagagccuucac

SEQ ID NO: 943298 - RNA, 22 nt, Human
cccaggagauaacguucccaag

SEQ ID NO: 943299 - RNA, 22 nt, Human
guuacacaggaaaacauuagca

SEQ ID NO: 943300 - RNA, 22 nt, Human
aucucagggcuggagcccugga

SEQ ID NO: 943301 - RNA, 22 nt, Human
ccucucauagucuguauccuuu

SEQ ID NO: 943302 - RNA, 22 nt, Human
gaugcacagugacccugccagu

SEQ ID NO: 943303 - RNA, 22 nt, Human
uucuuaaagaggcaaaacacag

SEQ ID NO: 943304 - RNA, 22 nt, Human
ccccaggacacauggaccaagu

SEQ ID NO: 943305 - RNA, 22 nt, Human
accagagaaaacacagcaggcu

SEQ ID NO: 943306 - RNA, 22 nt, Human
cucacugugaccucagcagaca

SEQ ID NO: 943307 - RNA, 22 nt, Human
uccaggaggcagggcugugccc

SEQ ID NO: 943308 - RNA, 22 nt, Human
gaaaugugggucaugacccauu

SEQ ID NO: 943309 - RNA, 22 nt, Human
uucucauguaaaugccaucauc

SEQ ID NO: 943310 - RNA, 22 nt, Human
cuauguuuaucuguauuucugu

SEQ ID NO: 943311 - RNA, 22 nt, Human
uuuauuuauccuucuggauugc

SEQ ID NO: 943312 - RNA, 22 nt, Human
accuuuuuucagaacucuaaag

SEQ ID NO: 943313 - RNA, 17 nt, Human
ccuguguuugcuccuuc

SEQ ID NO: 943314 - RNA, 22 nt, Human
caguggguaggaaaggcucuuc

SEQ ID NO: 943315 - RNA, 22 nt, Human
gcaggagccacuucagggaugc

SEQ ID NO: 943316 - RNA, 22 nt, Human
uucuuaagcguaugauaaugaa

SEQ ID NO: 943317 - RNA, 21 nt, Human
guggcucugccaggacugaaa

SEQ ID NO: 943318 - RNA, 22 nt, Human
agggcagauggaacuuccccga

SEQ ID NO: 943319 - RNA, 22 nt, Human
acccaggccugagagacaggag

SEQ ID NO: 943320 - RNA, 22 nt, Human
auggccaacugaaaugaaagau

SEQ ID NO: 943321 - RNA, 22 nt, Human
ugagccagaggaggcugugugg

SEQ ID NO: 943322 - RNA, 20 nt, Human
cugcuguguuauuguagaac

SEQ ID NO: 943323 - RNA, 22 nt, Human
cagagccagcccacuguucccg

SEQ ID NO: 943324 - RNA, 22 nt, Human
aggcagcuuucuggugcaccau

SEQ ID NO: 943325 - RNA, 20 nt, Human
gagacagcaaaagccucucc

SEQ ID NO: 943326 - RNA, 19 nt, Human
uguguguuuauauauguau

SEQ ID NO: 943327 - RNA, 22 nt, Human
ccuggagcacucucccuggcug

SEQ ID NO: 943328 - RNA, 22 nt, Human
aagggcugaaugaaggguugaa

SEQ ID NO: 943329 - RNA, 17 nt, Human
ccucacagggaccagac

SEQ ID NO: 943330 - RNA, 22 nt, Human
auuguuaugaaaauaagauguu

SEQ ID NO: 943331 - RNA, 22 nt, Human
uugucugaaagaucauuacauu

SEQ ID NO: 943332 - RNA, 22 nt, Human
cagaccagcucuaugaacccaa

SEQ ID NO: 943333 - RNA, 22 nt, Human
ccugggugucaugggcagcugg

SEQ ID NO: 943334 - RNA, 22 nt, Human
gcacagaacagagaaauagcca

SEQ ID NO: 943335 - RNA, 22 nt, Human
ucugaggcuauguucaggcuaa

SEQ ID NO: 943336 - RNA, 22 nt, Human
ugcugccaagcccgugcuccug

SEQ ID NO: 943337 - RNA, 22 nt, Human
ggagugacucucggggccacua

SEQ ID NO: 943338 - RNA, 22 nt, Human
ucugcugucacucauuugcuuc

SEQ ID NO: 943339 - RNA, 22 nt, Human
uuagauaauguuauuguaauuu

SEQ ID NO: 943340 - RNA, 22 nt, Human
cggagaggugggggcagcaucu

SEQ ID NO: 943341 - RNA, 19 nt, Human
ccucuccgcccaccagccc

SEQ ID NO: 943342 - RNA, 22 nt, Human
gguugccggggcaggacuggaa

SEQ ID NO: 943343 - RNA, 20 nt, Human
uguuaaaggacacuugcuuu

SEQ ID NO: 943344 - RNA, 22 nt, Human
uuugaaguaccugguucugacu

SEQ ID NO: 943345 - RNA, 22 nt, Human
augaaacaugagaaauggagag

SEQ ID NO: 943346 - RNA, 22 nt, Human
aggauguucgggucacauagcc

SEQ ID NO: 943347 - RNA, 22 nt, Human
aucccuggacggcgccucccca

SEQ ID NO: 943348 - RNA, 22 nt, Human
cccagcugcaccucuauggccu

SEQ ID NO: 943349 - RNA, 19 nt, Human
ccuuccuccccagggccau

SEQ ID NO: 943350 - RNA, 20 nt, Human
ucagacuugauucuaugcua

SEQ ID NO: 943351 - RNA, 22 nt, Human
ggcagcugcaaaucugcucugu

SEQ ID NO: 943352 - RNA, 19 nt, Human
aggcaggugcagagguccc

SEQ ID NO: 943353 - RNA, 19 nt, Human
gccaggagggcucuggcug

SEQ ID NO: 943354 - RNA, 22 nt, Human
ucagcaguggcucucaugcagu

SEQ ID NO: 943355 - RNA, 22 nt, Human
ccucucuguguggccucuccau

SEQ ID NO: 943356 - RNA, 22 nt, Human
agagggcagggcgguaaguccu

SEQ ID NO: 943357 - RNA, 22 nt, Human
ggaaggagggcggcaaugauga

SEQ ID NO: 943358 - RNA, 22 nt, Human
ccugugccauccugagcauccc

SEQ ID NO: 943359 - RNA, 22 nt, Human
cagggccaagccccuuuggcug

SEQ ID NO: 943360 - RNA, 22 nt, Human
aggcucugugcagccugcaucu

SEQ ID NO: 943361 - RNA, 22 nt, Human
agaugcugccucuccucacaag

SEQ ID NO: 943362 - RNA, 22 nt, Human
uuggcagagaguaugcugaaga

SEQ ID NO: 943363 - RNA, 22 nt, Human
cugccaggcagggagauggcug

SEQ ID NO: 943364 - RNA, 22 nt, Human
ucuucccuaaucaccaucuuca

SEQ ID NO: 943365 - RNA, 22 nt, Human
agugaguggacccugcaaggaa

SEQ ID NO: 943366 - RNA, 23 nt, Human
agcaauaagaagggauacaugug

SEQ ID NO: 943367 - RNA, 22 nt, Human
cccaggaggcagagguugcagu

SEQ ID NO: 943368 - RNA, 22 nt, Human
gaggcagugcauugucuagggg

SEQ ID NO: 943369 - RNA, 19 nt, Human
ccagcccugucacuucuug

SEQ ID NO: 943370 - RNA, 22 nt, Human
agaggccagcagugccuaucug

SEQ ID NO: 943371 - RNA, 22 nt, Human
gggacagacccaugggccaggu

SEQ ID NO: 943372 - RNA, 22 nt, Human
ugcagaagcugcaggucagugg

SEQ ID NO: 943373 - RNA, 22 nt, Human
ugcuuggccuacuuguccuuug

SEQ ID NO: 943374 - RNA, 23 nt, Human
uuagagaugauuaaaaaaucuug

SEQ ID NO: 943375 - RNA, 22 nt, Human
acugggccggugcagaguaguu

SEQ ID NO: 943376 - RNA, 22 nt, Human
auccccagaaaauaggugccua

SEQ ID NO: 943377 - RNA, 22 nt, Human
ccuggagcaaaaaucuaaggag

SEQ ID NO: 943378 - RNA, 22 nt, Human
uaaggcacgcauaagagggggc

SEQ ID NO: 943379 - RNA, 19 nt, Human
ugcucauggggacuucucc

SEQ ID NO: 943380 - RNA, 22 nt, Human
aaguguagauuauggagugucu

SEQ ID NO: 943381 - RNA, 22 nt, Human
ccaaagucagugcucagucguc

SEQ ID NO: 943382 - RNA, 22 nt, Human
gagcccuccauggagccaggca

SEQ ID NO: 943383 - RNA, 22 nt, Human
ucuuagaaguucauguuccagc

SEQ ID NO: 943384 - RNA, 22 nt, Human
gcccagcacauugcugaggacc

SEQ ID NO: 943385 - RNA, 22 nt, Human
augacagaaggccucccugaca

SEQ ID NO: 943386 - RNA, 22 nt, Human
ggcagaggaaggaugaauucac

SEQ ID NO: 943387 - RNA, 22 nt, Human
auucacaaguugauggauauuu

SEQ ID NO: 943388 - RNA, 22 nt, Human
aaauaauuauagcgagucuauc

SEQ ID NO: 943389 - RNA, 22 nt, Human
auugacaaggaaacuauaccag

SEQ ID NO: 943390 - RNA, 22 nt, Human
agaaauguuuauggcugccuau

SEQ ID NO: 943391 - RNA, 22 nt, Human
uaaaaguuuuaguuguacauaa

SEQ ID NO: 943392 - RNA, 22 nt, Human
ucagggcucaccagccucugcc

SEQ ID NO: 943393 - RNA, 22 nt, Human
acucaggagggaucagcuauca

SEQ ID NO: 943394 - RNA, 20 nt, Human
cauuuguuagcuuucuacug

SEQ ID NO: 943395 - RNA, 22 nt, Human
cccaguccuaaagcagacgcca

SEQ ID NO: 943396 - RNA, 20 nt, Human
gagauuuccaaucaugccca

SEQ ID NO: 943397 - RNA, 22 nt, Human
ugcucuggggagcuccucugcg

SEQ ID NO: 943398 - RNA, 22 nt, Human
aggcagggucuugcuauguugc

SEQ ID NO: 943399 - RNA, 22 nt, Human
aggcaggcacuccggaaguguc

SEQ ID NO: 943400 - RNA, 22 nt, Human
gcugucagaaggugaaggguaa

SEQ ID NO: 943401 - RNA, 22 nt, Human
ucccaggaugugcgugccgccg

SEQ ID NO: 943402 - RNA, 22 nt, Human
aggcagcaaagaaaugaugcug

SEQ ID NO: 943403 - RNA, 22 nt, Human
ucugucacucuagagauggcag

SEQ ID NO: 943404 - RNA, 22 nt, Human
cagagccugcucacgucucugu

SEQ ID NO: 943405 - RNA, 22 nt, Human
ccaggagucuggaugagguguc

SEQ ID NO: 943406 - RNA, 17 nt, Human
cagcugugagagccuua

SEQ ID NO: 943407 - RNA, 22 nt, Human
cugggcugcaguuccugguccu

SEQ ID NO: 943408 - RNA, 19 nt, Human
aagaagcaauaagcuguga

SEQ ID NO: 943409 - RNA, 22 nt, Human
cauaucccauuggccaggacau

SEQ ID NO: 943410 - RNA, 22 nt, Human
ugggccugccccaggcuucagc

SEQ ID NO: 943411 - RNA, 19 nt, Human
ggaagagaggaaaggugga

SEQ ID NO: 943412 - RNA, 22 nt, Human
agccaaagaucagugugcaagu

SEQ ID NO: 943413 - RNA, 21 nt, Human
cccaggaggcugagaagagca

SEQ ID NO: 943414 - RNA, 22 nt, Human
ugcagcugcuugauucaucuug

SEQ ID NO: 943415 - RNA, 22 nt, Human
acccagaggugucuagcaagcu

SEQ ID NO: 943416 - RNA, 22 nt, Human
ugacacauuaaaugcucacaaa

SEQ ID NO: 943417 - RNA, 22 nt, Human
agcuucuggaagccuggcagca

SEQ ID NO: 943418 - RNA, 22 nt, Human
ucccucagaaauucucucugaa

SEQ ID NO: 943419 - RNA, 22 nt, Human
uuuacagaaugucaauuucuau

SEQ ID NO: 943420 - RNA, 22 nt, Human
acagagcaauucuuggguguuu

SEQ ID NO: 943421 - RNA, 22 nt, Human
ggcaucuguccaucucuccagc

SEQ ID NO: 943422 - RNA, 22 nt, Human
agcaccugccugcauuggcuau

SEQ ID NO: 943423 - RNA, 22 nt, Human
aguuuucacacucaccaaaagg

SEQ ID NO: 943424 - RNA, 22 nt, Human
cuggcaggucucgcugacgugu

SEQ ID NO: 943425 - RNA, 22 nt, Human
uuuguucugaaaacucaagucc

SEQ ID NO: 943426 - RNA, 22 nt, Human
cuuguauuccccuaucucuaaa

SEQ ID NO: 943427 - RNA, 22 nt, Human
acagaacuuccugcuggagugg

SEQ ID NO: 943428 - RNA, 22 nt, Human
caacugagcaguagcgucugga

SEQ ID NO: 943429 - RNA, 22 nt, Human
gcugagcuagaaaaggaccaca

SEQ ID NO: 943430 - RNA, 22 nt, Human
aaguucaagucuccugaguaua

SEQ ID NO: 943431 - RNA, 22 nt, Human
cugcugugagugguucuugccu

SEQ ID NO: 943432 - RNA, 21 nt, Human
ucagaacaauuccaugccucc

SEQ ID NO: 943433 - RNA, 22 nt, Human
uggcagcugcaggccuccugag

SEQ ID NO: 943434 - RNA, 22 nt, Human
cuggcucaggguggucuggguc

SEQ ID NO: 943435 - RNA, 22 nt, Human
uuugcauuaucucacuuauaua

SEQ ID NO: 943436 - RNA, 22 nt, Human
gagcagugaagacagaaguaca

SEQ ID NO: 943437 - RNA, 22 nt, Human
uccugccuugccugggacauca

SEQ ID NO: 943438 - RNA, 22 nt, Human
auuuauguaucuguguagauca

SEQ ID NO: 943439 - RNA, 22 nt, Human
ccaggagaagcaucugagugua

SEQ ID NO: 943440 - RNA, 22 nt, Human
cuucuuaaugacagauuaaaau

SEQ ID NO: 943441 - RNA, 22 nt, Human
uuuggccacagauccuuggggg

SEQ ID NO: 943442 - RNA, 22 nt, Human
guugggaagcagauggaugagc

SEQ ID NO: 943443 - RNA, 22 nt, Human
uauugaaaugaaugacagugau

SEQ ID NO: 943444 - RNA, 22 nt, Human
agucucugccagcuuguccucu

SEQ ID NO: 943445 - RNA, 22 nt, Human
acaggugggcuuaagagucggc

SEQ ID NO: 943446 - RNA, 22 nt, Human
auggccaaggggccuaggcagg

SEQ ID NO: 943447 - RNA, 22 nt, Human
cccaggagagagacuugaaucu

SEQ ID NO: 943448 - RNA, 22 nt, Human
uugaaucauuacaauagauaag

SEQ ID NO: 943449 - RNA, 22 nt, Human
cauuuguuaaccaguguggauu

SEQ ID NO: 943450 - RNA, 22 nt, Human
guuauuuuaucucugagagguu

SEQ ID NO: 943451 - RNA, 22 nt, Human
guggcugcagagggcacagcau

SEQ ID NO: 943452 - RNA, 22 nt, Human
acagaaauauagaagguaggaa

SEQ ID NO: 943453 - RNA, 22 nt, Human
uggcagagucucuccuuuccag

SEQ ID NO: 943454 - RNA, 22 nt, Human
aucauguuccagaaacagugau

SEQ ID NO: 943455 - RNA, 22 nt, Human
gaaggccaguuuugagauaggu

SEQ ID NO: 943456 - RNA, 22 nt, Human
ggccugucucacccccgggugc

SEQ ID NO: 943457 - RNA, 22 nt, Human
ugggagcagccucagcuucggg

SEQ ID NO: 943458 - RNA, 22 nt, Human
agcaggaaguagucuguaagca

SEQ ID NO: 943459 - RNA, 19 nt, Human
gagcccucuccauggccac

SEQ ID NO: 943460 - RNA, 22 nt, Human
guuguauucuucaauaucagag

SEQ ID NO: 943461 - RNA, 22 nt, Human
aaaaaucacuuuuauaggcagc

SEQ ID NO: 943462 - RNA, 22 nt, Human
aaguguauauaugacuuauaaa

SEQ ID NO: 943463 - RNA, 22 nt, Human
ugucagaacucuauugaugucc

SEQ ID NO: 943464 - RNA, 22 nt, Human
ggucccagcugcucaagaggcu

SEQ ID NO: 943465 - RNA, 22 nt, Human
caaagguauaaguuaauauaca

SEQ ID NO: 943466 - RNA, 20 nt, Human
acaauagauuugagcaaagu

SEQ ID NO: 943467 - RNA, 22 nt, Human
cuguauuuguccucuauuuauu

SEQ ID NO: 943468 - RNA, 22 nt, Human
aaggcugcuuuuaacaugcaua

SEQ ID NO: 943469 - RNA, 20 nt, Human
cugcccagccacugagggau

SEQ ID NO: 943470 - RNA, 22 nt, Human
ucaaauaccagcaauuucaugu

SEQ ID NO: 943471 - RNA, 22 nt, Human
uuaacagagugccuggcaugua

SEQ ID NO: 943472 - RNA, 22 nt, Human
aaucacaauuacuuuugcacca

SEQ ID NO: 943473 - RNA, 22 nt, Human
ucagcaggcgguuccuuguggg

SEQ ID NO: 943474 - RNA, 18 nt, Human
uccugccugugccccagg

SEQ ID NO: 943475 - RNA, 22 nt, Human
augucacauggccuguacuuug

SEQ ID NO: 943476 - RNA, 22 nt, Human
aagacuuucucccaaauccuca

SEQ ID NO: 943477 - RNA, 22 nt, Human
ugaugaaauguugaggcaguga

SEQ ID NO: 943478 - RNA, 22 nt, Human
gagaccaggaaguacagcagcc

SEQ ID NO: 943479 - RNA, 22 nt, Human
ucaggcugccuaucagacugug

SEQ ID NO: 943480 - RNA, 22 nt, Human
ucagucucagcaccuagucaca

SEQ ID NO: 943481 - RNA, 22 nt, Human
uuuuaguguagucaccgugggu

SEQ ID NO: 943482 - RNA, 22 nt, Human
cagagccuuccuagcagacucu

SEQ ID NO: 943483 - RNA, 22 nt, Human
ugcuggcugggcugcuggagac

SEQ ID NO: 943484 - RNA, 22 nt, Human
aagagcuggcccaaucugagca

SEQ ID NO: 943485 - RNA, 22 nt, Human
uguacuuccccaaugacagcac

SEQ ID NO: 943486 - RNA, 22 nt, Human
cuggcccaggaagacguguccc

SEQ ID NO: 943487 - RNA, 21 nt, Human
aacauuucugggagaacucac

SEQ ID NO: 943488 - RNA, 23 nt, Human
cagaccuggcagucauccucaac

SEQ ID NO: 943489 - RNA, 22 nt, Human
aaagccuugagauccuauaguu

SEQ ID NO: 943490 - RNA, 22 nt, Human
ccagaggcuggcaagggcuccu

SEQ ID NO: 943491 - RNA, 22 nt, Human
cagcagcuacuuggagcagcag

SEQ ID NO: 943492 - RNA, 22 nt, Human
accucaggauguggacacagaa

SEQ ID NO: 943493 - RNA, 23 nt, Human
aggcccaacucugugagggcugc

SEQ ID NO: 943494 - RNA, 22 nt, Human
caagggcucuuuugaggaaugu

SEQ ID NO: 943495 - RNA, 22 nt, Human
uuuccucuccaccaggaggucu

SEQ ID NO: 943496 - RNA, 19 nt, Human
caugcugaccugcuguggu

SEQ ID NO: 943497 - RNA, 22 nt, Human
gcucugcuaauauuguaguacc

SEQ ID NO: 943498 - RNA, 22 nt, Human
gccagggggucagcaggcacuu

SEQ ID NO: 943499 - RNA, 22 nt, Human
cuggcuccauccuugagcucug

SEQ ID NO: 943500 - RNA, 22 nt, Human
cccaggaccgcgcggcugagcg

SEQ ID NO: 943501 - RNA, 22 nt, Human
uuuuccucugcaauaaaagcag

SEQ ID NO: 943502 - RNA, 22 nt, Human
cugcacaguuugauuucuugcu

SEQ ID NO: 943503 - RNA, 22 nt, Human
agugcuguuagguuaauauagu

SEQ ID NO: 943504 - RNA, 22 nt, Human
acguuuucagccuuaauguaga

SEQ ID NO: 943505 - RNA, 22 nt, Human
gcagggacaccuuugugaagcu

SEQ ID NO: 943506 - RNA, 22 nt, Human
ccagggagccuggugugucagc

SEQ ID NO: 943507 - RNA, 22 nt, Human
ggccaggaagggaagaucagca

SEQ ID NO: 943508 - RNA, 22 nt, Human
uccuucagcuuauuucuuagga

SEQ ID NO: 943509 - RNA, 20 nt, Human
ugaaggccagcagcauaggg

SEQ ID NO: 943510 - RNA, 22 nt, Human
aauuuuaaucaguggugcugag

SEQ ID NO: 943511 - RNA, 22 nt, Human
auuagcauauuaaauagucauu

SEQ ID NO: 943512 - RNA, 22 nt, Human
uauuuguauuucaugcaguaaa

SEQ ID NO: 943513 - RNA, 22 nt, Human
agaggcugcacuugcucaugau

SEQ ID NO: 943514 - RNA, 22 nt, Human
agcugaugccauguggaacagu

SEQ ID NO: 943515 - RNA, 22 nt, Human
ugccugaugcaggaguaucaga

SEQ ID NO: 943516 - RNA, 22 nt, Human
cugugcugauucagcacaggcc

SEQ ID NO: 943517 - RNA, 22 nt, Human
cugcugggcagaggcugcauga

SEQ ID NO: 943518 - RNA, 22 nt, Human
gaggcgagaagcuggagauggu

SEQ ID NO: 943519 - RNA, 22 nt, Human
cuauuuaugugcuauuuuguau

SEQ ID NO: 943520 - RNA, 22 nt, Human
gggaaggagccugcuugcuaga

SEQ ID NO: 943521 - RNA, 22 nt, Human
uauuuugucuucugcucaucac

SEQ ID NO: 943522 - RNA, 22 nt, Human
gaguuauuagucaaauagggaa

SEQ ID NO: 943523 - RNA, 22 nt, Human
agggaaauuaaugugagcaaug

SEQ ID NO: 943524 - RNA, 20 nt, Human
ucucaggguucagcaaagua

SEQ ID NO: 943525 - RNA, 22 nt, Human
uagagcuggaaaacugcaggua

SEQ ID NO: 943526 - RNA, 22 nt, Human
aggcuucuaggguuggcagcgg

SEQ ID NO: 943527 - RNA, 22 nt, Human
uaagcuauuccugaagaagguu

SEQ ID NO: 943528 - RNA, 22 nt, Human
cugggagcccugacuagccugg

SEQ ID NO: 943529 - RNA, 22 nt, Human
ugaagccagcuuuggaagacac

SEQ ID NO: 943530 - RNA, 22 nt, Human
guuuuauuuccaugagagaccg

SEQ ID NO: 943531 - RNA, 22 nt, Human
ugcacacacaugaaguagcaug

SEQ ID NO: 943532 - RNA, 22 nt, Human
agggggugcuacuuccagaguu

SEQ ID NO: 943533 - RNA, 23 nt, Human
uauggcaugguacuuccagcaga

SEQ ID NO: 943534 - RNA, 22 nt, Human
gagauuggccuggcuugccaac

SEQ ID NO: 943535 - RNA, 22 nt, Human
cuugaaagcuuugcgucuucua

SEQ ID NO: 943536 - RNA, 22 nt, Human
uugcacagaugagggugaugcu

SEQ ID NO: 943537 - RNA, 22 nt, Human
uucacauugguucuugauagcu

SEQ ID NO: 943538 - RNA, 22 nt, Human
cuggcucaccuccgcuccagca

SEQ ID NO: 943539 - RNA, 22 nt, Human
ggcugccugggagcccuccucu

SEQ ID NO: 943540 - RNA, 22 nt, Human
auaaauaucacuguugucccuc

SEQ ID NO: 943541 - RNA, 22 nt, Human
auaaacagcuccauuuagugcc

SEQ ID NO: 943542 - RNA, 22 nt, Human
cuggggcccaucgagggcugag

SEQ ID NO: 943543 - RNA, 22 nt, Human
ggcagcaguggcugcuauuguc

SEQ ID NO: 943544 - RNA, 22 nt, Human
agagcuguucaacguagcaaug

SEQ ID NO: 943545 - RNA, 22 nt, Human
ucaaaaguuucacauagagaua

SEQ ID NO: 943546 - RNA, 22 nt, Human
guggccuggaaaggcuggucug

SEQ ID NO: 943547 - RNA, 22 nt, Human
uuccucuccucacaugagucac

SEQ ID NO: 943548 - RNA, 22 nt, Human
acucuuuuauaaagcaucuuga

SEQ ID NO: 943549 - RNA, 22 nt, Human
ccugccuggagcugagugugga

SEQ ID NO: 943550 - RNA, 22 nt, Human
cugggccucauccucagaguuu

SEQ ID NO: 943551 - RNA, 22 nt, Human
uugaacauuaacuucagucuau

SEQ ID NO: 943552 - RNA, 22 nt, Human
gccccugggagcagagccacca

SEQ ID NO: 943553 - RNA, 22 nt, Human
uucuuaacuggaaaaugucaga

SEQ ID NO: 943554 - RNA, 22 nt, Human
cacuggggaaaacaggcuucuu

SEQ ID NO: 943555 - RNA, 22 nt, Human
ucacaaaugaggaaaucgagca

SEQ ID NO: 943556 - RNA, 22 nt, Human
aggugcagcugguggagucugg

SEQ ID NO: 943557 - RNA, 22 nt, Human
ucacaggagagcugaugcuggu

SEQ ID NO: 943558 - RNA, 22 nt, Human
aaaugugcuucuuacucucaau

SEQ ID NO: 943559 - RNA, 22 nt, Human
ccuuccagaguucagucugccc

SEQ ID NO: 943560 - RNA, 22 nt, Human
aaagucauuguaauauaugcua

SEQ ID NO: 943561 - RNA, 22 nt, Human
uggagcaggacugcugcccuca

SEQ ID NO: 943562 - RNA, 22 nt, Human
cucugugcccuacugcucagcu

SEQ ID NO: 943563 - RNA, 22 nt, Human
cugggcuacguguugacagcau

SEQ ID NO: 943564 - RNA, 22 nt, Human
auuguaaguagaaauguuaugg

SEQ ID NO: 943565 - RNA, 22 nt, Human
ucacaaaucauuuuaucugugu

SEQ ID NO: 943566 - RNA, 22 nt, Human
ugcagccaucgcagagucugua

SEQ ID NO: 943567 - RNA, 22 nt, Human
ccagggcaaaugagaucauagc

SEQ ID NO: 943568 - RNA, 22 nt, Human
gcguggugcugcccugcacaca

SEQ ID NO: 943569 - RNA, 19 nt, Human
gccacuccugaugcugccc

SEQ ID NO: 943570 - RNA, 22 nt, Human
aaauuauucucauguguuucuu

SEQ ID NO: 943571 - RNA, 23 nt, Human
uuuauccaacucuguaaucucuc

SEQ ID NO: 943572 - RNA, 21 nt, Human
ggcagcucagcagauggggac

SEQ ID NO: 943573 - RNA, 22 nt, Human
agcagcucuguuuaccuggagg

SEQ ID NO: 943574 - RNA, 22 nt, Human
uuucauggcuaggacuagagug

SEQ ID NO: 943575 - RNA, 22 nt, Human
cuggggaggcagggcugccccu

SEQ ID NO: 943576 - RNA, 22 nt, Human
gcaggagacuggcugugguagu

SEQ ID NO: 943577 - RNA, 22 nt, Human
ggggccuguagagcuucaggga

SEQ ID NO: 943578 - RNA, 22 nt, Human
cccagggucccugcucucugug

SEQ ID NO: 943579 - RNA, 22 nt, Human
gccuggagagcacugugcgcuu

SEQ ID NO: 943580 - RNA, 22 nt, Human
agaggccuccgaaaggugggcu

SEQ ID NO: 943581 - RNA, 22 nt, Human
cacagggcaggccccaggccuc

SEQ ID NO: 943582 - RNA, 22 nt, Human
aggaagccugcaggugacugcu

SEQ ID NO: 943583 - RNA, 22 nt, Human
guugaaagagcauggacuugaa

SEQ ID NO: 943584 - RNA, 22 nt, Human
cagaaggcuuuguggaguagac

SEQ ID NO: 943585 - RNA, 22 nt, Human
uggcacugccuggcagggcccc

SEQ ID NO: 943586 - RNA, 22 nt, Human
gggcagcuagcccucuagccca

SEQ ID NO: 943587 - RNA, 22 nt, Human
cagcauggggcuuggagucagc

SEQ ID NO: 943588 - RNA, 22 nt, Human
ggcuucucucccccagcuccac

SEQ ID NO: 943589 - RNA, 22 nt, Human
gaucuucuagcagaaguaauuu

SEQ ID NO: 943590 - RNA, 18 nt, Human
cugagggcagccccuggg

SEQ ID NO: 943591 - RNA, 22 nt, Human
guuuaagaaaauucauguuguu

SEQ ID NO: 943592 - RNA, 22 nt, Human
caggagcaaggagcagugggau

SEQ ID NO: 943593 - RNA, 22 nt, Human
uccucaggugacuagguaucuu

SEQ ID NO: 943594 - RNA, 22 nt, Human
uaauguguugaauauuuguaca

SEQ ID NO: 943595 - RNA, 22 nt, Human
ucucagaguuuacggggcugaa

SEQ ID NO: 943596 - RNA, 22 nt, Human
aauucacaauguguagucaugc

SEQ ID NO: 943597 - RNA, 22 nt, Human
gccuccugguugcuucuccaac

SEQ ID NO: 943598 - RNA, 22 nt, Human
cugugucucguuaaagcauugg

SEQ ID NO: 943599 - RNA, 22 nt, Human
uggccagguugggcuuugcagc

SEQ ID NO: 943600 - RNA, 18 nt, Human
auguauguacauauuuau

SEQ ID NO: 943601 - RNA, 22 nt, Human
ccuggcuggcaagaucgugaag

SEQ ID NO: 943602 - RNA, 22 nt, Human
auaguuugaaggcuguucuacu

SEQ ID NO: 943603 - RNA, 22 nt, Human
ggacucagcagccaggaguggc

SEQ ID NO: 943604 - RNA, 22 nt, Human
uacaucauaauaauacuuagaa

SEQ ID NO: 943605 - RNA, 22 nt, Human
acucugccccgaguucugggaa

SEQ ID NO: 943606 - RNA, 22 nt, Human
uuuaucagagauauguguggac

SEQ ID NO: 943607 - RNA, 22 nt, Human
ccacagagagugucagccuuug

SEQ ID NO: 943608 - RNA, 22 nt, Human
uccucaugccgggucucacgcu

SEQ ID NO: 943609 - RNA, 22 nt, Human
aauauccagguagaugucuucu

SEQ ID NO: 943610 - RNA, 22 nt, Human
ugccucagucuaaagucucuca

SEQ ID NO: 943611 - RNA, 23 nt, Human
agacagaggcugaggcuggccgc

SEQ ID NO: 943612 - RNA, 22 nt, Human
uccucccacauaggacaauggg

SEQ ID NO: 943613 - RNA, 23 nt, Human
ucccagccucuucucuugcauac

SEQ ID NO: 943614 - RNA, 23 nt, Human
aguaaagcaauuguuggcgagag

SEQ ID NO: 943615 - RNA, 22 nt, Human
gucaaguuuauccgcucauuca

SEQ ID NO: 943616 - RNA, 22 nt, Human
cagcccuggugccaagguuccc

SEQ ID NO: 943617 - RNA, 22 nt, Human
cugcaguguucuggaaugcauu

SEQ ID NO: 943618 - RNA, 22 nt, Human
ucagucuucccuccagugcaac

SEQ ID NO: 943619 - RNA, 23 nt, Human
aguacauucgaaaaauucuguga

SEQ ID NO: 943620 - RNA, 22 nt, Human
gagagugaugaaugguuaaaca

SEQ ID NO: 943621 - RNA, 22 nt, Human
ugcauggaggaagaugaaugca

SEQ ID NO: 943622 - RNA, 22 nt, Human
aucaguuuauacuuauaaaucu

SEQ ID NO: 943623 - RNA, 22 nt, Human
aguuaaagucugaaauagagaa

SEQ ID NO: 943624 - RNA, 19 nt, Human
aggcagcaggccagggaug

SEQ ID NO: 943625 - RNA, 22 nt, Human
uggcagcugccauguccacgug

SEQ ID NO: 943626 - RNA, 22 nt, Human
caggauggccccggggcugugc

SEQ ID NO: 943627 - RNA, 22 nt, Human
gaaggagggugcggaucugagc

SEQ ID NO: 943628 - RNA, 17 nt, Human
uucaaugauuaaugcau

SEQ ID NO: 943629 - RNA, 22 nt, Human
ccaggagagcucucguucagug

SEQ ID NO: 943630 - RNA, 22 nt, Human
auuagagaaauguugccaagau

SEQ ID NO: 943631 - RNA, 22 nt, Human
acauuuaaauaccuauguuucu

SEQ ID NO: 943632 - RNA, 22 nt, Human
ccucccagugccuccagagcag

SEQ ID NO: 943633 - RNA, 22 nt, Human
cagaguguugaccauaagccca

SEQ ID NO: 943634 - RNA, 18 nt, Human
gggcauggaugcagcauc

SEQ ID NO: 943635 - RNA, 22 nt, Human
ugugaagcuggauccuggagcu

SEQ ID NO: 943636 - RNA, 22 nt, Human
aaacaacucggcaacugcuuuu

SEQ ID NO: 943637 - RNA, 22 nt, Human
ccacacagucaguuuccaagaa

SEQ ID NO: 943638 - RNA, 22 nt, Human
ucugggcccuaaaccagcucua

SEQ ID NO: 943639 - RNA, 22 nt, Human
auuuguagugaagugaaaauaa

SEQ ID NO: 943640 - RNA, 22 nt, Human
uagauaaauuagaaaguuuacu

SEQ ID NO: 943641 - RNA, 21 nt, Human
ucuugaaaauuguagcaguuu

SEQ ID NO: 943642 - RNA, 22 nt, Human
ggagauagacuuggugagccac

SEQ ID NO: 943643 - RNA, 22 nt, Human
agcucccagaguccucugccca

SEQ ID NO: 943644 - RNA, 22 nt, Human
aguucucagcuuaguaugcugu

SEQ ID NO: 943645 - RNA, 20 nt, Human
uauuaggaaggaggaaggaa

SEQ ID NO: 943646 - RNA, 22 nt, Human
cuccacagcucaggcucagagu

SEQ ID NO: 943647 - RNA, 22 nt, Human
ugcugccuugaccuccugggcu

SEQ ID NO: 943648 - RNA, 22 nt, Human
ugccuggguguaaagggccaac

SEQ ID NO: 943649 - RNA, 22 nt, Human
ggcuccuggggaggugagcuug

SEQ ID NO: 943650 - RNA, 22 nt, Human
gcugucugcugugcacugagca

SEQ ID NO: 943651 - RNA, 22 nt, Human
auuaggaaauguguugcaagca

SEQ ID NO: 943652 - RNA, 22 nt, Human
uccaagggaaacugcacuucua

SEQ ID NO: 943653 - RNA, 22 nt, Human
ucagggaaucagacucugcagc

SEQ ID NO: 943654 - RNA, 22 nt, Human
uccagccaugacucggacagug

SEQ ID NO: 943655 - RNA, 22 nt, Human
uguuuauuacaguucuuggaau

SEQ ID NO: 943656 - RNA, 22 nt, Human
cuggagccugcaguuuucacuu

SEQ ID NO: 943657 - RNA, 22 nt, Human
uucuuaagaaaccaucacauuc

SEQ ID NO: 943658 - RNA, 22 nt, Human
cacagcagaaaguguaggagga

SEQ ID NO: 943659 - RNA, 22 nt, Human
gcauuguccugcuucugagugu

SEQ ID NO: 943660 - RNA, 22 nt, Human
ggcaccugcucaucuggacuca

SEQ ID NO: 943661 - RNA, 22 nt, Human
uuuaaauguuuaaaacucguga

SEQ ID NO: 943662 - RNA, 22 nt, Human
caugaaaaugucaaguucugcu

SEQ ID NO: 943663 - RNA, 22 nt, Human
ugaguuuuuucaacauaugaag

SEQ ID NO: 943664 - RNA, 22 nt, Human
uggggguguccuggugcacaca

SEQ ID NO: 943665 - RNA, 22 nt, Human
gaacccaguccaggugcagccu

SEQ ID NO: 943666 - RNA, 22 nt, Human
gggcucugcgcucagcuccagc

SEQ ID NO: 943667 - RNA, 22 nt, Human
ucacaucuuauuagaguaucuc

SEQ ID NO: 943668 - RNA, 22 nt, Human
aaaggcaggcuuucacaucuca

SEQ ID NO: 943669 - RNA, 22 nt, Human
guccucuguuagaaaugugcuu

SEQ ID NO: 943670 - RNA, 22 nt, Human
ugcguugcgcuccugcagcagg

SEQ ID NO: 943671 - RNA, 22 nt, Human
aaggcaguagguguuucaaacu

SEQ ID NO: 943672 - RNA, 22 nt, Human
uggcugggccgggccuugugcc

SEQ ID NO: 943673 - RNA, 22 nt, Human
ugaccaaaggugguuuauuugg

SEQ ID NO: 943674 - RNA, 22 nt, Human
aaacugcugguugcuggccagc

SEQ ID NO: 943675 - RNA, 21 nt, Human
acaguucaugauaacuccauc

SEQ ID NO: 943676 - RNA, 22 nt, Human
aagagcugauuaagucaugagg

SEQ ID NO: 943677 - RNA, 22 nt, Human
acagugcuggcuacaacccugg

SEQ ID NO: 943678 - RNA, 22 nt, Human
ggaccagagaagugagcaccug

SEQ ID NO: 943679 - RNA, 22 nt, Human
ucagugcuucggcgagcaccua

SEQ ID NO: 943680 - RNA, 22 nt, Human
acagagcugggaucugaaccca

SEQ ID NO: 943681 - RNA, 20 nt, Human
ggcagcucacuacuuucugu

SEQ ID NO: 943682 - RNA, 22 nt, Human
aaggagcucccggcagaccagg

SEQ ID NO: 943683 - RNA, 22 nt, Human
cagcaggguauacagggaauuu

SEQ ID NO: 943684 - RNA, 22 nt, Human
ucccaggaagaucccagggacc

SEQ ID NO: 943685 - RNA, 22 nt, Human
uccuccagugucuggggccuug

SEQ ID NO: 943686 - RNA, 22 nt, Human
uaugccagggacuguuucacca

SEQ ID NO: 943687 - RNA, 22 nt, Human
cccagggacagcuagguggggc

SEQ ID NO: 943688 - RNA, 21 nt, Human
gcagagccugagguucuugag

SEQ ID NO: 943689 - RNA, 22 nt, Human
gggcagagaaauggacaguugg

SEQ ID NO: 943690 - RNA, 23 nt, Human
uagcuguggcguaaggcucagcu

SEQ ID NO: 943691 - RNA, 22 nt, Human
ccagggcaacgcugucucagag

SEQ ID NO: 943692 - RNA, 22 nt, Human
aaagcucuuauagcagagugug

SEQ ID NO: 943693 - RNA, 22 nt, Human
uauuuccaagcugaauccaaug

SEQ ID NO: 943694 - RNA, 20 nt, Human
auuuggcaugaaguauugau

SEQ ID NO: 943695 - RNA, 22 nt, Human
ucaggccacuucacaggugauu

SEQ ID NO: 943696 - RNA, 22 nt, Human
guccugggaaggaagccaggga

SEQ ID NO: 943697 - RNA, 22 nt, Human
uagcucuucauuucaucugauu

SEQ ID NO: 943698 - RNA, 22 nt, Human
aacauacauauuucagugucca

SEQ ID NO: 943699 - RNA, 21 nt, Human
agagucugcauuucugacaag

SEQ ID NO: 943700 - RNA, 19 nt, Human
cuggugcuugagugaguca

SEQ ID NO: 943701 - RNA, 22 nt, Human
cugcugugucagaguccagggg

SEQ ID NO: 943702 - RNA, 22 nt, Human
auacaacagaaaaugauuauuc

SEQ ID NO: 943703 - RNA, 22 nt, Human
uagucccauuuugagguauuug

SEQ ID NO: 943704 - RNA, 22 nt, Human
aggauccuuuuucugcuguuug

SEQ ID NO: 943705 - RNA, 22 nt, Human
aggagcagaauuuaaugugcag

SEQ ID NO: 943706 - RNA, 22 nt, Human
ugcuauacauguacauauuagu

SEQ ID NO: 943707 - RNA, 18 nt, Human
ugacagaaccuggagccu

SEQ ID NO: 943708 - RNA, 22 nt, Human
caaaagucuuccuauucucuua

SEQ ID NO: 943709 - RNA, 22 nt, Human
cugcaagauuggaagaugcaau

SEQ ID NO: 943710 - RNA, 22 nt, Human
ccuuucucuuugcugaucaugu

SEQ ID NO: 943711 - RNA, 20 nt, Human
cugccuggaggccucuaccu

SEQ ID NO: 943712 - RNA, 22 nt, Human
cacaggguuguucugaggauuc

SEQ ID NO: 943713 - RNA, 22 nt, Human
ugggugggagcacccugucugg

SEQ ID NO: 943714 - RNA, 22 nt, Human
ugucucugauaaguaguucagu

SEQ ID NO: 943715 - RNA, 22 nt, Human
ggcagcuucuuaauauggagac

SEQ ID NO: 943716 - RNA, 21 nt, Human
acagcaagccuucacaugagu

SEQ ID NO: 943717 - RNA, 22 nt, Human
gcugucacacaugggaucucag

SEQ ID NO: 943718 - RNA, 22 nt, Human
agaaguauaaagaauguuuaug

SEQ ID NO: 943719 - RNA, 22 nt, Human
gcuggccugcaaagcccggcug

SEQ ID NO: 943720 - RNA, 22 nt, Human
cauugcacucuggcuggaacgg

SEQ ID NO: 943721 - RNA, 22 nt, Human
cagcccuguccagcagagggug

SEQ ID NO: 943722 - RNA, 23 nt, Human
uuacaguaggaguuggaaaacca

SEQ ID NO: 943723 - RNA, 22 nt, Human
uauuuucuggacagucuugcuu

SEQ ID NO: 943724 - RNA, 21 nt, Human
ugacauaauccauaguacaaa

SEQ ID NO: 943725 - RNA, 22 nt, Human
agggaagagcuugcaagaaacc

SEQ ID NO: 943726 - RNA, 22 nt, Human
uuuggaaaguguacaaauuuga

SEQ ID NO: 943727 - RNA, 22 nt, Human
caccuuguggcccagucagguu

SEQ ID NO: 943728 - RNA, 22 nt, Human
uuggaugaagucuagcuuuagu

SEQ ID NO: 943729 - RNA, 22 nt, Human
gucuucuguaagaugagguccc

SEQ ID NO: 943730 - RNA, 22 nt, Human
agcaugcgcuugaucagcucca

SEQ ID NO: 943731 - RNA, 22 nt, Human
uggcucagauuuuuguaggcuu

SEQ ID NO: 943732 - RNA, 22 nt, Human
ucuccuggguaaaaggguugau

SEQ ID NO: 943733 - RNA, 22 nt, Human
cugggaggcagucucucuagaa

SEQ ID NO: 943734 - RNA, 22 nt, Human
uugcaucuagggcaacccagag

SEQ ID NO: 943735 - RNA, 22 nt, Human
aaauaacuuaugaucgucuggc

SEQ ID NO: 943736 - RNA, 22 nt, Human
aaaauugaagugaucaggaacu

SEQ ID NO: 943737 - RNA, 21 nt, Human
agcugggccucagccugcagu

SEQ ID NO: 943738 - RNA, 17 nt, Human
uagcugccccgaaugcu

SEQ ID NO: 943739 - RNA, 22 nt, Human
accaggagagauuuuauugaga

SEQ ID NO: 943740 - RNA, 22 nt, Human
acauuugucuucuuucagauua

SEQ ID NO: 943741 - RNA, 22 nt, Human
auacuuugcuaguaucagugug

SEQ ID NO: 943742 - RNA, 22 nt, Human
gaggcagcauucgcauagacag

SEQ ID NO: 943743 - RNA, 22 nt, Human
ucaaauaugugauagaagcuaa

SEQ ID NO: 943744 - RNA, 22 nt, Human
ugacacagauuagagacauacc

SEQ ID NO: 943745 - RNA, 22 nt, Human
uggcucuguugugcugagccag

SEQ ID NO: 943746 - RNA, 22 nt, Human
cuggggcauugggagaggccug

SEQ ID NO: 943747 - RNA, 22 nt, Human
accugagggcccaaacuuggua

SEQ ID NO: 943748 - RNA, 22 nt, Human
cccaaggaagacgcuugugaua

SEQ ID NO: 943749 - RNA, 22 nt, Human
cagagccuaaaacgacuccacu

SEQ ID NO: 943750 - RNA, 22 nt, Human
caugugucaaaugauguagcug

SEQ ID NO: 943751 - RNA, 22 nt, Human
gagggagucugugcaaagaauu

SEQ ID NO: 943752 - RNA, 22 nt, Human
uacuaggaagcagcugcauugg

SEQ ID NO: 943753 - RNA, 20 nt, Human
uuuuuccuucucuacaggca

SEQ ID NO: 943754 - RNA, 22 nt, Human
uugacaaaaauaacacagcaua

SEQ ID NO: 943755 - RNA, 22 nt, Human
acuggccaggcagcaguagcuu

SEQ ID NO: 943756 - RNA, 22 nt, Human
ucugcucuaguugcuuccugcc

SEQ ID NO: 943757 - RNA, 22 nt, Human
ucugugacuugcgggaggagaa

SEQ ID NO: 943758 - RNA, 21 nt, Human
guauucuuuaugaagugaaaa

SEQ ID NO: 943759 - RNA, 22 nt, Human
ggcaugcucuuuguccacagua

SEQ ID NO: 943760 - RNA, 22 nt, Human
auuauggacguuaauuuuggaa

SEQ ID NO: 943761 - RNA, 21 nt, Human
uuucaauguguucuuuguagu

SEQ ID NO: 943762 - RNA, 22 nt, Human
cuucacaaagcucucuuuaugu

SEQ ID NO: 943763 - RNA, 22 nt, Human
ugucccagucaaggcugucauc

SEQ ID NO: 943764 - RNA, 22 nt, Human
ggaaggaggggcaaagcaguuc

SEQ ID NO: 943765 - RNA, 22 nt, Human
cguggccagccauuuccuggaa

SEQ ID NO: 943766 - RNA, 22 nt, Human
uccuugaauugugccacuuacc

SEQ ID NO: 943767 - RNA, 23 nt, Human
ccugaagggucaggguccucagc

SEQ ID NO: 943768 - RNA, 22 nt, Human
caucacagauguuguguggagu

SEQ ID NO: 943769 - RNA, 22 nt, Human
uggcagggucuugcuguguugc

SEQ ID NO: 943770 - RNA, 22 nt, Human
cuucuuaucaaguggcaaaucu

SEQ ID NO: 943771 - RNA, 22 nt, Human
cuuacauuaaguaagagauuga

SEQ ID NO: 943772 - RNA, 22 nt, Human
gagggagugccagagggccagc

SEQ ID NO: 943773 - RNA, 22 nt, Human
caggagacaaguuagcagcuga

SEQ ID NO: 943774 - RNA, 20 nt, Human
agaggaggauuauuuuauuc

SEQ ID NO: 943775 - RNA, 22 nt, Human
ccugccugcuuucugcuuugca

SEQ ID NO: 943776 - RNA, 21 nt, Human
ucccagagugcuugggacugc

SEQ ID NO: 943777 - RNA, 20 nt, Human
cucugcugcccgccggcugc

SEQ ID NO: 943778 - RNA, 22 nt, Human
ucaguguccggagccugagugc

SEQ ID NO: 943779 - RNA, 22 nt, Human
guucuucaggcugugcucuaga

SEQ ID NO: 943780 - RNA, 22 nt, Human
uaguaaaaguuuaguugaaagu

SEQ ID NO: 943781 - RNA, 22 nt, Human
uuagauaaauuaagacuuuaca

SEQ ID NO: 943782 - RNA, 22 nt, Human
gcauuuccugugcuuggcauau

SEQ ID NO: 943783 - RNA, 22 nt, Human
gaggagagagggacugucugca

SEQ ID NO: 943784 - RNA, 22 nt, Human
auguacauuuguaguaauauca

SEQ ID NO: 943785 - RNA, 22 nt, Human
ucaaugauaucagcaggaugug

SEQ ID NO: 943786 - RNA, 22 nt, Human
acagagagaaacaaucagcagc

SEQ ID NO: 943787 - RNA, 22 nt, Human
gcagggcuguucaggagggugg

SEQ ID NO: 943788 - RNA, 22 nt, Human
acuguacuguguauuguagaau

SEQ ID NO: 943789 - RNA, 22 nt, Human
ggcuggagacaacguccugccc

SEQ ID NO: 943790 - RNA, 22 nt, Human
ggauuugggcuugcagcagagc

SEQ ID NO: 943791 - RNA, 22 nt, Human
agcagagaagacacaggcuuca

SEQ ID NO: 943792 - RNA, 22 nt, Human
aaugugaaaccgcacagaauaa

SEQ ID NO: 943793 - RNA, 22 nt, Human
gccucaggacuggcauacucau

SEQ ID NO: 943794 - RNA, 22 nt, Human
agaggggagagcuaagcaauuc

SEQ ID NO: 943795 - RNA, 21 nt, Human
ugugucacuaacuagaggcua

SEQ ID NO: 943796 - RNA, 22 nt, Human
cuuucauucuuagauauuagug

SEQ ID NO: 943797 - RNA, 22 nt, Human
agccacagcgaaccucucuucc

SEQ ID NO: 943798 - RNA, 22 nt, Human
cucacuguuuaauagcuggauc

SEQ ID NO: 943799 - RNA, 22 nt, Human
guggccugccgugugguauggg

SEQ ID NO: 943800 - RNA, 22 nt, Human
ucccagaggucucugcugguuc

SEQ ID NO: 943801 - RNA, 22 nt, Human
uaagcugugggagauuggcaua

SEQ ID NO: 943802 - RNA, 20 nt, Human
aggcacuggggauagguaag

SEQ ID NO: 943803 - RNA, 22 nt, Human
acagaguagcucaagaagauug

SEQ ID NO: 943804 - RNA, 15 nt, Human
cccaggaguucgaga

SEQ ID NO: 943805 - RNA, 22 nt, Human
uggcucaggcuugaaaauagau

SEQ ID NO: 943806 - RNA, 20 nt, Human
uccagaggccacauccagug

SEQ ID NO: 943807 - RNA, 22 nt, Human
ugaaaucugucccacuuuagcu

SEQ ID NO: 943808 - RNA, 22 nt, Human
ugcugcacaauuggaaaguauc

SEQ ID NO: 943809 - RNA, 22 nt, Human
ucaagucucaauguauuauggu

SEQ ID NO: 943810 - RNA, 22 nt, Human
ucaguagcagaaagcaaugagu

SEQ ID NO: 943811 - RNA, 22 nt, Human
ucuuacauauagcaugaguaca

SEQ ID NO: 943812 - RNA, 22 nt, Human
cugcagagcauaaaucugaaua

SEQ ID NO: 943813 - RNA, 22 nt, Human
aucaagaauguucauucuucua

SEQ ID NO: 943814 - RNA, 21 nt, Human
acucaggagacuaacuauguc

SEQ ID NO: 943815 - RNA, 19 nt, Human
uuugaaagaguuuuauugg

SEQ ID NO: 943816 - RNA, 22 nt, Human
gaagcccauuuguacagcacau

SEQ ID NO: 943817 - RNA, 22 nt, Human
aaauugcaaaaguacuuuuagg

SEQ ID NO: 943818 - RNA, 22 nt, Human
acaauucucucauaucuuauua

SEQ ID NO: 943819 - RNA, 22 nt, Human
cugaaugaggaaaagagugagg

SEQ ID NO: 943820 - RNA, 22 nt, Human
ucugaagccuuuguacaggccu

SEQ ID NO: 943821 - RNA, 23 nt, Human
uggcagagacccagaaucuacau

SEQ ID NO: 943822 - RNA, 22 nt, Human
caaaugcuggcccugcuacuua

SEQ ID NO: 943823 - RNA, 22 nt, Human
ucauugaauauggggccauaca

SEQ ID NO: 943824 - RNA, 22 nt, Human
acuugcauuauauuuaucacaa

SEQ ID NO: 943825 - RNA, 22 nt, Human
cacacaggaugaagcagcagaa

SEQ ID NO: 943826 - RNA, 22 nt, Human
cccauuuaucccaagguuacuc

SEQ ID NO: 943827 - RNA, 17 nt, Human
ucuguccagggagugug

SEQ ID NO: 943828 - RNA, 21 nt, Human
cucaggcauuugaggagaguc

SEQ ID NO: 943829 - RNA, 22 nt, Human
accacaggacccaugagucagu

SEQ ID NO: 943830 - RNA, 20 nt, Human
auaaaauaacugccacaaga

SEQ ID NO: 943831 - RNA, 22 nt, Human
ucccuggguccugcuugcucuc

SEQ ID NO: 943832 - RNA, 22 nt, Human
gcacagggcccugugcguaggu

SEQ ID NO: 943833 - RNA, 22 nt, Human
ugcugccaugcagagcaacaga

SEQ ID NO: 943834 - RNA, 22 nt, Human
uugucuguaaagacggccacca

SEQ ID NO: 943835 - RNA, 22 nt, Human
uagaaaucauuuagaaguauug

SEQ ID NO: 943836 - RNA, 22 nt, Human
gauaugaaguggcauugugaag

SEQ ID NO: 943837 - RNA, 22 nt, Human
cagugcaguuucccagaugcug

SEQ ID NO: 943838 - RNA, 23 nt, Human
gucagcuugaccaguggagaguc

SEQ ID NO: 943839 - RNA, 22 nt, Human
uauagcaagcaggacagucuca

SEQ ID NO: 943840 - RNA, 22 nt, Human
gcugcuguugauuuaguccaau

SEQ ID NO: 943841 - RNA, 22 nt, Human
gcaggagacaacuguaaggaga

SEQ ID NO: 943842 - RNA, 19 nt, Human
gcuccuggaugaccugugg

SEQ ID NO: 943843 - RNA, 22 nt, Human
auugucuucuggucuuaucuuu

SEQ ID NO: 943844 - RNA, 22 nt, Human
ucucucagcuuugagaccugcu

SEQ ID NO: 943845 - RNA, 20 nt, Human
aggcugggguguuuugccca

SEQ ID NO: 943846 - RNA, 23 nt, Human
cauuugauccucacaauaaaugg

SEQ ID NO: 943847 - RNA, 22 nt, Human
gaggccacaguccugaggcauc

SEQ ID NO: 943848 - RNA, 22 nt, Human
cauggaaggcaaaagacacaga

SEQ ID NO: 943849 - RNA, 22 nt, Human
uauuuccugcauggugauguaa

SEQ ID NO: 943850 - RNA, 22 nt, Human
gcugggcacugucccauaggcu

SEQ ID NO: 943851 - RNA, 22 nt, Human
agcuggccuguuagagcugagu

SEQ ID NO: 943852 - RNA, 22 nt, Human
gcugcccugucugcagcaggac

SEQ ID NO: 943853 - RNA, 22 nt, Human
auauaauaguuucauaaaggcu

SEQ ID NO: 943854 - RNA, 22 nt, Human
ccacugggggcugcaggcacuc

SEQ ID NO: 943855 - RNA, 22 nt, Human
ugugugcagccucugucuuugg

SEQ ID NO: 943856 - RNA, 22 nt, Human
caggccugcaggaaaggcuccc

SEQ ID NO: 943857 - RNA, 22 nt, Human
gccuggagcuacuggacacuga

SEQ ID NO: 943858 - RNA, 22 nt, Human
agaggcaggagguugacuugag

SEQ ID NO: 943859 - RNA, 22 nt, Human
auuuggcauaggcagaggccca

SEQ ID NO: 943860 - RNA, 22 nt, Human
uagucuuuugagaaguauaucu

SEQ ID NO: 943861 - RNA, 19 nt, Human
ucccaggaaccuuuuauuu

SEQ ID NO: 943862 - RNA, 22 nt, Human
cauuguuaccaucuuuuaccua

SEQ ID NO: 943863 - RNA, 22 nt, Human
gcagccagaagacucagaacaa

SEQ ID NO: 943864 - RNA, 22 nt, Human
ugccuugguucucuacuuggag

SEQ ID NO: 943865 - RNA, 22 nt, Human
gcuucucuggccugcagggcau

SEQ ID NO: 943866 - RNA, 18 nt, Human
aaugcacacauuuacucc

SEQ ID NO: 943867 - RNA, 22 nt, Human
uacaaaguagaaauucaguaaa

SEQ ID NO: 943868 - RNA, 22 nt, Human
acagagcucccagccaucuccu

SEQ ID NO: 943869 - RNA, 22 nt, Human
uugcagcuucgagucuaucugu

SEQ ID NO: 943870 - RNA, 22 nt, Human
ucagauggcacacagagccugc

SEQ ID NO: 943871 - RNA, 22 nt, Human
auccaugauuaguaggauaaag

SEQ ID NO: 943872 - RNA, 20 nt, Human
ccagagcugauggcugcccg

SEQ ID NO: 943873 - RNA, 21 nt, Human
guggccugauuaugaaugggu

SEQ ID NO: 943874 - RNA, 22 nt, Human
ccugagggaggguauaggcugu

SEQ ID NO: 943875 - RNA, 22 nt, Human
uuacuuuggguccugcuuauaa

SEQ ID NO: 943876 - RNA, 22 nt, Human
aucaaaguccaucagaagguag

SEQ ID NO: 943877 - RNA, 22 nt, Human
aaaaaguauuggccaugguuga

SEQ ID NO: 943878 - RNA, 22 nt, Human
cacuaugcuuacaugcuuauau

SEQ ID NO: 943879 - RNA, 22 nt, Human
gcaccaggcuuagagccccagg

SEQ ID NO: 943880 - RNA, 22 nt, Human
uuauguacucugcaauguuuga

SEQ ID NO: 943881 - RNA, 17 nt, Human
gccaggagguuugagcu

SEQ ID NO: 943882 - RNA, 22 nt, Human
uuccauuuauucuuguccagau

SEQ ID NO: 943883 - RNA, 20 nt, Human
uaacagaaguagaagugggu

SEQ ID NO: 943884 - RNA, 22 nt, Human
aaugagcugcugcuguuccacc

SEQ ID NO: 943885 - RNA, 22 nt, Human
uaaauguauaggcacuaaaccu

SEQ ID NO: 943886 - RNA, 20 nt, Human
auuaggauuuuaggucauca

SEQ ID NO: 943887 - RNA, 22 nt, Human
cagucucuugcuucauuaguug

SEQ ID NO: 943888 - RNA, 21 nt, Human
uauuucuuugacucucucccu

SEQ ID NO: 943889 - RNA, 22 nt, Human
uuucacauaugguuguugauug

SEQ ID NO: 943890 - RNA, 22 nt, Human
caguggcagagaacagagaccu

SEQ ID NO: 943891 - RNA, 22 nt, Human
gcugucugacuccaaguuggag

SEQ ID NO: 943892 - RNA, 22 nt, Human
cccucaggagaugucagcugga

SEQ ID NO: 943893 - RNA, 22 nt, Human
uaggcacuggggaggcagcaug

SEQ ID NO: 943894 - RNA, 22 nt, Human
ggcucuggaaaguguccuugau

SEQ ID NO: 943895 - RNA, 22 nt, Human
aggacagcccuugagagcacau

SEQ ID NO: 943896 - RNA, 22 nt, Human
ccaaaguccacaguuuacauua

SEQ ID NO: 943897 - RNA, 22 nt, Human
uaaggcacccauguucauacag

SEQ ID NO: 943898 - RNA, 22 nt, Human
ucagccucucugaguccagacc

SEQ ID NO: 943899 - RNA, 22 nt, Human
uggcagcuagcuguuuucaugc

SEQ ID NO: 943900 - RNA, 22 nt, Human
cagaacugggcagggagcagag

SEQ ID NO: 943901 - RNA, 22 nt, Human
uuucugcugugcuuucuugcgu

SEQ ID NO: 943902 - RNA, 22 nt, Human
ccugcagguaaggcuaacugcc

SEQ ID NO: 943903 - RNA, 22 nt, Human
ucucagggagggcgagucagcg

SEQ ID NO: 943904 - RNA, 22 nt, Human
gcaucuaaauaaacgugggagu

SEQ ID NO: 943905 - RNA, 22 nt, Human
cacagaggaaaggcaguuggua

SEQ ID NO: 943906 - RNA, 22 nt, Human
ugccuguguugauuacuuuguc

SEQ ID NO: 943907 - RNA, 22 nt, Human
ugaggcagccugcauuaaagag

SEQ ID NO: 943908 - RNA, 22 nt, Human
cccaggaucaccuggucaaggg

SEQ ID NO: 943909 - RNA, 23 nt, Human
uggcuaaaggcucuaguccugcu

SEQ ID NO: 943910 - RNA, 22 nt, Human
ucugucugagggagugacauuu

SEQ ID NO: 943911 - RNA, 22 nt, Human
ccaaagagcuagaauuauaggc

SEQ ID NO: 943912 - RNA, 22 nt, Human
uccuaggcaguuggugcuccau

SEQ ID NO: 943913 - RNA, 20 nt, Human
aucuucuuggccagcuugcu

SEQ ID NO: 943914 - RNA, 22 nt, Human
uuauuauugugaccugagaaug

SEQ ID NO: 943915 - RNA, 22 nt, Human
gccagagguucaacaacugucu

SEQ ID NO: 943916 - RNA, 22 nt, Human
aacagaaaucauuuagggcucu

SEQ ID NO: 943917 - RNA, 22 nt, Human
ggcaggcaaugaggaugggaag

SEQ ID NO: 943918 - RNA, 22 nt, Human
auuuuacuuugugaauauugac

SEQ ID NO: 943919 - RNA, 22 nt, Human
ccccuuccaggaagcagaaucg

SEQ ID NO: 943920 - RNA, 22 nt, Human
gcaggaugggagcuucacucug

SEQ ID NO: 943921 - RNA, 22 nt, Human
guugaaagcuuuucauuuaguu

SEQ ID NO: 943922 - RNA, 21 nt, Human
aaauacagaaacuuguuuuca

SEQ ID NO: 943923 - RNA, 22 nt, Human
ucuggccagugaaaugcagaau

SEQ ID NO: 943924 - RNA, 22 nt, Human
gccagcucagugccaggccccu

SEQ ID NO: 943925 - RNA, 22 nt, Human
cagucccaaggaggaagcaguc

SEQ ID NO: 943926 - RNA, 22 nt, Human
uaaugcaguacugauauaaaca

SEQ ID NO: 943927 - RNA, 22 nt, Human
aguguuaagagaaaauucugcu

SEQ ID NO: 943928 - RNA, 22 nt, Human
uucacagggcagcagcugagcc

SEQ ID NO: 943929 - RNA, 22 nt, Human
aaguaaauguuggagcucaaau

SEQ ID NO: 943930 - RNA, 22 nt, Human
gucaggauguuuauucuccagu

SEQ ID NO: 943931 - RNA, 22 nt, Human
acagcagcuugcgugucugguc

SEQ ID NO: 943932 - RNA, 22 nt, Human
cuuucucugugugguaaagggc

SEQ ID NO: 943933 - RNA, 22 nt, Human
aggcuccuuguucaucauccau

SEQ ID NO: 943934 - RNA, 22 nt, Human
gaaaaguaaacacuagggguca

SEQ ID NO: 943935 - RNA, 22 nt, Human
aguucuuuugugaacauaugcu

SEQ ID NO: 943936 - RNA, 22 nt, Human
ccccuuccuuccucagacagcc

SEQ ID NO: 943937 - RNA, 22 nt, Human
agcccagggaaccaggaagugg

SEQ ID NO: 943938 - RNA, 22 nt, Human
ugccaaggguaugggcaagaua

SEQ ID NO: 943939 - RNA, 22 nt, Human
uguaugcaccauuguauuaccu

SEQ ID NO: 943940 - RNA, 22 nt, Human
ugcucuccggcuuccguggccu

SEQ ID NO: 943941 - RNA, 22 nt, Human
ugagccugguugcagugucugg

SEQ ID NO: 943942 - RNA, 22 nt, Human
ccagcugauucgguggugguug

SEQ ID NO: 943943 - RNA, 22 nt, Human
acagagguaggacaugagauau

SEQ ID NO: 943944 - RNA, 22 nt, Human
ugcaggugccucuugagcuugu

SEQ ID NO: 943945 - RNA, 22 nt, Human
uguccucacaggaaugaacuuu

SEQ ID NO: 943946 - RNA, 22 nt, Human
acugagcugugacaaugcuuaa

SEQ ID NO: 943947 - RNA, 22 nt, Human
uccuccuucgggacugcuugac

SEQ ID NO: 943948 - RNA, 22 nt, Human
ggucacugcucuaaacaaaagu

SEQ ID NO: 943949 - RNA, 21 nt, Human
cucaggauggcggccuggugg

SEQ ID NO: 943950 - RNA, 22 nt, Human
ucugggaagcugguccuguucu

SEQ ID NO: 943951 - RNA, 22 nt, Human
gugucccagccccacaggccug

SEQ ID NO: 943952 - RNA, 22 nt, Human
uccaggagacacaagguacaua

SEQ ID NO: 943953 - RNA, 22 nt, Human
aauguugaggauaucagaaaau

SEQ ID NO: 943954 - RNA, 22 nt, Human
uuccuguaguugugcaauguac

SEQ ID NO: 943955 - RNA, 22 nt, Human
uguauuuucugaagauaaucaa

SEQ ID NO: 943956 - RNA, 22 nt, Human
gaggccugaggcugccuggagc

SEQ ID NO: 943957 - RNA, 22 nt, Human
uucuuguauauaaaaaucauuu

SEQ ID NO: 943958 - RNA, 22 nt, Human
uagcacauaacuuagaauaguu

SEQ ID NO: 943959 - RNA, 20 nt, Human
gccagcacagggagcaguuc

SEQ ID NO: 943960 - RNA, 22 nt, Human
guggagccaggggcuguaggua

SEQ ID NO: 943961 - RNA, 22 nt, Human
ugucagugguagacccagaggu

SEQ ID NO: 943962 - RNA, 21 nt, Human
gucaaacuugcaccagugccc

SEQ ID NO: 943963 - RNA, 22 nt, Human
uugcauaaagauuuuauugcau

SEQ ID NO: 943964 - RNA, 22 nt, Human
cugcauucauaucagauagaag

SEQ ID NO: 943965 - RNA, 22 nt, Human
uggcucagugcauucacaguaa

SEQ ID NO: 943966 - RNA, 22 nt, Human
aggguggcaccuggaagggaug

SEQ ID NO: 943967 - RNA, 22 nt, Human
ugcaauaaggaguaauaguaaa

SEQ ID NO: 943968 - RNA, 22 nt, Human
cagcucugcugggaggaugcag

SEQ ID NO: 943969 - RNA, 23 nt, Human
acagcaagaggaccagaugugag

SEQ ID NO: 943970 - RNA, 22 nt, Human
agccaugcaccuuacucuugcu

SEQ ID NO: 943971 - RNA, 17 nt, Human
auucuuugaugucucug

SEQ ID NO: 943972 - RNA, 22 nt, Human
uucauucccaagaguaaacaua

SEQ ID NO: 943973 - RNA, 22 nt, Human
aucauuccacauguaccacuag

SEQ ID NO: 943974 - RNA, 22 nt, Human
aucagcaaaaaugccuucagaa

SEQ ID NO: 943975 - RNA, 22 nt, Human
aaugaacaggugaaugucagau

SEQ ID NO: 943976 - RNA, 22 nt, Human
uuccaaagaaauugaccaagac

SEQ ID NO: 943977 - RNA, 22 nt, Human
cuuccagguccuucuugagaag

SEQ ID NO: 943978 - RNA, 22 nt, Human
cugcacagagcagggcagacac

SEQ ID NO: 943979 - RNA, 22 nt, Human
cauuugaaugagauugcuguaa

SEQ ID NO: 943980 - RNA, 22 nt, Human
ggguggaggagaacaggcccca

SEQ ID NO: 943981 - RNA, 22 nt, Human
aggcucuggcuacuacagagcu

SEQ ID NO: 943982 - RNA, 22 nt, Human
caaaaguaauggcgguuuuuac

SEQ ID NO: 943983 - RNA, 22 nt, Human
auguguauacuugugcuuacuc

SEQ ID NO: 943984 - RNA, 20 nt, Human
ugcagggcucugcuucucuc

SEQ ID NO: 943985 - RNA, 22 nt, Human
ucaugccacuuacaaaauaaug

SEQ ID NO: 943986 - RNA, 22 nt, Human
uuccauaauaaccugagagaaa

SEQ ID NO: 943987 - RNA, 23 nt, Human
ggguccagagacaggcaugggug

SEQ ID NO: 943988 - RNA, 22 nt, Human
gggcugcuuccuggggaaugcu

SEQ ID NO: 943989 - RNA, 22 nt, Human
ugaagcaggguggccagauugu

SEQ ID NO: 943990 - RNA, 22 nt, Human
cugggcaguuuuacaucauugc

SEQ ID NO: 943991 - RNA, 22 nt, Human
gcugucuguggugucagcugac

SEQ ID NO: 943992 - RNA, 22 nt, Human
accaggaggcuacacuguccca

SEQ ID NO: 943993 - RNA, 22 nt, Human
aaguggacuaauacaaggacua

SEQ ID NO: 943994 - RNA, 22 nt, Human
aauucacaaaaccagauugcuu

SEQ ID NO: 943995 - RNA, 22 nt, Human
cuggcagcguguuuaugaacau

SEQ ID NO: 943996 - RNA, 22 nt, Human
uauauuaacacccacuugccuc

SEQ ID NO: 943997 - RNA, 22 nt, Human
ugcaguggaggccgugagacag

SEQ ID NO: 943998 - RNA, 22 nt, Human
aagcaaagaguuuaguggguga

SEQ ID NO: 943999 - RNA, 22 nt, Human
cugccagcucgccacaaugaca

SEQ ID NO: 944000 - RNA, 22 nt, Human
aguguacauguuuacagcaucu

SEQ ID NO: 944001 - RNA, 22 nt, Human
cucuuccucucaugcggucaua

SEQ ID NO: 944002 - RNA, 22 nt, Human
uugcaaaagccgaggcacucca

SEQ ID NO: 944003 - RNA, 17 nt, Human
ggcagcugugugcaugc

SEQ ID NO: 944004 - RNA, 22 nt, Human
aagaguaugcaugcauguuugu

SEQ ID NO: 944005 - RNA, 22 nt, Human
gcccucagcuccuggacacaug

SEQ ID NO: 944006 - RNA, 22 nt, Human
gcagcuggucuggccuagagua

SEQ ID NO: 944007 - RNA, 22 nt, Human
agagauaugcugccuaaauuua

SEQ ID NO: 944008 - RNA, 22 nt, Human
cuggcagcucuacucagagccu

SEQ ID NO: 944009 - RNA, 23 nt, Human
aggugcagcccuggaccugcccc

SEQ ID NO: 944010 - RNA, 22 nt, Human
ucucuguacaguacaugccgug

SEQ ID NO: 944011 - RNA, 22 nt, Human
ugggggugugccagggaccucc

SEQ ID NO: 944012 - RNA, 22 nt, Human
ggcagacuguaauaggagaauu

SEQ ID NO: 944013 - RNA, 22 nt, Human
uaaaugugucuuuuuaaggccu

SEQ ID NO: 944014 - RNA, 22 nt, Human
gcuggccauucucuuugagaug

SEQ ID NO: 944015 - RNA, 22 nt, Human
aguuauauaacuaucuagaugc

SEQ ID NO: 944016 - RNA, 22 nt, Human
ucaggggacuuaggagagaagu

SEQ ID NO: 944017 - RNA, 22 nt, Human
uucuucaacaaggacacuguua

SEQ ID NO: 944018 - RNA, 22 nt, Human
ugaggcagugcugggaagccug

SEQ ID NO: 944019 - RNA, 22 nt, Human
ggccuguguccuccuugcccug

SEQ ID NO: 944020 - RNA, 22 nt, Human
acuggaagccaguugacaauca

SEQ ID NO: 944021 - RNA, 22 nt, Human
uauuccagguauucuucaagag

SEQ ID NO: 944022 - RNA, 22 nt, Human
cagagguauugcaaaagccuag

SEQ ID NO: 944023 - RNA, 22 nt, Human
uuuaggauauuaauguucagag

SEQ ID NO: 944024 - RNA, 22 nt, Human
uuauuagagugcuuugagaaag

SEQ ID NO: 944025 - RNA, 22 nt, Human
ucuggccuuaucuguccaagcc

SEQ ID NO: 944026 - RNA, 22 nt, Human
aucuucucaagcagcauccugu

SEQ ID NO: 944027 - RNA, 19 nt, Human
ugcuagaaauucugugacu

SEQ ID NO: 944028 - RNA, 22 nt, Human
ugagcuuccucccugcauccau

SEQ ID NO: 944029 - RNA, 22 nt, Human
aggcagacaaggacacaguggg

SEQ ID NO: 944030 - RNA, 22 nt, Human
ucuuguuacaguuuauuacaug

SEQ ID NO: 944031 - RNA, 22 nt, Human
aaagaacagauguguggugcau

SEQ ID NO: 944032 - RNA, 22 nt, Human
cagcuuucaucagugacacuca

SEQ ID NO: 944033 - RNA, 22 nt, Human
uccuggccaggaugaccuaaca

SEQ ID NO: 944034 - RNA, 22 nt, Human
ggcucaggacugcagcguagag

SEQ ID NO: 944035 - RNA, 22 nt, Human
cucugggaccauggcaagugcg

SEQ ID NO: 944036 - RNA, 22 nt, Human
ugaggccagucucaucacaggc

SEQ ID NO: 944037 - RNA, 22 nt, Human
uacauuuauaaggcuucucugu

SEQ ID NO: 944038 - RNA, 22 nt, Human
ggacuggccggcgcugaggccc

SEQ ID NO: 944039 - RNA, 22 nt, Human
gccuggcugcuagccagaggca

SEQ ID NO: 944040 - RNA, 22 nt, Human
ccuccaaguuugacucaggaca

SEQ ID NO: 944041 - RNA, 22 nt, Human
ugaagggggagauauaugugug

SEQ ID NO: 944042 - RNA, 22 nt, Human
uauuggcagcaugagcuccugg

SEQ ID NO: 944043 - RNA, 22 nt, Human
uuccagagcaguuuucagauca

SEQ ID NO: 944044 - RNA, 22 nt, Human
gagacauggcaaaagcacuggu

SEQ ID NO: 944045 - RNA, 17 nt, Human
uuucuccuuccaucuca

SEQ ID NO: 944046 - RNA, 21 nt, Human
gcagccacagccaccaagcua

SEQ ID NO: 944047 - RNA, 22 nt, Human
ugugaaagcaagucuaguucuc

SEQ ID NO: 944048 - RNA, 22 nt, Human
ucccagccuuccuuguggugaa

SEQ ID NO: 944049 - RNA, 22 nt, Human
cccuggaggcggauguugcagu

SEQ ID NO: 944050 - RNA, 22 nt, Human
gcagaggcuccauuuuacagau

SEQ ID NO: 944051 - RNA, 22 nt, Human
aggcugcuucagcugcagggag

SEQ ID NO: 944052 - RNA, 20 nt, Human
ucugaggcugagcucuacuu

SEQ ID NO: 944053 - RNA, 22 nt, Human
cucccagagagcaggugggccg

SEQ ID NO: 944054 - RNA, 22 nt, Human
cugggagcccgcguccuggugg

SEQ ID NO: 944055 - RNA, 22 nt, Human
ccacagggacuguuaaaacccu

SEQ ID NO: 944056 - RNA, 22 nt, Human
gcccugcugucuucagaguaua

SEQ ID NO: 944057 - RNA, 23 nt, Human
acuauaaaguuguucugauuuac

SEQ ID NO: 944058 - RNA, 22 nt, Human
agguaggggguuugggaacugc

SEQ ID NO: 944059 - RNA, 22 nt, Human
auaugcacacucugcccacaga

SEQ ID NO: 944060 - RNA, 22 nt, Human
cccagccagccucuucccauau

SEQ ID NO: 944061 - RNA, 22 nt, Human
ucugagcccucuuuugcagccc

SEQ ID NO: 944062 - RNA, 22 nt, Human
ggcuuugccuggaauuuccuug

SEQ ID NO: 944063 - RNA, 22 nt, Human
guuucuaugguuuauauuacug

SEQ ID NO: 944064 - RNA, 22 nt, Human
aacauauaaacucuuaaguuca

SEQ ID NO: 944065 - RNA, 22 nt, Human
uucuucaaugugcccuguuuuc

SEQ ID NO: 944066 - RNA, 22 nt, Human
uucauucuugggaucagagagu

SEQ ID NO: 944067 - RNA, 22 nt, Human
gcuggcauuacaggagagaacc

SEQ ID NO: 944068 - RNA, 19 nt, Human
ugcucaggccaaggagccc

SEQ ID NO: 944069 - RNA, 22 nt, Human
uggcaguccccugugccuggaa

SEQ ID NO: 944070 - RNA, 22 nt, Human
ugcucuggaguggcuugugcac

SEQ ID NO: 944071 - RNA, 18 nt, Human
uucaccagugugaugggu

SEQ ID NO: 944072 - RNA, 22 nt, Human
gcucugagauugagccuuuggu

SEQ ID NO: 944073 - RNA, 22 nt, Human
auguuuuugagauacaaacaga

SEQ ID NO: 944074 - RNA, 22 nt, Human
ccugggcucuauccugacccag

SEQ ID NO: 944075 - RNA, 22 nt, Human
ugcagaaggaggaggaaaucca

SEQ ID NO: 944076 - RNA, 22 nt, Human
auccuugagccaaugacugauu

SEQ ID NO: 944077 - RNA, 22 nt, Human
cccugcaggggaccugcagccu

SEQ ID NO: 944078 - RNA, 22 nt, Human
gcuccuggcauccugcuuuuaa

SEQ ID NO: 944079 - RNA, 22 nt, Human
uccaggaguuugaccugugggc

SEQ ID NO: 944080 - RNA, 22 nt, Human
ucauggcacuuagcacaguccu

SEQ ID NO: 944081 - RNA, 22 nt, Human
gagcagggccacuucuguaccu

SEQ ID NO: 944082 - RNA, 22 nt, Human
ggaggagacccugugucaguuu

SEQ ID NO: 944083 - RNA, 22 nt, Human
agcccaggaaucugcaucuuga

SEQ ID NO: 944084 - RNA, 22 nt, Human
ucugccuggaugauggcagggc

SEQ ID NO: 944085 - RNA, 22 nt, Human
gagggacagcuaaagagaaauu

SEQ ID NO: 944086 - RNA, 22 nt, Human
uauugaugcuuggauugggcca

SEQ ID NO: 944087 - RNA, 22 nt, Human
cagugucuuauuuguagcucag

SEQ ID NO: 944088 - RNA, 23 nt, Human
gagcugggauacaggcuuacugc

SEQ ID NO: 944089 - RNA, 22 nt, Human
ugucuguaagguguuuauguua

SEQ ID NO: 944090 - RNA, 22 nt, Human
ugcugcuguauccuuaguguca

SEQ ID NO: 944091 - RNA, 22 nt, Human
ugguaucagagccaucuguauu

SEQ ID NO: 944092 - RNA, 22 nt, Human
guccucuggccuuucccaggac

SEQ ID NO: 944093 - RNA, 22 nt, Human
uccaggcccauggagcagagcu

SEQ ID NO: 944094 - RNA, 22 nt, Human
ugaggcaggaauggggaaaagu

SEQ ID NO: 944095 - RNA, 18 nt, Human
guccugagcucugcugua

SEQ ID NO: 944096 - RNA, 21 nt, Human
cccuguguuccacagcagaca

SEQ ID NO: 944097 - RNA, 22 nt, Human
ucugagggugggagaaggagcu

SEQ ID NO: 944098 - RNA, 23 nt, Human
ggccuccuggucuaggcuagacu

SEQ ID NO: 944099 - RNA, 18 nt, Human
aaacuggcuuggccugug

SEQ ID NO: 944100 - RNA, 20 nt, Human
agcugccccugggcacugcc

SEQ ID NO: 944101 - RNA, 22 nt, Human
aggggagccccugguccuggug

SEQ ID NO: 944102 - RNA, 19 nt, Human
uggcuuccaucucucucau

SEQ ID NO: 944103 - RNA, 22 nt, Human
uuuuaucugcuucauuaguuga

SEQ ID NO: 944104 - RNA, 22 nt, Human
auggcagccugagcagaggaau

SEQ ID NO: 944105 - RNA, 22 nt, Human
ucuguaucacccguucccagaa

SEQ ID NO: 944106 - RNA, 22 nt, Human
ucacacgugagguucuauccug

SEQ ID NO: 944107 - RNA, 22 nt, Human
aagcugccauagaacgagaggu

SEQ ID NO: 944108 - RNA, 22 nt, Human
cuccuggcucugccacuuacua

SEQ ID NO: 944109 - RNA, 22 nt, Human
ucagaagucccuugcaucuuag

SEQ ID NO: 944110 - RNA, 22 nt, Human
agcugccagaugacagugcuau

SEQ ID NO: 944111 - RNA, 20 nt, Human
uccugggguaagccaugguc

SEQ ID NO: 944112 - RNA, 22 nt, Human
ggcucuggcaaggggaggcuac

SEQ ID NO: 944113 - RNA, 22 nt, Human
uuagccaugugggaaaaacagc

SEQ ID NO: 944114 - RNA, 22 nt, Human
gccuucugauaucucuuggcau

SEQ ID NO: 944115 - RNA, 22 nt, Human
gggcuguggagccgcgagggcu

SEQ ID NO: 944116 - RNA, 22 nt, Human
caggugggccaugaaaaaugac

SEQ ID NO: 944117 - RNA, 22 nt, Human
ucugggaagcugcgugccuguu

SEQ ID NO: 944118 - RNA, 22 nt, Human
gugcucuccuggcugcccugac

SEQ ID NO: 944119 - RNA, 22 nt, Human
aaccaaauggaugguaagaggg

SEQ ID NO: 944120 - RNA, 22 nt, Human
auguaagguucagaguauguga

SEQ ID NO: 944121 - RNA, 22 nt, Human
agcuguguagggaaucagagaa

SEQ ID NO: 944122 - RNA, 22 nt, Human
aaggguggauuucugagcucua

SEQ ID NO: 944123 - RNA, 22 nt, Human
uguuggcaucucugagagaguu

SEQ ID NO: 944124 - RNA, 22 nt, Human
uaucuguuggcuccuaguugua

SEQ ID NO: 944125 - RNA, 17 nt, Human
cagacagauauccuggg

SEQ ID NO: 944126 - RNA, 22 nt, Human
caggcagcucugcuuuuccuaa

SEQ ID NO: 944127 - RNA, 22 nt, Human
ccucacagggccaggccccuca

SEQ ID NO: 944128 - RNA, 22 nt, Human
augcagagacagauguggcaug

SEQ ID NO: 944129 - RNA, 22 nt, Human
aucacuguguauguauaugcag

SEQ ID NO: 944130 - RNA, 22 nt, Human
gaggagcacaugaggcugaggg

SEQ ID NO: 944131 - RNA, 19 nt, Human
ugacaggcuguugccuuga

SEQ ID NO: 944132 - RNA, 22 nt, Human
uacuuuagaaggaaauaaguuc

SEQ ID NO: 944133 - RNA, 22 nt, Human
caugucuguguacacaugcaca

SEQ ID NO: 944134 - RNA, 22 nt, Human
agccuggagguaaugaggaaac

SEQ ID NO: 944135 - RNA, 22 nt, Human
gugcauugcgaugcagacgacc

SEQ ID NO: 944136 - RNA, 22 nt, Human
gccucugcggagcuguacauca

SEQ ID NO: 944137 - RNA, 22 nt, Human
gcucugaggcugggagcacucu

SEQ ID NO: 944138 - RNA, 22 nt, Human
ucuguaaaacuucuuuguaaau

SEQ ID NO: 944139 - RNA, 22 nt, Human
aaggcugaggagggccugcagg

SEQ ID NO: 944140 - RNA, 22 nt, Human
ucuggccacccgaggccccugc

SEQ ID NO: 944141 - RNA, 22 nt, Human
caaaguuaucaacugcaacauu

SEQ ID NO: 944142 - RNA, 22 nt, Human
uuauuauaaugagggauaaaaa

SEQ ID NO: 944143 - RNA, 22 nt, Human
uuccucaugggguuccuucaga

SEQ ID NO: 944144 - RNA, 22 nt, Human
agucccagcucagaaccacuag

SEQ ID NO: 944145 - RNA, 22 nt, Human
ucuuuggaucccaacuggcugg

SEQ ID NO: 944146 - RNA, 22 nt, Human
cagaggcuguguaggcagacug

SEQ ID NO: 944147 - RNA, 22 nt, Human
uuucccagagguaugaauaagu

SEQ ID NO: 944148 - RNA, 22 nt, Human
uaaugaauaaacuugagaguca

SEQ ID NO: 944149 - RNA, 22 nt, Human
acauguggucaaucuguguagg

SEQ ID NO: 944150 - RNA, 22 nt, Human
uaauuauucuagucacauagca

SEQ ID NO: 944151 - RNA, 22 nt, Human
agcucccagucuccucuccaug

SEQ ID NO: 944152 - RNA, 22 nt, Human
ucuggccauggcaagccgagug

SEQ ID NO: 944153 - RNA, 22 nt, Human
uuuacagagaauguacauaaag

SEQ ID NO: 944154 - RNA, 22 nt, Human
cacagcagaaauaugaaggcag

SEQ ID NO: 944155 - RNA, 22 nt, Human
cagagccaugguaugggcuugu

SEQ ID NO: 944156 - RNA, 22 nt, Human
cgcaccacugaauuccagccug

SEQ ID NO: 944157 - RNA, 20 nt, Human
ucucaggccccaguuuucuu

SEQ ID NO: 944158 - RNA, 22 nt, Human
aaacuguaagagaauaaacuac

SEQ ID NO: 944159 - RNA, 22 nt, Human
acagaauuaucaggaaauguua

SEQ ID NO: 944160 - RNA, 22 nt, Human
ugcccaaguccuccaccgaggu

SEQ ID NO: 944161 - RNA, 22 nt, Human
aaaugcaucagcucauaagaga

SEQ ID NO: 944162 - RNA, 22 nt, Human
ugcaguggaaucuggagagcag

SEQ ID NO: 944163 - RNA, 22 nt, Human
gcccugucggaacugcgaccuc

SEQ ID NO: 944164 - RNA, 22 nt, Human
uaaauuuacccaaggaacaugu

SEQ ID NO: 944165 - RNA, 22 nt, Human
cagcugagcucccaggccauca

SEQ ID NO: 944166 - RNA, 22 nt, Human
uagaggugacacugagaccaua

SEQ ID NO: 944167 - RNA, 22 nt, Human
ccagcugggauuaagggaaaau

SEQ ID NO: 944168 - RNA, 22 nt, Human
guaguucugcagugucaccuga

SEQ ID NO: 944169 - RNA, 22 nt, Human
ggucucaggagacuggagagca

SEQ ID NO: 944170 - RNA, 23 nt, Human
gggggcugguugacucucugcag

SEQ ID NO: 944171 - RNA, 22 nt, Human
gguggccuuucaguggaucagg

SEQ ID NO: 944172 - RNA, 20 nt, Human
acaauuuccucacuauaugc

SEQ ID NO: 944173 - RNA, 22 nt, Human
ucuccuggucaccucagaaguc

SEQ ID NO: 944174 - RNA, 22 nt, Human
aguauucuggaauucuauguga

SEQ ID NO: 944175 - RNA, 22 nt, Human
ggggcagcuaccggaaguaggg

SEQ ID NO: 944176 - RNA, 22 nt, Human
gucagaggaauggaugagugau

SEQ ID NO: 944177 - RNA, 21 nt, Human
aguucauacugaguaacaaaa

SEQ ID NO: 944178 - RNA, 22 nt, Human
gggcagcugccccucucugggc

SEQ ID NO: 944179 - RNA, 22 nt, Human
uaacagaaguuguucauugugg

SEQ ID NO: 944180 - RNA, 23 nt, Human
agcuggaggcugucuacucccaa

SEQ ID NO: 944181 - RNA, 22 nt, Human
aauggacaggagagcauaguca

SEQ ID NO: 944182 - RNA, 22 nt, Human
gcauucaucuuccuccaugcag

SEQ ID NO: 944183 - RNA, 22 nt, Human
auccugggcagugugucacucu

SEQ ID NO: 944184 - RNA, 22 nt, Human
augaaauaucuugaagaaauuc

SEQ ID NO: 944185 - RNA, 22 nt, Human
gggcagcucucacagcagccaa

SEQ ID NO: 944186 - RNA, 22 nt, Human
ucaagugcuugugagguauuug

SEQ ID NO: 944187 - RNA, 22 nt, Human
ccugauggagcccugcugcaug

SEQ ID NO: 944188 - RNA, 22 nt, Human
augaguaaaaccacuauuuaca

SEQ ID NO: 944189 - RNA, 22 nt, Human
ugaaggaaugagggaguggguc

SEQ ID NO: 944190 - RNA, 22 nt, Human
cauuauguucaguagcuuaaaa

SEQ ID NO: 944191 - RNA, 22 nt, Human
uaucuuugcaaauaucucuaag

SEQ ID NO: 944192 - RNA, 22 nt, Human
uucaugaaaguguaucuugugg

SEQ ID NO: 944193 - RNA, 22 nt, Human
uuggagguuugaaaauaugugu

SEQ ID NO: 944194 - RNA, 22 nt, Human
cacugcaguuccccagugcgca

SEQ ID NO: 944195 - RNA, 22 nt, Human
ccagcugaggcagccacacagg

SEQ ID NO: 944196 - RNA, 22 nt, Human
ggaagggcaaaagagaugaacu

SEQ ID NO: 944197 - RNA, 22 nt, Human
cugcccuggucccauggcugau

SEQ ID NO: 944198 - RNA, 22 nt, Human
aaggagagguuguccguguugu

SEQ ID NO: 944199 - RNA, 19 nt, Human
ugccuggacaaaugugggg

SEQ ID NO: 944200 - RNA, 22 nt, Human
cagagccagaacuagaccuugu

SEQ ID NO: 944201 - RNA, 23 nt, Human
ucuguucaaggcuuucuccuuga

SEQ ID NO: 944202 - RNA, 22 nt, Human
acaaaguaggucaucaaagcuc

SEQ ID NO: 944203 - RNA, 22 nt, Human
acauuguuugagaauacagaug

SEQ ID NO: 944204 - RNA, 22 nt, Human
ggagaaggaagaaagcuacuau

SEQ ID NO: 944205 - RNA, 22 nt, Human
gagagcuggauucuggauaggu

SEQ ID NO: 944206 - RNA, 22 nt, Human
ucaaugauuagaguuuagugug

SEQ ID NO: 944207 - RNA, 23 nt, Human
aagcugccuucgcaguuggucug

SEQ ID NO: 944208 - RNA, 22 nt, Human
gucaggaugggcagccaaacua

SEQ ID NO: 944209 - RNA, 22 nt, Human
uagaaaguaaaucaguuuuauu

SEQ ID NO: 944210 - RNA, 22 nt, Human
ccuggagcacagcccaguccca

SEQ ID NO: 944211 - RNA, 22 nt, Human
uggguucagaucccagcucugu

SEQ ID NO: 944212 - RNA, 22 nt, Human
ugugaaaagcaggcuacuuucu

SEQ ID NO: 944213 - RNA, 22 nt, Human
uccaggaguccuggguggcccc

SEQ ID NO: 944214 - RNA, 22 nt, Human
caugaagcacagcucucuuuuu

SEQ ID NO: 944215 - RNA, 22 nt, Human
cagacaggaauucuggcguggu

SEQ ID NO: 944216 - RNA, 22 nt, Human
agagggcaaguguaguccagua

SEQ ID NO: 944217 - RNA, 22 nt, Human
aggcagcuggaggcagagacua

SEQ ID NO: 944218 - RNA, 22 nt, Human
caggggcuguuugccucaggcc

SEQ ID NO: 944219 - RNA, 22 nt, Human
uggcacaugguaagugcuuaac

SEQ ID NO: 944220 - RNA, 17 nt, Human
gccucugcuugugucau

SEQ ID NO: 944221 - RNA, 19 nt, Human
ccauggcaaugaucugaug

SEQ ID NO: 944222 - RNA, 22 nt, Human
ggcagccauggacacuggcuag

SEQ ID NO: 944223 - RNA, 22 nt, Human
ucauuacagagauauaaucuac

SEQ ID NO: 944224 - RNA, 22 nt, Human
acagaauauugguuacuguugc

SEQ ID NO: 944225 - RNA, 22 nt, Human
ggcaagcauaaccuguacagcc

SEQ ID NO: 944226 - RNA, 22 nt, Human
cacuacuugaaagaauuacaga

SEQ ID NO: 944227 - RNA, 22 nt, Human
aggguggagggagucccugagc

SEQ ID NO: 944228 - RNA, 22 nt, Human
cucacagcagcucugcgagaua

SEQ ID NO: 944229 - RNA, 22 nt, Human
ggcagagaugugggucagaauc

SEQ ID NO: 944230 - RNA, 22 nt, Human
cuggccuggucuggccucucca

SEQ ID NO: 944231 - RNA, 22 nt, Human
aacaugcucuguuucuuggaug

SEQ ID NO: 944232 - RNA, 22 nt, Human
uggggaggacgggcgccuuccu

SEQ ID NO: 944233 - RNA, 22 nt, Human
acauuuaaugauccuacuguga

SEQ ID NO: 944234 - RNA, 22 nt, Human
uagugcuuuaaguuuacagaga

SEQ ID NO: 944235 - RNA, 22 nt, Human
ucaaagucuaucuguaauuacu

SEQ ID NO: 944236 - RNA, 22 nt, Human
ucagucuuugcuuaugacaaua

SEQ ID NO: 944237 - RNA, 22 nt, Human
agucagcagccuggccaggaga

SEQ ID NO: 944238 - RNA, 22 nt, Human
ugucuuccucuuggcuugagcu

SEQ ID NO: 944239 - RNA, 22 nt, Human
aacauucaccucuaccuccuuc

SEQ ID NO: 944240 - RNA, 22 nt, Human
agaaggaguguacaggucaugc

SEQ ID NO: 944241 - RNA, 22 nt, Human
ccagugggugcugggcucugcc

SEQ ID NO: 944242 - RNA, 22 nt, Human
ccaaaugugccuguuucaacaa

SEQ ID NO: 944243 - RNA, 22 nt, Human
gaagcagcugccagagaugucu

SEQ ID NO: 944244 - RNA, 22 nt, Human
uccacauccauugcuugacuuu

SEQ ID NO: 944245 - RNA, 22 nt, Human
agacccugcaccucucgugggc

SEQ ID NO: 944246 - RNA, 22 nt, Human
aucugccucuucuucauugcga

SEQ ID NO: 944247 - RNA, 22 nt, Human
auguuucaccaguuuuauaaga

SEQ ID NO: 944248 - RNA, 22 nt, Human
cugugucuguggaauagcgaau

SEQ ID NO: 944249 - RNA, 22 nt, Human
acaccuuugccccaagucauag

SEQ ID NO: 944250 - RNA, 22 nt, Human
gagcuggcaggaggcuccccga

SEQ ID NO: 944251 - RNA, 22 nt, Human
aggcagcagucaugaggaaaga

SEQ ID NO: 944252 - RNA, 22 nt, Human
accaaggaagagauucucaguu

SEQ ID NO: 944253 - RNA, 22 nt, Human
ugcaacagacuuuauuaacucu

SEQ ID NO: 944254 - RNA, 22 nt, Human
uucuuaagcaccuaaaaagugg

SEQ ID NO: 944255 - RNA, 22 nt, Human
ugugucuguguauacacggcau

SEQ ID NO: 944256 - RNA, 20 nt, Human
ccugucuccucuuaccuggc

SEQ ID NO: 944257 - RNA, 22 nt, Human
caggaugagguagaggcagaua

SEQ ID NO: 944258 - RNA, 22 nt, Human
cugccagccaggccagguaggc

SEQ ID NO: 944259 - RNA, 21 nt, Human
uuugaauagaaauagugcuua

SEQ ID NO: 944260 - RNA, 22 nt, Human
ugcucugugguccaagauggcu

SEQ ID NO: 944261 - RNA, 22 nt, Human
guuuuaguggguggccacugau

SEQ ID NO: 944262 - RNA, 22 nt, Human
gcugccugauguccagcaggac

SEQ ID NO: 944263 - RNA, 22 nt, Human
uccaugaguuugaggaaaagag

SEQ ID NO: 944264 - RNA, 20 nt, Human
ccaauaaagcucuauaggga

SEQ ID NO: 944265 - RNA, 22 nt, Human
uaucuguuguccaugcagaaag

SEQ ID NO: 944266 - RNA, 22 nt, Human
gcacugugcuagaagccagggg

SEQ ID NO: 944267 - RNA, 22 nt, Human
ggucaggguuccagguaucuuc

SEQ ID NO: 944268 - RNA, 22 nt, Human
agagcuggcugguagcccugau

SEQ ID NO: 944269 - RNA, 22 nt, Human
cuggccaacuugcuuguuggca

SEQ ID NO: 944270 - RNA, 22 nt, Human
ucugagaggcagaccuuccuaa

SEQ ID NO: 944271 - RNA, 22 nt, Human
guagcuuaugaaaugugagggg

SEQ ID NO: 944272 - RNA, 22 nt, Human
aggccagcuuccagaggggcag

SEQ ID NO: 944273 - RNA, 22 nt, Human
uuugauucuguaaaauaacagg

SEQ ID NO: 944274 - RNA, 22 nt, Human
caaauccagaucccagucguag

SEQ ID NO: 944275 - RNA, 22 nt, Human
agaaaugugagccccuuaucaa

SEQ ID NO: 944276 - RNA, 22 nt, Human
aggcagcauuugaauccagguc

SEQ ID NO: 944277 - RNA, 22 nt, Human
cuaggccacuugcucucaugga

SEQ ID NO: 944278 - RNA, 22 nt, Human
gcaggcaguuauuuaguagaau

SEQ ID NO: 944279 - RNA, 22 nt, Human
gguuugcaugugauguugggca

SEQ ID NO: 944280 - RNA, 23 nt, Human
acuuuauugaccccaggucaguu

SEQ ID NO: 944281 - RNA, 18 nt, Human
cuuguucuucucuuggcg

SEQ ID NO: 944282 - RNA, 22 nt, Human
acagaauacuacagacugguua

SEQ ID NO: 944283 - RNA, 22 nt, Human
cauuuguauagugcuuagacca

SEQ ID NO: 944284 - RNA, 22 nt, Human
ucauuuguaccauuuuuuaaga

SEQ ID NO: 944285 - RNA, 22 nt, Human
uccuggccuagcucacccugga

SEQ ID NO: 944286 - RNA, 22 nt, Human
cuggcagucugccucuucacug

SEQ ID NO: 944287 - RNA, 22 nt, Human
uuuccucuuugugacacagcug

SEQ ID NO: 944288 - RNA, 22 nt, Human
gucauucuuaacaacucaguag

SEQ ID NO: 944289 - RNA, 22 nt, Human
aguuauauuccauagauucaga

SEQ ID NO: 944290 - RNA, 22 nt, Human
cuggggcucacuuuggucaggc

SEQ ID NO: 944291 - RNA, 22 nt, Human
aagcacaaugaacaucuuagau

SEQ ID NO: 944292 - RNA, 22 nt, Human
ucucagagaagugaugagcaau

SEQ ID NO: 944293 - RNA, 22 nt, Human
ugcuucuggaaacaguggcugu

SEQ ID NO: 944294 - RNA, 22 nt, Human
cccaggagaucuggaucucguc

SEQ ID NO: 944295 - RNA, 22 nt, Human
gcugggaggaucucucccuguc

SEQ ID NO: 944296 - RNA, 22 nt, Human
uuugcauugcauuaaguauucu

SEQ ID NO: 944297 - RNA, 22 nt, Human
gcaguccucucauuggccuccu

SEQ ID NO: 944298 - RNA, 22 nt, Human
ccaggagaugggagcaucuaaa

SEQ ID NO: 944299 - RNA, 18 nt, Human
cugaggcuggcaggagcc

SEQ ID NO: 944300 - RNA, 21 nt, Human
gggccuggcugcgcaggacgg

SEQ ID NO: 944301 - RNA, 22 nt, Human
auacuguuucucuucuacauga

SEQ ID NO: 944302 - RNA, 22 nt, Human
ugucuuaagaaauugcauuugu

SEQ ID NO: 944303 - RNA, 22 nt, Human
guuuaauaauguugaauuacua

SEQ ID NO: 944304 - RNA, 22 nt, Human
guccucuguguaggcugcagac

SEQ ID NO: 944305 - RNA, 22 nt, Human
uguuaucugagcaacgucgacg

SEQ ID NO: 944306 - RNA, 22 nt, Human
uggagcuggaauuucugggccu

SEQ ID NO: 944307 - RNA, 22 nt, Human
gccugagauucccggagccgug

SEQ ID NO: 944308 - RNA, 22 nt, Human
aucuuucagggccauuuguauu

SEQ ID NO: 944309 - RNA, 22 nt, Human
ucuuugcaugugcuucuuggcc

SEQ ID NO: 944310 - RNA, 22 nt, Human
agcugcccagcuaggaagaagg

SEQ ID NO: 944311 - RNA, 22 nt, Human
cugccacuuacuaggcauggug

SEQ ID NO: 944312 - RNA, 22 nt, Human
ucucaggaauagaguggcagca

SEQ ID NO: 944313 - RNA, 22 nt, Human
ucugagagccucuagccuaagu

SEQ ID NO: 944314 - RNA, 22 nt, Human
uauugacaauaggcaacugagg

SEQ ID NO: 944315 - RNA, 22 nt, Human
aguugaaauuagaguccuggcu

SEQ ID NO: 944316 - RNA, 22 nt, Human
uauccagggaguuuuagggcuu

SEQ ID NO: 944317 - RNA, 22 nt, Human
auucagcauaaucaguagcuug

SEQ ID NO: 944318 - RNA, 22 nt, Human
ccuggcagcgugccgagcugcg

SEQ ID NO: 944319 - RNA, 22 nt, Human
gugugcaguagagaaagagcag

SEQ ID NO: 944320 - RNA, 19 nt, Human
uauggcaggccgaggcacu

SEQ ID NO: 944321 - RNA, 22 nt, Human
ugcagcucauugcuggggucug

SEQ ID NO: 944322 - RNA, 22 nt, Human
ugggagccauuuuagaggcugc

SEQ ID NO: 944323 - RNA, 22 nt, Human
ggagcagagcucuucaucugca

SEQ ID NO: 944324 - RNA, 20 nt, Human
cccaggagugagcagcuuua

SEQ ID NO: 944325 - RNA, 22 nt, Human
gcccaggaguuggaggcugcag

SEQ ID NO: 944326 - RNA, 22 nt, Human
ggccucacccaucggugccuuu

SEQ ID NO: 944327 - RNA, 22 nt, Human
cugccaggacugacgucuucag

SEQ ID NO: 944328 - RNA, 22 nt, Human
cuugaaagcacuccuuugacug

SEQ ID NO: 944329 - RNA, 22 nt, Human
ucuggccugggccugccggugc

SEQ ID NO: 944330 - RNA, 22 nt, Human
cugcagagguugguucuaagau

SEQ ID NO: 944331 - RNA, 22 nt, Human
uugaauaauuaauuacacucag

SEQ ID NO: 944332 - RNA, 22 nt, Human
ugccugggccuucccaccucug

SEQ ID NO: 944333 - RNA, 22 nt, Human
cagagccagcaguggggacagg

SEQ ID NO: 944334 - RNA, 23 nt, Human
agcccagcagagaaccuaggucc

SEQ ID NO: 944335 - RNA, 22 nt, Human
ggcaaaguuuucaucucauaac

SEQ ID NO: 944336 - RNA, 22 nt, Human
gagccuggauugucaccgacuu

SEQ ID NO: 944337 - RNA, 22 nt, Human
auugacaaauggauguugacau

SEQ ID NO: 944338 - RNA, 22 nt, Human
caggccugauacacugaacucu

SEQ ID NO: 944339 - RNA, 22 nt, Human
ucuggcucaggagcuguguuca

SEQ ID NO: 944340 - RNA, 22 nt, Human
gaggccugucgcuaggccucug

SEQ ID NO: 944341 - RNA, 22 nt, Human
uuuuuuauaucaacugaagucu

SEQ ID NO: 944342 - RNA, 22 nt, Human
acagcagcaauagcagugacau

SEQ ID NO: 944343 - RNA, 22 nt, Human
cagcaccaggcagaccuggagc

SEQ ID NO: 944344 - RNA, 22 nt, Human
ugcauguguuugccacagugag

SEQ ID NO: 944345 - RNA, 22 nt, Human
uuugaaagccuggcuuuucucu

SEQ ID NO: 944346 - RNA, 22 nt, Human
guguccagagaaacucacagcu

SEQ ID NO: 944347 - RNA, 22 nt, Human
guucuucaggccauccucccag

SEQ ID NO: 944348 - RNA, 22 nt, Human
cugggccagaccuuguggucuu

SEQ ID NO: 944349 - RNA, 22 nt, Human
auggccaaauaacagcuugcau

SEQ ID NO: 944350 - RNA, 22 nt, Human
ggaggcaggaaagacagguuca

SEQ ID NO: 944351 - RNA, 22 nt, Human
augguacaauguguuuguuagg

SEQ ID NO: 944352 - RNA, 22 nt, Human
cugggcuguaauguggcacuga

SEQ ID NO: 944353 - RNA, 22 nt, Human
agaagauuuagguugacgcuau

SEQ ID NO: 944354 - RNA, 22 nt, Human
gugcuuuccauccucccugcug

SEQ ID NO: 944355 - RNA, 21 nt, Human
gagugucuaauccaggcuguc

SEQ ID NO: 944356 - RNA, 22 nt, Human
cugaagaggacgcagcagcaag

SEQ ID NO: 944357 - RNA, 22 nt, Human
gggcagcugcagggauggugac

SEQ ID NO: 944358 - RNA, 22 nt, Human
agcccucauggaacagcuccua

SEQ ID NO: 944359 - RNA, 22 nt, Human
uccaggagcauccaggugaagc

SEQ ID NO: 944360 - RNA, 22 nt, Human
uguucuucuagauugccuuuua

SEQ ID NO: 944361 - RNA, 22 nt, Human
uagaauauacacuacagcuuaa

SEQ ID NO: 944362 - RNA, 22 nt, Human
acagcagccuuguugguuucga

SEQ ID NO: 944363 - RNA, 22 nt, Human
gacaugcaacaauuuggcauuu

SEQ ID NO: 944364 - RNA, 21 nt, Human
acccuggguucuccauacccu

SEQ ID NO: 944365 - RNA, 20 nt, Human
gccaggagggugugaugagc

SEQ ID NO: 944366 - RNA, 22 nt, Human
guuauauauaguauuucucuga

SEQ ID NO: 944367 - RNA, 22 nt, Human
ccagagcuucggggcggcugua

SEQ ID NO: 944368 - RNA, 22 nt, Human
aaaauacacauacuaggggaaa

SEQ ID NO: 944369 - RNA, 22 nt, Human
ccucugaguccucccugguugc

SEQ ID NO: 944370 - RNA, 22 nt, Human
cccuggugguacggcacuggca

SEQ ID NO: 944371 - RNA, 22 nt, Human
gcaccuuucuauauucaguggc

SEQ ID NO: 944372 - RNA, 22 nt, Human
ggcccacacugacagcugagcu

SEQ ID NO: 944373 - RNA, 22 nt, Human
gguuggaggugggaauagcuag

SEQ ID NO: 944374 - RNA, 22 nt, Human
uuaguuaggaaacaaaguuguu

SEQ ID NO: 944375 - RNA, 22 nt, Human
aguaaugugccugaaauacuug

SEQ ID NO: 944376 - RNA, 22 nt, Human
cugaggccccucuugugagcau

SEQ ID NO: 944377 - RNA, 22 nt, Human
cucagcuggcaauucuggcucc

SEQ ID NO: 944378 - RNA, 22 nt, Human
caggagagcccggguccgggcu

SEQ ID NO: 944379 - RNA, 22 nt, Human
gcauuuguacaaaaugcaguag

SEQ ID NO: 944380 - RNA, 22 nt, Human
cagagcagguaucuuuggugaa

SEQ ID NO: 944381 - RNA, 19 nt, Human
uggcagggagugauauuag

SEQ ID NO: 944382 - RNA, 22 nt, Human
uugcaaaggggaauaaagcaau

SEQ ID NO: 944383 - RNA, 22 nt, Human
ugagguggcuagggaggcacuc

SEQ ID NO: 944384 - RNA, 22 nt, Human
acauucuagauauguuauauuu

SEQ ID NO: 944385 - RNA, 22 nt, Human
uauuucagcacaugggauaggu

SEQ ID NO: 944386 - RNA, 22 nt, Human
acaaaugcaaguuuuaugucaa

SEQ ID NO: 944387 - RNA, 22 nt, Human
agagacugcgugucagcgcugg

SEQ ID NO: 944388 - RNA, 22 nt, Human
acuaaauaguuuugacagaaca

SEQ ID NO: 944389 - RNA, 22 nt, Human
gcugcccagacauugaaucagg

SEQ ID NO: 944390 - RNA, 22 nt, Human
cugggagacaagagagggcuga

SEQ ID NO: 944391 - RNA, 23 nt, Human
uccucccaaauuucagccucauu

SEQ ID NO: 944392 - RNA, 22 nt, Human
aggcaggcucaggcccaugcuu

SEQ ID NO: 944393 - RNA, 19 nt, Human
agggccugagcagauguug

SEQ ID NO: 944394 - RNA, 22 nt, Human
auuuucagagacaucuggacuu

SEQ ID NO: 944395 - RNA, 22 nt, Human
caggagaaauguggcugcuacc

SEQ ID NO: 944396 - RNA, 22 nt, Human
gggggcuggacuuucccacaca

SEQ ID NO: 944397 - RNA, 22 nt, Human
aaggaaagacauauaaaugacu

SEQ ID NO: 944398 - RNA, 22 nt, Human
gacauaaaauucaauaauuugu

SEQ ID NO: 944399 - RNA, 22 nt, Human
uggcucugaucagauguccagu

SEQ ID NO: 944400 - RNA, 22 nt, Human
uucaaugauuuuuagggaucau

SEQ ID NO: 944401 - RNA, 22 nt, Human
aggaagcuagagccaccggacu

SEQ ID NO: 944402 - RNA, 22 nt, Human
gcagggaggaagagaugcuucc

SEQ ID NO: 944403 - RNA, 20 nt, Human
acagaauaugcugguugugg

SEQ ID NO: 944404 - RNA, 22 nt, Human
acccaggauagagugcugcagu

SEQ ID NO: 944405 - RNA, 22 nt, Human
acuggccaugggauuuauauuu

SEQ ID NO: 944406 - RNA, 22 nt, Human
agucucugcugguugugccuau

SEQ ID NO: 944407 - RNA, 22 nt, Human
aagcuuucagagcagaauguga

SEQ ID NO: 944408 - RNA, 22 nt, Human
caucacccggaacugugucugc

SEQ ID NO: 944409 - RNA, 22 nt, Human
gcagcugcuggaaguuccugcc

SEQ ID NO: 944410 - RNA, 23 nt, Human
caggcaggaugaggacuacacuc

SEQ ID NO: 944411 - RNA, 22 nt, Human
gucccauaaguagugcaacuug

SEQ ID NO: 944412 - RNA, 22 nt, Human
ggagaggagauuguggcauuuu

SEQ ID NO: 944413 - RNA, 22 nt, Human
ggcaccuggauguagcagugaa

SEQ ID NO: 944414 - RNA, 22 nt, Human
ccaaaguccauaguuuacauua

SEQ ID NO: 944415 - RNA, 22 nt, Human
cagcuuggaggaggaucuaaga

SEQ ID NO: 944416 - RNA, 22 nt, Human
acuggagcccguggaggcgcag

SEQ ID NO: 944417 - RNA, 22 nt, Human
ucuuccucuagaucugaggccc

SEQ ID NO: 944418 - RNA, 22 nt, Human
uggcagagugcagaagaggcau

SEQ ID NO: 944419 - RNA, 22 nt, Human
gagagugucgggggccccagga

SEQ ID NO: 944420 - RNA, 22 nt, Human
cagcuucugagcaagccagggg

SEQ ID NO: 944421 - RNA, 22 nt, Human
ggcuucuguccucuggaucugu

SEQ ID NO: 944422 - RNA, 22 nt, Human
uaaugcacaugacugaacuauu

SEQ ID NO: 944423 - RNA, 22 nt, Human
uguguucuggaaagcucacuga

SEQ ID NO: 944424 - RNA, 22 nt, Human
auuuauuaccucggaguuucug

SEQ ID NO: 944425 - RNA, 22 nt, Human
aagaaauaagacuucucugucc

SEQ ID NO: 944426 - RNA, 22 nt, Human
cuuauuagugucugucugaguu

SEQ ID NO: 944427 - RNA, 22 nt, Human
ccagcugguguuccuuaggacc

SEQ ID NO: 944428 - RNA, 22 nt, Human
uggcugggagcuggaacugggc

SEQ ID NO: 944429 - RNA, 22 nt, Human
gauauuuugagaaauccuauga

SEQ ID NO: 944430 - RNA, 19 nt, Human
ucccagagucuagagguug

SEQ ID NO: 944431 - RNA, 20 nt, Human
agcugguuaucuuaauucuu

SEQ ID NO: 944432 - RNA, 22 nt, Human
auuagagaaugugcugacauug

SEQ ID NO: 944433 - RNA, 23 nt, Human
uuguuuuuagagguggcaugaga

SEQ ID NO: 944434 - RNA, 22 nt, Human
ucacaaaagcuuuugaauuugg

SEQ ID NO: 944435 - RNA, 22 nt, Human
agcucacagaaauccugcagga

SEQ ID NO: 944436 - RNA, 22 nt, Human
cagcuccugggccaucuccuag

SEQ ID NO: 944437 - RNA, 21 nt, Human
uuuuuucuugcgugaggccug

SEQ ID NO: 944438 - RNA, 22 nt, Human
ggcagucuuaucagcauuggac

SEQ ID NO: 944439 - RNA, 22 nt, Human
aggucaaggccaaaagaguggu

SEQ ID NO: 944440 - RNA, 22 nt, Human
caaggccaagguuuugugaacu

SEQ ID NO: 944441 - RNA, 22 nt, Human
ucccaggacaggccacauggaa

SEQ ID NO: 944442 - RNA, 22 nt, Human
ugucaccucuuuggcugcagcu

SEQ ID NO: 944443 - RNA, 22 nt, Human
gcucacuggccugaagaggacg

SEQ ID NO: 944444 - RNA, 22 nt, Human
ccagcccugucaccaacuggag

SEQ ID NO: 944445 - RNA, 22 nt, Human
gcauuccuacaggcugcuauga

SEQ ID NO: 944446 - RNA, 22 nt, Human
gauuucaaguaucuugggcgag

SEQ ID NO: 944447 - RNA, 22 nt, Human
cuucucuucccagggacacagg

SEQ ID NO: 944448 - RNA, 20 nt, Human
agagaauucccuuuggagau

SEQ ID NO: 944449 - RNA, 22 nt, Human
gggaggugauuaggaccaugua

SEQ ID NO: 944450 - RNA, 22 nt, Human
gcugccugcucggcuccuggga

SEQ ID NO: 944451 - RNA, 22 nt, Human
aagcagccucauuugugguaag

SEQ ID NO: 944452 - RNA, 22 nt, Human
uugaacaguuuugucagguuca

SEQ ID NO: 944453 - RNA, 22 nt, Human
agcugguguccuccuggagcug

SEQ ID NO: 944454 - RNA, 22 nt, Human
ucacuguugaccuggaaguggg

SEQ ID NO: 944455 - RNA, 22 nt, Human
ugcauguuauuguggcaagaau

SEQ ID NO: 944456 - RNA, 22 nt, Human
cacuugggagcauugcacaugu

SEQ ID NO: 944457 - RNA, 22 nt, Human
aaagagcuucauuuccauuuau

SEQ ID NO: 944458 - RNA, 23 nt, Human
auaauaacgucugucuugucucu

SEQ ID NO: 944459 - RNA, 22 nt, Human
gagccuguguuuccuguagcca

SEQ ID NO: 944460 - RNA, 22 nt, Human
acacagggcaaugcuuugaccu

SEQ ID NO: 944461 - RNA, 22 nt, Human
aggacuuagaacauuauguacu

SEQ ID NO: 944462 - RNA, 22 nt, Human
cccagcagaaucugaugagggc

SEQ ID NO: 944463 - RNA, 22 nt, Human
gagggcagagacagugauucac

SEQ ID NO: 944464 - RNA, 22 nt, Human
aaagguuaguucuuagaagugc

SEQ ID NO: 944465 - RNA, 22 nt, Human
gcuggcugcgucaucacagggc

SEQ ID NO: 944466 - RNA, 22 nt, Human
uugcauuguaggauguuagaag

SEQ ID NO: 944467 - RNA, 22 nt, Human
aggcagagagcaguggccgucu

SEQ ID NO: 944468 - RNA, 22 nt, Human
agggagaaaauuggaugcacaa

SEQ ID NO: 944469 - RNA, 18 nt, Human
ugucucaggcugaaacag

SEQ ID NO: 944470 - RNA, 22 nt, Human
ugcuccagugagcuggccaucc

SEQ ID NO: 944471 - RNA, 22 nt, Human
acugccuugaaagauuguugag

SEQ ID NO: 944472 - RNA, 22 nt, Human
agggcccauagaucgucagcuu

SEQ ID NO: 944473 - RNA, 19 nt, Human
accaggaguaucagagcug

SEQ ID NO: 944474 - RNA, 22 nt, Human
gagagggauacugaguuuuggu

SEQ ID NO: 944475 - RNA, 22 nt, Human
caggcagccuucucgucucaca

SEQ ID NO: 944476 - RNA, 22 nt, Human
gcacccagaggucagcagugcu

SEQ ID NO: 944477 - RNA, 22 nt, Human
cauuuugugcuagacacuaugg

SEQ ID NO: 944478 - RNA, 22 nt, Human
uggguaaacugggucuggagag

SEQ ID NO: 944479 - RNA, 22 nt, Human
agccugccuugggcugcuugag

SEQ ID NO: 944480 - RNA, 22 nt, Human
guggccaagaaaauagaugcau

SEQ ID NO: 944481 - RNA, 22 nt, Human
auagaauagcauagaaaauuga

SEQ ID NO: 944482 - RNA, 22 nt, Human
caggugggagcggagacugauu

SEQ ID NO: 944483 - RNA, 22 nt, Human
ucuuuuggguucuuaugauuua

SEQ ID NO: 944484 - RNA, 21 nt, Human
aagaaguuuggauuuuguccu

SEQ ID NO: 944485 - RNA, 22 nt, Human
uagcugcccaucuuuccuuuag

SEQ ID NO: 944486 - RNA, 22 nt, Human
gacccuguuucuacaaauaauu

SEQ ID NO: 944487 - RNA, 22 nt, Human
cccugccuacaggguuuucuuu

SEQ ID NO: 944488 - RNA, 22 nt, Human
aguuauaaucugcuacugauau

SEQ ID NO: 944489 - RNA, 22 nt, Human
agaccaagaaaggaugaggauc

SEQ ID NO: 944490 - RNA, 22 nt, Human
gcuggcuguguuccuucugcca

SEQ ID NO: 944491 - RNA, 20 nt, Human
gccuggaggcagagauaaag

SEQ ID NO: 944492 - RNA, 22 nt, Human
caguugcuggaugugcagcucu

SEQ ID NO: 944493 - RNA, 22 nt, Human
aauucacagcauuugcccaucu

SEQ ID NO: 944494 - RNA, 21 nt, Human
ggucagggggugccuccaggu

SEQ ID NO: 944495 - RNA, 22 nt, Human
aggcagagcugauguucuguga

SEQ ID NO: 944496 - RNA, 22 nt, Human
cugccagcaaugugaccaugcu

SEQ ID NO: 944497 - RNA, 22 nt, Human
caaggccaaagggccacuguca

SEQ ID NO: 944498 - RNA, 22 nt, Human
ccugggcaacauagugagaccc

SEQ ID NO: 944499 - RNA, 22 nt, Human
acauuucuuccuaauuaucccu

SEQ ID NO: 944500 - RNA, 22 nt, Human
caggccugacccugagcuucac

SEQ ID NO: 944501 - RNA, 22 nt, Human
cuguccauuuucgugccuccuu

SEQ ID NO: 944502 - RNA, 22 nt, Human
aacucaguguguuucuuaguau

SEQ ID NO: 944503 - RNA, 22 nt, Human
acauagcuuaaaugagaagaua

SEQ ID NO: 944504 - RNA, 22 nt, Human
cugcuuuguguggucccuccag

SEQ ID NO: 944505 - RNA, 22 nt, Human
ugcucugggcaacagccucccu

SEQ ID NO: 944506 - RNA, 18 nt, Human
uggagccauugccaccau

SEQ ID NO: 944507 - RNA, 22 nt, Human
auaaggcagaaaugauucuagu

SEQ ID NO: 944508 - RNA, 22 nt, Human
cugggccuagaggaagcugaca

SEQ ID NO: 944509 - RNA, 22 nt, Human
agcagccaaaugaagauuuuac

SEQ ID NO: 944510 - RNA, 22 nt, Human
uuauuccagcuaagaguccugg

SEQ ID NO: 944511 - RNA, 22 nt, Human
uuagcugacugugugauuuggc

SEQ ID NO: 944512 - RNA, 22 nt, Human
acagauugaucuugagaauuau

SEQ ID NO: 944513 - RNA, 22 nt, Human
cuggagcuccagggucuccucu

SEQ ID NO: 944514 - RNA, 22 nt, Human
agcuccugaaaauccagacugg

SEQ ID NO: 944515 - RNA, 22 nt, Human
ccaggacuucgaggcuacagug

SEQ ID NO: 944516 - RNA, 22 nt, Human
ccugagggaaggaugcuaccca

SEQ ID NO: 944517 - RNA, 22 nt, Human
agagugaagguugacacuucac

SEQ ID NO: 944518 - RNA, 22 nt, Human
cacagaaucugugacuccaaga

SEQ ID NO: 944519 - RNA, 22 nt, Human
agucuugcauuuucugaagaug

SEQ ID NO: 944520 - RNA, 22 nt, Human
ugucaucucacugauauagaug

SEQ ID NO: 944521 - RNA, 21 nt, Human
gcagccagccgagaccaugcc

SEQ ID NO: 944522 - RNA, 16 nt, Human
uggaaggggucuccgg

SEQ ID NO: 944523 - RNA, 22 nt, Human
gugaggugguacaauauuaacu

SEQ ID NO: 944524 - RNA, 22 nt, Human
agcagggcagguaaggaucaga

SEQ ID NO: 944525 - RNA, 22 nt, Human
cuugugcaauugacauugaauc

SEQ ID NO: 944526 - RNA, 22 nt, Human
cagugcuccugauguacccuug

SEQ ID NO: 944527 - RNA, 22 nt, Human
gcagcagaugcuuucauggaca

SEQ ID NO: 944528 - RNA, 22 nt, Human
gcccuggaaucucuccauggga

SEQ ID NO: 944529 - RNA, 22 nt, Human
cugggucuccggcagccucggg

SEQ ID NO: 944530 - RNA, 22 nt, Human
gaggugagaagggggucagaug

SEQ ID NO: 944531 - RNA, 20 nt, Human
cccagccccuaccuguugcc

SEQ ID NO: 944532 - RNA, 22 nt, Human
cucugaacucuugggcagcaug

SEQ ID NO: 944533 - RNA, 18 nt, Human
acugugugaauuagcucc

SEQ ID NO: 944534 - RNA, 22 nt, Human
caggaaagggaugggcugccac

SEQ ID NO: 944535 - RNA, 22 nt, Human
ugagcccagagaucugagcuau

SEQ ID NO: 944536 - RNA, 22 nt, Human
uacaugcucaguaacuuucagu

SEQ ID NO: 944537 - RNA, 22 nt, Human
ucuguucuuguccccacuucag

SEQ ID NO: 944538 - RNA, 22 nt, Human
ucucagagaggggccgggccuu

SEQ ID NO: 944539 - RNA, 22 nt, Human
acaaagugcacaagaugagaac

SEQ ID NO: 944540 - RNA, 22 nt, Human
aguuguaagagacagauauaaa

SEQ ID NO: 944541 - RNA, 22 nt, Human
ggacaggguaaguacuagugug

SEQ ID NO: 944542 - RNA, 22 nt, Human
gagggugggccagauaugaggg

SEQ ID NO: 944543 - RNA, 22 nt, Human
uucaaucauuuuuacauagucc

SEQ ID NO: 944544 - RNA, 22 nt, Human
ucucaggagccacagcgggagu

SEQ ID NO: 944545 - RNA, 22 nt, Human
aaaugaugcucacagauuagug

SEQ ID NO: 944546 - RNA, 22 nt, Human
acaggggcuccgaaggugaggg

SEQ ID NO: 944547 - RNA, 22 nt, Human
acauagaaccuggcacauagua

SEQ ID NO: 944548 - RNA, 22 nt, Human
uuggcagauuugucaguaagcu

SEQ ID NO: 944549 - RNA, 22 nt, Human
agccuccaucccaugcacaaag

SEQ ID NO: 944550 - RNA, 21 nt, Human
accucaagcaacaaccaaggu

SEQ ID NO: 944551 - RNA, 22 nt, Human
ucaguuuuuaagaguuaugcga

SEQ ID NO: 944552 - RNA, 22 nt, Human
ucuuggccccaccugugccagc

SEQ ID NO: 944553 - RNA, 22 nt, Human
cugccaggcagcagagggagaa

SEQ ID NO: 944554 - RNA, 21 nt, Human
aaggagccuaggaggcucagg

SEQ ID NO: 944555 - RNA, 22 nt, Human
cuucuugcaauuuucaucuuau

SEQ ID NO: 944556 - RNA, 23 nt, Human
cagaaaacccagagcucaguccc

SEQ ID NO: 944557 - RNA, 22 nt, Human
uuccugaugcacacagucauuu

SEQ ID NO: 944558 - RNA, 22 nt, Human
gggaaauugugugagaucuuug

SEQ ID NO: 944559 - RNA, 22 nt, Human
ggggccugcgagguucaacuuc

SEQ ID NO: 944560 - RNA, 22 nt, Human
agacaaauggaguaugagcaac

SEQ ID NO: 944561 - RNA, 22 nt, Human
cagucccacaagaucuccacaa

SEQ ID NO: 944562 - RNA, 22 nt, Human
auguguaggugaaucgaggcug

SEQ ID NO: 944563 - RNA, 21 nt, Human
cccaggagaagaaaagaugca

SEQ ID NO: 944564 - RNA, 22 nt, Human
uaugaaaagguggccaauguag

SEQ ID NO: 944565 - RNA, 22 nt, Human
acucaagauagggaaaguacaa

SEQ ID NO: 944566 - RNA, 22 nt, Human
ugcugcacucaccaacagauaa

SEQ ID NO: 944567 - RNA, 22 nt, Human
ucacaccuguaaucccaggccu

SEQ ID NO: 944568 - RNA, 20 nt, Human
gcauggcauguagugaagug

SEQ ID NO: 944569 - RNA, 22 nt, Human
gcugcugcgcuugucuacuguu

SEQ ID NO: 944570 - RNA, 22 nt, Human
guugggaaggcaagaaguagaa

SEQ ID NO: 944571 - RNA, 20 nt, Human
aaucagaaagugugagcucu

SEQ ID NO: 944572 - RNA, 22 nt, Human
acaaagugaauugcaucgaguu

SEQ ID NO: 944573 - RNA, 20 nt, Human
gugcauuucaccuguacugu

SEQ ID NO: 944574 - RNA, 22 nt, Human
guaacacagaaaugaaauucca

SEQ ID NO: 944575 - RNA, 22 nt, Human
ucucuggaauuuugagagugac

SEQ ID NO: 944576 - RNA, 22 nt, Human
gccugcagauauauaggauggu

SEQ ID NO: 944577 - RNA, 22 nt, Human
gggccaggucggugaaugguca

SEQ ID NO: 944578 - RNA, 22 nt, Human
aguaaugucccuuaaauguggu

SEQ ID NO: 944579 - RNA, 22 nt, Human
agagcaggcauaaagcuuugaa

SEQ ID NO: 944580 - RNA, 22 nt, Human
gccaggagacuccauucauuug

SEQ ID NO: 944581 - RNA, 22 nt, Human
cuucaagauauuucuagaauca

SEQ ID NO: 944582 - RNA, 22 nt, Human
auccaaagauggaaagaacuuu

SEQ ID NO: 944583 - RNA, 22 nt, Human
cccugccuucuuggccuuuaaa

SEQ ID NO: 944584 - RNA, 22 nt, Human
auggacagugugaagcagauag

SEQ ID NO: 944585 - RNA, 22 nt, Human
uucuggagagaaaccuuacaaa

SEQ ID NO: 944586 - RNA, 22 nt, Human
cugcucaguaauaguccuaucu

SEQ ID NO: 944587 - RNA, 22 nt, Human
ccccagccuuccaugggaauug

SEQ ID NO: 944588 - RNA, 22 nt, Human
ggccuugggcagacacgucaca

SEQ ID NO: 944589 - RNA, 22 nt, Human
acugaaagauaaaucaguuagc

SEQ ID NO: 944590 - RNA, 22 nt, Human
cacugcuuucacaguuuguucc

SEQ ID NO: 944591 - RNA, 22 nt, Human
aggcugggaaaccugaaguugu

SEQ ID NO: 944592 - RNA, 22 nt, Human
ggcagcuguaagaugagugaau

SEQ ID NO: 944593 - RNA, 22 nt, Human
uggccugccuucgcugagcuga

SEQ ID NO: 944594 - RNA, 22 nt, Human
gccagagccggcuucacaggau

SEQ ID NO: 944595 - RNA, 22 nt, Human
cccaggcagccugcagggaagg

SEQ ID NO: 944596 - RNA, 22 nt, Human
uggcaguggcucagagugcaga

SEQ ID NO: 944597 - RNA, 22 nt, Human
gggcagcagcaggaggucucug

SEQ ID NO: 944598 - RNA, 22 nt, Human
gcuguauuuauuuucuaggguu

SEQ ID NO: 944599 - RNA, 22 nt, Human
uuaaaacagcgugaaucuggca

SEQ ID NO: 944600 - RNA, 22 nt, Human
uuuuaguuguaguuggugagga

SEQ ID NO: 944601 - RNA, 20 nt, Human
cugggccauccuuuuacaau

SEQ ID NO: 944602 - RNA, 22 nt, Human
agucccagcccaguccuguaag

SEQ ID NO: 944603 - RNA, 22 nt, Human
ccucuuccacugggccccaucc

SEQ ID NO: 944604 - RNA, 22 nt, Human
uccugccucaggcucuggagua

SEQ ID NO: 944605 - RNA, 22 nt, Human
gagcucuggguggcaggugucu

SEQ ID NO: 944606 - RNA, 19 nt, Human
gggcagaauggcaucucag

SEQ ID NO: 944607 - RNA, 22 nt, Human
agucagugaaggcauugcucaa

SEQ ID NO: 944608 - RNA, 22 nt, Human
gaaaugcauggaucuuggcaga

SEQ ID NO: 944609 - RNA, 19 nt, Human
aauaauguucaugagauug

SEQ ID NO: 944610 - RNA, 22 nt, Human
ucuugggaagcccauuuccacc

SEQ ID NO: 944611 - RNA, 19 nt, Human
cugggccagagcuguccuc

SEQ ID NO: 944612 - RNA, 22 nt, Human
ugcagcugauuaaagggcagac

SEQ ID NO: 944613 - RNA, 22 nt, Human
caggugggagcgaggagcuacu

SEQ ID NO: 944614 - RNA, 22 nt, Human
uuggccuuaaccucucugugcc

SEQ ID NO: 944615 - RNA, 22 nt, Human
cagagccaaaccucagggcccg

SEQ ID NO: 944616 - RNA, 22 nt, Human
agaaauguggaggaacagggcu

SEQ ID NO: 944617 - RNA, 22 nt, Human
gcagcugcagguggucccaugc

SEQ ID NO: 944618 - RNA, 22 nt, Human
cugcaucacagcaggaggcaca

SEQ ID NO: 944619 - RNA, 22 nt, Human
gagcagcuuaugucaagccaga

SEQ ID NO: 944620 - RNA, 22 nt, Human
ccagcuggagccaagguggacu

SEQ ID NO: 944621 - RNA, 22 nt, Human
agugucauuuuguccaucuucu

SEQ ID NO: 944622 - RNA, 22 nt, Human
aauaucaguauauuguaucagu

SEQ ID NO: 944623 - RNA, 22 nt, Human
uuuauuauccaguguugucaug

SEQ ID NO: 944624 - RNA, 22 nt, Human
gucuucuuguguugccugucuu

SEQ ID NO: 944625 - RNA, 22 nt, Human
agagacaggguuuugccauguu

SEQ ID NO: 944626 - RNA, 22 nt, Human
ugaggcaggaaguuauauaaug

SEQ ID NO: 944627 - RNA, 23 nt, Human
uggcagcuguguaagagaaagca

SEQ ID NO: 944628 - RNA, 22 nt, Human
ugucaucugauauuacuuauag

SEQ ID NO: 944629 - RNA, 22 nt, Human
uaugccugauaacugugucucu

SEQ ID NO: 944630 - RNA, 22 nt, Human
acuuuauuuccuauugcaucca

SEQ ID NO: 944631 - RNA, 22 nt, Human
cagcugcaggaacaaaaaugug

SEQ ID NO: 944632 - RNA, 22 nt, Human
agugccaggagcaaggagcucc

SEQ ID NO: 944633 - RNA, 22 nt, Human
agacaggacacaagcugcauaa

SEQ ID NO: 944634 - RNA, 23 nt, Human
gaguguucauagcaggcucuugc

SEQ ID NO: 944635 - RNA, 22 nt, Human
uaugugaauacagcaguggaug

SEQ ID NO: 944636 - RNA, 22 nt, Human
uguuucaugauugcugucauuu

SEQ ID NO: 944637 - RNA, 22 nt, Human
gcaaaugaguuguaacauaaaa

SEQ ID NO: 944638 - RNA, 22 nt, Human
cacaagacuuauuuguguagaa

SEQ ID NO: 944639 - RNA, 22 nt, Human
aggacccugagcgggcaugccg

SEQ ID NO: 944640 - RNA, 22 nt, Human
gcuguguuugacaguagcagac

SEQ ID NO: 944641 - RNA, 20 nt, Human
gugggcagcaggcauacugg

SEQ ID NO: 944642 - RNA, 22 nt, Human
uccugccucuugccuucuucac

SEQ ID NO: 944643 - RNA, 21 nt, Human
auugaaagucaacaaucaguu

SEQ ID NO: 944644 - RNA, 22 nt, Human
uucuccaacacaagcaugaugu

SEQ ID NO: 944645 - RNA, 23 nt, Human
agagcuuagggaauucacaugag

SEQ ID NO: 944646 - RNA, 22 nt, Human
cuacauuaaauuggcuuacuua

SEQ ID NO: 944647 - RNA, 22 nt, Human
cccaagagcuucuaggacgcug

SEQ ID NO: 944648 - RNA, 22 nt, Human
gccagagcacaggcugguagua

SEQ ID NO: 944649 - RNA, 22 nt, Human
cuggcugguuacuauuucuggu

SEQ ID NO: 944650 - RNA, 22 nt, Human
ccagcagagucuaggaaggagg

SEQ ID NO: 944651 - RNA, 23 nt, Human
aggauguaggauguauggcagag

SEQ ID NO: 944652 - RNA, 18 nt, Human
gcuccugguuggaaagaa

SEQ ID NO: 944653 - RNA, 18 nt, Human
agucucagcggaggagua

SEQ ID NO: 944654 - RNA, 22 nt, Human
aagcagaggguauggccagguu

SEQ ID NO: 944655 - RNA, 22 nt, Human
acuccuggguucuaaauuugaa

SEQ ID NO: 944656 - RNA, 22 nt, Human
gaggcacugcaguacagugacu

SEQ ID NO: 944657 - RNA, 22 nt, Human
uuugaaagaauuuauguacuuu

SEQ ID NO: 944658 - RNA, 22 nt, Human
uuaaauuauuucuagugaggug

SEQ ID NO: 944659 - RNA, 22 nt, Human
ugugucugaacuaguugcucuc

SEQ ID NO: 944660 - RNA, 22 nt, Human
uggcugcugcuuggucuucuuc

SEQ ID NO: 944661 - RNA, 22 nt, Human
augggcuguccuaguccagccc

SEQ ID NO: 944662 - RNA, 22 nt, Human
uauuuuaaagacugccagccua

SEQ ID NO: 944663 - RNA, 17 nt, Human
ggcagccucaggcguuu

SEQ ID NO: 944664 - RNA, 22 nt, Human
uuauuacacugaaagaauugcg

SEQ ID NO: 944665 - RNA, 22 nt, Human
accuguuuggaggagguguuag

SEQ ID NO: 944666 - RNA, 22 nt, Human
uccuuguaacguugggcugggg

SEQ ID NO: 944667 - RNA, 22 nt, Human
cacauggggcgcugcauuggcc

SEQ ID NO: 944668 - RNA, 22 nt, Human
gaaggccaagaggcuccaagau

SEQ ID NO: 944669 - RNA, 19 nt, Human
auuuacugccuaaaaucuc

SEQ ID NO: 944670 - RNA, 22 nt, Human
ucacaggagggagagacaccca

SEQ ID NO: 944671 - RNA, 22 nt, Human
gaacaguaucaguagugccagu

SEQ ID NO: 944672 - RNA, 22 nt, Human
ggacacagcugcagccacaccc

SEQ ID NO: 944673 - RNA, 22 nt, Human
gcugccugaagugucuacacug

SEQ ID NO: 944674 - RNA, 22 nt, Human
ugucccagguccuagaugacca

SEQ ID NO: 944675 - RNA, 22 nt, Human
ugcauuaugcuugugcuguaua

SEQ ID NO: 944676 - RNA, 22 nt, Human
cccuggcauaaaacuucuccag

SEQ ID NO: 944677 - RNA, 22 nt, Human
augcuuuuaugucacaugguca

SEQ ID NO: 944678 - RNA, 22 nt, Human
cagucccagacauaguaaggga

SEQ ID NO: 944679 - RNA, 22 nt, Human
augggaggaugcucgggugcuc

SEQ ID NO: 944680 - RNA, 22 nt, Human
gccuucaguaguauccucauga

SEQ ID NO: 944681 - RNA, 22 nt, Human
ccugggugacccgugagcgucc

SEQ ID NO: 944682 - RNA, 22 nt, Human
cugcagcuccccugagaucaag

SEQ ID NO: 944683 - RNA, 22 nt, Human
caaaacauucagagagcucacu

SEQ ID NO: 944684 - RNA, 19 nt, Human
auagucuuuccaauuauac

SEQ ID NO: 944685 - RNA, 22 nt, Human
ugggcagacgggagcuugccuu

SEQ ID NO: 944686 - RNA, 22 nt, Human
aggaugagaagauuggaaucuu

SEQ ID NO: 944687 - RNA, 22 nt, Human
uaggagagcugaacuauugucu

SEQ ID NO: 944688 - RNA, 22 nt, Human
aggagcugcagauucugccuug

SEQ ID NO: 944689 - RNA, 22 nt, Human
ggggaggcugaugugggcaaag

SEQ ID NO: 944690 - RNA, 22 nt, Human
acauuuuuuagagucccacauu

SEQ ID NO: 944691 - RNA, 22 nt, Human
uagaaaagauaacauucugugc

SEQ ID NO: 944692 - RNA, 22 nt, Human
cauguugaauggccuugauuuu

SEQ ID NO: 944693 - RNA, 18 nt, Human
cccagcccaccauuucuc

SEQ ID NO: 944694 - RNA, 20 nt, Human
cagcaguggaugagaguuuu

SEQ ID NO: 944695 - RNA, 20 nt, Human
agguggcuccugcugggggu

SEQ ID NO: 944696 - RNA, 22 nt, Human
ugucaugcuuauguuacauacu

SEQ ID NO: 944697 - RNA, 22 nt, Human
ugaugaaacugagguuccaaga

SEQ ID NO: 944698 - RNA, 22 nt, Human
ugaugcuucacgcugaauaugc

SEQ ID NO: 944699 - RNA, 22 nt, Human
agcccaggucuggcccagccug

SEQ ID NO: 944700 - RNA, 22 nt, Human
auucuuucaaggaauaguuauu

SEQ ID NO: 944701 - RNA, 22 nt, Human
gagguggaaggcaggaacaaau

SEQ ID NO: 944702 - RNA, 22 nt, Human
cauuaucugccauugacaccau

SEQ ID NO: 944703 - RNA, 22 nt, Human
ugugaaggcagcagcucugucc

SEQ ID NO: 944704 - RNA, 22 nt, Human
ugucacauaggcaaaauguuuu

SEQ ID NO: 944705 - RNA, 22 nt, Human
guggcuugaccaucccugcuac

SEQ ID NO: 944706 - RNA, 22 nt, Human
gauaaugaugacaaugacaacc

SEQ ID NO: 944707 - RNA, 22 nt, Human
guucacaauuuuuacugauugg

SEQ ID NO: 944708 - RNA, 22 nt, Human
ggccccacgggggaguccuagu

SEQ ID NO: 944709 - RNA, 22 nt, Human
uagcuguguaagcuugguaaga

SEQ ID NO: 944710 - RNA, 22 nt, Human
cacugccugugagcugugugcc

SEQ ID NO: 944711 - RNA, 21 nt, Human
uuucugucucugccacuaguu

SEQ ID NO: 944712 - RNA, 23 nt, Human
ugcaggggaggcuuaaagcaggu

SEQ ID NO: 944713 - RNA, 22 nt, Human
gcuaugcaggagccuaaugaca

SEQ ID NO: 944714 - RNA, 19 nt, Human
cuggcucuuggguggagga

SEQ ID NO: 944715 - RNA, 22 nt, Human
aucaguuuguauaugaaacacu

SEQ ID NO: 944716 - RNA, 22 nt, Human
cuggcagcuucaggacacucgg

SEQ ID NO: 944717 - RNA, 19 nt, Human
gccagcagaaugaugaggc

SEQ ID NO: 944718 - RNA, 22 nt, Human
caggggcugagaaggaacgucc

SEQ ID NO: 944719 - RNA, 20 nt, Human
cugagcgucuaagaggugag

SEQ ID NO: 944720 - RNA, 22 nt, Human
gagggaugguaguugacacuga

SEQ ID NO: 944721 - RNA, 22 nt, Human
uggccuuccuggugacucauga

SEQ ID NO: 944722 - RNA, 22 nt, Human
caacccaaaagcguuuccauuu

SEQ ID NO: 944723 - RNA, 22 nt, Human
ggagcugaugacgucaccaugg

SEQ ID NO: 944724 - RNA, 22 nt, Human
aggaaaugcugaugcuccugga

SEQ ID NO: 944725 - RNA, 22 nt, Human
ccagggcagggaccacgugucu

SEQ ID NO: 944726 - RNA, 22 nt, Human
ugccuaggaaaccucaugcuuc

SEQ ID NO: 944727 - RNA, 22 nt, Human
acagcuguauccccagagcuca

SEQ ID NO: 944728 - RNA, 22 nt, Human
acuggcagcagcagcccuuggg

SEQ ID NO: 944729 - RNA, 19 nt, Human
uccuccuuacuuccucuug

SEQ ID NO: 944730 - RNA, 22 nt, Human
uggcaauuucagaaaauagaau

SEQ ID NO: 944731 - RNA, 22 nt, Human
cucugagaggugagaagcagca

SEQ ID NO: 944732 - RNA, 22 nt, Human
ucugucugcucauuuaccucag

SEQ ID NO: 944733 - RNA, 22 nt, Human
cuuccuggccauugccauggca

SEQ ID NO: 944734 - RNA, 22 nt, Human
gucaggaugcuauuguuauuaa

SEQ ID NO: 944735 - RNA, 22 nt, Human
aggcaagggggcgccaccuucc

SEQ ID NO: 944736 - RNA, 22 nt, Human
cagagcuggagggaacccuggc

SEQ ID NO: 944737 - RNA, 22 nt, Human
cagggccagcgucucgggcuau

SEQ ID NO: 944738 - RNA, 22 nt, Human
aguacauuuauuaaugguaaaa

SEQ ID NO: 944739 - RNA, 22 nt, Human
gccaccaggagcccaguccaaa

SEQ ID NO: 944740 - RNA, 22 nt, Human
ccaggcccugcuccucacacca

SEQ ID NO: 944741 - RNA, 22 nt, Human
gagagcuguaauagucaugucu

SEQ ID NO: 944742 - RNA, 22 nt, Human
ugaaagcagcaccaauaccauu

SEQ ID NO: 944743 - RNA, 22 nt, Human
ugaggcaguugagcuuccugag

SEQ ID NO: 944744 - RNA, 22 nt, Human
gccagggcaggggagcaucugc

SEQ ID NO: 944745 - RNA, 22 nt, Human
cacucugcaggccaaaccaaag

SEQ ID NO: 944746 - RNA, 23 nt, Human
aggcccugccugucccucuuuuu

SEQ ID NO: 944747 - RNA, 22 nt, Human
ucccaaggcacagggcagggac

SEQ ID NO: 944748 - RNA, 22 nt, Human
ugucuuuaugcacacugacuug

SEQ ID NO: 944749 - RNA, 22 nt, Human
aggguagggcccggagacagac

SEQ ID NO: 944750 - RNA, 22 nt, Human
aggccucacucucagagcuucu

SEQ ID NO: 944751 - RNA, 22 nt, Human
auucuucagcaggggacacuau

SEQ ID NO: 944752 - RNA, 22 nt, Human
cggagcugccugccaagccugc

SEQ ID NO: 944753 - RNA, 22 nt, Human
uggcaagccugagauccgggag

SEQ ID NO: 944754 - RNA, 22 nt, Human
acacuugauaggucaaaucagu

SEQ ID NO: 944755 - RNA, 17 nt, Human
gaaagguccuagaaauc

SEQ ID NO: 944756 - RNA, 22 nt, Human
ccuggcagcccagagcgccgcu

SEQ ID NO: 944757 - RNA, 22 nt, Human
agcauuuaguuaguaaauguuu

SEQ ID NO: 944758 - RNA, 22 nt, Human
ggcagcagcaagguuggagcug

SEQ ID NO: 944759 - RNA, 22 nt, Human
gcugucugggaugucacugcug

SEQ ID NO: 944760 - RNA, 22 nt, Human
gcagcuucaguaggugaagaca

SEQ ID NO: 944761 - RNA, 22 nt, Human
ugagccagaguggagugugccu

SEQ ID NO: 944762 - RNA, 22 nt, Human
agggccugcucuaucacucuca

SEQ ID NO: 944763 - RNA, 21 nt, Human
ugauuuccaucuuaaaauaaa

SEQ ID NO: 944764 - RNA, 18 nt, Human
aggcaggugcuggaaguc

SEQ ID NO: 944765 - RNA, 22 nt, Human
aaaacauucugugaacucucaa

SEQ ID NO: 944766 - RNA, 22 nt, Human
uggcugcuagccagagcuucag

SEQ ID NO: 944767 - RNA, 22 nt, Human
gucauuucuguuucuucagugc

SEQ ID NO: 944768 - RNA, 22 nt, Human
auaucaaacgaaguuauuuuaa

SEQ ID NO: 944769 - RNA, 19 nt, Human
gcugucugaugcugagguc

SEQ ID NO: 944770 - RNA, 22 nt, Human
cccaggagguggagguugcagu

SEQ ID NO: 944771 - RNA, 22 nt, Human
uuuauucuugagagugagaaga

SEQ ID NO: 944772 - RNA, 22 nt, Human
aggguggcaguuacuggagcaa

SEQ ID NO: 944773 - RNA, 22 nt, Human
uuccauaauuaaguggagagaa

SEQ ID NO: 944774 - RNA, 22 nt, Human
gcugcucucucccuaaguuggg

SEQ ID NO: 944775 - RNA, 22 nt, Human
cugucauugagccugucagggc

SEQ ID NO: 944776 - RNA, 22 nt, Human
aguguccccuacagaggcauuc

SEQ ID NO: 944777 - RNA, 22 nt, Human
cacauuuaaagguugaagcuga

SEQ ID NO: 944778 - RNA, 22 nt, Human
ggccagcuuugagcugcaggaa

SEQ ID NO: 944779 - RNA, 22 nt, Human
caggccacaaguuggguucaag

SEQ ID NO: 944780 - RNA, 21 nt, Human
uauaguguggauaugcugaug

SEQ ID NO: 944781 - RNA, 22 nt, Human
uccugggaagagaccugagcau

SEQ ID NO: 944782 - RNA, 22 nt, Human
caagagcucaccggagagcauu

SEQ ID NO: 944783 - RNA, 22 nt, Human
gggcagcuggccagguauucug

SEQ ID NO: 944784 - RNA, 22 nt, Human
uuucacaaucaaauggugaaau

SEQ ID NO: 944785 - RNA, 22 nt, Human
cuuggcagauccaaaaaugaca

SEQ ID NO: 944786 - RNA, 22 nt, Human
uugaaggaggcuccuuuuuaaa

SEQ ID NO: 944787 - RNA, 22 nt, Human
uuucauuauaaaaaguuggcuu

SEQ ID NO: 944788 - RNA, 20 nt, Human
uuccuguauacaaagaguuc

SEQ ID NO: 944789 - RNA, 22 nt, Human
agugcauauaugaagaguauga

SEQ ID NO: 944790 - RNA, 22 nt, Human
gcuggggcugggcugaggaaga

SEQ ID NO: 944791 - RNA, 22 nt, Human
uauuuauucauucagcaagcau

SEQ ID NO: 944792 - RNA, 23 nt, Human
ggaaagagaggaguugugcauag

SEQ ID NO: 944793 - RNA, 22 nt, Human
cagccaucccagccugugguuc

SEQ ID NO: 944794 - RNA, 22 nt, Human
ggccuuggggaggauggugucc

SEQ ID NO: 944795 - RNA, 22 nt, Human
ccagggugaccagcuggccuag

SEQ ID NO: 944796 - RNA, 23 nt, Human
ucugggccacuugucugcacuuc

SEQ ID NO: 944797 - RNA, 22 nt, Human
gcucaggagcucuugguggcgc

SEQ ID NO: 944798 - RNA, 22 nt, Human
agcaguggccuggggcucugug

SEQ ID NO: 944799 - RNA, 22 nt, Human
acaccuuuuauucgccaggcac

SEQ ID NO: 944800 - RNA, 22 nt, Human
gcugggagcaaagccaugcaua

SEQ ID NO: 944801 - RNA, 22 nt, Human
cuucacaaaauauuucauuaua

SEQ ID NO: 944802 - RNA, 22 nt, Human
agguggguaucaugagagauua

SEQ ID NO: 944803 - RNA, 17 nt, Human
gccuuccuuccuccaca

SEQ ID NO: 944804 - RNA, 22 nt, Human
uaggaaaaauacagaauuauau

SEQ ID NO: 944805 - RNA, 21 nt, Human
uugaaaguaaauucagcagcu

SEQ ID NO: 944806 - RNA, 22 nt, Human
gcagauggcagcccaggcuggg

SEQ ID NO: 944807 - RNA, 22 nt, Human
ccagggcauguaacuaauggug

SEQ ID NO: 944808 - RNA, 22 nt, Human
ugacucuguaccugucugccuu

SEQ ID NO: 944809 - RNA, 22 nt, Human
uuugcauucuagaaaaauuucu

SEQ ID NO: 944810 - RNA, 22 nt, Human
uauggcauuguuggugaugaua

SEQ ID NO: 944811 - RNA, 22 nt, Human
aggauuucugugccuggaaaau

SEQ ID NO: 944812 - RNA, 22 nt, Human
augucccuucuuuggugcucag

SEQ ID NO: 944813 - RNA, 22 nt, Human
ugucccagacauaaguggacau

SEQ ID NO: 944814 - RNA, 22 nt, Human
ccacaggcugcugcaggucccg

SEQ ID NO: 944815 - RNA, 22 nt, Human
uucaggauucuuucagacuggg

SEQ ID NO: 944816 - RNA, 22 nt, Human
ccucugccaccucccacgaggc

SEQ ID NO: 944817 - RNA, 22 nt, Human
agccacagagcaggagaccuuu

SEQ ID NO: 944818 - RNA, 22 nt, Human
ggcaaaaaguucccaucagugu

SEQ ID NO: 944819 - RNA, 22 nt, Human
agugcuuugguauagaacuauu

SEQ ID NO: 944820 - RNA, 22 nt, Human
ggcugccuugacccuggcuccg

SEQ ID NO: 944821 - RNA, 22 nt, Human
acuaggggcucaggcccaggga

SEQ ID NO: 944822 - RNA, 21 nt, Human
aagaagcaauuuauuggaagg

SEQ ID NO: 944823 - RNA, 22 nt, Human
aaaucagucccucuuggaauuu

SEQ ID NO: 944824 - RNA, 18 nt, Human
gucuggaggucaggagcu

SEQ ID NO: 944825 - RNA, 22 nt, Human
ugaggcacuccaggaugcuguu

SEQ ID NO: 944826 - RNA, 22 nt, Human
uuaaacagacaguaaaugaaac

SEQ ID NO: 944827 - RNA, 18 nt, Human
ggccugaggauuucagca

SEQ ID NO: 944828 - RNA, 22 nt, Human
acaugcauaggagaagucuuua

SEQ ID NO: 944829 - RNA, 22 nt, Human
ugcucacagcccagaacauaau

SEQ ID NO: 944830 - RNA, 22 nt, Human
gcugccucugcgacucugggcg

SEQ ID NO: 944831 - RNA, 22 nt, Human
ugaagcagcuucuuucugucaa

SEQ ID NO: 944832 - RNA, 22 nt, Human
uuuugcuugagugcacaaaaug

SEQ ID NO: 944833 - RNA, 22 nt, Human
cuggagccaugucuugacugcu

SEQ ID NO: 944834 - RNA, 22 nt, Human
uaggacaggugaggggcugugg

SEQ ID NO: 944835 - RNA, 22 nt, Human
uuugaacaugcugcaugauaau

SEQ ID NO: 944836 - RNA, 22 nt, Human
cagagcaguaaaucuggggcac

SEQ ID NO: 944837 - RNA, 22 nt, Human
uguguacauaucuauccuagau

SEQ ID NO: 944838 - RNA, 22 nt, Human
ucagggugaaccaggcaggaau

SEQ ID NO: 944839 - RNA, 23 nt, Human
ucuugaaaagccuacagcaguuc

SEQ ID NO: 944840 - RNA, 22 nt, Human
acugggccuggauuggcguguc

SEQ ID NO: 944841 - RNA, 22 nt, Human
uggagccauaacccuuucguac

SEQ ID NO: 944842 - RNA, 22 nt, Human
cuguggcuaugguguacauacu

SEQ ID NO: 944843 - RNA, 22 nt, Human
gcuguucacaucuggaccauuu

SEQ ID NO: 944844 - RNA, 22 nt, Human
ucccagaggacuguuggugcua

SEQ ID NO: 944845 - RNA, 22 nt, Human
gccaggcuggucuugaacuccu

SEQ ID NO: 944846 - RNA, 22 nt, Human
gaaucucaguggaagcaggaag

SEQ ID NO: 944847 - RNA, 22 nt, Human
aggcccuguaagguguggagau

SEQ ID NO: 944848 - RNA, 22 nt, Human
auaauuuacuaagcucuaccuu

SEQ ID NO: 944849 - RNA, 22 nt, Human
ccucaggcuuacgggcaaugga

SEQ ID NO: 944850 - RNA, 22 nt, Human
uuuccucugcugccauugcccc

SEQ ID NO: 944851 - RNA, 20 nt, Human
uucauucauuccacaacuuc

SEQ ID NO: 944852 - RNA, 20 nt, Human
cuuuggcaaugagaacaggg

SEQ ID NO: 944853 - RNA, 22 nt, Human
cugcuucugggaugauggagua

SEQ ID NO: 944854 - RNA, 22 nt, Human
agggagcucuaaguagagggac

SEQ ID NO: 944855 - RNA, 22 nt, Human
uaaaaugacuuccuccaacauc

SEQ ID NO: 944856 - RNA, 22 nt, Human
agcagggcagcugaugcgcacg

SEQ ID NO: 944857 - RNA, 22 nt, Human
ccauccugcauugcuauucaga

SEQ ID NO: 944858 - RNA, 22 nt, Human
ugccugggugcuggcuggucac

SEQ ID NO: 944859 - RNA, 21 nt, Human
ugagagccuccaaccggcuac

SEQ ID NO: 944860 - RNA, 22 nt, Human
auuagguaagauaaagcagagg

SEQ ID NO: 944861 - RNA, 22 nt, Human
cauuuguaauacugacuugcag

SEQ ID NO: 944862 - RNA, 22 nt, Human
gcagagaaaguuuuguccucag

SEQ ID NO: 944863 - RNA, 20 nt, Human
ucccuggaggugguggcauc

SEQ ID NO: 944864 - RNA, 22 nt, Human
uucuguaagggauuuauucuga

SEQ ID NO: 944865 - RNA, 22 nt, Human
uuuugaaagggugauuuggcuu

SEQ ID NO: 944866 - RNA, 22 nt, Human
cagcugacccagugaggaggca

SEQ ID NO: 944867 - RNA, 22 nt, Human
agcaaaguagcugcuguucuua

SEQ ID NO: 944868 - RNA, 22 nt, Human
uggagccagagcgcagccuggg

SEQ ID NO: 944869 - RNA, 22 nt, Human
augcccugcugcuggggcagug

SEQ ID NO: 944870 - RNA, 22 nt, Human
cagggccagagagggcuggcug

SEQ ID NO: 944871 - RNA, 22 nt, Human
aagucagagcaacugagacauu

SEQ ID NO: 944872 - RNA, 22 nt, Human
guuuucaaggggauuuaacuga

SEQ ID NO: 944873 - RNA, 22 nt, Human
auucacaaaugcugccccauuc

SEQ ID NO: 944874 - RNA, 22 nt, Human
acuugaaaggaagcucuaaaac

SEQ ID NO: 944875 - RNA, 23 nt, Human
gcagauggccccagagugcugcc

SEQ ID NO: 944876 - RNA, 22 nt, Human
uaccuugggguuuuguugcucu

SEQ ID NO: 944877 - RNA, 22 nt, Human
ccaggguguagggauuccagau

SEQ ID NO: 944878 - RNA, 22 nt, Human
cacagggcuucucauggggugc

SEQ ID NO: 944879 - RNA, 22 nt, Human
auuuucuaagccugucagacuu

SEQ ID NO: 944880 - RNA, 22 nt, Human
uccagaaacuuuuccagucuca

SEQ ID NO: 944881 - RNA, 22 nt, Human
ggccaaauuuggccaugagcau

SEQ ID NO: 944882 - RNA, 22 nt, Human
agcagagcccuuccauggccuu

SEQ ID NO: 944883 - RNA, 22 nt, Human
cagaggcagccgggggagaacg

SEQ ID NO: 944884 - RNA, 22 nt, Human
cacccagcagcacuuaagacua

SEQ ID NO: 944885 - RNA, 22 nt, Human
uuagugauuacuacauagauga

SEQ ID NO: 944886 - RNA, 22 nt, Human
agaaaacuugucacagcucuca

SEQ ID NO: 944887 - RNA, 22 nt, Human
gcagcugguuaaugggagaauu

SEQ ID NO: 944888 - RNA, 22 nt, Human
ucuuuggauaucgcuagaccgu

SEQ ID NO: 944889 - RNA, 19 nt, Human
ugucucagugucccuuccu

SEQ ID NO: 944890 - RNA, 22 nt, Human
gaaggaagucauuagugcagac

SEQ ID NO: 944891 - RNA, 22 nt, Human
uguuuuaaucucccauugcucu

SEQ ID NO: 944892 - RNA, 22 nt, Human
aagucauucuauuucucuaugu

SEQ ID NO: 944893 - RNA, 22 nt, Human
auggccugggcccgcuucagau

SEQ ID NO: 944894 - RNA, 22 nt, Human
cuugaaucuggcuuugccacuu

SEQ ID NO: 944895 - RNA, 22 nt, Human
uuggcagucucagucagauggc

SEQ ID NO: 944896 - RNA, 22 nt, Human
ccagcucucagcgggagacuca

SEQ ID NO: 944897 - RNA, 22 nt, Human
auuucacucauucauguuacuu

SEQ ID NO: 944898 - RNA, 22 nt, Human
ccugcaggggagagacuucuag

SEQ ID NO: 944899 - RNA, 22 nt, Human
cacaagagagugcgcguugcaa

SEQ ID NO: 944900 - RNA, 22 nt, Human
agaaauguuguggguuuuguua

SEQ ID NO: 944901 - RNA, 19 nt, Human
agggaguuuauauuugcac

SEQ ID NO: 944902 - RNA, 22 nt, Human
acugucuuccaggucuggaggu

SEQ ID NO: 944903 - RNA, 22 nt, Human
caagcuccuuacauccacaggg

SEQ ID NO: 944904 - RNA, 22 nt, Human
augugcuaaacucaacaaaucu

SEQ ID NO: 944905 - RNA, 22 nt, Human
ccuguccuccaagagcacaucu

SEQ ID NO: 944906 - RNA, 22 nt, Human
auccuugaacuuagacacuagg

SEQ ID NO: 944907 - RNA, 22 nt, Human
cacuccagccucagugacagag

SEQ ID NO: 944908 - RNA, 19 nt, Human
ucaaggcucccugagggau

SEQ ID NO: 944909 - RNA, 22 nt, Human
aauguguauaugaacauacagg

SEQ ID NO: 944910 - RNA, 23 nt, Human
cagaggcaucggauucaacauca

SEQ ID NO: 944911 - RNA, 22 nt, Human
gcugguuuccuuaucuauaaag

SEQ ID NO: 944912 - RNA, 22 nt, Human
agagacaggguuuugucguguu

SEQ ID NO: 944913 - RNA, 22 nt, Human
ggaggggagauguuugggcuca

SEQ ID NO: 944914 - RNA, 18 nt, Human
aaugcuauuguuauaggg

SEQ ID NO: 944915 - RNA, 23 nt, Human
gggugggccaaauuagguagccu

SEQ ID NO: 944916 - RNA, 22 nt, Human
aagcagcuggaagaguaagaug

SEQ ID NO: 944917 - RNA, 22 nt, Human
aaggcagcaggauuuggugacu

SEQ ID NO: 944918 - RNA, 22 nt, Human
ggcagaaggccucccagcuccu

SEQ ID NO: 944919 - RNA, 22 nt, Human
ggccaugguuggggaagacaug

SEQ ID NO: 944920 - RNA, 23 nt, Human
auucuucauuaucuucuagaaaa

SEQ ID NO: 944921 - RNA, 19 nt, Human
ggugaccaccuggucagug

SEQ ID NO: 944922 - RNA, 22 nt, Human
uauccaggaggaacucauuuug

SEQ ID NO: 944923 - RNA, 21 nt, Human
ccuggcagaagccugauaugc

SEQ ID NO: 944924 - RNA, 22 nt, Human
aaguuauuuccucgugacugaa

SEQ ID NO: 944925 - RNA, 22 nt, Human
gugugccagacaugaugcuaug

SEQ ID NO: 944926 - RNA, 22 nt, Human
cuggagccuucaccaggggaaa

SEQ ID NO: 944927 - RNA, 22 nt, Human
accaggaguugggggugggacc

SEQ ID NO: 944928 - RNA, 22 nt, Human
auccaugaucaauuuauuacua

SEQ ID NO: 944929 - RNA, 22 nt, Human
uuacuuuggauggucaagaaag

SEQ ID NO: 944930 - RNA, 22 nt, Human
uggcagcauuuuuuccagaaca

SEQ ID NO: 944931 - RNA, 22 nt, Human
aaaagucugcucucauuucaga

SEQ ID NO: 944932 - RNA, 22 nt, Human
uccuuucccuuuccauccuggc

SEQ ID NO: 944933 - RNA, 20 nt, Human
cugccaugauugauagagug

SEQ ID NO: 944934 - RNA, 20 nt, Human
cucugcagcaaggccugggu

SEQ ID NO: 944935 - RNA, 22 nt, Human
ugcauugcauuugucaugaaga

SEQ ID NO: 944936 - RNA, 22 nt, Human
gccuugggcacaggcagggccc

SEQ ID NO: 944937 - RNA, 22 nt, Human
ccagagagaaauggauuugagu

SEQ ID NO: 944938 - RNA, 22 nt, Human
cagcauggagacaaagugggca

SEQ ID NO: 944939 - RNA, 22 nt, Human
cugucccucaucaccucugggu

SEQ ID NO: 944940 - RNA, 22 nt, Human
gcaggagcugcucuccugacga

SEQ ID NO: 944941 - RNA, 22 nt, Human
aggcauguauaugugcacaugu

SEQ ID NO: 944942 - RNA, 22 nt, Human
accaaggagacaaagguguauu

SEQ ID NO: 944943 - RNA, 22 nt, Human
ggggaaggauugaguugaccca

SEQ ID NO: 944944 - RNA, 22 nt, Human
ucuccuggauagauacuaucca

SEQ ID NO: 944945 - RNA, 22 nt, Human
augggaggaagagaagaugucu

SEQ ID NO: 944946 - RNA, 22 nt, Human
uuuccucuuccgagggggaggc

SEQ ID NO: 944947 - RNA, 22 nt, Human
ccugugccagcugggcccugcc

SEQ ID NO: 944948 - RNA, 22 nt, Human
ucacucugcugcccgagggcug

SEQ ID NO: 944949 - RNA, 22 nt, Human
guaaaugugcuucuuuuaacuu

SEQ ID NO: 944950 - RNA, 22 nt, Human
cugagagucagcuucuccuccu

SEQ ID NO: 944951 - RNA, 22 nt, Human
uuaaauauuuucagcaggguca

SEQ ID NO: 944952 - RNA, 22 nt, Human
ccugggugaaaucucuccugca

SEQ ID NO: 944953 - RNA, 22 nt, Human
auccuugagccuuaucuuuugu

SEQ ID NO: 944954 - RNA, 22 nt, Human
aaauuauaggugccaccuugga

SEQ ID NO: 944955 - RNA, 22 nt, Human
gcucccagcauugcuucccagg

SEQ ID NO: 944956 - RNA, 22 nt, Human
auuauucuuaugucaucauggc

SEQ ID NO: 944957 - RNA, 22 nt, Human
agaggggcucauauccugucau

SEQ ID NO: 944958 - RNA, 22 nt, Human
acagccaggagccaugggcagg

SEQ ID NO: 944959 - RNA, 22 nt, Human
cagaacauucacucauaugugg

SEQ ID NO: 944960 - RNA, 23 nt, Human
ucacacagcuggucagguacaga

SEQ ID NO: 944961 - RNA, 22 nt, Human
uccuuagagacaagaccaguuu

SEQ ID NO: 944962 - RNA, 22 nt, Human
aacccagccguguagcugccgc

SEQ ID NO: 944963 - RNA, 22 nt, Human
uuaagucacuuaucuaaagaca

SEQ ID NO: 944964 - RNA, 20 nt, Human
uggcuccucuuggcuguggc

SEQ ID NO: 944965 - RNA, 22 nt, Human
augauguugauaaauuacuuua

SEQ ID NO: 944966 - RNA, 22 nt, Human
cauugcacuuuggguccaggac

SEQ ID NO: 944967 - RNA, 22 nt, Human
uucuguauauuguaaagacuca

SEQ ID NO: 944968 - RNA, 22 nt, Human
uccugccugagcguggaggagg

SEQ ID NO: 944969 - RNA, 22 nt, Human
cuggccgguauuugccucuggg

SEQ ID NO: 944970 - RNA, 22 nt, Human
aaguuuaagguggaaguggugg

SEQ ID NO: 944971 - RNA, 22 nt, Human
cacucuccagcacaccccauuu

SEQ ID NO: 944972 - RNA, 22 nt, Human
ggcugccuggaccuccucuuuc

SEQ ID NO: 944973 - RNA, 22 nt, Human
aagguacaaaguauuauuuaaa

SEQ ID NO: 944974 - RNA, 22 nt, Human
ggcugugcgggcagccguggga

SEQ ID NO: 944975 - RNA, 22 nt, Human
uuaugaaagacauuucuguugg

SEQ ID NO: 944976 - RNA, 22 nt, Human
ucugcagauuuaucagcagcug

SEQ ID NO: 944977 - RNA, 22 nt, Human
caucuggcuagcuaucauugug

SEQ ID NO: 944978 - RNA, 22 nt, Human
ugcucuucggggccacugcuug

SEQ ID NO: 944979 - RNA, 22 nt, Human
augaagcugaccuugucuugcu

SEQ ID NO: 944980 - RNA, 22 nt, Human
ucagaggacgcacuaggguugu

SEQ ID NO: 944981 - RNA, 22 nt, Human
uugcuuugccaccagaagucua

SEQ ID NO: 944982 - RNA, 22 nt, Human
cugggcagcuaccaccacugcu

SEQ ID NO: 944983 - RNA, 22 nt, Human
gggagcaggagccugccugcca

SEQ ID NO: 944984 - RNA, 22 nt, Human
ugcacuggggucccagcgcacg

SEQ ID NO: 944985 - RNA, 22 nt, Human
auuauuaggacuacugggguug

SEQ ID NO: 944986 - RNA, 22 nt, Human
gacagcaggaugugaggggaug

SEQ ID NO: 944987 - RNA, 22 nt, Human
ucaucuugcugccauugcuuua

SEQ ID NO: 944988 - RNA, 22 nt, Human
gcugauuauuacaugucugugg

SEQ ID NO: 944989 - RNA, 22 nt, Human
uuucuauaugaggagcuaaagu

SEQ ID NO: 944990 - RNA, 19 nt, Human
cagaguacaccagauagga

SEQ ID NO: 944991 - RNA, 22 nt, Human
gcuggccuuugaggaagcugcg

SEQ ID NO: 944992 - RNA, 22 nt, Human
ucauccaguuguggagagggaa

SEQ ID NO: 944993 - RNA, 22 nt, Human
ccuguguggaaaccgcaugacg

SEQ ID NO: 944994 - RNA, 22 nt, Human
aggagcugaagucucugcacuc

SEQ ID NO: 944995 - RNA, 22 nt, Human
gggccugggaacuugcauuuag

SEQ ID NO: 944996 - RNA, 22 nt, Human
aguauuucugcucaugaaagag

SEQ ID NO: 944997 - RNA, 22 nt, Human
ugcagcauugcaaagcagucuu

SEQ ID NO: 944998 - RNA, 22 nt, Human
uggccacacccaccuagaggag

SEQ ID NO: 944999 - RNA, 22 nt, Human
caaagguauucucauuuuggaa

SEQ ID NO: 945000 - RNA, 22 nt, Human
gggcagugguuacacagcugag

SEQ ID NO: 945001 - RNA, 22 nt, Human
agaggcagcagucauacuacag

SEQ ID NO: 945002 - RNA, 22 nt, Human
uugauacaggccuucuagauga

SEQ ID NO: 945003 - RNA, 22 nt, Human
cccagcuccaagggacagcgaa

SEQ ID NO: 945004 - RNA, 22 nt, Human
cggcagagcuuccugcucagcg

SEQ ID NO: 945005 - RNA, 22 nt, Human
auauuagguuggugcaaaagua

SEQ ID NO: 945006 - RNA, 22 nt, Human
cuggagccggcgagccccagcc

SEQ ID NO: 945007 - RNA, 22 nt, Human
uccuggccuugcgucuugggag

SEQ ID NO: 945008 - RNA, 22 nt, Human
ugaaggagcucaaugaugaugc

SEQ ID NO: 945009 - RNA, 22 nt, Human
gcccuuccuuagacagcaggau

SEQ ID NO: 945010 - RNA, 22 nt, Human
ucugccaccuucauccuccacu

SEQ ID NO: 945011 - RNA, 22 nt, Human
ucccugcucagcucaccuggca

SEQ ID NO: 945012 - RNA, 22 nt, Human
cacaggcuugucagcaugaggc

SEQ ID NO: 945013 - RNA, 22 nt, Human
gcugcugucacggugcuaaggg

SEQ ID NO: 945014 - RNA, 22 nt, Human
ucccagccuuccagucugguuu

SEQ ID NO: 945015 - RNA, 22 nt, Human
ucacugcagagaccucuaguca

SEQ ID NO: 945016 - RNA, 22 nt, Human
uuucuauagcuuucuugggagu

SEQ ID NO: 945017 - RNA, 22 nt, Human
ggcacugggagaggugagacgg

SEQ ID NO: 945018 - RNA, 22 nt, Human
aaaucagacuugaauuuucauc

SEQ ID NO: 945019 - RNA, 22 nt, Human
uugcauuugacaaauuauuuaa

SEQ ID NO: 945020 - RNA, 22 nt, Human
gugauuucuaaucaucugaaug

SEQ ID NO: 945021 - RNA, 22 nt, Human
cuggccugggagcugcuagcgu

SEQ ID NO: 945022 - RNA, 22 nt, Human
aagcccaguuucacacugagac

SEQ ID NO: 945023 - RNA, 22 nt, Human
ucuacuuuucccuauacaguuu

SEQ ID NO: 945024 - RNA, 22 nt, Human
agucugucuacuuaaagucugu

SEQ ID NO: 945025 - RNA, 22 nt, Human
cagccagaaccuaggaugagcu

SEQ ID NO: 945026 - RNA, 22 nt, Human
cucugucccagacccaccucuc

SEQ ID NO: 945027 - RNA, 19 nt, Human
ugagagugaggaaggcuuc

SEQ ID NO: 945028 - RNA, 22 nt, Human
gccauaaauugcuggucaaaau

SEQ ID NO: 945029 - RNA, 22 nt, Human
ucuuagaaguuuauggcacgga

SEQ ID NO: 945030 - RNA, 22 nt, Human
gaggagaggggcucccaagagc

SEQ ID NO: 945031 - RNA, 22 nt, Human
cagcuccucacgagucuugaaa

SEQ ID NO: 945032 - RNA, 22 nt, Human
cuucugcaauaaguuuuggucc

SEQ ID NO: 945033 - RNA, 22 nt, Human
auucuguauggggaaacuagag

SEQ ID NO: 945034 - RNA, 22 nt, Human
gagagcugggcuuugggugaag

SEQ ID NO: 945035 - RNA, 22 nt, Human
cauuucuguacauguuuuggug

SEQ ID NO: 945036 - RNA, 17 nt, Human
acagaggcaggagugga

SEQ ID NO: 945037 - RNA, 22 nt, Human
ucagagugggagaaugugccaa

SEQ ID NO: 945038 - RNA, 22 nt, Human
uuucuuauauucugucauuguu

SEQ ID NO: 945039 - RNA, 22 nt, Human
uguauuuucuucuggaagcuua

SEQ ID NO: 945040 - RNA, 20 nt, Human
uccagcugucuuucagagac

SEQ ID NO: 945041 - RNA, 22 nt, Human
caaaaguaauugugguuuuugc

SEQ ID NO: 945042 - RNA, 22 nt, Human
cagccuuugggucagaagauuc

SEQ ID NO: 945043 - RNA, 22 nt, Human
ucuggccuacuggaguccauga

SEQ ID NO: 945044 - RNA, 22 nt, Human
guauuaggaggaacacaggccu

SEQ ID NO: 945045 - RNA, 22 nt, Human
ucauuauccuaguaucuugaau

SEQ ID NO: 945046 - RNA, 18 nt, Human
aacuucaacuacaaugga

SEQ ID NO: 945047 - RNA, 22 nt, Human
cagagaaacucagauagcugau

SEQ ID NO: 945048 - RNA, 22 nt, Human
gauuuucauuauagcuaguuuc

SEQ ID NO: 945049 - RNA, 22 nt, Human
auuucuuuucaagagggugcuu

SEQ ID NO: 945050 - RNA, 22 nt, Human
uugaagcaaauucugugcagua

SEQ ID NO: 945051 - RNA, 22 nt, Human
aggcacuggguaauuaguagcu

SEQ ID NO: 945052 - RNA, 22 nt, Human
aauaacuucaguucuuacauua

SEQ ID NO: 945053 - RNA, 22 nt, Human
ucuccuggaagugauuccccug

SEQ ID NO: 945054 - RNA, 22 nt, Human
aggaagcucggagagggcaaau

SEQ ID NO: 945055 - RNA, 22 nt, Human
cucuccucugaaguggugaccc

SEQ ID NO: 945056 - RNA, 22 nt, Human
caagagcuuuagaaaugcucau

SEQ ID NO: 945057 - RNA, 22 nt, Human
uuguaaauaguaguaagaugcc

SEQ ID NO: 945058 - RNA, 22 nt, Human
ggugccaggcuguagucagggu

SEQ ID NO: 945059 - RNA, 22 nt, Human
cuauuuucauucuuacauuguc

SEQ ID NO: 945060 - RNA, 22 nt, Human
cggagaggaccugcaacucgcu

SEQ ID NO: 945061 - RNA, 22 nt, Human
aguucuucauaaccuuacugug

SEQ ID NO: 945062 - RNA, 22 nt, Human
auuacacaggauuugccuuacu

SEQ ID NO: 945063 - RNA, 22 nt, Human
uuguuugaggucacugauauuu

SEQ ID NO: 945064 - RNA, 22 nt, Human
ugcuccuuccucauccugugca

SEQ ID NO: 945065 - RNA, 22 nt, Human
uugugaaacauucauggauuug

SEQ ID NO: 945066 - RNA, 22 nt, Human
acccaggauaaucuguguaucu

SEQ ID NO: 945067 - RNA, 20 nt, Human
aucuggcucagauccugcag

SEQ ID NO: 945068 - RNA, 22 nt, Human
cccaggagguagagguugcagu

SEQ ID NO: 945069 - RNA, 22 nt, Human
gaggcagccucaguggaccucg

SEQ ID NO: 945070 - RNA, 22 nt, Human
agaaaucuaagaugcucaagga

SEQ ID NO: 945071 - RNA, 22 nt, Human
ugccugagugauguggcagcca

SEQ ID NO: 945072 - RNA, 22 nt, Human
ccuguucauuuuuugacucugc

SEQ ID NO: 945073 - RNA, 22 nt, Human
uccucagaaaccccugugaggu

SEQ ID NO: 945074 - RNA, 22 nt, Human
gggggcucugacucccucagcu

SEQ ID NO: 945075 - RNA, 22 nt, Human
cugcucuggucucuucauguuu

SEQ ID NO: 945076 - RNA, 20 nt, Human
cucuccuugccgacuuggca

SEQ ID NO: 945077 - RNA, 22 nt, Human
aucaggaugaagcuguagcgaa

SEQ ID NO: 945078 - RNA, 22 nt, Human
gaggccugguuuccagcauccu

SEQ ID NO: 945079 - RNA, 22 nt, Human
ucuggagcuuccucauuuacag

SEQ ID NO: 945080 - RNA, 22 nt, Human
gagacagcagggccagggccug

SEQ ID NO: 945081 - RNA, 22 nt, Human
gcauuuaaauuugaacuucaga

SEQ ID NO: 945082 - RNA, 22 nt, Human
gcaggagucacugacuuggucc

SEQ ID NO: 945083 - RNA, 22 nt, Human
ugcaggagcugugcggugaggg

SEQ ID NO: 945084 - RNA, 22 nt, Human
ugaagccacagagcaucugccu

SEQ ID NO: 945085 - RNA, 21 nt, Human
uggcagacaggaggagcucac

SEQ ID NO: 945086 - RNA, 22 nt, Human
ggaugcugcuaucaggcuucga

SEQ ID NO: 945087 - RNA, 22 nt, Human
cugaagaugucugagaugcuca

SEQ ID NO: 945088 - RNA, 22 nt, Human
gcaggauggugcccuuucugcc

SEQ ID NO: 945089 - RNA, 23 nt, Human
uugaaagguagcuggcagcuaga

SEQ ID NO: 945090 - RNA, 22 nt, Human
caggaggccaacugugggacuu

SEQ ID NO: 945091 - RNA, 22 nt, Human
uuuuaaguuaauauaauugagg

SEQ ID NO: 945092 - RNA, 22 nt, Human
auacauacguacauacguaugu

SEQ ID NO: 945093 - RNA, 22 nt, Human
ccuggaugauccaugucaugga

SEQ ID NO: 945094 - RNA, 22 nt, Human
uauuauuaaauggcagaauuuu

SEQ ID NO: 945095 - RNA, 18 nt, Human
acauuucuccuucugacc

SEQ ID NO: 945096 - RNA, 22 nt, Human
auacacaugcacacaugugugu

SEQ ID NO: 945097 - RNA, 22 nt, Human
uaaaaaguagugagaauggcgc

SEQ ID NO: 945098 - RNA, 22 nt, Human
acauuguauaaugauuaucaca

SEQ ID NO: 945099 - RNA, 22 nt, Human
acagugucuccugguacccagu

SEQ ID NO: 945100 - RNA, 17 nt, Human
ucugaagccagucugcu

SEQ ID NO: 945101 - RNA, 22 nt, Human
ccuucagaccuagacaggaauc

SEQ ID NO: 945102 - RNA, 22 nt, Human
uucuuacagaguuuacagagcc

SEQ ID NO: 945103 - RNA, 22 nt, Human
gagggaauggugugcaagaggu

SEQ ID NO: 945104 - RNA, 22 nt, Human
cccaggaaaugaacuucugauu

SEQ ID NO: 945105 - RNA, 22 nt, Human
gcaucuaaacuugcaucauugu

SEQ ID NO: 945106 - RNA, 22 nt, Human
gcucagaaaagugaggcucagu

SEQ ID NO: 945107 - RNA, 22 nt, Human
cagcagagaccaagugauuuga

SEQ ID NO: 945108 - RNA, 22 nt, Human
gaaauacaaaugccuagauccu

SEQ ID NO: 945109 - RNA, 22 nt, Human
gcugguccacucccuggaggcu

SEQ ID NO: 945110 - RNA, 21 nt, Human
gagcucucaggcaagaagcag

SEQ ID NO: 945111 - RNA, 22 nt, Human
uccauaagcagguucuuccuga

SEQ ID NO: 945112 - RNA, 22 nt, Human
aacauucugguucuaaaaaccu

SEQ ID NO: 945113 - RNA, 22 nt, Human
cccaggagauggugcguggucu

SEQ ID NO: 945114 - RNA, 22 nt, Human
aguggacucuucccagugcuug

SEQ ID NO: 945115 - RNA, 22 nt, Human
ugaaagcacugauucucaacuc

SEQ ID NO: 945116 - RNA, 21 nt, Human
agcagagugcuuugacuuugu

SEQ ID NO: 945117 - RNA, 20 nt, Human
aguaggggaaugcaagagca

SEQ ID NO: 945118 - RNA, 22 nt, Human
acacucugcucugagcuucagg

SEQ ID NO: 945119 - RNA, 22 nt, Human
uacuuugcagcuugauaaaaug

SEQ ID NO: 945120 - RNA, 20 nt, Human
accccagccccucuaucuga

SEQ ID NO: 945121 - RNA, 22 nt, Human
ccccuuccgucucuugaguguc

SEQ ID NO: 945122 - RNA, 22 nt, Human
ucaaguauaucuagucauuagg

SEQ ID NO: 945123 - RNA, 22 nt, Human
cauugcacuucugcuuuuccuc

SEQ ID NO: 945124 - RNA, 22 nt, Human
gagaggcaggcgcugcaauggu

SEQ ID NO: 945125 - RNA, 22 nt, Human
aagugaagaaauacaugagaau

SEQ ID NO: 945126 - RNA, 22 nt, Human
uuauuaaugaguacaaguuauu

SEQ ID NO: 945127 - RNA, 22 nt, Human
ccagagccagagaggugccugc

SEQ ID NO: 945128 - RNA, 22 nt, Human
ggccaggcuggucucagacuuc

SEQ ID NO: 945129 - RNA, 22 nt, Human
auguagagcaguguuguccaau

SEQ ID NO: 945130 - RNA, 22 nt, Human
uggacagcgaaagugccuggga

SEQ ID NO: 945131 - RNA, 22 nt, Human
cuucacaacgacaucugguuag

SEQ ID NO: 945132 - RNA, 22 nt, Human
uggcaccaggcgggguggcugu

SEQ ID NO: 945133 - RNA, 22 nt, Human
agggcagaaaccaccuugaugg

SEQ ID NO: 945134 - RNA, 21 nt, Human
aaauguguuccauaaugcuuu

SEQ ID NO: 945135 - RNA, 22 nt, Human
gagacacacacaggagguggca

SEQ ID NO: 945136 - RNA, 22 nt, Human
aauuucagaacccaaauuagcg

SEQ ID NO: 945137 - RNA, 18 nt, Human
gggcaagcggcugucacc

SEQ ID NO: 945138 - RNA, 22 nt, Human
acacuaaugagaaaggaauuaa

SEQ ID NO: 945139 - RNA, 22 nt, Human
gugguuuucuccaacccagaac

SEQ ID NO: 945140 - RNA, 22 nt, Human
agccauugaauuuagugccuuu

SEQ ID NO: 945141 - RNA, 22 nt, Human
acugccugcucauaacauugcu

SEQ ID NO: 945142 - RNA, 22 nt, Human
ccugggcagguguggcuucccc

SEQ ID NO: 945143 - RNA, 22 nt, Human
acagggcauuuccucuaugugu

SEQ ID NO: 945144 - RNA, 22 nt, Human
cugccucucaggucccugagau

SEQ ID NO: 945145 - RNA, 22 nt, Human
ucugccugcuaacuccugcacc

SEQ ID NO: 945146 - RNA, 21 nt, Human
cugaggcagcacagcuaguca

SEQ ID NO: 945147 - RNA, 22 nt, Human
aauagaauguaaucuaauacau

SEQ ID NO: 945148 - RNA, 19 nt, Human
gcaugcuugguggcuucug

SEQ ID NO: 945149 - RNA, 22 nt, Human
aggucacacuuggaucauagaa

SEQ ID NO: 945150 - RNA, 22 nt, Human
cagugccaugucugagccccua

SEQ ID NO: 945151 - RNA, 19 nt, Human
cccaggaggcggagguugc

SEQ ID NO: 945152 - RNA, 22 nt, Human
gaaagaagcuuuagauggcuau

SEQ ID NO: 945153 - RNA, 22 nt, Human
gcacagggcaacaggucuguua

SEQ ID NO: 945154 - RNA, 22 nt, Human
ggugggcaggucacucugccuc

SEQ ID NO: 945155 - RNA, 22 nt, Human
caggcuugggagcagagccacu

SEQ ID NO: 945156 - RNA, 20 nt, Human
gcaggcagggaaugggggug

SEQ ID NO: 945157 - RNA, 22 nt, Human
cagcaggaccauugaggcauca

SEQ ID NO: 945158 - RNA, 22 nt, Human
cacucugcagcugaagggcugg

SEQ ID NO: 945159 - RNA, 22 nt, Human
gggaaauugucaacacucucaa

SEQ ID NO: 945160 - RNA, 22 nt, Human
agugcagccgagaucaggugcu

SEQ ID NO: 945161 - RNA, 22 nt, Human
cuucucagucaccugugagucu

SEQ ID NO: 945162 - RNA, 22 nt, Human
uugaacaguccuaagagacccu

SEQ ID NO: 945163 - RNA, 17 nt, Human
uagcuguguuucagcua

SEQ ID NO: 945164 - RNA, 22 nt, Human
uaaccaaagggccuaaggaaug

SEQ ID NO: 945165 - RNA, 22 nt, Human
ggcuucugccacgagagggaag

SEQ ID NO: 945166 - RNA, 20 nt, Human
aagaaacuugaaaguacaag

SEQ ID NO: 945167 - RNA, 22 nt, Human
ugggcagacugagcccuguccc

SEQ ID NO: 945168 - RNA, 22 nt, Human
acuggcaguuugagaaugcauu

SEQ ID NO: 945169 - RNA, 22 nt, Human
accugccuucucaaggacauga

SEQ ID NO: 945170 - RNA, 22 nt, Human
ucccaggagcaccuuuugagcc

SEQ ID NO: 945171 - RNA, 22 nt, Human
ccagaggcauguucaaagcaau

SEQ ID NO: 945172 - RNA, 23 nt, Human
aggcagcagguuguccaggguga

SEQ ID NO: 945173 - RNA, 22 nt, Human
gccaggcuccccggaucccugg

SEQ ID NO: 945174 - RNA, 22 nt, Human
ccuuugggugaauuccucucuu

SEQ ID NO: 945175 - RNA, 22 nt, Human
ucucagaguaauucuuuaaggu

SEQ ID NO: 945176 - RNA, 22 nt, Human
aacaguaaagacagaauuuauc

SEQ ID NO: 945177 - RNA, 22 nt, Human
gacagcaggagaucaugauaga

SEQ ID NO: 945178 - RNA, 22 nt, Human
aaggcucucugauggcagcagu

SEQ ID NO: 945179 - RNA, 22 nt, Human
ccucugcaccauagccuucagc

SEQ ID NO: 945180 - RNA, 22 nt, Human
augcaguacugauacaugccac

SEQ ID NO: 945181 - RNA, 22 nt, Human
uuugacauuggcuuauucuguu

SEQ ID NO: 945182 - RNA, 22 nt, Human
cauggcagcaauuuuccugacu

SEQ ID NO: 945183 - RNA, 22 nt, Human
ccucacucugcacccugcagca

SEQ ID NO: 945184 - RNA, 22 nt, Human
acuuuuuacaggguguauacca

SEQ ID NO: 945185 - RNA, 22 nt, Human
ugggcagaaugugggauccaga

SEQ ID NO: 945186 - RNA, 22 nt, Human
cacacuuuuggcauguuugguu

SEQ ID NO: 945187 - RNA, 22 nt, Human
cccucugcaggcuggaccugcc

SEQ ID NO: 945188 - RNA, 22 nt, Human
aggaccagaggccagagucagc

SEQ ID NO: 945189 - RNA, 22 nt, Human
acauaucuuucccucuccugaa

SEQ ID NO: 945190 - RNA, 22 nt, Human
aguggcagaucucuggucugga

SEQ ID NO: 945191 - RNA, 22 nt, Human
acuuucauguuggugaaggguu

SEQ ID NO: 945192 - RNA, 22 nt, Human
cagcauuggguuaccuuuguuu

SEQ ID NO: 945193 - RNA, 22 nt, Human
gggcacagcugcuacccagugc

SEQ ID NO: 945194 - RNA, 22 nt, Human
cacagcagagggagccauugaa

SEQ ID NO: 945195 - RNA, 22 nt, Human
agauaacuuuuggguauucaug

SEQ ID NO: 945196 - RNA, 22 nt, Human
aaugugguuaacccauuuaaga

SEQ ID NO: 945197 - RNA, 22 nt, Human
ccccagcugcauacuugccaag

SEQ ID NO: 945198 - RNA, 17 nt, Human
agcugccagggagugug

SEQ ID NO: 945199 - RNA, 21 nt, Human
agcugcuccagggagcucagg

SEQ ID NO: 945200 - RNA, 22 nt, Human
cagagcugcuucccaguuugug

SEQ ID NO: 945201 - RNA, 22 nt, Human
gccuuucaguuccaucaaagga

SEQ ID NO: 945202 - RNA, 22 nt, Human
guggccaauaggagcagcuauc

SEQ ID NO: 945203 - RNA, 22 nt, Human
cuugauguauaaguugauaugu

SEQ ID NO: 945204 - RNA, 22 nt, Human
aacuagaaaacaagaugcugau

SEQ ID NO: 945205 - RNA, 22 nt, Human
gggcugccaagccugccugccu

SEQ ID NO: 945206 - RNA, 17 nt, Human
aggcauggucuggggug

SEQ ID NO: 945207 - RNA, 22 nt, Human
aagcagccaccucaucuccacu

SEQ ID NO: 945208 - RNA, 22 nt, Human
uuagaaaugauuucaccucuuu

SEQ ID NO: 945209 - RNA, 22 nt, Human
auaaugugaagauaaugcaaga

SEQ ID NO: 945210 - RNA, 22 nt, Human
gaggcagagugcaccccaggag

SEQ ID NO: 945211 - RNA, 22 nt, Human
ugguggcuguugcagaacugag

SEQ ID NO: 945212 - RNA, 22 nt, Human
cagcaggcucugaguggcugcc

SEQ ID NO: 945213 - RNA, 22 nt, Human
uuuguuaaauauuuauugagug

SEQ ID NO: 945214 - RNA, 22 nt, Human
acauacuaugaauacauguguc

SEQ ID NO: 945215 - RNA, 22 nt, Human
caggcacucauucagagaggug

SEQ ID NO: 945216 - RNA, 22 nt, Human
cuggagaggccccaagauauuu

SEQ ID NO: 945217 - RNA, 22 nt, Human
acugggagggucuugaagaggg

SEQ ID NO: 945218 - RNA, 22 nt, Human
caauagcagcuucugaaugcaa

SEQ ID NO: 945219 - RNA, 22 nt, Human
cucucuguuaugcuuucaugaa

SEQ ID NO: 945220 - RNA, 22 nt, Human
auucugaguccaugggggcagg

SEQ ID NO: 945221 - RNA, 22 nt, Human
gccagugguagaggggaggccg

SEQ ID NO: 945222 - RNA, 22 nt, Human
gauuucuugauaauucaaaucc

SEQ ID NO: 945223 - RNA, 22 nt, Human
gaagagcuuaguuguccuagaa

SEQ ID NO: 945224 - RNA, 22 nt, Human
agauguuccagccaaugggaau

SEQ ID NO: 945225 - RNA, 22 nt, Human
auauacuuggagacuaucauug

SEQ ID NO: 945226 - RNA, 21 nt, Human
uagcagaaacaguucaggcca

SEQ ID NO: 945227 - RNA, 22 nt, Human
aauuaggagaaaacuguugucu

SEQ ID NO: 945228 - RNA, 22 nt, Human
ggcaggagaauggcgugaacuc

SEQ ID NO: 945229 - RNA, 22 nt, Human
caggcugaucagggcugggaug

SEQ ID NO: 945230 - RNA, 22 nt, Human
ucuguucaguuguaccuucccc

SEQ ID NO: 945231 - RNA, 22 nt, Human
auggaguucuuuaaauucacag

SEQ ID NO: 945232 - RNA, 21 nt, Human
ugaaugaggaggauggcauuu

SEQ ID NO: 945233 - RNA, 22 nt, Human
cugaacuuauugagugcuugcu

SEQ ID NO: 945234 - RNA, 22 nt, Human
aggagcccugcgggaggcagag

SEQ ID NO: 945235 - RNA, 22 nt, Human
ccuagagcucugcuuuaucuaa

SEQ ID NO: 945236 - RNA, 22 nt, Human
uggccugccccgagauccuggc

SEQ ID NO: 945237 - RNA, 22 nt, Human
aggccugcagcaggagcaaacc

SEQ ID NO: 945238 - RNA, 22 nt, Human
gcucccaggaugaggagccagg

SEQ ID NO: 945239 - RNA, 22 nt, Human
uggcucagcauucacuggucuu

SEQ ID NO: 945240 - RNA, 22 nt, Human
aaggccugcucagcugucugug

SEQ ID NO: 945241 - RNA, 22 nt, Human
guauguauguauauguuuaaga

SEQ ID NO: 945242 - RNA, 22 nt, Human
ggcuccucucuggccgcucccg

SEQ ID NO: 945243 - RNA, 22 nt, Human
uggcuuccacugugugcccccu

SEQ ID NO: 945244 - RNA, 22 nt, Human
gugugcagugagcaaaagaucu

SEQ ID NO: 945245 - RNA, 22 nt, Human
gcaggccagcugugcagauggg

SEQ ID NO: 945246 - RNA, 22 nt, Human
acugaaggguaaugugggagcc

SEQ ID NO: 945247 - RNA, 22 nt, Human
uuuccuaugauauucuaugugu

SEQ ID NO: 945248 - RNA, 22 nt, Human
agagccuguuuugugggagaug

SEQ ID NO: 945249 - RNA, 22 nt, Human
cuacccaggcuuagagggcugg

SEQ ID NO: 945250 - RNA, 22 nt, Human
gggagccaaggagagaggccuu

SEQ ID NO: 945251 - RNA, 22 nt, Human
aagaauaaauuaagauacuuag

SEQ ID NO: 945252 - RNA, 22 nt, Human
uuaugcuaaaugaaucaaguca

SEQ ID NO: 945253 - RNA, 22 nt, Human
uucugagguccaugcaguacug

SEQ ID NO: 945254 - RNA, 22 nt, Human
ggcagagcuugcagugagccga

SEQ ID NO: 945255 - RNA, 22 nt, Human
ucuucacauggaacaugaagcu

SEQ ID NO: 945256 - RNA, 22 nt, Human
ugaaagguguccaauauuucuc

SEQ ID NO: 945257 - RNA, 20 nt, Human
agugccagggcaggugagag

SEQ ID NO: 945258 - RNA, 22 nt, Human
uaacagaagaugaaacuucuuu

SEQ ID NO: 945259 - RNA, 22 nt, Human
accaggagcauuuuuuauuagu

SEQ ID NO: 945260 - RNA, 22 nt, Human
aacugcauucagaaagcucacu

SEQ ID NO: 945261 - RNA, 22 nt, Human
ucugggagcagaugaugguaua

SEQ ID NO: 945262 - RNA, 22 nt, Human
caccguuugguuuggauuuaca

SEQ ID NO: 945263 - RNA, 22 nt, Human
acuuucucaaaucagacuuuaa

SEQ ID NO: 945264 - RNA, 22 nt, Human
auguaguguagagauuagucuc

SEQ ID NO: 945265 - RNA, 22 nt, Human
gccaagaguuuccagcugcaag

SEQ ID NO: 945266 - RNA, 22 nt, Human
aggcacugagaggcuguguugc

SEQ ID NO: 945267 - RNA, 22 nt, Human
ucacaguuauagucuguagaau

SEQ ID NO: 945268 - RNA, 22 nt, Human
acacagggcggaaagcaugaga

SEQ ID NO: 945269 - RNA, 22 nt, Human
gcugucacaaauauuucucagc

SEQ ID NO: 945270 - RNA, 22 nt, Human
guuucauacagauuauucaugg

SEQ ID NO: 945271 - RNA, 22 nt, Human
cugggcugcagcgggagcgacg

SEQ ID NO: 945272 - RNA, 22 nt, Human
gcuguucacagacucugcucug

SEQ ID NO: 945273 - RNA, 22 nt, Human
agggccagggaagcuguauuuu

SEQ ID NO: 945274 - RNA, 22 nt, Human
agcugcucaggagagccagguc

SEQ ID NO: 945275 - RNA, 20 nt, Human
ugaaaaggucaggagacaug

SEQ ID NO: 945276 - RNA, 22 nt, Human
gcagaggauagcauaugaaccu

SEQ ID NO: 945277 - RNA, 22 nt, Human
agcuuguuaaggaugcauauua

SEQ ID NO: 945278 - RNA, 21 nt, Human
ccuggcugcacaguugcuggu

SEQ ID NO: 945279 - RNA, 22 nt, Human
uuuccucugggcccugccaccc

SEQ ID NO: 945280 - RNA, 22 nt, Human
uauagaagagacaugugcauag

SEQ ID NO: 945281 - RNA, 22 nt, Human
gcucucuggaggccauggacag

SEQ ID NO: 945282 - RNA, 22 nt, Human
guggcugcuaagucuccuuccu

SEQ ID NO: 945283 - RNA, 22 nt, Human
gauuuauuggucuuucauuggu

SEQ ID NO: 945284 - RNA, 22 nt, Human
uggagggaacaaaggaguccca

SEQ ID NO: 945285 - RNA, 23 nt, Human
cagugcagggcaacucagacucc

SEQ ID NO: 945286 - RNA, 22 nt, Human
agaagcugccuacaugaccagc

SEQ ID NO: 945287 - RNA, 22 nt, Human
uaggcagggauuaggguugauu

SEQ ID NO: 945288 - RNA, 23 nt, Human
cauaaaauauuaguaugguagca

SEQ ID NO: 945289 - RNA, 21 nt, Human
ccauaccuaccucaccugguu

SEQ ID NO: 945290 - RNA, 17 nt, Human
ugcauuguaggcuagcc

SEQ ID NO: 945291 - RNA, 22 nt, Human
uuuguuaaggaguauugcuucu

SEQ ID NO: 945292 - RNA, 22 nt, Human
acccaggagacggaggugcagu

SEQ ID NO: 945293 - RNA, 22 nt, Human
ucugugaacaucacauugacag

SEQ ID NO: 945294 - RNA, 22 nt, Human
gggcucugggaugcucuuagag

SEQ ID NO: 945295 - RNA, 22 nt, Human
augcacuaugaugagcuagucu

SEQ ID NO: 945296 - RNA, 22 nt, Human
aagcaccucuaugauugcuuuu

SEQ ID NO: 945297 - RNA, 22 nt, Human
cugcugggucuaugcaagugga

SEQ ID NO: 945298 - RNA, 22 nt, Human
uguuuuauuucuccaagaggga

SEQ ID NO: 945299 - RNA, 22 nt, Human
gcugccucaggcaccuccuggc

SEQ ID NO: 945300 - RNA, 22 nt, Human
uuaauacagucuccagaaguaa

SEQ ID NO: 945301 - RNA, 22 nt, Human
auugagaauccauuugagauga

SEQ ID NO: 945302 - RNA, 22 nt, Human
aucaggaucaugcuggguggga

SEQ ID NO: 945303 - RNA, 22 nt, Human
cuggacuuuggcccaucugcca

SEQ ID NO: 945304 - RNA, 22 nt, Human
cucaugucuucacccauucuaa

SEQ ID NO: 945305 - RNA, 22 nt, Human
ugcagcugguuuagaacuagau

SEQ ID NO: 945306 - RNA, 22 nt, Human
cagaccuggaaaacaggcuugc

SEQ ID NO: 945307 - RNA, 22 nt, Human
gaaaaaugcuccaaaucugugg

SEQ ID NO: 945308 - RNA, 21 nt, Human
uccucugcagugagguggccu

SEQ ID NO: 945309 - RNA, 22 nt, Human
ugcagaggugaaagacuagcaa

SEQ ID NO: 945310 - RNA, 22 nt, Human
agcagggcuugccgcuuguccu

SEQ ID NO: 945311 - RNA, 22 nt, Human
uugcaaaugggcaaagcagauc

SEQ ID NO: 945312 - RNA, 22 nt, Human
cugugucggacgugggcagcag

SEQ ID NO: 945313 - RNA, 22 nt, Human
aggccagcucacccuggcuccu

SEQ ID NO: 945314 - RNA, 22 nt, Human
agagggcccauguugggcugcu

SEQ ID NO: 945315 - RNA, 22 nt, Human
gcucagggaacuuuuugcaggc

SEQ ID NO: 945316 - RNA, 22 nt, Human
uggccugguaccacauagauuu

SEQ ID NO: 945317 - RNA, 22 nt, Human
ugaggcuggcaaggcugguauu

SEQ ID NO: 945318 - RNA, 22 nt, Human
ucacaugcccuguauuuaccag

SEQ ID NO: 945319 - RNA, 22 nt, Human
aauguguagauguugcauuccu

SEQ ID NO: 945320 - RNA, 22 nt, Human
ucugcaggcucuagaugagguu

SEQ ID NO: 945321 - RNA, 22 nt, Human
ggagcugggacccugucaucug

SEQ ID NO: 945322 - RNA, 22 nt, Human
acugggaggcaaagagcaagga

SEQ ID NO: 945323 - RNA, 23 nt, Human
uggccuggagagaaaagaugagu

SEQ ID NO: 945324 - RNA, 22 nt, Human
ccugucagaugaaguaauugug

SEQ ID NO: 945325 - RNA, 22 nt, Human
auucacaaagucacccuuacac

SEQ ID NO: 945326 - RNA, 17 nt, Human
ucaggauccaggguucu

SEQ ID NO: 945327 - RNA, 21 nt, Human
ccaggcuccugaggcugguca

SEQ ID NO: 945328 - RNA, 22 nt, Human
ugcaggccggcccuaggccuca

SEQ ID NO: 945329 - RNA, 22 nt, Human
cccuuggggcucuuugccaggc

SEQ ID NO: 945330 - RNA, 23 nt, Human
gggcaguuauguuguccuuggcu

SEQ ID NO: 945331 - RNA, 19 nt, Human
ggcugucucggcccagcca

SEQ ID NO: 945332 - RNA, 22 nt, Human
uagggcagauucgguggaguuu

SEQ ID NO: 945333 - RNA, 23 nt, Human
uagggcagcugggagggacaugc

SEQ ID NO: 945334 - RNA, 22 nt, Human
gcagugaaucuggcaagaauuu

SEQ ID NO: 945335 - RNA, 22 nt, Human
ugucauuuucuaaucuguuguc

SEQ ID NO: 945336 - RNA, 22 nt, Human
uagcagcucacagccucccauu

SEQ ID NO: 945337 - RNA, 19 nt, Human
ucugcuggcagaauucccu

SEQ ID NO: 945338 - RNA, 22 nt, Human
ggagagcugguagcuggcucca

SEQ ID NO: 945339 - RNA, 22 nt, Human
gcuggagguuucaccugaguuu

SEQ ID NO: 945340 - RNA, 22 nt, Human
cagagagagugggguguggauu

SEQ ID NO: 945341 - RNA, 22 nt, Human
augcagcugugggcaagaaaug

SEQ ID NO: 945342 - RNA, 21 nt, Human
caggaaaagcggaagucuagc

SEQ ID NO: 945343 - RNA, 22 nt, Human
aaucuucacagaaaaaugucug

SEQ ID NO: 945344 - RNA, 22 nt, Human
caggcagcugaggacuuugcua

SEQ ID NO: 945345 - RNA, 22 nt, Human
aauaauguuaugucauucuucu

SEQ ID NO: 945346 - RNA, 22 nt, Human
gggauggggggaagcguccaug

SEQ ID NO: 945347 - RNA, 22 nt, Human
caaaaugugagucccaccucaa

SEQ ID NO: 945348 - RNA, 22 nt, Human
uucuuuccucccagccuuugga

SEQ ID NO: 945349 - RNA, 22 nt, Human
gcagccacuaguuuuccuguuu

SEQ ID NO: 945350 - RNA, 22 nt, Human
ccccaccugugcgucugccgca

SEQ ID NO: 945351 - RNA, 20 nt, Human
cugugcuuuggaaccuggaa

SEQ ID NO: 945352 - RNA, 18 nt, Human
gcuggcugcacuucugcu

SEQ ID NO: 945353 - RNA, 22 nt, Human
ggccugugagcccuugcaugua

SEQ ID NO: 945354 - RNA, 22 nt, Human
cuccaggagggggauggcugua

SEQ ID NO: 945355 - RNA, 22 nt, Human
acagggccaggugagaggugcu

SEQ ID NO: 945356 - RNA, 22 nt, Human
acagagccuccaggagugcugg

SEQ ID NO: 945357 - RNA, 22 nt, Human
uggcagagaacacggcugaucu

SEQ ID NO: 945358 - RNA, 22 nt, Human
aguauuuccuggcuuaucugcu

SEQ ID NO: 945359 - RNA, 22 nt, Human
uucuuucagaacacaagugauu

SEQ ID NO: 945360 - RNA, 21 nt, Human
ucagcagcaucugccuagagu

SEQ ID NO: 945361 - RNA, 22 nt, Human
gccaggaggcuuaacuggacag

SEQ ID NO: 945362 - RNA, 22 nt, Human
uuagccauuaaauuacaaggug

SEQ ID NO: 945363 - RNA, 20 nt, Human
uuucuugucggcuguugcug

SEQ ID NO: 945364 - RNA, 18 nt, Human
aagaggaggaaacccagg

SEQ ID NO: 945365 - RNA, 22 nt, Human
uugauuuuaaaauagugacacu

SEQ ID NO: 945366 - RNA, 22 nt, Human
uggcagagaacacacaugauuc

SEQ ID NO: 945367 - RNA, 22 nt, Human
gagucacauuaauuuaauuuua

SEQ ID NO: 945368 - RNA, 22 nt, Human
aggguggggugcuacaucuuua

SEQ ID NO: 945369 - RNA, 22 nt, Human
aggagcugucagagugccagag

SEQ ID NO: 945370 - RNA, 22 nt, Human
ccaccaggacagcccugagggg

SEQ ID NO: 945371 - RNA, 19 nt, Human
ccugggaggcggagguugc

SEQ ID NO: 945372 - RNA, 22 nt, Human
uuccucagcuggccugauuggg

SEQ ID NO: 945373 - RNA, 22 nt, Human
cucuggccgcagcucagcucug

SEQ ID NO: 945374 - RNA, 22 nt, Human
auucagaaauagaaaauuugau

SEQ ID NO: 945375 - RNA, 19 nt, Human
ugucuuaauuaacucagag

SEQ ID NO: 945376 - RNA, 20 nt, Human
aggcccugccagggacggag

SEQ ID NO: 945377 - RNA, 22 nt, Human
ccagggcuccauugcucauccu

SEQ ID NO: 945378 - RNA, 22 nt, Human
ugcugucaguuggcaggaugag

SEQ ID NO: 945379 - RNA, 22 nt, Human
uuugaaagggacaaagucacug

SEQ ID NO: 945380 - RNA, 21 nt, Human
gggccacaccuucugcagacc

SEQ ID NO: 945381 - RNA, 22 nt, Human
ucucuucuauuugagacuauuu

SEQ ID NO: 945382 - RNA, 22 nt, Human
acagaaugcguagugcauguug

SEQ ID NO: 945383 - RNA, 22 nt, Human
cugcgcagggguggcgccagaa

SEQ ID NO: 945384 - RNA, 22 nt, Human
ucaugacaacuauauuauucca

SEQ ID NO: 945385 - RNA, 22 nt, Human
aucaggauggguuuggcuuagg

SEQ ID NO: 945386 - RNA, 22 nt, Human
gggcagcugucuugguucucaa

SEQ ID NO: 945387 - RNA, 21 nt, Human
uccaggagcacgggacuagga

SEQ ID NO: 945388 - RNA, 22 nt, Human
uggagcugagagccaggcuggc

SEQ ID NO: 945389 - RNA, 22 nt, Human
gaggcagcaugguaccuuggag

SEQ ID NO: 945390 - RNA, 22 nt, Human
uggggcgcgagguccuggcucc

SEQ ID NO: 945391 - RNA, 22 nt, Human
agauuuagacugccuuaaucau

SEQ ID NO: 945392 - RNA, 22 nt, Human
acagacauucagcuaagucuau

SEQ ID NO: 945393 - RNA, 22 nt, Human
ucugggugaugaaaugcacugu

SEQ ID NO: 945394 - RNA, 22 nt, Human
uaacuuugauaagaaucaggga

SEQ ID NO: 945395 - RNA, 22 nt, Human
ugagcuggucuugaguguagcu

SEQ ID NO: 945396 - RNA, 22 nt, Human
gaggcagcaauaaaaagaauuu

SEQ ID NO: 945397 - RNA, 22 nt, Human
gucugcugcagagcauggcuuu

SEQ ID NO: 945398 - RNA, 22 nt, Human
caccagcuacagacuacugugu

SEQ ID NO: 945399 - RNA, 22 nt, Human
cucuuccuacagucugcuaugc

SEQ ID NO: 945400 - RNA, 22 nt, Human
aaggcagauauaaagacuagag

SEQ ID NO: 945401 - RNA, 22 nt, Human
uaacagaaauaguaggugaggg

SEQ ID NO: 945402 - RNA, 19 nt, Human
ucuaagccucaauguuuuc

SEQ ID NO: 945403 - RNA, 22 nt, Human
ggagccugggcauuaguaauuu

SEQ ID NO: 945404 - RNA, 22 nt, Human
gaugagggccugguggcugugc

SEQ ID NO: 945405 - RNA, 22 nt, Human
augcugugcuggcuaaccaugg

SEQ ID NO: 945406 - RNA, 22 nt, Human
gaaggggacuggcagcugcaga

SEQ ID NO: 945407 - RNA, 21 nt, Human
uuauugagacauuuguggaaa

SEQ ID NO: 945408 - RNA, 22 nt, Human
cauuuguagcuauuuacuguau

SEQ ID NO: 945409 - RNA, 22 nt, Human
ugcugcuguuuccuacaucuca

SEQ ID NO: 945410 - RNA, 22 nt, Human
ccaagggcucugacuugccugc

SEQ ID NO: 945411 - RNA, 22 nt, Human
uuggccaaaaaagucauuagaa

SEQ ID NO: 945412 - RNA, 22 nt, Human
ggucagagggugggcugccugu

SEQ ID NO: 945413 - RNA, 22 nt, Human
cucagggcaguauggcugagag

SEQ ID NO: 945414 - RNA, 22 nt, Human
uggcagagucugggcuugggca

SEQ ID NO: 945415 - RNA, 22 nt, Human
ugcccagcacugugccagucac

SEQ ID NO: 945416 - RNA, 22 nt, Human
ucagaacauuuaaaaagugguu

SEQ ID NO: 945417 - RNA, 22 nt, Human
cccuggccagcucaugucugag

SEQ ID NO: 945418 - RNA, 22 nt, Human
uaacacugauuuguucucaggg

SEQ ID NO: 945419 - RNA, 22 nt, Human
acaauguaggauauguacuugu

SEQ ID NO: 945420 - RNA, 22 nt, Human
ucacucugaaugguacugagga

SEQ ID NO: 945421 - RNA, 22 nt, Human
ggccucugguucacagggagga

SEQ ID NO: 945422 - RNA, 22 nt, Human
ugaagcaguucucagaaguggg

SEQ ID NO: 945423 - RNA, 22 nt, Human
uguuuuguuuaugagagcacag

SEQ ID NO: 945424 - RNA, 22 nt, Human
augcagguugggcaaguguggg

SEQ ID NO: 945425 - RNA, 18 nt, Human
ggcugagguugacuagaa

SEQ ID NO: 945426 - RNA, 22 nt, Human
uauguagguaaacacagacaua

SEQ ID NO: 945427 - RNA, 22 nt, Human
auaauaacaccugaauaggaaa

SEQ ID NO: 945428 - RNA, 22 nt, Human
gcugagagaaaagugagguucu

SEQ ID NO: 945429 - RNA, 22 nt, Human
cugcucuggcguacucggcauc

SEQ ID NO: 945430 - RNA, 22 nt, Human
cucuggagaacuccuugugucu

SEQ ID NO: 945431 - RNA, 22 nt, Human
cugaaggauucaaaauggcagg

SEQ ID NO: 945432 - RNA, 22 nt, Human
ucccagagucagagguggggcc

SEQ ID NO: 945433 - RNA, 22 nt, Human
ugucaugccaccguuucccaga

SEQ ID NO: 945434 - RNA, 17 nt, Human
gagagcugcugcuuccg

SEQ ID NO: 945435 - RNA, 22 nt, Human
ggcaucuccaaaacaugaacuc

SEQ ID NO: 945436 - RNA, 22 nt, Human
uggccucugggaaagcagauuc

SEQ ID NO: 945437 - RNA, 22 nt, Human
ccuaugccugucacucugcgcu

SEQ ID NO: 945438 - RNA, 22 nt, Human
ugucucugugagaucugacgau

SEQ ID NO: 945439 - RNA, 22 nt, Human
uccaggagggauugggcugugg

SEQ ID NO: 945440 - RNA, 22 nt, Human
cucaggaggugguagaggcccu

SEQ ID NO: 945441 - RNA, 22 nt, Human
gauggcaggugauagccgaguc

SEQ ID NO: 945442 - RNA, 22 nt, Human
gcagcuguguaaugagcccaca

SEQ ID NO: 945443 - RNA, 22 nt, Human
ccuggcuccugccucugcaggg

SEQ ID NO: 945444 - RNA, 22 nt, Human
ugcaccuucauuuuaggcagcu

SEQ ID NO: 945445 - RNA, 22 nt, Human
gcuggaaggcuaggcucaguug

SEQ ID NO: 945446 - RNA, 22 nt, Human
augggcugugagguccggcagg

SEQ ID NO: 945447 - RNA, 22 nt, Human
gguggggccugcuccagcggcc

SEQ ID NO: 945448 - RNA, 22 nt, Human
cagagacaguuucacagggucu

SEQ ID NO: 945449 - RNA, 22 nt, Human
ugucugugaccucuuuggagcc

SEQ ID NO: 945450 - RNA, 22 nt, Human
uaauuccaaguugagacaugca

SEQ ID NO: 945451 - RNA, 22 nt, Human
ggcagcuguggacgucgucauu

SEQ ID NO: 945452 - RNA, 22 nt, Human
auguucaaacuuuuuacacacc

SEQ ID NO: 945453 - RNA, 22 nt, Human
uauuucuugaguggucaguuuc

SEQ ID NO: 945454 - RNA, 22 nt, Human
caccuuuugugucugcguuugu

SEQ ID NO: 945455 - RNA, 22 nt, Human
guggcucucgccagccugcggg

SEQ ID NO: 945456 - RNA, 22 nt, Human
ccaggcugcuguugguguccgc

SEQ ID NO: 945457 - RNA, 22 nt, Human
gcugccacucugagcuugcuuc

SEQ ID NO: 945458 - RNA, 22 nt, Human
aaaguuuggauuagcaguuaga

SEQ ID NO: 945459 - RNA, 21 nt, Human
cccaggaggagcuccggcucc

SEQ ID NO: 945460 - RNA, 22 nt, Human
cccaggaggcagagcuugcagu

SEQ ID NO: 945461 - RNA, 22 nt, Human
augucuuuauaaauguauaaug

SEQ ID NO: 945462 - RNA, 22 nt, Human
uauccaauucaccauugauggg

SEQ ID NO: 945463 - RNA, 22 nt, Human
uccuuggcuuucuggagcuucu

SEQ ID NO: 945464 - RNA, 22 nt, Human
uggaagcuguggcauaacugag

SEQ ID NO: 945465 - RNA, 22 nt, Human
gcuggccugggcucaagaccag

SEQ ID NO: 945466 - RNA, 19 nt, Human
accuugggcaagugccuuc

SEQ ID NO: 945467 - RNA, 22 nt, Human
ugguccagaugccuuggcuuua

SEQ ID NO: 945468 - RNA, 22 nt, Human
cauugucacccaaagcucauag

SEQ ID NO: 945469 - RNA, 22 nt, Human
cugagccagagggagucggguc

SEQ ID NO: 945470 - RNA, 22 nt, Human
ucuuugcaacucccauuuccau

SEQ ID NO: 945471 - RNA, 22 nt, Human
cuaggaggcgggggcugcagua

SEQ ID NO: 945472 - RNA, 22 nt, Human
agcaguggcugaagauguuccu

SEQ ID NO: 945473 - RNA, 22 nt, Human
cccugccuuguuggagccuaug

SEQ ID NO: 945474 - RNA, 22 nt, Human
uaaaaguauacuuucaaaggag

SEQ ID NO: 945475 - RNA, 22 nt, Human
auucaguaggucuagaauaaga

SEQ ID NO: 945476 - RNA, 22 nt, Human
uauuugaagauucuucugaugu

SEQ ID NO: 945477 - RNA, 22 nt, Human
uuugcaauuugugcugcaaaug

SEQ ID NO: 945478 - RNA, 22 nt, Human
augcacaagaggcuagaaaaga

SEQ ID NO: 945479 - RNA, 22 nt, Human
uuccaaauuaaaauguacaaug

SEQ ID NO: 945480 - RNA, 22 nt, Human
aggagcuguuuuguucagcaaa

SEQ ID NO: 945481 - RNA, 22 nt, Human
agaggcuguuacacucccagau

SEQ ID NO: 945482 - RNA, 22 nt, Human
aaaucuaggcucauccuggucc

SEQ ID NO: 945483 - RNA, 22 nt, Human
gcugccaugguccaggcuccag

SEQ ID NO: 945484 - RNA, 22 nt, Human
agggccagagucuguguagaua

SEQ ID NO: 945485 - RNA, 22 nt, Human
augcaucuauucccaagggcag

SEQ ID NO: 945486 - RNA, 22 nt, Human
uggcagagcccagacuccaguc

SEQ ID NO: 945487 - RNA, 22 nt, Human
aaauguauccuacuuccugagu

SEQ ID NO: 945488 - RNA, 22 nt, Human
uugaaaaguuuugaaacacucu

SEQ ID NO: 945489 - RNA, 22 nt, Human
acuccuggguuccggagauucu

SEQ ID NO: 945490 - RNA, 22 nt, Human
gggccugucucacucccugguu

SEQ ID NO: 945491 - RNA, 19 nt, Human
aucugccuuagugcugcug

SEQ ID NO: 945492 - RNA, 22 nt, Human
gugggggcaggcagugcuagga

SEQ ID NO: 945493 - RNA, 16 nt, Human
ucucugcuucauaggu

SEQ ID NO: 945494 - RNA, 22 nt, Human
gccugcuguuaacugcaggaau

SEQ ID NO: 945495 - RNA, 22 nt, Human
uuucauaaugucacagucaaaa

SEQ ID NO: 945496 - RNA, 22 nt, Human
uagaaacauauaggauggcagg

SEQ ID NO: 945497 - RNA, 22 nt, Human
uaaugcacagaauugacauggg

SEQ ID NO: 945498 - RNA, 22 nt, Human
ucuucagauugcacugagcaag

SEQ ID NO: 945499 - RNA, 22 nt, Human
aauucacaggagguauuugucc

SEQ ID NO: 945500 - RNA, 22 nt, Human
gcagagccuugcgucaugugcc

SEQ ID NO: 945501 - RNA, 22 nt, Human
caggcuggaguuaccuuuaggg

SEQ ID NO: 945502 - RNA, 22 nt, Human
uucaggauuauacucucuuccc

SEQ ID NO: 945503 - RNA, 22 nt, Human
ugcuggccaauggcagaggcgg

SEQ ID NO: 945504 - RNA, 21 nt, Human
aaaggccauaaucacggagca

SEQ ID NO: 945505 - RNA, 22 nt, Human
auuucaguguugguuagcaagc

SEQ ID NO: 945506 - RNA, 22 nt, Human
gcuggcaggguucucacugaaa

SEQ ID NO: 945507 - RNA, 22 nt, Human
gaggcagcggcucacagagaaa

SEQ ID NO: 945508 - RNA, 22 nt, Human
ccugccugacagagaagguuca

SEQ ID NO: 945509 - RNA, 22 nt, Human
ggucauuguucuuuucugugau

SEQ ID NO: 945510 - RNA, 22 nt, Human
aauaaacugcucaauugcauca

SEQ ID NO: 945511 - RNA, 22 nt, Human
ccuccagcugccucagucucuu

SEQ ID NO: 945512 - RNA, 22 nt, Human
ugcaggugugguuccucagcca

SEQ ID NO: 945513 - RNA, 22 nt, Human
gccagagcaugcacugccugca

SEQ ID NO: 945514 - RNA, 22 nt, Human
aagagcuggaagugaagauaac

SEQ ID NO: 945515 - RNA, 22 nt, Human
agggccagaaucccucagucua

SEQ ID NO: 945516 - RNA, 22 nt, Human
ccugggagagccaucuguggcc

SEQ ID NO: 945517 - RNA, 22 nt, Human
aauuaacagagggcuuauuacu

SEQ ID NO: 945518 - RNA, 22 nt, Human
aaaaauaggucaaccguguaug

SEQ ID NO: 945519 - RNA, 22 nt, Human
guggccuggcgagcuggcgcgg

SEQ ID NO: 945520 - RNA, 22 nt, Human
cugagcugcucccgcugcagcg

SEQ ID NO: 945521 - RNA, 20 nt, Human
guggcaggcagugaaggagc

SEQ ID NO: 945522 - RNA, 22 nt, Human
cugagccagcgggcucacuuuu

SEQ ID NO: 945523 - RNA, 22 nt, Human
ucugucacugagcucaggauuc

SEQ ID NO: 945524 - RNA, 22 nt, Human
auauauuuugcggucacguggc

SEQ ID NO: 945525 - RNA, 22 nt, Human
uccccagggcugcagagggugu

SEQ ID NO: 945526 - RNA, 19 nt, Human
guaagggcuaauggacuau

SEQ ID NO: 945527 - RNA, 22 nt, Human
agacagcauggagcugauaaca

SEQ ID NO: 945528 - RNA, 22 nt, Human
cacaagucuguggucuccaaca

SEQ ID NO: 945529 - RNA, 22 nt, Human
acugcuuuucagagucugccug

SEQ ID NO: 945530 - RNA, 22 nt, Human
agauaaauuccuaagauuucag

SEQ ID NO: 945531 - RNA, 22 nt, Human
ucuccuggcucuaaaaggcugu

SEQ ID NO: 945532 - RNA, 23 nt, Human
uuuggacuugugacucuucuccu

SEQ ID NO: 945533 - RNA, 22 nt, Human
caggcagcaggagcccugcucg

SEQ ID NO: 945534 - RNA, 22 nt, Human
ccuguucauuuguauuugucuu

SEQ ID NO: 945535 - RNA, 22 nt, Human
cuggcagcagcuucuggaucga

SEQ ID NO: 945536 - RNA, 22 nt, Human
uauuccaagcacagcaacccag

SEQ ID NO: 945537 - RNA, 22 nt, Human
acugcuuuaucugagaaguccu

SEQ ID NO: 945538 - RNA, 22 nt, Human
caugcaggcacccagagcccac

SEQ ID NO: 945539 - RNA, 22 nt, Human
uuuucuauucauugucuauggu

SEQ ID NO: 945540 - RNA, 22 nt, Human
uuaaaucaguaggcuacuccuu

SEQ ID NO: 945541 - RNA, 22 nt, Human
gcugauguuuaguugauguuac

SEQ ID NO: 945542 - RNA, 20 nt, Human
ugugcaggagagugaggcug

SEQ ID NO: 945543 - RNA, 22 nt, Human
gaaacugugaucguguucuggg

SEQ ID NO: 945544 - RNA, 22 nt, Human
aaacuccugcauacucagaagc

SEQ ID NO: 945545 - RNA, 22 nt, Human
agcugagcucaggcugauguaa

SEQ ID NO: 945546 - RNA, 20 nt, Human
caggaggcaaggucaagguc

SEQ ID NO: 945547 - RNA, 22 nt, Human
ggcagcaggagccaucugguag

SEQ ID NO: 945548 - RNA, 22 nt, Human
cacaggcuccggccuugcagcc

SEQ ID NO: 945549 - RNA, 22 nt, Human
cagugcauagauccugaggccu

SEQ ID NO: 945550 - RNA, 22 nt, Human
acauuucucaucuaguagagua

SEQ ID NO: 945551 - RNA, 22 nt, Human
augaaauuugcugcuaaguucc

SEQ ID NO: 945552 - RNA, 21 nt, Human
ggccucugucauccugggaag

SEQ ID NO: 945553 - RNA, 22 nt, Human
gggcacuguggggcccaugcug

SEQ ID NO: 945554 - RNA, 22 nt, Human
uugggcucaggaguuugagacc

SEQ ID NO: 945555 - RNA, 22 nt, Human
ucucccagaggaucccagugga

SEQ ID NO: 945556 - RNA, 20 nt, Human
uggagccacagucagguucc

SEQ ID NO: 945557 - RNA, 22 nt, Human
agaggucagauuucuccuggug

SEQ ID NO: 945558 - RNA, 20 nt, Human
aggcacuguugucuguaucc

SEQ ID NO: 945559 - RNA, 22 nt, Human
gcuuuuucaaaugaaagcuggu

SEQ ID NO: 945560 - RNA, 22 nt, Human
cugcuuuguaaaauagacauaa

SEQ ID NO: 945561 - RNA, 23 nt, Human
guaaaauacgcagugcaguguga

SEQ ID NO: 945562 - RNA, 22 nt, Human
ggcuggcuugccaagcucaggg

SEQ ID NO: 945563 - RNA, 22 nt, Human
cuucagaagccugcagccuuug

SEQ ID NO: 945564 - RNA, 22 nt, Human
gagucuuugguaaagucugcug

SEQ ID NO: 945565 - RNA, 22 nt, Human
uguguauucagcaagcgaaaca

SEQ ID NO: 945566 - RNA, 22 nt, Human
uuauguuuuaaguguguaucuu

SEQ ID NO: 945567 - RNA, 22 nt, Human
gacccaggagugcagagagugg

SEQ ID NO: 945568 - RNA, 22 nt, Human
gccaugcuugguaugcugugag

SEQ ID NO: 945569 - RNA, 20 nt, Human
uuuacauuuugaaacaguga

SEQ ID NO: 945570 - RNA, 22 nt, Human
cugggcuucucccccuggcaga

SEQ ID NO: 945571 - RNA, 22 nt, Human
ucacuuagauggggaucaucac

SEQ ID NO: 945572 - RNA, 18 nt, Human
ccuggaccugucuccuuu

SEQ ID NO: 945573 - RNA, 22 nt, Human
cucucugguuucagcgaagggg

SEQ ID NO: 945574 - RNA, 22 nt, Human
ccucuucugagugagacucccu

SEQ ID NO: 945575 - RNA, 22 nt, Human
ugucucugggugauucaguccu

SEQ ID NO: 945576 - RNA, 22 nt, Human
cagcaguggaacuacccaggga

SEQ ID NO: 945577 - RNA, 22 nt, Human
ggcugcugguggaaugguaggc

SEQ ID NO: 945578 - RNA, 22 nt, Human
ucagggcauguauguuucuuua

SEQ ID NO: 945579 - RNA, 22 nt, Human
uuauguuugaguauaugacuca

SEQ ID NO: 945580 - RNA, 22 nt, Human
gcagcugccuucagcuggaugg

SEQ ID NO: 945581 - RNA, 22 nt, Human
aggcccaguagugcugccuuua

SEQ ID NO: 945582 - RNA, 22 nt, Human
gggccuguguguucaggagccu

SEQ ID NO: 945583 - RNA, 22 nt, Human
gucccagaggacagggucacau

SEQ ID NO: 945584 - RNA, 22 nt, Human
ccagcagacacacaggcguggg

SEQ ID NO: 945585 - RNA, 22 nt, Human
gcuccuggcuucacugacauca

SEQ ID NO: 945586 - RNA, 22 nt, Human
uagagcauuuagaggggcagga

SEQ ID NO: 945587 - RNA, 22 nt, Human
ugcugucuguuuacuggcuaua

SEQ ID NO: 945588 - RNA, 22 nt, Human
agaaaugacacacaugagacau

SEQ ID NO: 945589 - RNA, 22 nt, Human
cagcuccugcagcugcugccgu

SEQ ID NO: 945590 - RNA, 22 nt, Human
ggcugcagaaguacuuccggau

SEQ ID NO: 945591 - RNA, 22 nt, Human
guuucacagucugcagaauuuu

SEQ ID NO: 945592 - RNA, 22 nt, Human
gcaggguaggugacagguaguc

SEQ ID NO: 945593 - RNA, 22 nt, Human
cucaguuucugacauuaaaauc

SEQ ID NO: 945594 - RNA, 22 nt, Human
aggaagaauguuuacauaucaa

SEQ ID NO: 945595 - RNA, 22 nt, Human
auucuucaguauguguggauug

SEQ ID NO: 945596 - RNA, 22 nt, Human
gagcuucccucugcagucccug

SEQ ID NO: 945597 - RNA, 22 nt, Human
gccagcagccacagaagucacu

SEQ ID NO: 945598 - RNA, 22 nt, Human
cagagacagggcagggagugug

SEQ ID NO: 945599 - RNA, 22 nt, Human
gagcccagguucugcuuccagc

SEQ ID NO: 945600 - RNA, 22 nt, Human
augcugaggacaaagagaucaa

SEQ ID NO: 945601 - RNA, 22 nt, Human
uugaaggacaucuuguuucuag

SEQ ID NO: 945602 - RNA, 22 nt, Human
aaguuauaucaucucauugacg

SEQ ID NO: 945603 - RNA, 22 nt, Human
auuuauuauugugguuacuucu

SEQ ID NO: 945604 - RNA, 22 nt, Human
auucuuauuauaguaaaacagu

SEQ ID NO: 945605 - RNA, 22 nt, Human
cucacuggcaagacuacaggug

SEQ ID NO: 945606 - RNA, 22 nt, Human
ugggccuggagcccuggagagu

SEQ ID NO: 945607 - RNA, 22 nt, Human
uuaacauacaucaugaacaaug

SEQ ID NO: 945608 - RNA, 22 nt, Human
gagcagcuagauaaagcccuuc

SEQ ID NO: 945609 - RNA, 22 nt, Human
aggcacugaagugguaaaugua

SEQ ID NO: 945610 - RNA, 22 nt, Human
ugggagagcacugcagccccgg

SEQ ID NO: 945611 - RNA, 20 nt, Human
ggcugugcccuuccguggcc

SEQ ID NO: 945612 - RNA, 22 nt, Human
cagcagagcauuugguaggagg

SEQ ID NO: 945613 - RNA, 22 nt, Human
gcccaggaguuugcauuuuaac

SEQ ID NO: 945614 - RNA, 20 nt, Human
augugagggguugaaguggg

SEQ ID NO: 945615 - RNA, 22 nt, Human
auaccuuuuagacauguaguug

SEQ ID NO: 945616 - RNA, 22 nt, Human
ggcacugggugagggucacugg

SEQ ID NO: 945617 - RNA, 22 nt, Human
ccaggccuuccaguacgcagaa

SEQ ID NO: 945618 - RNA, 22 nt, Human
gccaguuccuguggagucagag

SEQ ID NO: 945619 - RNA, 22 nt, Human
gacagacauuuccugauccaau

SEQ ID NO: 945620 - RNA, 20 nt, Human
uuggcagcuucaggguacua

SEQ ID NO: 945621 - RNA, 22 nt, Human
uuacugaaaauucuucaggauu

SEQ ID NO: 945622 - RNA, 22 nt, Human
ccugggugaugugcugcccucg

SEQ ID NO: 945623 - RNA, 22 nt, Human
uuugacaaaggaaaaaugcaca

SEQ ID NO: 945624 - RNA, 22 nt, Human
augccacugacauggacaauuu

SEQ ID NO: 945625 - RNA, 22 nt, Human
guaggcagggcuguggggagaa

SEQ ID NO: 945626 - RNA, 18 nt, Human
ggcugccuguuccugaag

SEQ ID NO: 945627 - RNA, 22 nt, Human
ugugccugucacccucagagag

SEQ ID NO: 945628 - RNA, 22 nt, Human
acacugaagagcacuuucaaag

SEQ ID NO: 945629 - RNA, 22 nt, Human
uacaaagagguaauugcauaua

SEQ ID NO: 945630 - RNA, 22 nt, Human
cugggagagaagcgaagcuggg

SEQ ID NO: 945631 - RNA, 22 nt, Human
aaguuugagagccuuuaguaua

SEQ ID NO: 945632 - RNA, 22 nt, Human
ccugggcauaaaucacuccaag

SEQ ID NO: 945633 - RNA, 21 nt, Human
uucuucaguuuaauauaaaau

SEQ ID NO: 945634 - RNA, 22 nt, Human
cccuggagggauuucucaauca

SEQ ID NO: 945635 - RNA, 22 nt, Human
gccuucugauugcuggacugac

SEQ ID NO: 945636 - RNA, 19 nt, Human
cccaggagucuggcugguu

SEQ ID NO: 945637 - RNA, 18 nt, Human
aggcacagagcauacaua

SEQ ID NO: 945638 - RNA, 22 nt, Human
ucugcuguccuuuauauagauu

SEQ ID NO: 945639 - RNA, 23 nt, Human
uggggagaguuacccuggaagcg

SEQ ID NO: 945640 - RNA, 22 nt, Human
cuaauacacccuauugcuuguu

SEQ ID NO: 945641 - RNA, 22 nt, Human
ucagaggugguaaaggacagca

SEQ ID NO: 945642 - RNA, 22 nt, Human
aggagcuggguuccuuuggugg

SEQ ID NO: 945643 - RNA, 22 nt, Human
gccugggugaauuugauccuaa

SEQ ID NO: 945644 - RNA, 22 nt, Human
acuggcagagguuggacaccau

SEQ ID NO: 945645 - RNA, 19 nt, Human
ugccugucaguagaucuca

SEQ ID NO: 945646 - RNA, 22 nt, Human
aaucaguuguucacucugaaaa

SEQ ID NO: 945647 - RNA, 22 nt, Human
aaggcugagacagcacaggucc

SEQ ID NO: 945648 - RNA, 22 nt, Human
ucugagccguauggcuuggcua

SEQ ID NO: 945649 - RNA, 22 nt, Human
ccagcccuugagauggaaggga

SEQ ID NO: 945650 - RNA, 22 nt, Human
gacauguugaagaauauuugga

SEQ ID NO: 945651 - RNA, 22 nt, Human
uguguauagcaguuuccagucu

SEQ ID NO: 945652 - RNA, 22 nt, Human
uggcagcucccagagcuuccaa

SEQ ID NO: 945653 - RNA, 22 nt, Human
auuuccucaugaucauaaugca

SEQ ID NO: 945654 - RNA, 22 nt, Human
ccacagggugucaucagcuuga

SEQ ID NO: 945655 - RNA, 22 nt, Human
uugcuucauuuuaaauaaagac

SEQ ID NO: 945656 - RNA, 22 nt, Human
auccauggaggacaagagcaau

SEQ ID NO: 945657 - RNA, 22 nt, Human
ggugcagaaggaagggagcugg

SEQ ID NO: 945658 - RNA, 22 nt, Human
cagggucuuauaaggccaauuu

SEQ ID NO: 945659 - RNA, 22 nt, Human
acacaggggaaaguggagcuga

SEQ ID NO: 945660 - RNA, 20 nt, Human
augugucuguaaacaacucu

SEQ ID NO: 945661 - RNA, 22 nt, Human
ggucuuccgagaggccugugcu

SEQ ID NO: 945662 - RNA, 22 nt, Human
ugcaggcaggggaugagcagcc

SEQ ID NO: 945663 - RNA, 22 nt, Human
gcacucuguuucuccugucagc

SEQ ID NO: 945664 - RNA, 22 nt, Human
aguagaaagaaggcacugggcc

SEQ ID NO: 945665 - RNA, 22 nt, Human
cacucccuucaggagccuagga

SEQ ID NO: 945666 - RNA, 22 nt, Human
gagcuggugugugcccgagcac

SEQ ID NO: 945667 - RNA, 22 nt, Human
agaaaucaugacuaagagcagu

SEQ ID NO: 945668 - RNA, 22 nt, Human
agaugaaaauacgugacuuuaa

SEQ ID NO: 945669 - RNA, 22 nt, Human
acugggagagcgaccagauucu

SEQ ID NO: 945670 - RNA, 22 nt, Human
uggcucugugcuucuaguaucu

SEQ ID NO: 945671 - RNA, 22 nt, Human
caauaauauccugugcuguuug

SEQ ID NO: 945672 - RNA, 22 nt, Human
aacucaguucuuuccacaaugc

SEQ ID NO: 945673 - RNA, 19 nt, Human
cuuugucagaacaugcuuc

SEQ ID NO: 945674 - RNA, 22 nt, Human
cagccugggcuccagagucccu

SEQ ID NO: 945675 - RNA, 22 nt, Human
ugcuggcccaugaagacgcagu

SEQ ID NO: 945676 - RNA, 22 nt, Human
uuccuuccgggcaccaggcacu

SEQ ID NO: 945677 - RNA, 22 nt, Human
cuguggaaaauuuguauguaau

SEQ ID NO: 945678 - RNA, 22 nt, Human
cccauugugguuguugaggaua

SEQ ID NO: 945679 - RNA, 22 nt, Human
gauuucuucauuuguggugaau

SEQ ID NO: 945680 - RNA, 22 nt, Human
ggguccagacacuccagaggaa

SEQ ID NO: 945681 - RNA, 22 nt, Human
aagaaauguagagccuaguaaa

SEQ ID NO: 945682 - RNA, 22 nt, Human
uguggugagaaacugguagauu

SEQ ID NO: 945683 - RNA, 22 nt, Human
ccuggagcacauggcaggaggc

SEQ ID NO: 945684 - RNA, 22 nt, Human
aacauacagugagcaguggacu

SEQ ID NO: 945685 - RNA, 22 nt, Human
ucccaggacaugggcucugcuc

SEQ ID NO: 945686 - RNA, 22 nt, Human
guuauaaaaugcacaguuguuu

SEQ ID NO: 945687 - RNA, 22 nt, Human
ugcuugagacacauaugaauuu

SEQ ID NO: 945688 - RNA, 22 nt, Human
ucacugaagacugggcucuaaa

SEQ ID NO: 945689 - RNA, 22 nt, Human
agggcccuccccgcucagggca

SEQ ID NO: 945690 - RNA, 22 nt, Human
gacacagcacuguacaaggaau

SEQ ID NO: 945691 - RNA, 22 nt, Human
ucagaaguaggagacauucuug

SEQ ID NO: 945692 - RNA, 22 nt, Human
gggcugagggguaucucauggg

SEQ ID NO: 945693 - RNA, 22 nt, Human
cuugcuggugguguuuucuaug

SEQ ID NO: 945694 - RNA, 23 nt, Human
aaaguugauuugcaguuuaagag

SEQ ID NO: 945695 - RNA, 22 nt, Human
gcagcccaauggacugagacag

SEQ ID NO: 945696 - RNA, 22 nt, Human
gacccaggguggucaccugaaa

SEQ ID NO: 945697 - RNA, 22 nt, Human
uauuggucuuggaagguuuugu

SEQ ID NO: 945698 - RNA, 22 nt, Human
uccuggaggcaaaugagcacau

SEQ ID NO: 945699 - RNA, 22 nt, Human
uuauuuaaaauguagguuggga

SEQ ID NO: 945700 - RNA, 22 nt, Human
caggccugggcuucggggcuga

SEQ ID NO: 945701 - RNA, 22 nt, Human
auguacauuuuccuaauguuuu

SEQ ID NO: 945702 - RNA, 22 nt, Human
auguaucagaaauagcauuggc

SEQ ID NO: 945703 - RNA, 22 nt, Human
cuggcaggagcauucacagagg

SEQ ID NO: 945704 - RNA, 22 nt, Human
caguauuuauggcuugaguauu

SEQ ID NO: 945705 - RNA, 22 nt, Human
aaggcagcaagaauuccagguu

SEQ ID NO: 945706 - RNA, 22 nt, Human
uuauuucauugauuucuaagac

SEQ ID NO: 945707 - RNA, 22 nt, Human
aaguaugcuaauuaacuagcac

SEQ ID NO: 945708 - RNA, 22 nt, Human
uggcuggggagccccgacuccc

SEQ ID NO: 945709 - RNA, 22 nt, Human
aaaaaugcugugguagcugugu

SEQ ID NO: 945710 - RNA, 22 nt, Human
agcaucuggugagggccuaguu

SEQ ID NO: 945711 - RNA, 22 nt, Human
agggauggaagcucgucugcaa

SEQ ID NO: 945712 - RNA, 22 nt, Human
gagcugccugugugccaugaug

SEQ ID NO: 945713 - RNA, 22 nt, Human
gcaagcaagcagguagagcuga

SEQ ID NO: 945714 - RNA, 21 nt, Human
ugggagagggcucagcuaccc

SEQ ID NO: 945715 - RNA, 22 nt, Human
aagcugccuugcugaggagaaa

SEQ ID NO: 945716 - RNA, 22 nt, Human
uucuggagcuaaaguccacucu

SEQ ID NO: 945717 - RNA, 22 nt, Human
cuggagagauccuccugaaaaa

SEQ ID NO: 945718 - RNA, 22 nt, Human
uguggagcacuguuccuggcau

SEQ ID NO: 945719 - RNA, 19 nt, Human
cuggggcuuugguacugcc

SEQ ID NO: 945720 - RNA, 22 nt, Human
aaugagacacgugaagcagaug

SEQ ID NO: 945721 - RNA, 22 nt, Human
ggaggccaucuggcuggaggcu

SEQ ID NO: 945722 - RNA, 22 nt, Human
ugugucaagacauuuagucauu

SEQ ID NO: 945723 - RNA, 22 nt, Human
gcugcccuaauaucacauguua

SEQ ID NO: 945724 - RNA, 22 nt, Human
uucauuccuucccuaagcaacu

SEQ ID NO: 945725 - RNA, 22 nt, Human
agucccaguucgguucuuccuc

SEQ ID NO: 945726 - RNA, 22 nt, Human
ucucugucugagccuggcagac

SEQ ID NO: 945727 - RNA, 20 nt, Human
uuugagaccagucugcccaa

SEQ ID NO: 945728 - RNA, 22 nt, Human
uacucugcaggauggacuaugg

SEQ ID NO: 945729 - RNA, 18 nt, Human
ucugucuguacaaguauc

SEQ ID NO: 945730 - RNA, 22 nt, Human
ugaggaggucagagucuggcug

SEQ ID NO: 945731 - RNA, 22 nt, Human
uccagccacucagcagggauug

SEQ ID NO: 945732 - RNA, 22 nt, Human
uuuauucaucaucuguucauau

SEQ ID NO: 945733 - RNA, 22 nt, Human
uauauuuaaauccagguugaaa

SEQ ID NO: 945734 - RNA, 22 nt, Human
gcagggcagcuuagucccuguc

SEQ ID NO: 945735 - RNA, 22 nt, Human
cugcccugggaguaccuguccu

SEQ ID NO: 945736 - RNA, 22 nt, Human
gcaugcugcaccagagccucuc

SEQ ID NO: 945737 - RNA, 22 nt, Human
ccagcuccaggacugggagcug

SEQ ID NO: 945738 - RNA, 22 nt, Human
ugaaugaguuuggcugcuguuc

SEQ ID NO: 945739 - RNA, 22 nt, Human
uaugcacgucuauuuaugaaga

SEQ ID NO: 945740 - RNA, 22 nt, Human
cagcuggggcagccacgugcgg

SEQ ID NO: 945741 - RNA, 22 nt, Human
ugccuggaaggcccaugggaag

SEQ ID NO: 945742 - RNA, 22 nt, Human
aagguacaccaaaguucaaguu

SEQ ID NO: 945743 - RNA, 22 nt, Human
caaagguaaagaucugcugugg

SEQ ID NO: 945744 - RNA, 22 nt, Human
cugugcuuaccugcccagguga

SEQ ID NO: 945745 - RNA, 22 nt, Human
agcugggagcagagccacagcc

SEQ ID NO: 945746 - RNA, 22 nt, Human
aggaugaauaacugaaauggug

SEQ ID NO: 945747 - RNA, 22 nt, Human
guguacauagaauugugcuuug

SEQ ID NO: 945748 - RNA, 22 nt, Human
gggcacagaagucuaagacauc

SEQ ID NO: 945749 - RNA, 22 nt, Human
gcugccacauuuucaggacuaa

SEQ ID NO: 945750 - RNA, 22 nt, Human
ccagcuucucucugaugcagcu

SEQ ID NO: 945751 - RNA, 22 nt, Human
cucaggagacaguguccacaug

SEQ ID NO: 945752 - RNA, 22 nt, Human
cacaugggcguaauguccaugg

SEQ ID NO: 945753 - RNA, 22 nt, Human
aaacaugagcaucucuucaagc

SEQ ID NO: 945754 - RNA, 22 nt, Human
ccacccuggacaggccucugag

SEQ ID NO: 945755 - RNA, 22 nt, Human
ggucagguuuuuaggagugacc

SEQ ID NO: 945756 - RNA, 22 nt, Human
agaugaagauaucugcaggggc

SEQ ID NO: 945757 - RNA, 22 nt, Human
gcagggacaucuuugucuagua

SEQ ID NO: 945758 - RNA, 22 nt, Human
auacauucagcagugcucauga

SEQ ID NO: 945759 - RNA, 22 nt, Human
agugcuguaacaacuuauuugg

SEQ ID NO: 945760 - RNA, 22 nt, Human
gggcucugguacuuccuggcuc

SEQ ID NO: 945761 - RNA, 22 nt, Human
cccaggagaugcacuccauugg

SEQ ID NO: 945762 - RNA, 23 nt, Human
gccaggaguggguagacuaaugc

SEQ ID NO: 945763 - RNA, 22 nt, Human
uuggaauucaaguuguagcuua

SEQ ID NO: 945764 - RNA, 18 nt, Human
ugcucuggucucacuugg

SEQ ID NO: 945765 - RNA, 22 nt, Human
cuuaagauuugcgauaccuaau

SEQ ID NO: 945766 - RNA, 22 nt, Human
aucuuucuauuucuaaaaacua

SEQ ID NO: 945767 - RNA, 22 nt, Human
cuuuucaugagucuguuauggg

SEQ ID NO: 945768 - RNA, 22 nt, Human
uuauuugguugcugacuuggaa

SEQ ID NO: 945769 - RNA, 22 nt, Human
acugcuuuagaccuagagcucu

SEQ ID NO: 945770 - RNA, 23 nt, Human
agaugagccaacaccuccaugcc

SEQ ID NO: 945771 - RNA, 22 nt, Human
guugacagcuggugagcugcua

SEQ ID NO: 945772 - RNA, 22 nt, Human
uauccuuguacuauaguauuua

SEQ ID NO: 945773 - RNA, 20 nt, Human
ucugcccaccccggcuccca

SEQ ID NO: 945774 - RNA, 22 nt, Human
aaagccuugggauuugugauca

SEQ ID NO: 945775 - RNA, 23 nt, Human
uccuucagagccucccuccaagc

SEQ ID NO: 945776 - RNA, 22 nt, Human
gaaggaaaacagaucugccuga

SEQ ID NO: 945777 - RNA, 22 nt, Human
ucccagagugugggcaucaagg

SEQ ID NO: 945778 - RNA, 20 nt, Human
gcagcuacucugucucgcuc

SEQ ID NO: 945779 - RNA, 22 nt, Human
gaaugugucacccugucccaug

SEQ ID NO: 945780 - RNA, 22 nt, Human
cugcucuguucccccaucaucu

SEQ ID NO: 945781 - RNA, 22 nt, Human
ccucuucuaggacguccuugug

SEQ ID NO: 945782 - RNA, 21 nt, Human
uccucugcucucauaccacaa

SEQ ID NO: 945783 - RNA, 22 nt, Human
cucaugauguagcgaaugagaa

SEQ ID NO: 945784 - RNA, 22 nt, Human
agccucugcuuaugcaaaggua

SEQ ID NO: 945785 - RNA, 22 nt, Human
cccucccagaugggcuugaggu

SEQ ID NO: 945786 - RNA, 17 nt, Human
gaggacagggaaguagg

SEQ ID NO: 945787 - RNA, 22 nt, Human
ugcagccaccaccucugcugaa

SEQ ID NO: 945788 - RNA, 20 nt, Human
guccaggacccagcaggagg

SEQ ID NO: 945789 - RNA, 21 nt, Human
caugaagccgguucccuguuu

SEQ ID NO: 945790 - RNA, 22 nt, Human
ugggccaggauuucaagacccu

SEQ ID NO: 945791 - RNA, 22 nt, Human
aaaugucuuugaguauuucugc

SEQ ID NO: 945792 - RNA, 22 nt, Human
cacucugcugaaaucgccuugu

SEQ ID NO: 945793 - RNA, 22 nt, Human
uggugcuguggaggggcagaag

SEQ ID NO: 945794 - RNA, 22 nt, Human
cgggcagauugggaagguucau

SEQ ID NO: 945795 - RNA, 22 nt, Human
auccuucaaggggcugacagcu

SEQ ID NO: 945796 - RNA, 22 nt, Human
agagcuggccagggaucacucu

SEQ ID NO: 945797 - RNA, 22 nt, Human
ccagcugcuugggaaaaugucu

SEQ ID NO: 945798 - RNA, 22 nt, Human
uccuggccgccgcguggggccg

SEQ ID NO: 945799 - RNA, 22 nt, Human
ucuucacaugaccuucaugucu

SEQ ID NO: 945800 - RNA, 22 nt, Human
ucuguuccaguagaaaggugca

SEQ ID NO: 945801 - RNA, 22 nt, Human
uuccuggcugaacugaacuccu

SEQ ID NO: 945802 - RNA, 22 nt, Human
gguguccaucaggcugugcuuc

SEQ ID NO: 945803 - RNA, 21 nt, Human
ggggcagagcuaggcccugca

SEQ ID NO: 945804 - RNA, 22 nt, Human
ggagccuguuaguugagugcuc

SEQ ID NO: 945805 - RNA, 18 nt, Human
uugagggaggggcagagu

SEQ ID NO: 945806 - RNA, 22 nt, Human
gcauuuagcuuuaaaauauuuc

SEQ ID NO: 945807 - RNA, 22 nt, Human
acaggcucucagccaguuggca

SEQ ID NO: 945808 - RNA, 22 nt, Human
cccucuggcucuucucaggccg

SEQ ID NO: 945809 - RNA, 22 nt, Human
ugcuuccuauccacacaaugcc

SEQ ID NO: 945810 - RNA, 22 nt, Human
augaagucugcacaugcaugug

SEQ ID NO: 945811 - RNA, 22 nt, Human
caacauuucaaggucuuuagga

SEQ ID NO: 945812 - RNA, 22 nt, Human
auaugagaauuggaaaauauca

SEQ ID NO: 945813 - RNA, 22 nt, Human
uggcucuguucgccaucaggag

SEQ ID NO: 945814 - RNA, 22 nt, Human
uacauuugggacaauaagagaa

SEQ ID NO: 945815 - RNA, 22 nt, Human
aaggcacugagccagccgucuc

SEQ ID NO: 945816 - RNA, 22 nt, Human
auugcagcuggucaggguaauu

SEQ ID NO: 945817 - RNA, 21 nt, Human
ucugucucuccacugcccugc

SEQ ID NO: 945818 - RNA, 22 nt, Human
uggccuggcugcccugucugga

SEQ ID NO: 945819 - RNA, 22 nt, Human
agcugcucccuauccuuuccuu

SEQ ID NO: 945820 - RNA, 22 nt, Human
ugugaaaggggucacagggaaa

SEQ ID NO: 945821 - RNA, 22 nt, Human
uccuugaaaaucuugguuuaga

SEQ ID NO: 945822 - RNA, 22 nt, Human
caagagcucccagaccugggca

SEQ ID NO: 945823 - RNA, 22 nt, Human
uaaaaguggauaagcuguagga

SEQ ID NO: 945824 - RNA, 22 nt, Human
uuugaaaggagcuuuauccaga

SEQ ID NO: 945825 - RNA, 22 nt, Human
acuggcaguagagggagcgcau

SEQ ID NO: 945826 - RNA, 22 nt, Human
gccagucuucauauucauggug

SEQ ID NO: 945827 - RNA, 22 nt, Human
caggccuggagugcaauggcac

SEQ ID NO: 945828 - RNA, 22 nt, Human
cuuuggcaugguccucacuaua

SEQ ID NO: 945829 - RNA, 23 nt, Human
agucucagcuggaaacauguguc

SEQ ID NO: 945830 - RNA, 22 nt, Human
uaagucaugauucuguguuacu

SEQ ID NO: 945831 - RNA, 22 nt, Human
ucaagaaggaguuauuuauuca

SEQ ID NO: 945832 - RNA, 22 nt, Human
uccagcagaaaagagguaggga

SEQ ID NO: 945833 - RNA, 22 nt, Human
uuccaggaggagguacuagagg

SEQ ID NO: 945834 - RNA, 22 nt, Human
gaggcaguguugaaaaggagag

SEQ ID NO: 945835 - RNA, 22 nt, Human
auuauguauuugguauaguuug

SEQ ID NO: 945836 - RNA, 22 nt, Human
uuucauaaggguuucuagacuu

SEQ ID NO: 945837 - RNA, 22 nt, Human
gcugccuccugaaagcgcucug

SEQ ID NO: 945838 - RNA, 22 nt, Human
acacagggcagagagcuggcuc

SEQ ID NO: 945839 - RNA, 22 nt, Human
acacagggggcauucuaggagu

SEQ ID NO: 945840 - RNA, 18 nt, Human
ugugaacacauuuuucug

SEQ ID NO: 945841 - RNA, 22 nt, Human
uagcagggguagauagagugug

SEQ ID NO: 945842 - RNA, 22 nt, Human
cacagcuugggcucugacaaua

SEQ ID NO: 945843 - RNA, 22 nt, Human
cauugaaauauggaaacugaug

SEQ ID NO: 945844 - RNA, 20 nt, Human
aggagaugauccagagucag

SEQ ID NO: 945845 - RNA, 22 nt, Human
augcuguguggucaaguuaauu

SEQ ID NO: 945846 - RNA, 22 nt, Human
cagagccaggguugcaccccug

SEQ ID NO: 945847 - RNA, 22 nt, Human
auguuuaaucggcugccuuucc

SEQ ID NO: 945848 - RNA, 22 nt, Human
aagucauugguagcuugauagg

SEQ ID NO: 945849 - RNA, 23 nt, Human
agaggggagcaucugcuggcuga

SEQ ID NO: 945850 - RNA, 22 nt, Human
gggcagagagcuggaacuccuu

SEQ ID NO: 945851 - RNA, 23 nt, Human
auagucauguaaaauauuugaag

SEQ ID NO: 945852 - RNA, 22 nt, Human
acaguacauaauccugagucug

SEQ ID NO: 945853 - RNA, 22 nt, Human
uucuucaaauagcagggaguca

SEQ ID NO: 945854 - RNA, 22 nt, Human
agcagaacugaugagacuugag

SEQ ID NO: 945855 - RNA, 22 nt, Human
caagagcuggagaggcagucua

SEQ ID NO: 945856 - RNA, 19 nt, Human
gggcuccuugggccucucu

SEQ ID NO: 945857 - RNA, 22 nt, Human
acaaaaauuagcugggcauggu

SEQ ID NO: 945858 - RNA, 22 nt, Human
ccuuuccuuuuuagugugggag

SEQ ID NO: 945859 - RNA, 22 nt, Human
cccaggaaugggaaggaggaau

SEQ ID NO: 945860 - RNA, 22 nt, Human
agaggaggcagcuuaacucagu

SEQ ID NO: 945861 - RNA, 22 nt, Human
acccaggcuggagugcaguagc

SEQ ID NO: 945862 - RNA, 22 nt, Human
ucucuucuaauuaggguccaug

SEQ ID NO: 945863 - RNA, 22 nt, Human
ccuuggaggacugcugcuucuu

SEQ ID NO: 945864 - RNA, 22 nt, Human
uugaauaguuuuggauagcaua

SEQ ID NO: 945865 - RNA, 20 nt, Human
cccucugcuacacugggagc

SEQ ID NO: 945866 - RNA, 22 nt, Human
augaagucuagcaagcauugaa

SEQ ID NO: 945867 - RNA, 22 nt, Human
gucuauauauugcuugaauaau

SEQ ID NO: 945868 - RNA, 22 nt, Human
ucagaagagcuggugcugccug

SEQ ID NO: 945869 - RNA, 22 nt, Human
cagccagggucaggcagcuucu

SEQ ID NO: 945870 - RNA, 22 nt, Human
uugaagcaaggcgaaucuugug

SEQ ID NO: 945871 - RNA, 22 nt, Human
auucccaucgucaacuucacug

SEQ ID NO: 945872 - RNA, 22 nt, Human
ccugggaggcuguuuccagccu

SEQ ID NO: 945873 - RNA, 22 nt, Human
cuucaucaacucuaacaaaugu

SEQ ID NO: 945874 - RNA, 22 nt, Human
cucuggaggccuaaggaagugg

SEQ ID NO: 945875 - RNA, 22 nt, Human
augcagcaguuuacaaagcaau

SEQ ID NO: 945876 - RNA, 22 nt, Human
gcccaggaguugaaugcagcag

SEQ ID NO: 945877 - RNA, 22 nt, Human
gcccaggauggagaauaguggu

SEQ ID NO: 945878 - RNA, 22 nt, Human
uaugcauaauuggauaaguaga

SEQ ID NO: 945879 - RNA, 22 nt, Human
agggagcuucuggccucagccu

SEQ ID NO: 945880 - RNA, 22 nt, Human
uccagggacagcgcuggagcua

SEQ ID NO: 945881 - RNA, 22 nt, Human
acucugcuggcugcagggcagc

SEQ ID NO: 945882 - RNA, 19 nt, Human
caaggccaccauuucuccg

SEQ ID NO: 945883 - RNA, 22 nt, Human
uggagggcaugcuguccauggg

SEQ ID NO: 945884 - RNA, 22 nt, Human
aaugcacaaaaauuguauguaa

SEQ ID NO: 945885 - RNA, 17 nt, Human
uggacccuugggccucc

SEQ ID NO: 945886 - RNA, 22 nt, Human
agugacucacuagcucucagug

SEQ ID NO: 945887 - RNA, 22 nt, Human
gccugagagacccauggggcaa

SEQ ID NO: 945888 - RNA, 22 nt, Human
cuggccuucagacucggacuga

SEQ ID NO: 945889 - RNA, 22 nt, Human
aaauaggagcuuaagcacuucu

SEQ ID NO: 945890 - RNA, 22 nt, Human
cucaggauuaaggaaucuaaau

SEQ ID NO: 945891 - RNA, 22 nt, Human
gggcagagguucaacuucaaca

SEQ ID NO: 945892 - RNA, 22 nt, Human
cagcuccacuugaguggggccu

SEQ ID NO: 945893 - RNA, 19 nt, Human
ccuuccagcuccuuuucag

SEQ ID NO: 945894 - RNA, 22 nt, Human
cagagugaaaacugagcucaaa

SEQ ID NO: 945895 - RNA, 22 nt, Human
ggagucccagcaaagccuuccc

SEQ ID NO: 945896 - RNA, 22 nt, Human
uuugaguugcuuauuuaauagg

SEQ ID NO: 945897 - RNA, 19 nt, Human
uaaggccaaaaguaagugu

SEQ ID NO: 945898 - RNA, 22 nt, Human
cagaguguauucugcaguugca

SEQ ID NO: 945899 - RNA, 22 nt, Human
aggauccuuuggccacuucuua

SEQ ID NO: 945900 - RNA, 22 nt, Human
agcuuuaugggagcuuagauaa

SEQ ID NO: 945901 - RNA, 23 nt, Human
aaauucaguccuucaacucugag

SEQ ID NO: 945902 - RNA, 22 nt, Human
aaggcacuagcaagcugccugg

SEQ ID NO: 945903 - RNA, 22 nt, Human
gcagaaggucuggcacuucagg

SEQ ID NO: 945904 - RNA, 22 nt, Human
agcaacaggaaauagcugauua

SEQ ID NO: 945905 - RNA, 22 nt, Human
ugggacagugugccuugcuccu

SEQ ID NO: 945906 - RNA, 22 nt, Human
ugagccugggagauggaggcug

SEQ ID NO: 945907 - RNA, 22 nt, Human
ugccucugaggaagauuguguu

SEQ ID NO: 945908 - RNA, 22 nt, Human
aggccuggugugccggaugcag

SEQ ID NO: 945909 - RNA, 22 nt, Human
ugaggcagcauucuucaagaca

SEQ ID NO: 945910 - RNA, 19 nt, Human
uagcugccuguuaccucca

SEQ ID NO: 945911 - RNA, 22 nt, Human
acaaagucuuuuacaacaguca

SEQ ID NO: 945912 - RNA, 22 nt, Human
ggcugggcaggucugcacaggg

SEQ ID NO: 945913 - RNA, 22 nt, Human
aaggcagcccuggcucagccug

SEQ ID NO: 945914 - RNA, 22 nt, Human
uugucuuaaauggauggacaau

SEQ ID NO: 945915 - RNA, 19 nt, Human
uccaaaggacccaccucca

SEQ ID NO: 945916 - RNA, 22 nt, Human
ggccugaggcaauagucagaca

SEQ ID NO: 945917 - RNA, 22 nt, Human
gaaaugugcagaauguguuaga

SEQ ID NO: 945918 - RNA, 22 nt, Human
gcuuugaagucugugucuuuug

SEQ ID NO: 945919 - RNA, 18 nt, Human
cugaaggauccaggugua

SEQ ID NO: 945920 - RNA, 22 nt, Human
cagcuccagcccaggcagcucc

SEQ ID NO: 945921 - RNA, 19 nt, Human
ggcugcugguuacagaggc

SEQ ID NO: 945922 - RNA, 22 nt, Human
uucagaauauuuguuuuacaug

SEQ ID NO: 945923 - RNA, 22 nt, Human
ugaaugugaugcuaaacauaug

SEQ ID NO: 945924 - RNA, 22 nt, Human
uagaaaugauugguugagcucu

SEQ ID NO: 945925 - RNA, 22 nt, Human
caugcacaacauacucaagagg

SEQ ID NO: 945926 - RNA, 22 nt, Human
ucagaguguggugagaugugca

SEQ ID NO: 945927 - RNA, 22 nt, Human
ugaaagguuauuuaggucugcu

SEQ ID NO: 945928 - RNA, 22 nt, Human
cagaggcaaaagagguggaggu

SEQ ID NO: 945929 - RNA, 22 nt, Human
augugucugauggcccugaauu

SEQ ID NO: 945930 - RNA, 22 nt, Human
cugccuuggcccuaguucaugg

SEQ ID NO: 945931 - RNA, 22 nt, Human
uuugacauggaauaacucauuu

SEQ ID NO: 945932 - RNA, 22 nt, Human
cagggcuguuagcugcugcucu

SEQ ID NO: 945933 - RNA, 18 nt, Human
ccugccagucuggagcag

SEQ ID NO: 945934 - RNA, 22 nt, Human
auaaagauuucuuuuucucuac

SEQ ID NO: 945935 - RNA, 22 nt, Human
cucuugaagggcaucugaguua

SEQ ID NO: 945936 - RNA, 22 nt, Human
cugaaggauuagagagcacuua

SEQ ID NO: 945937 - RNA, 22 nt, Human
ccaggcagagggauccccaucc

SEQ ID NO: 945938 - RNA, 22 nt, Human
ugggcucugugccagguuggug

SEQ ID NO: 945939 - RNA, 23 nt, Human
aucagucuugguagcugugccca

SEQ ID NO: 945940 - RNA, 21 nt, Human
uagaaaucagcuggugccucu

SEQ ID NO: 945941 - RNA, 22 nt, Human
ugcacagugaccccuggugacu

SEQ ID NO: 945942 - RNA, 22 nt, Human
agcagcugucccuuaacaucag

SEQ ID NO: 945943 - RNA, 22 nt, Human
aauucuagcauugugaaaauau

SEQ ID NO: 945944 - RNA, 22 nt, Human
ucauccaguaugacuggugucu

SEQ ID NO: 945945 - RNA, 18 nt, Human
acaguaaagaaaggaauu

SEQ ID NO: 945946 - RNA, 22 nt, Human
cucugggcaaguaugauagaaa

SEQ ID NO: 945947 - RNA, 22 nt, Human
ggcaagcucaggccucaggugu

SEQ ID NO: 945948 - RNA, 22 nt, Human
gcugggagccccgagccagcgc

SEQ ID NO: 945949 - RNA, 22 nt, Human
uccugcugagcgucugucauuu

SEQ ID NO: 945950 - RNA, 22 nt, Human
gggcugcugcugccagcgacac

SEQ ID NO: 945951 - RNA, 22 nt, Human
cugugugcugaaaugcagugag

SEQ ID NO: 945952 - RNA, 22 nt, Human
ggcagcuaguuuaagaaagagg

SEQ ID NO: 945953 - RNA, 22 nt, Human
gcucccagcuggagccucaaca

SEQ ID NO: 945954 - RNA, 22 nt, Human
agaggagcugggaggcccucgu

SEQ ID NO: 945955 - RNA, 22 nt, Human
augugucugguuauugacaugc

SEQ ID NO: 945956 - RNA, 23 nt, Human
cuucuggcucuauaucagaauuc

SEQ ID NO: 945957 - RNA, 22 nt, Human
acuguucaaguuuuaugcugga

SEQ ID NO: 945958 - RNA, 22 nt, Human
gcugucacacauggccccagcu

SEQ ID NO: 945959 - RNA, 22 nt, Human
ccucagcucuucccugugcaca

SEQ ID NO: 945960 - RNA, 22 nt, Human
ggagucaggagcaggcugggcu

SEQ ID NO: 945961 - RNA, 22 nt, Human
cugccaggcgauggauuggcug

SEQ ID NO: 945962 - RNA, 22 nt, Human
ggccagaaguuggaaaagagcc

SEQ ID NO: 945963 - RNA, 17 nt, Human
ucuggccuuccugaacu

SEQ ID NO: 945964 - RNA, 17 nt, Human
agcuccugcccauggcu

SEQ ID NO: 945965 - RNA, 22 nt, Human
ugggccuguggcuuggcucuag

SEQ ID NO: 945966 - RNA, 22 nt, Human
uuuuaguuguacugucaacagu

SEQ ID NO: 945967 - RNA, 22 nt, Human
gccucugcaccaguacugugcc

SEQ ID NO: 945968 - RNA, 22 nt, Human
ugaugguugauuauaaaucagu

SEQ ID NO: 945969 - RNA, 18 nt, Human
cugggucuccaggcugcc

SEQ ID NO: 945970 - RNA, 17 nt, Human
gcucccugaggacagcu

SEQ ID NO: 945971 - RNA, 21 nt, Human
gggucugaauaucuggugcug

SEQ ID NO: 945972 - RNA, 22 nt, Human
ccugggcagggcuggacucuca

SEQ ID NO: 945973 - RNA, 22 nt, Human
guucacauccuugugaggauuu

SEQ ID NO: 945974 - RNA, 23 nt, Human
gccucuggagccccagugcucag

SEQ ID NO: 945975 - RNA, 20 nt, Human
gcauugaguauagacagaug

SEQ ID NO: 945976 - RNA, 22 nt, Human
ucugagcuuuuauuaucaaccu

SEQ ID NO: 945977 - RNA, 22 nt, Human
cugucaccuguucacugcagca

SEQ ID NO: 945978 - RNA, 22 nt, Human
cccaggagacagaaacagaggu

SEQ ID NO: 945979 - RNA, 22 nt, Human
ugguccaggguguaguacagag

SEQ ID NO: 945980 - RNA, 17 nt, Human
aaugaaugaauucuuug

SEQ ID NO: 945981 - RNA, 22 nt, Human
uuugaaauaugugucuuuugaa

SEQ ID NO: 945982 - RNA, 17 nt, Human
cugucugcgcaugaggu

SEQ ID NO: 945983 - RNA, 22 nt, Human
ggcacugaaguggguguugggu

SEQ ID NO: 945984 - RNA, 22 nt, Human
uaucuacuccucuuucagaugc

SEQ ID NO: 945985 - RNA, 22 nt, Human
uuugcauuauauuuauagaaga

SEQ ID NO: 945986 - RNA, 22 nt, Human
aagugaguggccuggagaggug

SEQ ID NO: 945987 - RNA, 22 nt, Human
gcagccagccccucugaccucu

SEQ ID NO: 945988 - RNA, 22 nt, Human
uccuuuuuauaguuagagaaac

SEQ ID NO: 945989 - RNA, 18 nt, Human
acagaaauagcugugccu

SEQ ID NO: 945990 - RNA, 22 nt, Human
ggucagggcucuuccaguggcu

SEQ ID NO: 945991 - RNA, 22 nt, Human
agggcucugagugggaaagagg

SEQ ID NO: 945992 - RNA, 20 nt, Human
uccaguuuuggagacauucu

SEQ ID NO: 945993 - RNA, 21 nt, Human
agugaaaugaaguguaugcuc

SEQ ID NO: 945994 - RNA, 22 nt, Human
cccaggaaccuaccagcucgag

SEQ ID NO: 945995 - RNA, 22 nt, Human
acaacauuauacauagaaagcu

SEQ ID NO: 945996 - RNA, 22 nt, Human
caguguccucagccagcagcua

SEQ ID NO: 945997 - RNA, 22 nt, Human
aggaagccaugguggacgucua

SEQ ID NO: 945998 - RNA, 22 nt, Human
aaaaagguugauccagauuagg

SEQ ID NO: 945999 - RNA, 22 nt, Human
ugucccauggauaccaggcuau

SEQ ID NO: 946000 - RNA, 21 nt, Human
agcaccuuacagcuauaaugg

SEQ ID NO: 946001 - RNA, 22 nt, Human
cagccuguagaauacaguaaau

SEQ ID NO: 946002 - RNA, 22 nt, Human
agccuggaggaggaguugagca

SEQ ID NO: 946003 - RNA, 22 nt, Human
ucagaagacuacuaggacacau

SEQ ID NO: 946004 - RNA, 22 nt, Human
gggcguggauggucagugcagg

SEQ ID NO: 946005 - RNA, 22 nt, Human
cagcagagcugugugggaaggg

SEQ ID NO: 946006 - RNA, 22 nt, Human
ggcugucugugguggagcguug

SEQ ID NO: 946007 - RNA, 22 nt, Human
cugugucugaauaacucugugu

SEQ ID NO: 946008 - RNA, 22 nt, Human
uacuacauuaauaaaacauuca

SEQ ID NO: 946009 - RNA, 22 nt, Human
uuggccaagauacgagcacaua

SEQ ID NO: 946010 - RNA, 22 nt, Human
augccuguaaucccagugcuuu

SEQ ID NO: 946011 - RNA, 22 nt, Human
uuuaggauaacuccaguuuucc

SEQ ID NO: 946012 - RNA, 22 nt, Human
ugcucuggguccugggccuccu

SEQ ID NO: 946013 - RNA, 22 nt, Human
caguacuuaguucucaugguuu

SEQ ID NO: 946014 - RNA, 22 nt, Human
aguuauagaaccagguccucac

SEQ ID NO: 946015 - RNA, 22 nt, Human
cagcuguggcugccacugcucc

SEQ ID NO: 946016 - RNA, 22 nt, Human
gugcagcagggggaagacagug

SEQ ID NO: 946017 - RNA, 21 nt, Human
uggagcugaauuuuuggcauc

SEQ ID NO: 946018 - RNA, 22 nt, Human
cuuucaaugugccugccuuggg

SEQ ID NO: 946019 - RNA, 22 nt, Human
ccuggcaguuuugcccaggauu

SEQ ID NO: 946020 - RNA, 20 nt, Human
ggccuuggguuucgccuguu

SEQ ID NO: 946021 - RNA, 22 nt, Human
guccaugauucugugacacccu

SEQ ID NO: 946022 - RNA, 22 nt, Human
uacagauacagaucuagauaca

SEQ ID NO: 946023 - RNA, 22 nt, Human
uucugugaaucuuuuuucccac

SEQ ID NO: 946024 - RNA, 22 nt, Human
gcucccugcacucugcagcccu

SEQ ID NO: 946025 - RNA, 22 nt, Human
uggcaggcagugugggagcugg

SEQ ID NO: 946026 - RNA, 22 nt, Human
cuggcucaggaaaguugcugcu

SEQ ID NO: 946027 - RNA, 22 nt, Human
caaaugcuacuaauaggcaagu

SEQ ID NO: 946028 - RNA, 22 nt, Human
cacagccugcugcacucaagaa

SEQ ID NO: 946029 - RNA, 22 nt, Human
uuguuaguuuauauaauguagu

SEQ ID NO: 946030 - RNA, 22 nt, Human
gcuaccugagcaagagcuucaa

SEQ ID NO: 946031 - RNA, 22 nt, Human
uuuucuuacugucugugauccu

SEQ ID NO: 946032 - RNA, 22 nt, Human
gcugcccugugguccagcaggu

SEQ ID NO: 946033 - RNA, 22 nt, Human
gggaagaguaacuagcccaugu

SEQ ID NO: 946034 - RNA, 22 nt, Human
uucacauuaucaggauuguuuc

SEQ ID NO: 946035 - RNA, 18 nt, Human
agggagagaccgcggguc

SEQ ID NO: 946036 - RNA, 22 nt, Human
agagcugaauuuggguggugga

SEQ ID NO: 946037 - RNA, 17 nt, Human
aggaaacauuuucuuuc

SEQ ID NO: 946038 - RNA, 22 nt, Human
aaauaguaaagugguagccauc

SEQ ID NO: 946039 - RNA, 22 nt, Human
aaguucuaauuuugcauucagg

SEQ ID NO: 946040 - RNA, 22 nt, Human
cuucagaggggacucaaaguca

SEQ ID NO: 946041 - RNA, 22 nt, Human
ucaguaacuuacuuauucaccu

SEQ ID NO: 946042 - RNA, 22 nt, Human
agacauaagugcuaugacauug

SEQ ID NO: 946043 - RNA, 22 nt, Human
gcugcaggggggucuggacuug

SEQ ID NO: 946044 - RNA, 22 nt, Human
agagccagccuucucagcuuac

SEQ ID NO: 946045 - RNA, 22 nt, Human
auucacaaagaagggaaguaca

SEQ ID NO: 946046 - RNA, 22 nt, Human
ccagggccaguaagauuggcau

SEQ ID NO: 946047 - RNA, 22 nt, Human
acucugcuuaauuaaaaccagg

SEQ ID NO: 946048 - RNA, 22 nt, Human
uagggcaguuucauguuaucuu

SEQ ID NO: 946049 - RNA, 20 nt, Human
accaauguuagcuuaguacu

SEQ ID NO: 946050 - RNA, 22 nt, Human
cugcuaaaccucucugagagcu

SEQ ID NO: 946051 - RNA, 22 nt, Human
uauucaaaguaccuucauugcc

SEQ ID NO: 946052 - RNA, 22 nt, Human
guuuuguugcugcagagcucaa

SEQ ID NO: 946053 - RNA, 22 nt, Human
cuuagaaauaaugguuucaguu

SEQ ID NO: 946054 - RNA, 22 nt, Human
augaaaacggaccagagcuauu

SEQ ID NO: 946055 - RNA, 22 nt, Human
cugcugcugagaaugccucagg

SEQ ID NO: 946056 - RNA, 17 nt, Human
cugcuuugugcaacgcu

SEQ ID NO: 946057 - RNA, 22 nt, Human
aaaaugcuauuucauggaggag

SEQ ID NO: 946058 - RNA, 22 nt, Human
aguguuccuugcuuucccagag

SEQ ID NO: 946059 - RNA, 22 nt, Human
cagggagaucuuggcuccuggu

SEQ ID NO: 946060 - RNA, 22 nt, Human
ggcugcaggcagaggcugucug

SEQ ID NO: 946061 - RNA, 22 nt, Human
ugcagaagaaugagcuuggagu

SEQ ID NO: 946062 - RNA, 22 nt, Human
uggccuuggcagugagaagagu

SEQ ID NO: 946063 - RNA, 22 nt, Human
uccaggcauaaugcccaguggu

SEQ ID NO: 946064 - RNA, 22 nt, Human
gccccagccaaggugacacgaa

SEQ ID NO: 946065 - RNA, 22 nt, Human
cacaggcucuucucacuugauu

SEQ ID NO: 946066 - RNA, 22 nt, Human
uuggcagcccagcuuacuagca

SEQ ID NO: 946067 - RNA, 22 nt, Human
ccaaggagcucauauucuuguu

SEQ ID NO: 946068 - RNA, 22 nt, Human
acucugcuuauugcugcaggca

SEQ ID NO: 946069 - RNA, 22 nt, Human
auaguguguaaagugcagugau

SEQ ID NO: 946070 - RNA, 17 nt, Human
ccacucaguaauuucuc

SEQ ID NO: 946071 - RNA, 22 nt, Human
ugcaucuuacguuuugaaaggg

SEQ ID NO: 946072 - RNA, 22 nt, Human
auguccuuugcuucucuggucc

SEQ ID NO: 946073 - RNA, 22 nt, Human
ugaauaguccuuggaauaacug

SEQ ID NO: 946074 - RNA, 22 nt, Human
aggugcuuggcucgugcacaca

SEQ ID NO: 946075 - RNA, 22 nt, Human
gccuggcaggccugggccagca

SEQ ID NO: 946076 - RNA, 22 nt, Human
ccuccugggacaggcuggcaca

SEQ ID NO: 946077 - RNA, 22 nt, Human
uuuuuggguccaggcuguaucu

SEQ ID NO: 946078 - RNA, 22 nt, Human
uugcagcuuagugauguuaucu

SEQ ID NO: 946079 - RNA, 22 nt, Human
uauguacauggagagcaauuga

SEQ ID NO: 946080 - RNA, 22 nt, Human
uuguauuagcuguaaauuuucu

SEQ ID NO: 946081 - RNA, 22 nt, Human
gaaucauuuauuuuugacagca

SEQ ID NO: 946082 - RNA, 22 nt, Human
ccagggugaggaggcucccacg

SEQ ID NO: 946083 - RNA, 22 nt, Human
gccagccccuuagggcucuccc

SEQ ID NO: 946084 - RNA, 22 nt, Human
guauacauagaugaugaacaag

SEQ ID NO: 946085 - RNA, 22 nt, Human
cucccuggcacagcgagagguu

SEQ ID NO: 946086 - RNA, 22 nt, Human
aaaacuacauuugacauuuugu

SEQ ID NO: 946087 - RNA, 22 nt, Human
uugcugaaguuaaugcuugcaa

SEQ ID NO: 946088 - RNA, 22 nt, Human
aauucauccaugaacaauucca

SEQ ID NO: 946089 - RNA, 22 nt, Human
aggcagauuuaggagaaaagaa

SEQ ID NO: 946090 - RNA, 22 nt, Human
uccuggcccgaucccugugaag

SEQ ID NO: 946091 - RNA, 22 nt, Human
guguguccucaguaguggcaug

SEQ ID NO: 946092 - RNA, 22 nt, Human
gccuggagcccaguguggggcu

SEQ ID NO: 946093 - RNA, 22 nt, Human
uagaaaucagguuuuuagaaag

SEQ ID NO: 946094 - RNA, 22 nt, Human
cucaggcccacagcagacccac

SEQ ID NO: 946095 - RNA, 22 nt, Human
uuaaacagguuuuugaauggcc

SEQ ID NO: 946096 - RNA, 21 nt, Human
aaaaagcuggggcaugcaugc

SEQ ID NO: 946097 - RNA, 22 nt, Human
cuuauguaugcuacuuuguggu

SEQ ID NO: 946098 - RNA, 22 nt, Human
guggauggauuuugaggaaugg

SEQ ID NO: 946099 - RNA, 22 nt, Human
agcaccugcacaguggaggaaa

SEQ ID NO: 946100 - RNA, 22 nt, Human
uuucaaauaccauaaaccuaau

SEQ ID NO: 946101 - RNA, 22 nt, Human
uauagccauuuccaguggcauc

SEQ ID NO: 946102 - RNA, 22 nt, Human
caggagugagaugcgaucacuu

SEQ ID NO: 946103 - RNA, 22 nt, Human
cacaggagguuaggaagugguc

SEQ ID NO: 946104 - RNA, 22 nt, Human
ggccucugcccucacuccuguc

SEQ ID NO: 946105 - RNA, 21 nt, Human
aacauuucaggauccaaauug

SEQ ID NO: 946106 - RNA, 22 nt, Human
caggcagcguccugcuuccugu

SEQ ID NO: 946107 - RNA, 22 nt, Human
gccuggcaggccuguuggggcu

SEQ ID NO: 946108 - RNA, 22 nt, Human
auggauaauggugauaguugca

SEQ ID NO: 946109 - RNA, 22 nt, Human
uacuuugucauucuaaccuucc

SEQ ID NO: 946110 - RNA, 22 nt, Human
ggcugccucugaugugcagacg

SEQ ID NO: 946111 - RNA, 22 nt, Human
aacuccagugucagcugcaaug

SEQ ID NO: 946112 - RNA, 22 nt, Human
gcugccaccguggagaugagug

SEQ ID NO: 946113 - RNA, 22 nt, Human
aggcacugugcugaugucuuau

SEQ ID NO: 946114 - RNA, 22 nt, Human
cucucugguacauagaguuugg

SEQ ID NO: 946115 - RNA, 22 nt, Human
agagggagugaaauggaauaga

SEQ ID NO: 946116 - RNA, 22 nt, Human
uaacaauaguguuugcuaguca

SEQ ID NO: 946117 - RNA, 19 nt, Human
uggcuccugccugccuucu

SEQ ID NO: 946118 - RNA, 22 nt, Human
acccaggaggcagagguugcag

SEQ ID NO: 946119 - RNA, 20 nt, Human
acugccuugguucaguaggu

SEQ ID NO: 946120 - RNA, 22 nt, Human
aguguuccugcucucaggaagc

SEQ ID NO: 946121 - RNA, 23 nt, Human
agggcacugaagcuggaauuggg

SEQ ID NO: 946122 - RNA, 22 nt, Human
cagagcucagagcagggcacuc

SEQ ID NO: 946123 - RNA, 23 nt, Human
cagguggcuccacgagggguggg

SEQ ID NO: 946124 - RNA, 22 nt, Human
gcucagaggcacgaccucuugg

SEQ ID NO: 946125 - RNA, 22 nt, Human
acaaaugcagcauaaagugaac

SEQ ID NO: 946126 - RNA, 22 nt, Human
uggcucaguaaucgagucuccu

SEQ ID NO: 946127 - RNA, 21 nt, Human
auggagccuaagaguggaggu

SEQ ID NO: 946128 - RNA, 22 nt, Human
ucuggcucaaaauacguacucu

SEQ ID NO: 946129 - RNA, 22 nt, Human
gggaugucacugugccuggcac

SEQ ID NO: 946130 - RNA, 23 nt, Human
uccuccuuuugcuugugcuuccc

SEQ ID NO: 946131 - RNA, 22 nt, Human
ugcugcuccccagcacacagca

SEQ ID NO: 946132 - RNA, 22 nt, Human
acacauuaugagcaguugucuu

SEQ ID NO: 946133 - RNA, 22 nt, Human
cagcagccuacaaugcacagaa

SEQ ID NO: 946134 - RNA, 22 nt, Human
ucauguaaguauagaaagcagu

SEQ ID NO: 946135 - RNA, 22 nt, Human
uugauguacagaauuguucaca

SEQ ID NO: 946136 - RNA, 19 nt, Human
agccuggcuuugcucugcu

SEQ ID NO: 946137 - RNA, 22 nt, Human
aagagagaacucccuucgccag

SEQ ID NO: 946138 - RNA, 16 nt, Human
gcuccugggcccucga

SEQ ID NO: 946139 - RNA, 22 nt, Human
auuugcuuucagguauaaaagg

SEQ ID NO: 946140 - RNA, 22 nt, Human
uguggcugucuguucuccuagg

SEQ ID NO: 946141 - RNA, 18 nt, Human
gagguccugcucuagccc

SEQ ID NO: 946142 - RNA, 22 nt, Human
uccagccaugcaugacaaucac

SEQ ID NO: 946143 - RNA, 21 nt, Human
acaggcuuuagaaaaugacuc

SEQ ID NO: 946144 - RNA, 21 nt, Human
augaagucuaugcuucugugu

SEQ ID NO: 946145 - RNA, 22 nt, Human
guggccagcaagugcugccucu

SEQ ID NO: 946146 - RNA, 22 nt, Human
ucacuuaaaaauucuaguuaug

SEQ ID NO: 946147 - RNA, 22 nt, Human
gcagcuccuccugggcuggaga

SEQ ID NO: 946148 - RNA, 22 nt, Human
uucuuucccaguagaugugaaa

SEQ ID NO: 946149 - RNA, 22 nt, Human
cugccuccugccgugcagcuuc

SEQ ID NO: 946150 - RNA, 21 nt, Human
cucuugugucagagccagagg

SEQ ID NO: 946151 - RNA, 22 nt, Human
uaauuuaauuccauggauucua

SEQ ID NO: 946152 - RNA, 22 nt, Human
ggccagggccuggggacugucc

SEQ ID NO: 946153 - RNA, 22 nt, Human
ugaaaaggaguccuuguuuuca

SEQ ID NO: 946154 - RNA, 22 nt, Human
cacagggccuugugugacugca

SEQ ID NO: 946155 - RNA, 22 nt, Human
gccaagagaaugugagagaaau

SEQ ID NO: 946156 - RNA, 22 nt, Human
ucagaagcaggagugugcacaa

SEQ ID NO: 946157 - RNA, 22 nt, Human
uggccacagccucugccaguuc

SEQ ID NO: 946158 - RNA, 22 nt, Human
aggcgcugcgcuggggccagaa

SEQ ID NO: 946159 - RNA, 20 nt, Human
uccaugaguuagagacuaua

SEQ ID NO: 946160 - RNA, 22 nt, Human
ugagccuggagucguggagggg

SEQ ID NO: 946161 - RNA, 23 nt, Human
gggaccagcuagggcugugaccu

SEQ ID NO: 946162 - RNA, 20 nt, Human
uuucaagucagcaauucuca

SEQ ID NO: 946163 - RNA, 22 nt, Human
auaacagagagcuacugaacug

SEQ ID NO: 946164 - RNA, 22 nt, Human
auuucauugaaguuaauucuuc

SEQ ID NO: 946165 - RNA, 22 nt, Human
guccucagagugggcagguccu

SEQ ID NO: 946166 - RNA, 22 nt, Human
cccuggaggcggagcuugcagu

SEQ ID NO: 946167 - RNA, 22 nt, Human
cacagggcaccaguuggccauc

SEQ ID NO: 946168 - RNA, 21 nt, Human
uccucagggccccagagcacu

SEQ ID NO: 946169 - RNA, 22 nt, Human
ugagagauugcuguauguuuug

SEQ ID NO: 946170 - RNA, 22 nt, Human
ggagcuggucagccuugagcau

SEQ ID NO: 946171 - RNA, 22 nt, Human
ucuguucaguugauguaguuuu

SEQ ID NO: 946172 - RNA, 22 nt, Human
uuauuccaguaaucucuguaau

SEQ ID NO: 946173 - RNA, 22 nt, Human
uggcugugugccaggcugucug

SEQ ID NO: 946174 - RNA, 18 nt, Human
aagcugcccucaggcagg

SEQ ID NO: 946175 - RNA, 22 nt, Human
cuacacaguucugccuaauggc

SEQ ID NO: 946176 - RNA, 22 nt, Human
cugggcugcaucaaagaggcau

SEQ ID NO: 946177 - RNA, 22 nt, Human
ugaacaguuucaagaaaacuuu

SEQ ID NO: 946178 - RNA, 22 nt, Human
gcagcugauggaaguccuauug

SEQ ID NO: 946179 - RNA, 22 nt, Human
gaguuuaacacuuggagaaaag

SEQ ID NO: 946180 - RNA, 22 nt, Human
gcagagugauggaaugugggug

SEQ ID NO: 946181 - RNA, 23 nt, Human
uggggccaagugaggaagggucu

SEQ ID NO: 946182 - RNA, 21 nt, Human
ugcaugcuauguuuuuauuuc

SEQ ID NO: 946183 - RNA, 22 nt, Human
aggcccugcccagugccacaag

SEQ ID NO: 946184 - RNA, 22 nt, Human
aggagagcuggugucuggaauc

SEQ ID NO: 946185 - RNA, 22 nt, Human
ucuggcucauacaagccugcaa

SEQ ID NO: 946186 - RNA, 22 nt, Human
aggagagaauguuccaggcuug

SEQ ID NO: 946187 - RNA, 22 nt, Human
ccagcuccucuucccaguguca

SEQ ID NO: 946188 - RNA, 22 nt, Human
ucagaggacaagcucccuggug

SEQ ID NO: 946189 - RNA, 20 nt, Human
gcuuccuucccagcccccac

SEQ ID NO: 946190 - RNA, 22 nt, Human
caucuuuaacaauuuacaaugu

SEQ ID NO: 946191 - RNA, 22 nt, Human
gcagaggggaagcugaggaauu

SEQ ID NO: 946192 - RNA, 22 nt, Human
uaggauaugguagaaaucauuc

SEQ ID NO: 946193 - RNA, 22 nt, Human
gggaggaggaauguuuugugua

SEQ ID NO: 946194 - RNA, 22 nt, Human
uuaaugcagaaaucaaacugac

SEQ ID NO: 946195 - RNA, 22 nt, Human
uccuuggcagcagggagcauga

SEQ ID NO: 946196 - RNA, 22 nt, Human
ccugggagaacugcuggguugg

SEQ ID NO: 946197 - RNA, 22 nt, Human
cagagagaggccacugcuauua

SEQ ID NO: 946198 - RNA, 22 nt, Human
aagccuuccugagugcaaggcc

SEQ ID NO: 946199 - RNA, 22 nt, Human
agugcugaagacuggcuaggga

SEQ ID NO: 946200 - RNA, 18 nt, Human
aggccagcccugcuacug

SEQ ID NO: 946201 - RNA, 22 nt, Human
agccccaguccgcugcgggcgg

SEQ ID NO: 946202 - RNA, 22 nt, Human
uuugagauggagucuugcucug

SEQ ID NO: 946203 - RNA, 22 nt, Human
ugccugucuucaggagugucac

SEQ ID NO: 946204 - RNA, 22 nt, Human
ucugccucgcuaacagcagcca

SEQ ID NO: 946205 - RNA, 22 nt, Human
ugaggggagcccgcccuggacg

SEQ ID NO: 946206 - RNA, 22 nt, Human
agcugauuccacuuuuucccca

SEQ ID NO: 946207 - RNA, 22 nt, Human
gcccugucccuuggcuucuagg

SEQ ID NO: 946208 - RNA, 22 nt, Human
agucucagcuacuugggaggcu

SEQ ID NO: 946209 - RNA, 22 nt, Human
uacuaugugaaaauacuauagu

SEQ ID NO: 946210 - RNA, 22 nt, Human
uaucuguugucuuuuacaugua

SEQ ID NO: 946211 - RNA, 22 nt, Human
auaucaguaucuauguauuugu

SEQ ID NO: 946212 - RNA, 22 nt, Human
uggcaggagguuuucuccagga

SEQ ID NO: 946213 - RNA, 20 nt, Human
cuguggaauuuuaccaugcg

SEQ ID NO: 946214 - RNA, 22 nt, Human
ccuguucacccuccaugcacag

SEQ ID NO: 946215 - RNA, 22 nt, Human
agugugcugcuuaaacaguugu

SEQ ID NO: 946216 - RNA, 22 nt, Human
ucagggcaagauugguuaauaa

SEQ ID NO: 946217 - RNA, 22 nt, Human
acagccuguguaccagcuggga

SEQ ID NO: 946218 - RNA, 22 nt, Human
uuucaaagaccauuaacuauca

SEQ ID NO: 946219 - RNA, 22 nt, Human
agagccugggaauuugcauguu

SEQ ID NO: 946220 - RNA, 22 nt, Human
aaggcacugcuuugcugcgccc

SEQ ID NO: 946221 - RNA, 22 nt, Human
aagauuucugcuccugagagaa

SEQ ID NO: 946222 - RNA, 22 nt, Human
agggcugcaggcaagauauggc

SEQ ID NO: 946223 - RNA, 22 nt, Human
ucaggagacuggcagugcccac

SEQ ID NO: 946224 - RNA, 22 nt, Human
agaaaucauucccaaacccaua

SEQ ID NO: 946225 - RNA, 22 nt, Human
auugaggcagcauaguucaggg

SEQ ID NO: 946226 - RNA, 22 nt, Human
agugauggugagugagaagcuc

SEQ ID NO: 946227 - RNA, 21 nt, Human
aggcuguccuuugccagcccu

SEQ ID NO: 946228 - RNA, 22 nt, Human
accaaggaguuugguauuuuag

SEQ ID NO: 946229 - RNA, 22 nt, Human
ucacucuggccucugcagcagu

SEQ ID NO: 946230 - RNA, 22 nt, Human
agggcagagcacugaauuggga

SEQ ID NO: 946231 - RNA, 22 nt, Human
agcccaggcagagggaugcuug

SEQ ID NO: 946232 - RNA, 22 nt, Human
cugggagauugaggccauggug

SEQ ID NO: 946233 - RNA, 22 nt, Human
gcugucuucacuuccugguuuc

SEQ ID NO: 946234 - RNA, 22 nt, Human
agagugggugaucucuguuguc

SEQ ID NO: 946235 - RNA, 19 nt, Human
gcugugccucucuccugcu

SEQ ID NO: 946236 - RNA, 18 nt, Human
ucaggagacacagacgca

SEQ ID NO: 946237 - RNA, 22 nt, Human
agcagcauguugggaugugaaa

SEQ ID NO: 946238 - RNA, 22 nt, Human
augaguucaauuguuucaguca

SEQ ID NO: 946239 - RNA, 20 nt, Human
acaaaugcauucugugacau

SEQ ID NO: 946240 - RNA, 22 nt, Human
gaaugcacucacccaucacuca

SEQ ID NO: 946241 - RNA, 22 nt, Human
uggcucagccauucguguugcc

SEQ ID NO: 946242 - RNA, 22 nt, Human
uacugcauaacuggcauguggg

SEQ ID NO: 946243 - RNA, 22 nt, Human
ucuggagcuuguuucagauggu

SEQ ID NO: 946244 - RNA, 22 nt, Human
acauuuuuauucaucaaagcag

SEQ ID NO: 946245 - RNA, 21 nt, Human
uaucuacuggugucuuucaga

SEQ ID NO: 946246 - RNA, 20 nt, Human
gccuggcacccggggcuggc

SEQ ID NO: 946247 - RNA, 22 nt, Human
uggugcugauaauggcaggauu

SEQ ID NO: 946248 - RNA, 22 nt, Human
agggugcauguuugcaagagug

SEQ ID NO: 946249 - RNA, 22 nt, Human
gcaggugggggucggugcaucu

SEQ ID NO: 946250 - RNA, 22 nt, Human
caaggccacuccagagacuggu

SEQ ID NO: 946251 - RNA, 22 nt, Human
uuucacaacacaaucucguuaa

SEQ ID NO: 946252 - RNA, 22 nt, Human
uggcucaguuuagcagcucagu

SEQ ID NO: 946253 - RNA, 22 nt, Human
gcagggaagaucuuggagcugc

SEQ ID NO: 946254 - RNA, 22 nt, Human
uaaaguauauuuuuucucaaua

SEQ ID NO: 946255 - RNA, 20 nt, Human
caguccaaucagaggccacc

SEQ ID NO: 946256 - RNA, 22 nt, Human
aauguucaacagauggauauuu

SEQ ID NO: 946257 - RNA, 22 nt, Human
uggagcugagaaguggagcucu

SEQ ID NO: 946258 - RNA, 22 nt, Human
cugggaguguucuaggucacau

SEQ ID NO: 946259 - RNA, 22 nt, Human
ggagaggagcuauugggggcuc

SEQ ID NO: 946260 - RNA, 22 nt, Human
ggaggccuagccagcuccaguu

SEQ ID NO: 946261 - RNA, 22 nt, Human
aaacauuguuaugauaaauuac

SEQ ID NO: 946262 - RNA, 21 nt, Human
cugugcuucuuccuaagccag

SEQ ID NO: 946263 - RNA, 22 nt, Human
aaguuacuggcaagggcugcag

SEQ ID NO: 946264 - RNA, 22 nt, Human
ucauugcaccccagucccagcu

SEQ ID NO: 946265 - RNA, 22 nt, Human
ugcugguggagaaaguggaggu

SEQ ID NO: 946266 - RNA, 22 nt, Human
gucuggccugccagcucuggug

SEQ ID NO: 946267 - RNA, 22 nt, Human
gaggcacugagagugggggaug

SEQ ID NO: 946268 - RNA, 22 nt, Human
ucucaggguuuccugggggcug

SEQ ID NO: 946269 - RNA, 22 nt, Human
gguggcagcgucuaucugacau

SEQ ID NO: 946270 - RNA, 22 nt, Human
gcaggagcagucaggggcagcu

SEQ ID NO: 946271 - RNA, 22 nt, Human
agccagcuguacugccugcuca

SEQ ID NO: 946272 - RNA, 22 nt, Human
aaggcaguuugggccaccaucu

SEQ ID NO: 946273 - RNA, 22 nt, Human
cuaauuuuuguucugcauugaa

SEQ ID NO: 946274 - RNA, 22 nt, Human
gcccaggaggucaaguagcuau

SEQ ID NO: 946275 - RNA, 22 nt, Human
ggcagcucacgggcauggggug

SEQ ID NO: 946276 - RNA, 22 nt, Human
cuggcuuucucugugguguuca

SEQ ID NO: 946277 - RNA, 22 nt, Human
ucacaugcuugaggaaagaaaa

SEQ ID NO: 946278 - RNA, 22 nt, Human
ggagggacccacucuagaggug

SEQ ID NO: 946279 - RNA, 22 nt, Human
ggaggcgauccugggaaacacc

SEQ ID NO: 946280 - RNA, 22 nt, Human
augcugagugagugaaacccag

SEQ ID NO: 946281 - RNA, 22 nt, Human
ccugccaggccagugagcuucc

SEQ ID NO: 946282 - RNA, 22 nt, Human
cacugaagguaggaccaaggcu

SEQ ID NO: 946283 - RNA, 22 nt, Human
guaaaauagaauaacguggcua

SEQ ID NO: 946284 - RNA, 19 nt, Human
ccugucugucuucagcuag

SEQ ID NO: 946285 - RNA, 22 nt, Human
ggugaaggucuacugugugcca

SEQ ID NO: 946286 - RNA, 22 nt, Human
cccaggagagaggccaguuggc

SEQ ID NO: 946287 - RNA, 22 nt, Human
agccuucaguaaauccacugug

SEQ ID NO: 946288 - RNA, 22 nt, Human
gaggcuguuagggccugaggua

SEQ ID NO: 946289 - RNA, 22 nt, Human
gcuccuggagagauugagaaag

SEQ ID NO: 946290 - RNA, 22 nt, Human
ccagcagagcauggggaggaag

SEQ ID NO: 946291 - RNA, 22 nt, Human
ccugccugcguccucugagggc

SEQ ID NO: 946292 - RNA, 22 nt, Human
caaggccaguccauuuuggaag

SEQ ID NO: 946293 - RNA, 22 nt, Human
aagagcuggaugaagaaaucaa

SEQ ID NO: 946294 - RNA, 22 nt, Human
gggcugggaauggcuaaguaug

SEQ ID NO: 946295 - RNA, 22 nt, Human
uggcagcuggagggcaauggcc

SEQ ID NO: 946296 - RNA, 22 nt, Human
uuuauuccaugugucuaugacc

SEQ ID NO: 946297 - RNA, 22 nt, Human
guuugcauguguacuuaauugg

SEQ ID NO: 946298 - RNA, 22 nt, Human
aguggcagagccaaguagagcc

SEQ ID NO: 946299 - RNA, 22 nt, Human
auuguacuuuuauuacauguag

SEQ ID NO: 946300 - RNA, 22 nt, Human
uuuggaauuggaaagugcugug

SEQ ID NO: 946301 - RNA, 22 nt, Human
ggcagcuuccugagccagcagc

SEQ ID NO: 946302 - RNA, 22 nt, Human
ggagccugcgggagcucccauu

SEQ ID NO: 946303 - RNA, 18 nt, Human
aaauguacuguccauggc

SEQ ID NO: 946304 - RNA, 22 nt, Human
aaaagcagaucuccaaagucua

SEQ ID NO: 946305 - RNA, 22 nt, Human
gcagaagcugggcagcgaggug

SEQ ID NO: 946306 - RNA, 22 nt, Human
acuuucuauggcuuauuaugag

SEQ ID NO: 946307 - RNA, 20 nt, Human
ccuccuggucaggugugcag

SEQ ID NO: 946308 - RNA, 17 nt, Human
ugaggccugcaucagug

SEQ ID NO: 946309 - RNA, 22 nt, Human
acagaguauuggaaaggcagug

SEQ ID NO: 946310 - RNA, 22 nt, Human
uuggccaauuccagaggaucau

SEQ ID NO: 946311 - RNA, 22 nt, Human
ugggauggcauccugggccuug

SEQ ID NO: 946312 - RNA, 22 nt, Human
guuucuuaaauguagcaggacc

SEQ ID NO: 946313 - RNA, 22 nt, Human
gccuucugaucgcuggacugac

SEQ ID NO: 946314 - RNA, 22 nt, Human
cagaaguaagauuacugugagu

SEQ ID NO: 946315 - RNA, 22 nt, Human
agccaagcaccacuggcacucg

SEQ ID NO: 946316 - RNA, 19 nt, Human
gcugcuggcucuggcugga

SEQ ID NO: 946317 - RNA, 22 nt, Human
gagggcugauaacaggaauaca

SEQ ID NO: 946318 - RNA, 22 nt, Human
cugcccugucugcagccuggcu

SEQ ID NO: 946319 - RNA, 18 nt, Human
acauuucucucugcguga

SEQ ID NO: 946320 - RNA, 22 nt, Human
ucagggcacauucugcaguggc

SEQ ID NO: 946321 - RNA, 22 nt, Human
acauuucuugaugccucuguga

SEQ ID NO: 946322 - RNA, 22 nt, Human
gccugcuggauguggccaggcc

SEQ ID NO: 946323 - RNA, 22 nt, Human
uaggaucucaccauagaaggaa

SEQ ID NO: 946324 - RNA, 22 nt, Human
gagcuuccauggacgccaucug

SEQ ID NO: 946325 - RNA, 22 nt, Human
uggcucaguuucaguccugguu

SEQ ID NO: 946326 - RNA, 22 nt, Human
uggcucagaggggaagugguuu

SEQ ID NO: 946327 - RNA, 22 nt, Human
gaagagcugugauucaggcuua

SEQ ID NO: 946328 - RNA, 22 nt, Human
ugagccagucugucugggugaa

SEQ ID NO: 946329 - RNA, 22 nt, Human
cgcugggcgccgaccugcuggc

SEQ ID NO: 946330 - RNA, 18 nt, Human
uggagcaggaagccuggc

SEQ ID NO: 946331 - RNA, 22 nt, Human
aggauguuaucugugcaggugg

SEQ ID NO: 946332 - RNA, 22 nt, Human
caucaaauggcaagugaaagcu

SEQ ID NO: 946333 - RNA, 22 nt, Human
gugaaaauaaggcugguucuug

SEQ ID NO: 946334 - RNA, 22 nt, Human
gucuggagccacccuaagcauu

SEQ ID NO: 946335 - RNA, 22 nt, Human
ugggcagauuaaugcaguggcu

SEQ ID NO: 946336 - RNA, 21 nt, Human
uggcucuggguaggagagugc

SEQ ID NO: 946337 - RNA, 22 nt, Human
uuuacuuugugucaagucaaga

SEQ ID NO: 946338 - RNA, 22 nt, Human
cauugcugugggcauuugcugc

SEQ ID NO: 946339 - RNA, 22 nt, Human
ccagcagccaccuucucgaaau

SEQ ID NO: 946340 - RNA, 22 nt, Human
agccucucuuucugguggcuaa

SEQ ID NO: 946341 - RNA, 22 nt, Human
gccugccuucggugcgcagcgg

SEQ ID NO: 946342 - RNA, 22 nt, Human
gcugagcugggacaguccuggg

SEQ ID NO: 946343 - RNA, 22 nt, Human
gaggagagggcugcgggcccac

SEQ ID NO: 946344 - RNA, 15 nt, Human
ugggcagaucacuug

SEQ ID NO: 946345 - RNA, 22 nt, Human
agaugcugucacacacacuguu

SEQ ID NO: 946346 - RNA, 22 nt, Human
caaggccagagccagcgauaag

SEQ ID NO: 946347 - RNA, 22 nt, Human
agcagcucacaggauuccugaa

SEQ ID NO: 946348 - RNA, 18 nt, Human
augcuuugcuuacguuau

SEQ ID NO: 946349 - RNA, 22 nt, Human
agggcucugggguggcagagau

SEQ ID NO: 946350 - RNA, 22 nt, Human
cugagcauggccgguccauggu

SEQ ID NO: 946351 - RNA, 22 nt, Human
ggcucaggaugagccuucucau

SEQ ID NO: 946352 - RNA, 22 nt, Human
agggcugcaccggggcuucgcg

SEQ ID NO: 946353 - RNA, 22 nt, Human
ucaacagaagugauagcuauua

SEQ ID NO: 946354 - RNA, 22 nt, Human
caguuaaaggcccaauaucugg

SEQ ID NO: 946355 - RNA, 22 nt, Human
ugccucagagugggcuugcuau

SEQ ID NO: 946356 - RNA, 22 nt, Human
auugcacaaacacagucagacu

SEQ ID NO: 946357 - RNA, 23 nt, Human
uuucaacaaugcuuagagaaaac

SEQ ID NO: 946358 - RNA, 22 nt, Human
uaaguucauuagacuacagaua

SEQ ID NO: 946359 - RNA, 22 nt, Human
gccucacugcagccccaggaag

SEQ ID NO: 946360 - RNA, 22 nt, Human
gagggggagaugugcacacacu

SEQ ID NO: 946361 - RNA, 22 nt, Human
uccugcagaccucagucagguc

SEQ ID NO: 946362 - RNA, 22 nt, Human
aggagagucuugagucacuggu

SEQ ID NO: 946363 - RNA, 22 nt, Human
ucacaucucccuggaggacaca

SEQ ID NO: 946364 - RNA, 18 nt, Human
ucugggcuucccgaggcu

SEQ ID NO: 946365 - RNA, 22 nt, Human
gagggcaguagccucguacccu

SEQ ID NO: 946366 - RNA, 22 nt, Human
ucucaggaagugauauugagac

SEQ ID NO: 946367 - RNA, 22 nt, Human
uguauguaaaguuuguaauaga

SEQ ID NO: 946368 - RNA, 22 nt, Human
gaggcccucuugccacaaugaa

SEQ ID NO: 946369 - RNA, 19 nt, Human
cagcaauaaugccagaugg

SEQ ID NO: 946370 - RNA, 22 nt, Human
uaggcacugggcuaggacaggu

SEQ ID NO: 946371 - RNA, 22 nt, Human
uccaguucuaggucacucucug

SEQ ID NO: 946372 - RNA, 22 nt, Human
agcuggcagcucucagggguac

SEQ ID NO: 946373 - RNA, 22 nt, Human
guaauguguuuugaaaaacagu

SEQ ID NO: 946374 - RNA, 22 nt, Human
aggugauguccacagcuugcag

SEQ ID NO: 946375 - RNA, 22 nt, Human
uggaggaugccuggggaggccu

SEQ ID NO: 946376 - RNA, 22 nt, Human
uuggaaagcaagcuggacauac

SEQ ID NO: 946377 - RNA, 22 nt, Human
uccaggaggcaccuuuggacca

SEQ ID NO: 946378 - RNA, 22 nt, Human
agcuggccuucggugucacugg

SEQ ID NO: 946379 - RNA, 22 nt, Human
gggcuggcaucgguugcugaga

SEQ ID NO: 946380 - RNA, 22 nt, Human
gggcacagagggucuugaagaa

SEQ ID NO: 946381 - RNA, 22 nt, Human
cauuucugauuacagaauacua

SEQ ID NO: 946382 - RNA, 22 nt, Human
ugggacaggaugaccagaaggu

SEQ ID NO: 946383 - RNA, 21 nt, Human
agcuggcagauauggugucug

SEQ ID NO: 946384 - RNA, 22 nt, Human
caggagcuacucagguuggguu

SEQ ID NO: 946385 - RNA, 22 nt, Human
gucaccagugcuaagaggugga

SEQ ID NO: 946386 - RNA, 22 nt, Human
gacucguucauaguuccaauuu

SEQ ID NO: 946387 - RNA, 22 nt, Human
acagcuggaggccccauugucc

SEQ ID NO: 946388 - RNA, 18 nt, Human
ucagagguacagaaaagu

SEQ ID NO: 946389 - RNA, 22 nt, Human
gcccaggaaauaaaagugggcu

SEQ ID NO: 946390 - RNA, 22 nt, Human
ccuucuuaaacaucauuuuggc

SEQ ID NO: 946391 - RNA, 22 nt, Human
cacugaaggcugcagcucagcc

SEQ ID NO: 946392 - RNA, 22 nt, Human
aucugccugagucuagguuuuc

SEQ ID NO: 946393 - RNA, 20 nt, Human
ugcuguaagauuagagagcu

SEQ ID NO: 946394 - RNA, 22 nt, Human
cagcucccgccaucgggaggca

SEQ ID NO: 946395 - RNA, 22 nt, Human
aaacccaucugucugucugcag

SEQ ID NO: 946396 - RNA, 22 nt, Human
uauuuaauuugcucauugugau

SEQ ID NO: 946397 - RNA, 22 nt, Human
uccacugcagcuucugauggaa

SEQ ID NO: 946398 - RNA, 22 nt, Human
ccugggucuugguucaugcucu

SEQ ID NO: 946399 - RNA, 18 nt, Human
uuccaugauuccuuucac

SEQ ID NO: 946400 - RNA, 22 nt, Human
augugucuuugagacucugcua

SEQ ID NO: 946401 - RNA, 22 nt, Human
ugaagcaggaaccagcagcauu

SEQ ID NO: 946402 - RNA, 22 nt, Human
aaguucaagaucaagguuccag

SEQ ID NO: 946403 - RNA, 22 nt, Human
uugauuucuauucagauguaga

SEQ ID NO: 946404 - RNA, 22 nt, Human
ccaaggaggccccaggucagcu

SEQ ID NO: 946405 - RNA, 22 nt, Human
gaaguucaggugggaauugagc

SEQ ID NO: 946406 - RNA, 21 nt, Human
ccaggguccagcugccauggu

SEQ ID NO: 946407 - RNA, 22 nt, Human
gacacauagaucuaucucacuc

SEQ ID NO: 946408 - RNA, 22 nt, Human
aaggcagcuucaccacagcauu

SEQ ID NO: 946409 - RNA, 18 nt, Human
aggagccuuugcacugga

SEQ ID NO: 946410 - RNA, 22 nt, Human
cuggagcucuguguguuccuga

SEQ ID NO: 946411 - RNA, 22 nt, Human
aaaaaguuucaacugccaacuc

SEQ ID NO: 946412 - RNA, 21 nt, Human
cagcuccacuaaagcagcugu

SEQ ID NO: 946413 - RNA, 22 nt, Human
caggguggaauggaaugcuggc

SEQ ID NO: 946414 - RNA, 22 nt, Human
cucuguagaaacagggcagaag

SEQ ID NO: 946415 - RNA, 22 nt, Human
uccuguaguugcuaaguuuguu

SEQ ID NO: 946416 - RNA, 22 nt, Human
ucauccuuuugcaugggaaggc

SEQ ID NO: 946417 - RNA, 21 nt, Human
ucucuggaauuagaccauguu

SEQ ID NO: 946418 - RNA, 22 nt, Human
uaauuucuagggacuaaggugc

SEQ ID NO: 946419 - RNA, 22 nt, Human
accagagcuggcagaguaucaa

SEQ ID NO: 946420 - RNA, 22 nt, Human
ucuggcaggucaaucauucuuu

SEQ ID NO: 946421 - RNA, 22 nt, Human
ccuaagaauuaaugaauacacc

SEQ ID NO: 946422 - RNA, 22 nt, Human
uucuggaggccccuuccuucuc

SEQ ID NO: 946423 - RNA, 22 nt, Human
uaugaaauuuaaacacagauca

SEQ ID NO: 946424 - RNA, 22 nt, Human
gucucccaaccccugugcccag

SEQ ID NO: 946425 - RNA, 22 nt, Human
auuucagaugaccaaauggaaa

SEQ ID NO: 946426 - RNA, 19 nt, Human
gagcgcagagggcagggga

SEQ ID NO: 946427 - RNA, 22 nt, Human
gcaccacaucaaugaggggagc

SEQ ID NO: 946428 - RNA, 22 nt, Human
auuuucuauucugcugguuuag

SEQ ID NO: 946429 - RNA, 21 nt, Human
agggcagauuagcuguaagag

SEQ ID NO: 946430 - RNA, 22 nt, Human
agauuucaaugugagcauuagu

SEQ ID NO: 946431 - RNA, 22 nt, Human
ucuguagcaagugagaggcauu

SEQ ID NO: 946432 - RNA, 22 nt, Human
aaacauugcuaaauaaugcugc

SEQ ID NO: 946433 - RNA, 22 nt, Human
cuggccuuggaagggagcccgu

SEQ ID NO: 946434 - RNA, 22 nt, Human
gcagugaaacaauaggaucaaa

SEQ ID NO: 946435 - RNA, 22 nt, Human
ucaggaaagaagaugcucagug

SEQ ID NO: 946436 - RNA, 22 nt, Human
gauaccagacagggagggagaa

SEQ ID NO: 946437 - RNA, 22 nt, Human
gggcuggcgggaaaggcaauuc

SEQ ID NO: 946438 - RNA, 22 nt, Human
ugggcucauggcccagcacugg

SEQ ID NO: 946439 - RNA, 22 nt, Human
ugaagcaggugaauggaugucg

SEQ ID NO: 946440 - RNA, 22 nt, Human
cugucauuuaagacauucugga

SEQ ID NO: 946441 - RNA, 22 nt, Human
ggcaggugcaccugagccaucu

SEQ ID NO: 946442 - RNA, 22 nt, Human
uggcugggugcuauccaguacu

SEQ ID NO: 946443 - RNA, 22 nt, Human
uaauaggagccaggucacauag

SEQ ID NO: 946444 - RNA, 22 nt, Human
gccaugccugugucuccaggcc

SEQ ID NO: 946445 - RNA, 22 nt, Human
uggcuuccgccgcgggccucgg

SEQ ID NO: 946446 - RNA, 22 nt, Human
agauguuuucuaauucuauauu

SEQ ID NO: 946447 - RNA, 22 nt, Human
uuuaaagaaauuccucaucuuu

SEQ ID NO: 946448 - RNA, 22 nt, Human
uguagcauguaaauugguuauu

SEQ ID NO: 946449 - RNA, 22 nt, Human
uccaggagucuagccucaggcc

SEQ ID NO: 946450 - RNA, 23 nt, Human
agggaaaguaguaauggccuuug

SEQ ID NO: 946451 - RNA, 22 nt, Human
ucaaauguucccuguacuggcc

SEQ ID NO: 946452 - RNA, 22 nt, Human
uaggcacugguuguggauaguu

SEQ ID NO: 946453 - RNA, 22 nt, Human
cuguggugagcaacugacugaa

SEQ ID NO: 946454 - RNA, 23 nt, Human
agggguggucaguacccgcagug

SEQ ID NO: 946455 - RNA, 22 nt, Human
aggcccugagaaaaucccugca

SEQ ID NO: 946456 - RNA, 22 nt, Human
uggaagagggagcuggguggcc

SEQ ID NO: 946457 - RNA, 22 nt, Human
agcagggccucuggcacugguc

SEQ ID NO: 946458 - RNA, 22 nt, Human
agacaugagaaacccaccagag

SEQ ID NO: 946459 - RNA, 22 nt, Human
aauaaaaugaacugguagaguu

SEQ ID NO: 946460 - RNA, 22 nt, Human
aggcacagagaaugcccuccau

SEQ ID NO: 946461 - RNA, 22 nt, Human
gggcugcugccaccagguggau

SEQ ID NO: 946462 - RNA, 22 nt, Human
aaguaaaagcuuuaccaugcgc

SEQ ID NO: 946463 - RNA, 22 nt, Human
ucugguaaccuuuaucccuccu

SEQ ID NO: 946464 - RNA, 17 nt, Human
uaugcuuuucuucucca

SEQ ID NO: 946465 - RNA, 22 nt, Human
gcuggcagagacaagaagacua

SEQ ID NO: 946466 - RNA, 18 nt, Human
agcagcugugccacacug

SEQ ID NO: 946467 - RNA, 22 nt, Human
ccagcccuucccaacuggccag

SEQ ID NO: 946468 - RNA, 22 nt, Human
uggcuggcaguaggcuaguggc

SEQ ID NO: 946469 - RNA, 22 nt, Human
uaucuaaauggaauauuccaga

SEQ ID NO: 946470 - RNA, 22 nt, Human
caaagugcuggaauuacaggug

SEQ ID NO: 946471 - RNA, 22 nt, Human
gaguaagagcuggcuuuggugu

SEQ ID NO: 946472 - RNA, 22 nt, Human
agacagguaaauagagaugcug

SEQ ID NO: 946473 - RNA, 22 nt, Human
ccacagcaugcaggccugacac

SEQ ID NO: 946474 - RNA, 22 nt, Human
uugauacauuuuuaggauaaac

SEQ ID NO: 946475 - RNA, 22 nt, Human
uucucagagcucacuguaguaa

SEQ ID NO: 946476 - RNA, 22 nt, Human
ggggauggaauguaguagugau

SEQ ID NO: 946477 - RNA, 22 nt, Human
aagggcaggcagagaucauaua

SEQ ID NO: 946478 - RNA, 22 nt, Human
aaagccagagcaagcugucaca

SEQ ID NO: 946479 - RNA, 22 nt, Human
ggcagcucugcuccacaugagu

SEQ ID NO: 946480 - RNA, 22 nt, Human
gcucaaggcaggcagacaugag

SEQ ID NO: 946481 - RNA, 22 nt, Human
uggcuggcaaggcuggagucag

SEQ ID NO: 946482 - RNA, 22 nt, Human
uguuucuaggucaauaauuuuu

SEQ ID NO: 946483 - RNA, 22 nt, Human
uuggcagcagggaguuggccgc

SEQ ID NO: 946484 - RNA, 22 nt, Human
auucuuaauugccaugcuguau

SEQ ID NO: 946485 - RNA, 22 nt, Human
ugaagcagcaaaugaugggaga

SEQ ID NO: 946486 - RNA, 22 nt, Human
cagcauggggaucacuguaggc

SEQ ID NO: 946487 - RNA, 22 nt, Human
uauguguuugacacccugcaag

SEQ ID NO: 946488 - RNA, 23 nt, Human
uugcauguagcccaugaguaacu

SEQ ID NO: 946489 - RNA, 20 nt, Human
uccaggagguuaguguggcu

SEQ ID NO: 946490 - RNA, 20 nt, Human
ucugccacugcacucugccc

SEQ ID NO: 946491 - RNA, 22 nt, Human
agucauaugacccuucacaaac

SEQ ID NO: 946492 - RNA, 22 nt, Human
auugaaucugcacuaguauuuu

SEQ ID NO: 946493 - RNA, 22 nt, Human
agcugcugagccaggcugaugu

SEQ ID NO: 946494 - RNA, 22 nt, Human
caagagcugcaaauagcgugac

SEQ ID NO: 946495 - RNA, 23 nt, Human
gccugggacucaggaggagcuca

SEQ ID NO: 946496 - RNA, 22 nt, Human
aaaaguguccagauuaugaaga

SEQ ID NO: 946497 - RNA, 22 nt, Human
aaagcaguauauugguaguugu

SEQ ID NO: 946498 - RNA, 22 nt, Human
uccaaacacccuccaugcugca

SEQ ID NO: 946499 - RNA, 22 nt, Human
ucuucagacccuuagcugugau

SEQ ID NO: 946500 - RNA, 22 nt, Human
ucucagggaccaugaugaugac

SEQ ID NO: 946501 - RNA, 22 nt, Human
gcugcucuccauggccgugagu

SEQ ID NO: 946502 - RNA, 20 nt, Human
agcuggccuguccuaggccu

SEQ ID NO: 946503 - RNA, 22 nt, Human
cagcuccugaggacugcuggga

SEQ ID NO: 946504 - RNA, 20 nt, Human
ccugccugccucggcucauu

SEQ ID NO: 946505 - RNA, 22 nt, Human
uucucagauauuuacugagcau

SEQ ID NO: 946506 - RNA, 22 nt, Human
aaugauguuuuuaaagaacaua

SEQ ID NO: 946507 - RNA, 21 nt, Human
acugggagaacgagccuuucc

SEQ ID NO: 946508 - RNA, 22 nt, Human
agaauucuccuucagggcagga

SEQ ID NO: 946509 - RNA, 22 nt, Human
caguggagagacuuuuacucuu

SEQ ID NO: 946510 - RNA, 22 nt, Human
ugucucuggcccaugagcagag

SEQ ID NO: 946511 - RNA, 22 nt, Human
cuaaucaucuuucucuuaaagc

SEQ ID NO: 946512 - RNA, 22 nt, Human
uacuuccuguuuccaugucugu

SEQ ID NO: 946513 - RNA, 22 nt, Human
ggugccagccuagugcaguggu

SEQ ID NO: 946514 - RNA, 22 nt, Human
gaggugaguggaucacgagguc

SEQ ID NO: 946515 - RNA, 22 nt, Human
uccuucagcucucuauuuagau

SEQ ID NO: 946516 - RNA, 19 nt, Human
ccagcagacacagcugccc

SEQ ID NO: 946517 - RNA, 21 nt, Human
cugagggccgcagcugggcuc

SEQ ID NO: 946518 - RNA, 22 nt, Human
ccucugggugggaggccgggcg

SEQ ID NO: 946519 - RNA, 22 nt, Human
gcugugcagguccccacugccu

SEQ ID NO: 946520 - RNA, 22 nt, Human
aagggcagcuuaaauugguagc

SEQ ID NO: 946521 - RNA, 22 nt, Human
ugggacagggaaucugaucccc

SEQ ID NO: 946522 - RNA, 22 nt, Human
acuguguguuugucuagcacag

SEQ ID NO: 946523 - RNA, 22 nt, Human
cuggccuuuuguuucuggagaa

SEQ ID NO: 946524 - RNA, 22 nt, Human
uuuucauuuuuguagaugcaag

SEQ ID NO: 946525 - RNA, 22 nt, Human
aggcuggcgucaggggcuguac

SEQ ID NO: 946526 - RNA, 22 nt, Human
aagugccaucauagcauggcug

SEQ ID NO: 946527 - RNA, 22 nt, Human
acagggcaugugcaagagacau

SEQ ID NO: 946528 - RNA, 22 nt, Human
cauuuuaaaugauuuaagccaa

SEQ ID NO: 946529 - RNA, 19 nt, Human
caguggccuggaggucucu

SEQ ID NO: 946530 - RNA, 22 nt, Human
agacagggucuugaucagagcu

SEQ ID NO: 946531 - RNA, 22 nt, Human
aggccagaaauuuggaguaugu

SEQ ID NO: 946532 - RNA, 22 nt, Human
ucaccgccuugcccggccgggc

SEQ ID NO: 946533 - RNA, 22 nt, Human
uaugugcaaaaugcuagacuag

SEQ ID NO: 946534 - RNA, 22 nt, Human
aggcagacucaauggcuagaua

SEQ ID NO: 946535 - RNA, 22 nt, Human
gcucucuguuauuaagaucuuu

SEQ ID NO: 946536 - RNA, 22 nt, Human
augcuauacucaaagaaauuca

SEQ ID NO: 946537 - RNA, 22 nt, Human
uccagccuuucuacucacugag

SEQ ID NO: 946538 - RNA, 17 nt, Human
gcugcagcgguaggcag

SEQ ID NO: 946539 - RNA, 22 nt, Human
aaugcuguauaucuuagcuaau

SEQ ID NO: 946540 - RNA, 22 nt, Human
agauuuccaucuuuuucaugug

SEQ ID NO: 946541 - RNA, 22 nt, Human
cagaggccccagaacuagcucu

SEQ ID NO: 946542 - RNA, 22 nt, Human
ucuucagauaaagggagaguau

SEQ ID NO: 946543 - RNA, 22 nt, Human
gaggggagacagggaaaucagu

SEQ ID NO: 946544 - RNA, 22 nt, Human
auugugcaaauauuaucuguag

SEQ ID NO: 946545 - RNA, 22 nt, Human
ugcagccaauucauucauucuu

SEQ ID NO: 946546 - RNA, 22 nt, Human
gagaggccaccugacgagcagu

SEQ ID NO: 946547 - RNA, 22 nt, Human
uccuugaauccuagcauccuau

SEQ ID NO: 946548 - RNA, 22 nt, Human
gcauggcauuaacaagauggaa

SEQ ID NO: 946549 - RNA, 22 nt, Human
agcugccacaugcccaagggca

SEQ ID NO: 946550 - RNA, 22 nt, Human
ugccagggugucaggagagcua

SEQ ID NO: 946551 - RNA, 22 nt, Human
uucuccuuuguaauucucaucc

SEQ ID NO: 946552 - RNA, 18 nt, Human
uggguggcuagggaguuu

SEQ ID NO: 946553 - RNA, 19 nt, Human
uggcucugucgaaggcaca

SEQ ID NO: 946554 - RNA, 22 nt, Human
acagagcauauaaagugcuuug

SEQ ID NO: 946555 - RNA, 22 nt, Human
augacagaggagugcaggugau

SEQ ID NO: 946556 - RNA, 22 nt, Human
ccaggccuggccaggggaugcc

SEQ ID NO: 946557 - RNA, 22 nt, Human
ucacucuguggcccaggcagug

SEQ ID NO: 946558 - RNA, 22 nt, Human
cugcaucaguggauaugauggu

SEQ ID NO: 946559 - RNA, 22 nt, Human
uucucuucuguucagugcccaa

SEQ ID NO: 946560 - RNA, 22 nt, Human
gccuuccugcagcucugagcgu

SEQ ID NO: 946561 - RNA, 22 nt, Human
ucauuuuucacacagggucacc

SEQ ID NO: 946562 - RNA, 19 nt, Human
uggcaggcccaggauggac

SEQ ID NO: 946563 - RNA, 22 nt, Human
cagggccagcgcccaggcccag

SEQ ID NO: 946564 - RNA, 22 nt, Human
cugagaggaacaucuuaugcuu

SEQ ID NO: 946565 - RNA, 22 nt, Human
acauugcugcauucuccuuccc

SEQ ID NO: 946566 - RNA, 19 nt, Human
agauggggaagagugugag

SEQ ID NO: 946567 - RNA, 22 nt, Human
ggaggggaugguuugacccugg

SEQ ID NO: 946568 - RNA, 22 nt, Human
auaaauuuauaauuguuuccug

SEQ ID NO: 946569 - RNA, 22 nt, Human
aaugucugccagaacugaucau

SEQ ID NO: 946570 - RNA, 22 nt, Human
uucuuacagcccuauuacuaaa

SEQ ID NO: 946571 - RNA, 22 nt, Human
auuuagaacuuuguuugccaau

SEQ ID NO: 946572 - RNA, 22 nt, Human
agucccagacuccaguuuucug

SEQ ID NO: 946573 - RNA, 22 nt, Human
ccugccugauuccaggauggcu

SEQ ID NO: 946574 - RNA, 22 nt, Human
uucucuaagcuggcugaggucu

SEQ ID NO: 946575 - RNA, 22 nt, Human
uuucuagucucgaucucuuaau

SEQ ID NO: 946576 - RNA, 22 nt, Human
gcucugggaacugacugccuuc

SEQ ID NO: 946577 - RNA, 21 nt, Human
gcccagcaaggugagaaggcc

SEQ ID NO: 946578 - RNA, 22 nt, Human
aggccuguuccaggccccuuuu

SEQ ID NO: 946579 - RNA, 22 nt, Human
cuggcagguggauggggacucc

SEQ ID NO: 946580 - RNA, 22 nt, Human
gagagggagccagccaggaacc

SEQ ID NO: 946581 - RNA, 22 nt, Human
ccagcugagaaguguaaaguga

SEQ ID NO: 946582 - RNA, 22 nt, Human
cccaggaacagcacagaacagc

SEQ ID NO: 946583 - RNA, 22 nt, Human
cugcuguggugucaagcaucuc

SEQ ID NO: 946584 - RNA, 22 nt, Human
cugaagcacagcauauaaauaa

SEQ ID NO: 946585 - RNA, 22 nt, Human
uaccauuucauucuuuccucau

SEQ ID NO: 946586 - RNA, 22 nt, Human
agcugaaagugcuuugaggacu

SEQ ID NO: 946587 - RNA, 22 nt, Human
auggaagguccuacagagcgca

SEQ ID NO: 946588 - RNA, 22 nt, Human
caaggccagggaauuuuucugg

SEQ ID NO: 946589 - RNA, 22 nt, Human
uuuucauuguuacuaugagcua

SEQ ID NO: 946590 - RNA, 22 nt, Human
guggcugcuguccucucugguu

SEQ ID NO: 946591 - RNA, 22 nt, Human
agcccagggacagggcggaugu

SEQ ID NO: 946592 - RNA, 22 nt, Human
cccaggaaagagacugcugggu

SEQ ID NO: 946593 - RNA, 22 nt, Human
uugcucaggcuggugugcagug

SEQ ID NO: 946594 - RNA, 22 nt, Human
uugaaguuguaguucagugaag

SEQ ID NO: 946595 - RNA, 20 nt, Human
agguccugggacuggcagag

SEQ ID NO: 946596 - RNA, 22 nt, Human
cccccuggcaggcuggccucuc

SEQ ID NO: 946597 - RNA, 20 nt, Human
cgugcugugaccuugagcau

SEQ ID NO: 946598 - RNA, 22 nt, Human
ucugaggcccugcaggcagugu

SEQ ID NO: 946599 - RNA, 22 nt, Human
uguggcuuaagaaugccuuuaa

SEQ ID NO: 946600 - RNA, 22 nt, Human
ggagccaguauuuaguggucuu

SEQ ID NO: 946601 - RNA, 22 nt, Human
ugagccugcaauaagcacagcc

SEQ ID NO: 946602 - RNA, 22 nt, Human
uuuuucauugcagccucucucc

SEQ ID NO: 946603 - RNA, 22 nt, Human
guuaggauguggggacuuuggg

SEQ ID NO: 946604 - RNA, 22 nt, Human
ucaaaccaccuuguuacugggg

SEQ ID NO: 946605 - RNA, 22 nt, Human
augguacaaaauguauaaaguc

SEQ ID NO: 946606 - RNA, 22 nt, Human
uuuauuacaccagguuaacuca

SEQ ID NO: 946607 - RNA, 22 nt, Human
caguguacuuggaauguaacag

SEQ ID NO: 946608 - RNA, 22 nt, Human
gaccaggacacaguggcaaggu

SEQ ID NO: 946609 - RNA, 22 nt, Human
auaaaaaggacagauguggucu

SEQ ID NO: 946610 - RNA, 22 nt, Human
gggccaaggggagcuggaaggg

SEQ ID NO: 946611 - RNA, 22 nt, Human
cugugucuucacauuugugugc

SEQ ID NO: 946612 - RNA, 22 nt, Human
uuuaagacuuagauuuauuggg

SEQ ID NO: 946613 - RNA, 22 nt, Human
ggcucuggcguccaauggagcg

SEQ ID NO: 946614 - RNA, 22 nt, Human
acaugcauacacguacauaccu

SEQ ID NO: 946615 - RNA, 22 nt, Human
agccagcagggcuuagaggaca

SEQ ID NO: 946616 - RNA, 22 nt, Human
cugaggagagaucacguggugu

SEQ ID NO: 946617 - RNA, 22 nt, Human
auacaucuagagucauaaaaac

SEQ ID NO: 946618 - RNA, 22 nt, Human
ccagaagggcuauugcagugac

SEQ ID NO: 946619 - RNA, 22 nt, Human
ucccagccggugccuggguccc

SEQ ID NO: 946620 - RNA, 22 nt, Human
uugcaaauuccaauccaauauu

SEQ ID NO: 946621 - RNA, 22 nt, Human
augugucucuaaaauuuaguaa

SEQ ID NO: 946622 - RNA, 22 nt, Human
uaaauguggagacucaggaguc

SEQ ID NO: 946623 - RNA, 22 nt, Human
uccagugguuugaaaggggugu

SEQ ID NO: 946624 - RNA, 22 nt, Human
agugaaaugacugaaucagaua

SEQ ID NO: 946625 - RNA, 22 nt, Human
uggcagcuguuaauguuuuguu

SEQ ID NO: 946626 - RNA, 22 nt, Human
agaugcugcuccacaggccagg

SEQ ID NO: 946627 - RNA, 22 nt, Human
guggaauguccuugaucauaag

SEQ ID NO: 946628 - RNA, 22 nt, Human
gcugucuggcauggcguggcug

SEQ ID NO: 946629 - RNA, 18 nt, Human
cugcugcaggcacucagg

SEQ ID NO: 946630 - RNA, 22 nt, Human
agugaaauugcuguaagaggaa

SEQ ID NO: 946631 - RNA, 22 nt, Human
aggcugcuucaauggauaagau

SEQ ID NO: 946632 - RNA, 22 nt, Human
aagugaaacauguaucucuuua

SEQ ID NO: 946633 - RNA, 22 nt, Human
caaagugcugagauuacaggua

SEQ ID NO: 946634 - RNA, 22 nt, Human
uuaauguguguacaggauuuug

SEQ ID NO: 946635 - RNA, 22 nt, Human
gugcauuuaggucacaugaugu

SEQ ID NO: 946636 - RNA, 22 nt, Human
uguuucaagcaauagcauuuca

SEQ ID NO: 946637 - RNA, 22 nt, Human
cauuucacaaauggccacauca

SEQ ID NO: 946638 - RNA, 22 nt, Human
cccaggcagggacgugcucugg

SEQ ID NO: 946639 - RNA, 22 nt, Human
ugcaugcugcacacaugcguag

SEQ ID NO: 946640 - RNA, 22 nt, Human
acuccuggaaaagaacgcaggg

SEQ ID NO: 946641 - RNA, 22 nt, Human
caaugauguuuagauaaaaucc

SEQ ID NO: 946642 - RNA, 22 nt, Human
agucacuguucugucaugucaa

SEQ ID NO: 946643 - RNA, 22 nt, Human
auaaaacuuauuagaauugugu

SEQ ID NO: 946644 - RNA, 22 nt, Human
agggcugccugacuccagagcc

SEQ ID NO: 946645 - RNA, 22 nt, Human
uuuauuuggcauccagggagaa

SEQ ID NO: 946646 - RNA, 22 nt, Human
gcugcagcccggcgcgccugag

SEQ ID NO: 946647 - RNA, 19 nt, Human
ugcagcucagggcaggggc

SEQ ID NO: 946648 - RNA, 22 nt, Human
cuugaaagaagggucuuuuaau

SEQ ID NO: 946649 - RNA, 21 nt, Human
uggcucugcucagagcagucc

SEQ ID NO: 946650 - RNA, 22 nt, Human
gaaccaaguaggauacaaggag

SEQ ID NO: 946651 - RNA, 22 nt, Human
ggccuuggugcucuguguugca

SEQ ID NO: 946652 - RNA, 22 nt, Human
augaaauguuggucccaaucgc

SEQ ID NO: 946653 - RNA, 22 nt, Human
aggacaggauugagcugaacug

SEQ ID NO: 946654 - RNA, 22 nt, Human
agaaaugaaaccaaagccuaga

SEQ ID NO: 946655 - RNA, 21 nt, Human
aggccucuucauggccaugau

SEQ ID NO: 946656 - RNA, 22 nt, Human
cugcccuguggcucugagucau

SEQ ID NO: 946657 - RNA, 22 nt, Human
uucucagagugaccaagucuuu

SEQ ID NO: 946658 - RNA, 22 nt, Human
auggcaagcaagcugaagagau

SEQ ID NO: 946659 - RNA, 22 nt, Human
gccugcagccucaagggcugag

SEQ ID NO: 946660 - RNA, 22 nt, Human
uucaggauccccaccgcguuua

SEQ ID NO: 946661 - RNA, 22 nt, Human
gauggcagcagcagccagggau

SEQ ID NO: 946662 - RNA, 22 nt, Human
ucuuguuaucaggaaaacagua

SEQ ID NO: 946663 - RNA, 22 nt, Human
cagggccaagcugcagcaucug

SEQ ID NO: 946664 - RNA, 22 nt, Human
cuggugagacgguugacaggag

SEQ ID NO: 946665 - RNA, 22 nt, Human
uccagggguaccggccaggcag

SEQ ID NO: 946666 - RNA, 22 nt, Human
gaggacagagccgccuggcaag

SEQ ID NO: 946667 - RNA, 22 nt, Human
aggcagccaucugcaggaagga

SEQ ID NO: 946668 - RNA, 22 nt, Human
acuguguccucauguggcagaa

SEQ ID NO: 946669 - RNA, 22 nt, Human
ggugugccuggggcuuagcugc

SEQ ID NO: 946670 - RNA, 22 nt, Human
ucccuggggauguuggccugcc

SEQ ID NO: 946671 - RNA, 22 nt, Human
aaaauacuacugucuucuuccc

SEQ ID NO: 946672 - RNA, 22 nt, Human
ugggcugcggauaggccucgga

SEQ ID NO: 946673 - RNA, 22 nt, Human
cuggcagugacauugcaggugc

SEQ ID NO: 946674 - RNA, 22 nt, Human
ucugucacccagagugcagugg

SEQ ID NO: 946675 - RNA, 22 nt, Human
agaggccacuuugccugugaug

SEQ ID NO: 946676 - RNA, 22 nt, Human
uugaaucuggguacuuguaaua

SEQ ID NO: 946677 - RNA, 22 nt, Human
uucaagucaaggaaagaggucu

SEQ ID NO: 946678 - RNA, 22 nt, Human
acagagauggcacagagaaggu

SEQ ID NO: 946679 - RNA, 22 nt, Human
ggugaguugggguucacagguc

SEQ ID NO: 946680 - RNA, 22 nt, Human
uuuaauugauucacagucugua

SEQ ID NO: 946681 - RNA, 22 nt, Human
ccuguucacuuugacuucucca

SEQ ID NO: 946682 - RNA, 19 nt, Human
acagggcagcaauaggaua

SEQ ID NO: 946683 - RNA, 22 nt, Human
uuucaguuguccuguuaauagc

SEQ ID NO: 946684 - RNA, 23 nt, Human
gggcugcuccaggccaaggcugg

SEQ ID NO: 946685 - RNA, 22 nt, Human
caggucagaggcgcagccccca

SEQ ID NO: 946686 - RNA, 22 nt, Human
ugcagcuucuuguccugugauu

SEQ ID NO: 946687 - RNA, 22 nt, Human
uuaaauuagucaagcuucucug

SEQ ID NO: 946688 - RNA, 22 nt, Human
ucugggagagcacguggcugac

SEQ ID NO: 946689 - RNA, 22 nt, Human
gucccuggaauggacucugcgc

SEQ ID NO: 946690 - RNA, 22 nt, Human
uggcccugcuuaugucucucuu

SEQ ID NO: 946691 - RNA, 22 nt, Human
uccuguuaguguuagacuuccc

SEQ ID NO: 946692 - RNA, 22 nt, Human
ggucccugguucccucugagcu

SEQ ID NO: 946693 - RNA, 22 nt, Human
cagcccucagguccucagcagc

SEQ ID NO: 946694 - RNA, 22 nt, Human
aaaaugcugggaaaguuggaau

SEQ ID NO: 946695 - RNA, 22 nt, Human
uccaggagaaggccauccagcg

SEQ ID NO: 946696 - RNA, 22 nt, Human
uauuccaguucaccuuuucauc

SEQ ID NO: 946697 - RNA, 22 nt, Human
augcccgauaccuaguuaacuc

SEQ ID NO: 946698 - RNA, 22 nt, Human
ggagcuguuggcagcuaucuug

SEQ ID NO: 946699 - RNA, 22 nt, Human
gaucauuugcaggaaacauuaa

SEQ ID NO: 946700 - RNA, 22 nt, Human
gcagggacaacugugcaccuga

SEQ ID NO: 946701 - RNA, 22 nt, Human
uagaacagaggguugcccagau

SEQ ID NO: 946702 - RNA, 22 nt, Human
uuccauauuuguguggcaaaag

SEQ ID NO: 946703 - RNA, 22 nt, Human
ggcagcugauuagcaucaagga

SEQ ID NO: 946704 - RNA, 22 nt, Human
aacaaaugauuguugguuggag

SEQ ID NO: 946705 - RNA, 22 nt, Human
aguggcagagcugugucuugaa

SEQ ID NO: 946706 - RNA, 22 nt, Human
auugaaagagaauguagcucuu

SEQ ID NO: 946707 - RNA, 22 nt, Human
uauucugugugauauguaaaug

SEQ ID NO: 946708 - RNA, 22 nt, Human
aaggccauuauucugauauauu

SEQ ID NO: 946709 - RNA, 22 nt, Human
uuuucuuaggugcuccaaguag

SEQ ID NO: 946710 - RNA, 22 nt, Human
gcagaggcaaucagguaugugg

SEQ ID NO: 946711 - RNA, 22 nt, Human
ggagcugcuccuucagccaagu

SEQ ID NO: 946712 - RNA, 22 nt, Human
agagauguucauucagcauguu

SEQ ID NO: 946713 - RNA, 22 nt, Human
gcaguggauccaaugguaucuu

SEQ ID NO: 946714 - RNA, 22 nt, Human
ucuuacauauacgucauuuagu

SEQ ID NO: 946715 - RNA, 19 nt, Human
ucaaugcaugaaaucagcc

SEQ ID NO: 946716 - RNA, 21 nt, Human
aaggcagaagcauggaaugag

SEQ ID NO: 946717 - RNA, 22 nt, Human
ugucaucuuggucuggaauaag

SEQ ID NO: 946718 - RNA, 22 nt, Human
uagaauaugugguguauacuuu

SEQ ID NO: 946719 - RNA, 22 nt, Human
guggccuggaugagcuucgaca

SEQ ID NO: 946720 - RNA, 22 nt, Human
cugaagagcucuccuguccccu

SEQ ID NO: 946721 - RNA, 22 nt, Human
aaauuacuuuacacuuucaucu

SEQ ID NO: 946722 - RNA, 18 nt, Human
accugccuguucuucucu

SEQ ID NO: 946723 - RNA, 22 nt, Human
cacagacccagaagggaugaag

SEQ ID NO: 946724 - RNA, 22 nt, Human
uucuucuuuccuauaauuaauu

SEQ ID NO: 946725 - RNA, 22 nt, Human
acaguaauuaaaauggaucugc

SEQ ID NO: 946726 - RNA, 22 nt, Human
gacagagugcagggcuagaaga

SEQ ID NO: 946727 - RNA, 22 nt, Human
aggcugugaguuuugucucaga

SEQ ID NO: 946728 - RNA, 22 nt, Human
acaguguccuuguggucccugu

SEQ ID NO: 946729 - RNA, 22 nt, Human
uccaggaguccugggagugauu

SEQ ID NO: 946730 - RNA, 22 nt, Human
ugcuuuauguuaucagaagggu

SEQ ID NO: 946731 - RNA, 22 nt, Human
cagccuccugggacacucaccg

SEQ ID NO: 946732 - RNA, 22 nt, Human
aaagcugcugccaaucaggcuu

SEQ ID NO: 946733 - RNA, 22 nt, Human
uccagucuucuugcagcuacau

SEQ ID NO: 946734 - RNA, 22 nt, Human
aagaggaaaugauugacuauau

SEQ ID NO: 946735 - RNA, 22 nt, Human
gaggucagucagaccaggguuu

SEQ ID NO: 946736 - RNA, 22 nt, Human
cauuguuauagcauuacacacc

SEQ ID NO: 946737 - RNA, 22 nt, Human
aaaugcacaaaguaaguguaau

SEQ ID NO: 946738 - RNA, 23 nt, Human
uccaugagaugugggcuucuagu

SEQ ID NO: 946739 - RNA, 22 nt, Human
gaguggggcguggauccagcgu

SEQ ID NO: 946740 - RNA, 19 nt, Human
agcagcuggagguggagug

SEQ ID NO: 946741 - RNA, 22 nt, Human
ugggagcaccuugagggcagaa

SEQ ID NO: 946742 - RNA, 22 nt, Human
aucagcaagacuaggggaauac

SEQ ID NO: 946743 - RNA, 22 nt, Human
ccucaugguacuuacuguagcu

SEQ ID NO: 946744 - RNA, 22 nt, Human
cccagcaguuguuggugcacau

SEQ ID NO: 946745 - RNA, 22 nt, Human
gccugggaagacuaagugggag

SEQ ID NO: 946746 - RNA, 22 nt, Human
agcagagccagaauuggaccag

SEQ ID NO: 946747 - RNA, 22 nt, Human
gcugugcacuaccuauacaucc

SEQ ID NO: 946748 - RNA, 23 nt, Human
ucucaggacacacaugucuauca

SEQ ID NO: 946749 - RNA, 22 nt, Human
uugcauuguugcaaugaaguau

SEQ ID NO: 946750 - RNA, 22 nt, Human
uauuucuuguuauucucguuga

SEQ ID NO: 946751 - RNA, 22 nt, Human
gcucccaguucccaaagugacc

SEQ ID NO: 946752 - RNA, 22 nt, Human
uccaggagguaugaguggcccc

SEQ ID NO: 946753 - RNA, 23 nt, Human
gccuggagaaaagcugcaguuca

SEQ ID NO: 946754 - RNA, 22 nt, Human
uccuugaauggacauuacacug

SEQ ID NO: 946755 - RNA, 22 nt, Human
gcacugggugugaggcagcguc

SEQ ID NO: 946756 - RNA, 22 nt, Human
aagacagagggaagcaaugaug

SEQ ID NO: 946757 - RNA, 22 nt, Human
ccugccugucaucgccugcgcc

SEQ ID NO: 946758 - RNA, 22 nt, Human
gcacagaagagcuuuggaauga

SEQ ID NO: 946759 - RNA, 22 nt, Human
aacagaauugcugcugccaaug

SEQ ID NO: 946760 - RNA, 22 nt, Human
gccagggaacccaagggccuca

SEQ ID NO: 946761 - RNA, 17 nt, Human
uuccaguuuaguauugu

SEQ ID NO: 946762 - RNA, 22 nt, Human
ucaaagcaucagucaauuuagg

SEQ ID NO: 946763 - RNA, 19 nt, Human
cugccuguuauggagagaa

SEQ ID NO: 946764 - RNA, 22 nt, Human
ggugcucaagagggcauccucu

SEQ ID NO: 946765 - RNA, 21 nt, Human
agugaaauugcaucagaggga

SEQ ID NO: 946766 - RNA, 22 nt, Human
gcagcuggacccacacggcuua

SEQ ID NO: 946767 - RNA, 22 nt, Human
ucugggcuuuacacugugcuua

SEQ ID NO: 946768 - RNA, 22 nt, Human
auccaggcuggguguggcuacu

SEQ ID NO: 946769 - RNA, 18 nt, Human
ugugguggagcugccuuc

SEQ ID NO: 946770 - RNA, 22 nt, Human
gcugcucuuuucagagaugaga

SEQ ID NO: 946771 - RNA, 22 nt, Human
cugguccauucucucccugaag

SEQ ID NO: 946772 - RNA, 22 nt, Human
gcugggcagccuggccgcugcc

SEQ ID NO: 946773 - RNA, 22 nt, Human
ucuggagcgaggucccugucug

SEQ ID NO: 946774 - RNA, 22 nt, Human
ugggccagcaauugcugcucag

SEQ ID NO: 946775 - RNA, 22 nt, Human
acuguucauauucuuagaaauu

SEQ ID NO: 946776 - RNA, 22 nt, Human
agugggcagugcgcucggaugc

SEQ ID NO: 946777 - RNA, 22 nt, Human
cccuccagccauggacccaggu

SEQ ID NO: 946778 - RNA, 22 nt, Human
gaucauuuugaugcccuuuuag

SEQ ID NO: 946779 - RNA, 22 nt, Human
agaaugcaguuugaaauaaggu

SEQ ID NO: 946780 - RNA, 22 nt, Human
guucuucagauuccauuucagu

SEQ ID NO: 946781 - RNA, 22 nt, Human
gcugggcaccucucccagauug

SEQ ID NO: 946782 - RNA, 22 nt, Human
uauaugcaugcccauguauaca

SEQ ID NO: 946783 - RNA, 22 nt, Human
uucauuacugcgguagucacac

SEQ ID NO: 946784 - RNA, 22 nt, Human
cuucuucauguauugauagucu

SEQ ID NO: 946785 - RNA, 22 nt, Human
augggagccaucgcauuugcug

SEQ ID NO: 946786 - RNA, 22 nt, Human
cagaauuuuucgaauguacugu

SEQ ID NO: 946787 - RNA, 22 nt, Human
agagcugcaccuaugcagaccu

SEQ ID NO: 946788 - RNA, 22 nt, Human
uuugaaagcuacuuucggguca

SEQ ID NO: 946789 - RNA, 22 nt, Human
augggaggaucacuugaggcca

SEQ ID NO: 946790 - RNA, 17 nt, Human
aggagucucagaugagc

SEQ ID NO: 946791 - RNA, 22 nt, Human
augucacagcucccauuccucc

SEQ ID NO: 946792 - RNA, 22 nt, Human
ccugucuggccaccagggcgau

SEQ ID NO: 946793 - RNA, 22 nt, Human
gucuuucuaugaugaacuguug

SEQ ID NO: 946794 - RNA, 22 nt, Human
agggggugucucugauuggguu

SEQ ID NO: 946795 - RNA, 22 nt, Human
acucugcugauagguccucaga

SEQ ID NO: 946796 - RNA, 22 nt, Human
ucaggagaguguucaguggagg

SEQ ID NO: 946797 - RNA, 22 nt, Human
uuuuucagccaugaauuacacu

SEQ ID NO: 946798 - RNA, 20 nt, Human
aggacagcagcugccacuug

SEQ ID NO: 946799 - RNA, 22 nt, Human
uauuucagucacuucuucucug

SEQ ID NO: 946800 - RNA, 22 nt, Human
cugcccaggaaggagaggaugg

SEQ ID NO: 946801 - RNA, 22 nt, Human
aggcaguggcugagaccagggg

SEQ ID NO: 946802 - RNA, 22 nt, Human
ugucccagacacaguaugcgcu

SEQ ID NO: 946803 - RNA, 20 nt, Human
uauuuguauuugggaaaguu

SEQ ID NO: 946804 - RNA, 22 nt, Human
ggcaggagcucuccaguuugcc

SEQ ID NO: 946805 - RNA, 22 nt, Human
ugcucaguccuaccuuggcucc

SEQ ID NO: 946806 - RNA, 22 nt, Human
uuaacaauagaguuucuucagg

SEQ ID NO: 946807 - RNA, 22 nt, Human
aaaugcagcagcuaauugaaaa

SEQ ID NO: 946808 - RNA, 22 nt, Human
uuuuucuaauggcuuaggaugu

SEQ ID NO: 946809 - RNA, 22 nt, Human
cuggggcucucuggaaugcuug

SEQ ID NO: 946810 - RNA, 22 nt, Human
aguccuuugggaaaaaugacua

SEQ ID NO: 946811 - RNA, 22 nt, Human
gaaugcacacgugugugcaugc

SEQ ID NO: 946812 - RNA, 22 nt, Human
cagaggcugaugugggaugggc

SEQ ID NO: 946813 - RNA, 22 nt, Human
uaggccaggacagagcuuccag

SEQ ID NO: 946814 - RNA, 21 nt, Human
ccagcuccaggaccuuggauc

SEQ ID NO: 946815 - RNA, 22 nt, Human
gcucuguccagcgugcacagaa

SEQ ID NO: 946816 - RNA, 22 nt, Human
agacccagaaagcagcugcauu

SEQ ID NO: 946817 - RNA, 22 nt, Human
cuuuguauucaguugggcugug

SEQ ID NO: 946818 - RNA, 18 nt, Human
ugggcugccuggccucug

SEQ ID NO: 946819 - RNA, 22 nt, Human
cagcuccugccugggcagcugu

SEQ ID NO: 946820 - RNA, 21 nt, Human
uucucagaucgaguagugaga

SEQ ID NO: 946821 - RNA, 22 nt, Human
aggcagucuaguccccaggcaa

SEQ ID NO: 946822 - RNA, 22 nt, Human
uaauuucaccguugcuagaaau

SEQ ID NO: 946823 - RNA, 22 nt, Human
acaggcugcugagccauuugcu

SEQ ID NO: 946824 - RNA, 19 nt, Human
gaguuauugccagggcaug

SEQ ID NO: 946825 - RNA, 22 nt, Human
gcaaagcauucuguggagucua

SEQ ID NO: 946826 - RNA, 21 nt, Human
gaugaagcaaucuuucuguug

SEQ ID NO: 946827 - RNA, 22 nt, Human
uguuucauuaguacugacaaua

SEQ ID NO: 946828 - RNA, 22 nt, Human
auucuguauggaaaagcacuau

SEQ ID NO: 946829 - RNA, 22 nt, Human
acaaggaggucuggggggcccu

SEQ ID NO: 946830 - RNA, 22 nt, Human
ggccugcugacccaaguccugu

SEQ ID NO: 946831 - RNA, 22 nt, Human
uguaugcuuguguauaauauaa

SEQ ID NO: 946832 - RNA, 20 nt, Human
agugucugggccucaggccc

SEQ ID NO: 946833 - RNA, 22 nt, Human
auuuggaaacaauuauauucuu

SEQ ID NO: 946834 - RNA, 22 nt, Human
gagagugagauaauuucacaua

SEQ ID NO: 946835 - RNA, 22 nt, Human
gaggcagcagggcugguuccuu

SEQ ID NO: 946836 - RNA, 22 nt, Human
ucacuuauugcucaucucaugc

SEQ ID NO: 946837 - RNA, 21 nt, Human
ugacugaggcuucuucacaca

SEQ ID NO: 946838 - RNA, 19 nt, Human
auacagauguauccaugau

SEQ ID NO: 946839 - RNA, 22 nt, Human
acacugcagaugaaagcauaag

SEQ ID NO: 946840 - RNA, 22 nt, Human
gaggccuggcugggaggaggug

SEQ ID NO: 946841 - RNA, 22 nt, Human
aagaauguggguggauaugaug

SEQ ID NO: 946842 - RNA, 22 nt, Human
gaggaggcacuugagcagaugu

SEQ ID NO: 946843 - RNA, 22 nt, Human
gaaauauuguacuggagauguu

SEQ ID NO: 946844 - RNA, 22 nt, Human
aagcagaaguugaucuaccaua

SEQ ID NO: 946845 - RNA, 22 nt, Human
ggcucugcagugacuugagggg

SEQ ID NO: 946846 - RNA, 22 nt, Human
cccaggugcugcgugaagccuc

SEQ ID NO: 946847 - RNA, 22 nt, Human
uccugccuguuuaccuguacuu

SEQ ID NO: 946848 - RNA, 22 nt, Human
agcccugggaggccagcuugua

SEQ ID NO: 946849 - RNA, 17 nt, Human
cuccuggcagccucagg

SEQ ID NO: 946850 - RNA, 22 nt, Human
ugcagcauuauucacaguagcc

SEQ ID NO: 946851 - RNA, 22 nt, Human
ccugggcucaagugauccuccu

SEQ ID NO: 946852 - RNA, 22 nt, Human
caggaccuggaaugcuugugaa

SEQ ID NO: 946853 - RNA, 22 nt, Human
cucccagggucuaggcugcugg

SEQ ID NO: 946854 - RNA, 22 nt, Human
aguauuucuaguugguucuacu

SEQ ID NO: 946855 - RNA, 22 nt, Human
ucucagagagcuguguuuuccu

SEQ ID NO: 946856 - RNA, 22 nt, Human
aaggccaacuaggaugagcuag

SEQ ID NO: 946857 - RNA, 22 nt, Human
ucugaggccccugggcaggaug

SEQ ID NO: 946858 - RNA, 18 nt, Human
aguggucuguuauaucau

SEQ ID NO: 946859 - RNA, 22 nt, Human
gguccccagcaguggcugcuuc

SEQ ID NO: 946860 - RNA, 22 nt, Human
cucagaguucuccugggaggug

SEQ ID NO: 946861 - RNA, 22 nt, Human
cuuuguagcugcuucugauuua

SEQ ID NO: 946862 - RNA, 22 nt, Human
gagcaguagaguacauggcucc

SEQ ID NO: 946863 - RNA, 22 nt, Human
gcacugugaucaaggcuaagca

SEQ ID NO: 946864 - RNA, 22 nt, Human
cuacauuuugugauuaugaaau

SEQ ID NO: 946865 - RNA, 21 nt, Human
uucagcaguccucuagagaua

SEQ ID NO: 946866 - RNA, 22 nt, Human
accaggagggacccugguggcc

SEQ ID NO: 946867 - RNA, 22 nt, Human
uuuacuguuuacagcuaaugca

SEQ ID NO: 946868 - RNA, 22 nt, Human
guuuuauuggaacacagccaug

SEQ ID NO: 946869 - RNA, 22 nt, Human
ggcgaggccgggacaggcugga

SEQ ID NO: 946870 - RNA, 22 nt, Human
gauucugagcugguguuuuacg

SEQ ID NO: 946871 - RNA, 22 nt, Human
ucuuccaagguugcacacuauc

SEQ ID NO: 946872 - RNA, 22 nt, Human
uccugagggcgauucagcaggu

SEQ ID NO: 946873 - RNA, 22 nt, Human
aauauguucaaaauagaucacu

SEQ ID NO: 946874 - RNA, 22 nt, Human
ucugucaccauucagcuugaau

SEQ ID NO: 946875 - RNA, 22 nt, Human
uggcccugcuguaucaucugcu

SEQ ID NO: 946876 - RNA, 22 nt, Human
aggaagcuaaccagggagugag

SEQ ID NO: 946877 - RNA, 22 nt, Human
acuccugggugcugaccagcgu

SEQ ID NO: 946878 - RNA, 22 nt, Human
caugggagguuggcuuggcaug

SEQ ID NO: 946879 - RNA, 22 nt, Human
aaauuauuuucagaauggagaa

SEQ ID NO: 946880 - RNA, 22 nt, Human
ccuggcucuucagagguuccua

SEQ ID NO: 946881 - RNA, 22 nt, Human
acugcuuacaaaaggaaagaau

SEQ ID NO: 946882 - RNA, 22 nt, Human
ugggacacccucacgccugcac

SEQ ID NO: 946883 - RNA, 22 nt, Human
cagccagggagggcaaaugaga

SEQ ID NO: 946884 - RNA, 22 nt, Human
gcacccagaauaaggacaggac

SEQ ID NO: 946885 - RNA, 22 nt, Human
cagcugcccaggccaccuggag

SEQ ID NO: 946886 - RNA, 20 nt, Human
cuguagggugcagcaggcuc

SEQ ID NO: 946887 - RNA, 22 nt, Human
cccauggggacaccaugaagga

SEQ ID NO: 946888 - RNA, 22 nt, Human
agggaagaugucucaucuuagg

SEQ ID NO: 946889 - RNA, 22 nt, Human
aaauguguuucgaaaacuggug

SEQ ID NO: 946890 - RNA, 22 nt, Human
ccaggccuccugugaguggacc

SEQ ID NO: 946891 - RNA, 22 nt, Human
uuacauuuggcuauguccucua

SEQ ID NO: 946892 - RNA, 22 nt, Human
ccugggaggcagagguugcagu

SEQ ID NO: 946893 - RNA, 23 nt, Human
uucaaaacuggaaaaucagaugc

SEQ ID NO: 946894 - RNA, 22 nt, Human
ucugucugcgcuugcccuggug

SEQ ID NO: 946895 - RNA, 22 nt, Human
cucucugcaaguuuugaaauag

SEQ ID NO: 946896 - RNA, 22 nt, Human
cagcaggcagccauuucacugu

SEQ ID NO: 946897 - RNA, 22 nt, Human
ucaguuuucucaucugugaaau

SEQ ID NO: 946898 - RNA, 22 nt, Human
ccagugcaggugagcaccaggu

SEQ ID NO: 946899 - RNA, 22 nt, Human
uccaggagucagacagauggug

SEQ ID NO: 946900 - RNA, 22 nt, Human
auuccaaagccugaauaaugga

SEQ ID NO: 946901 - RNA, 22 nt, Human
uaaagaacacagggaauagcac

SEQ ID NO: 946902 - RNA, 22 nt, Human
aaagucauuggaauauuaauga

SEQ ID NO: 946903 - RNA, 21 nt, Human
gaggccacuaauaggggcaga

SEQ ID NO: 946904 - RNA, 22 nt, Human
agcaggcuuucaagagucuucu

SEQ ID NO: 946905 - RNA, 22 nt, Human
caaggagaguaauugaaugaga

SEQ ID NO: 946906 - RNA, 22 nt, Human
cugcuguuccaccucugaaugc

SEQ ID NO: 946907 - RNA, 22 nt, Human
cagagcuguuacuauucaugaa

SEQ ID NO: 946908 - RNA, 20 nt, Human
cccugagacaaaggaggggc

SEQ ID NO: 946909 - RNA, 22 nt, Human
uggccucugcaauggauucacc

SEQ ID NO: 946910 - RNA, 17 nt, Human
cuccuggccaccccucu

SEQ ID NO: 946911 - RNA, 22 nt, Human
aaaggcuaugagauagaagaua

SEQ ID NO: 946912 - RNA, 22 nt, Human
uuuuaucuucauuccuaucuac

SEQ ID NO: 946913 - RNA, 22 nt, Human
gcugaagggagugcugagucug

SEQ ID NO: 946914 - RNA, 22 nt, Human
uacuuacagagcuuauaaguua

SEQ ID NO: 946915 - RNA, 20 nt, Human
uccagccacuuccgcugguc

SEQ ID NO: 946916 - RNA, 22 nt, Human
agggagaacaguugcagcagac

SEQ ID NO: 946917 - RNA, 22 nt, Human
ggcuuucuagaucuagcucugu

SEQ ID NO: 946918 - RNA, 22 nt, Human
aggcagcugcccucuccuuccu

SEQ ID NO: 946919 - RNA, 22 nt, Human
ugcauuccuccaccuccugcac

SEQ ID NO: 946920 - RNA, 22 nt, Human
caggccuggguucaaaucccuu

SEQ ID NO: 946921 - RNA, 22 nt, Human
cuucugggcauucagcugcaca

SEQ ID NO: 946922 - RNA, 22 nt, Human
uuugcauugcauacaaggaacu

SEQ ID NO: 946923 - RNA, 22 nt, Human
gcuuuggagccuguguucugcc

SEQ ID NO: 946924 - RNA, 22 nt, Human
uucuuagaugauuaaugauggg

SEQ ID NO: 946925 - RNA, 22 nt, Human
cuucuucacacuggucugaagc

SEQ ID NO: 946926 - RNA, 22 nt, Human
aggcagaucacuugaggccagg

SEQ ID NO: 946927 - RNA, 22 nt, Human
ugcagccauuuucugccaaugc

SEQ ID NO: 946928 - RNA, 22 nt, Human
ucugugcucuucucaguaucac

SEQ ID NO: 946929 - RNA, 22 nt, Human
ugcagaguaaaagcagaugcua

SEQ ID NO: 946930 - RNA, 22 nt, Human
uugaaaguuuauggagucugca

SEQ ID NO: 946931 - RNA, 22 nt, Human
gcucugaggcugugaggugcug

SEQ ID NO: 946932 - RNA, 22 nt, Human
uuucuucagagagagcuuuccc

SEQ ID NO: 946933 - RNA, 22 nt, Human
caguggugaagagcaggggcuc

SEQ ID NO: 946934 - RNA, 22 nt, Human
cauaacuagagugaaauguuga

SEQ ID NO: 946935 - RNA, 22 nt, Human
aaauucuuucauggcuaauaag

SEQ ID NO: 946936 - RNA, 18 nt, Human
ucagggaaucuuggccuu

SEQ ID NO: 946937 - RNA, 22 nt, Human
uaggcacuguguuuguaggagu

SEQ ID NO: 946938 - RNA, 20 nt, Human
gcacugaaauucaauguuug

SEQ ID NO: 946939 - RNA, 22 nt, Human
uucaugugaauauauuugucuu

SEQ ID NO: 946940 - RNA, 22 nt, Human
cugagacuuucaugugcuuuua

SEQ ID NO: 946941 - RNA, 22 nt, Human
gcacagggagcaggucucuggu

SEQ ID NO: 946942 - RNA, 22 nt, Human
ucuuuaaucauaaccaagaugg

SEQ ID NO: 946943 - RNA, 20 nt, Human
cucaguguggccugaguguu

SEQ ID NO: 946944 - RNA, 22 nt, Human
acaaggcugaacagugaagccg

SEQ ID NO: 946945 - RNA, 22 nt, Human
aaugcacauauauguguauaca

SEQ ID NO: 946946 - RNA, 22 nt, Human
agcccagcagaaaguccagccu

SEQ ID NO: 946947 - RNA, 23 nt, Human
ccuucagaagaaguaacaggggc

SEQ ID NO: 946948 - RNA, 22 nt, Human
gagaaggggugauguggguaau

SEQ ID NO: 946949 - RNA, 22 nt, Human
cuggcagggugggcuuugcuuu

SEQ ID NO: 946950 - RNA, 22 nt, Human
gcacagccagcaucugagggau

SEQ ID NO: 946951 - RNA, 22 nt, Human
cagggcuccccgcaccgcagcc

SEQ ID NO: 946952 - RNA, 17 nt, Human
acagagcacaucaagau

SEQ ID NO: 946953 - RNA, 22 nt, Human
acacagaaccucauagccucuc

SEQ ID NO: 946954 - RNA, 22 nt, Human
gcucccucugcucaggcacuug

SEQ ID NO: 946955 - RNA, 22 nt, Human
aauuaggaaaugagaguauuug

SEQ ID NO: 946956 - RNA, 22 nt, Human
cagggcugaaaucaagguguag

SEQ ID NO: 946957 - RNA, 22 nt, Human
uucaagaugacccagucacacg

SEQ ID NO: 946958 - RNA, 22 nt, Human
ccuggcugggguagaagugagg

SEQ ID NO: 946959 - RNA, 22 nt, Human
guggccaagggacucuaaggca

SEQ ID NO: 946960 - RNA, 22 nt, Human
gucccagggagguucagggcuu

SEQ ID NO: 946961 - RNA, 19 nt, Human
ucugccucuggucaggcuc

SEQ ID NO: 946962 - RNA, 22 nt, Human
cugaggucaauuaaucaacaac

SEQ ID NO: 946963 - RNA, 22 nt, Human
gauuuccuugcauauugguaau

SEQ ID NO: 946964 - RNA, 22 nt, Human
guuuaaguuucagaagcuaaga

SEQ ID NO: 946965 - RNA, 22 nt, Human
ucugggugcccuuugcucuguu

SEQ ID NO: 946966 - RNA, 22 nt, Human
acacuuuacagcuuccuuugca

SEQ ID NO: 946967 - RNA, 22 nt, Human
cucaggaugcaggucacaggac

SEQ ID NO: 946968 - RNA, 22 nt, Human
ucaaagucacaacucucuaauu

SEQ ID NO: 946969 - RNA, 22 nt, Human
acaggccacaguggagucucug

SEQ ID NO: 946970 - RNA, 22 nt, Human
ccagggucuuggagaggagugc

SEQ ID NO: 946971 - RNA, 23 nt, Human
gccuggccaccccagggcugcuu

SEQ ID NO: 946972 - RNA, 22 nt, Human
agggcugccugcucugcauuga

SEQ ID NO: 946973 - RNA, 22 nt, Human
uagagaaaagcagggaucagga

SEQ ID NO: 946974 - RNA, 22 nt, Human
ugaaaucuuuaguuucuguccc

SEQ ID NO: 946975 - RNA, 22 nt, Human
uucacaggaggguggaugcaug

SEQ ID NO: 946976 - RNA, 22 nt, Human
auuucugauaaacguaagcugc

SEQ ID NO: 946977 - RNA, 22 nt, Human
ucagaagaagagacuccacagc

SEQ ID NO: 946978 - RNA, 21 nt, Human
aggcagcaggauccagggaca

SEQ ID NO: 946979 - RNA, 22 nt, Human
gccuggcucacagagcagccuu

SEQ ID NO: 946980 - RNA, 20 nt, Human
agcaguaggaccucugggcc

SEQ ID NO: 946981 - RNA, 22 nt, Human
agcugcuaugacaacaccagcc

SEQ ID NO: 946982 - RNA, 19 nt, Human
guuuuucccagacgaggca

SEQ ID NO: 946983 - RNA, 22 nt, Human
gcccucucuucugcagccucca

SEQ ID NO: 946984 - RNA, 22 nt, Human
ccaggaguuggagguugcagug

SEQ ID NO: 946985 - RNA, 22 nt, Human
auuccaguuggguucuaauaca

SEQ ID NO: 946986 - RNA, 22 nt, Human
cugggcugucccaaccccaucc

SEQ ID NO: 946987 - RNA, 22 nt, Human
augcauaauguauguauugacu

SEQ ID NO: 946988 - RNA, 22 nt, Human
gcagagccaugggagguuuuug

SEQ ID NO: 946989 - RNA, 22 nt, Human
aucuaagauguauugagcacuu

SEQ ID NO: 946990 - RNA, 22 nt, Human
ggggaugguggcauuuguaaaa

SEQ ID NO: 946991 - RNA, 22 nt, Human
aaucuucauuuugacaagauuc

SEQ ID NO: 946992 - RNA, 22 nt, Human
aucaaaguaggcauauguuuuu

SEQ ID NO: 946993 - RNA, 22 nt, Human
guacuucccugggaggcaagca

SEQ ID NO: 946994 - RNA, 22 nt, Human
uggaagaggcccaugacugccu

SEQ ID NO: 946995 - RNA, 22 nt, Human
gugccuggagcuaauguguaua

SEQ ID NO: 946996 - RNA, 22 nt, Human
ugcauuugucuugucucaugaa

SEQ ID NO: 946997 - RNA, 22 nt, Human
ggugacuggagggacccaggcc

SEQ ID NO: 946998 - RNA, 22 nt, Human
gcacaugagcugcugggauggg

SEQ ID NO: 946999 - RNA, 22 nt, Human
aggcuggcuuggcucuccugug

SEQ ID NO: 947000 - RNA, 20 nt, Human
cuggguggcaagcaaggggg

SEQ ID NO: 947001 - RNA, 22 nt, Human
uccuugaauauaauaacaguag

SEQ ID NO: 947002 - RNA, 22 nt, Human
uccaggagaggccugaccaggu

SEQ ID NO: 947003 - RNA, 22 nt, Human
ccuuucucuuggauaccgauug

SEQ ID NO: 947004 - RNA, 22 nt, Human
aaagcagagguugcagugagcu

SEQ ID NO: 947005 - RNA, 22 nt, Human
aggcccugagcauccgagggca

SEQ ID NO: 947006 - RNA, 22 nt, Human
gauuucuuuaugaaguacagaa

SEQ ID NO: 947007 - RNA, 22 nt, Human
ucugccuggauuuuggaaagcu

SEQ ID NO: 947008 - RNA, 22 nt, Human
cugcagagcuaggcugagugaa

SEQ ID NO: 947009 - RNA, 22 nt, Human
ccgggccucgggacaccgggua

SEQ ID NO: 947010 - RNA, 22 nt, Human
aaguccaugaucaagauguggc

SEQ ID NO: 947011 - RNA, 22 nt, Human
uggaucucggcaaugcgggacu

SEQ ID NO: 947012 - RNA, 22 nt, Human
uguacauacauagauauacaca

SEQ ID NO: 947013 - RNA, 22 nt, Human
aaggcacuuaacgugggaggau

SEQ ID NO: 947014 - RNA, 22 nt, Human
cuggagagaccgaaagaggcug

SEQ ID NO: 947015 - RNA, 20 nt, Human
cacaagagaauacacacugg

SEQ ID NO: 947016 - RNA, 22 nt, Human
gcuggggagcuagaccucagca

SEQ ID NO: 947017 - RNA, 20 nt, Human
gccuggaggcaaugggaaga

SEQ ID NO: 947018 - RNA, 22 nt, Human
uggcagucuggguuggcaguua

SEQ ID NO: 947019 - RNA, 22 nt, Human
cuuaggauuuaauuucagacuc

SEQ ID NO: 947020 - RNA, 22 nt, Human
cuuuagugguauuuuagcaagu

SEQ ID NO: 947021 - RNA, 22 nt, Human
ggcucuggguucugcaaugcgu

SEQ ID NO: 947022 - RNA, 22 nt, Human
uaaauguguuguggaugaaguu

SEQ ID NO: 947023 - RNA, 22 nt, Human
ucucagggugaggaaagaauuu

SEQ ID NO: 947024 - RNA, 21 nt, Human
gagccuucccucugcccuuuc

SEQ ID NO: 947025 - RNA, 22 nt, Human
cacugaagaugcgacuagugcu

SEQ ID NO: 947026 - RNA, 22 nt, Human
cugucuguucagauucauuacu

SEQ ID NO: 947027 - RNA, 22 nt, Human
ugggcuggcugaacuucaaccu

SEQ ID NO: 947028 - RNA, 22 nt, Human
agggcagaaaucgauuacaccu

SEQ ID NO: 947029 - RNA, 22 nt, Human
ccaggagcaaagaucacuggga

SEQ ID NO: 947030 - RNA, 22 nt, Human
uaaaauagcaugugcagugaaa

SEQ ID NO: 947031 - RNA, 22 nt, Human
uguggaaaagaauaagggagau

SEQ ID NO: 947032 - RNA, 22 nt, Human
uccuuagagauacugucuugaa

SEQ ID NO: 947033 - RNA, 22 nt, Human
uaaggucauggugaauaauaag

SEQ ID NO: 947034 - RNA, 22 nt, Human
auuguggcuagacagucacaau

SEQ ID NO: 947035 - RNA, 22 nt, Human
agccauggcgccacuagaggga

SEQ ID NO: 947036 - RNA, 22 nt, Human
aguucucauugcaugagacaga

SEQ ID NO: 947037 - RNA, 23 nt, Human
auacauacagucuuacugacuuu

SEQ ID NO: 947038 - RNA, 22 nt, Human
cuggcaguggggccucaguguu

SEQ ID NO: 947039 - RNA, 23 nt, Human
uggugccucagaagcagugggcu

SEQ ID NO: 947040 - RNA, 22 nt, Human
gagggggcgugcaaggcuccgc

SEQ ID NO: 947041 - RNA, 22 nt, Human
aagugagauuauauguacggga

SEQ ID NO: 947042 - RNA, 17 nt, Human
caaggccagcaucuuca

SEQ ID NO: 947043 - RNA, 22 nt, Human
caguucuuauuuggccaguguc

SEQ ID NO: 947044 - RNA, 22 nt, Human
ucaagagauugaauaauaacug

SEQ ID NO: 947045 - RNA, 22 nt, Human
cuggaagaggaagccagcugga

SEQ ID NO: 947046 - RNA, 22 nt, Human
gguguccuacagggccgcaggc

SEQ ID NO: 947047 - RNA, 22 nt, Human
ucuggcuuucauuuguuuaaag

SEQ ID NO: 947048 - RNA, 22 nt, Human
gccagugugcaagaggccacca

SEQ ID NO: 947049 - RNA, 22 nt, Human
aggaagcuuagugaaaggacca

SEQ ID NO: 947050 - RNA, 22 nt, Human
agcgagggaggucugaggacag

SEQ ID NO: 947051 - RNA, 19 nt, Human
aucagcaagguaggaugug

SEQ ID NO: 947052 - RNA, 22 nt, Human
ugugcucugaagagugcauguc

SEQ ID NO: 947053 - RNA, 22 nt, Human
gaggaaccaaaucagcuugcac

SEQ ID NO: 947054 - RNA, 22 nt, Human
cuggcucauuuuagcaucaggu

SEQ ID NO: 947055 - RNA, 22 nt, Human
cagagaccccuggcaugguggu

SEQ ID NO: 947056 - RNA, 22 nt, Human
aaaugcacaauaaaguaaaggc

SEQ ID NO: 947057 - RNA, 22 nt, Human
gcagaggccuagguggaaggcc

SEQ ID NO: 947058 - RNA, 22 nt, Human
cagaugaggcaaccucauugcu

SEQ ID NO: 947059 - RNA, 22 nt, Human
uggggacauagccagucuggcu

SEQ ID NO: 947060 - RNA, 20 nt, Human
aaacauucauguacaaguga

SEQ ID NO: 947061 - RNA, 22 nt, Human
aagcagccuggacuugggcugg

SEQ ID NO: 947062 - RNA, 22 nt, Human
cugagagugcucuuugauguca

SEQ ID NO: 947063 - RNA, 22 nt, Human
augcacccagugucuggacuau

SEQ ID NO: 947064 - RNA, 22 nt, Human
gccuggagcucuccacuugggg

SEQ ID NO: 947065 - RNA, 22 nt, Human
ucacaacucuuuccauuuaaua

SEQ ID NO: 947066 - RNA, 22 nt, Human
guguguccaggcgggagucaag

SEQ ID NO: 947067 - RNA, 22 nt, Human
gugcauguuaaugguguacaaa

SEQ ID NO: 947068 - RNA, 22 nt, Human
uagugcuuuaggccugaguguc

SEQ ID NO: 947069 - RNA, 22 nt, Human
ggcagcugagcauggcuaccuu

SEQ ID NO: 947070 - RNA, 22 nt, Human
caaggccaguuucuccuaguca

SEQ ID NO: 947071 - RNA, 20 nt, Human
ggccugagcauggcuggcag

SEQ ID NO: 947072 - RNA, 22 nt, Human
gugggaugcaguggugaguggc

SEQ ID NO: 947073 - RNA, 22 nt, Human
uggccacaugcgucugugaggc

SEQ ID NO: 947074 - RNA, 22 nt, Human
gaggugggaugugugugcuacu

SEQ ID NO: 947075 - RNA, 22 nt, Human
gagaggaguagacacuuugguu

SEQ ID NO: 947076 - RNA, 22 nt, Human
uuaauguggaaagcucuugagu

SEQ ID NO: 947077 - RNA, 23 nt, Human
aacaauagguuuuggcagaauag

SEQ ID NO: 947078 - RNA, 20 nt, Human
ccagcugagccaaggggaga

SEQ ID NO: 947079 - RNA, 22 nt, Human
ccucccuuggccauagccagcc

SEQ ID NO: 947080 - RNA, 22 nt, Human
cagucccaguuugagacucugg

SEQ ID NO: 947081 - RNA, 17 nt, Human
ugcauuguuggaaauuu

SEQ ID NO: 947082 - RNA, 22 nt, Human
uucuacaauaugaauaaugaag

SEQ ID NO: 947083 - RNA, 22 nt, Human
gcugguuaggugagggugcgcc

SEQ ID NO: 947084 - RNA, 23 nt, Human
uaagaacagacaagcauuuacau

SEQ ID NO: 947085 - RNA, 22 nt, Human
augaggcaucugcagucacuag

SEQ ID NO: 947086 - RNA, 22 nt, Human
ggcucugcuggauugaggccag

SEQ ID NO: 947087 - RNA, 22 nt, Human
gagcucagcccaaagagcagug

SEQ ID NO: 947088 - RNA, 22 nt, Human
ucugagagguuaagcaauuuga

SEQ ID NO: 947089 - RNA, 22 nt, Human
ugcuauugugaacagugccaca

SEQ ID NO: 947090 - RNA, 22 nt, Human
augaagauaagaccaggcugga

SEQ ID NO: 947091 - RNA, 22 nt, Human
aaucaguuguccaaaguucaca

SEQ ID NO: 947092 - RNA, 22 nt, Human
acuugggucaaguagcucacag

SEQ ID NO: 947093 - RNA, 22 nt, Human
gcuucauuacugacagucugug

SEQ ID NO: 947094 - RNA, 22 nt, Human
ccugggcuugcaucugugcugg

SEQ ID NO: 947095 - RNA, 22 nt, Human
ucuguucacugagcaauggcaa

SEQ ID NO: 947096 - RNA, 22 nt, Human
gggagggaucugcuaggcaaug

SEQ ID NO: 947097 - RNA, 22 nt, Human
ggcugucucugugacugccacc

SEQ ID NO: 947098 - RNA, 22 nt, Human
gagcuuccacucuagaaggagu

SEQ ID NO: 947099 - RNA, 22 nt, Human
agcagcugguaggaguggccac

SEQ ID NO: 947100 - RNA, 22 nt, Human
gcagcugcaauaggcaucaagc

SEQ ID NO: 947101 - RNA, 22 nt, Human
aucuggcuccuacacuugaaga

SEQ ID NO: 947102 - RNA, 22 nt, Human
gggcagccucggugccugcugc

SEQ ID NO: 947103 - RNA, 22 nt, Human
uccuuuuuaagucguuguggua

SEQ ID NO: 947104 - RNA, 22 nt, Human
uacucagagucauugcccuucu

SEQ ID NO: 947105 - RNA, 22 nt, Human
uugaaucucuugaaucucuguu

SEQ ID NO: 947106 - RNA, 22 nt, Human
ugaggccacuuccccacagccc

SEQ ID NO: 947107 - RNA, 22 nt, Human
agccacagcauguguguaugua

SEQ ID NO: 947108 - RNA, 22 nt, Human
aauuaacaaauguagcugugau

SEQ ID NO: 947109 - RNA, 22 nt, Human
auucuguauuucuaauaagauc

SEQ ID NO: 947110 - RNA, 22 nt, Human
ggguggcuccuaugggcauagc

SEQ ID NO: 947111 - RNA, 22 nt, Human
auuauaaagaacaugugugugg

SEQ ID NO: 947112 - RNA, 22 nt, Human
ggugggcacccgagacuggauc

SEQ ID NO: 947113 - RNA, 22 nt, Human
uggaagagacacuuacauucag

SEQ ID NO: 947114 - RNA, 22 nt, Human
ucucagagccuaacuaaccuaa

SEQ ID NO: 947115 - RNA, 22 nt, Human
cagggaguuuuuguuccucuag

SEQ ID NO: 947116 - RNA, 22 nt, Human
aaguauuucguucugaaaaagu

SEQ ID NO: 947117 - RNA, 22 nt, Human
gcuggcaguaaaggguuuggca

SEQ ID NO: 947118 - RNA, 22 nt, Human
uuacaucuaaacugugaacaau

SEQ ID NO: 947119 - RNA, 22 nt, Human
cuggugucugcucccucacagc

SEQ ID NO: 947120 - RNA, 20 nt, Human
cauuugaaucuccauucugc

SEQ ID NO: 947121 - RNA, 19 nt, Human
ugagaaggcaguggggagc

SEQ ID NO: 947122 - RNA, 22 nt, Human
ugaaagcacaaguucuaacagg

SEQ ID NO: 947123 - RNA, 22 nt, Human
auucacaaguucuagggauuag

SEQ ID NO: 947124 - RNA, 22 nt, Human
gcucccacaaccuucuugcucc

SEQ ID NO: 947125 - RNA, 22 nt, Human
ugcuucagaggaaaggcaaaag

SEQ ID NO: 947126 - RNA, 22 nt, Human
uggcucagauaauucaaggggc

SEQ ID NO: 947127 - RNA, 22 nt, Human
guggccaagagauaaaauugug

SEQ ID NO: 947128 - RNA, 22 nt, Human
acagaaauuagcagugaguuua

SEQ ID NO: 947129 - RNA, 22 nt, Human
cuucaagaagacagcagagcau

SEQ ID NO: 947130 - RNA, 22 nt, Human
ugucugucugcaagccagaaag

SEQ ID NO: 947131 - RNA, 22 nt, Human
cccuguccuggaugggagcacu

SEQ ID NO: 947132 - RNA, 22 nt, Human
cauucugugauucuaaaucccu

SEQ ID NO: 947133 - RNA, 22 nt, Human
auaacagaugugaagugcuaau

SEQ ID NO: 947134 - RNA, 22 nt, Human
acugugcuuucucuggaggcau

SEQ ID NO: 947135 - RNA, 22 nt, Human
agugcuuuccuucuugugacau

SEQ ID NO: 947136 - RNA, 22 nt, Human
cacuuaagcaguuaauuuaucu

SEQ ID NO: 947137 - RNA, 22 nt, Human
acuccagggcuccaucccuugu

SEQ ID NO: 947138 - RNA, 22 nt, Human
ggcagugaaaaaguauguuucc

SEQ ID NO: 947139 - RNA, 22 nt, Human
uaaagcacauaucuuacaauaa

SEQ ID NO: 947140 - RNA, 22 nt, Human
uuauuuauuguguaccuacugu

SEQ ID NO: 947141 - RNA, 22 nt, Human
aagguacaguuuuaagaauaag

SEQ ID NO: 947142 - RNA, 22 nt, Human
ugaggccaggaucccaggcucu

SEQ ID NO: 947143 - RNA, 21 nt, Human
cggccaaauuccuccuaggga

SEQ ID NO: 947144 - RNA, 22 nt, Human
agugcauaaaggaaaaacugaa

SEQ ID NO: 947145 - RNA, 22 nt, Human
uggugccuugggccuacagcgc

SEQ ID NO: 947146 - RNA, 22 nt, Human
cuguauuuaguuaaaaugcuaa

SEQ ID NO: 947147 - RNA, 22 nt, Human
aaaagguuuugaguacaaauau

SEQ ID NO: 947148 - RNA, 22 nt, Human
agagugcagauaagagaauguu

SEQ ID NO: 947149 - RNA, 22 nt, Human
uuggccaaagcucaccagugcu

SEQ ID NO: 947150 - RNA, 22 nt, Human
cuagucacucagcacugacaaa

SEQ ID NO: 947151 - RNA, 22 nt, Human
caggcacuagcagaaugaggcu

SEQ ID NO: 947152 - RNA, 22 nt, Human
uucauugugaacacauucugcc

SEQ ID NO: 947153 - RNA, 17 nt, Human
aggcugcugggccaggg

SEQ ID NO: 947154 - RNA, 22 nt, Human
ugcagggccgcuggaggucaug

SEQ ID NO: 947155 - RNA, 22 nt, Human
guuuuauaauugcuucauaaga

SEQ ID NO: 947156 - RNA, 21 nt, Human
ugcauaaagaaauacaaauac

SEQ ID NO: 947157 - RNA, 15 nt, Human
cagucccagggaccc

SEQ ID NO: 947158 - RNA, 22 nt, Human
ucaggcugguggucagauggcu

SEQ ID NO: 947159 - RNA, 22 nt, Human
uaaauguguuagucaugguuuu

SEQ ID NO: 947160 - RNA, 22 nt, Human
auccaggccuugaaguaccagu

SEQ ID NO: 947161 - RNA, 22 nt, Human
aaguguguauuguuuaugcugc

SEQ ID NO: 947162 - RNA, 22 nt, Human
agggugguucuuuuaguggaag

SEQ ID NO: 947163 - RNA, 22 nt, Human
uccagugguaguaaagaggucu

SEQ ID NO: 947164 - RNA, 20 nt, Human
ggcaggcuuuauauggaggg

SEQ ID NO: 947165 - RNA, 22 nt, Human
uccaggagaaaacugacggugg

SEQ ID NO: 947166 - RNA, 22 nt, Human
ggcucagguugggucacaugac

SEQ ID NO: 947167 - RNA, 22 nt, Human
aaauauguaaccaaggugaagu

SEQ ID NO: 947168 - RNA, 22 nt, Human
agugaggcuaauaggcaauggu

SEQ ID NO: 947169 - RNA, 22 nt, Human
gcagggucgcucuaggagauca

SEQ ID NO: 947170 - RNA, 22 nt, Human
ugugucagagguagagauggca

SEQ ID NO: 947171 - RNA, 22 nt, Human
auguagcaugaggcacugugcc

SEQ ID NO: 947172 - RNA, 22 nt, Human
agagaagacuuacagccacagu

SEQ ID NO: 947173 - RNA, 21 nt, Human
cauuaaguaccagggcacugu

SEQ ID NO: 947174 - RNA, 20 nt, Human
uacugggcaagcccacagac

SEQ ID NO: 947175 - RNA, 19 nt, Human
aggucauugauagugcagg

SEQ ID NO: 947176 - RNA, 22 nt, Human
gcaugucaugucauguaggaau

SEQ ID NO: 947177 - RNA, 22 nt, Human
aaaacaguuauaaacagaguca

SEQ ID NO: 947178 - RNA, 22 nt, Human
agcagccagaaagggcagucga

SEQ ID NO: 947179 - RNA, 22 nt, Human
uagggcaggugaagaaaagcua

SEQ ID NO: 947180 - RNA, 22 nt, Human
aauguugagcuugaaaguaggu

SEQ ID NO: 947181 - RNA, 22 nt, Human
auuguauuagcacaauacaauu

SEQ ID NO: 947182 - RNA, 22 nt, Human
aggcagcuuuaacugguaguag

SEQ ID NO: 947183 - RNA, 22 nt, Human
cccuggaguccuggcaguugau

SEQ ID NO: 947184 - RNA, 22 nt, Human
agcuacccgaggacaggcuaag

SEQ ID NO: 947185 - RNA, 22 nt, Human
agacucugcuaagaauauaauu

SEQ ID NO: 947186 - RNA, 21 nt, Human
gagugcaggucugaugccauc

SEQ ID NO: 947187 - RNA, 17 nt, Human
agauggcaggaggcaga

SEQ ID NO: 947188 - RNA, 22 nt, Human
aaggcacuuuucuaaagaccuu

SEQ ID NO: 947189 - RNA, 22 nt, Human
uuugggcaguagauguaucacu

SEQ ID NO: 947190 - RNA, 20 nt, Human
cauuggacuuggcuucaugg

SEQ ID NO: 947191 - RNA, 22 nt, Human
uugcugaaaucuaugacauccu

SEQ ID NO: 947192 - RNA, 23 nt, Human
aggagaagagauuuccacaugca

SEQ ID NO: 947193 - RNA, 22 nt, Human
gugcuuuuaaaggcaauuagua

SEQ ID NO: 947194 - RNA, 22 nt, Human
guagaagugaugucauguuaua

SEQ ID NO: 947195 - RNA, 18 nt, Human
uggccuggagacaacucu

SEQ ID NO: 947196 - RNA, 17 nt, Human
uccuucagugccucugc

SEQ ID NO: 947197 - RNA, 22 nt, Human
gugcauauguguguauacaaac

SEQ ID NO: 947198 - RNA, 22 nt, Human
caagccugucucaccagugcua

SEQ ID NO: 947199 - RNA, 22 nt, Human
cucagaguccccaguggguuug

SEQ ID NO: 947200 - RNA, 22 nt, Human
uuauuuucuccucagaaagugg

SEQ ID NO: 947201 - RNA, 22 nt, Human
uuuaauguucaucucaaaggau

SEQ ID NO: 947202 - RNA, 22 nt, Human
caaagguaguauauauauuguu

SEQ ID NO: 947203 - RNA, 22 nt, Human
acacaguauuacaauaggugcu

SEQ ID NO: 947204 - RNA, 22 nt, Human
agggauguaaauucuucuucuu

SEQ ID NO: 947205 - RNA, 22 nt, Human
uccagagguauguagagaguau

SEQ ID NO: 947206 - RNA, 22 nt, Human
uuucacaauuuuaaggagcaaa

SEQ ID NO: 947207 - RNA, 22 nt, Human
gggauggacuuggggacuccag

SEQ ID NO: 947208 - RNA, 19 nt, Human
caggaaugagguaauggcu

SEQ ID NO: 947209 - RNA, 19 nt, Human
acuggcagcuguagucugu

SEQ ID NO: 947210 - RNA, 22 nt, Human
uguaugugcuugagaagguggg

SEQ ID NO: 947211 - RNA, 17 nt, Human
uugaacugcugagucag

SEQ ID NO: 947212 - RNA, 21 nt, Human
accagcaggagaucagaagga

SEQ ID NO: 947213 - RNA, 22 nt, Human
cugggaggugcagcaaaaauca

SEQ ID NO: 947214 - RNA, 22 nt, Human
ccuggagcuuuuccauccugga

SEQ ID NO: 947215 - RNA, 22 nt, Human
ugcugcucuucaccauggccuc

SEQ ID NO: 947216 - RNA, 22 nt, Human
gcagacagacugcagugauuuu

SEQ ID NO: 947217 - RNA, 22 nt, Human
ugccaggauauaagagugcgau

SEQ ID NO: 947218 - RNA, 22 nt, Human
auccaugaagguacuucucagg

SEQ ID NO: 947219 - RNA, 22 nt, Human
acuuugaaacuaaaauucauua

SEQ ID NO: 947220 - RNA, 22 nt, Human
ugggagcaguugugaagcucag

SEQ ID NO: 947221 - RNA, 22 nt, Human
uuuuccucaggaaugcuaagcu

SEQ ID NO: 947222 - RNA, 22 nt, Human
agucuugcucuugcaucugcuu

SEQ ID NO: 947223 - RNA, 22 nt, Human
cuggcagcccaaccuagagucu

SEQ ID NO: 947224 - RNA, 22 nt, Human
cugacuguaauucuguucuuaa

SEQ ID NO: 947225 - RNA, 22 nt, Human
augcacuacuagaugcaaaagu

SEQ ID NO: 947226 - RNA, 17 nt, Human
ucaggcugugccuggua

SEQ ID NO: 947227 - RNA, 22 nt, Human
aggaucuugcuguagaggauag

SEQ ID NO: 947228 - RNA, 22 nt, Human
caugggaggucugcaaggugcu

SEQ ID NO: 947229 - RNA, 22 nt, Human
cuagaaauauuuuacagucaag

SEQ ID NO: 947230 - RNA, 22 nt, Human
uagcuuuaccauagaagaguau

SEQ ID NO: 947231 - RNA, 22 nt, Human
uuccagggcuaauuccugugga

SEQ ID NO: 947232 - RNA, 22 nt, Human
uccuuucaccaaaaaguguugu

SEQ ID NO: 947233 - RNA, 22 nt, Human
cccagacuccucuggcuggugg

SEQ ID NO: 947234 - RNA, 22 nt, Human
cuuguaauuauaauguacuguu

SEQ ID NO: 947235 - RNA, 22 nt, Human
gacaauaaaaugaucuuacagu

SEQ ID NO: 947236 - RNA, 22 nt, Human
uuuccauguuggugaaaugagg

SEQ ID NO: 947237 - RNA, 23 nt, Human
ucuccuggcugcacuguggccac

SEQ ID NO: 947238 - RNA, 15 nt, Human
aaucuggcggcaagu

SEQ ID NO: 947239 - RNA, 22 nt, Human
guaucuuuuacaccaggaaauu

SEQ ID NO: 947240 - RNA, 22 nt, Human
uguauacauuuaacuagauaga

SEQ ID NO: 947241 - RNA, 21 nt, Human
uucucagagucuauuacaguu

SEQ ID NO: 947242 - RNA, 22 nt, Human
gguuugaacagcuuuggagaag

SEQ ID NO: 947243 - RNA, 22 nt, Human
cuacuucuaaguacauggugau

SEQ ID NO: 947244 - RNA, 22 nt, Human
auauuucaugggguuccauacu

SEQ ID NO: 947245 - RNA, 22 nt, Human
agaaagaacguugguuaucuua

SEQ ID NO: 947246 - RNA, 22 nt, Human
gccugccuuuguaugacccuga

SEQ ID NO: 947247 - RNA, 22 nt, Human
cagggccaccguguuugcugcu

SEQ ID NO: 947248 - RNA, 22 nt, Human
ugugaugguucacugggcauga

SEQ ID NO: 947249 - RNA, 22 nt, Human
ccagugcuaagguagccucugc

SEQ ID NO: 947250 - RNA, 22 nt, Human
auucaagagcccauguuuccug

SEQ ID NO: 947251 - RNA, 22 nt, Human
uuguaaaugaccuuuucuaauu

SEQ ID NO: 947252 - RNA, 22 nt, Human
gccugccuggagcuugagguga

SEQ ID NO: 947253 - RNA, 22 nt, Human
agcaguagugauggccccugag

SEQ ID NO: 947254 - RNA, 22 nt, Human
auaagagcuagucuuuuccuug

SEQ ID NO: 947255 - RNA, 21 nt, Human
aggcagaaagagcccaggcug

SEQ ID NO: 947256 - RNA, 22 nt, Human
aagucuuacauaaacaggaaau

SEQ ID NO: 947257 - RNA, 22 nt, Human
ucagagugugacuuggucauga

SEQ ID NO: 947258 - RNA, 22 nt, Human
acaguuauucuuuaugcaacca

SEQ ID NO: 947259 - RNA, 19 nt, Human
gccugagccagccaugcaa

SEQ ID NO: 947260 - RNA, 22 nt, Human
guccucuguagggcugggccac

SEQ ID NO: 947261 - RNA, 22 nt, Human
aaggccagaguacuagaggcug

SEQ ID NO: 947262 - RNA, 22 nt, Human
uagggcaggggaggaaucugaa

SEQ ID NO: 947263 - RNA, 22 nt, Human
aggcacugacagauucuguguc

SEQ ID NO: 947264 - RNA, 22 nt, Human
cacaauguauauguauaucaaa

SEQ ID NO: 947265 - RNA, 22 nt, Human
agacuuucuugaccuaguuaau

SEQ ID NO: 947266 - RNA, 22 nt, Human
acauacuuuuuaaaagauugcu

SEQ ID NO: 947267 - RNA, 22 nt, Human
aagauacugaugauguaggcua

SEQ ID NO: 947268 - RNA, 22 nt, Human
uugcagcuucuaccacuguuuc

SEQ ID NO: 947269 - RNA, 22 nt, Human
ucucugaguaagugacaguuca

SEQ ID NO: 947270 - RNA, 22 nt, Human
uuagggcuuuucugaauaggcc

SEQ ID NO: 947271 - RNA, 22 nt, Human
caguuuuucaaaauuacaugau

SEQ ID NO: 947272 - RNA, 22 nt, Human
aggggcugggacagagccaagc

SEQ ID NO: 947273 - RNA, 21 nt, Human
gauuuuaaagagacugccaca

SEQ ID NO: 947274 - RNA, 22 nt, Human
cuucuggggauggagcccagaa

SEQ ID NO: 947275 - RNA, 22 nt, Human
caggaugggugucggccagcac

SEQ ID NO: 947276 - RNA, 22 nt, Human
aauuucaauuacuuuugcacca

SEQ ID NO: 947277 - RNA, 22 nt, Human
cagcuuugcccuuugcccaauc

SEQ ID NO: 947278 - RNA, 22 nt, Human
agaaauguauucuguauguuuu

SEQ ID NO: 947279 - RNA, 22 nt, Human
gagaggaguuacuauuuccgag

SEQ ID NO: 947280 - RNA, 22 nt, Human
agaauucugacaauagaauugg

SEQ ID NO: 947281 - RNA, 22 nt, Human
guugaaagaugucuugguuccc

SEQ ID NO: 947282 - RNA, 22 nt, Human
gggccuggggacaccaccauga

SEQ ID NO: 947283 - RNA, 23 nt, Human
uguaaaaugggguaguguuacca

SEQ ID NO: 947284 - RNA, 22 nt, Human
cucaggggaccuggcuccgagu

SEQ ID NO: 947285 - RNA, 22 nt, Human
ugggaggaucgcuugagcccag

SEQ ID NO: 947286 - RNA, 22 nt, Human
agcagccacacgccuccuucuc

SEQ ID NO: 947287 - RNA, 22 nt, Human
cugucucucuaggacacugggg

SEQ ID NO: 947288 - RNA, 22 nt, Human
ugccugucuuggaguccuggcc

SEQ ID NO: 947289 - RNA, 19 nt, Human
ucucaauguucagaaagcu

SEQ ID NO: 947290 - RNA, 22 nt, Human
gaggggcugggcagucccugga

SEQ ID NO: 947291 - RNA, 22 nt, Human
aggccagagaggggaccagccu

SEQ ID NO: 947292 - RNA, 22 nt, Human
ugcagcuucuccaucuccuugu

SEQ ID NO: 947293 - RNA, 22 nt, Human
uaacagaauccuguuauugcca

SEQ ID NO: 947294 - RNA, 18 nt, Human
cugcuuugccuucauucc

SEQ ID NO: 947295 - RNA, 20 nt, Human
uuggccaaaucuuagucaug

SEQ ID NO: 947296 - RNA, 22 nt, Human
aucuuguuaaaaugcagaaacu

SEQ ID NO: 947297 - RNA, 22 nt, Human
uaugcacacauuagcacagggu

SEQ ID NO: 947298 - RNA, 22 nt, Human
uccaugagcuagggauucauca

SEQ ID NO: 947299 - RNA, 22 nt, Human
cugggagcugaggcugacgcug

SEQ ID NO: 947300 - RNA, 22 nt, Human
gggccuccggggugagcugugg

SEQ ID NO: 947301 - RNA, 22 nt, Human
agccuauuccaggaugagcuca

SEQ ID NO: 947302 - RNA, 22 nt, Human
aguuggcauuuuauuuaaguau

SEQ ID NO: 947303 - RNA, 22 nt, Human
acuguucauccuuuuugaacaa

SEQ ID NO: 947304 - RNA, 22 nt, Human
ccuggcugucguuuugugaaau

SEQ ID NO: 947305 - RNA, 22 nt, Human
aaacaaguguaaacuagucugu

SEQ ID NO: 947306 - RNA, 22 nt, Human
cuccaugaauuugagcuuugug

SEQ ID NO: 947307 - RNA, 22 nt, Human
acaugucaauuuaguacucuua

SEQ ID NO: 947308 - RNA, 21 nt, Human
aguguccuugaucuugccuug

SEQ ID NO: 947309 - RNA, 22 nt, Human
cucuuucugauucgcugggacc

SEQ ID NO: 947310 - RNA, 22 nt, Human
gggcugugagaguggggcugcu

SEQ ID NO: 947311 - RNA, 22 nt, Human
gcaaggagacuguagggccaag

SEQ ID NO: 947312 - RNA, 22 nt, Human
ucuuucucucuaaucaagcaca

SEQ ID NO: 947313 - RNA, 22 nt, Human
uaaaauguagcuucuaggcugg

SEQ ID NO: 947314 - RNA, 22 nt, Human
auaaugaggauuugcauauuag

SEQ ID NO: 947315 - RNA, 22 nt, Human
ucaggggaaaucucucagcgaa

SEQ ID NO: 947316 - RNA, 22 nt, Human
ucagaccauccugcuguuagug

SEQ ID NO: 947317 - RNA, 22 nt, Human
agcugccugcuuaugagcucca

SEQ ID NO: 947318 - RNA, 22 nt, Human
uguucauuuggcccuuuuguau

SEQ ID NO: 947319 - RNA, 22 nt, Human
aaaaauguuaucuacuguccga

SEQ ID NO: 947320 - RNA, 22 nt, Human
ucagagugaggcccagcaaucu

SEQ ID NO: 947321 - RNA, 22 nt, Human
acagggcagagggcaguuggua

SEQ ID NO: 947322 - RNA, 22 nt, Human
cugggagcucagcccuggggug

SEQ ID NO: 947323 - RNA, 22 nt, Human
ccuuuugcucucccauccagaa

SEQ ID NO: 947324 - RNA, 22 nt, Human
ugauggcuaucccuggaagggc

SEQ ID NO: 947325 - RNA, 22 nt, Human
aaaucacuguuauugaucuuaa

SEQ ID NO: 947326 - RNA, 22 nt, Human
uuucuuauacuauauugucauc

SEQ ID NO: 947327 - RNA, 22 nt, Human
ggcagagacuggguuggcagag

SEQ ID NO: 947328 - RNA, 22 nt, Human
gccagcagguggagagaucaag

SEQ ID NO: 947329 - RNA, 22 nt, Human
ucagaaaagguagcugugacaa

SEQ ID NO: 947330 - RNA, 22 nt, Human
caggcccugggcaggaucagcc

SEQ ID NO: 947331 - RNA, 22 nt, Human
uaucuguuugcucacagguguu

SEQ ID NO: 947332 - RNA, 22 nt, Human
gagcacagcuggagguagcauu

SEQ ID NO: 947333 - RNA, 22 nt, Human
guugaaauccuaacccccuagu

SEQ ID NO: 947334 - RNA, 22 nt, Human
cuggccagacuacacaugugug

SEQ ID NO: 947335 - RNA, 22 nt, Human
auuucagcccaguaugagcccc

SEQ ID NO: 947336 - RNA, 22 nt, Human
ggggcuggcucacuaagagacu

SEQ ID NO: 947337 - RNA, 22 nt, Human
cuuuggcagccucugcuauuga

SEQ ID NO: 947338 - RNA, 22 nt, Human
uacauggguagguuaagucaua

SEQ ID NO: 947339 - RNA, 22 nt, Human
ucugccacuagugguuaccuua

SEQ ID NO: 947340 - RNA, 22 nt, Human
cccuugggugccagccacaagu

SEQ ID NO: 947341 - RNA, 22 nt, Human
auggcagccuguggacagucaa

SEQ ID NO: 947342 - RNA, 22 nt, Human
gagcagcucugggugacccagu

SEQ ID NO: 947343 - RNA, 22 nt, Human
ugcuucaggaagaaacgccagg

SEQ ID NO: 947344 - RNA, 22 nt, Human
auuucccaugugaaucaauugg

SEQ ID NO: 947345 - RNA, 22 nt, Human
uuccauaacugaccgaaugcau

SEQ ID NO: 947346 - RNA, 22 nt, Human
gcagggugugucucauacaguu

SEQ ID NO: 947347 - RNA, 22 nt, Human
acaccagggccuagccagggcg

SEQ ID NO: 947348 - RNA, 22 nt, Human
ggccacaacuugcuccuagccc

SEQ ID NO: 947349 - RNA, 22 nt, Human
acuggacagaggaaauauggag

SEQ ID NO: 947350 - RNA, 22 nt, Human
aucuucaacuugaucauuugaa

SEQ ID NO: 947351 - RNA, 22 nt, Human
auuugcuucugugaaaucaagu

SEQ ID NO: 947352 - RNA, 22 nt, Human
agccucugacugucagcaaggu

SEQ ID NO: 947353 - RNA, 22 nt, Human
ccucucuguaagggucccuccc

SEQ ID NO: 947354 - RNA, 22 nt, Human
acuugggaguucuggaagccug

SEQ ID NO: 947355 - RNA, 22 nt, Human
cccaggaaugaggggcggaggc

SEQ ID NO: 947356 - RNA, 22 nt, Human
aggcugcuuucauggccgcccc

SEQ ID NO: 947357 - RNA, 22 nt, Human
uccagcagaccaucaaggcuca

SEQ ID NO: 947358 - RNA, 22 nt, Human
ccugggcaggccggacgcuggg

SEQ ID NO: 947359 - RNA, 22 nt, Human
gcuggccugggcagccugucgg

SEQ ID NO: 947360 - RNA, 22 nt, Human
aacugcuguggccuaguacuua

SEQ ID NO: 947361 - RNA, 22 nt, Human
caggcagcugacugucagauau

SEQ ID NO: 947362 - RNA, 22 nt, Human
ugguuuugcuaaaauagaaaga

SEQ ID NO: 947363 - RNA, 23 nt, Human
auugaugacuugauuacacuuuu

SEQ ID NO: 947364 - RNA, 23 nt, Human
gccucugcucugcguuggggacu

SEQ ID NO: 947365 - RNA, 22 nt, Human
uauaguacauggaaucuucaua

SEQ ID NO: 947366 - RNA, 22 nt, Human
auuaaagaaacccagcauguga

SEQ ID NO: 947367 - RNA, 22 nt, Human
gccaggguggcagaaggcccca

SEQ ID NO: 947368 - RNA, 22 nt, Human
uggccacccagcugacgccuuc

SEQ ID NO: 947369 - RNA, 17 nt, Human
acacagccagguucucc

SEQ ID NO: 947370 - RNA, 22 nt, Human
accugagaaugggggcaugugu

SEQ ID NO: 947371 - RNA, 22 nt, Human
cauugcacuccaucuugggcaa

SEQ ID NO: 947372 - RNA, 22 nt, Human
gaggcugaggguuagagaguca

SEQ ID NO: 947373 - RNA, 22 nt, Human
acccaggaugauaauguucaca

SEQ ID NO: 947374 - RNA, 22 nt, Human
ccugccagcccgcguucaugcc

SEQ ID NO: 947375 - RNA, 22 nt, Human
cagagggcucaguccugcugga

SEQ ID NO: 947376 - RNA, 22 nt, Human
ucagccacuacccaccuuaaca

SEQ ID NO: 947377 - RNA, 22 nt, Human
ucagaagcaaacaucacucuag

SEQ ID NO: 947378 - RNA, 22 nt, Human
ggcagcucacugauuagcaauu

SEQ ID NO: 947379 - RNA, 22 nt, Human
gggcagcucugcccaucagagg

SEQ ID NO: 947380 - RNA, 22 nt, Human
uggcagcuccuggggccagcac

SEQ ID NO: 947381 - RNA, 22 nt, Human
aagaacauuuuguagaaugaca

SEQ ID NO: 947382 - RNA, 22 nt, Human
ggcucugccugcccagcagcac

SEQ ID NO: 947383 - RNA, 22 nt, Human
cccagccugucuuucccaauga

SEQ ID NO: 947384 - RNA, 22 nt, Human
cauaagaaauaaugaugaugac

SEQ ID NO: 947385 - RNA, 22 nt, Human
ggaggaccccagcagcucccca

SEQ ID NO: 947386 - RNA, 22 nt, Human
uucacagggccacuggcaggag

SEQ ID NO: 947387 - RNA, 22 nt, Human
cacaauuuguuuuaucaguauu

SEQ ID NO: 947388 - RNA, 22 nt, Human
augaggauuaacuguugucaua

SEQ ID NO: 947389 - RNA, 22 nt, Human
ucaggggcccuucccucagcag

SEQ ID NO: 947390 - RNA, 22 nt, Human
aagccgaggccacacagcagga

SEQ ID NO: 947391 - RNA, 22 nt, Human
ggccugccucacagucagcacc

SEQ ID NO: 947392 - RNA, 22 nt, Human
cagugauggauauggagaaguc

SEQ ID NO: 947393 - RNA, 22 nt, Human
ugaauaagaauuauuauaauga

SEQ ID NO: 947394 - RNA, 22 nt, Human
gccuggagugcaguggcgugau

SEQ ID NO: 947395 - RNA, 22 nt, Human
agugaaaacacuaguucuugcc

SEQ ID NO: 947396 - RNA, 22 nt, Human
ucucugcucugugccucaguuu

SEQ ID NO: 947397 - RNA, 22 nt, Human
augugugccccuuuuacucuuu

SEQ ID NO: 947398 - RNA, 22 nt, Human
agcuggagaugcccagcaccgg

SEQ ID NO: 947399 - RNA, 22 nt, Human
ggcagccuccagggcacuggug

SEQ ID NO: 947400 - RNA, 22 nt, Human
uaaagguaugucuuaaucaaac

SEQ ID NO: 947401 - RNA, 22 nt, Human
cugggcacugcaggguguugag

SEQ ID NO: 947402 - RNA, 22 nt, Human
cccaggagguggagguugcagc

SEQ ID NO: 947403 - RNA, 22 nt, Human
ccugagcugaacuaagcaguuu

SEQ ID NO: 947404 - RNA, 22 nt, Human
uguuuucagucauauagcaggu

SEQ ID NO: 947405 - RNA, 22 nt, Human
cagaaccaggaacugauggaga

SEQ ID NO: 947406 - RNA, 22 nt, Human
agggcuggccacaugauuuggu

SEQ ID NO: 947407 - RNA, 22 nt, Human
ggugaggcuaagugacacaggg

SEQ ID NO: 947408 - RNA, 22 nt, Human
ucacucugcaggaaggagcagc

SEQ ID NO: 947409 - RNA, 22 nt, Human
gcaggcagagguggaggagaca

SEQ ID NO: 947410 - RNA, 22 nt, Human
ggaggagggguuuacauuggaa

SEQ ID NO: 947411 - RNA, 22 nt, Human
uguggccaccagagcugcuauu

SEQ ID NO: 947412 - RNA, 22 nt, Human
agucauguguucaucuuucauu

SEQ ID NO: 947413 - RNA, 22 nt, Human
gggccccaaaaugccaggcucu

SEQ ID NO: 947414 - RNA, 22 nt, Human
agcagcugagccccagcuguga

SEQ ID NO: 947415 - RNA, 22 nt, Human
auugucgcuuauuuaggugcuu

SEQ ID NO: 947416 - RNA, 22 nt, Human
cuucaaacccagauuaaaugca

SEQ ID NO: 947417 - RNA, 22 nt, Human
gcguaaggccucuggucucgga

SEQ ID NO: 947418 - RNA, 22 nt, Human
ucucacuuuccagacuuuucaa

SEQ ID NO: 947419 - RNA, 22 nt, Human
gaauucuuuucuuucugaaagu

SEQ ID NO: 947420 - RNA, 19 nt, Human
cuugguuaugguaugaugc

SEQ ID NO: 947421 - RNA, 23 nt, Human
gcugcagcuguggauguucucag

SEQ ID NO: 947422 - RNA, 22 nt, Human
auugcuguaaauuaucuuauua

SEQ ID NO: 947423 - RNA, 22 nt, Human
acucugcucuuauaguguuaua

SEQ ID NO: 947424 - RNA, 17 nt, Human
agcugaaauugcugaag

SEQ ID NO: 947425 - RNA, 22 nt, Human
agaggacagguuuuccaugggc

SEQ ID NO: 947426 - RNA, 17 nt, Human
cucagaguugcuuuguc

SEQ ID NO: 947427 - RNA, 22 nt, Human
gucagcaggguccccuugagug

SEQ ID NO: 947428 - RNA, 22 nt, Human
ccagggugagugucauggguua

SEQ ID NO: 947429 - RNA, 19 nt, Human
uggcagcauugguaccuug

SEQ ID NO: 947430 - RNA, 22 nt, Human
auuuuuaugacaaaccauccuc

SEQ ID NO: 947431 - RNA, 22 nt, Human
uauguacaucguugaauucaaa

SEQ ID NO: 947432 - RNA, 22 nt, Human
acauuucucuugaugucucuau

SEQ ID NO: 947433 - RNA, 21 nt, Human
gcugccaccgcgugcuccagg

SEQ ID NO: 947434 - RNA, 22 nt, Human
aaagacauuagauuaacguaca

SEQ ID NO: 947435 - RNA, 22 nt, Human
aaagguaguacuucuagaaggg

SEQ ID NO: 947436 - RNA, 22 nt, Human
uguugauuaguguuuagacuua

SEQ ID NO: 947437 - RNA, 22 nt, Human
aaucuggcauguaagcuuagag

SEQ ID NO: 947438 - RNA, 22 nt, Human
uccagggcugacuugggagagg

SEQ ID NO: 947439 - RNA, 22 nt, Human
cugucccagauguucucagcac

SEQ ID NO: 947440 - RNA, 23 nt, Human
gcugagguacauuuacaggaaga

SEQ ID NO: 947441 - RNA, 22 nt, Human
agcagagcgccugcucagaggg

SEQ ID NO: 947442 - RNA, 22 nt, Human
ugcugggggcuuucuggauacc

SEQ ID NO: 947443 - RNA, 22 nt, Human
ccagcaccuugaucuuggaguu

SEQ ID NO: 947444 - RNA, 22 nt, Human
ccccaggagauuugggagcaca

SEQ ID NO: 947445 - RNA, 22 nt, Human
auuaaaauuccaagguaugcca

SEQ ID NO: 947446 - RNA, 22 nt, Human
gcccagugguaaaagcaggccu

SEQ ID NO: 947447 - RNA, 22 nt, Human
gucccaggcuuauguggagcuu

SEQ ID NO: 947448 - RNA, 22 nt, Human
cauucacucagcgaugccagua

SEQ ID NO: 947449 - RNA, 22 nt, Human
ccugggagagucuguggucucc

SEQ ID NO: 947450 - RNA, 22 nt, Human
uaggaugaaaauccagcuuaua

SEQ ID NO: 947451 - RNA, 18 nt, Human
ugucaucuguuuaaaacc

SEQ ID NO: 947452 - RNA, 22 nt, Human
cccagcaucccagugggcagca

SEQ ID NO: 947453 - RNA, 22 nt, Human
ucacucuguguuugaacucaag

SEQ ID NO: 947454 - RNA, 22 nt, Human
gcuggccuugugucugaggaag

SEQ ID NO: 947455 - RNA, 22 nt, Human
cugcugcucagugucaucaugu

SEQ ID NO: 947456 - RNA, 22 nt, Human
uugugucuuaaagauuaaaugg

SEQ ID NO: 947457 - RNA, 22 nt, Human
caugcuccaaaaacaagagaau

SEQ ID NO: 947458 - RNA, 22 nt, Human
gccaguggucacugaggaagaa

SEQ ID NO: 947459 - RNA, 21 nt, Human
ugcaggaaagugcugcgaccc

SEQ ID NO: 947460 - RNA, 22 nt, Human
uuauguaggauaaugaauugcc

SEQ ID NO: 947461 - RNA, 22 nt, Human
uaaacauuuguuauucuuguuu

SEQ ID NO: 947462 - RNA, 22 nt, Human
cugccucuauucacugaggcag

SEQ ID NO: 947463 - RNA, 22 nt, Human
uuuuguuguaauauaccuaucc

SEQ ID NO: 947464 - RNA, 21 nt, Human
uggaggaauaaagcacagaag

SEQ ID NO: 947465 - RNA, 22 nt, Human
cuggugccauucuguggccuag

SEQ ID NO: 947466 - RNA, 22 nt, Human
ugcagcaggagccaggccuggu

SEQ ID NO: 947467 - RNA, 22 nt, Human
aaaaguuaccucuguaauauaa

SEQ ID NO: 947468 - RNA, 22 nt, Human
ggccucuguucugcauuccucc

SEQ ID NO: 947469 - RNA, 22 nt, Human
cugaaagaauaagauguuuaca

SEQ ID NO: 947470 - RNA, 22 nt, Human
gaccuggaggauccucuucuug

SEQ ID NO: 947471 - RNA, 22 nt, Human
augagcuucccagacaggaugg

SEQ ID NO: 947472 - RNA, 22 nt, Human
accaucagucauugucaguggg

SEQ ID NO: 947473 - RNA, 22 nt, Human
uagcugccuuugggcuccugcu

SEQ ID NO: 947474 - RNA, 22 nt, Human
gggcagcucuuugguauccuuc

SEQ ID NO: 947475 - RNA, 22 nt, Human
ucagaggauugccucagcgagc

SEQ ID NO: 947476 - RNA, 22 nt, Human
guuugaaugcaguaugcauuuu

SEQ ID NO: 947477 - RNA, 22 nt, Human
gacagaggcuggagcaccuccu

SEQ ID NO: 947478 - RNA, 22 nt, Human
uuggcacagagcugcagccugg

SEQ ID NO: 947479 - RNA, 22 nt, Human
ucagggcauccauugccuguug

SEQ ID NO: 947480 - RNA, 22 nt, Human
ugggccuggacaaggccacuag

SEQ ID NO: 947481 - RNA, 22 nt, Human
uccugccucacaguugaaguuu

SEQ ID NO: 947482 - RNA, 22 nt, Human
caaguaaacaauaugugauuca

SEQ ID NO: 947483 - RNA, 22 nt, Human
aggcacugguccauuuucugca

SEQ ID NO: 947484 - RNA, 22 nt, Human
ggucacaggggagaagagugau

SEQ ID NO: 947485 - RNA, 22 nt, Human
ucuguaguagguuguaguucuu

SEQ ID NO: 947486 - RNA, 22 nt, Human
cccuuagcucaauuucuugccc

SEQ ID NO: 947487 - RNA, 19 nt, Human
uucuccaggcugcagaggg

SEQ ID NO: 947488 - RNA, 17 nt, Human
ucagcaggggccaagcu

SEQ ID NO: 947489 - RNA, 22 nt, Human
uuucuucauucaccuucacccc

SEQ ID NO: 947490 - RNA, 22 nt, Human
acaggcugggcgcuuccugcgg

SEQ ID NO: 947491 - RNA, 22 nt, Human
uggccucaagucugagggccuu

SEQ ID NO: 947492 - RNA, 22 nt, Human
cauauuuauagaucuggcauuu

SEQ ID NO: 947493 - RNA, 22 nt, Human
guguauaacuaucuaucuagua

SEQ ID NO: 947494 - RNA, 22 nt, Human
aguaaaaauugaggugcaaaau

SEQ ID NO: 947495 - RNA, 22 nt, Human
aaugcuagugugauauguaagg

SEQ ID NO: 947496 - RNA, 22 nt, Human
gcagcuggggccacacuuaggc

SEQ ID NO: 947497 - RNA, 22 nt, Human
caccagagugggugagggugau

SEQ ID NO: 947498 - RNA, 22 nt, Human
agcagggcagugcuucagcucu

SEQ ID NO: 947499 - RNA, 22 nt, Human
augcccugcaucaagugacacu

SEQ ID NO: 947500 - RNA, 22 nt, Human
aggccugaaguguggagugggg

SEQ ID NO: 947501 - RNA, 18 nt, Human
gagagggaucccucagga

SEQ ID NO: 947502 - RNA, 22 nt, Human
auauaauacaaccugcuaagug

SEQ ID NO: 947503 - RNA, 22 nt, Human
ugcucugucaagaaaagaugcc

SEQ ID NO: 947504 - RNA, 22 nt, Human
ugcuggcccuggcucagggaac

SEQ ID NO: 947505 - RNA, 21 nt, Human
aagagcugucaggaaggcugc

SEQ ID NO: 947506 - RNA, 22 nt, Human
cagggugacugcccuggccacu

SEQ ID NO: 947507 - RNA, 22 nt, Human
auuuucuauguuguaauuguua

SEQ ID NO: 947508 - RNA, 22 nt, Human
ggcugccaggagaagcucagug

SEQ ID NO: 947509 - RNA, 22 nt, Human
ugucuuaauaugugcauucugu

SEQ ID NO: 947510 - RNA, 22 nt, Human
uuacaaagaguguucuuuucca

SEQ ID NO: 947511 - RNA, 22 nt, Human
ugaagcaggcauugacugauga

SEQ ID NO: 947512 - RNA, 22 nt, Human
uaggcagcgcuuggcugugcuu

SEQ ID NO: 947513 - RNA, 22 nt, Human
ucacccuugauaauguucuucu

SEQ ID NO: 947514 - RNA, 22 nt, Human
aaggaaccauuugugugcaugg

SEQ ID NO: 947515 - RNA, 23 nt, Human
ugggccuggaaagccuuagagag

SEQ ID NO: 947516 - RNA, 22 nt, Human
agcuuuauauuuaaugaauucu

SEQ ID NO: 947517 - RNA, 22 nt, Human
aggacagcaguuggugagguuc

SEQ ID NO: 947518 - RNA, 22 nt, Human
aaaugugugcacaaagacagcu

SEQ ID NO: 947519 - RNA, 22 nt, Human
uucuguguggguagcuccuguu

SEQ ID NO: 947520 - RNA, 22 nt, Human
agucucuuccuucaaggcuggu

SEQ ID NO: 947521 - RNA, 22 nt, Human
ggcucagaaacuaaaggcgcug

SEQ ID NO: 947522 - RNA, 22 nt, Human
agccuggaccaggggccucaga

SEQ ID NO: 947523 - RNA, 22 nt, Human
ucuacccagagcuaugaccuga

SEQ ID NO: 947524 - RNA, 22 nt, Human
uugcauuccaguccccacugug

SEQ ID NO: 947525 - RNA, 22 nt, Human
ccugucugcggaggaguggaag

SEQ ID NO: 947526 - RNA, 22 nt, Human
ggaguuggugagcaccaggcuu

SEQ ID NO: 947527 - RNA, 22 nt, Human
cagggccauuggcguggcuguc

SEQ ID NO: 947528 - RNA, 22 nt, Human
uaaggcaccuguccaggcuggg

SEQ ID NO: 947529 - RNA, 22 nt, Human
ggccaggcugcccugggagcag

SEQ ID NO: 947530 - RNA, 22 nt, Human
cucuccagaauaugccgccgug

SEQ ID NO: 947531 - RNA, 17 nt, Human
cagcucugcaucuuccu

SEQ ID NO: 947532 - RNA, 22 nt, Human
uggagcagcuaagccucugaga

SEQ ID NO: 947533 - RNA, 22 nt, Human
ucugaagaacugaguaaacaug

SEQ ID NO: 947534 - RNA, 22 nt, Human
ugggcucuccuggaggacaaca

SEQ ID NO: 947535 - RNA, 22 nt, Human
agggcagcagcuccuccuagcu

SEQ ID NO: 947536 - RNA, 22 nt, Human
guucauuuuacuguaaauagca

SEQ ID NO: 947537 - RNA, 22 nt, Human
aggauccuccuuagaaaagacc

SEQ ID NO: 947538 - RNA, 22 nt, Human
aguggccagugcugcucugggg

SEQ ID NO: 947539 - RNA, 18 nt, Human
cggcagagugcuucuagc

SEQ ID NO: 947540 - RNA, 22 nt, Human
cuauuacauuucuggacauuca

SEQ ID NO: 947541 - RNA, 22 nt, Human
cucaagacugaucgcaguggaa

SEQ ID NO: 947542 - RNA, 22 nt, Human
ugggcugcugucugcacaugcu

SEQ ID NO: 947543 - RNA, 22 nt, Human
ugggcagaggacagggaagauc

SEQ ID NO: 947544 - RNA, 22 nt, Human
uacaaaguuugagaaugcuuuc

SEQ ID NO: 947545 - RNA, 22 nt, Human
gccuguguggaugcgccggugc

SEQ ID NO: 947546 - RNA, 22 nt, Human
cggagggguuugaacagaggag

SEQ ID NO: 947547 - RNA, 22 nt, Human
ucauugaauuugguucaauaug

SEQ ID NO: 947548 - RNA, 22 nt, Human
aggagcuggaguccaggcaagu

SEQ ID NO: 947549 - RNA, 22 nt, Human
ucucauugguauauacaugugu

SEQ ID NO: 947550 - RNA, 22 nt, Human
aacaugcugccuuucuacgagu

SEQ ID NO: 947551 - RNA, 22 nt, Human
agcaccaugaccuugccauuga

SEQ ID NO: 947552 - RNA, 22 nt, Human
caggcagaagaaguggaaggac

SEQ ID NO: 947553 - RNA, 22 nt, Human
gagagguccauuccccugucag

SEQ ID NO: 947554 - RNA, 22 nt, Human
uugggcugaacccugcagcuga

SEQ ID NO: 947555 - RNA, 22 nt, Human
gauguguuuccaggauuuguuu

SEQ ID NO: 947556 - RNA, 22 nt, Human
auuucaaggcuauuaauauaaa

SEQ ID NO: 947557 - RNA, 22 nt, Human
cuuuaagagaucaccaaucaca

SEQ ID NO: 947558 - RNA, 22 nt, Human
aaaugucuuucaauagagaaau

SEQ ID NO: 947559 - RNA, 22 nt, Human
uucuggagaucugccuauggga

SEQ ID NO: 947560 - RNA, 22 nt, Human
ucagcagugcagggugaggcag

SEQ ID NO: 947561 - RNA, 22 nt, Human
agacagagauacuauguuguca

SEQ ID NO: 947562 - RNA, 20 nt, Human
caguuuaacuuugagcaguu

SEQ ID NO: 947563 - RNA, 22 nt, Human
acagaguaggugcugucgacug

SEQ ID NO: 947564 - RNA, 22 nt, Human
agcagaacauuuucagggcugu

SEQ ID NO: 947565 - RNA, 23 nt, Human
gggauauggaccuuggaggaguc

SEQ ID NO: 947566 - RNA, 22 nt, Human
uuaacagagaacauagaaguag

SEQ ID NO: 947567 - RNA, 21 nt, Human
ugcccacagcaaaugcagagg

SEQ ID NO: 947568 - RNA, 22 nt, Human
agagugauggguugugcugacc

SEQ ID NO: 947569 - RNA, 22 nt, Human
aaagauaauguuuccuuauucu

SEQ ID NO: 947570 - RNA, 22 nt, Human
uccaggaggccucauuuccugu

SEQ ID NO: 947571 - RNA, 22 nt, Human
guuauguaugggggccuuauga

SEQ ID NO: 947572 - RNA, 22 nt, Human
gcagagugagccgaggcugcuc

SEQ ID NO: 947573 - RNA, 22 nt, Human
cucccugguguccccuccagga

SEQ ID NO: 947574 - RNA, 22 nt, Human
agcauggggcuccgcaaugaac

SEQ ID NO: 947575 - RNA, 22 nt, Human
uguacauuuagagcucaauaga

SEQ ID NO: 947576 - RNA, 22 nt, Human
cccagcaggucggugcugccug

SEQ ID NO: 947577 - RNA, 22 nt, Human
cagacuugacggcagcugcuuu

SEQ ID NO: 947578 - RNA, 23 nt, Human
agggugagcaagcuauggagacc

SEQ ID NO: 947579 - RNA, 22 nt, Human
aaaguguugggaagaaagugca

SEQ ID NO: 947580 - RNA, 22 nt, Human
acuggccaugaacuugggaucu

SEQ ID NO: 947581 - RNA, 22 nt, Human
ccagcuggcacuguggcugccc

SEQ ID NO: 947582 - RNA, 21 nt, Human
ccagccucagaucagggagcu

SEQ ID NO: 947583 - RNA, 22 nt, Human
acuccuggguugcaguccucaa

SEQ ID NO: 947584 - RNA, 20 nt, Human
aaaguguaagcauauaauua

SEQ ID NO: 947585 - RNA, 19 nt, Human
gugaggauacugcucagag

SEQ ID NO: 947586 - RNA, 22 nt, Human
ggagacagugacuuagagacug

SEQ ID NO: 947587 - RNA, 22 nt, Human
acuucuggauagagucagcuuu

SEQ ID NO: 947588 - RNA, 22 nt, Human
gucaccaggucugaugcagcca

SEQ ID NO: 947589 - RNA, 22 nt, Human
gcugccuggaauaacggcuggc

SEQ ID NO: 947590 - RNA, 22 nt, Human
cccaggcagucuggcucuaaag

SEQ ID NO: 947591 - RNA, 22 nt, Human
acuguagcugccacuggaugca

SEQ ID NO: 947592 - RNA, 22 nt, Human
cuggcagcuuagcacucugguu

SEQ ID NO: 947593 - RNA, 23 nt, Human
gggagccaggaccucgcgcccca

SEQ ID NO: 947594 - RNA, 22 nt, Human
caucacugacgcugagauucca

SEQ ID NO: 947595 - RNA, 22 nt, Human
agcuggguguguaucagauaaa

SEQ ID NO: 947596 - RNA, 22 nt, Human
caaauucucacccuguuugauu

SEQ ID NO: 947597 - RNA, 22 nt, Human
acccacgaagaugagcggcaug

SEQ ID NO: 947598 - RNA, 16 nt, Human
ccccaggacuuggcac

SEQ ID NO: 947599 - RNA, 19 nt, Human
gacagugcaguuguaguac

SEQ ID NO: 947600 - RNA, 22 nt, Human
gaaauauuacaguggaggggau

SEQ ID NO: 947601 - RNA, 23 nt, Human
aacaccaaggcucagagagauaa

SEQ ID NO: 947602 - RNA, 22 nt, Human
ggucccaggcugcgggcuggug

SEQ ID NO: 947603 - RNA, 22 nt, Human
uacauuuguuauagaaaugaag

SEQ ID NO: 947604 - RNA, 22 nt, Human
cugcaggcaucuaacugugggc

SEQ ID NO: 947605 - RNA, 22 nt, Human
acauucuuaacaguuaaaaacu

SEQ ID NO: 947606 - RNA, 22 nt, Human
ucagggacuaggugcugccuga

SEQ ID NO: 947607 - RNA, 22 nt, Human
aucagcaagauugugucuugua

SEQ ID NO: 947608 - RNA, 22 nt, Human
aauaucagcacuuuugugguau

SEQ ID NO: 947609 - RNA, 22 nt, Human
caaauguguagagcuuuugggg

SEQ ID NO: 947610 - RNA, 22 nt, Human
ccuggcugcuuucacuauggag

SEQ ID NO: 947611 - RNA, 22 nt, Human
agaggcuccuagccacuggcuu

SEQ ID NO: 947612 - RNA, 22 nt, Human
uuugaauagcauaggauuacau

SEQ ID NO: 947613 - RNA, 22 nt, Human
gccaggcauucuagaaguagug

SEQ ID NO: 947614 - RNA, 22 nt, Human
ugccagccagguucugaggcua

SEQ ID NO: 947615 - RNA, 22 nt, Human
gggucugaggaguaccauuguc

SEQ ID NO: 947616 - RNA, 22 nt, Human
cugcucucuguuccccuggauc

SEQ ID NO: 947617 - RNA, 22 nt, Human
cagcucaaguuucccaggucag

SEQ ID NO: 947618 - RNA, 22 nt, Human
uggguagagacacagucugggg

SEQ ID NO: 947619 - RNA, 22 nt, Human
ucacucugagaggucacuggaa

SEQ ID NO: 947620 - RNA, 22 nt, Human
augccagucaaagaagaugaca

SEQ ID NO: 947621 - RNA, 22 nt, Human
aggcagcaugggccccagcucc

SEQ ID NO: 947622 - RNA, 20 nt, Human
gcagagccucacugcaaggg

SEQ ID NO: 947623 - RNA, 22 nt, Human
aaauaguuguuuggaucaauaa

SEQ ID NO: 947624 - RNA, 22 nt, Human
cugggccaguuaugucucaucu

SEQ ID NO: 947625 - RNA, 22 nt, Human
gcucugggcugcccucuggaca

SEQ ID NO: 947626 - RNA, 23 nt, Human
aucaaacuggugagaaugucagu

SEQ ID NO: 947627 - RNA, 22 nt, Human
gacucugcuacaggccgagguu

SEQ ID NO: 947628 - RNA, 22 nt, Human
uacaaagcuguauagccugguc

SEQ ID NO: 947629 - RNA, 22 nt, Human
gagccugaugaaacaggcagac

SEQ ID NO: 947630 - RNA, 19 nt, Human
agucucacccaagcagucu

SEQ ID NO: 947631 - RNA, 22 nt, Human
ccugucugcagauaucucaggu

SEQ ID NO: 947632 - RNA, 22 nt, Human
agagcccucuucacugccccuu

SEQ ID NO: 947633 - RNA, 23 nt, Human
uuauugaggguguagauuggugu

SEQ ID NO: 947634 - RNA, 22 nt, Human
cacuucaauuaacuucagcauu

SEQ ID NO: 947635 - RNA, 22 nt, Human
gcugagcugcuguucauccugc

SEQ ID NO: 947636 - RNA, 20 nt, Human
ugccaugguaacagagugug

SEQ ID NO: 947637 - RNA, 22 nt, Human
ggagccagagucugcaguguaa

SEQ ID NO: 947638 - RNA, 17 nt, Human
accagccucuccugggg

SEQ ID NO: 947639 - RNA, 22 nt, Human
ggcuguggcagcuggaaguggu

SEQ ID NO: 947640 - RNA, 22 nt, Human
cggagccugcuuguugcagcug

SEQ ID NO: 947641 - RNA, 22 nt, Human
uggcgagccccgacugaguguu

SEQ ID NO: 947642 - RNA, 22 nt, Human
ggccucgcggcuucugguggcu

SEQ ID NO: 947643 - RNA, 22 nt, Human
cacguuuuaugacagaagaagc

SEQ ID NO: 947644 - RNA, 22 nt, Human
aaaguauuugugauuuuuacca

SEQ ID NO: 947645 - RNA, 22 nt, Human
augcugugccuggaaagcggcu

SEQ ID NO: 947646 - RNA, 22 nt, Human
aggcccugcaggaagcaggaug

SEQ ID NO: 947647 - RNA, 19 nt, Human
aagggcugggcaccucacu

SEQ ID NO: 947648 - RNA, 22 nt, Human
uggcucagaguucaucuuuuag

SEQ ID NO: 947649 - RNA, 18 nt, Human
caaagcucacguuccauc

SEQ ID NO: 947650 - RNA, 22 nt, Human
ucaugcuuauugcauauuugga

SEQ ID NO: 947651 - RNA, 22 nt, Human
uuuauauuucccaggauuggcc

SEQ ID NO: 947652 - RNA, 22 nt, Human
gaggguccccaugcagagcuca

SEQ ID NO: 947653 - RNA, 22 nt, Human
aaggccagccugagagcuaaca

SEQ ID NO: 947654 - RNA, 22 nt, Human
cuggcccuucucuugcuuccug

SEQ ID NO: 947655 - RNA, 22 nt, Human
cccagagccucauucuguuggg

SEQ ID NO: 947656 - RNA, 22 nt, Human
uuaugauuugccacagauuggu

SEQ ID NO: 947657 - RNA, 22 nt, Human
cuguccuccggccaccuacagu

SEQ ID NO: 947658 - RNA, 22 nt, Human
uguggccuggaaggggcugcuc

SEQ ID NO: 947659 - RNA, 22 nt, Human
gucccacaccuugaggggucuu

SEQ ID NO: 947660 - RNA, 22 nt, Human
cugaggugcuauggaggauacg

SEQ ID NO: 947661 - RNA, 22 nt, Human
guacauuuugagguuaaaacaa

SEQ ID NO: 947662 - RNA, 22 nt, Human
aacauuucuucugaaacugagu

SEQ ID NO: 947663 - RNA, 22 nt, Human
uagcagcuuaaguaauuagaau

SEQ ID NO: 947664 - RNA, 22 nt, Human
ucaugacaucuguuuaucucaa

SEQ ID NO: 947665 - RNA, 22 nt, Human
cugggguggaggagcuccccug

SEQ ID NO: 947666 - RNA, 22 nt, Human
uccaggagguuuggaggaagca

SEQ ID NO: 947667 - RNA, 22 nt, Human
caggcgagugaacagacucuca

SEQ ID NO: 947668 - RNA, 22 nt, Human
cagagcugugauaaauagauau

SEQ ID NO: 947669 - RNA, 22 nt, Human
acagagcuuaauucaggagcuu

SEQ ID NO: 947670 - RNA, 22 nt, Human
agcagggcagugaucagaaagg

SEQ ID NO: 947671 - RNA, 22 nt, Human
gaggcagccagagguucucauu

SEQ ID NO: 947672 - RNA, 22 nt, Human
cugccugugccaaugcuccuuu

SEQ ID NO: 947673 - RNA, 22 nt, Human
cugcuggccuagcccauccucu

SEQ ID NO: 947674 - RNA, 22 nt, Human
ucugggaaugaauaagaccugu

SEQ ID NO: 947675 - RNA, 22 nt, Human
ugucucugcuuuccuugcaggg

SEQ ID NO: 947676 - RNA, 22 nt, Human
cuguggaguuuguggcgcugac

SEQ ID NO: 947677 - RNA, 22 nt, Human
caggaguggugugagggacucc

SEQ ID NO: 947678 - RNA, 22 nt, Human
uguuuaauucaccaucauguuc

SEQ ID NO: 947679 - RNA, 20 nt, Human
ugaaaggugggaauuguggg

SEQ ID NO: 947680 - RNA, 22 nt, Human
ggggugggcgugcagggacacc

SEQ ID NO: 947681 - RNA, 22 nt, Human
gcaggguccauggaggcagccc

SEQ ID NO: 947682 - RNA, 18 nt, Human
aaagaaggauuggagagc

SEQ ID NO: 947683 - RNA, 22 nt, Human
cucugcaugccuugcucagaca

SEQ ID NO: 947684 - RNA, 22 nt, Human
agugucugccaacugcaugguc

SEQ ID NO: 947685 - RNA, 22 nt, Human
ggaugcaggacggcauggaugu

SEQ ID NO: 947686 - RNA, 22 nt, Human
cccagccucagcuuuacuucca

SEQ ID NO: 947687 - RNA, 22 nt, Human
gguuugcauucugaaaggcuca

SEQ ID NO: 947688 - RNA, 22 nt, Human
ggcuccugauaggagaaugcgg

SEQ ID NO: 947689 - RNA, 23 nt, Human
gcagagcugcccuauugccuugg

SEQ ID NO: 947690 - RNA, 22 nt, Human
accugagcaugccaggagagug

SEQ ID NO: 947691 - RNA, 22 nt, Human
aacagcagggggaccugcuggu

SEQ ID NO: 947692 - RNA, 22 nt, Human
guggccugucagaagccguggg

SEQ ID NO: 947693 - RNA, 20 nt, Human
ugugugcacacaugacauuc

SEQ ID NO: 947694 - RNA, 21 nt, Human
uguuguuuuauggcuaugaau

SEQ ID NO: 947695 - RNA, 22 nt, Human
agugcuuuagcauccaacuguc

SEQ ID NO: 947696 - RNA, 20 nt, Human
cuucuucaguaguuuguucu

SEQ ID NO: 947697 - RNA, 22 nt, Human
gcauguguggaggagaugugcu

SEQ ID NO: 947698 - RNA, 22 nt, Human
uggcaucucaaacaggcagauu

SEQ ID NO: 947699 - RNA, 22 nt, Human
gggagggaggugaugcuuggcu

SEQ ID NO: 947700 - RNA, 22 nt, Human
ugcaggaaucagaggggaagcg

SEQ ID NO: 947701 - RNA, 22 nt, Human
aggggagaguuaaugugaaugu

SEQ ID NO: 947702 - RNA, 22 nt, Human
ggucucuguugccuccaucaag

SEQ ID NO: 947703 - RNA, 22 nt, Human
ggagaggcgaugagucacagcc

SEQ ID NO: 947704 - RNA, 22 nt, Human
cuguccugauggugccacuggu

SEQ ID NO: 947705 - RNA, 22 nt, Human
ucauugaagugacugaaagauu

SEQ ID NO: 947706 - RNA, 22 nt, Human
ugaaggaaagagggaacauccc

SEQ ID NO: 947707 - RNA, 22 nt, Human
ucccaagugucuuggaccaggg

SEQ ID NO: 947708 - RNA, 22 nt, Human
acuucuugggacccuggcaccg

SEQ ID NO: 947709 - RNA, 22 nt, Human
cccaggaguaagugacauuguu

SEQ ID NO: 947710 - RNA, 22 nt, Human
gaugaggggucauuggcuggga

SEQ ID NO: 947711 - RNA, 22 nt, Human
aaacagcugucauuguuuuaaa

SEQ ID NO: 947712 - RNA, 19 nt, Human
auagaaaggguuaaagaca

SEQ ID NO: 947713 - RNA, 22 nt, Human
uaacagaaaggcucaggugcuc

SEQ ID NO: 947714 - RNA, 22 nt, Human
uguccucuaauuggccucuugc

SEQ ID NO: 947715 - RNA, 22 nt, Human
aggcaggggagcuggaagggua

SEQ ID NO: 947716 - RNA, 22 nt, Human
ugucaguguauacauacaguau

SEQ ID NO: 947717 - RNA, 22 nt, Human
gcugcagcagaaguucucagag

SEQ ID NO: 947718 - RNA, 22 nt, Human
acugugcaugaaccgaaacaaa

SEQ ID NO: 947719 - RNA, 22 nt, Human
gaacagaagaggcuggugccac

SEQ ID NO: 947720 - RNA, 23 nt, Human
cagggcugguagggaagagcgug

SEQ ID NO: 947721 - RNA, 22 nt, Human
gugcagcugugguggagccagg

SEQ ID NO: 947722 - RNA, 22 nt, Human
uaggcacuagacaugguuacca

SEQ ID NO: 947723 - RNA, 22 nt, Human
uguuuuaaagccauugccuuuc

SEQ ID NO: 947724 - RNA, 22 nt, Human
agccucugauggcucccaagga

SEQ ID NO: 947725 - RNA, 22 nt, Human
aaauguggguaaugggacugga

SEQ ID NO: 947726 - RNA, 22 nt, Human
uuuguaaauagcaguacucaug

SEQ ID NO: 947727 - RNA, 22 nt, Human
cugccucuguugggcauggucu

SEQ ID NO: 947728 - RNA, 19 nt, Human
ucccgcccacugagcgugc

SEQ ID NO: 947729 - RNA, 22 nt, Human
uacauuccauguguguguauuc

SEQ ID NO: 947730 - RNA, 22 nt, Human
accugagccuagggagguugag

SEQ ID NO: 947731 - RNA, 22 nt, Human
gcucugucuucagcacacagua

SEQ ID NO: 947732 - RNA, 22 nt, Human
acacaaguucuaaagauugcgc

SEQ ID NO: 947733 - RNA, 22 nt, Human
ugagcuggucacuccuucugaa

SEQ ID NO: 947734 - RNA, 22 nt, Human
cucuggagcauuucaccuacau

SEQ ID NO: 947735 - RNA, 22 nt, Human
gagaggccaaaaucccugcccc

SEQ ID NO: 947736 - RNA, 22 nt, Human
aucuguucuucaaaauauuaca

SEQ ID NO: 947737 - RNA, 22 nt, Human
gagagcuguuuaucuucuucaa

SEQ ID NO: 947738 - RNA, 22 nt, Human
ggaccagagcucgggcuucuca

SEQ ID NO: 947739 - RNA, 22 nt, Human
aaggcacugaacuuaaauucug

SEQ ID NO: 947740 - RNA, 22 nt, Human
agaagcaguuauuuuuugcaca

SEQ ID NO: 947741 - RNA, 22 nt, Human
uagugcuuaauaaauuucagaa

SEQ ID NO: 947742 - RNA, 22 nt, Human
augcuguggaugccuugcccca

SEQ ID NO: 947743 - RNA, 22 nt, Human
gaggccugguuugcaugagaau

SEQ ID NO: 947744 - RNA, 22 nt, Human
gugucccaaucuacuuuucccu

SEQ ID NO: 947745 - RNA, 22 nt, Human
ucuccugggaggacaaggaagg

SEQ ID NO: 947746 - RNA, 22 nt, Human
gcagccugaugaucuggguugu

SEQ ID NO: 947747 - RNA, 22 nt, Human
uucauauauaugcacuacguac

SEQ ID NO: 947748 - RNA, 22 nt, Human
aggcacugauucuguuuuccau

SEQ ID NO: 947749 - RNA, 23 nt, Human
agucuucauuguauuuccagacc

SEQ ID NO: 947750 - RNA, 22 nt, Human
ucagagaggcaauacuguuuaa

SEQ ID NO: 947751 - RNA, 22 nt, Human
gauggcaggcaggugaguagag

SEQ ID NO: 947752 - RNA, 22 nt, Human
agccagcugugggcucaggcgg

SEQ ID NO: 947753 - RNA, 22 nt, Human
agggcuggaggguacuaguuua

SEQ ID NO: 947754 - RNA, 22 nt, Human
uugauuaaacaggcauauucaa

SEQ ID NO: 947755 - RNA, 22 nt, Human
uggcagagagacucuccuugau

SEQ ID NO: 947756 - RNA, 22 nt, Human
uugaggagucaggggcacggaa

SEQ ID NO: 947757 - RNA, 22 nt, Human
uugaagcauuugcuauagcauu

SEQ ID NO: 947758 - RNA, 22 nt, Human
ggaggaggggcgcuuugucuau

SEQ ID NO: 947759 - RNA, 22 nt, Human
auauuucuugagcaccugguau

SEQ ID NO: 947760 - RNA, 22 nt, Human
ugcccugcagugagugcgucug

SEQ ID NO: 947761 - RNA, 22 nt, Human
gcagagaagaugcccaggcuuc

SEQ ID NO: 947762 - RNA, 22 nt, Human
ucacuaaguuacauuuaguauu

SEQ ID NO: 947763 - RNA, 22 nt, Human
acaggagaaaucuggucaaaag

SEQ ID NO: 947764 - RNA, 22 nt, Human
ugggcuacucugggagccuaac

SEQ ID NO: 947765 - RNA, 22 nt, Human
ucuccaagcagggcugcaaggc

SEQ ID NO: 947766 - RNA, 22 nt, Human
aagaaugucguugguauuuuaa

SEQ ID NO: 947767 - RNA, 22 nt, Human
uaaagguagcaugaaacugcaa

SEQ ID NO: 947768 - RNA, 22 nt, Human
aggcuggcccuacuggcugccu

SEQ ID NO: 947769 - RNA, 22 nt, Human
gucaggauuggggucaugaguc

SEQ ID NO: 947770 - RNA, 20 nt, Human
uacagaaugcaauaaaaugg

SEQ ID NO: 947771 - RNA, 22 nt, Human
cuggagagaaaugacaaagcua

SEQ ID NO: 947772 - RNA, 22 nt, Human
cugagccauccauaccagcuua

SEQ ID NO: 947773 - RNA, 22 nt, Human
aacuucuggauguuucaaaugu

SEQ ID NO: 947774 - RNA, 22 nt, Human
caaaaguaauuaugguuuuugc

SEQ ID NO: 947775 - RNA, 22 nt, Human
ugcuuccuucccguucuucucc

SEQ ID NO: 947776 - RNA, 20 nt, Human
uggagcuccagcguccaugu

SEQ ID NO: 947777 - RNA, 22 nt, Human
ucuccugguacccuuccuagca

SEQ ID NO: 947778 - RNA, 22 nt, Human
ucacuaagugccgaguuuaguu

SEQ ID NO: 947779 - RNA, 17 nt, Human
gguguauggggagggaa

SEQ ID NO: 947780 - RNA, 23 nt, Human
aggcgagcucuucuccagcacgu

SEQ ID NO: 947781 - RNA, 22 nt, Human
gcuguguuggugaagcuguagc

SEQ ID NO: 947782 - RNA, 22 nt, Human
aggcugcaggucugggucaugu

SEQ ID NO: 947783 - RNA, 22 nt, Human
uggagccuguguuucugcccag

SEQ ID NO: 947784 - RNA, 22 nt, Human
uccugccugcaaucccagcacu

SEQ ID NO: 947785 - RNA, 22 nt, Human
aguuuuuccguggcuacgauaa

SEQ ID NO: 947786 - RNA, 23 nt, Human
aaugauuucaugaugauagcagc

SEQ ID NO: 947787 - RNA, 22 nt, Human
auuuucaaaacaucugcugugu

SEQ ID NO: 947788 - RNA, 22 nt, Human
gcaggggcuaaggacacagaga

SEQ ID NO: 947789 - RNA, 22 nt, Human
uaaauucugaucaaguuccuuc

SEQ ID NO: 947790 - RNA, 23 nt, Human
ucguugaauagcaauagcacaac

SEQ ID NO: 947791 - RNA, 21 nt, Human
acuggccaccacuggcagggg

SEQ ID NO: 947792 - RNA, 22 nt, Human
caggccucagagaguggcgggg

SEQ ID NO: 947793 - RNA, 22 nt, Human
cccaggaggcggagguuguggu

SEQ ID NO: 947794 - RNA, 21 nt, Human
acuguucauuugaugaacugg

SEQ ID NO: 947795 - RNA, 20 nt, Human
cugcucagaccaacucuucu

SEQ ID NO: 947796 - RNA, 22 nt, Human
aaaugccucugcuguacacaau

SEQ ID NO: 947797 - RNA, 22 nt, Human
agucccuguacuuuccacugcc

SEQ ID NO: 947798 - RNA, 22 nt, Human
auagugcaguggacugaguuaa

SEQ ID NO: 947799 - RNA, 20 nt, Human
agccagaagaaggcuggaga

SEQ ID NO: 947800 - RNA, 22 nt, Human
ccacucugauuucaagggagau

SEQ ID NO: 947801 - RNA, 22 nt, Human
caggagaggcuguacguuucuc

SEQ ID NO: 947802 - RNA, 22 nt, Human
gcugucuugcucacucuugcag

SEQ ID NO: 947803 - RNA, 22 nt, Human
acauuucagcgugcaugacaug

SEQ ID NO: 947804 - RNA, 22 nt, Human
aagccaagaguuaacuauuugu

SEQ ID NO: 947805 - RNA, 22 nt, Human
gaggcugggaaguccaagacca

SEQ ID NO: 947806 - RNA, 22 nt, Human
agauuucacaugcugcucuauu

SEQ ID NO: 947807 - RNA, 22 nt, Human
cucaggccauucuuccagcugc

SEQ ID NO: 947808 - RNA, 22 nt, Human
gggcugugggacccggcacuuu

SEQ ID NO: 947809 - RNA, 22 nt, Human
aucugccuccaaguccaugugu

SEQ ID NO: 947810 - RNA, 22 nt, Human
agagggcugcugcacagugcuc

SEQ ID NO: 947811 - RNA, 22 nt, Human
aggagcugagucagcccgacag

SEQ ID NO: 947812 - RNA, 22 nt, Human
gggugggguguaucggauccua

SEQ ID NO: 947813 - RNA, 22 nt, Human
aucuggcucucucauuuacaaa

SEQ ID NO: 947814 - RNA, 22 nt, Human
caggaugugaggaggccauuug

SEQ ID NO: 947815 - RNA, 18 nt, Human
aagaggaggagcagguug

SEQ ID NO: 947816 - RNA, 17 nt, Human
uguuccauuugaccacc

SEQ ID NO: 947817 - RNA, 22 nt, Human
uucuaaaauaaguuuaucuggu

SEQ ID NO: 947818 - RNA, 22 nt, Human
cuucucagcauuuugucagucu

SEQ ID NO: 947819 - RNA, 22 nt, Human
uauaagaaacaaggcaaauuuu

SEQ ID NO: 947820 - RNA, 22 nt, Human
ugucccagauacuggacauaga

SEQ ID NO: 947821 - RNA, 22 nt, Human
ccucugaggucauggacuuggc

SEQ ID NO: 947822 - RNA, 22 nt, Human
ucagcacugauguuucagaaga

SEQ ID NO: 947823 - RNA, 22 nt, Human
auauuaggugcucaauacaugc

SEQ ID NO: 947824 - RNA, 22 nt, Human
ugcccuguuaucuuggaagagu

SEQ ID NO: 947825 - RNA, 22 nt, Human
acuggcagaggauagcacuaau

SEQ ID NO: 947826 - RNA, 22 nt, Human
ggaagugaggaaauauuuuguu

SEQ ID NO: 947827 - RNA, 21 nt, Human
aaaaugugagcgugaugcuua

SEQ ID NO: 947828 - RNA, 22 nt, Human
ucugggaauuuauuggcacuuu

SEQ ID NO: 947829 - RNA, 22 nt, Human
ugagccagcaggccuccagugg

SEQ ID NO: 947830 - RNA, 22 nt, Human
gcucagaggaugcuccuuuaug

SEQ ID NO: 947831 - RNA, 22 nt, Human
cauuuacuguugaaucccuagc

SEQ ID NO: 947832 - RNA, 22 nt, Human
ccuguuuaucuaucuagagaug

SEQ ID NO: 947833 - RNA, 22 nt, Human
gcugaaauucagauuccuaggc

SEQ ID NO: 947834 - RNA, 22 nt, Human
gcacuugguaggacuucaguga

SEQ ID NO: 947835 - RNA, 22 nt, Human
gggucuggcaugcugagaugga

SEQ ID NO: 947836 - RNA, 22 nt, Human
uuugcauuucuaaugagcuccg

SEQ ID NO: 947837 - RNA, 22 nt, Human
ugaaaugauguacaagaaggca

SEQ ID NO: 947838 - RNA, 22 nt, Human
ugcuauacggagcaucuucagg

SEQ ID NO: 947839 - RNA, 20 nt, Human
gccugccucagcuagcugag

SEQ ID NO: 947840 - RNA, 22 nt, Human
uucaggaugacaccauguccag

SEQ ID NO: 947841 - RNA, 17 nt, Human
uggagcugcguguguuc

SEQ ID NO: 947842 - RNA, 22 nt, Human
auacagcagugaauaagauaaa

SEQ ID NO: 947843 - RNA, 23 nt, Human
cagagcuggcucagagcugccug

SEQ ID NO: 947844 - RNA, 22 nt, Human
aucaggaugacaacugcugggu

SEQ ID NO: 947845 - RNA, 23 nt, Human
cacaccaggagccgucugggcca

SEQ ID NO: 947846 - RNA, 21 nt, Human
agacagagugcagucuacaua

SEQ ID NO: 947847 - RNA, 22 nt, Human
uaaauucagugaguaauuucug

SEQ ID NO: 947848 - RNA, 22 nt, Human
uaguuaggguucugcagagaca

SEQ ID NO: 947849 - RNA, 21 nt, Human
ugguuugcggccaaaguuaaa

SEQ ID NO: 947850 - RNA, 22 nt, Human
uuguggaaauacagacuccaag

SEQ ID NO: 947851 - RNA, 22 nt, Human
ucauggauggccgggaggugau

SEQ ID NO: 947852 - RNA, 21 nt, Human
cucuggagucaagagcuucca

SEQ ID NO: 947853 - RNA, 22 nt, Human
acagaauugauggaaaucucag

SEQ ID NO: 947854 - RNA, 22 nt, Human
gcugccugguuucucagcugca

SEQ ID NO: 947855 - RNA, 22 nt, Human
guuuucuuugaaugcuucuaga

SEQ ID NO: 947856 - RNA, 22 nt, Human
gcuuggaaguaggauugggaga

SEQ ID NO: 947857 - RNA, 17 nt, Human
ggccuguguggcugcag

SEQ ID NO: 947858 - RNA, 22 nt, Human
uuaaaugaacgagauaugcaac

SEQ ID NO: 947859 - RNA, 20 nt, Human
agcccuguuuccuggagaga

SEQ ID NO: 947860 - RNA, 22 nt, Human
agcagggccaacaguaaacacc

SEQ ID NO: 947861 - RNA, 19 nt, Human
ugggcuuccccagggcaga

SEQ ID NO: 947862 - RNA, 22 nt, Human
agggcacaagacucugagcccc

SEQ ID NO: 947863 - RNA, 22 nt, Human
accaggaguagaauaucuguga

SEQ ID NO: 947864 - RNA, 19 nt, Human
acacugaauguagaauugg

SEQ ID NO: 947865 - RNA, 22 nt, Human
cuggcagauuggggucagcagu

SEQ ID NO: 947866 - RNA, 17 nt, Human
ugauaguucauuuuaag

SEQ ID NO: 947867 - RNA, 22 nt, Human
acuugauuuugaaccuuucuac

SEQ ID NO: 947868 - RNA, 20 nt, Human
uagauuucauacuucucuuu

SEQ ID NO: 947869 - RNA, 22 nt, Human
uuuauguacauauccacaagga

SEQ ID NO: 947870 - RNA, 22 nt, Human
aggauguugcuauuggcagucu

SEQ ID NO: 947871 - RNA, 22 nt, Human
aaggucauuguugcauguucuc

SEQ ID NO: 947872 - RNA, 22 nt, Human
gaggcugguaggaaaggaaaca

SEQ ID NO: 947873 - RNA, 22 nt, Human
agcuccuccugugccaggccag

SEQ ID NO: 947874 - RNA, 22 nt, Human
ucuguucuauuggucuaugugu

SEQ ID NO: 947875 - RNA, 22 nt, Human
auuagggaaggauuuggccuga

SEQ ID NO: 947876 - RNA, 23 nt, Human
ugcagcugccucuggcgggccgg

SEQ ID NO: 947877 - RNA, 22 nt, Human
cucagugugaaugcucaguaaa

SEQ ID NO: 947878 - RNA, 22 nt, Human
agagcuggauggucaagauggc

SEQ ID NO: 947879 - RNA, 22 nt, Human
auacagauguugaauguuauau

SEQ ID NO: 947880 - RNA, 22 nt, Human
agucucagggccacccggggaa

SEQ ID NO: 947881 - RNA, 22 nt, Human
cagggacugagauccagacugu

SEQ ID NO: 947882 - RNA, 22 nt, Human
cccuggaggaccccaauguggc

SEQ ID NO: 947883 - RNA, 22 nt, Human
cagauggaacacagaaaggaga

SEQ ID NO: 947884 - RNA, 22 nt, Human
ccagucccaggcagaaauccag

SEQ ID NO: 947885 - RNA, 22 nt, Human
ggcagcucaccucugguccagg

SEQ ID NO: 947886 - RNA, 22 nt, Human
gcauugaguccacucugucuuu

SEQ ID NO: 947887 - RNA, 22 nt, Human
acaaaccagcuuaagcaagaug

SEQ ID NO: 947888 - RNA, 21 nt, Human
uaaagaagaugaaugugauca

SEQ ID NO: 947889 - RNA, 22 nt, Human
cuggccucauagccaagcugug

SEQ ID NO: 947890 - RNA, 22 nt, Human
gggucucucucggcuccacgcg

SEQ ID NO: 947891 - RNA, 22 nt, Human
agucuuuccugcuugacuguuc

SEQ ID NO: 947892 - RNA, 21 nt, Human
gaggcugucugcugcuggccu

SEQ ID NO: 947893 - RNA, 22 nt, Human
gaaaauguuagcuucauaguca

SEQ ID NO: 947894 - RNA, 22 nt, Human
auuugucugcuugcugccuucc

SEQ ID NO: 947895 - RNA, 22 nt, Human
ugcucuguaacaaauugacaug

SEQ ID NO: 947896 - RNA, 22 nt, Human
ccacuugugaaauaaucaaaua

SEQ ID NO: 947897 - RNA, 22 nt, Human
ggggcagagaauaaaaaccuaa

SEQ ID NO: 947898 - RNA, 17 nt, Human
aaucuguuuacagucag

SEQ ID NO: 947899 - RNA, 22 nt, Human
guggccaagaggggacuggaua

SEQ ID NO: 947900 - RNA, 22 nt, Human
ggcccugugguuuugcaaaguc

SEQ ID NO: 947901 - RNA, 22 nt, Human
agggcaaguugagugugcgugg

SEQ ID NO: 947902 - RNA, 17 nt, Human
agagagagcaugccacc

SEQ ID NO: 947903 - RNA, 22 nt, Human
gagcugccaguguaugaauucu

SEQ ID NO: 947904 - RNA, 22 nt, Human
cugugucccaguaccuugggua

SEQ ID NO: 947905 - RNA, 22 nt, Human
gcuccuggcaggcagugugugu

SEQ ID NO: 947906 - RNA, 22 nt, Human
uuguuucagcuguaugcuaugu

SEQ ID NO: 947907 - RNA, 22 nt, Human
ucuccuccuuuuuucaacauag

SEQ ID NO: 947908 - RNA, 22 nt, Human
agguauagaauugaaaggguuu

SEQ ID NO: 947909 - RNA, 22 nt, Human
ucccagcagagccagcaagccg

SEQ ID NO: 947910 - RNA, 22 nt, Human
cuguggcuuucucugccuccuu

SEQ ID NO: 947911 - RNA, 22 nt, Human
uggggacacagagguucguugg

SEQ ID NO: 947912 - RNA, 22 nt, Human
cugcccugacugaccuuuugaa

SEQ ID NO: 947913 - RNA, 23 nt, Human
uugauacagaagaaucaguuugu

SEQ ID NO: 947914 - RNA, 21 nt, Human
acagaacuguauagugauaaa

SEQ ID NO: 947915 - RNA, 22 nt, Human
cagggcagaacauauagauagu

SEQ ID NO: 947916 - RNA, 22 nt, Human
uuucuucagccacuccaaacug

SEQ ID NO: 947917 - RNA, 22 nt, Human
gccagcugguaggcaccuagcc

SEQ ID NO: 947918 - RNA, 22 nt, Human
uagaaacaucagcuaaccaaaa

SEQ ID NO: 947919 - RNA, 22 nt, Human
gggcagcucuggcugugggaag

SEQ ID NO: 947920 - RNA, 22 nt, Human
aaggcacuacgcugcuggggcg

SEQ ID NO: 947921 - RNA, 22 nt, Human
caggcacuggccagucagcaca

SEQ ID NO: 947922 - RNA, 22 nt, Human
cugagucucccggcaguggagg

SEQ ID NO: 947923 - RNA, 22 nt, Human
acaaaguuauucuuucagagga

SEQ ID NO: 947924 - RNA, 22 nt, Human
cugggaaggggaagguccucuc

SEQ ID NO: 947925 - RNA, 22 nt, Human
uagcagcugugaguaaaagcca

SEQ ID NO: 947926 - RNA, 22 nt, Human
ucucaggaagauuagggcuaag

SEQ ID NO: 947927 - RNA, 22 nt, Human
uggauaaacucacuguaaguug

SEQ ID NO: 947928 - RNA, 22 nt, Human
accuauuuaugcaauuaugaaa

SEQ ID NO: 947929 - RNA, 22 nt, Human
acaaagucaaauugcagccgcc

SEQ ID NO: 947930 - RNA, 22 nt, Human
ugccugcugcuaagcucuuugu

SEQ ID NO: 947931 - RNA, 22 nt, Human
uggcccugucccuggagccugg

SEQ ID NO: 947932 - RNA, 22 nt, Human
acugugugaaacaucaaugugu

SEQ ID NO: 947933 - RNA, 22 nt, Human
ugucacuucaggaaugcaggga

SEQ ID NO: 947934 - RNA, 22 nt, Human
ggccuugggauguggcugcagc

SEQ ID NO: 947935 - RNA, 22 nt, Human
agcuauguauaaauaggccacu

SEQ ID NO: 947936 - RNA, 22 nt, Human
uuaaauauuauguugucugcaa

SEQ ID NO: 947937 - RNA, 22 nt, Human
uuccagaauuuuguucugcuug

SEQ ID NO: 947938 - RNA, 22 nt, Human
cccagcuccgagcuccgagccg

SEQ ID NO: 947939 - RNA, 22 nt, Human
ccuuccuggcuguccgccugau

SEQ ID NO: 947940 - RNA, 19 nt, Human
ggcucucccuugagagagc

SEQ ID NO: 947941 - RNA, 22 nt, Human
aagcagccagccaucaugcccg

SEQ ID NO: 947942 - RNA, 22 nt, Human
cugagccagcuggcaugugcua

SEQ ID NO: 947943 - RNA, 22 nt, Human
gucucuaucauagcugaacccu

SEQ ID NO: 947944 - RNA, 22 nt, Human
aucaaaguucguaacugauaac

SEQ ID NO: 947945 - RNA, 22 nt, Human
gaaugcagauggcugguguaug

SEQ ID NO: 947946 - RNA, 22 nt, Human
guguuuccaguucagaaagcaa

SEQ ID NO: 947947 - RNA, 20 nt, Human
cagggccacgcuccaaggca

SEQ ID NO: 947948 - RNA, 22 nt, Human
acauuucuuucuauucaguagc

SEQ ID NO: 947949 - RNA, 22 nt, Human
gggccugacugagagcuccuca

SEQ ID NO: 947950 - RNA, 22 nt, Human
uuuaguagaaauauuugggccu

SEQ ID NO: 947951 - RNA, 19 nt, Human
ugccagcauuaggcugaag

SEQ ID NO: 947952 - RNA, 15 nt, Human
ugauuuccuacuaac

SEQ ID NO: 947953 - RNA, 22 nt, Human
gcacacaggcaguuuccagcca

SEQ ID NO: 947954 - RNA, 23 nt, Human
ggggccugcaccggucugcgcgg

SEQ ID NO: 947955 - RNA, 22 nt, Human
cagggccucuccuccaggaacu

SEQ ID NO: 947956 - RNA, 22 nt, Human
agauuucccaaauacuuguuau

SEQ ID NO: 947957 - RNA, 22 nt, Human
aacucacuuuguggcuucugaa

SEQ ID NO: 947958 - RNA, 22 nt, Human
uccaggaguuugagacugcagu

SEQ ID NO: 947959 - RNA, 22 nt, Human
agaggggacagccaccugcccg

SEQ ID NO: 947960 - RNA, 22 nt, Human
agauuucccucuuguauuugca

SEQ ID NO: 947961 - RNA, 22 nt, Human
ugggccugaguuugggaacugg

SEQ ID NO: 947962 - RNA, 22 nt, Human
aaccauuugccauuaucuuaag

SEQ ID NO: 947963 - RNA, 22 nt, Human
ccuggaccaaacacuggccugg

SEQ ID NO: 947964 - RNA, 19 nt, Human
cugggccagaaucagcuca

SEQ ID NO: 947965 - RNA, 23 nt, Human
agaagcagcuucuggaguaucgg

SEQ ID NO: 947966 - RNA, 22 nt, Human
uuauuagggugguuuauguucu

SEQ ID NO: 947967 - RNA, 22 nt, Human
ggagcugcacgcucugaagccu

SEQ ID NO: 947968 - RNA, 22 nt, Human
ugccagcaguagcaguaggcca

SEQ ID NO: 947969 - RNA, 22 nt, Human
gaacccaaccucacuuggggua

SEQ ID NO: 947970 - RNA, 22 nt, Human
gcacuaaaccaacauguaauaa

SEQ ID NO: 947971 - RNA, 22 nt, Human
gagcuggcuccgccaugcugcu

SEQ ID NO: 947972 - RNA, 22 nt, Human
acuggcaggcugcuggccggcg

SEQ ID NO: 947973 - RNA, 22 nt, Human
ucucuucuugauuuucacugga

SEQ ID NO: 947974 - RNA, 22 nt, Human
auagucuuagucuauaguuuug

SEQ ID NO: 947975 - RNA, 22 nt, Human
agggcacagccuaaagccuaug

SEQ ID NO: 947976 - RNA, 22 nt, Human
uggcagcuggaucccaaggcag

SEQ ID NO: 947977 - RNA, 22 nt, Human
auccaggcgaaugcagaaggcc

SEQ ID NO: 947978 - RNA, 23 nt, Human
uuucuguuggguauauauccaag

SEQ ID NO: 947979 - RNA, 22 nt, Human
cugugccaguguauuccuguga

SEQ ID NO: 947980 - RNA, 22 nt, Human
agucccagagaggucggggcca

SEQ ID NO: 947981 - RNA, 22 nt, Human
caggaggaacaagagguucugg

SEQ ID NO: 947982 - RNA, 22 nt, Human
gagcucccaggccccagcaagg

SEQ ID NO: 947983 - RNA, 22 nt, Human
uuaaguaagaccuuaugucuug

SEQ ID NO: 947984 - RNA, 22 nt, Human
uuaugacaggaaaaucacagaa

SEQ ID NO: 947985 - RNA, 22 nt, Human
ucaggcagaccaccgugggcag

SEQ ID NO: 947986 - RNA, 22 nt, Human
ggagaggauguuuuaguaacuu

SEQ ID NO: 947987 - RNA, 22 nt, Human
ugcacacacgcggcacaucugu

SEQ ID NO: 947988 - RNA, 23 nt, Human
cuggggcuuucaaaucugggcag

SEQ ID NO: 947989 - RNA, 20 nt, Human
gcauccauauaugcaugugu

SEQ ID NO: 947990 - RNA, 22 nt, Human
ugagcuucuuuauuuggccaga

SEQ ID NO: 947991 - RNA, 22 nt, Human
ucaugcccagagcaguaaauua

SEQ ID NO: 947992 - RNA, 22 nt, Human
uucaguaaaacacugcaauguc

SEQ ID NO: 947993 - RNA, 22 nt, Human
uagagcugauaaugaggccaag

SEQ ID NO: 947994 - RNA, 22 nt, Human
gaggggcagaaugugaucaggg

SEQ ID NO: 947995 - RNA, 22 nt, Human
cuguaaauaugaagaauauaug

SEQ ID NO: 947996 - RNA, 22 nt, Human
gcuggccugggcagaggcuaug

SEQ ID NO: 947997 - RNA, 22 nt, Human
cugucuguuuuaccuucuccag

SEQ ID NO: 947998 - RNA, 22 nt, Human
acuuucucaggaauucacagac

SEQ ID NO: 947999 - RNA, 22 nt, Human
cagagcugggaucccaugggcg

SEQ ID NO: 948000 - RNA, 22 nt, Human
ucuuuauuuuaugcuugugcaa

SEQ ID NO: 948001 - RNA, 22 nt, Human
uagaaucuaguucauucauuug

SEQ ID NO: 948002 - RNA, 22 nt, Human
ccaggccagcaggcacaccugc

SEQ ID NO: 948003 - RNA, 22 nt, Human
gccagcucagaugcaggaagga

SEQ ID NO: 948004 - RNA, 22 nt, Human
agugcagcaugcuggggaggcu

SEQ ID NO: 948005 - RNA, 22 nt, Human
augcugcacaagccacauguag

SEQ ID NO: 948006 - RNA, 22 nt, Human
gacucugcuaggaaaaucucag

SEQ ID NO: 948007 - RNA, 22 nt, Human
uauuucaugugcaccauaauuc

SEQ ID NO: 948008 - RNA, 22 nt, Human
ucaaaugcaggucuggucuugg

SEQ ID NO: 948009 - RNA, 22 nt, Human
auaaaaguaggaccaacuuaca

SEQ ID NO: 948010 - RNA, 22 nt, Human
ucucuuccaguaagagucuuua

SEQ ID NO: 948011 - RNA, 22 nt, Human
uucagcaacucaaaccuauuag

SEQ ID NO: 948012 - RNA, 22 nt, Human
ucccagagaaagucaaggucuu

SEQ ID NO: 948013 - RNA, 22 nt, Human
ccuccugggacucauuagcacc

SEQ ID NO: 948014 - RNA, 22 nt, Human
uaccugggcccaccagugccug

SEQ ID NO: 948015 - RNA, 23 nt, Human
cagggcugggcuugguguuaggc

SEQ ID NO: 948016 - RNA, 22 nt, Human
cagucucagaggugggaguggg

SEQ ID NO: 948017 - RNA, 22 nt, Human
gaggucaggcuugcagcagggu

SEQ ID NO: 948018 - RNA, 22 nt, Human
caguuucugggcguucacaggu

SEQ ID NO: 948019 - RNA, 22 nt, Human
cugcuuuggacaacuauucuug

SEQ ID NO: 948020 - RNA, 22 nt, Human
ugagccaggcucaagugauccu

SEQ ID NO: 948021 - RNA, 22 nt, Human
ggagcuguaacgagccauugcu

SEQ ID NO: 948022 - RNA, 20 nt, Human
ccuguucacugcgcaguuuc

SEQ ID NO: 948023 - RNA, 22 nt, Human
cccagggcuuuucucacuagac

SEQ ID NO: 948024 - RNA, 22 nt, Human
ccaggaaauagugcugugaucu

SEQ ID NO: 948025 - RNA, 15 nt, Human
ucacucuggaaggga

SEQ ID NO: 948026 - RNA, 22 nt, Human
auuuguacaaauuuauguuagu

SEQ ID NO: 948027 - RNA, 22 nt, Human
caugcugugcaucuugaugacc

SEQ ID NO: 948028 - RNA, 22 nt, Human
cagcugaguuacucugaggucu

SEQ ID NO: 948029 - RNA, 19 nt, Human
ugaggggaggagaggccug

SEQ ID NO: 948030 - RNA, 22 nt, Human
uuuuagauaguuuaacugcacu

SEQ ID NO: 948031 - RNA, 22 nt, Human
auacagaaaaugaugcagaguu

SEQ ID NO: 948032 - RNA, 22 nt, Human
ucccagagguugagucacuuau

SEQ ID NO: 948033 - RNA, 22 nt, Human
cagcugccccauaaaucacagu

SEQ ID NO: 948034 - RNA, 22 nt, Human
agcccuggcccggcugugcuuu

SEQ ID NO: 948035 - RNA, 22 nt, Human
cuuaaaaucuggcaguuagcua

SEQ ID NO: 948036 - RNA, 22 nt, Human
gcuggcagaauuucuucuugcu

SEQ ID NO: 948037 - RNA, 22 nt, Human
gccuccugaaaggaagagcucc

SEQ ID NO: 948038 - RNA, 23 nt, Human
gccucugcagccuaguuaguguc

SEQ ID NO: 948039 - RNA, 22 nt, Human
acagaauuaaaguguuugugga

SEQ ID NO: 948040 - RNA, 22 nt, Human
gcaggaugagugaguacauuua

SEQ ID NO: 948041 - RNA, 22 nt, Human
gaggcucagagggagcaugguc

SEQ ID NO: 948042 - RNA, 22 nt, Human
aggcugaggcagguggaucacc

SEQ ID NO: 948043 - RNA, 22 nt, Human
gguggccucugcaggccucgac

SEQ ID NO: 948044 - RNA, 22 nt, Human
ucagcaaugagaacuggcauuu

SEQ ID NO: 948045 - RNA, 22 nt, Human
ugcauaaagugccauaguauua

SEQ ID NO: 948046 - RNA, 22 nt, Human
ugcccacauucaaaaggugaug

SEQ ID NO: 948047 - RNA, 22 nt, Human
ugcugucuuccaggauggugaa

SEQ ID NO: 948048 - RNA, 22 nt, Human
ccagccucacuggcaucaccua

SEQ ID NO: 948049 - RNA, 22 nt, Human
ugugcuucugcagagacuauuu

SEQ ID NO: 948050 - RNA, 22 nt, Human
cagcccugccauggagccuccu

SEQ ID NO: 948051 - RNA, 22 nt, Human
caaggccaagucucugugaaga

SEQ ID NO: 948052 - RNA, 22 nt, Human
aaggcugaguaaaacagagaac

SEQ ID NO: 948053 - RNA, 19 nt, Human
gugauuucuuuccacaagc

SEQ ID NO: 948054 - RNA, 22 nt, Human
agccuccaaaugucaggucccg

SEQ ID NO: 948055 - RNA, 22 nt, Human
gaacuguaguuaauacuacaca

SEQ ID NO: 948056 - RNA, 22 nt, Human
gagucaguaauggauaugucau

SEQ ID NO: 948057 - RNA, 22 nt, Human
cagaagcaaaugccuugcugag

SEQ ID NO: 948058 - RNA, 22 nt, Human
gagggcugccacguugggcgag

SEQ ID NO: 948059 - RNA, 22 nt, Human
acucugcucuguauuucacugu

SEQ ID NO: 948060 - RNA, 22 nt, Human
ucccucuguguugggcaugccu

SEQ ID NO: 948061 - RNA, 22 nt, Human
aaggcaguaaaaucuaccuugc

SEQ ID NO: 948062 - RNA, 22 nt, Human
acucacuuuccauucaagcacc

SEQ ID NO: 948063 - RNA, 22 nt, Human
ugccaggagucaggccaggcag

SEQ ID NO: 948064 - RNA, 22 nt, Human
guuugaaaaaagcaguauguaa

SEQ ID NO: 948065 - RNA, 22 nt, Human
gagcccaggcagagguugcagu

SEQ ID NO: 948066 - RNA, 22 nt, Human
ugcagaagcagagccgguggcc

SEQ ID NO: 948067 - RNA, 22 nt, Human
cuguagcagugugcucuuuuuc

SEQ ID NO: 948068 - RNA, 22 nt, Human
cccaggaagagugaguggcauu

SEQ ID NO: 948069 - RNA, 22 nt, Human
ccauuguaguaucuguuuuagu

SEQ ID NO: 948070 - RNA, 22 nt, Human
gaguuauuaauggcugaguuug

SEQ ID NO: 948071 - RNA, 18 nt, Human
agcuucccucugagaggg

SEQ ID NO: 948072 - RNA, 22 nt, Human
uacauguauugauuucucuucu

SEQ ID NO: 948073 - RNA, 22 nt, Human
uccuggagcuuccuucauggua

SEQ ID NO: 948074 - RNA, 22 nt, Human
cagcaauauacacagucuaugg

SEQ ID NO: 948075 - RNA, 22 nt, Human
acuggccagaacuaagucacau

SEQ ID NO: 948076 - RNA, 22 nt, Human
uauaacaguuuaggugguguca

SEQ ID NO: 948077 - RNA, 22 nt, Human
ggccugcugggccccacagucc

SEQ ID NO: 948078 - RNA, 22 nt, Human
ugcugccuccaacuccugggcu

SEQ ID NO: 948079 - RNA, 22 nt, Human
ucugcaagauggucuuagaggu

SEQ ID NO: 948080 - RNA, 22 nt, Human
acagugacguuuauuugagacg

SEQ ID NO: 948081 - RNA, 22 nt, Human
gaggcacugaauacuugagggu

SEQ ID NO: 948082 - RNA, 18 nt, Human
ggagagugacagagucgu

SEQ ID NO: 948083 - RNA, 20 nt, Human
acauugauuauguuuguaga

SEQ ID NO: 948084 - RNA, 19 nt, Human
agggagaauuccaagagga

SEQ ID NO: 948085 - RNA, 22 nt, Human
ccugucucuuucaaucugagag

SEQ ID NO: 948086 - RNA, 22 nt, Human
ucuccuucgaggcccagcuccc

SEQ ID NO: 948087 - RNA, 22 nt, Human
uacauggugguggcacuugacu

SEQ ID NO: 948088 - RNA, 22 nt, Human
cacugcuuauaaauucuaggca

SEQ ID NO: 948089 - RNA, 22 nt, Human
cacagggcuuugauggcugagu

SEQ ID NO: 948090 - RNA, 22 nt, Human
aaaucaguuagugguaggauug

SEQ ID NO: 948091 - RNA, 22 nt, Human
ccagccugaaaugccucauccu

SEQ ID NO: 948092 - RNA, 22 nt, Human
cugggaggacaacuuggagcuc

SEQ ID NO: 948093 - RNA, 22 nt, Human
ucacagggcauuauggcuccag

SEQ ID NO: 948094 - RNA, 22 nt, Human
uauuucagcaagaagaaugugg

SEQ ID NO: 948095 - RNA, 22 nt, Human
acaguaaugauucugagucucu

SEQ ID NO: 948096 - RNA, 22 nt, Human
gcagacaggcccaguggaggga

SEQ ID NO: 948097 - RNA, 22 nt, Human
aaccuucacuugcuucauuuga

SEQ ID NO: 948098 - RNA, 22 nt, Human
aauaucaacaguguccuucuaa

SEQ ID NO: 948099 - RNA, 22 nt, Human
uucuucaauuuuccauauacug

SEQ ID NO: 948100 - RNA, 22 nt, Human
aggcuuccucgugccuuagaua

SEQ ID NO: 948101 - RNA, 22 nt, Human
cugugcuggagaugggccagag

SEQ ID NO: 948102 - RNA, 22 nt, Human
gaaauguguuguucauuucuaa

SEQ ID NO: 948103 - RNA, 22 nt, Human
uaauguauaacaaauacucauc

SEQ ID NO: 948104 - RNA, 22 nt, Human
auugaaagauauacuguucuca

SEQ ID NO: 948105 - RNA, 22 nt, Human
aggccuggccuuuauguucaag

SEQ ID NO: 948106 - RNA, 22 nt, Human
ucauuaagauuacgugccagaa

SEQ ID NO: 948107 - RNA, 22 nt, Human
uaggagggcccugaaaauggca

SEQ ID NO: 948108 - RNA, 22 nt, Human
ugggcagagaguagaggcaacg

SEQ ID NO: 948109 - RNA, 17 nt, Human
agguggcugcugcgccu

SEQ ID NO: 948110 - RNA, 22 nt, Human
acugccaggauggcacuagagg

SEQ ID NO: 948111 - RNA, 22 nt, Human
ugggcagaaggaagagccaccu

SEQ ID NO: 948112 - RNA, 22 nt, Human
ugagccaggcacugcuccugga

SEQ ID NO: 948113 - RNA, 19 nt, Human
ugcaagcuuuuucuuguua

SEQ ID NO: 948114 - RNA, 22 nt, Human
gcaggaagaugagcucagguaa

SEQ ID NO: 948115 - RNA, 22 nt, Human
gccuggaggggacagucucugg

SEQ ID NO: 948116 - RNA, 22 nt, Human
ccacucugauuggucaccucug

SEQ ID NO: 948117 - RNA, 22 nt, Human
gcuugggauaugcugauguaaa

SEQ ID NO: 948118 - RNA, 22 nt, Human
aguuugaaaguauugacagaag

SEQ ID NO: 948119 - RNA, 22 nt, Human
aauauaaugcuguuuuaugcca

SEQ ID NO: 948120 - RNA, 22 nt, Human
cacucugccugauguuacaugg

SEQ ID NO: 948121 - RNA, 17 nt, Human
agaugcuggccacaugu

SEQ ID NO: 948122 - RNA, 22 nt, Human
cagcugcuuuaguuuuccaucc

SEQ ID NO: 948123 - RNA, 22 nt, Human
ccugcugggccugagcaaugag

SEQ ID NO: 948124 - RNA, 22 nt, Human
ugaggcagucacccccuccugc

SEQ ID NO: 948125 - RNA, 22 nt, Human
cuggccaacaucuggggcacau

SEQ ID NO: 948126 - RNA, 22 nt, Human
gccagguggcugagugacugag

SEQ ID NO: 948127 - RNA, 22 nt, Human
cccuggaggcaaagguugcagu

SEQ ID NO: 948128 - RNA, 22 nt, Human
cagcaagauuuuuaaagcaagg

SEQ ID NO: 948129 - RNA, 22 nt, Human
cuucucaguugcaagugucaga

SEQ ID NO: 948130 - RNA, 22 nt, Human
ugcagaagacacaagguaacgu

SEQ ID NO: 948131 - RNA, 22 nt, Human
ucagugugaguaccaugcucag

SEQ ID NO: 948132 - RNA, 22 nt, Human
cugccuggccugaucuccacgc

SEQ ID NO: 948133 - RNA, 22 nt, Human
acacucugugaggcauguaaug

SEQ ID NO: 948134 - RNA, 22 nt, Human
cagcuggcugcaugaugccaaa

SEQ ID NO: 948135 - RNA, 22 nt, Human
ccagcacugcucucagacugag

SEQ ID NO: 948136 - RNA, 22 nt, Human
cagaggaugaucuggccucucu

SEQ ID NO: 948137 - RNA, 22 nt, Human
augaaagaugauuuaaaguacu

SEQ ID NO: 948138 - RNA, 22 nt, Human
ugcauuuccagauuucuggagu

SEQ ID NO: 948139 - RNA, 22 nt, Human
gaggaaaagagacagguuauug

SEQ ID NO: 948140 - RNA, 21 nt, Human
aacaaagggaugcucaucuuu

SEQ ID NO: 948141 - RNA, 22 nt, Human
acuuuugguucuguaacuguga

SEQ ID NO: 948142 - RNA, 22 nt, Human
uuuuucaugagacuagaaguca

SEQ ID NO: 948143 - RNA, 22 nt, Human
cagggcccaagacacaaugagg

SEQ ID NO: 948144 - RNA, 22 nt, Human
aaugucugcucuacucaggagg

SEQ ID NO: 948145 - RNA, 22 nt, Human
uggcccugcugggucagagcug

SEQ ID NO: 948146 - RNA, 23 nt, Human
gagguacagcaccagugaauagg

SEQ ID NO: 948147 - RNA, 22 nt, Human
ccaggaguuugaggcugcagug

SEQ ID NO: 948148 - RNA, 22 nt, Human
uggcagcagacaucugaggucu

SEQ ID NO: 948149 - RNA, 22 nt, Human
uuaauaaaguaugaauuggaaa

SEQ ID NO: 948150 - RNA, 22 nt, Human
caguuuuugccauuaagaguaa

SEQ ID NO: 948151 - RNA, 22 nt, Human
ugggcuguggagcaccuuugca

SEQ ID NO: 948152 - RNA, 18 nt, Human
ccugcagcccaggaggcc

SEQ ID NO: 948153 - RNA, 22 nt, Human
gccagcccagcuccaggggaaa

SEQ ID NO: 948154 - RNA, 22 nt, Human
ccaggcuggauuuugcaguuca

SEQ ID NO: 948155 - RNA, 22 nt, Human
uuuaggaucucucuuguuacau

SEQ ID NO: 948156 - RNA, 22 nt, Human
cuggccacuggagguggcaccc

SEQ ID NO: 948157 - RNA, 22 nt, Human
gcuguucugcgucccaggcugg

SEQ ID NO: 948158 - RNA, 22 nt, Human
agaguucagcuacugcaaaugu

SEQ ID NO: 948159 - RNA, 22 nt, Human
cagaaaauaaaguuucuacgca

SEQ ID NO: 948160 - RNA, 22 nt, Human
cauuucugggagacaugcuaga

SEQ ID NO: 948161 - RNA, 21 nt, Human
ucccacucuaaauggacugaa

SEQ ID NO: 948162 - RNA, 22 nt, Human
ugauuuccaguugcugggugcu

SEQ ID NO: 948163 - RNA, 22 nt, Human
ggcugccucuggaagcuggaga

SEQ ID NO: 948164 - RNA, 22 nt, Human
guuauguauugggaaauccaag

SEQ ID NO: 948165 - RNA, 22 nt, Human
ggggcuguuuuuggaauggcug

SEQ ID NO: 948166 - RNA, 20 nt, Human
cuguaucagguuacaaagua

SEQ ID NO: 948167 - RNA, 22 nt, Human
augcuuuacaguuuuccaaaca

SEQ ID NO: 948168 - RNA, 22 nt, Human
ggaagaggcugaggccaugcug

SEQ ID NO: 948169 - RNA, 22 nt, Human
cagccagcugaauguaccauga

SEQ ID NO: 948170 - RNA, 22 nt, Human
gucaggauuauuuuauuaaaag

SEQ ID NO: 948171 - RNA, 22 nt, Human
uguaggaguccaaucaggagac

SEQ ID NO: 948172 - RNA, 21 nt, Human
aaagugguaaggauuauuuug

SEQ ID NO: 948173 - RNA, 22 nt, Human
caguccuggggaccaggcugag

SEQ ID NO: 948174 - RNA, 22 nt, Human
cucagaguccccacaucugggu

SEQ ID NO: 948175 - RNA, 22 nt, Human
guucuucagcauuagaagucau

SEQ ID NO: 948176 - RNA, 22 nt, Human
gcagggacagggcagggccuuu

SEQ ID NO: 948177 - RNA, 22 nt, Human
gacccagcuuaagucacauguu

SEQ ID NO: 948178 - RNA, 22 nt, Human
gaggcagcgggucaggaccgug

SEQ ID NO: 948179 - RNA, 22 nt, Human
ugacagaaauaguucuuaauuu

SEQ ID NO: 948180 - RNA, 22 nt, Human
agucucuuuguggacucugccu

SEQ ID NO: 948181 - RNA, 20 nt, Human
ugccagggccagcagaggcu

SEQ ID NO: 948182 - RNA, 22 nt, Human
gacagggcaagacucugucuaa

SEQ ID NO: 948183 - RNA, 22 nt, Human
cugagggcaugaacauuccaua

SEQ ID NO: 948184 - RNA, 22 nt, Human
cagcuugggaguuugguuuuau

SEQ ID NO: 948185 - RNA, 22 nt, Human
augaaaacuuuagccucauuag

SEQ ID NO: 948186 - RNA, 17 nt, Human
caggcagacauguaagc

SEQ ID NO: 948187 - RNA, 22 nt, Human
uacagaaaucacaucgcuuuga

SEQ ID NO: 948188 - RNA, 22 nt, Human
cugucaguaggcucccaucauu

SEQ ID NO: 948189 - RNA, 22 nt, Human
uggccaguagauaggcaggcaa

SEQ ID NO: 948190 - RNA, 22 nt, Human
ucauugaauuucacagcuuuau

SEQ ID NO: 948191 - RNA, 22 nt, Human
ggcuccuguccuccuggagcuc

SEQ ID NO: 948192 - RNA, 22 nt, Human
uagcagcuuccagagagggcag

SEQ ID NO: 948193 - RNA, 19 nt, Human
uucccaggaaaggggugca

SEQ ID NO: 948194 - RNA, 22 nt, Human
ugccaggcauauggccucuuug

SEQ ID NO: 948195 - RNA, 22 nt, Human
agguggggugagcugcagacua

SEQ ID NO: 948196 - RNA, 23 nt, Human
uccuuccuuugagaggcuccauc

SEQ ID NO: 948197 - RNA, 22 nt, Human
cucaaggacuuauucaugccug

SEQ ID NO: 948198 - RNA, 22 nt, Human
auucuuaauuccaaagacugag

SEQ ID NO: 948199 - RNA, 20 nt, Human
agaagcugauacugauggaa

SEQ ID NO: 948200 - RNA, 22 nt, Human
ugggcagaucuuugguggcuag

SEQ ID NO: 948201 - RNA, 22 nt, Human
uguguacaggccuugcuagacu

SEQ ID NO: 948202 - RNA, 22 nt, Human
gcagggaagacccggagcagcg

SEQ ID NO: 948203 - RNA, 22 nt, Human
ugggagcugggguuggacgucu

SEQ ID NO: 948204 - RNA, 22 nt, Human
gacuccugggccucugagaggc

SEQ ID NO: 948205 - RNA, 22 nt, Human
guggccaaggugcagagcagcu

SEQ ID NO: 948206 - RNA, 22 nt, Human
cuucccugauaagagccucaga

SEQ ID NO: 948207 - RNA, 22 nt, Human
uccucagcaaacacuucacucu

SEQ ID NO: 948208 - RNA, 22 nt, Human
agauacauuaguaguuacuugu

SEQ ID NO: 948209 - RNA, 22 nt, Human
ccugugcauccgguggucauug

SEQ ID NO: 948210 - RNA, 22 nt, Human
ucuuccaguguagacaucugcc

SEQ ID NO: 948211 - RNA, 22 nt, Human
ugaaggccucugguacaugcca

SEQ ID NO: 948212 - RNA, 22 nt, Human
ucucuggaagcgcagaucuguu

SEQ ID NO: 948213 - RNA, 18 nt, Human
ugucauugccagggaagc

SEQ ID NO: 948214 - RNA, 22 nt, Human
ccugcagcuguaggagaaggcg

SEQ ID NO: 948215 - RNA, 23 nt, Human
auguuauuauuagcagucuugcc

SEQ ID NO: 948216 - RNA, 22 nt, Human
cacagugcaugaugggcagaag

SEQ ID NO: 948217 - RNA, 22 nt, Human
uccugggcuuuguuucucuccu

SEQ ID NO: 948218 - RNA, 22 nt, Human
cagucccagaagagccugggag

SEQ ID NO: 948219 - RNA, 22 nt, Human
aaaugcacagaggccagagagg

SEQ ID NO: 948220 - RNA, 22 nt, Human
uucacaggcuuggagguggggg

SEQ ID NO: 948221 - RNA, 22 nt, Human
cugggccucaaucucagaguuu

SEQ ID NO: 948222 - RNA, 22 nt, Human
ucagagccccuccgcuguccca

SEQ ID NO: 948223 - RNA, 22 nt, Human
auuucaguguuuuaagaguuca

SEQ ID NO: 948224 - RNA, 22 nt, Human
gggcaugagagggcagcuggca

SEQ ID NO: 948225 - RNA, 23 nt, Human
uauuagggccaggacuggcaaau

SEQ ID NO: 948226 - RNA, 22 nt, Human
aagaaauauugggccuuauaaa

SEQ ID NO: 948227 - RNA, 22 nt, Human
cugaaggauguguggugggagu

SEQ ID NO: 948228 - RNA, 22 nt, Human
ucucagagauuuuguuucccuu

SEQ ID NO: 948229 - RNA, 22 nt, Human
caggggcagucugugugcgugg

SEQ ID NO: 948230 - RNA, 22 nt, Human
aauggccagcugggagaguuga

SEQ ID NO: 948231 - RNA, 22 nt, Human
uauccaaaguuucucagaaacu

SEQ ID NO: 948232 - RNA, 18 nt, Human
uuuaugagcugugggacc

SEQ ID NO: 948233 - RNA, 22 nt, Human
uggccugaggcucggcaugggu

SEQ ID NO: 948234 - RNA, 22 nt, Human
ucaggagaacuuccuucuaccc

SEQ ID NO: 948235 - RNA, 23 nt, Human
agaggccagccuuuggagacacc

SEQ ID NO: 948236 - RNA, 22 nt, Human
aaugcuguucugagucugcagg

SEQ ID NO: 948237 - RNA, 21 nt, Human
uccuccuucaaguccuggccu

SEQ ID NO: 948238 - RNA, 22 nt, Human
ucauugcauuuauucacuggca

SEQ ID NO: 948239 - RNA, 22 nt, Human
cagcugacuucauaggaagaca

SEQ ID NO: 948240 - RNA, 22 nt, Human
agcagggguaacagaaggaaag

SEQ ID NO: 948241 - RNA, 22 nt, Human
agcugccagcaucccggaaggg

SEQ ID NO: 948242 - RNA, 22 nt, Human
uccucacagucaacacuuugag

SEQ ID NO: 948243 - RNA, 22 nt, Human
uuucauaauagugcaguuuguu

SEQ ID NO: 948244 - RNA, 22 nt, Human
auuuccagcagcauauuugucu

SEQ ID NO: 948245 - RNA, 22 nt, Human
ggccagagaagucagacccuug

SEQ ID NO: 948246 - RNA, 22 nt, Human
cccuggcaugcaugucccuggc

SEQ ID NO: 948247 - RNA, 22 nt, Human
gccaggccugcaagugcuggug

SEQ ID NO: 948248 - RNA, 22 nt, Human
uuguaacagguacuaaauaacu

SEQ ID NO: 948249 - RNA, 22 nt, Human
ugggcugccagcucuccagaug

SEQ ID NO: 948250 - RNA, 22 nt, Human
ucaaggcuaaacuuucagagua

SEQ ID NO: 948251 - RNA, 22 nt, Human
ccaggagcaacuugaaggcaag

SEQ ID NO: 948252 - RNA, 22 nt, Human
uaccugagcccagugcagcaua

SEQ ID NO: 948253 - RNA, 22 nt, Human
ggcagagcuuguuccuucuguu

SEQ ID NO: 948254 - RNA, 22 nt, Human
caugcuguguguuuuagcucca

SEQ ID NO: 948255 - RNA, 18 nt, Human
ugaggcagucagugaugg

SEQ ID NO: 948256 - RNA, 18 nt, Human
cucagggcaucagucugg

SEQ ID NO: 948257 - RNA, 22 nt, Human
acaaauaugguacucggagaaa

SEQ ID NO: 948258 - RNA, 22 nt, Human
cuggcuggccggaggcaucccu

SEQ ID NO: 948259 - RNA, 22 nt, Human
gccugugacucgucuugggcca

SEQ ID NO: 948260 - RNA, 22 nt, Human
aaaugcauuuuuaauuagaccc

SEQ ID NO: 948261 - RNA, 18 nt, Human
cagaagcaggcagugcag

SEQ ID NO: 948262 - RNA, 20 nt, Human
uuucaguuaucuugaccuuc

SEQ ID NO: 948263 - RNA, 22 nt, Human
caggagcucucaucgucagggc

SEQ ID NO: 948264 - RNA, 22 nt, Human
cugaaugucgaucagcuugggu

SEQ ID NO: 948265 - RNA, 22 nt, Human
ccagacaggaacacacaucucc

SEQ ID NO: 948266 - RNA, 22 nt, Human
auccaaagcccuaaguuaacug

SEQ ID NO: 948267 - RNA, 22 nt, Human
gaaggagacccugaagaugcug

SEQ ID NO: 948268 - RNA, 22 nt, Human
ccaggagagcucuaaauggcug

SEQ ID NO: 948269 - RNA, 22 nt, Human
cugccuggaaggagcaagggga

SEQ ID NO: 948270 - RNA, 22 nt, Human
uucagugucaauuuuuaaauau

SEQ ID NO: 948271 - RNA, 22 nt, Human
cagugcagaacacauggaaaau

SEQ ID NO: 948272 - RNA, 20 nt, Human
cccagggaccugagcuccau

SEQ ID NO: 948273 - RNA, 22 nt, Human
uggcagcagggaggccaguguu

SEQ ID NO: 948274 - RNA, 22 nt, Human
caggacaguuugcuuugcccug

SEQ ID NO: 948275 - RNA, 22 nt, Human
uuuccuuccaaaugcccgggag

SEQ ID NO: 948276 - RNA, 22 nt, Human
ugcuaucucuauauccauuuau

SEQ ID NO: 948277 - RNA, 22 nt, Human
ugaaaucuucacuaagucucuu

SEQ ID NO: 948278 - RNA, 22 nt, Human
cucuggagugcagccugguggc

SEQ ID NO: 948279 - RNA, 22 nt, Human
aggccugagcagaggaguggac

SEQ ID NO: 948280 - RNA, 21 nt, Human
aucacauuggcuguuauuauu

SEQ ID NO: 948281 - RNA, 22 nt, Human
cacugagaggucucauuuccaa

SEQ ID NO: 948282 - RNA, 22 nt, Human
gcagggcacagacagugccaag

SEQ ID NO: 948283 - RNA, 22 nt, Human
ucugccugccagucugguccuc

SEQ ID NO: 948284 - RNA, 22 nt, Human
uuuguuuacucauucauugaug

SEQ ID NO: 948285 - RNA, 19 nt, Human
caucuggaugauucuccug

SEQ ID NO: 948286 - RNA, 22 nt, Human
aaagguuaagguguucaagaaa

SEQ ID NO: 948287 - RNA, 22 nt, Human
acagcugugaaaauccacagga

SEQ ID NO: 948288 - RNA, 22 nt, Human
guaggcagucucucaggugauc

SEQ ID NO: 948289 - RNA, 22 nt, Human
gggcccacuggcugucugaccc

SEQ ID NO: 948290 - RNA, 22 nt, Human
gcuguuaggugcccugaccuug

SEQ ID NO: 948291 - RNA, 22 nt, Human
uuaauuaaauucaugagcauug

SEQ ID NO: 948292 - RNA, 22 nt, Human
aggccugacuugaauuuagggc

SEQ ID NO: 948293 - RNA, 20 nt, Human
aagggcagagggaacagacu

SEQ ID NO: 948294 - RNA, 22 nt, Human
gcuggcuguuggagguaccugc

SEQ ID NO: 948295 - RNA, 22 nt, Human
agggacuggcucucugagcagg

SEQ ID NO: 948296 - RNA, 22 nt, Human
augaagcugguuuuggcuuggg

SEQ ID NO: 948297 - RNA, 22 nt, Human
guucuccauucagcuuccugug

SEQ ID NO: 948298 - RNA, 22 nt, Human
gccuggugguauccuggcaaga

SEQ ID NO: 948299 - RNA, 22 nt, Human
agacuucucaguuuuauuagua

SEQ ID NO: 948300 - RNA, 22 nt, Human
ccaggagcuggagggugcagug

SEQ ID NO: 948301 - RNA, 22 nt, Human
uuggccuucccuaccugggcca

SEQ ID NO: 948302 - RNA, 22 nt, Human
ugccucugugugcaggugagca

SEQ ID NO: 948303 - RNA, 22 nt, Human
ccugccagucacuaugucaccu

SEQ ID NO: 948304 - RNA, 22 nt, Human
uucaccuugaauaugucuuaaa

SEQ ID NO: 948305 - RNA, 22 nt, Human
aucugacaaccuauugacuuga

SEQ ID NO: 948306 - RNA, 22 nt, Human
ucaggcugagaaaaucuggacc

SEQ ID NO: 948307 - RNA, 22 nt, Human
gcugggagaggcccugaaguga

SEQ ID NO: 948308 - RNA, 22 nt, Human
cuggguggaucgcagccccagg

SEQ ID NO: 948309 - RNA, 22 nt, Human
uccuggaguugugcagugcaca

SEQ ID NO: 948310 - RNA, 22 nt, Human
ucggagcuguagaugaaacccu

SEQ ID NO: 948311 - RNA, 22 nt, Human
cagggccugccugguuccugga

SEQ ID NO: 948312 - RNA, 19 nt, Human
cugcucaggucagucuguc

SEQ ID NO: 948313 - RNA, 22 nt, Human
caguuucuguuuuaaauagcag

SEQ ID NO: 948314 - RNA, 22 nt, Human
cccuuggggaugcugugucugg

SEQ ID NO: 948315 - RNA, 22 nt, Human
ucccugggaacaaaggaugaga

SEQ ID NO: 948316 - RNA, 22 nt, Human
auggcagggcagccucucagag

SEQ ID NO: 948317 - RNA, 22 nt, Human
augcacgccccacacuggugug

SEQ ID NO: 948318 - RNA, 22 nt, Human
uccucuucugcccaucagaggc

SEQ ID NO: 948319 - RNA, 22 nt, Human
cccuucccuucugggagaucca

SEQ ID NO: 948320 - RNA, 22 nt, Human
uguuuaagcugaugagguaucg

SEQ ID NO: 948321 - RNA, 22 nt, Human
ggcagcuccucaaaaaauuaaa

SEQ ID NO: 948322 - RNA, 23 nt, Human
ccagugauugccuggaaggaggu

SEQ ID NO: 948323 - RNA, 22 nt, Human
gaugcugagagguggagggaac

SEQ ID NO: 948324 - RNA, 22 nt, Human
ggcaugggagugagcaaccuua

SEQ ID NO: 948325 - RNA, 19 nt, Human
cagaguccuugaccagucc

SEQ ID NO: 948326 - RNA, 22 nt, Human
cagagcugcgcuuuuuccuggu

SEQ ID NO: 948327 - RNA, 22 nt, Human
cacaaugugguuugucaucuuu

SEQ ID NO: 948328 - RNA, 22 nt, Human
uucugggacaucuggacaguuu

SEQ ID NO: 948329 - RNA, 23 nt, Human
ggccauggagacuuagaaugggc

SEQ ID NO: 948330 - RNA, 21 nt, Human
ucaaagcacauauuugcacau

SEQ ID NO: 948331 - RNA, 22 nt, Human
uccuccaggucuaggguggcuu

SEQ ID NO: 948332 - RNA, 22 nt, Human
gagaggcugaaaucacaggagc

SEQ ID NO: 948333 - RNA, 22 nt, Human
auucacagggacaaugggagag

SEQ ID NO: 948334 - RNA, 22 nt, Human
caugucuuggcuuaggcacaga

SEQ ID NO: 948335 - RNA, 20 nt, Human
aaagucuuaugguuaauuuu

SEQ ID NO: 948336 - RNA, 22 nt, Human
ccagcccuccuccaucagagga

SEQ ID NO: 948337 - RNA, 22 nt, Human
ucaggggcuugaggugcauguc

SEQ ID NO: 948338 - RNA, 22 nt, Human
acagcauugcuccaucucaaga

SEQ ID NO: 948339 - RNA, 22 nt, Human
cuggggcuggugaggcaggcuc

SEQ ID NO: 948340 - RNA, 22 nt, Human
caguggccugagccaggcuucc

SEQ ID NO: 948341 - RNA, 22 nt, Human
agaaauacuaggaauauucaua

SEQ ID NO: 948342 - RNA, 17 nt, Human
agcugagcuggccaggg

SEQ ID NO: 948343 - RNA, 22 nt, Human
guucuucaguaaaauuaaaugu

SEQ ID NO: 948344 - RNA, 22 nt, Human
auauucuuccaaaacaucauuu

SEQ ID NO: 948345 - RNA, 22 nt, Human
guucacaagaguuacagacaga

SEQ ID NO: 948346 - RNA, 22 nt, Human
ccagaggaaaaauaucucccua

SEQ ID NO: 948347 - RNA, 23 nt, Human
agggccugauggcucccgcuggc

SEQ ID NO: 948348 - RNA, 22 nt, Human
auauucuucuuguucagacuau

SEQ ID NO: 948349 - RNA, 22 nt, Human
ucuaagccuaggaaaugaguuu

SEQ ID NO: 948350 - RNA, 22 nt, Human
cccaggaguuggaggcuacggu

SEQ ID NO: 948351 - RNA, 22 nt, Human
caggagcccagaguccucagcu

SEQ ID NO: 948352 - RNA, 22 nt, Human
gaggccaaucaauagggcaaua

SEQ ID NO: 948353 - RNA, 22 nt, Human
aaggcacuguacuaguuaguua

SEQ ID NO: 948354 - RNA, 20 nt, Human
guggccucucacauucugag

SEQ ID NO: 948355 - RNA, 22 nt, Human
cuggcuccaucacugggugaug

SEQ ID NO: 948356 - RNA, 22 nt, Human
ccugggagguggagguugcagc

SEQ ID NO: 948357 - RNA, 22 nt, Human
aggcuccuaucgcuuucagcaa

SEQ ID NO: 948358 - RNA, 22 nt, Human
cagagcugggcauggugaaagg

SEQ ID NO: 948359 - RNA, 22 nt, Human
ggagggcucaauugacuccuga

SEQ ID NO: 948360 - RNA, 20 nt, Human
gugccuggagaagaggcugu

SEQ ID NO: 948361 - RNA, 22 nt, Human
aaagacuuggcuuaugauuugc

SEQ ID NO: 948362 - RNA, 22 nt, Human
uuucaguuuuugcucgauguau

SEQ ID NO: 948363 - RNA, 22 nt, Human
gcagcuccuucaaucucaccau

SEQ ID NO: 948364 - RNA, 22 nt, Human
cagcccuggaacagcugacuca

SEQ ID NO: 948365 - RNA, 22 nt, Human
agggccucugacgcccccagcc

SEQ ID NO: 948366 - RNA, 22 nt, Human
uaagauguuuugguuugauaag

SEQ ID NO: 948367 - RNA, 22 nt, Human
ucuguggauuuuaguguucaug

SEQ ID NO: 948368 - RNA, 22 nt, Human
caacagaaggaagcagggucag

SEQ ID NO: 948369 - RNA, 22 nt, Human
agggcagcccuucugggagggc

SEQ ID NO: 948370 - RNA, 22 nt, Human
aaaggaagauugagcuuuucca

SEQ ID NO: 948371 - RNA, 22 nt, Human
cagccucucuguaucucaggau

SEQ ID NO: 948372 - RNA, 22 nt, Human
agccacagucugaugccugaga

SEQ ID NO: 948373 - RNA, 22 nt, Human
cugcaggauucucccaguugga

SEQ ID NO: 948374 - RNA, 19 nt, Human
acccagagcccuuugcagg

SEQ ID NO: 948375 - RNA, 22 nt, Human
gaggcaggcacuguuaucagca

SEQ ID NO: 948376 - RNA, 22 nt, Human
cagcagagggagccauugaaau

SEQ ID NO: 948377 - RNA, 20 nt, Human
cagucccaauccagggccag

SEQ ID NO: 948378 - RNA, 22 nt, Human
cccagggagguagcaggagaaa

SEQ ID NO: 948379 - RNA, 22 nt, Human
aauguacaaggguuccaguuuu

SEQ ID NO: 948380 - RNA, 22 nt, Human
auaugaaaguaagcaugugugu

SEQ ID NO: 948381 - RNA, 22 nt, Human
guucuguacuccaagcucuucc

SEQ ID NO: 948382 - RNA, 23 nt, Human
ugcauuauccucucugaagacca

SEQ ID NO: 948383 - RNA, 22 nt, Human
uucuggaguauuccuggcaccu

SEQ ID NO: 948384 - RNA, 22 nt, Human
ucuucuucccaucccucaaaug

SEQ ID NO: 948385 - RNA, 22 nt, Human
uugugcauuucucugagugugu

SEQ ID NO: 948386 - RNA, 22 nt, Human
uauguacaguccuuaacuuaaa

SEQ ID NO: 948387 - RNA, 22 nt, Human
uuuguaaaggccugaauuucag

SEQ ID NO: 948388 - RNA, 22 nt, Human
cugagcugcggcaggcaccugg

SEQ ID NO: 948389 - RNA, 22 nt, Human
ggccugugucugugccuguccu

SEQ ID NO: 948390 - RNA, 22 nt, Human
ugggaccaagucauuucuuuag

SEQ ID NO: 948391 - RNA, 22 nt, Human
gcugucacaucaaggcacuaaa

SEQ ID NO: 948392 - RNA, 22 nt, Human
aacaucuuuuuguuugcugaaa

SEQ ID NO: 948393 - RNA, 22 nt, Human
uugcaaaugugaauaauuacac

SEQ ID NO: 948394 - RNA, 20 nt, Human
gguagcagcugcugucaucc

SEQ ID NO: 948395 - RNA, 22 nt, Human
auaucacaguaguuguuuaguu

SEQ ID NO: 948396 - RNA, 22 nt, Human
uggagcagcaucacuuugagcu

SEQ ID NO: 948397 - RNA, 22 nt, Human
uuagucuucuuccuuauauguu

SEQ ID NO: 948398 - RNA, 22 nt, Human
ugggggugaaagucuggacagu

SEQ ID NO: 948399 - RNA, 18 nt, Human
aggauauuaagaguacag

SEQ ID NO: 948400 - RNA, 22 nt, Human
uauauucaaugauuaguaucag

SEQ ID NO: 948401 - RNA, 22 nt, Human
gcucccagggaccgcagggcag

SEQ ID NO: 948402 - RNA, 22 nt, Human
gcagagccaggagagacccuug

SEQ ID NO: 948403 - RNA, 22 nt, Human
acucccacuccagaguagaagc

SEQ ID NO: 948404 - RNA, 22 nt, Human
ugaacccaggagguugcaguga

SEQ ID NO: 948405 - RNA, 22 nt, Human
agugaaauccuggucaacaggu

SEQ ID NO: 948406 - RNA, 22 nt, Human
uuuucucuacaaaauaaccagc

SEQ ID NO: 948407 - RNA, 22 nt, Human
uguacauagaucuugaaaauua

SEQ ID NO: 948408 - RNA, 22 nt, Human
gacagcuguggagaggcaugug

SEQ ID NO: 948409 - RNA, 22 nt, Human
ggagccuuccagacugcccaca

SEQ ID NO: 948410 - RNA, 22 nt, Human
agccucugcacgggcacgggug

SEQ ID NO: 948411 - RNA, 22 nt, Human
gaugugagugguagcugggauu

SEQ ID NO: 948412 - RNA, 23 nt, Human
gggagccauggguggucauggag

SEQ ID NO: 948413 - RNA, 22 nt, Human
ucuagaaaaaaacugcugugga

SEQ ID NO: 948414 - RNA, 22 nt, Human
guggagaccuccuaggaugugu

SEQ ID NO: 948415 - RNA, 22 nt, Human
ugcuuccugaggccgucuucuc

SEQ ID NO: 948416 - RNA, 22 nt, Human
uccagggcuuggcugggacggu

SEQ ID NO: 948417 - RNA, 22 nt, Human
uggagcaggcaucuuucucucu

SEQ ID NO: 948418 - RNA, 19 nt, Human
ucgagucaagacacuaggc

SEQ ID NO: 948419 - RNA, 22 nt, Human
aggccugagccccagguuuguu

SEQ ID NO: 948420 - RNA, 18 nt, Human
cagcagagacauucaaaa

SEQ ID NO: 948421 - RNA, 22 nt, Human
aauaugucugcuaauuguuucu

SEQ ID NO: 948422 - RNA, 22 nt, Human
cagagcagugaggaguugugua

SEQ ID NO: 948423 - RNA, 22 nt, Human
ucugcugcugagcacacuccua

SEQ ID NO: 948424 - RNA, 22 nt, Human
uauuuccauguuagaacuaagu

SEQ ID NO: 948425 - RNA, 22 nt, Human
gcuggcccagggucaccuagga

SEQ ID NO: 948426 - RNA, 22 nt, Human
caggucccgccccgggcugacc

SEQ ID NO: 948427 - RNA, 22 nt, Human
auguuuaagaaagucuuccaua

SEQ ID NO: 948428 - RNA, 22 nt, Human
uggcucaagugauccuccugcc

SEQ ID NO: 948429 - RNA, 22 nt, Human
ucgugucagaucagagguuccu

SEQ ID NO: 948430 - RNA, 22 nt, Human
aaaguucagauuagacucaaga

SEQ ID NO: 948431 - RNA, 22 nt, Human
ccaggcucugucuggucagaag

SEQ ID NO: 948432 - RNA, 22 nt, Human
guggcaggagacuggaagaugg

SEQ ID NO: 948433 - RNA, 22 nt, Human
gcuggguggaucggaggcucug

SEQ ID NO: 948434 - RNA, 22 nt, Human
caccucuuugauuugaggcaag

SEQ ID NO: 948435 - RNA, 22 nt, Human
ugaaggaaaugacggcagaaga

SEQ ID NO: 948436 - RNA, 23 nt, Human
cagcccuuccugcauguuuuugu

SEQ ID NO: 948437 - RNA, 22 nt, Human
cugggguggugcaggccucaug

SEQ ID NO: 948438 - RNA, 22 nt, Human
cagcuggcuggucagugcacaa

SEQ ID NO: 948439 - RNA, 22 nt, Human
uaucuaaaggauuuaauuuagu

SEQ ID NO: 948440 - RNA, 22 nt, Human
ccucucucuccugcacacacac

SEQ ID NO: 948441 - RNA, 23 nt, Human
uugucugugcuuuuccaguugcu

SEQ ID NO: 948442 - RNA, 22 nt, Human
agagcuggguggacuuguaguu

SEQ ID NO: 948443 - RNA, 22 nt, Human
agcugcccuggcggagcugcuc

SEQ ID NO: 948444 - RNA, 22 nt, Human
agaaaaggcuugaagagguuuu

SEQ ID NO: 948445 - RNA, 22 nt, Human
ucaagauaccaccauuauaugu

SEQ ID NO: 948446 - RNA, 22 nt, Human
ugaugcugagccugggacugac

SEQ ID NO: 948447 - RNA, 21 nt, Human
guuugcaugaacaagucagcc

SEQ ID NO: 948448 - RNA, 22 nt, Human
uacccagcuucaagucaggacu

SEQ ID NO: 948449 - RNA, 22 nt, Human
gcaggcuggaggcuguucuggg

SEQ ID NO: 948450 - RNA, 23 nt, Human
acaguuauagcugugaauaacau

SEQ ID NO: 948451 - RNA, 22 nt, Human
cagggagggacaauugucaccu

SEQ ID NO: 948452 - RNA, 22 nt, Human
cuaaauaaucccucuggucuua

SEQ ID NO: 948453 - RNA, 22 nt, Human
uaaaauguguuucuguaugguu

SEQ ID NO: 948454 - RNA, 23 nt, Human
cuggccuccgacacuggccaaga

SEQ ID NO: 948455 - RNA, 22 nt, Human
agagcagcuggggcagagacca

SEQ ID NO: 948456 - RNA, 22 nt, Human
cucccuggugacucccaaagcu

SEQ ID NO: 948457 - RNA, 22 nt, Human
aauguacacugaaagccuauca

SEQ ID NO: 948458 - RNA, 19 nt, Human
uucacaauuaugaaauuag

SEQ ID NO: 948459 - RNA, 22 nt, Human
uggagcccagacacuggcauug

SEQ ID NO: 948460 - RNA, 20 nt, Human
ggaggguggaagaaagcaag

SEQ ID NO: 948461 - RNA, 22 nt, Human
ccagcugcugugaggaccacag

SEQ ID NO: 948462 - RNA, 22 nt, Human
aggcagcuggaaaacuccaggc

SEQ ID NO: 948463 - RNA, 22 nt, Human
gaaggccucacucugcagcaua

SEQ ID NO: 948464 - RNA, 22 nt, Human
aucuggcuuaccuagggugccu

SEQ ID NO: 948465 - RNA, 22 nt, Human
ggccugugcacaugugcaggaa

SEQ ID NO: 948466 - RNA, 22 nt, Human
ugaagcaaacgcuucuguuccu

SEQ ID NO: 948467 - RNA, 22 nt, Human
uggcagggccuaccccaauauc

SEQ ID NO: 948468 - RNA, 22 nt, Human
aaguguguugacugaauugggg

SEQ ID NO: 948469 - RNA, 23 nt, Human
cauguacagaguuugauaaagug

SEQ ID NO: 948470 - RNA, 22 nt, Human
ggccuggaaugcuuuccuacca

SEQ ID NO: 948471 - RNA, 21 nt, Human
ugaagccugaggcauagcccc

SEQ ID NO: 948472 - RNA, 22 nt, Human
gaccaggagauuugagcuaggc

SEQ ID NO: 948473 - RNA, 22 nt, Human
ccucacugcuauguguuugcuc

SEQ ID NO: 948474 - RNA, 21 nt, Human
ggcagcccgcccucuccuggc

SEQ ID NO: 948475 - RNA, 22 nt, Human
ucacucugacuuggccuccaac

SEQ ID NO: 948476 - RNA, 22 nt, Human
cauguaaaacacucagaacagu

SEQ ID NO: 948477 - RNA, 22 nt, Human
gcccaggaguugguggcugcag

SEQ ID NO: 948478 - RNA, 22 nt, Human
agguggaacguucaggugcuag

SEQ ID NO: 948479 - RNA, 22 nt, Human
ucuggccaggggucccugaagg

SEQ ID NO: 948480 - RNA, 22 nt, Human
uucuucaaccaucuacauaaac

SEQ ID NO: 948481 - RNA, 22 nt, Human
aggaggggcaaugauagucugg

SEQ ID NO: 948482 - RNA, 22 nt, Human
acuuucuaggugcuauugugau

SEQ ID NO: 948483 - RNA, 22 nt, Human
cagugcauaaucuaaauggggg

SEQ ID NO: 948484 - RNA, 22 nt, Human
gugcugcucacaucuggaggua

SEQ ID NO: 948485 - RNA, 21 nt, Human
gcaggaugcaucuuggugucu

SEQ ID NO: 948486 - RNA, 22 nt, Human
aaaauguguuuaugcauuucgu

SEQ ID NO: 948487 - RNA, 17 nt, Human
gcaaucucagucuccuu

SEQ ID NO: 948488 - RNA, 22 nt, Human
ggcuucugagugcucugcuguu

SEQ ID NO: 948489 - RNA, 22 nt, Human
ccugagaccaaguugcagccau

SEQ ID NO: 948490 - RNA, 22 nt, Human
ccagagaccagaacauggggau

SEQ ID NO: 948491 - RNA, 22 nt, Human
uggcuuucucccccagcuucuc

SEQ ID NO: 948492 - RNA, 22 nt, Human
ucaaaugcugccuuugugugcc

SEQ ID NO: 948493 - RNA, 22 nt, Human
ucucaagcuuguugguauguuu

SEQ ID NO: 948494 - RNA, 22 nt, Human
caauacuuccuuguuagaggca

SEQ ID NO: 948495 - RNA, 22 nt, Human
gcaugggcaagaggacuggggg

SEQ ID NO: 948496 - RNA, 22 nt, Human
uugcacuaggaaaaggcagcca

SEQ ID NO: 948497 - RNA, 22 nt, Human
ugggaggcuuccagaccuugcu

SEQ ID NO: 948498 - RNA, 22 nt, Human
gggccagagcuuggcagcuggg

SEQ ID NO: 948499 - RNA, 22 nt, Human
ucuggccaacccucaaguugua

SEQ ID NO: 948500 - RNA, 22 nt, Human
ugauugaagaggugaggaaguu

SEQ ID NO: 948501 - RNA, 22 nt, Human
uacauguaggugacauuuuaau

SEQ ID NO: 948502 - RNA, 22 nt, Human
ggcucccugccuguccucaguc

SEQ ID NO: 948503 - RNA, 22 nt, Human
caggcacugugcugagcucugc

SEQ ID NO: 948504 - RNA, 22 nt, Human
aggcugcagugcagguaggauu

SEQ ID NO: 948505 - RNA, 21 nt, Human
gcugagagguugggaaguuca

SEQ ID NO: 948506 - RNA, 22 nt, Human
gcuguggcuguacagagaccau

SEQ ID NO: 948507 - RNA, 22 nt, Human
gcucaagggaugggagugggug

SEQ ID NO: 948508 - RNA, 22 nt, Human
caaaugcaaaauauaacccugu

SEQ ID NO: 948509 - RNA, 22 nt, Human
uggggcugugagacuacaggau

SEQ ID NO: 948510 - RNA, 22 nt, Human
caggaaugacugcagauggggc

SEQ ID NO: 948511 - RNA, 22 nt, Human
gugcaguggcagauccuagcuc

SEQ ID NO: 948512 - RNA, 18 nt, Human
ucucagaggccauccuag

SEQ ID NO: 948513 - RNA, 22 nt, Human
gccuggaguacuccuugaagug

SEQ ID NO: 948514 - RNA, 22 nt, Human
aguugcagacgcagagauguug

SEQ ID NO: 948515 - RNA, 21 nt, Human
uacauuugagagcuauaagcu

SEQ ID NO: 948516 - RNA, 22 nt, Human
aaacagaaggguagguaaacau

SEQ ID NO: 948517 - RNA, 19 nt, Human
agcaccugugagagccugg

SEQ ID NO: 948518 - RNA, 22 nt, Human
uaguccagccuuggguguagcc

SEQ ID NO: 948519 - RNA, 22 nt, Human
cauggggagacaccuagggaaa

SEQ ID NO: 948520 - RNA, 22 nt, Human
ccaugagcuucaacugacacag

SEQ ID NO: 948521 - RNA, 22 nt, Human
uuugcaguuucauugcugaaau

SEQ ID NO: 948522 - RNA, 22 nt, Human
ucugccugcaguguggcagggc

SEQ ID NO: 948523 - RNA, 22 nt, Human
ucagagaguuggaaagaauuaa

SEQ ID NO: 948524 - RNA, 22 nt, Human
gcaagcaguuguggcuucugag

SEQ ID NO: 948525 - RNA, 22 nt, Human
gaaggaagugcucauacuaguu

SEQ ID NO: 948526 - RNA, 22 nt, Human
acugcagccuuugggcucauaa

SEQ ID NO: 948527 - RNA, 22 nt, Human
uuauucuuuucuccagaauccc

SEQ ID NO: 948528 - RNA, 22 nt, Human
ucugcaggaaaaaagugccugg

SEQ ID NO: 948529 - RNA, 22 nt, Human
guuuuuccuugcugaggacccg

SEQ ID NO: 948530 - RNA, 22 nt, Human
gcugucccaugguugcaagaug

SEQ ID NO: 948531 - RNA, 23 nt, Human
ccaaagucgaagucuaguccaga

SEQ ID NO: 948532 - RNA, 22 nt, Human
gugucacaugguuuacugcagc

SEQ ID NO: 948533 - RNA, 19 nt, Human
uugaaauuguuugauaugg

SEQ ID NO: 948534 - RNA, 22 nt, Human
agcugccauccgaggugucaga

SEQ ID NO: 948535 - RNA, 22 nt, Human
uaaacagaaagcagauguacuu

SEQ ID NO: 948536 - RNA, 22 nt, Human
auccaggcugcgggucucaagu

SEQ ID NO: 948537 - RNA, 22 nt, Human
ucuugcuaaagaccaacacauu

SEQ ID NO: 948538 - RNA, 22 nt, Human
cuggccaggcucucacgugguc

SEQ ID NO: 948539 - RNA, 22 nt, Human
gagcuggcuaauacugacuuau

SEQ ID NO: 948540 - RNA, 22 nt, Human
acucaggaaaugagaggcucuc

SEQ ID NO: 948541 - RNA, 22 nt, Human
gucucagauucagacaucuaca

SEQ ID NO: 948542 - RNA, 22 nt, Human
ggagcugcauuuagggagccuu

SEQ ID NO: 948543 - RNA, 19 nt, Human
ugcagaagacacaguggug

SEQ ID NO: 948544 - RNA, 18 nt, Human
gguggccuugacuucucu

SEQ ID NO: 948545 - RNA, 23 nt, Human
uggccugcagaguuucugcuggg

SEQ ID NO: 948546 - RNA, 22 nt, Human
ucauuucaaugauacuacuaag

SEQ ID NO: 948547 - RNA, 22 nt, Human
ggaggccaaggcagguggauca

SEQ ID NO: 948548 - RNA, 22 nt, Human
uccaggagguugagacugcagu

SEQ ID NO: 948549 - RNA, 22 nt, Human
ggcucaggaccugggauugcca

SEQ ID NO: 948550 - RNA, 22 nt, Human
ugucuagggagcugcucaggcu

SEQ ID NO: 948551 - RNA, 22 nt, Human
uuccuggcaccaccacuucuag

SEQ ID NO: 948552 - RNA, 22 nt, Human
ggccucagugggccgcugcagg

SEQ ID NO: 948553 - RNA, 22 nt, Human
ucuggccugaaaguccaugcuu

SEQ ID NO: 948554 - RNA, 22 nt, Human
acaugcuuucuagguccuucug

SEQ ID NO: 948555 - RNA, 22 nt, Human
gacuccuggcuuucccucuuag

SEQ ID NO: 948556 - RNA, 22 nt, Human
cuuuuccacugagccucacaaa

SEQ ID NO: 948557 - RNA, 21 nt, Human
acagcauguuuguguguuugc

SEQ ID NO: 948558 - RNA, 22 nt, Human
gagguagccacagauagagacu

SEQ ID NO: 948559 - RNA, 22 nt, Human
agggggugcccagaugaaggau

SEQ ID NO: 948560 - RNA, 22 nt, Human
cccaggaggcagagguuggagc

SEQ ID NO: 948561 - RNA, 22 nt, Human
cuucaguucuaaaguagaaugu

SEQ ID NO: 948562 - RNA, 22 nt, Human
ucagcagggcugugguguggcu

SEQ ID NO: 948563 - RNA, 22 nt, Human
cucugcuuuuuaaaaggagucc

SEQ ID NO: 948564 - RNA, 22 nt, Human
cagagcugcucaugguggccag

SEQ ID NO: 948565 - RNA, 22 nt, Human
ccugggagguggauguugcggu

SEQ ID NO: 948566 - RNA, 22 nt, Human
gugugucuugaccaggaucgga

SEQ ID NO: 948567 - RNA, 22 nt, Human
cugccuguuagucuagcaguua

SEQ ID NO: 948568 - RNA, 22 nt, Human
ccugucuguccucucaugagcc

SEQ ID NO: 948569 - RNA, 22 nt, Human
uucaguuucagucuugcaaaaa

SEQ ID NO: 948570 - RNA, 22 nt, Human
agaaacuucagcuauucuuuug

SEQ ID NO: 948571 - RNA, 22 nt, Human
aauaauuuugagagccuggaaa

SEQ ID NO: 948572 - RNA, 21 nt, Human
ccuauugaauauaggaagauu

SEQ ID NO: 948573 - RNA, 22 nt, Human
uguacaguauauuucaaagcca

SEQ ID NO: 948574 - RNA, 22 nt, Human
cuuacagagaagaaaauguagu

SEQ ID NO: 948575 - RNA, 22 nt, Human
uggcacaugguaagacucagua

SEQ ID NO: 948576 - RNA, 22 nt, Human
ggcaccuggagguuuacuggau

SEQ ID NO: 948577 - RNA, 22 nt, Human
augcuguggaaguuccugaagc

SEQ ID NO: 948578 - RNA, 22 nt, Human
ggcagaagaaaggcuaagucuc

SEQ ID NO: 948579 - RNA, 23 nt, Human
cucugcaggagagugggcagggc

SEQ ID NO: 948580 - RNA, 22 nt, Human
aaggcagccuuuguuugauuga

SEQ ID NO: 948581 - RNA, 22 nt, Human
agccuugaguucaagugcuggc

SEQ ID NO: 948582 - RNA, 23 nt, Human
aaagacugcugagaauuuuagga

SEQ ID NO: 948583 - RNA, 21 nt, Human
cugcuguggcccccgacaugc

SEQ ID NO: 948584 - RNA, 22 nt, Human
aaaaucaguacacuuuauuuug

SEQ ID NO: 948585 - RNA, 22 nt, Human
uggcucugcaccucaguguacc

SEQ ID NO: 948586 - RNA, 22 nt, Human
cacugaaauauuaauaucuuau

SEQ ID NO: 948587 - RNA, 22 nt, Human
acuccaggcaucugcuucugcu

SEQ ID NO: 948588 - RNA, 22 nt, Human
uauuccagaugaaaucauucag

SEQ ID NO: 948589 - RNA, 23 nt, Human
ugggaguguugggaucucugcuc

SEQ ID NO: 948590 - RNA, 22 nt, Human
ccugugcccucagccuggcucu

SEQ ID NO: 948591 - RNA, 22 nt, Human
aggcagagcuggguuuugaaau

SEQ ID NO: 948592 - RNA, 22 nt, Human
ucuuagaaaugaaguucuuucu

SEQ ID NO: 948593 - RNA, 21 nt, Human
ucauuuuuauugcuaccuugc

SEQ ID NO: 948594 - RNA, 22 nt, Human
ugcaggugcguuuucaagccuc

SEQ ID NO: 948595 - RNA, 17 nt, Human
cccaugagcccacuccc

SEQ ID NO: 948596 - RNA, 22 nt, Human
guuuggggucugcagagcggcg

SEQ ID NO: 948597 - RNA, 22 nt, Human
ccuguucaugaaacugcuuucc

SEQ ID NO: 948598 - RNA, 22 nt, Human
cauagaaacugagacaaggauu

SEQ ID NO: 948599 - RNA, 22 nt, Human
agcaggugaauuccuggaugug

SEQ ID NO: 948600 - RNA, 22 nt, Human
acucugaggcaggucagggcag

SEQ ID NO: 948601 - RNA, 22 nt, Human
cucaggauguacuacagaaggc

SEQ ID NO: 948602 - RNA, 23 nt, Human
aaggccagaauuucaauggugcc

SEQ ID NO: 948603 - RNA, 18 nt, Human
gaaaggagagacaguagg

SEQ ID NO: 948604 - RNA, 22 nt, Human
caaagggcucuagacucagcag

SEQ ID NO: 948605 - RNA, 22 nt, Human
gccugcuggcuguccauugcag

SEQ ID NO: 948606 - RNA, 22 nt, Human
uucauuccuucuguaccuugcc

SEQ ID NO: 948607 - RNA, 22 nt, Human
guauuaggugguggaauuguag

SEQ ID NO: 948608 - RNA, 19 nt, Human
agucugcauuucuagcaag

SEQ ID NO: 948609 - RNA, 22 nt, Human
caacugugaauuuuaugauacc

SEQ ID NO: 948610 - RNA, 20 nt, Human
ugggccugagccugugggcu

SEQ ID NO: 948611 - RNA, 22 nt, Human
cuuaagaugaggucaugcuaua

SEQ ID NO: 948612 - RNA, 22 nt, Human
aaagguaacaguuauaaccagg

SEQ ID NO: 948613 - RNA, 22 nt, Human
uuauugccugauugaggucauu

SEQ ID NO: 948614 - RNA, 22 nt, Human
ucuggagcuggagggcaaggca

SEQ ID NO: 948615 - RNA, 22 nt, Human
agcugguggauuaugcuguaca

SEQ ID NO: 948616 - RNA, 22 nt, Human
caggcaggagccagggauucca

SEQ ID NO: 948617 - RNA, 22 nt, Human
auguguauugagcaccuacugc

SEQ ID NO: 948618 - RNA, 22 nt, Human
aucagacucagaaaugacgugg

SEQ ID NO: 948619 - RNA, 22 nt, Human
agggucccgaaggagacagcaa

SEQ ID NO: 948620 - RNA, 22 nt, Human
caccaggcuggagugcagaggu

SEQ ID NO: 948621 - RNA, 22 nt, Human
agagacaccgcgcaucauggcu

SEQ ID NO: 948622 - RNA, 20 nt, Human
gcaaggcacagugaggaggg

SEQ ID NO: 948623 - RNA, 22 nt, Human
caagaauuguacaaacugggug

SEQ ID NO: 948624 - RNA, 22 nt, Human
aaagccauuacaaaauuucaua

SEQ ID NO: 948625 - RNA, 22 nt, Human
aaucaguuaggguguuaaugag

SEQ ID NO: 948626 - RNA, 22 nt, Human
aucagacucugcauugcagucu

SEQ ID NO: 948627 - RNA, 22 nt, Human
auacacauuacuuucugucuga

SEQ ID NO: 948628 - RNA, 22 nt, Human
aguacauacuucaaauguacuu

SEQ ID NO: 948629 - RNA, 22 nt, Human
acucugcuugggccauaucugg

SEQ ID NO: 948630 - RNA, 22 nt, Human
ccucagagguguggcaucucug

SEQ ID NO: 948631 - RNA, 22 nt, Human
acagaauugaaaguauaaucug

SEQ ID NO: 948632 - RNA, 18 nt, Human
gggcuguguucaugccca

SEQ ID NO: 948633 - RNA, 22 nt, Human
uccugagaugagacagugcugc

SEQ ID NO: 948634 - RNA, 22 nt, Human
cugaaggacacgugaggagcca

SEQ ID NO: 948635 - RNA, 22 nt, Human
uuucucugcugccugugucgau

SEQ ID NO: 948636 - RNA, 22 nt, Human
ucccagcccagauuugugugac

SEQ ID NO: 948637 - RNA, 22 nt, Human
caggggccaggcugucugcugu

SEQ ID NO: 948638 - RNA, 22 nt, Human
ccuccugguaauuagcgaaagg

SEQ ID NO: 948639 - RNA, 22 nt, Human
ugagacaguucugcagcugggu

SEQ ID NO: 948640 - RNA, 22 nt, Human
ccaggaggcggaagguacagug

SEQ ID NO: 948641 - RNA, 22 nt, Human
aggcacaguggcucacaccugu

SEQ ID NO: 948642 - RNA, 22 nt, Human
uucacauuggugauauguuucu

SEQ ID NO: 948643 - RNA, 19 nt, Human
augauacaggugaaaauug

SEQ ID NO: 948644 - RNA, 22 nt, Human
gcaggaguguauuugcauguaa

SEQ ID NO: 948645 - RNA, 17 nt, Human
cucacggaggaugaauc

SEQ ID NO: 948646 - RNA, 22 nt, Human
ucucucagaggccaggguccug

SEQ ID NO: 948647 - RNA, 22 nt, Human
uccugcagagacagaggccuca

SEQ ID NO: 948648 - RNA, 22 nt, Human
uagaaaagaauuuuauuugaua

SEQ ID NO: 948649 - RNA, 20 nt, Human
cccagugaagcauggaagag

SEQ ID NO: 948650 - RNA, 21 nt, Human
ggcagccucuguggaagggga

SEQ ID NO: 948651 - RNA, 22 nt, Human
cuuucacaguccugacugagcg

SEQ ID NO: 948652 - RNA, 22 nt, Human
uuccucugaaauggcuuggaaa

SEQ ID NO: 948653 - RNA, 22 nt, Human
ucccagaaaaaggaggcuauga

SEQ ID NO: 948654 - RNA, 22 nt, Human
caggcagcugcuggguucagcc

SEQ ID NO: 948655 - RNA, 22 nt, Human
ggcccuguccuggcugucuccg

SEQ ID NO: 948656 - RNA, 18 nt, Human
ccagcaugccagaggcug

SEQ ID NO: 948657 - RNA, 22 nt, Human
ugauuuccuaggucuggagaag

SEQ ID NO: 948658 - RNA, 22 nt, Human
ugcccagggauaagccuagaga

SEQ ID NO: 948659 - RNA, 22 nt, Human
accuucaaugaaaauaauaguc

SEQ ID NO: 948660 - RNA, 22 nt, Human
ggcugggcucgcugauuggcug

SEQ ID NO: 948661 - RNA, 22 nt, Human
ugaaggcauugaugaaggaauc

SEQ ID NO: 948662 - RNA, 22 nt, Human
uggcacugcacuuuaagauuua

SEQ ID NO: 948663 - RNA, 22 nt, Human
ccuggcuguggcggugcucuca

SEQ ID NO: 948664 - RNA, 22 nt, Human
cuuccugcauugugccagaguu

SEQ ID NO: 948665 - RNA, 22 nt, Human
uggcucaguuugggggauugaa

SEQ ID NO: 948666 - RNA, 22 nt, Human
ggcuuggaaauugcaggacaca

SEQ ID NO: 948667 - RNA, 23 nt, Human
uggaccugaaccagugccucugu

SEQ ID NO: 948668 - RNA, 22 nt, Human
uguuaaucaaucaacaguauua

SEQ ID NO: 948669 - RNA, 22 nt, Human
acuuggagagcauugcugggga

SEQ ID NO: 948670 - RNA, 22 nt, Human
cuuguucaguugccucuccugc

SEQ ID NO: 948671 - RNA, 19 nt, Human
ugcagccacgugagagacu

SEQ ID NO: 948672 - RNA, 22 nt, Human
uccugccucuuuucuuauucca

SEQ ID NO: 948673 - RNA, 22 nt, Human
uuagaaagaacuuuagauauca

SEQ ID NO: 948674 - RNA, 22 nt, Human
ucagcaaugugauacugugcaa

SEQ ID NO: 948675 - RNA, 22 nt, Human
gcugguuagaaaacagagcuca

SEQ ID NO: 948676 - RNA, 22 nt, Human
cucacugugccuuuucccaaac

SEQ ID NO: 948677 - RNA, 22 nt, Human
uuugcauaggauggacauuuua

SEQ ID NO: 948678 - RNA, 22 nt, Human
aaugcacauguuguaauaaaua

SEQ ID NO: 948679 - RNA, 17 nt, Human
gcagccagugcagcagg

SEQ ID NO: 948680 - RNA, 22 nt, Human
uuauuagagauauuugguuagg

SEQ ID NO: 948681 - RNA, 22 nt, Human
auuuuacuacuccaauuaauga

SEQ ID NO: 948682 - RNA, 22 nt, Human
ucagcaguuuuauaugcagcuu

SEQ ID NO: 948683 - RNA, 22 nt, Human
uggagcaggugcucaggguaau

SEQ ID NO: 948684 - RNA, 22 nt, Human
auaguaacuggcauguuuauga

SEQ ID NO: 948685 - RNA, 22 nt, Human
agguaggguuaauggagauaua

SEQ ID NO: 948686 - RNA, 23 nt, Human
uuucauaugguguggaugaagaa

SEQ ID NO: 948687 - RNA, 22 nt, Human
augcuguguuugagaaccuagg

SEQ ID NO: 948688 - RNA, 22 nt, Human
cauuuucaugaguuucuguuca

SEQ ID NO: 948689 - RNA, 22 nt, Human
uggucuuuaagguagcugucau

SEQ ID NO: 948690 - RNA, 22 nt, Human
uuucaucuuccuuggcauaggu

SEQ ID NO: 948691 - RNA, 22 nt, Human
aggcuguggugcugaaggaggg

SEQ ID NO: 948692 - RNA, 22 nt, Human
augugaggcagcacggagauua

SEQ ID NO: 948693 - RNA, 22 nt, Human
ugcauuguugaauauuucauag

SEQ ID NO: 948694 - RNA, 22 nt, Human
gggagggaagguaccuguguga

SEQ ID NO: 948695 - RNA, 19 nt, Human
ugcccaggccagguugggc

SEQ ID NO: 948696 - RNA, 22 nt, Human
ugagguaggugguaagagauac

SEQ ID NO: 948697 - RNA, 22 nt, Human
auuaaauuuucacuaggcuccc

SEQ ID NO: 948698 - RNA, 22 nt, Human
auuuccuuugcaaagacugugc

SEQ ID NO: 948699 - RNA, 22 nt, Human
cugugggcugaaagugcucccg

SEQ ID NO: 948700 - RNA, 23 nt, Human
ucagugauguugaaccuagcagu

SEQ ID NO: 948701 - RNA, 18 nt, Human
ucuggcucaggacugaac

SEQ ID NO: 948702 - RNA, 22 nt, Human
ugagggagagggcgaaaaugaa

SEQ ID NO: 948703 - RNA, 22 nt, Human
uaaggcacuucaauguuuagaa

SEQ ID NO: 948704 - RNA, 22 nt, Human
ugcugcugauggcaccuaggca

SEQ ID NO: 948705 - RNA, 22 nt, Human
gccaggagggaaaggacaauuu

SEQ ID NO: 948706 - RNA, 22 nt, Human
uuuccuaggagauugaucacau

SEQ ID NO: 948707 - RNA, 22 nt, Human
ugagccuggcggaagcagcgug

SEQ ID NO: 948708 - RNA, 22 nt, Human
auguagcagaagauguuuuccu

SEQ ID NO: 948709 - RNA, 22 nt, Human
uucuucuccgaggagggcuggu

SEQ ID NO: 948710 - RNA, 20 nt, Human
aagagaagaagucuuugaaa

SEQ ID NO: 948711 - RNA, 20 nt, Human
agaggccaguuaggagucua

SEQ ID NO: 948712 - RNA, 22 nt, Human
uuaugacauaugaguacaagua

SEQ ID NO: 948713 - RNA, 22 nt, Human
agggcccucuggcaggccaggc

SEQ ID NO: 948714 - RNA, 23 nt, Human
uuucacaaugagcauuacagaau

SEQ ID NO: 948715 - RNA, 22 nt, Human
ugggccugaaggagcugcgccc

SEQ ID NO: 948716 - RNA, 22 nt, Human
ugucaccagcugcuccucagga

SEQ ID NO: 948717 - RNA, 22 nt, Human
aauuuccaaauuucugucacac

SEQ ID NO: 948718 - RNA, 22 nt, Human
cuggguaaguuccuaaggcuca

SEQ ID NO: 948719 - RNA, 22 nt, Human
agccacaccuguccugccagcu

SEQ ID NO: 948720 - RNA, 22 nt, Human
cccaggagaccugugaaaggac

SEQ ID NO: 948721 - RNA, 22 nt, Human
gucucccaucguuugugaggaa

SEQ ID NO: 948722 - RNA, 22 nt, Human
uacaagagguauauagaaacag

SEQ ID NO: 948723 - RNA, 22 nt, Human
auccaaaucaugucagaagaac

SEQ ID NO: 948724 - RNA, 21 nt, Human
ucucuggaguuagcagagaga

SEQ ID NO: 948725 - RNA, 22 nt, Human
ugucacauguguggcauuuuuc

SEQ ID NO: 948726 - RNA, 22 nt, Human
uccucuggcucuuucccuagga

SEQ ID NO: 948727 - RNA, 22 nt, Human
ugccaggggaccuagggauguc

SEQ ID NO: 948728 - RNA, 22 nt, Human
cugcuguggccagccaggucaa

SEQ ID NO: 948729 - RNA, 22 nt, Human
cacaggggcaaacuguagggga

SEQ ID NO: 948730 - RNA, 22 nt, Human
ucaauucaacacaugcacauug

SEQ ID NO: 948731 - RNA, 22 nt, Human
auuuguaauuucuuaucugugu

SEQ ID NO: 948732 - RNA, 20 nt, Human
uauauguguacauacacaca

SEQ ID NO: 948733 - RNA, 20 nt, Human
uacauucaaaacaaacucug

SEQ ID NO: 948734 - RNA, 22 nt, Human
uguguauuucuggaacagacua

SEQ ID NO: 948735 - RNA, 22 nt, Human
uggcagcaccagcaguguccuu

SEQ ID NO: 948736 - RNA, 22 nt, Human
uuuccucuuuguaccuugacua

SEQ ID NO: 948737 - RNA, 22 nt, Human
ucauuuauaaggaugcaauuaa

SEQ ID NO: 948738 - RNA, 22 nt, Human
cagcucuggcgucagggagcga

SEQ ID NO: 948739 - RNA, 22 nt, Human
uuaagaauggaaugaggaauuu

SEQ ID NO: 948740 - RNA, 22 nt, Human
uauugaaauucuucauguccuc

SEQ ID NO: 948741 - RNA, 22 nt, Human
uaacagaaauagaaaugagagu

SEQ ID NO: 948742 - RNA, 22 nt, Human
uuagagaaauucugguaaugua

SEQ ID NO: 948743 - RNA, 22 nt, Human
gaaggcuggcuuucugagagca

SEQ ID NO: 948744 - RNA, 22 nt, Human
ucugcuguauuagguugaacug

SEQ ID NO: 948745 - RNA, 22 nt, Human
ccacaaguuucagcacccagag

SEQ ID NO: 948746 - RNA, 22 nt, Human
uagcagaaccagcagucaauuu

SEQ ID NO: 948747 - RNA, 22 nt, Human
cugcugugacagcugccguguu

SEQ ID NO: 948748 - RNA, 22 nt, Human
uuugaagugggcauuagaaccu

SEQ ID NO: 948749 - RNA, 22 nt, Human
cagggccuuuuagcaucuucuc

SEQ ID NO: 948750 - RNA, 19 nt, Human
ccuguucaugacucugucc

SEQ ID NO: 948751 - RNA, 20 nt, Human
agagcagcaguuggugaggu

SEQ ID NO: 948752 - RNA, 22 nt, Human
aaguauaagcuauucuucauga

SEQ ID NO: 948753 - RNA, 22 nt, Human
ccucuggcaacuucacagccca

SEQ ID NO: 948754 - RNA, 22 nt, Human
auaugaaaauguuuuagcugua

SEQ ID NO: 948755 - RNA, 22 nt, Human
acucagaaccauuuacucugag

SEQ ID NO: 948756 - RNA, 23 nt, Human
ugucccagagggagggauaggcu

SEQ ID NO: 948757 - RNA, 22 nt, Human
cccuggagugugacgaggcauu

SEQ ID NO: 948758 - RNA, 22 nt, Human
gcaggagagucugugccagguu

SEQ ID NO: 948759 - RNA, 22 nt, Human
gaggcaacacauuuggaaagca

SEQ ID NO: 948760 - RNA, 22 nt, Human
uuccaaagucauguugcugaua

SEQ ID NO: 948761 - RNA, 22 nt, Human
agguaaggcuguaagcuaagcc

SEQ ID NO: 948762 - RNA, 21 nt, Human
gggugcuguggucaugcagga

SEQ ID NO: 948763 - RNA, 22 nt, Human
acugucacuccaacugagucgu

SEQ ID NO: 948764 - RNA, 22 nt, Human
cuuguaaaagguacauuaugcu

SEQ ID NO: 948765 - RNA, 20 nt, Human
agauuauuccuaagauuucu

SEQ ID NO: 948766 - RNA, 22 nt, Human
cagaguccugcaccagcuccag

SEQ ID NO: 948767 - RNA, 22 nt, Human
caggcucccugggcaguggcag

SEQ ID NO: 948768 - RNA, 21 nt, Human
gauguuggaggcuggggucug

SEQ ID NO: 948769 - RNA, 22 nt, Human
ugaaggaauggaggaucagagc

SEQ ID NO: 948770 - RNA, 22 nt, Human
ggcaaggccuugcccagcauuc

SEQ ID NO: 948771 - RNA, 22 nt, Human
uggugagcucuuuagacuggga

SEQ ID NO: 948772 - RNA, 20 nt, Human
ggcugccuccuuccuuuccu

SEQ ID NO: 948773 - RNA, 22 nt, Human
agaacagcagcacgucaagcug

SEQ ID NO: 948774 - RNA, 22 nt, Human
aggggccauuguucugcccgcu

SEQ ID NO: 948775 - RNA, 22 nt, Human
uggaggcaccacuggcugcccg

SEQ ID NO: 948776 - RNA, 18 nt, Human
ggcucaggcuauccuaac

SEQ ID NO: 948777 - RNA, 22 nt, Human
uggcucagcaagacauugaccu

SEQ ID NO: 948778 - RNA, 20 nt, Human
uacuuaggcuuguuuuggcc

SEQ ID NO: 948779 - RNA, 22 nt, Human
cuggugguucaggagaauggcu

SEQ ID NO: 948780 - RNA, 20 nt, Human
uccaggagaacugggagccg

SEQ ID NO: 948781 - RNA, 22 nt, Human
acugagcugcaagucagggagg

SEQ ID NO: 948782 - RNA, 22 nt, Human
agccaggaauuggacaacacau

SEQ ID NO: 948783 - RNA, 22 nt, Human
caggcagcucgaugccuuguug

SEQ ID NO: 948784 - RNA, 22 nt, Human
aggguccaucaaggacugcaca

SEQ ID NO: 948785 - RNA, 22 nt, Human
gccuccuggauuuuagugccau

SEQ ID NO: 948786 - RNA, 22 nt, Human
ucugggcucugucagcaccucu

SEQ ID NO: 948787 - RNA, 22 nt, Human
ucaggcaggcagagggcaaaug

SEQ ID NO: 948788 - RNA, 22 nt, Human
acaggcugacuuccugccaugu

SEQ ID NO: 948789 - RNA, 22 nt, Human
uauucacauucucaggccuggu

SEQ ID NO: 948790 - RNA, 22 nt, Human
gccagcugcaucuccugggcug

SEQ ID NO: 948791 - RNA, 22 nt, Human
acagagcuuaggaugacuccca

SEQ ID NO: 948792 - RNA, 22 nt, Human
cuuauggcuguagucuggaagu

SEQ ID NO: 948793 - RNA, 22 nt, Human
agcaggguauguuagagcugua

SEQ ID NO: 948794 - RNA, 22 nt, Human
cauagaaaagaguagguaaugu

SEQ ID NO: 948795 - RNA, 22 nt, Human
ucagccuggcaggauggccugg

SEQ ID NO: 948796 - RNA, 20 nt, Human
aggagggaccuggauuggcg

SEQ ID NO: 948797 - RNA, 22 nt, Human
gccuggaguucagccaaguccc

SEQ ID NO: 948798 - RNA, 22 nt, Human
agcacauucuugccuuaaccuc

SEQ ID NO: 948799 - RNA, 19 nt, Human
ucuggcuccgccucuuagu

SEQ ID NO: 948800 - RNA, 19 nt, Human
gggaugggcccucacccuc

SEQ ID NO: 948801 - RNA, 22 nt, Human
gcuggccaguguggugaccacc

SEQ ID NO: 948802 - RNA, 22 nt, Human
uccaggaggaggaaggcugcca

SEQ ID NO: 948803 - RNA, 22 nt, Human
cagaggcucuuccucacugccc

SEQ ID NO: 948804 - RNA, 22 nt, Human
uccuggagagugggcgagcaca

SEQ ID NO: 948805 - RNA, 22 nt, Human
ugcauguggaccccuggugccu

SEQ ID NO: 948806 - RNA, 22 nt, Human
aggccuguuggcgugggcucua

SEQ ID NO: 948807 - RNA, 22 nt, Human
ucuuugcaggagcccuuugaac

SEQ ID NO: 948808 - RNA, 22 nt, Human
cagggccuccuaaggcaucuaa

SEQ ID NO: 948809 - RNA, 22 nt, Human
uccaggagugcugguuagagua

SEQ ID NO: 948810 - RNA, 22 nt, Human
aucauguugcucaaaauuaaac

SEQ ID NO: 948811 - RNA, 22 nt, Human
ugccugccaugcagaaagcuga

SEQ ID NO: 948812 - RNA, 22 nt, Human
ugcauuauaacugaauguuguu

SEQ ID NO: 948813 - RNA, 22 nt, Human
cuggcucagacagcugugcagu

SEQ ID NO: 948814 - RNA, 22 nt, Human
cauggccuugagugacugcacu

SEQ ID NO: 948815 - RNA, 22 nt, Human
uguggucucguuauguugccca

SEQ ID NO: 948816 - RNA, 22 nt, Human
gccacagggcagaugcgcagag

SEQ ID NO: 948817 - RNA, 20 nt, Human
ccagcauguacacaugugga

SEQ ID NO: 948818 - RNA, 22 nt, Human
gagaaacuuggaguuauucugg

SEQ ID NO: 948819 - RNA, 22 nt, Human
ugggcucucuggcaggaaggcu

SEQ ID NO: 948820 - RNA, 22 nt, Human
cuccuuccugccccagugauaa

SEQ ID NO: 948821 - RNA, 22 nt, Human
uugggagcuggaagcaaggccu

SEQ ID NO: 948822 - RNA, 18 nt, Human
gagcccugagucugcaca

SEQ ID NO: 948823 - RNA, 21 nt, Human
ccugugugucugacugggcua

SEQ ID NO: 948824 - RNA, 19 nt, Human
uccaccuuucuucauuugg

SEQ ID NO: 948825 - RNA, 22 nt, Human
gccugucucuuggaacuuggua

SEQ ID NO: 948826 - RNA, 22 nt, Human
gaggagguuccggguggagaag

SEQ ID NO: 948827 - RNA, 22 nt, Human
ggccugagcuugggcagcguau

SEQ ID NO: 948828 - RNA, 21 nt, Human
gcagcuggucucagagcuugc

SEQ ID NO: 948829 - RNA, 22 nt, Human
aucaguuucuaccauguggaau

SEQ ID NO: 948830 - RNA, 22 nt, Human
ggaggcucccacgcagcucaca

SEQ ID NO: 948831 - RNA, 22 nt, Human
auguuacacauaggcauaaaug

SEQ ID NO: 948832 - RNA, 22 nt, Human
aguguuucccaguaggaugaaa

SEQ ID NO: 948833 - RNA, 22 nt, Human
gucauuccuauccauuugauac

SEQ ID NO: 948834 - RNA, 22 nt, Human
agggccugggguagcuuacugc

SEQ ID NO: 948835 - RNA, 22 nt, Human
auuacaaaagaagggagaaggu

SEQ ID NO: 948836 - RNA, 22 nt, Human
ccacucugcugugcuccaugau

SEQ ID NO: 948837 - RNA, 22 nt, Human
agggugggcuagacucuucccc

SEQ ID NO: 948838 - RNA, 22 nt, Human
ucacagugagccaugucagaga

SEQ ID NO: 948839 - RNA, 22 nt, Human
aggcucuguuauucuagagggc

SEQ ID NO: 948840 - RNA, 22 nt, Human
ugaaagcuguccacuaggcugu

SEQ ID NO: 948841 - RNA, 22 nt, Human
ccucgaccuccccaggcucagg

SEQ ID NO: 948842 - RNA, 22 nt, Human
aucagcaagcaugguuaggugu

SEQ ID NO: 948843 - RNA, 22 nt, Human
auauuaggaguuaaauguauua

SEQ ID NO: 948844 - RNA, 22 nt, Human
auggaaagccaguguuccauca

SEQ ID NO: 948845 - RNA, 17 nt, Human
aggugcagaggcagagc

SEQ ID NO: 948846 - RNA, 22 nt, Human
ugcaugcauaaauguacacaca

SEQ ID NO: 948847 - RNA, 22 nt, Human
gugagcaggauuucauggugua

SEQ ID NO: 948848 - RNA, 22 nt, Human
gccugguggugugcucaagugg

SEQ ID NO: 948849 - RNA, 22 nt, Human
ucuuuguaacugucuauugaga

SEQ ID NO: 948850 - RNA, 22 nt, Human
ccaggaaauggcuugcuucuuu

SEQ ID NO: 948851 - RNA, 22 nt, Human
ugcauugccucuauucauuaua

SEQ ID NO: 948852 - RNA, 22 nt, Human
acaggccugacacacagagggc

SEQ ID NO: 948853 - RNA, 22 nt, Human
ucagcuccacagcuccucugcc

SEQ ID NO: 948854 - RNA, 22 nt, Human
gagccugggacugggggucaug

SEQ ID NO: 948855 - RNA, 22 nt, Human
gaagcccaggcuuccuuggcuu

SEQ ID NO: 948856 - RNA, 22 nt, Human
gagaggugaauguggaugccac

SEQ ID NO: 948857 - RNA, 22 nt, Human
agaaaucucaguaucucaggga

SEQ ID NO: 948858 - RNA, 22 nt, Human
aaagacauggaacuagagaugg

SEQ ID NO: 948859 - RNA, 22 nt, Human
caggcugagcucuggccugggc

SEQ ID NO: 948860 - RNA, 22 nt, Human
gccauuuagggaggcaagguga

SEQ ID NO: 948861 - RNA, 22 nt, Human
ccaaagugcugggguuacaggc

SEQ ID NO: 948862 - RNA, 22 nt, Human
cuguuuauggagguaaggcauc

SEQ ID NO: 948863 - RNA, 22 nt, Human
ccugagugaauucccucacugu

SEQ ID NO: 948864 - RNA, 22 nt, Human
uuuucaguaaugucuacauaau

SEQ ID NO: 948865 - RNA, 22 nt, Human
gggcuucucuuuagugagcuga

SEQ ID NO: 948866 - RNA, 22 nt, Human
uagagcuagcuucaaaaugcga

SEQ ID NO: 948867 - RNA, 22 nt, Human
ugcagggccuucuagaccaugg

SEQ ID NO: 948868 - RNA, 22 nt, Human
ggcugggcaaacaagacucuuc

SEQ ID NO: 948869 - RNA, 22 nt, Human
auuucucuuagcaagacauuac

SEQ ID NO: 948870 - RNA, 22 nt, Human
ccugagccugaguggugcaggg

SEQ ID NO: 948871 - RNA, 22 nt, Human
ggucauugaaaucagaaggguu

SEQ ID NO: 948872 - RNA, 22 nt, Human
gggcccuggauuuaagcaugga

SEQ ID NO: 948873 - RNA, 22 nt, Human
aggauuugaaccugcauccagu

SEQ ID NO: 948874 - RNA, 22 nt, Human
uggccucuggcugaggacuaac

SEQ ID NO: 948875 - RNA, 22 nt, Human
gcugucuuccuugcuccaaggg

SEQ ID NO: 948876 - RNA, 22 nt, Human
ugcagggcccuugggguugaac

SEQ ID NO: 948877 - RNA, 22 nt, Human
cagaggcugggaccucaggcau

SEQ ID NO: 948878 - RNA, 22 nt, Human
agugcacagcgugauguauugg

SEQ ID NO: 948879 - RNA, 22 nt, Human
uccaaggguucaugugcauuca

SEQ ID NO: 948880 - RNA, 22 nt, Human
gaagcagcaaguauaggacagg

SEQ ID NO: 948881 - RNA, 22 nt, Human
uugcauuuaaguagauguuaca

SEQ ID NO: 948882 - RNA, 22 nt, Human
guucacaaaguacuguaugcau

SEQ ID NO: 948883 - RNA, 22 nt, Human
uguucagagacagaaauucuaa

SEQ ID NO: 948884 - RNA, 22 nt, Human
uggcccugcuggccaaaggcua

SEQ ID NO: 948885 - RNA, 22 nt, Human
caggcacucagucuggaucccu

SEQ ID NO: 948886 - RNA, 22 nt, Human
gcucugagaggugcagcaguaa

SEQ ID NO: 948887 - RNA, 22 nt, Human
agccacagcccacaggacucuu

SEQ ID NO: 948888 - RNA, 22 nt, Human
agggagcuuccgaacuacagcu

SEQ ID NO: 948889 - RNA, 22 nt, Human
aggcacuguggaagacaugguu

SEQ ID NO: 948890 - RNA, 22 nt, Human
agggcccaggacagcaucaggg

SEQ ID NO: 948891 - RNA, 19 nt, Human
augucccaccgccccugag

SEQ ID NO: 948892 - RNA, 22 nt, Human
uccaagggcagcagccauagcc

SEQ ID NO: 948893 - RNA, 22 nt, Human
auccuugacacacuccaguacu

SEQ ID NO: 948894 - RNA, 22 nt, Human
caaggcugcugcgggucgcacc

SEQ ID NO: 948895 - RNA, 20 nt, Human
ugagugauggaggcggguca

SEQ ID NO: 948896 - RNA, 22 nt, Human
cccaggaggcagagauagcagu

SEQ ID NO: 948897 - RNA, 22 nt, Human
agcagaugagccucaugacugg

SEQ ID NO: 948898 - RNA, 22 nt, Human
uggcaaggccacaggugcaguu

SEQ ID NO: 948899 - RNA, 22 nt, Human
uaacagaaacagauaaguguaa

SEQ ID NO: 948900 - RNA, 22 nt, Human
aagcaauauacugauaugauua

SEQ ID NO: 948901 - RNA, 22 nt, Human
ucaaaguagggguaagccaggc

SEQ ID NO: 948902 - RNA, 22 nt, Human
uccuugaacagagggccugggu

SEQ ID NO: 948903 - RNA, 22 nt, Human
gcucagagauguucaguagcuu

SEQ ID NO: 948904 - RNA, 22 nt, Human
agaggcugucccuugcuauucc

SEQ ID NO: 948905 - RNA, 22 nt, Human
ugucuuuggaauauuuagcuga

SEQ ID NO: 948906 - RNA, 22 nt, Human
ucuuuccuuagaauaauucuuu

SEQ ID NO: 948907 - RNA, 20 nt, Human
uccuucaggcagggccuagu

SEQ ID NO: 948908 - RNA, 22 nt, Human
auguuauaguuauaaaaugagg

SEQ ID NO: 948909 - RNA, 22 nt, Human
ccugggaagagcugacaggagg

SEQ ID NO: 948910 - RNA, 22 nt, Human
aagcagaugggacuccaaggca

SEQ ID NO: 948911 - RNA, 22 nt, Human
cuggccaagcuucucuaagcag

SEQ ID NO: 948912 - RNA, 22 nt, Human
aucuacagcugucugcacagua

SEQ ID NO: 948913 - RNA, 22 nt, Human
augucaaaucaguuuuaucaga

SEQ ID NO: 948914 - RNA, 22 nt, Human
ccuggaaguuggagguugcagu

SEQ ID NO: 948915 - RNA, 22 nt, Human
ugcagggccagacuggguugga

SEQ ID NO: 948916 - RNA, 22 nt, Human
cacugccaccugcaugcccuga

SEQ ID NO: 948917 - RNA, 22 nt, Human
gcagcaggcacggucucgacau

SEQ ID NO: 948918 - RNA, 22 nt, Human
uccucuggggcgugguccugga

SEQ ID NO: 948919 - RNA, 22 nt, Human
aaguuugugucagagcuguuac

SEQ ID NO: 948920 - RNA, 21 nt, Human
ucacauuucucauggguaaau

SEQ ID NO: 948921 - RNA, 22 nt, Human
agcuagaauguuccuuuucauu

SEQ ID NO: 948922 - RNA, 22 nt, Human
caguagcaggcacucagcacgu

SEQ ID NO: 948923 - RNA, 22 nt, Human
uuaaacagucccagaggcugac

SEQ ID NO: 948924 - RNA, 22 nt, Human
gggcuggcaggaccugggcuga

SEQ ID NO: 948925 - RNA, 22 nt, Human
aguugacauccauaacaggaag

SEQ ID NO: 948926 - RNA, 22 nt, Human
ugcaugugcccacucuggcuua

SEQ ID NO: 948927 - RNA, 22 nt, Human
aucuagaaaguguugaagauca

SEQ ID NO: 948928 - RNA, 22 nt, Human
ugagagugguucagcucagaag

SEQ ID NO: 948929 - RNA, 22 nt, Human
uucuucaaacaaaaguggcaug

SEQ ID NO: 948930 - RNA, 22 nt, Human
acauuaaugaggugaugacaca

SEQ ID NO: 948931 - RNA, 17 nt, Human
acagagguuauacagac

SEQ ID NO: 948932 - RNA, 22 nt, Human
auuaaauuggacgcugggggaa

SEQ ID NO: 948933 - RNA, 22 nt, Human
uugaacauuggcaauuucauau

SEQ ID NO: 948934 - RNA, 22 nt, Human
uggcugccuagucccucagccu

SEQ ID NO: 948935 - RNA, 22 nt, Human
aaaugguguuucuaaugcuaga

SEQ ID NO: 948936 - RNA, 22 nt, Human
ucacuucacacccacuaucaug

SEQ ID NO: 948937 - RNA, 22 nt, Human
uguuuaaucuauaaaauggaga

SEQ ID NO: 948938 - RNA, 22 nt, Human
ccagagugacgugaagugugaa

SEQ ID NO: 948939 - RNA, 22 nt, Human
ugucccagcagcuggguucucu

SEQ ID NO: 948940 - RNA, 22 nt, Human
gcaaagcugggugugaaugcac

SEQ ID NO: 948941 - RNA, 22 nt, Human
auugcuaggaacagguugcacc

SEQ ID NO: 948942 - RNA, 20 nt, Human
acugggcauaccuguccugu

SEQ ID NO: 948943 - RNA, 22 nt, Human
auaagguaugaaaaguaaaugg

SEQ ID NO: 948944 - RNA, 22 nt, Human
aacuuucagcaaguaauucugg

SEQ ID NO: 948945 - RNA, 22 nt, Human
uggccggggcugauggacagug

SEQ ID NO: 948946 - RNA, 22 nt, Human
caucugccuaaguggcccuguu

SEQ ID NO: 948947 - RNA, 22 nt, Human
uuucaaacauaucuucauuacu

SEQ ID NO: 948948 - RNA, 22 nt, Human
gcagagcuaucuucuggauuug

SEQ ID NO: 948949 - RNA, 22 nt, Human
uggucucugacucugaagaccc

SEQ ID NO: 948950 - RNA, 22 nt, Human
gaguuauuuugagcagaugguu

SEQ ID NO: 948951 - RNA, 22 nt, Human
agagugauccuaauugauuugg

SEQ ID NO: 948952 - RNA, 22 nt, Human
uugaagcagagaaauacuugaa

SEQ ID NO: 948953 - RNA, 22 nt, Human
uacaguucacaguaucauaaau

SEQ ID NO: 948954 - RNA, 22 nt, Human
cuccuucccuucaaguguuccu

SEQ ID NO: 948955 - RNA, 22 nt, Human
uuguuuuuaugaacauccagga

SEQ ID NO: 948956 - RNA, 22 nt, Human
agagcagauggagcuggaagag

SEQ ID NO: 948957 - RNA, 22 nt, Human
gcacuuggauauacaaaugaag

SEQ ID NO: 948958 - RNA, 19 nt, Human
gcauuucucuuuacagcca

SEQ ID NO: 948959 - RNA, 22 nt, Human
aaaagaggagugguuuaugaca

SEQ ID NO: 948960 - RNA, 22 nt, Human
ccagucccagcucugccaugcu

SEQ ID NO: 948961 - RNA, 22 nt, Human
uccugagauucugcauuucuaa

SEQ ID NO: 948962 - RNA, 22 nt, Human
gccugagagucugcauuucuaa

SEQ ID NO: 948963 - RNA, 22 nt, Human
ugccagaagugcuuuauaagug

SEQ ID NO: 948964 - RNA, 22 nt, Human
accaggagucuagccuagucaa

SEQ ID NO: 948965 - RNA, 18 nt, Human
cagggcuguggggucacu

SEQ ID NO: 948966 - RNA, 22 nt, Human
ggcacugaucugauuucccucc

SEQ ID NO: 948967 - RNA, 22 nt, Human
augggguggaguccgggcagcg

SEQ ID NO: 948968 - RNA, 22 nt, Human
ccacagggaacaugacagccuu

SEQ ID NO: 948969 - RNA, 22 nt, Human
agggcugccauuucuggcccaa

SEQ ID NO: 948970 - RNA, 22 nt, Human
ucccagcauuaaugccugucag

SEQ ID NO: 948971 - RNA, 22 nt, Human
gaggcugccccuuccucagcug

SEQ ID NO: 948972 - RNA, 22 nt, Human
cccaggagaauauaauguucuu

SEQ ID NO: 948973 - RNA, 22 nt, Human
ugcuggggguucagaugaguaa

SEQ ID NO: 948974 - RNA, 22 nt, Human
caauauucaguggaaaagccau

SEQ ID NO: 948975 - RNA, 22 nt, Human
aggggcuguggaaaccaacucu

SEQ ID NO: 948976 - RNA, 22 nt, Human
agugaaauaugcccauugcugu

SEQ ID NO: 948977 - RNA, 22 nt, Human
aaucuuucccuauuaaaugugg

SEQ ID NO: 948978 - RNA, 22 nt, Human
cagcaggauaugguggagagag

SEQ ID NO: 948979 - RNA, 22 nt, Human
aagcagcauaauugcuauuuua

SEQ ID NO: 948980 - RNA, 22 nt, Human
uuaagacauucagauauuucua

SEQ ID NO: 948981 - RNA, 22 nt, Human
uggcagcaauuugugauguuga

SEQ ID NO: 948982 - RNA, 22 nt, Human
augaaggcaguuaaacgucauc

SEQ ID NO: 948983 - RNA, 19 nt, Human
ucccaggaagcaaauguca

SEQ ID NO: 948984 - RNA, 22 nt, Human
gagcucugacugcugggugaca

SEQ ID NO: 948985 - RNA, 22 nt, Human
ggcuccagggaguggagagaag

SEQ ID NO: 948986 - RNA, 22 nt, Human
gucccuaguggaaagacaugau

SEQ ID NO: 948987 - RNA, 17 nt, Human
gagugcugguggagcuc

SEQ ID NO: 948988 - RNA, 20 nt, Human
ucagcucugugccugggaug

SEQ ID NO: 948989 - RNA, 22 nt, Human
ucucugcucaggcaccagcccu

SEQ ID NO: 948990 - RNA, 22 nt, Human
uucaaacaaaacuguucccaua

SEQ ID NO: 948991 - RNA, 22 nt, Human
cacucugcgcugggcgccagcg

SEQ ID NO: 948992 - RNA, 22 nt, Human
auguuuccagguucuuccuaug

SEQ ID NO: 948993 - RNA, 22 nt, Human
uuccuguuucauagaaaacuga

SEQ ID NO: 948994 - RNA, 22 nt, Human
cuuauuauaaaauccuguuuga

SEQ ID NO: 948995 - RNA, 22 nt, Human
ccucuucugcuucaggagcacu

SEQ ID NO: 948996 - RNA, 22 nt, Human
uuauuaggaaaaggucagaugu

SEQ ID NO: 948997 - RNA, 22 nt, Human
gggugcugacuggggccugaaa

SEQ ID NO: 948998 - RNA, 22 nt, Human
ucacaccuuuuagaauuacuau

SEQ ID NO: 948999 - RNA, 18 nt, Human
acauacauucugucugca

SEQ ID NO: 949000 - RNA, 22 nt, Human
cugcuuugaaaauaaacuuguc

SEQ ID NO: 949001 - RNA, 22 nt, Human
ucauugcagcuucagguguuca

SEQ ID NO: 949002 - RNA, 22 nt, Human
gcuccuggugcaaaguuucuuc

SEQ ID NO: 949003 - RNA, 22 nt, Human
gugacagucaaagacaugacuu

SEQ ID NO: 949004 - RNA, 22 nt, Human
agggcagacuaggauggaagug

SEQ ID NO: 949005 - RNA, 22 nt, Human
auggggugagacuaggauuaaa

SEQ ID NO: 949006 - RNA, 22 nt, Human
agaggccaucugcucugugggg

SEQ ID NO: 949007 - RNA, 23 nt, Human
uggcagugaucaaaagcuuacau

SEQ ID NO: 949008 - RNA, 21 nt, Human
gcugcugccccuagugaggcc

SEQ ID NO: 949009 - RNA, 20 nt, Human
caaguguagaaacuaauaag

SEQ ID NO: 949010 - RNA, 22 nt, Human
acucugugugaguagagccugu

SEQ ID NO: 949011 - RNA, 22 nt, Human
ucaggagaaagccaauuagagu

SEQ ID NO: 949012 - RNA, 22 nt, Human
cugaugcuauaagccacagugg

SEQ ID NO: 949013 - RNA, 22 nt, Human
cacaaaugugcagaaaugugag

SEQ ID NO: 949014 - RNA, 22 nt, Human
ucauugcaggcauuccccugcc

SEQ ID NO: 949015 - RNA, 22 nt, Human
uugaagcauuguggcuuguauu

SEQ ID NO: 949016 - RNA, 22 nt, Human
aaggcagucugguuucaaagca

SEQ ID NO: 949017 - RNA, 22 nt, Human
cugcucugagaggcucuuccua

SEQ ID NO: 949018 - RNA, 22 nt, Human
accuuuuuguucuguucucagc

SEQ ID NO: 949019 - RNA, 22 nt, Human
cucccaggcacagggaggagcc

SEQ ID NO: 949020 - RNA, 22 nt, Human
aagaagagaaaugugcugcugg

SEQ ID NO: 949021 - RNA, 22 nt, Human
uggcucugagacacaggcucuc

SEQ ID NO: 949022 - RNA, 22 nt, Human
ugucuccucauacugucauauu

SEQ ID NO: 949023 - RNA, 22 nt, Human
agaaaagguugaaaguaggauu

SEQ ID NO: 949024 - RNA, 22 nt, Human
uuuuccagauuggacuuagucc

SEQ ID NO: 949025 - RNA, 22 nt, Human
agggcuggcaagggauugaaau

SEQ ID NO: 949026 - RNA, 22 nt, Human
acuucauuguaauauuauagca

SEQ ID NO: 949027 - RNA, 22 nt, Human
ggcagaagauaggacagggaau

SEQ ID NO: 949028 - RNA, 22 nt, Human
uuccuuaguguuagauucugug

SEQ ID NO: 949029 - RNA, 22 nt, Human
caagcagacaguaggccuagaa

SEQ ID NO: 949030 - RNA, 22 nt, Human
agagggcagucucagauuggga

SEQ ID NO: 949031 - RNA, 22 nt, Human
acccaggaggugacacagggcu

SEQ ID NO: 949032 - RNA, 19 nt, Human
gcccugcaggagguggggc

SEQ ID NO: 949033 - RNA, 22 nt, Human
uccucaggagagcuccuaugcc

SEQ ID NO: 949034 - RNA, 22 nt, Human
ucacuguauuugcugaugcaua

SEQ ID NO: 949035 - RNA, 20 nt, Human
aauguauauuuuaugccagg

SEQ ID NO: 949036 - RNA, 22 nt, Human
uuguuucauggggauguuuauu

SEQ ID NO: 949037 - RNA, 20 nt, Human
aaaauauguauaacucuucu

SEQ ID NO: 949038 - RNA, 22 nt, Human
guaucacuuuugagagugagaa

SEQ ID NO: 949039 - RNA, 22 nt, Human
auucaaauuaaguuaauucagc

SEQ ID NO: 949040 - RNA, 22 nt, Human
ccacagagacaggguccuugcu

SEQ ID NO: 949041 - RNA, 22 nt, Human
aggccagcccugggcugagaga

SEQ ID NO: 949042 - RNA, 22 nt, Human
uggcagcugguacagugggucu

SEQ ID NO: 949043 - RNA, 22 nt, Human
ggcuggcaagugucugcucaug

SEQ ID NO: 949044 - RNA, 22 nt, Human
ggagccagggaagcugcuuccu

SEQ ID NO: 949045 - RNA, 20 nt, Human
gcacugaagguuccagggga

SEQ ID NO: 949046 - RNA, 19 nt, Human
gaggucagcaagaaguauu

SEQ ID NO: 949047 - RNA, 22 nt, Human
agacaaagaaaccguagaagca

SEQ ID NO: 949048 - RNA, 22 nt, Human
cuucacaaauggccuagaguuc

SEQ ID NO: 949049 - RNA, 23 nt, Human
ugauuuccagugagucaguggga

SEQ ID NO: 949050 - RNA, 22 nt, Human
gccaggagcccugggcaaguuc

SEQ ID NO: 949051 - RNA, 22 nt, Human
aggccuggugaaugaaguaucu

SEQ ID NO: 949052 - RNA, 22 nt, Human
cugccagcucucuggaggcucu

SEQ ID NO: 949053 - RNA, 20 nt, Human
ccugucugcaauggagguca

SEQ ID NO: 949054 - RNA, 22 nt, Human
uguucuuucaguuagacacagu

SEQ ID NO: 949055 - RNA, 22 nt, Human
ucugaagccaccucugcuuguc

SEQ ID NO: 949056 - RNA, 22 nt, Human
gaggcccugguaggucagagug

SEQ ID NO: 949057 - RNA, 22 nt, Human
uccucaggauguggaguagaau

SEQ ID NO: 949058 - RNA, 22 nt, Human
uucagggagagcgggacgggug

SEQ ID NO: 949059 - RNA, 22 nt, Human
cagagccacugucugccaggca

SEQ ID NO: 949060 - RNA, 22 nt, Human
cugagcuuccaguuccuccagg

SEQ ID NO: 949061 - RNA, 22 nt, Human
cauggcagaaaccugagcugcu

SEQ ID NO: 949062 - RNA, 22 nt, Human
agggcagcagcggcccaggccu

SEQ ID NO: 949063 - RNA, 22 nt, Human
ccuggcagcuguuuggcuuggc

SEQ ID NO: 949064 - RNA, 22 nt, Human
aggccuggcuuugguuugcuga

SEQ ID NO: 949065 - RNA, 20 nt, Human
acuuucucgguuucucaccu

SEQ ID NO: 949066 - RNA, 22 nt, Human
uuuuccuauaugcaaagaaugc

SEQ ID NO: 949067 - RNA, 22 nt, Human
cagcugugcuguauuaagcucu

SEQ ID NO: 949068 - RNA, 22 nt, Human
gucacuguuuccuauuauauuu

SEQ ID NO: 949069 - RNA, 22 nt, Human
gcagggcuauuggaaggagaug

SEQ ID NO: 949070 - RNA, 22 nt, Human
ugagacaguuuuucuauuucca

SEQ ID NO: 949071 - RNA, 22 nt, Human
cuccucuggcuuccuggaggca

SEQ ID NO: 949072 - RNA, 22 nt, Human
aggagcagaacugauucugacu

SEQ ID NO: 949073 - RNA, 22 nt, Human
uuuguaaaaggaggaagcaugg

SEQ ID NO: 949074 - RNA, 22 nt, Human
gugagcaucuuggcagauauga

SEQ ID NO: 949075 - RNA, 22 nt, Human
aggugaguuacaggaggagguc

SEQ ID NO: 949076 - RNA, 22 nt, Human
cagugccucuuaagugucaccc

SEQ ID NO: 949077 - RNA, 22 nt, Human
aggcagcguagcaaggcuagua

SEQ ID NO: 949078 - RNA, 22 nt, Human
uggcuggcgccgggcuagccac

SEQ ID NO: 949079 - RNA, 22 nt, Human
ucagagcugcccaugcaagggg

SEQ ID NO: 949080 - RNA, 17 nt, Human
gcgcagcuccuggcgcg

SEQ ID NO: 949081 - RNA, 22 nt, Human
cugagccaaggggacagugaca

SEQ ID NO: 949082 - RNA, 22 nt, Human
ugagccuggggccugggcagcg

SEQ ID NO: 949083 - RNA, 22 nt, Human
cuccaggaaaauagggaaugag

SEQ ID NO: 949084 - RNA, 20 nt, Human
uugagcuuuuaguacagaca

SEQ ID NO: 949085 - RNA, 23 nt, Human
acuuaaaugguucuuuaucucag

SEQ ID NO: 949086 - RNA, 22 nt, Human
guucacaagcugauugucuuuc

SEQ ID NO: 949087 - RNA, 22 nt, Human
ugcaagagguaaaaugaaagga

SEQ ID NO: 949088 - RNA, 22 nt, Human
aacuccugaggaaauggucuca

SEQ ID NO: 949089 - RNA, 22 nt, Human
ugaggcaggaguucaggcugcg

SEQ ID NO: 949090 - RNA, 22 nt, Human
ccagcagcucccucaggguccg

SEQ ID NO: 949091 - RNA, 22 nt, Human
cuuaaauucuuaaugcccucau

SEQ ID NO: 949092 - RNA, 22 nt, Human
gcugccaguaguuggagcucca

SEQ ID NO: 949093 - RNA, 22 nt, Human
uuucaguucaguuuauuauauc

SEQ ID NO: 949094 - RNA, 22 nt, Human
aauauuaauagaagggguucua

SEQ ID NO: 949095 - RNA, 22 nt, Human
agggaaaggcugaugcuguggg

SEQ ID NO: 949096 - RNA, 16 nt, Human
agcagggcgggaagga

SEQ ID NO: 949097 - RNA, 22 nt, Human
caggcacugugcuagauccuug

SEQ ID NO: 949098 - RNA, 22 nt, Human
augucacagucugacucaguga

SEQ ID NO: 949099 - RNA, 22 nt, Human
acccaggacucucuuccaguag

SEQ ID NO: 949100 - RNA, 22 nt, Human
gaggacugcagaugggugcauc

SEQ ID NO: 949101 - RNA, 22 nt, Human
agcugcccugggcuggagaugg

SEQ ID NO: 949102 - RNA, 22 nt, Human
uucucugagauagacuaagugg

SEQ ID NO: 949103 - RNA, 22 nt, Human
caggcugggcagccuccccggc

SEQ ID NO: 949104 - RNA, 22 nt, Human
gaaggcuugcagcucuguggca

SEQ ID NO: 949105 - RNA, 22 nt, Human
gccagggaggcuguaggguccu

SEQ ID NO: 949106 - RNA, 22 nt, Human
gcugaaugaauguauuuuaaaa

SEQ ID NO: 949107 - RNA, 22 nt, Human
gucuggaguggggccugagaau

SEQ ID NO: 949108 - RNA, 22 nt, Human
uguucucacuggaugcuucaca

SEQ ID NO: 949109 - RNA, 22 nt, Human
ggcauggcuggguucuggugag

SEQ ID NO: 949110 - RNA, 22 nt, Human
gcagagcaguacucucuugacu

SEQ ID NO: 949111 - RNA, 22 nt, Human
aguuuauguaaaauuaguaaug

SEQ ID NO: 949112 - RNA, 22 nt, Human
ggaaaguggugguggaaagagg

SEQ ID NO: 949113 - RNA, 22 nt, Human
gcugucugcaagccaggaaaug

SEQ ID NO: 949114 - RNA, 22 nt, Human
ucucaccaaagccuugaccaua

SEQ ID NO: 949115 - RNA, 22 nt, Human
auuauuauuguugauguuaggg

SEQ ID NO: 949116 - RNA, 22 nt, Human
agcugccgaugcccagcugcau

SEQ ID NO: 949117 - RNA, 22 nt, Human
gaaaugcagaaccugagaccau

SEQ ID NO: 949118 - RNA, 19 nt, Human
uucuccagccugaccugag

SEQ ID NO: 949119 - RNA, 22 nt, Human
uaguaucuuucuauauuuccca

SEQ ID NO: 949120 - RNA, 22 nt, Human
ggguccagcuacaucagggugg

SEQ ID NO: 949121 - RNA, 22 nt, Human
aggcacugcuucuaaguaggaa

SEQ ID NO: 949122 - RNA, 21 nt, Human
aggcacuguuugugguuuggg

SEQ ID NO: 949123 - RNA, 22 nt, Human
uuucauuauucaugcuaguuau

SEQ ID NO: 949124 - RNA, 22 nt, Human
acagggccauuaucuguucuag

SEQ ID NO: 949125 - RNA, 23 nt, Human
ugaaggccuggaggacgcguugu

SEQ ID NO: 949126 - RNA, 22 nt, Human
ggcagcagaacuggcccuguau

SEQ ID NO: 949127 - RNA, 18 nt, Human
cguuuuuccgggauugca

SEQ ID NO: 949128 - RNA, 20 nt, Human
ccuaggcaugcugagucucc

SEQ ID NO: 949129 - RNA, 22 nt, Human
ugugugcaauucuuaacauaca

SEQ ID NO: 949130 - RNA, 23 nt, Human
ccucagcauggcaggagcccagc

SEQ ID NO: 949131 - RNA, 20 nt, Human
auucacaaagccaguguugc

SEQ ID NO: 949132 - RNA, 22 nt, Human
ugcauuccauguguuuccugag

SEQ ID NO: 949133 - RNA, 22 nt, Human
uuuuaauugcaauuaugguccc

SEQ ID NO: 949134 - RNA, 22 nt, Human
agugucauaugccacugcaucc

SEQ ID NO: 949135 - RNA, 22 nt, Human
gcugcucugcuguguaagcagg

SEQ ID NO: 949136 - RNA, 22 nt, Human
aggacuccauguguccuggaga

SEQ ID NO: 949137 - RNA, 22 nt, Human
uuuucauuguuccucgagcauu

SEQ ID NO: 949138 - RNA, 22 nt, Human
caagggaguuacugagggcggg

SEQ ID NO: 949139 - RNA, 23 nt, Human
uaugaacugcauugcuggugugu

SEQ ID NO: 949140 - RNA, 22 nt, Human
ucacagaaauaagauaguuauu

SEQ ID NO: 949141 - RNA, 22 nt, Human
ccaggcauccauugcuuccucu

SEQ ID NO: 949142 - RNA, 22 nt, Human
ugagcccuaagggucaagcagg

SEQ ID NO: 949143 - RNA, 22 nt, Human
aaaguguugauaugugacaucc

SEQ ID NO: 949144 - RNA, 22 nt, Human
aaucauaauuguauacauucau

SEQ ID NO: 949145 - RNA, 22 nt, Human
cagacacagauaugcauauggc

SEQ ID NO: 949146 - RNA, 22 nt, Human
cccagcucaagcagagagcuaa

SEQ ID NO: 949147 - RNA, 22 nt, Human
ugcugucugauucagggugauu

SEQ ID NO: 949148 - RNA, 22 nt, Human
gaguuuaaagcauacauauuuu

SEQ ID NO: 949149 - RNA, 22 nt, Human
cccagcuaccucugcuaggaga

SEQ ID NO: 949150 - RNA, 22 nt, Human
uccugagagcagaguccaggug

SEQ ID NO: 949151 - RNA, 22 nt, Human
acccaggacaugggcacccgug

SEQ ID NO: 949152 - RNA, 22 nt, Human
cacagggcagagaccugggugc

SEQ ID NO: 949153 - RNA, 22 nt, Human
ggcucuggugggaagguuagau

SEQ ID NO: 949154 - RNA, 22 nt, Human
ugucugugaccucuuaggcaag

SEQ ID NO: 949155 - RNA, 20 nt, Human
guaaaauauggucuuugggu

SEQ ID NO: 949156 - RNA, 22 nt, Human
uugagggucuggaucugcugcu

SEQ ID NO: 949157 - RNA, 22 nt, Human
cucaaauauguggucagaaagc

SEQ ID NO: 949158 - RNA, 22 nt, Human
cugggcaguuuauucaguucug

SEQ ID NO: 949159 - RNA, 18 nt, Human
ucaaagucuggcuccacu

SEQ ID NO: 949160 - RNA, 22 nt, Human
acaggacuguggaaggaucucu

SEQ ID NO: 949161 - RNA, 23 nt, Human
uucaagauacgguuuccaggcug

SEQ ID NO: 949162 - RNA, 22 nt, Human
gccaggcagauaugugagcuua

SEQ ID NO: 949163 - RNA, 22 nt, Human
gccucuggucccucaugcugug

SEQ ID NO: 949164 - RNA, 22 nt, Human
gugcuuaauacaugucaauaac

SEQ ID NO: 949165 - RNA, 22 nt, Human
agaagccauugaagcagaccuc

SEQ ID NO: 949166 - RNA, 22 nt, Human
aguaacuaugcuugagaaucag

SEQ ID NO: 949167 - RNA, 22 nt, Human
ccugagaggcccucucacuguc

SEQ ID NO: 949168 - RNA, 22 nt, Human
uggagcugggaguccugggcug

SEQ ID NO: 949169 - RNA, 22 nt, Human
gccucugcucucagguagccuc

SEQ ID NO: 949170 - RNA, 20 nt, Human
ccaagagcaugcaugaggaa

SEQ ID NO: 949171 - RNA, 22 nt, Human
uacaguauuaugagugauugaa

SEQ ID NO: 949172 - RNA, 22 nt, Human
gaguuauucuagguccuuugua

SEQ ID NO: 949173 - RNA, 22 nt, Human
uggucaacaggcagggaugaaa

SEQ ID NO: 949174 - RNA, 22 nt, Human
ccaggagcauuaagagaacaua

SEQ ID NO: 949175 - RNA, 22 nt, Human
cagggcugcuggccgugcccuc

SEQ ID NO: 949176 - RNA, 22 nt, Human
agccacagucaaccuguccaua

SEQ ID NO: 949177 - RNA, 22 nt, Human
gcagcuguggguuccaagucua

SEQ ID NO: 949178 - RNA, 22 nt, Human
agaauaaacugcuuuagggcag

SEQ ID NO: 949179 - RNA, 22 nt, Human
aggcucagauccuuguguccug

SEQ ID NO: 949180 - RNA, 22 nt, Human
gcaggaugccagggcagcagcg

SEQ ID NO: 949181 - RNA, 22 nt, Human
gggagcaggacauaauagcaau

SEQ ID NO: 949182 - RNA, 22 nt, Human
guggcuucuggcugggccucag

SEQ ID NO: 949183 - RNA, 22 nt, Human
ugugucaaguggaauuucaggg

SEQ ID NO: 949184 - RNA, 23 nt, Human
ugggggugcacgggccacaucuu

SEQ ID NO: 949185 - RNA, 18 nt, Human
cccggcuaauuuuuggua

SEQ ID NO: 949186 - RNA, 22 nt, Human
cagaggauucccuagugaccug

SEQ ID NO: 949187 - RNA, 22 nt, Human
agcuuccuuggcgcugaggccu

SEQ ID NO: 949188 - RNA, 22 nt, Human
ccugccuguaagauggguacaa

SEQ ID NO: 949189 - RNA, 22 nt, Human
gcaguucuacuuauccauagac

SEQ ID NO: 949190 - RNA, 22 nt, Human
uaggauguagcuaugucaucau

SEQ ID NO: 949191 - RNA, 22 nt, Human
gugguaauagagcuccaaacua

SEQ ID NO: 949192 - RNA, 22 nt, Human
acuggcagcuguaggaugcaug

SEQ ID NO: 949193 - RNA, 22 nt, Human
ugcauuaugcuacccagaagcu

SEQ ID NO: 949194 - RNA, 22 nt, Human
uuuuuccuuagggguuacucac

SEQ ID NO: 949195 - RNA, 22 nt, Human
uaaagguacgaagugagggauu

SEQ ID NO: 949196 - RNA, 22 nt, Human
auucucuuuguauaacaucuug

SEQ ID NO: 949197 - RNA, 22 nt, Human
agacaguguguguauauauggu

SEQ ID NO: 949198 - RNA, 22 nt, Human
cugggagcuuggagccuuuggu

SEQ ID NO: 949199 - RNA, 22 nt, Human
ugucaucuuuuuaaagaagaga

SEQ ID NO: 949200 - RNA, 22 nt, Human
agcuuguagaaggccacgagca

SEQ ID NO: 949201 - RNA, 22 nt, Human
uauucacaggcuggagugaugu

SEQ ID NO: 949202 - RNA, 22 nt, Human
gaagaggaugacaggagccggu

SEQ ID NO: 949203 - RNA, 22 nt, Human
cccaucaggaacccaggagccc

SEQ ID NO: 949204 - RNA, 22 nt, Human
cuaucuuucgauucuagcuuaa

SEQ ID NO: 949205 - RNA, 22 nt, Human
caccuagcagaacagaggugcu

SEQ ID NO: 949206 - RNA, 22 nt, Human
uuggcaguagugguaguacauu

SEQ ID NO: 949207 - RNA, 22 nt, Human
ucuggccaauguugugaucaca

SEQ ID NO: 949208 - RNA, 22 nt, Human
ccucagaggugaacaucagugc

SEQ ID NO: 949209 - RNA, 22 nt, Human
agucuuauguuugugaagaacu

SEQ ID NO: 949210 - RNA, 22 nt, Human
auugcuguacacuucuagaucu

SEQ ID NO: 949211 - RNA, 22 nt, Human
cagggccacccucugcugggug

SEQ ID NO: 949212 - RNA, 22 nt, Human
aagcccagaugugagaacugag

SEQ ID NO: 949213 - RNA, 22 nt, Human
caaaugcauaguuuauaagaag

SEQ ID NO: 949214 - RNA, 22 nt, Human
uggagccagcccaggccccucu

SEQ ID NO: 949215 - RNA, 22 nt, Human
cugccgagugggucaugaggca

SEQ ID NO: 949216 - RNA, 22 nt, Human
gcuggccucuacaggccggcca

SEQ ID NO: 949217 - RNA, 22 nt, Human
gagagcugugguuugaccaggc

SEQ ID NO: 949218 - RNA, 22 nt, Human
ucuccuggauggaccuucucuu

SEQ ID NO: 949219 - RNA, 22 nt, Human
uugacaagaaucguugccuugg

SEQ ID NO: 949220 - RNA, 22 nt, Human
uagcccagcaugagcagagcug

SEQ ID NO: 949221 - RNA, 22 nt, Human
gcccaggaguugaagggcugac

SEQ ID NO: 949222 - RNA, 22 nt, Human
cucuucaaaagucuaauccuua

SEQ ID NO: 949223 - RNA, 22 nt, Human
cuggcacaugcucccugagugg

SEQ ID NO: 949224 - RNA, 22 nt, Human
ugugcuucuugcagcuccugua

SEQ ID NO: 949225 - RNA, 19 nt, Human
gcucugugaugcugagggg

SEQ ID NO: 949226 - RNA, 22 nt, Human
agcagcugagaugguaagauuc

SEQ ID NO: 949227 - RNA, 22 nt, Human
agcccagaggcugggcgugcau

SEQ ID NO: 949228 - RNA, 22 nt, Human
agucuucagagaaauuaacucu

SEQ ID NO: 949229 - RNA, 22 nt, Human
cugggcugagccugggcugugu

SEQ ID NO: 949230 - RNA, 22 nt, Human
uccagagccuauauguucaacu

SEQ ID NO: 949231 - RNA, 22 nt, Human
aacucugccagguuucaggagc

SEQ ID NO: 949232 - RNA, 22 nt, Human
agcagcugggcucagagcuggg

SEQ ID NO: 949233 - RNA, 22 nt, Human
agcugcccugguaagauugaug

SEQ ID NO: 949234 - RNA, 22 nt, Human
gccucugggcucugccccuggc

SEQ ID NO: 949235 - RNA, 22 nt, Human
acagagcauuugggacagagag

SEQ ID NO: 949236 - RNA, 22 nt, Human
guauccuuugcggaaauuucua

SEQ ID NO: 949237 - RNA, 22 nt, Human
ccugguggccuucagcccacaa

SEQ ID NO: 949238 - RNA, 22 nt, Human
cagugguuauacuuacuguuuc

SEQ ID NO: 949239 - RNA, 22 nt, Human
uugcagggcaggaccauggaca

SEQ ID NO: 949240 - RNA, 22 nt, Human
aaugccuuggagagccuagagg

SEQ ID NO: 949241 - RNA, 22 nt, Human
ggcugcuugcuguuucuuggau

SEQ ID NO: 949242 - RNA, 22 nt, Human
uuucaauguaugucuuucugag

SEQ ID NO: 949243 - RNA, 22 nt, Human
uguaaauugaaggaaauuugug

SEQ ID NO: 949244 - RNA, 22 nt, Human
ugggggacugcacuggcgucag

SEQ ID NO: 949245 - RNA, 22 nt, Human
aaagucauguaaugauaugauu

SEQ ID NO: 949246 - RNA, 20 nt, Human
acugcuucuuucucugaccu

SEQ ID NO: 949247 - RNA, 22 nt, Human
uagauuucgcugcaucucaauc

SEQ ID NO: 949248 - RNA, 22 nt, Human
ugccucugugggcagagcugcc

SEQ ID NO: 949249 - RNA, 20 nt, Human
ccuuuauuauuuguaugaug

SEQ ID NO: 949250 - RNA, 22 nt, Human
gaggaggcuggcgccgccugcc

SEQ ID NO: 949251 - RNA, 22 nt, Human
ccauggcaauggucagucuauu

SEQ ID NO: 949252 - RNA, 22 nt, Human
agagcuguucagcagccagguu

SEQ ID NO: 949253 - RNA, 22 nt, Human
cucugcugcccaggccugcuag

SEQ ID NO: 949254 - RNA, 22 nt, Human
ggggcagcucccgagggcagga

SEQ ID NO: 949255 - RNA, 18 nt, Human
cagauccaggcagcuauu

SEQ ID NO: 949256 - RNA, 22 nt, Human
uccugagagcagcugcuuugga

SEQ ID NO: 949257 - RNA, 22 nt, Human
gcacccaggcuugggcagcaac

SEQ ID NO: 949258 - RNA, 22 nt, Human
cccagcccagcguucgaggggu

SEQ ID NO: 949259 - RNA, 22 nt, Human
acuuuggaucugauguaaucag

SEQ ID NO: 949260 - RNA, 22 nt, Human
uucuucagucccacuagccaca

SEQ ID NO: 949261 - RNA, 22 nt, Human
cuuuggcacagucucauuugau

SEQ ID NO: 949262 - RNA, 22 nt, Human
ccaggacuuauuacaguauaac

SEQ ID NO: 949263 - RNA, 22 nt, Human
ccuggccuggcacucccucugc

SEQ ID NO: 949264 - RNA, 18 nt, Human
uguacaguuaugagcauu

SEQ ID NO: 949265 - RNA, 22 nt, Human
aggagcugggcugcugcuggga

SEQ ID NO: 949266 - RNA, 22 nt, Human
agagaaaagaguucaggcuuug

SEQ ID NO: 949267 - RNA, 22 nt, Human
gacagcagacagaacuaccugc

SEQ ID NO: 949268 - RNA, 22 nt, Human
acagggucaagggugcuacaag

SEQ ID NO: 949269 - RNA, 22 nt, Human
uccaggagggggagccgugccg

SEQ ID NO: 949270 - RNA, 22 nt, Human
uccccagccgugaaggagagga

SEQ ID NO: 949271 - RNA, 17 nt, Human
gccuggcccagccuggc

SEQ ID NO: 949272 - RNA, 22 nt, Human
aaggcaggaugcggacccaucu

SEQ ID NO: 949273 - RNA, 22 nt, Human
gcugggaggaauuuggggaaua

SEQ ID NO: 949274 - RNA, 22 nt, Human
aggcaccuugagagcaggagcu

SEQ ID NO: 949275 - RNA, 17 nt, Human
ugaaggaaggaugaugu

SEQ ID NO: 949276 - RNA, 22 nt, Human
gggcugcuuauacugaugauaa

SEQ ID NO: 949277 - RNA, 22 nt, Human
caaaaguaauguaugcucaucg

SEQ ID NO: 949278 - RNA, 22 nt, Human
aaugaugguuaaacacuggagg

SEQ ID NO: 949279 - RNA, 19 nt, Human
gagcugccuuuugaagacc

SEQ ID NO: 949280 - RNA, 22 nt, Human
ugggagcaagcuacuuagggaa

SEQ ID NO: 949281 - RNA, 22 nt, Human
cagguggguacaucacagagac

SEQ ID NO: 949282 - RNA, 22 nt, Human
auggccuggggagcaugggaag

SEQ ID NO: 949283 - RNA, 22 nt, Human
uccuggccagaggacaaagcug

SEQ ID NO: 949284 - RNA, 22 nt, Human
caagagcuagacuuugucagga

SEQ ID NO: 949285 - RNA, 22 nt, Human
uggagcaggaagucuauggcug

SEQ ID NO: 949286 - RNA, 22 nt, Human
ugcuauaagaauuauauuacuc

SEQ ID NO: 949287 - RNA, 22 nt, Human
ccuccaggauaagucagggccu

SEQ ID NO: 949288 - RNA, 22 nt, Human
augugaaagagguguucagugg

SEQ ID NO: 949289 - RNA, 22 nt, Human
cauuuguaucugggcugcugug

SEQ ID NO: 949290 - RNA, 22 nt, Human
aaaugguauuuacucuguauua

SEQ ID NO: 949291 - RNA, 17 nt, Human
gagaguguauuggaugc

SEQ ID NO: 949292 - RNA, 22 nt, Human
cuuggccucuucucaggguggg

SEQ ID NO: 949293 - RNA, 22 nt, Human
uaggcaauauuagacuuugucu

SEQ ID NO: 949294 - RNA, 22 nt, Human
ugucugguggguugacaggcag

SEQ ID NO: 949295 - RNA, 22 nt, Human
agagggagcccagucauagcug

SEQ ID NO: 949296 - RNA, 22 nt, Human
gccugccuuuuggaggcacauu

SEQ ID NO: 949297 - RNA, 22 nt, Human
uacucugcucauuggagugugu

SEQ ID NO: 949298 - RNA, 22 nt, Human
uuggccaacauggugaaacccc

SEQ ID NO: 949299 - RNA, 22 nt, Human
cucuggagggaggcugagcugg

SEQ ID NO: 949300 - RNA, 22 nt, Human
gagcagagacaguacaacuggc

SEQ ID NO: 949301 - RNA, 22 nt, Human
aggcacagcacaccuggccccc

SEQ ID NO: 949302 - RNA, 22 nt, Human
cugccagcacugccuccugagg

SEQ ID NO: 949303 - RNA, 22 nt, Human
cccaggagacauauagaaggac

SEQ ID NO: 949304 - RNA, 22 nt, Human
gccuggagaccugcuccucuac

SEQ ID NO: 949305 - RNA, 22 nt, Human
cugggacacccaaggaaagagc

SEQ ID NO: 949306 - RNA, 22 nt, Human
aaccaggacaauuugaauagaa

SEQ ID NO: 949307 - RNA, 22 nt, Human
acagggcuuagaaaucuguugc

SEQ ID NO: 949308 - RNA, 22 nt, Human
ucauguuugagacuaauuuuuc

SEQ ID NO: 949309 - RNA, 22 nt, Human
ucucagaguuccucuggagucc

SEQ ID NO: 949310 - RNA, 22 nt, Human
aaaagacauaugugggcauucu

SEQ ID NO: 949311 - RNA, 22 nt, Human
cagcugagaccagaaugcaggu

SEQ ID NO: 949312 - RNA, 22 nt, Human
uagaacaugcucauguauaaau

SEQ ID NO: 949313 - RNA, 21 nt, Human
ugccagggauuuacagagccu

SEQ ID NO: 949314 - RNA, 22 nt, Human
uauuuauaaucugccaaagaga

SEQ ID NO: 949315 - RNA, 18 nt, Human
gagucuuuguuacugcug

SEQ ID NO: 949316 - RNA, 22 nt, Human
agugaccaacaaugcugagaag

SEQ ID NO: 949317 - RNA, 22 nt, Human
agauacauauagaaaacaucaa

SEQ ID NO: 949318 - RNA, 22 nt, Human
agauaauuugaguaaauuaauu

SEQ ID NO: 949319 - RNA, 22 nt, Human
ccucagggucugaggagaccgu

SEQ ID NO: 949320 - RNA, 22 nt, Human
aucacgucaugguuugaucugg

SEQ ID NO: 949321 - RNA, 22 nt, Human
gugcugggcuccaccccagagg

SEQ ID NO: 949322 - RNA, 23 nt, Human
aggucagcaggcaaggaaauggc

SEQ ID NO: 949323 - RNA, 22 nt, Human
aaguuugcauagauuaagcauu

SEQ ID NO: 949324 - RNA, 22 nt, Human
aggcaguuucugggacagcaua

SEQ ID NO: 949325 - RNA, 22 nt, Human
cauacauugcucauucaguauc

SEQ ID NO: 949326 - RNA, 22 nt, Human
auacagaagaacuauagccacu

SEQ ID NO: 949327 - RNA, 22 nt, Human
cagaggccuuucuacagugaua

SEQ ID NO: 949328 - RNA, 22 nt, Human
aggaggccccuccuggguugcu

SEQ ID NO: 949329 - RNA, 22 nt, Human
agagagcccgggccagggcaca

SEQ ID NO: 949330 - RNA, 22 nt, Human
agccagcucccuccccugcagg

SEQ ID NO: 949331 - RNA, 22 nt, Human
acugcagccuugaacucugggc

SEQ ID NO: 949332 - RNA, 22 nt, Human
caggccugagacaucugagaua

SEQ ID NO: 949333 - RNA, 17 nt, Human
agcagcuggcacaggag

SEQ ID NO: 949334 - RNA, 22 nt, Human
gggagacacgcugcaggcauaa

SEQ ID NO: 949335 - RNA, 22 nt, Human
ccaggagcuggcauguggagag

SEQ ID NO: 949336 - RNA, 22 nt, Human
ugaaggccagcucuuuaucagc

SEQ ID NO: 949337 - RNA, 22 nt, Human
gaagaacaccugcugcccagug

SEQ ID NO: 949338 - RNA, 23 nt, Human
guuguaauggauaaugcaaauug

SEQ ID NO: 949339 - RNA, 22 nt, Human
aggaggccgcugaugggcuccc

SEQ ID NO: 949340 - RNA, 19 nt, Human
ucauaaaaaugguaaccca

SEQ ID NO: 949341 - RNA, 22 nt, Human
cagugguugguagauacuugag

SEQ ID NO: 949342 - RNA, 22 nt, Human
gcaaguuauuuccauuuaaagc

SEQ ID NO: 949343 - RNA, 22 nt, Human
uugaaaguagcagcugcauaug

SEQ ID NO: 949344 - RNA, 22 nt, Human
guccucugacucagccuuggga

SEQ ID NO: 949345 - RNA, 22 nt, Human
uggaaggagcuaaggaccuggg

SEQ ID NO: 949346 - RNA, 22 nt, Human
auucuucaccauggauaauuug

SEQ ID NO: 949347 - RNA, 22 nt, Human
uaucuguuguaguacagaugau

SEQ ID NO: 949348 - RNA, 17 nt, Human
augugucuagugcaacc

SEQ ID NO: 949349 - RNA, 22 nt, Human
uuugugaacaaacaugaagaug

SEQ ID NO: 949350 - RNA, 22 nt, Human
cucugagcagaggccguggcua

SEQ ID NO: 949351 - RNA, 22 nt, Human
aacaguaucuuuuaucagaaau

SEQ ID NO: 949352 - RNA, 22 nt, Human
ggagacagugguagggccuaag

SEQ ID NO: 949353 - RNA, 22 nt, Human
cugugucucuccuuacaagacu

SEQ ID NO: 949354 - RNA, 22 nt, Human
uggagcugguaaacagugacau

SEQ ID NO: 949355 - RNA, 22 nt, Human
aagcuggcaauuaucaaaacug

SEQ ID NO: 949356 - RNA, 22 nt, Human
aaaaacugcaauuacuuuuguc

SEQ ID NO: 949357 - RNA, 22 nt, Human
aucuugcauuugcuaaaaugca

SEQ ID NO: 949358 - RNA, 22 nt, Human
ggccucugcaacuggcuguggc

SEQ ID NO: 949359 - RNA, 22 nt, Human
gugccugguuuggggaguguuc

SEQ ID NO: 949360 - RNA, 20 nt, Human
agacccuguguccuguggcc

SEQ ID NO: 949361 - RNA, 22 nt, Human
ccagcagaggggcggagugcag

SEQ ID NO: 949362 - RNA, 22 nt, Human
ggcgugggaaguggggcuucug

SEQ ID NO: 949363 - RNA, 22 nt, Human
cuucuauaaacugugaucuuuc

SEQ ID NO: 949364 - RNA, 22 nt, Human
aggccaggcaacauucugaagu

SEQ ID NO: 949365 - RNA, 22 nt, Human
uuccuguaugucagugaagagc

SEQ ID NO: 949366 - RNA, 22 nt, Human
uggccugcccagagcagcucug

SEQ ID NO: 949367 - RNA, 22 nt, Human
cugugcuugacagugggaagca

SEQ ID NO: 949368 - RNA, 22 nt, Human
ucccugggccacagcugugagc

SEQ ID NO: 949369 - RNA, 22 nt, Human
ucaggggcugugcauuucccag

SEQ ID NO: 949370 - RNA, 22 nt, Human
gucccuggucuaccguggcuuc

SEQ ID NO: 949371 - RNA, 22 nt, Human
gcccuuccaacccagagggcaa

SEQ ID NO: 949372 - RNA, 22 nt, Human
auccuuggaugugucuuuuugu

SEQ ID NO: 949373 - RNA, 23 nt, Human
aucaaaguggaaaucaauuaucu

SEQ ID NO: 949374 - RNA, 22 nt, Human
ccacccuuggguucggaggccg

SEQ ID NO: 949375 - RNA, 22 nt, Human
ccagggugugggcgucggcacg

SEQ ID NO: 949376 - RNA, 22 nt, Human
guauguguaaguaugccaccuu

SEQ ID NO: 949377 - RNA, 20 nt, Human
cagagaccugucuucacaga

SEQ ID NO: 949378 - RNA, 22 nt, Human
agggaguguaaauggugcucag

SEQ ID NO: 949379 - RNA, 22 nt, Human
cacugcaggucugagauggggg

SEQ ID NO: 949380 - RNA, 22 nt, Human
gccugagacagugugguccaau

SEQ ID NO: 949381 - RNA, 22 nt, Human
uggcagcugaauggcuggaugg

SEQ ID NO: 949382 - RNA, 22 nt, Human
agcaccuggucuccuggcgcug

SEQ ID NO: 949383 - RNA, 18 nt, Human
uccucucuuuccccaggg

SEQ ID NO: 949384 - RNA, 22 nt, Human
cucagcucuuuauacuagcugu

SEQ ID NO: 949385 - RNA, 22 nt, Human
gcugucugucucugugacuuaa

SEQ ID NO: 949386 - RNA, 22 nt, Human
ggcacugacacuagcauggcac

SEQ ID NO: 949387 - RNA, 22 nt, Human
ucaggggacagccagcuggagg

SEQ ID NO: 949388 - RNA, 22 nt, Human
uaccuucaccagcgaauguuug

SEQ ID NO: 949389 - RNA, 22 nt, Human
cagccuuugugaacaucaggug

SEQ ID NO: 949390 - RNA, 22 nt, Human
uucauugugauucuuggcuagc

SEQ ID NO: 949391 - RNA, 22 nt, Human
agaccaagugcaggugccacua

SEQ ID NO: 949392 - RNA, 22 nt, Human
aaaucagagucugauuuuaagg

SEQ ID NO: 949393 - RNA, 22 nt, Human
gcccaggagccuggagaugugu

SEQ ID NO: 949394 - RNA, 22 nt, Human
augucccagcugagagacaacu

SEQ ID NO: 949395 - RNA, 22 nt, Human
cugagcugaaacuugagaggcu

SEQ ID NO: 949396 - RNA, 18 nt, Human
acucaggaaaugaugaca

SEQ ID NO: 949397 - RNA, 22 nt, Human
gaggccuggguuggaggugcau

SEQ ID NO: 949398 - RNA, 22 nt, Human
ccuggaggagcgcugaccagcu

SEQ ID NO: 949399 - RNA, 22 nt, Human
ccccuuccacagugcuuccuaa

SEQ ID NO: 949400 - RNA, 22 nt, Human
aagcagccacuggccaguuaua

SEQ ID NO: 949401 - RNA, 22 nt, Human
agcugccagcaaguuucaaaca

SEQ ID NO: 949402 - RNA, 22 nt, Human
gguuauauaauucagugcuuuc

SEQ ID NO: 949403 - RNA, 22 nt, Human
ccagaaaaugcagaacauagaa

SEQ ID NO: 949404 - RNA, 22 nt, Human
ugaagcaacuggacaaguuggc

SEQ ID NO: 949405 - RNA, 22 nt, Human
gagauggggaauaggagcaagc

SEQ ID NO: 949406 - RNA, 22 nt, Human
ggugauuuucgaguuucauguu

SEQ ID NO: 949407 - RNA, 22 nt, Human
aucuggcucccuuggaauccgu

SEQ ID NO: 949408 - RNA, 22 nt, Human
uguuaacaucuuggacucguga

SEQ ID NO: 949409 - RNA, 22 nt, Human
gaagcacauggcuauagcuauu

SEQ ID NO: 949410 - RNA, 22 nt, Human
cugagccauaagggaggcuggg

SEQ ID NO: 949411 - RNA, 23 nt, Human
cuccuggaggguccggcccugcc

SEQ ID NO: 949412 - RNA, 20 nt, Human
cucuggcuccgcgugaccgc

SEQ ID NO: 949413 - RNA, 22 nt, Human
aggggugugcauccuggaggau

SEQ ID NO: 949414 - RNA, 22 nt, Human
agugauggagcuuccucugcua

SEQ ID NO: 949415 - RNA, 18 nt, Human
aggccaaacuuguaagca

SEQ ID NO: 949416 - RNA, 22 nt, Human
ucaguuacuccuuuccuuaggu

SEQ ID NO: 949417 - RNA, 22 nt, Human
uguaggccuauguccagcaauu

SEQ ID NO: 949418 - RNA, 22 nt, Human
cacuggaauucaagauacugag

SEQ ID NO: 949419 - RNA, 22 nt, Human
uccaugaggaccaaauucguag

SEQ ID NO: 949420 - RNA, 22 nt, Human
ucaggugggaccugcuaggaca

SEQ ID NO: 949421 - RNA, 22 nt, Human
uagcagugccaggauuuugcug

SEQ ID NO: 949422 - RNA, 22 nt, Human
cuacauuuguucuauagcuuuu

SEQ ID NO: 949423 - RNA, 18 nt, Human
cugaggccaacuacacug

SEQ ID NO: 949424 - RNA, 22 nt, Human
ggcagggaggaggugaaaguga

SEQ ID NO: 949425 - RNA, 22 nt, Human
gaggagggagcuggaagcucuu

SEQ ID NO: 949426 - RNA, 22 nt, Human
ggcuuccuuucacuacccucag

SEQ ID NO: 949427 - RNA, 21 nt, Human
auuguuaucauugugcugugu

SEQ ID NO: 949428 - RNA, 22 nt, Human
caugucuggguauaugcauaug

SEQ ID NO: 949429 - RNA, 20 nt, Human
gggcuggcgcauggggaaag

SEQ ID NO: 949430 - RNA, 18 nt, Human
ccagagcuggcuccucgc

SEQ ID NO: 949431 - RNA, 22 nt, Human
uucauugucucuguuugccuuc

SEQ ID NO: 949432 - RNA, 22 nt, Human
cauuuagaaacuguuuuuaaca

SEQ ID NO: 949433 - RNA, 22 nt, Human
ggaucauuaacacauccaucac

SEQ ID NO: 949434 - RNA, 22 nt, Human
uugugucccccuuugagagcca

SEQ ID NO: 949435 - RNA, 22 nt, Human
caguacuucuuggaaacuggau

SEQ ID NO: 949436 - RNA, 22 nt, Human
gcagaggccugaagguggcggg

SEQ ID NO: 949437 - RNA, 22 nt, Human
ugccaggagagugcaugcaggg

SEQ ID NO: 949438 - RNA, 22 nt, Human
ccccaggacguggcccucauag

SEQ ID NO: 949439 - RNA, 22 nt, Human
aggaaagcucccaguagggcuc

SEQ ID NO: 949440 - RNA, 22 nt, Human
ggcucuggugcccuggcuccca

SEQ ID NO: 949441 - RNA, 22 nt, Human
ugcugggggugucucaccaggc

SEQ ID NO: 949442 - RNA, 22 nt, Human
uaacugauauugaaaaacauca

SEQ ID NO: 949443 - RNA, 22 nt, Human
cacagagagcuacgugcagcgu

SEQ ID NO: 949444 - RNA, 22 nt, Human
agagccaggaucuguuuugggg

SEQ ID NO: 949445 - RNA, 22 nt, Human
ucccagcagggccgaccagccu

SEQ ID NO: 949446 - RNA, 22 nt, Human
gaagcagcucagauugacugaa

SEQ ID NO: 949447 - RNA, 22 nt, Human
guuccacaaaauguacccaguu

SEQ ID NO: 949448 - RNA, 22 nt, Human
uugccuugauucuucucaugug

SEQ ID NO: 949449 - RNA, 22 nt, Human
aaggagugcaugacucagagua

SEQ ID NO: 949450 - RNA, 22 nt, Human
cuggaaauuggagaugauguuu

SEQ ID NO: 949451 - RNA, 22 nt, Human
aauugcuaaagauuauguuuuc

SEQ ID NO: 949452 - RNA, 22 nt, Human
agugacagcugggaaggugaaa

SEQ ID NO: 949453 - RNA, 22 nt, Human
guggccaggacauugccaggca

SEQ ID NO: 949454 - RNA, 22 nt, Human
auggagacgcaagggaccuagg

SEQ ID NO: 949455 - RNA, 22 nt, Human
auuauuagugauguuguuacug

SEQ ID NO: 949456 - RNA, 22 nt, Human
caaauguguaaggaaguguuag

SEQ ID NO: 949457 - RNA, 22 nt, Human
cugcuggagguuggagcaugca

SEQ ID NO: 949458 - RNA, 22 nt, Human
cccaggagguguagcugcgugg

SEQ ID NO: 949459 - RNA, 22 nt, Human
ccaggccuguguuguguggagg

SEQ ID NO: 949460 - RNA, 22 nt, Human
aggaccaacauagcagcagugg

SEQ ID NO: 949461 - RNA, 22 nt, Human
auuguguccucauugaccuuca

SEQ ID NO: 949462 - RNA, 22 nt, Human
uuacaaagagugccagagugug

SEQ ID NO: 949463 - RNA, 16 nt, Human
ccagaggccuggccuc

SEQ ID NO: 949464 - RNA, 23 nt, Human
uggcucagggucucuuaugaagu

SEQ ID NO: 949465 - RNA, 22 nt, Human
ucuggcucacuucaggcuucac

SEQ ID NO: 949466 - RNA, 22 nt, Human
uuaguaauguguuaauaugaau

SEQ ID NO: 949467 - RNA, 22 nt, Human
aguguacaguuuguaguacuac

SEQ ID NO: 949468 - RNA, 22 nt, Human
aauauuguuucaagaucacaga

SEQ ID NO: 949469 - RNA, 22 nt, Human
ggcuuccuggagaaggucugag

SEQ ID NO: 949470 - RNA, 22 nt, Human
ugccucuguugagccuuggcug

SEQ ID NO: 949471 - RNA, 22 nt, Human
ccacugggcguuucuguccaau

SEQ ID NO: 949472 - RNA, 22 nt, Human
aauuuguuaaaagugagugaca

SEQ ID NO: 949473 - RNA, 18 nt, Human
uuccauaauguauguaac

SEQ ID NO: 949474 - RNA, 22 nt, Human
ccugggcaucucaugcaccugc

SEQ ID NO: 949475 - RNA, 22 nt, Human
agagaagagcaaugauaaauuu

SEQ ID NO: 949476 - RNA, 22 nt, Human
guccucuggugaaagcauuccc

SEQ ID NO: 949477 - RNA, 23 nt, Human
aggcagcuggguagcaucuuucu

SEQ ID NO: 949478 - RNA, 22 nt, Human
uaggaaaagucuagauugauga

SEQ ID NO: 949479 - RNA, 22 nt, Human
uugagggaacaugagaaucauc

SEQ ID NO: 949480 - RNA, 21 nt, Human
gacaggggaagaagcaaggag

SEQ ID NO: 949481 - RNA, 22 nt, Human
ccuccuggcuuuucccauugaa

SEQ ID NO: 949482 - RNA, 23 nt, Human
uugcauagacauccucauagauu

SEQ ID NO: 949483 - RNA, 22 nt, Human
uugcaggaaacugagugugagc

SEQ ID NO: 949484 - RNA, 22 nt, Human
uucugagacaauugagagucua

SEQ ID NO: 949485 - RNA, 22 nt, Human
aggcccugaagucggccccuca

SEQ ID NO: 949486 - RNA, 22 nt, Human
ucaagcaucuuggucuacgauc

SEQ ID NO: 949487 - RNA, 22 nt, Human
ugaaaugaagggcuuguucugg

SEQ ID NO: 949488 - RNA, 22 nt, Human
gcagaggccaucaacuuugcca

SEQ ID NO: 949489 - RNA, 22 nt, Human
gaugaagccugacuucucggug

SEQ ID NO: 949490 - RNA, 22 nt, Human
aauuucagaccauuugcaauua

SEQ ID NO: 949491 - RNA, 22 nt, Human
ucauauaccagagaguuuauau

SEQ ID NO: 949492 - RNA, 22 nt, Human
acagcuguggggacucuugccc

SEQ ID NO: 949493 - RNA, 22 nt, Human
ccuggagaccagaggauacuuc

SEQ ID NO: 949494 - RNA, 22 nt, Human
auuugcagagcucugaauuuug

SEQ ID NO: 949495 - RNA, 17 nt, Human
cuggagccaagagggcc

SEQ ID NO: 949496 - RNA, 22 nt, Human
cucuucucugcagccuuugaag

SEQ ID NO: 949497 - RNA, 22 nt, Human
uucauuaguucugaagaugucu

SEQ ID NO: 949498 - RNA, 22 nt, Human
uaugcacaguuacaagaauauc

SEQ ID NO: 949499 - RNA, 21 nt, Human
uuugaaagcccuauguuuuca

SEQ ID NO: 949500 - RNA, 22 nt, Human
aggcacugggaauaugcugagg

SEQ ID NO: 949501 - RNA, 18 nt, Human
ugcucuguuuaaugauuu

SEQ ID NO: 949502 - RNA, 23 nt, Human
uggcucucucagugcugcagagg

SEQ ID NO: 949503 - RNA, 22 nt, Human
aaugaacaaaauaugcuuugca

SEQ ID NO: 949504 - RNA, 22 nt, Human
cugacucuccucaagcauaaau

SEQ ID NO: 949505 - RNA, 22 nt, Human
ccuauugacaauucucuucucc

SEQ ID NO: 949506 - RNA, 22 nt, Human
gaggacaggagacucacuguuu

SEQ ID NO: 949507 - RNA, 22 nt, Human
cuguugcucugaacaggucuug

SEQ ID NO: 949508 - RNA, 22 nt, Human
auguguaaaaagugcuuaauau

SEQ ID NO: 949509 - RNA, 22 nt, Human
cauccaggcaccacaaccagcu

SEQ ID NO: 949510 - RNA, 22 nt, Human
gcugcugucagugguggcaguu

SEQ ID NO: 949511 - RNA, 20 nt, Human
uuggcagcagcucagccacc

SEQ ID NO: 949512 - RNA, 22 nt, Human
ccucaggaaccacauugcugcu

SEQ ID NO: 949513 - RNA, 22 nt, Human
ucucagagugguggucccucug

SEQ ID NO: 949514 - RNA, 22 nt, Human
ucugggcagcagcagcuaguag

SEQ ID NO: 949515 - RNA, 22 nt, Human
ugggauaguggccaggaccccc

SEQ ID NO: 949516 - RNA, 22 nt, Human
caugggagcuaucuccaucacu

SEQ ID NO: 949517 - RNA, 20 nt, Human
ggccuuggccucuuugcagc

SEQ ID NO: 949518 - RNA, 22 nt, Human
ccagcuugaagaugugcugguu

SEQ ID NO: 949519 - RNA, 21 nt, Human
cacaggugggucagugaggcc

SEQ ID NO: 949520 - RNA, 22 nt, Human
ucuguuuaggcaaaauagcuac

SEQ ID NO: 949521 - RNA, 22 nt, Human
agacagugcaagaagagcaggc

SEQ ID NO: 949522 - RNA, 22 nt, Human
auggcuggcauccaggugggcu

SEQ ID NO: 949523 - RNA, 22 nt, Human
ugagcacaaguuugcaugugug

SEQ ID NO: 949524 - RNA, 22 nt, Human
uuucacauacaguguauaguag

SEQ ID NO: 949525 - RNA, 22 nt, Human
aggucacccguuugacuaucca

SEQ ID NO: 949526 - RNA, 22 nt, Human
auuucuauaggaggacaguauu

SEQ ID NO: 949527 - RNA, 22 nt, Human
cuggcagcugugugaagaacug

SEQ ID NO: 949528 - RNA, 21 nt, Human
cagaggcagguccugggacgg

SEQ ID NO: 949529 - RNA, 22 nt, Human
gaagccaguacugugcucugca

SEQ ID NO: 949530 - RNA, 22 nt, Human
ggguccagaguugaagagguua

SEQ ID NO: 949531 - RNA, 22 nt, Human
aggagagagcugagcuuugcug

SEQ ID NO: 949532 - RNA, 22 nt, Human
cuugccuucuuuuccuauagaa

SEQ ID NO: 949533 - RNA, 22 nt, Human
gaggcagcucuucugaaugggg

SEQ ID NO: 949534 - RNA, 23 nt, Human
agcagggccagaauacuugcugu

SEQ ID NO: 949535 - RNA, 22 nt, Human
cauauuaaggucuguaaggggu

SEQ ID NO: 949536 - RNA, 22 nt, Human
gacccugccaugagugacaggg

SEQ ID NO: 949537 - RNA, 22 nt, Human
agguaagggucacaguucauau

SEQ ID NO: 949538 - RNA, 19 nt, Human
agcuggggcgguguguguu

SEQ ID NO: 949539 - RNA, 22 nt, Human
ccugaggcuuaaucugucccaa

SEQ ID NO: 949540 - RNA, 23 nt, Human
cuggcuccgaagacuccaggauc

SEQ ID NO: 949541 - RNA, 22 nt, Human
uggcucagagcagggacucugg

SEQ ID NO: 949542 - RNA, 19 nt, Human
aggguccagggagcggcuc

SEQ ID NO: 949543 - RNA, 22 nt, Human
ucagguguuagaagaaauuuca

SEQ ID NO: 949544 - RNA, 22 nt, Human
uuggccaauccuauuggguggg

SEQ ID NO: 949545 - RNA, 22 nt, Human
gguccuggaaauugacggaaag

SEQ ID NO: 949546 - RNA, 22 nt, Human
caaaggagguaaugggugugag

SEQ ID NO: 949547 - RNA, 22 nt, Human
aggacuucuccgauaagucaga

SEQ ID NO: 949548 - RNA, 22 nt, Human
cagggugggcacccagccucca

SEQ ID NO: 949549 - RNA, 22 nt, Human
caggggcucugggugaugugag

SEQ ID NO: 949550 - RNA, 22 nt, Human
agaaacauuuagauuauauguc

SEQ ID NO: 949551 - RNA, 21 nt, Human
uggcugagccaggugugugga

SEQ ID NO: 949552 - RNA, 22 nt, Human
acacacagguaaaggagccugg

SEQ ID NO: 949553 - RNA, 22 nt, Human
agcaccuguggcucaugcucgu

SEQ ID NO: 949554 - RNA, 22 nt, Human
cuggaguuagaguagacacuga

SEQ ID NO: 949555 - RNA, 22 nt, Human
cuguagccagaagcagaaggcc

SEQ ID NO: 949556 - RNA, 22 nt, Human
caggaacauuuaaccacagggu

SEQ ID NO: 949557 - RNA, 22 nt, Human
uuugaaaguucuucugacacua

SEQ ID NO: 949558 - RNA, 22 nt, Human
acagaggaaggcugagcugccc

SEQ ID NO: 949559 - RNA, 22 nt, Human
caaauguauaaauguacuuucu

SEQ ID NO: 949560 - RNA, 22 nt, Human
aaaggccagguuggcugguauu

SEQ ID NO: 949561 - RNA, 22 nt, Human
ucuuuccuaggugauaugcaau

SEQ ID NO: 949562 - RNA, 22 nt, Human
ggcuucccuuuccgagaggaga

SEQ ID NO: 949563 - RNA, 22 nt, Human
agaacuguccuuggaggagagu

SEQ ID NO: 949564 - RNA, 22 nt, Human
cagcuuccauaagagauggaga

SEQ ID NO: 949565 - RNA, 22 nt, Human
cccaggaggguggccucugccc

SEQ ID NO: 949566 - RNA, 22 nt, Human
agaguguaauaagggcaagggc

SEQ ID NO: 949567 - RNA, 22 nt, Human
augcugugucuagcaggaacac

SEQ ID NO: 949568 - RNA, 21 nt, Human
acagcagggcuggcaugacag

SEQ ID NO: 949569 - RNA, 21 nt, Human
ccuggccaaucugauaggguu

SEQ ID NO: 949570 - RNA, 22 nt, Human
aucucccagccacagcauucuu

SEQ ID NO: 949571 - RNA, 22 nt, Human
uuccaagagcuuuaauuguuga

SEQ ID NO: 949572 - RNA, 22 nt, Human
cguguacagucuaucuuuuuuc

SEQ ID NO: 949573 - RNA, 22 nt, Human
acucugagcaucccaagucuua

SEQ ID NO: 949574 - RNA, 20 nt, Human
uggccuuggggagcucacac

SEQ ID NO: 949575 - RNA, 22 nt, Human
ugggcugcuucuauuggugguc

SEQ ID NO: 949576 - RNA, 22 nt, Human
agguguguauaaacauacauau

SEQ ID NO: 949577 - RNA, 22 nt, Human
uguuuuaugagccauauaaccu

SEQ ID NO: 949578 - RNA, 23 nt, Human
uacaugcuauaauuucacccuca

SEQ ID NO: 949579 - RNA, 22 nt, Human
uguccugggaaugggaugcagu

SEQ ID NO: 949580 - RNA, 19 nt, Human
ggcagcuugggaagguagc

SEQ ID NO: 949581 - RNA, 22 nt, Human
ugcagcagguuccaaaggguua

SEQ ID NO: 949582 - RNA, 22 nt, Human
gaaggccauuagagccugugcc

SEQ ID NO: 949583 - RNA, 22 nt, Human
ucaccuuagcuagaggaagaga

SEQ ID NO: 949584 - RNA, 22 nt, Human
ucuggccagaaagacuugaugu

SEQ ID NO: 949585 - RNA, 22 nt, Human
aagggcagggaguuugugucua

SEQ ID NO: 949586 - RNA, 18 nt, Human
uccuccuuuggccuuuuc

SEQ ID NO: 949587 - RNA, 22 nt, Human
agacucaagacugcagaagacg

SEQ ID NO: 949588 - RNA, 22 nt, Human
gggauggggagcuggaaagggg

SEQ ID NO: 949589 - RNA, 22 nt, Human
cagcaggacauggaggaguaaa

SEQ ID NO: 949590 - RNA, 22 nt, Human
caugcaggcccgccugaauggg

SEQ ID NO: 949591 - RNA, 22 nt, Human
ugccucugggugaccaaggagc

SEQ ID NO: 949592 - RNA, 22 nt, Human
auaauguguucaucuuacaauu

SEQ ID NO: 949593 - RNA, 22 nt, Human
ucuuuguaaaugccuagcauaa

SEQ ID NO: 949594 - RNA, 22 nt, Human
gaaaucugcccagugcacuggu

SEQ ID NO: 949595 - RNA, 22 nt, Human
ugcaguggaaagacucagacuu

SEQ ID NO: 949596 - RNA, 22 nt, Human
ucaaaugcggucauggcuuuua

SEQ ID NO: 949597 - RNA, 22 nt, Human
ccaggaagcugucugauaugaa

SEQ ID NO: 949598 - RNA, 19 nt, Human
acccucucagugccugagg

SEQ ID NO: 949599 - RNA, 22 nt, Human
agcccuccucacaucagcgucc

SEQ ID NO: 949600 - RNA, 22 nt, Human
ucucuucuuguguuuuccugcc

SEQ ID NO: 949601 - RNA, 20 nt, Human
ugcuccaucuaaagugauua

SEQ ID NO: 949602 - RNA, 22 nt, Human
gugggcaaggucccugccagcu

SEQ ID NO: 949603 - RNA, 22 nt, Human
gaggaguggaguugcuggguug

SEQ ID NO: 949604 - RNA, 22 nt, Human
ugccucccucucugccacugga

SEQ ID NO: 949605 - RNA, 22 nt, Human
ugcccuuggguaacuugcugau

SEQ ID NO: 949606 - RNA, 22 nt, Human
uauaauccauucauugauuucu

SEQ ID NO: 949607 - RNA, 21 nt, Human
ucucugugucuuuaagcugga

SEQ ID NO: 949608 - RNA, 21 nt, Human
uccagggaacuucucaggaau

SEQ ID NO: 949609 - RNA, 20 nt, Human
gugggcagaugugugcaugg

SEQ ID NO: 949610 - RNA, 22 nt, Human
aagaagagaacuggcauccuaa

SEQ ID NO: 949611 - RNA, 22 nt, Human
agccucugugacucacagguca

SEQ ID NO: 949612 - RNA, 22 nt, Human
gcaaaugcuaaaguguagagac

SEQ ID NO: 949613 - RNA, 22 nt, Human
uuucaacauauaccauaaugcc

SEQ ID NO: 949614 - RNA, 22 nt, Human
cucuggaguucucaugaggaac

SEQ ID NO: 949615 - RNA, 22 nt, Human
acagcuuuucaauucugcugag

SEQ ID NO: 949616 - RNA, 22 nt, Human
ugugugacccccagugaagccu

SEQ ID NO: 949617 - RNA, 21 nt, Human
cauuucuauugaugagaaaag

SEQ ID NO: 949618 - RNA, 22 nt, Human
uucuuguaauuuggagaaauga

SEQ ID NO: 949619 - RNA, 22 nt, Human
uuugacauugccaauuugcuca

SEQ ID NO: 949620 - RNA, 22 nt, Human
ugaaacagucuccagacuugga

SEQ ID NO: 949621 - RNA, 22 nt, Human
agagccagcaacucuagcccug

SEQ ID NO: 949622 - RNA, 22 nt, Human
gagagugaggcaucaggggcag

SEQ ID NO: 949623 - RNA, 22 nt, Human
aggcacugcagauuacaggcgc

SEQ ID NO: 949624 - RNA, 19 nt, Human
uccauaagcuuguguucau

SEQ ID NO: 949625 - RNA, 22 nt, Human
acaaaggugcgucccuucagcu

SEQ ID NO: 949626 - RNA, 22 nt, Human
aguguccccuccaagggccugg

SEQ ID NO: 949627 - RNA, 22 nt, Human
ugggcagaggcagcagaaaccu

SEQ ID NO: 949628 - RNA, 22 nt, Human
aaugcacauaaauauggucuua

SEQ ID NO: 949629 - RNA, 22 nt, Human
cucuugaaaauuggaacacaga

SEQ ID NO: 949630 - RNA, 22 nt, Human
gaggcugauucggggaacagca

SEQ ID NO: 949631 - RNA, 22 nt, Human
ugccaggcccagcuccagagcu

SEQ ID NO: 949632 - RNA, 22 nt, Human
cugaagccacgauagcuuccua

SEQ ID NO: 949633 - RNA, 22 nt, Human
gggcugccuuucuucugggagc

SEQ ID NO: 949634 - RNA, 22 nt, Human
ccagcugcgggcaucgagaguu

SEQ ID NO: 949635 - RNA, 22 nt, Human
caggcuggagugaguguagugg

SEQ ID NO: 949636 - RNA, 22 nt, Human
agggcagccucucagccuaggu

SEQ ID NO: 949637 - RNA, 22 nt, Human
gaggggcuggcuguggucccau

SEQ ID NO: 949638 - RNA, 22 nt, Human
ccuccagcgcgauccacuccgg

SEQ ID NO: 949639 - RNA, 22 nt, Human
auugucuuuggugcuuccagga

SEQ ID NO: 949640 - RNA, 22 nt, Human
uauuuccaaaagccuauuauga

SEQ ID NO: 949641 - RNA, 22 nt, Human
uggcugggcccccaccugccuc

SEQ ID NO: 949642 - RNA, 22 nt, Human
aggucacauggauaaugaucag

SEQ ID NO: 949643 - RNA, 22 nt, Human
cagggcagggagcuuagaauga

SEQ ID NO: 949644 - RNA, 22 nt, Human
ugcugucccccgugucugggcu

SEQ ID NO: 949645 - RNA, 22 nt, Human
uuggcugagagaggaaaagggc

SEQ ID NO: 949646 - RNA, 22 nt, Human
ccaggagagcagaagcccaggc

SEQ ID NO: 949647 - RNA, 22 nt, Human
ggaggggaacuaaucccgugac

SEQ ID NO: 949648 - RNA, 22 nt, Human
auucacaaugauacauaagcga

SEQ ID NO: 949649 - RNA, 22 nt, Human
uggcucugggaaucuguugcuu

SEQ ID NO: 949650 - RNA, 22 nt, Human
gagauggggucagcugggacau

SEQ ID NO: 949651 - RNA, 18 nt, Human
uggcucagauggcuuuaa

SEQ ID NO: 949652 - RNA, 22 nt, Human
gcagagccccucaagccagccu

SEQ ID NO: 949653 - RNA, 22 nt, Human
caggguggcacaucacagcauu

SEQ ID NO: 949654 - RNA, 22 nt, Human
ggagacaguauggcuuguagcu

SEQ ID NO: 949655 - RNA, 22 nt, Human
cucuguccuugcacaguuccua

SEQ ID NO: 949656 - RNA, 22 nt, Human
ugucuucaucucagacacaguu

SEQ ID NO: 949657 - RNA, 22 nt, Human
augugucugaccacuguauugg

SEQ ID NO: 949658 - RNA, 22 nt, Human
agcugccaucugaagaacugca

SEQ ID NO: 949659 - RNA, 20 nt, Human
cucuccucacccgugucagg

SEQ ID NO: 949660 - RNA, 22 nt, Human
cagcuuuguccugcaaaccuga

SEQ ID NO: 949661 - RNA, 22 nt, Human
acugcccucccaucuauugcaa

SEQ ID NO: 949662 - RNA, 22 nt, Human
auaucaaagcuaguggaaauuu

SEQ ID NO: 949663 - RNA, 22 nt, Human
acuuaaaaagaaucuuuucacg

SEQ ID NO: 949664 - RNA, 22 nt, Human
aaugauggucauggcaacuuuu

SEQ ID NO: 949665 - RNA, 22 nt, Human
auguaauaggguaacauaacau

SEQ ID NO: 949666 - RNA, 22 nt, Human
gaguuuaaaacgcuuguauuua

SEQ ID NO: 949667 - RNA, 22 nt, Human
ggcuucagugagcugagcucac

SEQ ID NO: 949668 - RNA, 22 nt, Human
cuggcucccucgcugaggugcu

SEQ ID NO: 949669 - RNA, 22 nt, Human
auuuaagauugcguauucaugu

SEQ ID NO: 949670 - RNA, 22 nt, Human
cucuggccugcagauccaugcu

SEQ ID NO: 949671 - RNA, 22 nt, Human
cuuugcaauagaggcacacaug

SEQ ID NO: 949672 - RNA, 22 nt, Human
caucugcugcugaagccagcau

SEQ ID NO: 949673 - RNA, 22 nt, Human
cucaggauagcugcgcagccug

SEQ ID NO: 949674 - RNA, 22 nt, Human
cagcucccuauggugaggcgac

SEQ ID NO: 949675 - RNA, 22 nt, Human
cccaggaggccaagguugcagu

SEQ ID NO: 949676 - RNA, 22 nt, Human
aacaugauggggaagaacaaga

SEQ ID NO: 949677 - RNA, 19 nt, Human
ucuuuggcuaaauugggug

SEQ ID NO: 949678 - RNA, 22 nt, Human
uaggccagaggagcagcuuugg

SEQ ID NO: 949679 - RNA, 22 nt, Human
caggacaguauaggcuuuagga

SEQ ID NO: 949680 - RNA, 19 nt, Human
ggccccucucacaggaguu

SEQ ID NO: 949681 - RNA, 22 nt, Human
agccagggauggcagugcccag

SEQ ID NO: 949682 - RNA, 22 nt, Human
uucacaggaauguaggggucuu

SEQ ID NO: 949683 - RNA, 22 nt, Human
cagcaucaccgccauuucugau

SEQ ID NO: 949684 - RNA, 22 nt, Human
uuccauuguuucugucuucacu

SEQ ID NO: 949685 - RNA, 22 nt, Human
cagcccagcagucuuagccugc

SEQ ID NO: 949686 - RNA, 22 nt, Human
cugggggcaagcagacagcugu

SEQ ID NO: 949687 - RNA, 22 nt, Human
ucuggcucggauuugucuagca

SEQ ID NO: 949688 - RNA, 22 nt, Human
gaggucaggggagaggcugaug

SEQ ID NO: 949689 - RNA, 22 nt, Human
cuauuagguaugcagccuauuu

SEQ ID NO: 949690 - RNA, 22 nt, Human
cucaggauauugggcuggagca

SEQ ID NO: 949691 - RNA, 22 nt, Human
gaggaccacagaugagccugca

SEQ ID NO: 949692 - RNA, 22 nt, Human
aggcaggcuggucugaagagug

SEQ ID NO: 949693 - RNA, 22 nt, Human
gcugccugauuuacauagugaa

SEQ ID NO: 949694 - RNA, 22 nt, Human
gacagcuggcaguggaaaggug

SEQ ID NO: 949695 - RNA, 22 nt, Human
auggaaagcuaagccauuuacc

SEQ ID NO: 949696 - RNA, 22 nt, Human
ccugagagcgaguggccucaug

SEQ ID NO: 949697 - RNA, 22 nt, Human
guuuuuaucuaauagcaguuau

SEQ ID NO: 949698 - RNA, 22 nt, Human
cugagccaaaaagcagagcuug

SEQ ID NO: 949699 - RNA, 22 nt, Human
ggagggcaucaaucaggccugg

SEQ ID NO: 949700 - RNA, 22 nt, Human
cugggcugucaauggcccucug

SEQ ID NO: 949701 - RNA, 22 nt, Human
aucuggcuggauucuuagcguu

SEQ ID NO: 949702 - RNA, 22 nt, Human
gaaaggucaguuccacuuccau

SEQ ID NO: 949703 - RNA, 22 nt, Human
gucugucaucugagauggagug

SEQ ID NO: 949704 - RNA, 22 nt, Human
gucaugccagcggagcucggga

SEQ ID NO: 949705 - RNA, 22 nt, Human
caagaugccccugguagggauc

SEQ ID NO: 949706 - RNA, 22 nt, Human
agagcugaggauccagcugagc

SEQ ID NO: 949707 - RNA, 22 nt, Human
cugcugagcccuggcacaggug

SEQ ID NO: 949708 - RNA, 23 nt, Human
gugcaugugucuuuacaguagca

SEQ ID NO: 949709 - RNA, 22 nt, Human
uuugcauaaaggagcauuucuc

SEQ ID NO: 949710 - RNA, 22 nt, Human
uuuaccaagcuuuaauuacaua

SEQ ID NO: 949711 - RNA, 18 nt, Human
gucacuguguuucugagc

SEQ ID NO: 949712 - RNA, 22 nt, Human
gaguguuccagaaacuggcccu

SEQ ID NO: 949713 - RNA, 22 nt, Human
uuugcaaagaaauuauugcugu

SEQ ID NO: 949714 - RNA, 19 nt, Human
aaggcagcaguagcaucca

SEQ ID NO: 949715 - RNA, 22 nt, Human
uggcacauaguaggugcucaau

SEQ ID NO: 949716 - RNA, 22 nt, Human
cuggaaggcucugcugccuguc

SEQ ID NO: 949717 - RNA, 22 nt, Human
ugggcuggugagggaucauuua

SEQ ID NO: 949718 - RNA, 22 nt, Human
uuguuuguaugcugagaagaau

SEQ ID NO: 949719 - RNA, 22 nt, Human
uggcuggacagugggcagugga

SEQ ID NO: 949720 - RNA, 22 nt, Human
ccugcagguugcagaggcggaa

SEQ ID NO: 949721 - RNA, 22 nt, Human
agaugggcgcccuggacugagg

SEQ ID NO: 949722 - RNA, 18 nt, Human
augugcaauuuuguauuu

SEQ ID NO: 949723 - RNA, 22 nt, Human
ugggagcaguucagguguggcu

SEQ ID NO: 949724 - RNA, 22 nt, Human
ucagaggagccaaaguucugag

SEQ ID NO: 949725 - RNA, 18 nt, Human
gaagggagcuggaaugca

SEQ ID NO: 949726 - RNA, 23 nt, Human
uccaagggcuacaaacacagacc

SEQ ID NO: 949727 - RNA, 22 nt, Human
uuucaugagauuccuccacauc

SEQ ID NO: 949728 - RNA, 22 nt, Human
aaaacaguuuaggcaucacagu

SEQ ID NO: 949729 - RNA, 22 nt, Human
ugauuuccugugcgcccuuagg

SEQ ID NO: 949730 - RNA, 20 nt, Human
guauuaggagguaaauguaa

SEQ ID NO: 949731 - RNA, 22 nt, Human
gggaaccagccgcuuccgccuc

SEQ ID NO: 949732 - RNA, 22 nt, Human
caggaucccuggccuccgccca

SEQ ID NO: 949733 - RNA, 22 nt, Human
agugggcagcccaggaggucuu

SEQ ID NO: 949734 - RNA, 22 nt, Human
agaggcacagaggcaguccccu

SEQ ID NO: 949735 - RNA, 19 nt, Human
aggaaagguggccuuagca

SEQ ID NO: 949736 - RNA, 22 nt, Human
ccagggcagugggagaaggugc

SEQ ID NO: 949737 - RNA, 22 nt, Human
gcagagcucaagguguucagcu

SEQ ID NO: 949738 - RNA, 17 nt, Human
acaagcaguggccaugg

SEQ ID NO: 949739 - RNA, 20 nt, Human
acagccagaggaggcagaca

SEQ ID NO: 949740 - RNA, 22 nt, Human
ugcccugucuaagcugucagua

SEQ ID NO: 949741 - RNA, 22 nt, Human
auucuggauuaucaguccacca

SEQ ID NO: 949742 - RNA, 22 nt, Human
ugaagacagaccaaggagaaug

SEQ ID NO: 949743 - RNA, 22 nt, Human
gggugggagucuggcccucaaa

SEQ ID NO: 949744 - RNA, 22 nt, Human
cauagcaacagcaucaagucaa

SEQ ID NO: 949745 - RNA, 22 nt, Human
gaaacacaugcagcuccauaga

SEQ ID NO: 949746 - RNA, 22 nt, Human
cuggccugaggucggcuguagg

SEQ ID NO: 949747 - RNA, 22 nt, Human
aagcugccaccagcccagggca

SEQ ID NO: 949748 - RNA, 22 nt, Human
uggguagagcaggcuggggcuu

SEQ ID NO: 949749 - RNA, 23 nt, Human
uuucaacuccugccauuauuucu

SEQ ID NO: 949750 - RNA, 22 nt, Human
uuugaauaucacaaacuuucaa

SEQ ID NO: 949751 - RNA, 19 nt, Human
cagagccucagagcuagaa

SEQ ID NO: 949752 - RNA, 22 nt, Human
aaauuggauuuuaaacuguugg

SEQ ID NO: 949753 - RNA, 20 nt, Human
ugcucugucuaaaacuuccc

SEQ ID NO: 949754 - RNA, 23 nt, Human
aggaggaaaaguuaucugcugag

SEQ ID NO: 949755 - RNA, 18 nt, Human
uguuaggaagggcacaca

SEQ ID NO: 949756 - RNA, 22 nt, Human
ucuuugcaucccuuccauaguu

SEQ ID NO: 949757 - RNA, 22 nt, Human
ccagucccaucucugucgcuua

SEQ ID NO: 949758 - RNA, 22 nt, Human
aaauguguuccuuugcuacaga

SEQ ID NO: 949759 - RNA, 23 nt, Human
cuuuuaacuagaguaucagcugc

SEQ ID NO: 949760 - RNA, 22 nt, Human
gcuuccuggagggagagagcug

SEQ ID NO: 949761 - RNA, 22 nt, Human
gagcugugaaaagugccugggg

SEQ ID NO: 949762 - RNA, 22 nt, Human
aggucagcaugaguagaaggua

SEQ ID NO: 949763 - RNA, 22 nt, Human
gagccaagggcgugcuggagag

SEQ ID NO: 949764 - RNA, 20 nt, Human
aguuauaguaucuagccaug

SEQ ID NO: 949765 - RNA, 22 nt, Human
cucucugggcccaguuggcacc

SEQ ID NO: 949766 - RNA, 22 nt, Human
aaggccaugaccacuugcugug

SEQ ID NO: 949767 - RNA, 22 nt, Human
agcaccuugcucuuggccuucc

SEQ ID NO: 949768 - RNA, 22 nt, Human
cugagaaggaagccuccacucu

SEQ ID NO: 949769 - RNA, 22 nt, Human
auuucuguugcuuauaaauuac

SEQ ID NO: 949770 - RNA, 23 nt, Human
ucucuuucaagagcuuaaugugc

SEQ ID NO: 949771 - RNA, 22 nt, Human
uuuuauuggagugauaccaagc

SEQ ID NO: 949772 - RNA, 22 nt, Human
ugcacacaaaugugaacgugcc

SEQ ID NO: 949773 - RNA, 22 nt, Human
gagcucuggcagggcaggucug

SEQ ID NO: 949774 - RNA, 22 nt, Human
auucuucauuuacuguuacuug

SEQ ID NO: 949775 - RNA, 22 nt, Human
gcacagggccuggcacauaaga

SEQ ID NO: 949776 - RNA, 22 nt, Human
aggagccaggaaaccugcucug

SEQ ID NO: 949777 - RNA, 22 nt, Human
ucugucuccugccagugccucu

SEQ ID NO: 949778 - RNA, 22 nt, Human
uccuucagugucccgcucaggu

SEQ ID NO: 949779 - RNA, 21 nt, Human
aggagggcacaaggccaggaa

SEQ ID NO: 949780 - RNA, 22 nt, Human
gaggggaaaguucugcacaagg

SEQ ID NO: 949781 - RNA, 22 nt, Human
gagcaggcauucuaguggcuga

SEQ ID NO: 949782 - RNA, 22 nt, Human
acacugaauaauugagaguuga

SEQ ID NO: 949783 - RNA, 22 nt, Human
cagagcagaagcgguccucaca

SEQ ID NO: 949784 - RNA, 22 nt, Human
ccuggccaggcuccaaguacug

SEQ ID NO: 949785 - RNA, 22 nt, Human
agccaggaagaaggucacacca

SEQ ID NO: 949786 - RNA, 22 nt, Human
ucagcugaaguggagaagcaga

SEQ ID NO: 949787 - RNA, 22 nt, Human
acagggcagagugaaaugcuau

SEQ ID NO: 949788 - RNA, 22 nt, Human
gcaggccuccccugcuggagcu

SEQ ID NO: 949789 - RNA, 22 nt, Human
ugcuguuauacuuagcugguua

SEQ ID NO: 949790 - RNA, 22 nt, Human
ccagcucucugcagaaaggacu

SEQ ID NO: 949791 - RNA, 22 nt, Human
cugcuucuaagaaccugcagcu

SEQ ID NO: 949792 - RNA, 22 nt, Human
cuguuaaucugcuugcaugaug

SEQ ID NO: 949793 - RNA, 22 nt, Human
ugccuuggugcuucuucaugug

SEQ ID NO: 949794 - RNA, 22 nt, Human
ggaggcugcugccucacguggg

SEQ ID NO: 949795 - RNA, 22 nt, Human
guacacauuaugcuucucuaaa

SEQ ID NO: 949796 - RNA, 22 nt, Human
augugcaacuucagcagaaagg

SEQ ID NO: 949797 - RNA, 22 nt, Human
uauaucaccaaaaacaguucug

SEQ ID NO: 949798 - RNA, 22 nt, Human
uuggcagcauccaagucucggg

SEQ ID NO: 949799 - RNA, 22 nt, Human
gagcacugauuuauuuuugucu

SEQ ID NO: 949800 - RNA, 22 nt, Human
ugacaguuaagguauacauuca

SEQ ID NO: 949801 - RNA, 22 nt, Human
cucugugcucccaugcuaguaa

SEQ ID NO: 949802 - RNA, 22 nt, Human
gugucaugggagucagaaguga

SEQ ID NO: 949803 - RNA, 22 nt, Human
ugggaguguucuuggcuugcuu

SEQ ID NO: 949804 - RNA, 22 nt, Human
uagaaaugauuuugaugcuuca

SEQ ID NO: 949805 - RNA, 19 nt, Human
ucucuggggacacuuucac

SEQ ID NO: 949806 - RNA, 22 nt, Human
gaggccagcuaguccaggaagu

SEQ ID NO: 949807 - RNA, 22 nt, Human
ccugucuguauugguuugcuau

SEQ ID NO: 949808 - RNA, 23 nt, Human
uaauucacauauacauugcuuca

SEQ ID NO: 949809 - RNA, 22 nt, Human
gcucaggacccaggugugaccu

SEQ ID NO: 949810 - RNA, 22 nt, Human
agugaguggguuacagauggga

SEQ ID NO: 949811 - RNA, 19 nt, Human
gcacugaagaguuggucac

SEQ ID NO: 949812 - RNA, 22 nt, Human
caaaugaagaaccuucucaccu

SEQ ID NO: 949813 - RNA, 22 nt, Human
uuugaacugauaaucuucuguu

SEQ ID NO: 949814 - RNA, 22 nt, Human
aggagaaggaagugcaucacua

SEQ ID NO: 949815 - RNA, 22 nt, Human
gcaaaacagucgaugccuccca

SEQ ID NO: 949816 - RNA, 22 nt, Human
ucagucucuggggcuucuguuu

SEQ ID NO: 949817 - RNA, 22 nt, Human
acuuucucccacccacccgucu

SEQ ID NO: 949818 - RNA, 22 nt, Human
ugaaagguuaaaaguaguauug

SEQ ID NO: 949819 - RNA, 22 nt, Human
cauuugaaccuggauguucuua

SEQ ID NO: 949820 - RNA, 18 nt, Human
gggcaucauucacaaagu

SEQ ID NO: 949821 - RNA, 22 nt, Human
aaguucaaguguaaucuuuauu

SEQ ID NO: 949822 - RNA, 22 nt, Human
uuguuauaaagacuaaauaugu

SEQ ID NO: 949823 - RNA, 22 nt, Human
gauuucaaccuaacaguaugac

SEQ ID NO: 949824 - RNA, 22 nt, Human
agcagccaaccuuacauucauc

SEQ ID NO: 949825 - RNA, 22 nt, Human
gaucuucucuuuaguagaaaca

SEQ ID NO: 949826 - RNA, 22 nt, Human
gugucccaaagauuagaaauca

SEQ ID NO: 949827 - RNA, 22 nt, Human
gcagcugaauguccauugcugc

SEQ ID NO: 949828 - RNA, 22 nt, Human
uguaauggaagugggauugcau

SEQ ID NO: 949829 - RNA, 22 nt, Human
ccaaaguccuuucuccaccugc

SEQ ID NO: 949830 - RNA, 22 nt, Human
ucagaaaugaucguuauucauu

SEQ ID NO: 949831 - RNA, 22 nt, Human
agcugaguuaauucaucacuua

SEQ ID NO: 949832 - RNA, 21 nt, Human
gacucugcaccaaauuaagcc

SEQ ID NO: 949833 - RNA, 22 nt, Human
ggcugccuccucgagacaggau

SEQ ID NO: 949834 - RNA, 22 nt, Human
uugauaaaaugauaucuucuuu

SEQ ID NO: 949835 - RNA, 22 nt, Human
uggagcugacucacaccagcua

SEQ ID NO: 949836 - RNA, 22 nt, Human
agggcagagauuaauuaagaca

SEQ ID NO: 949837 - RNA, 22 nt, Human
gcugcccauuccacuggauggu

SEQ ID NO: 949838 - RNA, 22 nt, Human
ucccagggacaccaagcuguuu

SEQ ID NO: 949839 - RNA, 22 nt, Human
uuuuauauggcacauugguugg

SEQ ID NO: 949840 - RNA, 22 nt, Human
ucuggaaguuagaggaggaaag

SEQ ID NO: 949841 - RNA, 22 nt, Human
cuggccacugguggucauaggc

SEQ ID NO: 949842 - RNA, 22 nt, Human
aaucaguuagaaggaagagaau

SEQ ID NO: 949843 - RNA, 22 nt, Human
gauuucuacuugaacuugcuaa

SEQ ID NO: 949844 - RNA, 22 nt, Human
agucucuuuaaucacagugucu

SEQ ID NO: 949845 - RNA, 22 nt, Human
auuaggcagggcaugguggcuc

SEQ ID NO: 949846 - RNA, 22 nt, Human
uuugaaucugauauggcagcau

SEQ ID NO: 949847 - RNA, 22 nt, Human
gcuugggacuggagaauagggu

SEQ ID NO: 949848 - RNA, 19 nt, Human
ggcagaagguguaggggga

SEQ ID NO: 949849 - RNA, 22 nt, Human
uggcucagcgcggccuggucuu

SEQ ID NO: 949850 - RNA, 22 nt, Human
guguccacggcugagaaugauu

SEQ ID NO: 949851 - RNA, 22 nt, Human
gacagaggcaagaccagaagcc

SEQ ID NO: 949852 - RNA, 22 nt, Human
ucugggagauccaagcagaacu

SEQ ID NO: 949853 - RNA, 22 nt, Human
aagcugccaaugguaagcugcu

SEQ ID NO: 949854 - RNA, 17 nt, Human
ucccaggaacagggaau

SEQ ID NO: 949855 - RNA, 22 nt, Human
gcucuguguccacagcuggaaa

SEQ ID NO: 949856 - RNA, 22 nt, Human
aaaugcauaucaaagacuugaa

SEQ ID NO: 949857 - RNA, 22 nt, Human
ggagccuugggcgcucucccau

SEQ ID NO: 949858 - RNA, 22 nt, Human
aauguauaaaguguuaauaacu

SEQ ID NO: 949859 - RNA, 22 nt, Human
gagaggcugacuggcuguccug

SEQ ID NO: 949860 - RNA, 22 nt, Human
uugaaaggccuguuuauccagc

SEQ ID NO: 949861 - RNA, 22 nt, Human
uuguuacaucuuauguaagugg

SEQ ID NO: 949862 - RNA, 22 nt, Human
uguuucuagagaaaauauuuac

SEQ ID NO: 949863 - RNA, 22 nt, Human
caaaauguucuggcaccuuuaa

SEQ ID NO: 949864 - RNA, 22 nt, Human
gucaucuugcuguuuuagaucu

SEQ ID NO: 949865 - RNA, 20 nt, Human
cagaggcauuuucagacucu

SEQ ID NO: 949866 - RNA, 20 nt, Human
guauuagguguuccucuuuc

SEQ ID NO: 949867 - RNA, 22 nt, Human
gcugagugagguccagagcuug

SEQ ID NO: 949868 - RNA, 22 nt, Human
aacuuucaggcaaugaauauuu

SEQ ID NO: 949869 - RNA, 22 nt, Human
cugcugggcuccucaugugacu

SEQ ID NO: 949870 - RNA, 22 nt, Human
aaacucuggagauguuuaugca

SEQ ID NO: 949871 - RNA, 22 nt, Human
ucagagugcagggaguagcagc

SEQ ID NO: 949872 - RNA, 22 nt, Human
cagaggcccagugagagggcug

SEQ ID NO: 949873 - RNA, 22 nt, Human
uugcacuccagcccgagcaaca

SEQ ID NO: 949874 - RNA, 22 nt, Human
gcuacugauugaccuuggagag

SEQ ID NO: 949875 - RNA, 22 nt, Human
guggcugggcuccgagcggcuu

SEQ ID NO: 949876 - RNA, 22 nt, Human
gcuggccuucugcagaguucug

SEQ ID NO: 949877 - RNA, 22 nt, Human
uuuaaauucugucugccgcuua

SEQ ID NO: 949878 - RNA, 22 nt, Human
uccagaguacggaagagucauc

SEQ ID NO: 949879 - RNA, 22 nt, Human
agaggccagggacacugcucaa

SEQ ID NO: 949880 - RNA, 22 nt, Human
gagccagguuggaggcugcagu

SEQ ID NO: 949881 - RNA, 20 nt, Human
uucaggauucuagaccacac

SEQ ID NO: 949882 - RNA, 22 nt, Human
ucucccacagccgugcuucaag

SEQ ID NO: 949883 - RNA, 22 nt, Human
aacuuugucuuuuaugcuuaca

SEQ ID NO: 949884 - RNA, 22 nt, Human
uuauuucuugucuauguagcca

SEQ ID NO: 949885 - RNA, 22 nt, Human
uccuucaguuaaagaucucaca

SEQ ID NO: 949886 - RNA, 22 nt, Human
ucuggccaacaaaaacuaaguc

SEQ ID NO: 949887 - RNA, 22 nt, Human
cccagguggguuggccucuguc

SEQ ID NO: 949888 - RNA, 22 nt, Human
ggcgcuggccacgguggcucug

SEQ ID NO: 949889 - RNA, 22 nt, Human
ucagaacagaagaaggaacacg

SEQ ID NO: 949890 - RNA, 22 nt, Human
ccuggggcucaagauggcgccg

SEQ ID NO: 949891 - RNA, 22 nt, Human
ccucacuuuccuuucuccuggg

SEQ ID NO: 949892 - RNA, 22 nt, Human
cagcuggcagcccuggcccugc

SEQ ID NO: 949893 - RNA, 22 nt, Human
cagaagcacuaggaggaaacgu

SEQ ID NO: 949894 - RNA, 22 nt, Human
caggcuugcugcuagagcacuu

SEQ ID NO: 949895 - RNA, 22 nt, Human
acagagaugcaaguguguauuu

SEQ ID NO: 949896 - RNA, 21 nt, Human
ugggggagaauugguugcuuu

SEQ ID NO: 949897 - RNA, 22 nt, Human
uaagucauaagucaugauguua

SEQ ID NO: 949898 - RNA, 22 nt, Human
cugcagggcccgccugagcccu

SEQ ID NO: 949899 - RNA, 22 nt, Human
uugucccaggacuugcauagau

SEQ ID NO: 949900 - RNA, 22 nt, Human
uggccaaaguagaaaauaauag

SEQ ID NO: 949901 - RNA, 22 nt, Human
ccccagccagcaggaccucuga

SEQ ID NO: 949902 - RNA, 22 nt, Human
uauuucagcccuacuacuuggc

SEQ ID NO: 949903 - RNA, 22 nt, Human
uugauacauagcacaguuuagg

SEQ ID NO: 949904 - RNA, 22 nt, Human
ccccaggaagccucagauuugc

SEQ ID NO: 949905 - RNA, 22 nt, Human
acucuugucucaacuuuuguau

SEQ ID NO: 949906 - RNA, 22 nt, Human
agggaauccaucuaucuucauu

SEQ ID NO: 949907 - RNA, 22 nt, Human
uuuggaauauuaaaaugucuca

SEQ ID NO: 949908 - RNA, 22 nt, Human
caaauaucuuuggcaaagagaa

SEQ ID NO: 949909 - RNA, 22 nt, Human
uaagacauuugaaaugugaucc

SEQ ID NO: 949910 - RNA, 22 nt, Human
acucugcucuuuggacaaugcc

SEQ ID NO: 949911 - RNA, 19 nt, Human
ccuggguccacucagacua

SEQ ID NO: 949912 - RNA, 22 nt, Human
agccuggagaggcgccauacac

SEQ ID NO: 949913 - RNA, 22 nt, Human
aguuauucauuuauucuguaca

SEQ ID NO: 949914 - RNA, 22 nt, Human
ucauuguuucugcuuuucauga

SEQ ID NO: 949915 - RNA, 22 nt, Human
aaucuucacagagaaaauuagg

SEQ ID NO: 949916 - RNA, 22 nt, Human
uauucacaguugauuuacaguu

SEQ ID NO: 949917 - RNA, 22 nt, Human
gcugucugucuucacaucucgc

SEQ ID NO: 949918 - RNA, 22 nt, Human
ccagggcaugggaagaacugaa

SEQ ID NO: 949919 - RNA, 22 nt, Human
aagggcuggaucucucugagca

SEQ ID NO: 949920 - RNA, 22 nt, Human
uuggcaucaguguaggaccugu

SEQ ID NO: 949921 - RNA, 22 nt, Human
gagggaaggacccauuuuaagu

SEQ ID NO: 949922 - RNA, 20 nt, Human
caggagggacauuucagcau

SEQ ID NO: 949923 - RNA, 22 nt, Human
gccagcaguauguccuggcagu

SEQ ID NO: 949924 - RNA, 21 nt, Human
ucccucagaagcucuugguca

SEQ ID NO: 949925 - RNA, 22 nt, Human
uuucuauaaaaagugcuaggau

SEQ ID NO: 949926 - RNA, 22 nt, Human
uguauuuugugaggaucacucu

SEQ ID NO: 949927 - RNA, 22 nt, Human
agucuccuuggccucaaugccu

SEQ ID NO: 949928 - RNA, 22 nt, Human
auguuuuauauuuugcagcagu

SEQ ID NO: 949929 - RNA, 22 nt, Human
caguggaggcucaagugugcuu

SEQ ID NO: 949930 - RNA, 22 nt, Human
ccuuuuauaaaguuguauugaa

SEQ ID NO: 949931 - RNA, 19 nt, Human
gggcucuggccucaguggg

SEQ ID NO: 949932 - RNA, 22 nt, Human
gcuguucagaugcgauucagga

SEQ ID NO: 949933 - RNA, 23 nt, Human
cccuggagcuagucugagcagag

SEQ ID NO: 949934 - RNA, 22 nt, Human
aauuuagaauucgcuagcuaau

SEQ ID NO: 949935 - RNA, 22 nt, Human
aggccuuuguggagcucauggc

SEQ ID NO: 949936 - RNA, 22 nt, Human
gcagcccaaaaaagagguagau

SEQ ID NO: 949937 - RNA, 22 nt, Human
ucucugguuauuaacuaacucc

SEQ ID NO: 949938 - RNA, 22 nt, Human
ucccaggguccucuucuggaau

SEQ ID NO: 949939 - RNA, 22 nt, Human
acaugcauacaagcacauguag

SEQ ID NO: 949940 - RNA, 22 nt, Human
ugcauuaucuuuaauguucuca

SEQ ID NO: 949941 - RNA, 22 nt, Human
aaaaguucccugguuagaaaag

SEQ ID NO: 949942 - RNA, 22 nt, Human
gcccacacaccagcucaggagg

SEQ ID NO: 949943 - RNA, 22 nt, Human
cugggcuggcgcauccgacacg

SEQ ID NO: 949944 - RNA, 22 nt, Human
uugaaaacuuucuagaccaaga

SEQ ID NO: 949945 - RNA, 22 nt, Human
agaaauguggaucguuuuaaaa

SEQ ID NO: 949946 - RNA, 22 nt, Human
agccccaguaagggagggccug

SEQ ID NO: 949947 - RNA, 22 nt, Human
gcccagcagcugguggagaagg

SEQ ID NO: 949948 - RNA, 22 nt, Human
uuuccucauuuaucugcuggga

SEQ ID NO: 949949 - RNA, 22 nt, Human
cagggcaguuugugccuaugag

SEQ ID NO: 949950 - RNA, 19 nt, Human
cugcugggugcugagggag

SEQ ID NO: 949951 - RNA, 22 nt, Human
gcaggaugggagcuucacuuug

SEQ ID NO: 949952 - RNA, 22 nt, Human
acacaggagauauguaauggcu

SEQ ID NO: 949953 - RNA, 22 nt, Human
agcugcaguaaagcucuccagg

SEQ ID NO: 949954 - RNA, 22 nt, Human
ggaggggauuuaguagaugcua

SEQ ID NO: 949955 - RNA, 22 nt, Human
auaugaagaauuccaauuugga

SEQ ID NO: 949956 - RNA, 22 nt, Human
aauaguguuguucacucaggag

SEQ ID NO: 949957 - RNA, 22 nt, Human
cccuggaguccggagcucaccu

SEQ ID NO: 949958 - RNA, 22 nt, Human
gcucaggaaggcucaaccagga

SEQ ID NO: 949959 - RNA, 22 nt, Human
gugcagagaaaugagaagucga

SEQ ID NO: 949960 - RNA, 22 nt, Human
ccagaggugcugggagaggucu

SEQ ID NO: 949961 - RNA, 22 nt, Human
ugagcuucaaaauaugugaauc

SEQ ID NO: 949962 - RNA, 22 nt, Human
gcugccuuuugcuccucccacc

SEQ ID NO: 949963 - RNA, 22 nt, Human
cugagccuuauucaccagcccu

SEQ ID NO: 949964 - RNA, 22 nt, Human
ucucuggccgagagucccuggg

SEQ ID NO: 949965 - RNA, 22 nt, Human
ucccaggauguuggcggcaggu

SEQ ID NO: 949966 - RNA, 22 nt, Human
cacucaggcugugucaggagga

SEQ ID NO: 949967 - RNA, 23 nt, Human
agccuucaggcaaugucaguaga

SEQ ID NO: 949968 - RNA, 22 nt, Human
guacauguugguuguuuccagu

SEQ ID NO: 949969 - RNA, 22 nt, Human
cugcuguguuggcauuggauag

SEQ ID NO: 949970 - RNA, 22 nt, Human
ccuuccuggagcccaugcagau

SEQ ID NO: 949971 - RNA, 22 nt, Human
agggagcaugggugaagcaggc

SEQ ID NO: 949972 - RNA, 22 nt, Human
acagguggaggcuuuaggaggu

SEQ ID NO: 949973 - RNA, 22 nt, Human
augcaguaaauguuaagaaaaa

SEQ ID NO: 949974 - RNA, 22 nt, Human
gggugacauuucccaaugagcc

SEQ ID NO: 949975 - RNA, 22 nt, Human
gagagucacugucugcauuucc

SEQ ID NO: 949976 - RNA, 22 nt, Human
uagccgcuuaauuauuugguga

SEQ ID NO: 949977 - RNA, 22 nt, Human
uggaaagaaaaacaggccauga

SEQ ID NO: 949978 - RNA, 22 nt, Human
gccuaggaguggggauggcggu

SEQ ID NO: 949979 - RNA, 22 nt, Human
cagcugccugucuggaggcaau

SEQ ID NO: 949980 - RNA, 22 nt, Human
ccacacugaaccucagugucuu

SEQ ID NO: 949981 - RNA, 22 nt, Human
auuguuuuccaaagaugcugcu

SEQ ID NO: 949982 - RNA, 22 nt, Human
uuugcacuagcauuuguccaug

SEQ ID NO: 949983 - RNA, 22 nt, Human
acaggugaccugcucauaugaa

SEQ ID NO: 949984 - RNA, 22 nt, Human
ugcugccaccugguggcugaag

SEQ ID NO: 949985 - RNA, 22 nt, Human
uccaagggcaugcugaaauaag

SEQ ID NO: 949986 - RNA, 22 nt, Human
gcagauggcugagccugcagau

SEQ ID NO: 949987 - RNA, 20 nt, Human
aauaaaagaagccuucaccc

SEQ ID NO: 949988 - RNA, 22 nt, Human
ccugaagcaaggguaggcaggu

SEQ ID NO: 949989 - RNA, 22 nt, Human
ccagucccgcaugguccagaau

SEQ ID NO: 949990 - RNA, 22 nt, Human
aagaauuauugcaauacuagau

SEQ ID NO: 949991 - RNA, 19 nt, Human
cuguggcugaccucuggcc

SEQ ID NO: 949992 - RNA, 22 nt, Human
uggagggaacccaggcugcucu

SEQ ID NO: 949993 - RNA, 22 nt, Human
gcagcguggggcugagucagcu

SEQ ID NO: 949994 - RNA, 22 nt, Human
gcucccaccaggcagaccuacc

SEQ ID NO: 949995 - RNA, 22 nt, Human
gcagcugccgugagcucacgcc

SEQ ID NO: 949996 - RNA, 22 nt, Human
auuacacacucaaguccuguua

SEQ ID NO: 949997 - RNA, 22 nt, Human
uuucuaguccucaugcaucauu

SEQ ID NO: 949998 - RNA, 22 nt, Human
augauguuauuuucagaaacau

SEQ ID NO: 949999 - RNA, 20 nt, Human
aagauucauuguaauuaggg

SEQ ID NO: 950000 - RNA, 22 nt, Human
cuguauuucccacauucucuau

SEQ ID NO: 950001 - RNA, 22 nt, Human
aagacaauuugauacuaguugc

SEQ ID NO: 950002 - RNA, 22 nt, Human
cucuuaaauaacaucauugcuu

SEQ ID NO: 950003 - RNA, 22 nt, Human
cuccuggcacugucuugaccca

SEQ ID NO: 950004 - RNA, 22 nt, Human
ggccugcuccgggggcugagcu

SEQ ID NO: 950005 - RNA, 22 nt, Human
ugcugaaagucccaaaucucau

SEQ ID NO: 950006 - RNA, 22 nt, Human
uauugaaauccauuacguucuu

SEQ ID NO: 950007 - RNA, 22 nt, Human
uagggcagccacccaggcugcu

SEQ ID NO: 950008 - RNA, 22 nt, Human
agaaugcuccagagcugaaaga

SEQ ID NO: 950009 - RNA, 21 nt, Human
gcucucugcaugguggcucag

SEQ ID NO: 950010 - RNA, 22 nt, Human
caggaacaauguaagucucauu

SEQ ID NO: 950011 - RNA, 18 nt, Human
ucugcugcugcguccugc

SEQ ID NO: 950012 - RNA, 22 nt, Human
uauuuuaaagugaagggucuug

SEQ ID NO: 950013 - RNA, 22 nt, Human
gggacaggccccucgcuagcuu

SEQ ID NO: 950014 - RNA, 22 nt, Human
uuuaacacuaguuucuuuaacu

SEQ ID NO: 950015 - RNA, 22 nt, Human
cacaggcugcccgcagcuggga

SEQ ID NO: 950016 - RNA, 22 nt, Human
uauguacacauacacuuguaau

SEQ ID NO: 950017 - RNA, 19 nt, Human
gcuuuggagggagguucua

SEQ ID NO: 950018 - RNA, 22 nt, Human
ugcagccuugccuccucccagc

SEQ ID NO: 950019 - RNA, 22 nt, Human
gugaggggaguaaagccauguu

SEQ ID NO: 950020 - RNA, 18 nt, Human
ugcuggcaacuacuauug

SEQ ID NO: 950021 - RNA, 22 nt, Human
ggccugaggcgucccagcugug

SEQ ID NO: 950022 - RNA, 22 nt, Human
gggcagcuccuguggaauccac

SEQ ID NO: 950023 - RNA, 22 nt, Human
cucugggcacauuuuccaggac

SEQ ID NO: 950024 - RNA, 21 nt, Human
uggaccaaaguaauuugccuu

SEQ ID NO: 950025 - RNA, 22 nt, Human
aaagaauacccugggucauaaa

SEQ ID NO: 950026 - RNA, 22 nt, Human
ugaaggugucuuugugaacauc

SEQ ID NO: 950027 - RNA, 22 nt, Human
ugggcuggcguggagaguuuag

SEQ ID NO: 950028 - RNA, 22 nt, Human
gccuaauaacuagcuguguaac

SEQ ID NO: 950029 - RNA, 22 nt, Human
gucagugucuuaacagagauua

SEQ ID NO: 950030 - RNA, 22 nt, Human
cagucccuaguggagcucacag

SEQ ID NO: 950031 - RNA, 22 nt, Human
gaguccaguuguucacagaggc

SEQ ID NO: 950032 - RNA, 22 nt, Human
cccuggaggagcuuagagcuug

SEQ ID NO: 950033 - RNA, 22 nt, Human
cccaggcuggagugcaauggug

SEQ ID NO: 950034 - RNA, 22 nt, Human
cugggcagugguggcccuuccc

SEQ ID NO: 950035 - RNA, 22 nt, Human
uggaggagggcuggugucugua

SEQ ID NO: 950036 - RNA, 22 nt, Human
ugagcccaggaguaugaggcug

SEQ ID NO: 950037 - RNA, 22 nt, Human
auucaguucuaaggucagugcc

SEQ ID NO: 950038 - RNA, 22 nt, Human
aggcaggcaaccaccugggaag

SEQ ID NO: 950039 - RNA, 22 nt, Human
uuauguacaauguuaauguaaa

SEQ ID NO: 950040 - RNA, 22 nt, Human
uagggaggaggguuuucaaauc

SEQ ID NO: 950041 - RNA, 22 nt, Human
gagcagcuguccccaaagcuuc

SEQ ID NO: 950042 - RNA, 19 nt, Human
ucuuucauuucuagcucug

SEQ ID NO: 950043 - RNA, 22 nt, Human
ucccagggugcgccugcccucg

SEQ ID NO: 950044 - RNA, 22 nt, Human
uggcacugaagcuggaaagccu

SEQ ID NO: 950045 - RNA, 21 nt, Human
uuccuggcggcagaaacguga

SEQ ID NO: 950046 - RNA, 22 nt, Human
ugguaauuuacgcauuucugua

SEQ ID NO: 950047 - RNA, 22 nt, Human
cucuccuugcagauggcugccu

SEQ ID NO: 950048 - RNA, 22 nt, Human
aagcaggcauuccagagacaau

SEQ ID NO: 950049 - RNA, 22 nt, Human
ggcuccugaaagacuaugggaa

SEQ ID NO: 950050 - RNA, 22 nt, Human
auuaucuauguagaaugauuuu

SEQ ID NO: 950051 - RNA, 22 nt, Human
agugcauugcaucucugcuuca

SEQ ID NO: 950052 - RNA, 22 nt, Human
ugcaagaggaauucuagaagca

SEQ ID NO: 950053 - RNA, 22 nt, Human
ccaggagaaugggauuacccua

SEQ ID NO: 950054 - RNA, 22 nt, Human
ucccugggagaugaugaugagg

SEQ ID NO: 950055 - RNA, 22 nt, Human
uucuuaaaacuuauggacaggu

SEQ ID NO: 950056 - RNA, 22 nt, Human
aggcaagcccccagugaggcuc

SEQ ID NO: 950057 - RNA, 22 nt, Human
gggagcugagcuggaagagaau

SEQ ID NO: 950058 - RNA, 22 nt, Human
agagcagugcugaagaguaggg

SEQ ID NO: 950059 - RNA, 18 nt, Human
cauuguacaaugcuuuau

SEQ ID NO: 950060 - RNA, 22 nt, Human
ccuggagauuucuucaagcuuu

SEQ ID NO: 950061 - RNA, 22 nt, Human
cugggaggcggagguuguagug

SEQ ID NO: 950062 - RNA, 19 nt, Human
uguggccaugguucagcug

SEQ ID NO: 950063 - RNA, 22 nt, Human
gaaacugugaggaucuuaacuu

SEQ ID NO: 950064 - RNA, 22 nt, Human
gucucuggguuaagcagugcau

SEQ ID NO: 950065 - RNA, 22 nt, Human
cccuccagcucaaagcaaccgg

SEQ ID NO: 950066 - RNA, 22 nt, Human
ugccuugccacugcucuuaaug

SEQ ID NO: 950067 - RNA, 22 nt, Human
ucaguuuuucuauacuuuguag

SEQ ID NO: 950068 - RNA, 19 nt, Human
aauccaggauaagccccuu

SEQ ID NO: 950069 - RNA, 23 nt, Human
uggccucuccccaccuggcagaa

SEQ ID NO: 950070 - RNA, 22 nt, Human
cccaggaaacccgaaggcgacc

SEQ ID NO: 950071 - RNA, 22 nt, Human
cugccuggcauggagaagagaa

SEQ ID NO: 950072 - RNA, 22 nt, Human
cuacauuuggagaguauaggaa

SEQ ID NO: 950073 - RNA, 22 nt, Human
guggcccugucccaggccuccu

SEQ ID NO: 950074 - RNA, 22 nt, Human
ugaggcagcccacuuuccuuag

SEQ ID NO: 950075 - RNA, 22 nt, Human
ugcucagacaagcugaacagua

SEQ ID NO: 950076 - RNA, 22 nt, Human
uuagccauuuuauacaagugua

SEQ ID NO: 950077 - RNA, 22 nt, Human
ggcagcaguaggagcuaaucuu

SEQ ID NO: 950078 - RNA, 22 nt, Human
cccagagcugagucugauauau

SEQ ID NO: 950079 - RNA, 22 nt, Human
uuuauguaaguggaaugaugcc

SEQ ID NO: 950080 - RNA, 22 nt, Human
uggaaagcgaggaguuggcauu

SEQ ID NO: 950081 - RNA, 22 nt, Human
agcucccaauugacuugaacua

SEQ ID NO: 950082 - RNA, 22 nt, Human
gcucugcuggagggaaagagaa

SEQ ID NO: 950083 - RNA, 22 nt, Human
aagugacacauggcacuucuau

SEQ ID NO: 950084 - RNA, 21 nt, Human
ucagacuugagcucuucuaca

SEQ ID NO: 950085 - RNA, 22 nt, Human
cuccucagacuuuccuuguccg

SEQ ID NO: 950086 - RNA, 22 nt, Human
cuucuuaaagauuacacaauga

SEQ ID NO: 950087 - RNA, 22 nt, Human
uggcucaguagcagugugguca

SEQ ID NO: 950088 - RNA, 22 nt, Human
ugauuuuuagcuauucugaaga

SEQ ID NO: 950089 - RNA, 22 nt, Human
aggggccuggacauggacgcgc

SEQ ID NO: 950090 - RNA, 22 nt, Human
gaggccuggaauuccagccugg

SEQ ID NO: 950091 - RNA, 22 nt, Human
uaagaauuguguugaauagagu

SEQ ID NO: 950092 - RNA, 22 nt, Human
uuugaaauuggcucauugguuu

SEQ ID NO: 950093 - RNA, 22 nt, Human
cucucaggcuugggucguggca

SEQ ID NO: 950094 - RNA, 22 nt, Human
ugcucagggacaauggagaggg

SEQ ID NO: 950095 - RNA, 22 nt, Human
uaagacacaugcguacaagaua

SEQ ID NO: 950096 - RNA, 22 nt, Human
ccaggagcagggcuggcugcac

SEQ ID NO: 950097 - RNA, 22 nt, Human
cagaggcuaagaugagugggug

SEQ ID NO: 950098 - RNA, 22 nt, Human
aggcaguggaugucaggaaugg

SEQ ID NO: 950099 - RNA, 22 nt, Human
agaccaugggcucugaagagca

SEQ ID NO: 950100 - RNA, 22 nt, Human
uggcucaggaucuaagcagaau

SEQ ID NO: 950101 - RNA, 22 nt, Human
ggagccaguuuagaccucaguu

SEQ ID NO: 950102 - RNA, 22 nt, Human
uccagccaagccuugguagcug

SEQ ID NO: 950103 - RNA, 22 nt, Human
gcuggccagugucccagggauc

SEQ ID NO: 950104 - RNA, 22 nt, Human
aaaguguugggauuacaggugu

SEQ ID NO: 950105 - RNA, 22 nt, Human
uuggccaaggaaguagcaacgg

SEQ ID NO: 950106 - RNA, 22 nt, Human
gcucagagcaucccagugaaug

SEQ ID NO: 950107 - RNA, 22 nt, Human
gagagcuggccagcuucaguau

SEQ ID NO: 950108 - RNA, 22 nt, Human
uguguauuaccauuuuacagcu

SEQ ID NO: 950109 - RNA, 22 nt, Human
gggcaguuuauucuagaugguu

SEQ ID NO: 950110 - RNA, 22 nt, Human
auacuguuuugugacuuaucuu

SEQ ID NO: 950111 - RNA, 22 nt, Human
gcacagggagacagccguggcc

SEQ ID NO: 950112 - RNA, 22 nt, Human
cugcccuggcagccuaccaugg

SEQ ID NO: 950113 - RNA, 22 nt, Human
gcuguucauuagaaauagaaug

SEQ ID NO: 950114 - RNA, 22 nt, Human
gcucugagagugggugauucug

SEQ ID NO: 950115 - RNA, 22 nt, Human
cuuccuguugucacagucugcg

SEQ ID NO: 950116 - RNA, 22 nt, Human
auuucaguagaaaaucuugauu

SEQ ID NO: 950117 - RNA, 22 nt, Human
aucugcaggaaugugugcagag

SEQ ID NO: 950118 - RNA, 22 nt, Human
gcuggccucuggagaagggcuu

SEQ ID NO: 950119 - RNA, 22 nt, Human
ucacaggagauuaugugugcua

SEQ ID NO: 950120 - RNA, 22 nt, Human
uuggaggcaaugggaaggaggc

SEQ ID NO: 950121 - RNA, 22 nt, Human
aggcuucccaagcagcugcaaa

SEQ ID NO: 950122 - RNA, 22 nt, Human
aaauuuucagagcacuagagaa

SEQ ID NO: 950123 - RNA, 22 nt, Human
ggccucagaccggagcuggcca

SEQ ID NO: 950124 - RNA, 22 nt, Human
aagagcuggauugugcugcaga

SEQ ID NO: 950125 - RNA, 21 nt, Human
cugguguagcacucaggugcu

SEQ ID NO: 950126 - RNA, 22 nt, Human
aggcuucuacguggucccaggg

SEQ ID NO: 950127 - RNA, 22 nt, Human
cucagagcaaugaacaugcaaa

SEQ ID NO: 950128 - RNA, 22 nt, Human
acagacauuuucuguauugccu

SEQ ID NO: 950129 - RNA, 22 nt, Human
cagggcuggcuguggcaaucuc

SEQ ID NO: 950130 - RNA, 22 nt, Human
ggcucugggucuguggggagcg

SEQ ID NO: 950131 - RNA, 22 nt, Human
gggugggacugaagucugaggg

SEQ ID NO: 950132 - RNA, 22 nt, Human
ugcccaggaucuggcgaugcuc

SEQ ID NO: 950133 - RNA, 22 nt, Human
guucauuuaugauguaacaugu

SEQ ID NO: 950134 - RNA, 20 nt, Human
uugcagcagugaggugaagg

SEQ ID NO: 950135 - RNA, 22 nt, Human
ugaaccagagucuccagugguu

SEQ ID NO: 950136 - RNA, 22 nt, Human
uuugaaugcaggacauacagaa

SEQ ID NO: 950137 - RNA, 22 nt, Human
agcuguguguuuccacugagcu

SEQ ID NO: 950138 - RNA, 22 nt, Human
ugaaaguugcacauaagagaau

SEQ ID NO: 950139 - RNA, 22 nt, Human
acaaaaagcuccauuacugucc

SEQ ID NO: 950140 - RNA, 23 nt, Human
cugcagucgccggccugggugcc

SEQ ID NO: 950141 - RNA, 22 nt, Human
aggcccugggagcagagaugca

SEQ ID NO: 950142 - RNA, 22 nt, Human
gggagggaaggaggcgccgugu

SEQ ID NO: 950143 - RNA, 20 nt, Human
gacauucauaguuauuacca

SEQ ID NO: 950144 - RNA, 22 nt, Human
cuccagggaugagacagaguag

SEQ ID NO: 950145 - RNA, 22 nt, Human
agcugguuagcaaucuaaguga

SEQ ID NO: 950146 - RNA, 22 nt, Human
ggagcuguucaggacugcuuca

SEQ ID NO: 950147 - RNA, 22 nt, Human
cuccagggaaaggggcguccgc

SEQ ID NO: 950148 - RNA, 22 nt, Human
ccccuggguccaggcuucucug

SEQ ID NO: 950149 - RNA, 22 nt, Human
auaacagaguugggaagugaaa

SEQ ID NO: 950150 - RNA, 22 nt, Human
uccuucagucuucugagccaua

SEQ ID NO: 950151 - RNA, 20 nt, Human
aggagccauugacugcagca

SEQ ID NO: 950152 - RNA, 22 nt, Human
cauuucuagggaucauaaagua

SEQ ID NO: 950153 - RNA, 22 nt, Human
ggcccagccggcgagucucgcg

SEQ ID NO: 950154 - RNA, 22 nt, Human
agugcuuucuugcuccaucagu

SEQ ID NO: 950155 - RNA, 22 nt, Human
cagggcaugaggugugcuucuc

SEQ ID NO: 950156 - RNA, 22 nt, Human
uaaaucaguagauaugguauag

SEQ ID NO: 950157 - RNA, 22 nt, Human
aaaguuuuagaacuaggaagca

SEQ ID NO: 950158 - RNA, 22 nt, Human
acccaggacacagagaugaccc

SEQ ID NO: 950159 - RNA, 22 nt, Human
cuggcaaguacugggccagcuc

SEQ ID NO: 950160 - RNA, 22 nt, Human
aacagaaugcaggggaugcugc

SEQ ID NO: 950161 - RNA, 22 nt, Human
cccaggagauggagguugcagu

SEQ ID NO: 950162 - RNA, 22 nt, Human
ucagaacagaagcuggcuauaa

SEQ ID NO: 950163 - RNA, 22 nt, Human
aguaugaagaugaugaaaaaua

SEQ ID NO: 950164 - RNA, 22 nt, Human
ucccagggacucucugccuucc

SEQ ID NO: 950165 - RNA, 22 nt, Human
uuauuuggaaauauggcuucug

SEQ ID NO: 950166 - RNA, 22 nt, Human
uauauuaaacccucucuguagg

SEQ ID NO: 950167 - RNA, 22 nt, Human
gagcucagcacuaaaaucaugu

SEQ ID NO: 950168 - RNA, 22 nt, Human
acacuuuguuguggcauauacg

SEQ ID NO: 950169 - RNA, 22 nt, Human
uagcagagcagggaucagagcc

SEQ ID NO: 950170 - RNA, 22 nt, Human
gaggagagaugguagauugggu

SEQ ID NO: 950171 - RNA, 22 nt, Human
gauuuuauauggcauacugugg

SEQ ID NO: 950172 - RNA, 22 nt, Human
gagcucauucauucauugccug

SEQ ID NO: 950173 - RNA, 22 nt, Human
ccugccugcggcccgcggggag

SEQ ID NO: 950174 - RNA, 22 nt, Human
uagcccagagucccaauuccag

SEQ ID NO: 950175 - RNA, 22 nt, Human
uggaguuccuuugaaaggcucu

SEQ ID NO: 950176 - RNA, 21 nt, Human
uccaggaguggcugggcaggg

SEQ ID NO: 950177 - RNA, 22 nt, Human
cuuccuucugaagcauagaagc

SEQ ID NO: 950178 - RNA, 22 nt, Human
ucagcugcucuguugagcugaa

SEQ ID NO: 950179 - RNA, 20 nt, Human
aaggcacuaugucugcuagc

SEQ ID NO: 950180 - RNA, 22 nt, Human
uuuauguaguuacggacuauca

SEQ ID NO: 950181 - RNA, 22 nt, Human
ugggccugacucaccugccucc

SEQ ID NO: 950182 - RNA, 22 nt, Human
ccuuuuauacucagugauauca

SEQ ID NO: 950183 - RNA, 22 nt, Human
acagcagcuaaaggugucuccu

SEQ ID NO: 950184 - RNA, 22 nt, Human
uugauacaggcucuauuucauc

SEQ ID NO: 950185 - RNA, 22 nt, Human
ggcagaguggagugcggccucc

SEQ ID NO: 950186 - RNA, 22 nt, Human
gcugagcucccagcaguaucug

SEQ ID NO: 950187 - RNA, 22 nt, Human
ccugccagcauggcuuaucucc

SEQ ID NO: 950188 - RNA, 22 nt, Human
aggggcuggcuuaucugagagu

SEQ ID NO: 950189 - RNA, 22 nt, Human
cucuucaauagauuguugaggg

SEQ ID NO: 950190 - RNA, 22 nt, Human
agugaaauggaugcugcuacug

SEQ ID NO: 950191 - RNA, 22 nt, Human
gcagugcuuuagucuguccuuu

SEQ ID NO: 950192 - RNA, 22 nt, Human
ccacccagccagaugcaggaag

SEQ ID NO: 950193 - RNA, 22 nt, Human
cagacuuucaaggagugaaggc

SEQ ID NO: 950194 - RNA, 22 nt, Human
ggcagccauacucagaccuggg

SEQ ID NO: 950195 - RNA, 22 nt, Human
caaaugcaugagaaauaagagg

SEQ ID NO: 950196 - RNA, 22 nt, Human
ugaggcagcaauuguauuguau

SEQ ID NO: 950197 - RNA, 22 nt, Human
aaaaauagcuucucuugucccu

SEQ ID NO: 950198 - RNA, 22 nt, Human
ccaggagagcaaaggucacucu

SEQ ID NO: 950199 - RNA, 22 nt, Human
ucuggcucuguguccccaccca

SEQ ID NO: 950200 - RNA, 22 nt, Human
ucauaauacaaagaguucugca

SEQ ID NO: 950201 - RNA, 22 nt, Human
acauuuguaugcguuuuuacug

SEQ ID NO: 950202 - RNA, 22 nt, Human
ugugcagagcccacaggcagcu

SEQ ID NO: 950203 - RNA, 22 nt, Human
uguacaauagcuauuaucucca

SEQ ID NO: 950204 - RNA, 22 nt, Human
uaugaacuuuugaugugacaug

SEQ ID NO: 950205 - RNA, 22 nt, Human
gcugagggcauguguggcgacu

SEQ ID NO: 950206 - RNA, 22 nt, Human
uuuauagggacaguucuuggag

SEQ ID NO: 950207 - RNA, 22 nt, Human
cuauuaggcuuccauuucaugc

SEQ ID NO: 950208 - RNA, 22 nt, Human
gggacagaaggaagugagcaca

SEQ ID NO: 950209 - RNA, 22 nt, Human
cagcagcuucuguugaucagaa

SEQ ID NO: 950210 - RNA, 22 nt, Human
caucagcaggcaacacucuugg

SEQ ID NO: 950211 - RNA, 22 nt, Human
aagaguuaagcaacagauacca

SEQ ID NO: 950212 - RNA, 22 nt, Human
cugcugugcagacagacucucu

SEQ ID NO: 950213 - RNA, 22 nt, Human
uuuguagaggguaauugacaga

SEQ ID NO: 950214 - RNA, 22 nt, Human
cugggccugucagggcuuuuug

SEQ ID NO: 950215 - RNA, 22 nt, Human
uugaaggacauccuauuucuag

SEQ ID NO: 950216 - RNA, 19 nt, Human
ccaggccaucccaguuccc

SEQ ID NO: 950217 - RNA, 21 nt, Human
ucacaugcccauuacuggagc

SEQ ID NO: 950218 - RNA, 22 nt, Human
uguaguaagugcgcaauaaaua

SEQ ID NO: 950219 - RNA, 22 nt, Human
ucugaggcuucagacuguacug

SEQ ID NO: 950220 - RNA, 22 nt, Human
uaugcacacauguaugcaugug

SEQ ID NO: 950221 - RNA, 22 nt, Human
uucaacuauuaugaauaaaauu

SEQ ID NO: 950222 - RNA, 22 nt, Human
aaggcagcaacuaauggaucuc

SEQ ID NO: 950223 - RNA, 22 nt, Human
uccuucagcuacucaguuucca

SEQ ID NO: 950224 - RNA, 22 nt, Human
ggcugagcaauuuugaugacau

SEQ ID NO: 950225 - RNA, 22 nt, Human
cucuucuugcuagacugagugc

SEQ ID NO: 950226 - RNA, 17 nt, Human
ucuuuccugccaugcuc

SEQ ID NO: 950227 - RNA, 22 nt, Human
aucaguuucacuugcuugcaaa

SEQ ID NO: 950228 - RNA, 22 nt, Human
gcagcugagagaagaacagggc

SEQ ID NO: 950229 - RNA, 22 nt, Human
uugugucuggaaugcguggagc

SEQ ID NO: 950230 - RNA, 22 nt, Human
agggagcucaguuggaagcggu

SEQ ID NO: 950231 - RNA, 22 nt, Human
ucacaugaguauuauuuuccaa

SEQ ID NO: 950232 - RNA, 22 nt, Human
gugcgccagcucaaggggaggc

SEQ ID NO: 950233 - RNA, 22 nt, Human
ccuggcagguggcgcccucggc

SEQ ID NO: 950234 - RNA, 22 nt, Human
ucugguuagccaauaaugccaa

SEQ ID NO: 950235 - RNA, 22 nt, Human
gcucuuccauuucucuugaacu

SEQ ID NO: 950236 - RNA, 22 nt, Human
uuaauaggcuucuaacauagcu

SEQ ID NO: 950237 - RNA, 20 nt, Human
uucuggaggcuacaagucug

SEQ ID NO: 950238 - RNA, 22 nt, Human
uaaaagacccucuagaguccca

SEQ ID NO: 950239 - RNA, 22 nt, Human
caagaugugccuaaucagaccu

SEQ ID NO: 950240 - RNA, 22 nt, Human
uuugcauuacuugacuuuaguu

SEQ ID NO: 950241 - RNA, 22 nt, Human
aagggaggaggauuuauuguac

SEQ ID NO: 950242 - RNA, 21 nt, Human
caugcaggauuuaaccuagaa

SEQ ID NO: 950243 - RNA, 22 nt, Human
gauuuuaauuauaggagguccu

SEQ ID NO: 950244 - RNA, 22 nt, Human
gagggcuccucacauucucuau

SEQ ID NO: 950245 - RNA, 22 nt, Human
uuucaguggguuuauuucaugu

SEQ ID NO: 950246 - RNA, 22 nt, Human
ggagccagaggcugcugcugug

SEQ ID NO: 950247 - RNA, 22 nt, Human
ugcauuguugaccaguugugca

SEQ ID NO: 950248 - RNA, 22 nt, Human
uuuccuucaucaucugagagcu

SEQ ID NO: 950249 - RNA, 22 nt, Human
aggcagaugggagcuggaaguu

SEQ ID NO: 950250 - RNA, 22 nt, Human
aagccucaccuuuuagaagcua

SEQ ID NO: 950251 - RNA, 22 nt, Human
cagggcagugaagaacacacgu

SEQ ID NO: 950252 - RNA, 22 nt, Human
ucugacauuuugagaaugacau

SEQ ID NO: 950253 - RNA, 22 nt, Human
cuaauguggacucuaucaaagu

SEQ ID NO: 950254 - RNA, 22 nt, Human
cacaaaaguaggaggcaggcgg

SEQ ID NO: 950255 - RNA, 22 nt, Human
uggccuggggaagaccaugggc

SEQ ID NO: 950256 - RNA, 22 nt, Human
guccaggaaucaaaagauggaa

SEQ ID NO: 950257 - RNA, 22 nt, Human
acagaaauauucguggugcuug

SEQ ID NO: 950258 - RNA, 19 nt, Human
aauguaguguuaugucaac

SEQ ID NO: 950259 - RNA, 22 nt, Human
aggucccaggcauagcuggucu

SEQ ID NO: 950260 - RNA, 22 nt, Human
ggcugcugggaauaugccagcu

SEQ ID NO: 950261 - RNA, 17 nt, Human
gcacugaacaauccugu

SEQ ID NO: 950262 - RNA, 22 nt, Human
caggcugccgugaagcaggccu

SEQ ID NO: 950263 - RNA, 22 nt, Human
agccaagcacucaacuccugga

SEQ ID NO: 950264 - RNA, 22 nt, Human
cagacaggcaggugcugcuuug

SEQ ID NO: 950265 - RNA, 21 nt, Human
uggcucugaaagagugcugca

SEQ ID NO: 950266 - RNA, 19 nt, Human
cacagggcaggucucaugu

SEQ ID NO: 950267 - RNA, 22 nt, Human
gagaaguuucugguuugcauag

SEQ ID NO: 950268 - RNA, 22 nt, Human
uucaagaucgaguuuaaaguga

SEQ ID NO: 950269 - RNA, 20 nt, Human
uggcccaguggggcagggug

SEQ ID NO: 950270 - RNA, 21 nt, Human
uuuuauugaugaauggccacu

SEQ ID NO: 950271 - RNA, 22 nt, Human
cagggcugugcccaucuucccc

SEQ ID NO: 950272 - RNA, 22 nt, Human
cagaaagaccugggcucaagag

SEQ ID NO: 950273 - RNA, 22 nt, Human
aggugccaauuuucagugaaca

SEQ ID NO: 950274 - RNA, 22 nt, Human
gcaaugauauugaagugaugaa

SEQ ID NO: 950275 - RNA, 22 nt, Human
uauauuaaccauaggguucuag

SEQ ID NO: 950276 - RNA, 22 nt, Human
cuguuuauacgacagguggagg

SEQ ID NO: 950277 - RNA, 22 nt, Human
uccagcagggaauuaguagucu

SEQ ID NO: 950278 - RNA, 22 nt, Human
cagaggccucacuuccagccag

SEQ ID NO: 950279 - RNA, 22 nt, Human
gcagagcuguuaauggagcuga

SEQ ID NO: 950280 - RNA, 22 nt, Human
aacuacuaccacagucaagaca

SEQ ID NO: 950281 - RNA, 22 nt, Human
gagauuucuuuugaugccuguc

SEQ ID NO: 950282 - RNA, 22 nt, Human
gcucaggaaaacagucuaguaa

SEQ ID NO: 950283 - RNA, 20 nt, Human
ucacauccucucccaacaug

SEQ ID NO: 950284 - RNA, 22 nt, Human
aaaaugugcaguuuuuaagcug

SEQ ID NO: 950285 - RNA, 17 nt, Human
agcagcugaagcagcca

SEQ ID NO: 950286 - RNA, 22 nt, Human
cagugauguuucugcaucagag

SEQ ID NO: 950287 - RNA, 22 nt, Human
aguuggagugaacaugagauug

SEQ ID NO: 950288 - RNA, 22 nt, Human
cuggcaggcagacuucugcaag

SEQ ID NO: 950289 - RNA, 22 nt, Human
gggagggaaagcuugaucuguc

SEQ ID NO: 950290 - RNA, 22 nt, Human
acccagcuggaugcauggaggc

SEQ ID NO: 950291 - RNA, 17 nt, Human
agugacuuggaaagagc

SEQ ID NO: 950292 - RNA, 22 nt, Human
uaauguguccugaaagcuucug

SEQ ID NO: 950293 - RNA, 22 nt, Human
guaucuuuccacaucuucagua

SEQ ID NO: 950294 - RNA, 19 nt, Human
agccuggagggcuggucac

SEQ ID NO: 950295 - RNA, 22 nt, Human
aaugcacaugucuuggccucac

SEQ ID NO: 950296 - RNA, 22 nt, Human
uucuuuccccauggaguucgga

SEQ ID NO: 950297 - RNA, 22 nt, Human
acucugcugucugauggcagga

SEQ ID NO: 950298 - RNA, 22 nt, Human
cccaggcucccaggugggacaa

SEQ ID NO: 950299 - RNA, 21 nt, Human
ugggcagauggcaguguggcu

SEQ ID NO: 950300 - RNA, 22 nt, Human
ccugccuggcuuccagaagaga

SEQ ID NO: 950301 - RNA, 22 nt, Human
ccugagagcauuccacacugaa

SEQ ID NO: 950302 - RNA, 22 nt, Human
uugcauuugagaaaguucuccu

SEQ ID NO: 950303 - RNA, 22 nt, Human
cagccugcuagggcaaugccuu

SEQ ID NO: 950304 - RNA, 22 nt, Human
aaggucauuuuuuccucuguug

SEQ ID NO: 950305 - RNA, 22 nt, Human
caggcagcgcucguggccuggc

SEQ ID NO: 950306 - RNA, 22 nt, Human
uacauugugauguuucaauaca

SEQ ID NO: 950307 - RNA, 22 nt, Human
acugccauuggucaaaugagug

SEQ ID NO: 950308 - RNA, 22 nt, Human
cugcccugagucaugccagaug

SEQ ID NO: 950309 - RNA, 22 nt, Human
uucuuauucuugaaauguggga

SEQ ID NO: 950310 - RNA, 21 nt, Human
accaggcuugugggagggagc

SEQ ID NO: 950311 - RNA, 22 nt, Human
ugagcugggcugggcugagcug

SEQ ID NO: 950312 - RNA, 22 nt, Human
agcaggcuaagggaccuguuua

SEQ ID NO: 950313 - RNA, 22 nt, Human
cggcagcuccgcgccguaggac

SEQ ID NO: 950314 - RNA, 22 nt, Human
aauguucagaggacaauauaaa

SEQ ID NO: 950315 - RNA, 22 nt, Human
gcccaggaaguugaggcugccg

SEQ ID NO: 950316 - RNA, 21 nt, Human
acagcaagccuuccuuucagg

SEQ ID NO: 950317 - RNA, 22 nt, Human
uguccugcaacugaaggagaag

SEQ ID NO: 950318 - RNA, 22 nt, Human
cccaggaaugagcaggcagggg

SEQ ID NO: 950319 - RNA, 22 nt, Human
ggaggggccggcugccugccac

SEQ ID NO: 950320 - RNA, 22 nt, Human
cagacagaaggcuccuugaggu

SEQ ID NO: 950321 - RNA, 22 nt, Human
uuuccuaagguagugauaauuu

SEQ ID NO: 950322 - RNA, 22 nt, Human
cacugcuuuuuuggcuauguac

SEQ ID NO: 950323 - RNA, 22 nt, Human
aagggcugagcacagugagcca

SEQ ID NO: 950324 - RNA, 22 nt, Human
aguacagaccugucucuuccug

SEQ ID NO: 950325 - RNA, 22 nt, Human
aaguucaaucagaugaaaaagc

SEQ ID NO: 950326 - RNA, 22 nt, Human
uggccugaauuauggcagaucu

SEQ ID NO: 950327 - RNA, 22 nt, Human
ugggaggcagguaggugaugau

SEQ ID NO: 950328 - RNA, 22 nt, Human
guggcucuaggugagcauggag

SEQ ID NO: 950329 - RNA, 22 nt, Human
ccagccucaucgccugccuguc

SEQ ID NO: 950330 - RNA, 22 nt, Human
uaggaugagggguggccaagua

SEQ ID NO: 950331 - RNA, 22 nt, Human
cacugccuccccaggcuccaca

SEQ ID NO: 950332 - RNA, 22 nt, Human
gagccagcuauguagcaagagg

SEQ ID NO: 950333 - RNA, 22 nt, Human
acacugcucacuucuucccuug

SEQ ID NO: 950334 - RNA, 21 nt, Human
acauccaggguccucacugcc

SEQ ID NO: 950335 - RNA, 19 nt, Human
aggacucuggaggcaugag

SEQ ID NO: 950336 - RNA, 22 nt, Human
ugggcacuggaagccugcugug

SEQ ID NO: 950337 - RNA, 22 nt, Human
ugaaaucuuauacuuugguagu

SEQ ID NO: 950338 - RNA, 22 nt, Human
cgucuuccucuuacgaugcgcu

SEQ ID NO: 950339 - RNA, 20 nt, Human
cuuggccuacuuagcuuugu

SEQ ID NO: 950340 - RNA, 22 nt, Human
cccaggagaauauuuuuggguc

SEQ ID NO: 950341 - RNA, 22 nt, Human
uggcucagaacuacuucuaguu

SEQ ID NO: 950342 - RNA, 18 nt, Human
acaaauguagugucuuaa

SEQ ID NO: 950343 - RNA, 22 nt, Human
auucacaacaaaaggauaugag

SEQ ID NO: 950344 - RNA, 22 nt, Human
uuagaaaauuugcuucuuugga

SEQ ID NO: 950345 - RNA, 22 nt, Human
aggaccaguaugagagcaucug

SEQ ID NO: 950346 - RNA, 22 nt, Human
caggccagugugcuucccaggc

SEQ ID NO: 950347 - RNA, 22 nt, Human
uuccuaauggcaaaacauguuu

SEQ ID NO: 950348 - RNA, 22 nt, Human
agcuuccugaugcaagagggcu

SEQ ID NO: 950349 - RNA, 22 nt, Human
gcagaggcauuucugacgcugc

SEQ ID NO: 950350 - RNA, 21 nt, Human
ugggcacugagggugcugcuc

SEQ ID NO: 950351 - RNA, 22 nt, Human
cuuccucacggugcaacaggaa

SEQ ID NO: 950352 - RNA, 22 nt, Human
auugacaaucuacuauguucug

SEQ ID NO: 950353 - RNA, 22 nt, Human
ucuccuggccuuuagguuaagg

SEQ ID NO: 950354 - RNA, 18 nt, Human
gugagcagagagcaucac

SEQ ID NO: 950355 - RNA, 22 nt, Human
aaacacauuuuaggaaaaucua

SEQ ID NO: 950356 - RNA, 22 nt, Human
uggggcuggcuauugucucccu

SEQ ID NO: 950357 - RNA, 22 nt, Human
aggcucuguuugcugugguacc

SEQ ID NO: 950358 - RNA, 22 nt, Human
guuucuaaauguucugaguuuu

SEQ ID NO: 950359 - RNA, 22 nt, Human
gagccaaggguugccauggaga

SEQ ID NO: 950360 - RNA, 19 nt, Human
cuucuggcccugagccacc

SEQ ID NO: 950361 - RNA, 22 nt, Human
uggaggaaguugcuggaaguca

SEQ ID NO: 950362 - RNA, 17 nt, Human
ucugggcuucagugguc

SEQ ID NO: 950363 - RNA, 22 nt, Human
gccagguggucuggcuccagag

SEQ ID NO: 950364 - RNA, 22 nt, Human
uuuaucuuuggaucuucagaaa

SEQ ID NO: 950365 - RNA, 17 nt, Human
agugaaauuuacauugc

SEQ ID NO: 950366 - RNA, 22 nt, Human
cagggucuuggcgccaucaccc

SEQ ID NO: 950367 - RNA, 22 nt, Human
cucaaguaagaaacagaauugg

SEQ ID NO: 950368 - RNA, 22 nt, Human
acuuagaacaggcagaauucca

SEQ ID NO: 950369 - RNA, 22 nt, Human
ucugccuugagguccucagcuc

SEQ ID NO: 950370 - RNA, 22 nt, Human
cccaggcagagagcuggugagc

SEQ ID NO: 950371 - RNA, 22 nt, Human
ccugcagacacuuguccagcaa

SEQ ID NO: 950372 - RNA, 22 nt, Human
cccucagcuucucccugcagcu

SEQ ID NO: 950373 - RNA, 22 nt, Human
uaaaucucacuggguauauugg

SEQ ID NO: 950374 - RNA, 22 nt, Human
caauagaaaacucaauacuuaa

SEQ ID NO: 950375 - RNA, 22 nt, Human
ccaggcugccgaggaaagaaag

SEQ ID NO: 950376 - RNA, 22 nt, Human
uuggccaagggaucgagguugg

SEQ ID NO: 950377 - RNA, 22 nt, Human
gcaggaaagguugagacuuugc

SEQ ID NO: 950378 - RNA, 22 nt, Human
uuguacacaauucuuaacauac

SEQ ID NO: 950379 - RNA, 20 nt, Human
ugugaaagcaguagaaugac

SEQ ID NO: 950380 - RNA, 22 nt, Human
acccaggagguggaggcugcag

SEQ ID NO: 950381 - RNA, 22 nt, Human
uuggcagugaugcagcuuguuc

SEQ ID NO: 950382 - RNA, 22 nt, Human
aggcucugugauccacaaugag

SEQ ID NO: 950383 - RNA, 22 nt, Human
gagaggcuaugagguucugugu

SEQ ID NO: 950384 - RNA, 22 nt, Human
agaaaugggccuugggacacaa

SEQ ID NO: 950385 - RNA, 22 nt, Human
uaugcauaugaccccaagcuug

SEQ ID NO: 950386 - RNA, 22 nt, Human
augcccugugguucaugugaga

SEQ ID NO: 950387 - RNA, 22 nt, Human
cccugagcccauaguugacauu

SEQ ID NO: 950388 - RNA, 22 nt, Human
caggagcccguugcuccggcgg

SEQ ID NO: 950389 - RNA, 22 nt, Human
ugcagugggccggaggccaggg

SEQ ID NO: 950390 - RNA, 21 nt, Human
aggaggggucuuucccacuga

SEQ ID NO: 950391 - RNA, 22 nt, Human
cucaggagaugacagaagguau

SEQ ID NO: 950392 - RNA, 22 nt, Human
caauguguguguuuuucucaac

SEQ ID NO: 950393 - RNA, 22 nt, Human
uaaaugauaauaaugcuagugu

SEQ ID NO: 950394 - RNA, 22 nt, Human
ucauugcacuccagccugggca

SEQ ID NO: 950395 - RNA, 22 nt, Human
uuccauauguauauagcuguua

SEQ ID NO: 950396 - RNA, 22 nt, Human
caggcugucugaauggaggccc

SEQ ID NO: 950397 - RNA, 22 nt, Human
ggguacuuaauauuuacggggu

SEQ ID NO: 950398 - RNA, 22 nt, Human
uugcauugaaaauauauuuuaa

SEQ ID NO: 950399 - RNA, 22 nt, Human
cagaguguuagcgcugguuggg

SEQ ID NO: 950400 - RNA, 22 nt, Human
ucaccagucuuucuuaccauug

SEQ ID NO: 950401 - RNA, 22 nt, Human
agcccaaggcuucccugcuggc

SEQ ID NO: 950402 - RNA, 22 nt, Human
ucccaggacuuccaguuggagg

SEQ ID NO: 950403 - RNA, 22 nt, Human
caguuucuauggcugggcucug

SEQ ID NO: 950404 - RNA, 22 nt, Human
acagcagagacacucaggaggc

SEQ ID NO: 950405 - RNA, 22 nt, Human
acagaguacauucagagacuau

SEQ ID NO: 950406 - RNA, 22 nt, Human
gccucugcaucuucgccgcacu

SEQ ID NO: 950407 - RNA, 22 nt, Human
uuugggaacucuaucauggaaa

SEQ ID NO: 950408 - RNA, 22 nt, Human
gaggccugaaaggggaccuaug

SEQ ID NO: 950409 - RNA, 22 nt, Human
uaauuuaauccaaguguuacau

SEQ ID NO: 950410 - RNA, 18 nt, Human
gcuccuggaccaggucac

SEQ ID NO: 950411 - RNA, 22 nt, Human
ugcagggcacacgcacgggugu

SEQ ID NO: 950412 - RNA, 22 nt, Human
uagaaaauagggccuguggagc

SEQ ID NO: 950413 - RNA, 22 nt, Human
cccagcucucucaguucugcuu

SEQ ID NO: 950414 - RNA, 22 nt, Human
gucucagaguccuacuuauucc

SEQ ID NO: 950415 - RNA, 22 nt, Human
auaaggcaagcugucaguuugu

SEQ ID NO: 950416 - RNA, 18 nt, Human
agagcagcggcaucacac

SEQ ID NO: 950417 - RNA, 18 nt, Human
uggcagcaggaagccauu

SEQ ID NO: 950418 - RNA, 22 nt, Human
accuuaaaacugacacauggag

SEQ ID NO: 950419 - RNA, 22 nt, Human
ccucuggucccagcucugcugc

SEQ ID NO: 950420 - RNA, 20 nt, Human
ggcugcugugggcagagagg

SEQ ID NO: 950421 - RNA, 22 nt, Human
cccuggguucuggcugggcugc

SEQ ID NO: 950422 - RNA, 22 nt, Human
augcuguguauuuuacucuuuc

SEQ ID NO: 950423 - RNA, 22 nt, Human
cagggcagagccaggauuucaa

SEQ ID NO: 950424 - RNA, 22 nt, Human
ugggggucaggaugaggccuug

SEQ ID NO: 950425 - RNA, 22 nt, Human
gcagaggcacagccccagauga

SEQ ID NO: 950426 - RNA, 22 nt, Human
ccagcagcccacaggcgucccu

SEQ ID NO: 950427 - RNA, 19 nt, Human
ugaggggcucacagucuca

SEQ ID NO: 950428 - RNA, 22 nt, Human
ggggacugccuuccacagacac

SEQ ID NO: 950429 - RNA, 22 nt, Human
agcagcuggguccggcggagca

SEQ ID NO: 950430 - RNA, 22 nt, Human
ugaggcagguaagcaaguuuug

SEQ ID NO: 950431 - RNA, 22 nt, Human
uggcagggccugaaucuuauac

SEQ ID NO: 950432 - RNA, 22 nt, Human
cucccuggcuuuguccugaggc

SEQ ID NO: 950433 - RNA, 22 nt, Human
agccccacacucucucugagaa

SEQ ID NO: 950434 - RNA, 22 nt, Human
gucaggaugacaagugcuuuca

SEQ ID NO: 950435 - RNA, 22 nt, Human
gggcacuggaaggcucucaggc

SEQ ID NO: 950436 - RNA, 17 nt, Human
aaggccauuuccaccca

SEQ ID NO: 950437 - RNA, 22 nt, Human
gcugccugcacagagcugcuuu

SEQ ID NO: 950438 - RNA, 22 nt, Human
cuggcucccagcuuucagggag

SEQ ID NO: 950439 - RNA, 22 nt, Human
uuuuaucugugacaucuggcag

SEQ ID NO: 950440 - RNA, 22 nt, Human
gcagggcucauucuaguacaau

SEQ ID NO: 950441 - RNA, 22 nt, Human
uuauuauagauuaugcaagauu

SEQ ID NO: 950442 - RNA, 22 nt, Human
ccaggcaggcagcguucucagg

SEQ ID NO: 950443 - RNA, 22 nt, Human
cacagcuuaugccacugauugg

SEQ ID NO: 950444 - RNA, 22 nt, Human
cugggcagccucacacaauguu

SEQ ID NO: 950445 - RNA, 22 nt, Human
cacaaaugguuguagacauuaa

SEQ ID NO: 950446 - RNA, 22 nt, Human
ucauuguuauguuuugcugucu

SEQ ID NO: 950447 - RNA, 20 nt, Human
augcaaacccugcuuugugg

SEQ ID NO: 950448 - RNA, 22 nt, Human
uaugucacauuguaacagugug

SEQ ID NO: 950449 - RNA, 22 nt, Human
aggcucauucuugccucugagc

SEQ ID NO: 950450 - RNA, 22 nt, Human
gcagccaggaaagcuggacccu

SEQ ID NO: 950451 - RNA, 22 nt, Human
ucucugaguauccugaacugcc

SEQ ID NO: 950452 - RNA, 22 nt, Human
gauuucuaguucauuaucuauu

SEQ ID NO: 950453 - RNA, 19 nt, Human
gccugggaugggcagaacu

SEQ ID NO: 950454 - RNA, 22 nt, Human
gagagaagaaagccaugguccu

SEQ ID NO: 950455 - RNA, 22 nt, Human
cugccuccuggcugauggguag

SEQ ID NO: 950456 - RNA, 22 nt, Human
ugcuguagcccugcacagugca

SEQ ID NO: 950457 - RNA, 22 nt, Human
ucaggcugugggcacuggccau

SEQ ID NO: 950458 - RNA, 22 nt, Human
gugauuuugagaccuauauagu

SEQ ID NO: 950459 - RNA, 22 nt, Human
acuuccugcagcuucucagccc

SEQ ID NO: 950460 - RNA, 22 nt, Human
aagaacaguguccugggacucg

SEQ ID NO: 950461 - RNA, 22 nt, Human
aguggggcggacaggaccagga

SEQ ID NO: 950462 - RNA, 22 nt, Human
uagucuuuuuaauaaauaaugc

SEQ ID NO: 950463 - RNA, 23 nt, Human
gagugcagaauagacaugcagug

SEQ ID NO: 950464 - RNA, 22 nt, Human
aaggccugggaguacugggaca

SEQ ID NO: 950465 - RNA, 22 nt, Human
uucauucauuacgugccaggca

SEQ ID NO: 950466 - RNA, 22 nt, Human
augauggugggagaugacccag

SEQ ID NO: 950467 - RNA, 22 nt, Human
aaaguucaugguguuauagaaa

SEQ ID NO: 950468 - RNA, 22 nt, Human
auaacagauacucucugugagg

SEQ ID NO: 950469 - RNA, 22 nt, Human
cucuucagauaaaagggauauu

SEQ ID NO: 950470 - RNA, 23 nt, Human
ucugcucugaaguucggcugagc

SEQ ID NO: 950471 - RNA, 18 nt, Human
cucucugggugaggacaa

SEQ ID NO: 950472 - RNA, 22 nt, Human
aauuucaaugcacucaugguug

SEQ ID NO: 950473 - RNA, 22 nt, Human
agggcugggcugcuuguuguca

SEQ ID NO: 950474 - RNA, 22 nt, Human
uggccuccccuaacagccucuu

SEQ ID NO: 950475 - RNA, 22 nt, Human
uaguuucagcuccuucauccug

SEQ ID NO: 950476 - RNA, 22 nt, Human
caggauggucucgaucuccuga

SEQ ID NO: 950477 - RNA, 22 nt, Human
uggcagacuuuagggucuacau

SEQ ID NO: 950478 - RNA, 22 nt, Human
gaggccaggacaugaaagcuga

SEQ ID NO: 950479 - RNA, 22 nt, Human
agcagcagauccaaaaaaugug

SEQ ID NO: 950480 - RNA, 20 nt, Human
ggcagcuugggcagcaguua

SEQ ID NO: 950481 - RNA, 22 nt, Human
aggagcugacuuguaaagcauu

SEQ ID NO: 950482 - RNA, 22 nt, Human
ugacccauggucugaucauagg

SEQ ID NO: 950483 - RNA, 22 nt, Human
uuucacaaugcaauccuacuuc

SEQ ID NO: 950484 - RNA, 22 nt, Human
uuuacauuucccucugucaguu

SEQ ID NO: 950485 - RNA, 23 nt, Human
uuucaaauuacucugcagaugac

SEQ ID NO: 950486 - RNA, 22 nt, Human
ugacagggugauuaugagagcu

SEQ ID NO: 950487 - RNA, 22 nt, Human
guacacauugucuguuuacuuc

SEQ ID NO: 950488 - RNA, 22 nt, Human
agcagagucugugugcacuuua

SEQ ID NO: 950489 - RNA, 22 nt, Human
aagaaauuaaugugccauuacu

SEQ ID NO: 950490 - RNA, 22 nt, Human
agccaggggauucaucagggac

SEQ ID NO: 950491 - RNA, 22 nt, Human
uuucucaucuggaaacagugcu

SEQ ID NO: 950492 - RNA, 22 nt, Human
auacauacauguacacauaaau

SEQ ID NO: 950493 - RNA, 22 nt, Human
aggcacuucucaaauucaugcc

SEQ ID NO: 950494 - RNA, 20 nt, Human
ccuggcuuugcaucugugau

SEQ ID NO: 950495 - RNA, 22 nt, Human
ucccccacucuaaaggagccuu

SEQ ID NO: 950496 - RNA, 22 nt, Human
agauggaguuaguaccagaguc

SEQ ID NO: 950497 - RNA, 22 nt, Human
cagucucucuuguagugcagcu

SEQ ID NO: 950498 - RNA, 22 nt, Human
cucugcaggggaggcaugcacu

SEQ ID NO: 950499 - RNA, 22 nt, Human
gauuucuguaacacuucagaua

SEQ ID NO: 950500 - RNA, 22 nt, Human
ggcucuggugugaagcagccuc

SEQ ID NO: 950501 - RNA, 22 nt, Human
gucaucuuugcccugugcagga

SEQ ID NO: 950502 - RNA, 22 nt, Human
uggccgggccgggcgccuccac

SEQ ID NO: 950503 - RNA, 18 nt, Human
acuaugcugaauaaaugg

SEQ ID NO: 950504 - RNA, 22 nt, Human
aaauguguuugauaggaauauu

SEQ ID NO: 950505 - RNA, 22 nt, Human
auuugucuagugguauucacgu

SEQ ID NO: 950506 - RNA, 22 nt, Human
gaaaggagggaaacagagcggu

SEQ ID NO: 950507 - RNA, 22 nt, Human
uaaagguaguuuuaaaggugcu

SEQ ID NO: 950508 - RNA, 22 nt, Human
acucacauuucaucaggccaag

SEQ ID NO: 950509 - RNA, 22 nt, Human
cuggccuggggccucagcugcu

SEQ ID NO: 950510 - RNA, 22 nt, Human
cucuccuccaacagcccugccg

SEQ ID NO: 950511 - RNA, 22 nt, Human
agagagggcauagaaaaaggga

SEQ ID NO: 950512 - RNA, 22 nt, Human
ggcccaaggcccaggucgagcu

SEQ ID NO: 950513 - RNA, 22 nt, Human
aggauuuuagauaagacagcaa

SEQ ID NO: 950514 - RNA, 22 nt, Human
gcacccagccagcaucucagag

SEQ ID NO: 950515 - RNA, 22 nt, Human
uggucaguugcaucagagaagu

SEQ ID NO: 950516 - RNA, 22 nt, Human
ggucuugcuauguugcccaggc

SEQ ID NO: 950517 - RNA, 22 nt, Human
cccuguccuuggcugugaggcu

SEQ ID NO: 950518 - RNA, 22 nt, Human
uucucugaucuugcuagacuga

SEQ ID NO: 950519 - RNA, 22 nt, Human
gccuggcacauugcaguggauu

SEQ ID NO: 950520 - RNA, 22 nt, Human
ccagaggucuccugcacgggau

SEQ ID NO: 950521 - RNA, 22 nt, Human
cccuucagcugagugggacagc

SEQ ID NO: 950522 - RNA, 22 nt, Human
aguggcagagcaggugcuggaa

SEQ ID NO: 950523 - RNA, 22 nt, Human
aucaaaaugcuccagugauggu

SEQ ID NO: 950524 - RNA, 22 nt, Human
gcuccucuucucccacugaaug

SEQ ID NO: 950525 - RNA, 22 nt, Human
ccaggaaaauaccaagcuuuaa

SEQ ID NO: 950526 - RNA, 22 nt, Human
ggaggaggggugacugaaugcu

SEQ ID NO: 950527 - RNA, 22 nt, Human
aggucauuaaaguuaaaugagg

SEQ ID NO: 950528 - RNA, 22 nt, Human
caaaugauacuguuuuuagucu

SEQ ID NO: 950529 - RNA, 22 nt, Human
acaucugaggagaccagccucu

SEQ ID NO: 950530 - RNA, 22 nt, Human
gaggcccaguccugcaagcacg

SEQ ID NO: 950531 - RNA, 22 nt, Human
caggugccgggaaugcagcaau

SEQ ID NO: 950532 - RNA, 22 nt, Human
ccaggcugcucacaagcugccc

SEQ ID NO: 950533 - RNA, 22 nt, Human
gccaggcuggaaagaacagaca

SEQ ID NO: 950534 - RNA, 17 nt, Human
ggcugcugugcuggugc

SEQ ID NO: 950535 - RNA, 22 nt, Human
aaagccuugcccgucacuggga

SEQ ID NO: 950536 - RNA, 20 nt, Human
uugauaggcagcuugucagg

SEQ ID NO: 950537 - RNA, 22 nt, Human
ccagccaggcuggcuguggagg

SEQ ID NO: 950538 - RNA, 22 nt, Human
cugagguggaacagaggugaag

SEQ ID NO: 950539 - RNA, 22 nt, Human
cuggagcuaggaaguccaagau

SEQ ID NO: 950540 - RNA, 22 nt, Human
agucccagaugacccagcuacu

SEQ ID NO: 950541 - RNA, 22 nt, Human
uugugucugggggagugacauc

SEQ ID NO: 950542 - RNA, 20 nt, Human
guucucacugaucugcaggg

SEQ ID NO: 950543 - RNA, 22 nt, Human
uggaaauggaucugaugagucu

SEQ ID NO: 950544 - RNA, 22 nt, Human
gccauccucugagcacuaggca

SEQ ID NO: 950545 - RNA, 21 nt, Human
ugaaaugagaaugcugagcac

SEQ ID NO: 950546 - RNA, 22 nt, Human
ugaaggcuguuggauggggaag

SEQ ID NO: 950547 - RNA, 21 nt, Human
aaugugugcuauuuaucuuuu

SEQ ID NO: 950548 - RNA, 22 nt, Human
gcuggcaucacuggcuucggug

SEQ ID NO: 950549 - RNA, 22 nt, Human
gggagagguuacccgagcaacu

SEQ ID NO: 950550 - RNA, 18 nt, Human
agcagagcccaugcauuc

SEQ ID NO: 950551 - RNA, 21 nt, Human
uucagcaagcacucuggacac

SEQ ID NO: 950552 - RNA, 22 nt, Human
cagugggcugugauggauucac

SEQ ID NO: 950553 - RNA, 22 nt, Human
auguguguauauauagucauuu

SEQ ID NO: 950554 - RNA, 22 nt, Human
cugccacuuucacccagugcuc

SEQ ID NO: 950555 - RNA, 22 nt, Human
auuugcuugugcuaugaaaguu

SEQ ID NO: 950556 - RNA, 22 nt, Human
cuguuuauagcagagcaagccu

SEQ ID NO: 950557 - RNA, 21 nt, Human
uggcaggcagcuggaagcuug

SEQ ID NO: 950558 - RNA, 22 nt, Human
agccagugcaacagcagugaag

SEQ ID NO: 950559 - RNA, 22 nt, Human
aaauccuaaggagaauaugauu

SEQ ID NO: 950560 - RNA, 22 nt, Human
uuucuguaaggacuuaaugcaa

SEQ ID NO: 950561 - RNA, 21 nt, Human
gcacagggacagaucaucaca

SEQ ID NO: 950562 - RNA, 22 nt, Human
cacauguacagaagcaggcugg

SEQ ID NO: 950563 - RNA, 21 nt, Human
agggaaagaaaaugagcuaau

SEQ ID NO: 950564 - RNA, 17 nt, Human
uucucugagcuguauug

SEQ ID NO: 950565 - RNA, 22 nt, Human
caaggccauaagagauacaaaa

SEQ ID NO: 950566 - RNA, 22 nt, Human
ucucucagaggaagaggcagug

SEQ ID NO: 950567 - RNA, 22 nt, Human
uguauuagaucugagaacuucu

SEQ ID NO: 950568 - RNA, 22 nt, Human
aaaacauugaauugcacacuau

SEQ ID NO: 950569 - RNA, 22 nt, Human
acucaggaaauugagauaaugg

SEQ ID NO: 950570 - RNA, 22 nt, Human
ugcuggguagaaguauuagucu

SEQ ID NO: 950571 - RNA, 23 nt, Human
uuacuuuugcaccaaccuaauau

SEQ ID NO: 950572 - RNA, 22 nt, Human
cugugcaguaggucagggcugg

SEQ ID NO: 950573 - RNA, 22 nt, Human
ccagaccacccuggccaugcac

SEQ ID NO: 950574 - RNA, 22 nt, Human
cucugaagggagggccaagccc

SEQ ID NO: 950575 - RNA, 20 nt, Human
ggggcccaagcccucuugcc

SEQ ID NO: 950576 - RNA, 22 nt, Human
acacaggaagucagcacugaug

SEQ ID NO: 950577 - RNA, 22 nt, Human
gggcaugguggcaggcaccugu

SEQ ID NO: 950578 - RNA, 22 nt, Human
agugucauuccagggacccucg

SEQ ID NO: 950579 - RNA, 22 nt, Human
ccuggagcccaaggcagugaga

SEQ ID NO: 950580 - RNA, 22 nt, Human
agccagagcugaugucauucuc

SEQ ID NO: 950581 - RNA, 22 nt, Human
augcugugucaggaauuugaua

SEQ ID NO: 950582 - RNA, 20 nt, Human
acauggaaggucaaacuauc

SEQ ID NO: 950583 - RNA, 22 nt, Human
ugcauguguguguauuuauaaa

SEQ ID NO: 950584 - RNA, 22 nt, Human
ggcagaggaagcuggaaguggg

SEQ ID NO: 950585 - RNA, 22 nt, Human
uggcagcugagugcacccccuc

SEQ ID NO: 950586 - RNA, 22 nt, Human
gcuguguccucacacagccuuu

SEQ ID NO: 950587 - RNA, 22 nt, Human
auucacaauagcagcuugcaug

SEQ ID NO: 950588 - RNA, 22 nt, Human
caagagcuagaaauugguuaga

SEQ ID NO: 950589 - RNA, 19 nt, Human
acauuuaaauucagaucuc

SEQ ID NO: 950590 - RNA, 22 nt, Human
cucuuaaaauuaccuuugcaaa

SEQ ID NO: 950591 - RNA, 22 nt, Human
aaaugaacaguugcauucucug

SEQ ID NO: 950592 - RNA, 22 nt, Human
gucuggaggaggaagaaggcac

SEQ ID NO: 950593 - RNA, 22 nt, Human
gagccuucaucgcagccuuguu

SEQ ID NO: 950594 - RNA, 22 nt, Human
aggucauuccuugucuucuugc

SEQ ID NO: 950595 - RNA, 22 nt, Human
agcugaaggcuagaacagcugg

SEQ ID NO: 950596 - RNA, 22 nt, Human
uuuuuccuagugcuuucuggua

SEQ ID NO: 950597 - RNA, 22 nt, Human
gcagauggaaagugcuugaggg

SEQ ID NO: 950598 - RNA, 22 nt, Human
gccuguccacuaaacagccaag

SEQ ID NO: 950599 - RNA, 22 nt, Human
uucagcaacauuuguugagugc

SEQ ID NO: 950600 - RNA, 22 nt, Human
uaacagaaaggggacagaaaua

SEQ ID NO: 950601 - RNA, 22 nt, Human
ucuuugcacugugcaagcagaa

SEQ ID NO: 950602 - RNA, 22 nt, Human
aggcugggaaauguauuccagc

SEQ ID NO: 950603 - RNA, 19 nt, Human
gggaaauucacuugcuucc

SEQ ID NO: 950604 - RNA, 22 nt, Human
ccaggcucaggugcgagagaca

SEQ ID NO: 950605 - RNA, 22 nt, Human
gcaccuggcugcccagguggag

SEQ ID NO: 950606 - RNA, 22 nt, Human
ggagagcaggguccugagauac

SEQ ID NO: 950607 - RNA, 22 nt, Human
gcagaagcccggucagcgcacg

SEQ ID NO: 950608 - RNA, 20 nt, Human
cucugcuuuaggagagucag

SEQ ID NO: 950609 - RNA, 22 nt, Human
ugccaaucuuugugauaauugc

SEQ ID NO: 950610 - RNA, 22 nt, Human
agaggggaggcgaaccagaguc

SEQ ID NO: 950611 - RNA, 22 nt, Human
cccuggagcaucucugcugucu

SEQ ID NO: 950612 - RNA, 22 nt, Human
cuggccugaucucaugcugucc

SEQ ID NO: 950613 - RNA, 22 nt, Human
uggcagagaaccugggcuuugu

SEQ ID NO: 950614 - RNA, 22 nt, Human
uggugagcucuggcagucugug

SEQ ID NO: 950615 - RNA, 22 nt, Human
cagcaggggaacugugggccag

SEQ ID NO: 950616 - RNA, 22 nt, Human
gggcucucaugaguguguggua

SEQ ID NO: 950617 - RNA, 22 nt, Human
uccacagaauguaagauccaca

SEQ ID NO: 950618 - RNA, 22 nt, Human
uccucagggaagaugagccuca

SEQ ID NO: 950619 - RNA, 22 nt, Human
acagagaaagugggcugaagau

SEQ ID NO: 950620 - RNA, 22 nt, Human
ucauaacagcuaagucccuuuc

SEQ ID NO: 950621 - RNA, 22 nt, Human
ucagggcaucaucaugaauaua

SEQ ID NO: 950622 - RNA, 22 nt, Human
aaguuuguucagggcuuacauu

SEQ ID NO: 950623 - RNA, 20 nt, Human
ugacucugcaaccgucucuc

SEQ ID NO: 950624 - RNA, 21 nt, Human
ugcuggccucaagggugacuu

SEQ ID NO: 950625 - RNA, 22 nt, Human
aagcagcagaccugauuuugaa

SEQ ID NO: 950626 - RNA, 22 nt, Human
gauggcagcauauugacagcau

SEQ ID NO: 950627 - RNA, 22 nt, Human
gaaggagcuaaagggagcccug

SEQ ID NO: 950628 - RNA, 22 nt, Human
ucugaacuccagcccugcucuc

SEQ ID NO: 950629 - RNA, 21 nt, Human
gggcagcucuguuuuauuuuc

SEQ ID NO: 950630 - RNA, 22 nt, Human
auuuuucucucacacuuaccag

SEQ ID NO: 950631 - RNA, 20 nt, Human
cacaggccuugugagcagac

SEQ ID NO: 950632 - RNA, 22 nt, Human
cucugagagcggucuguggcuu

SEQ ID NO: 950633 - RNA, 20 nt, Human
uugcauuggaugugcaggug

SEQ ID NO: 950634 - RNA, 22 nt, Human
uuaggcauauggcacaugauag

SEQ ID NO: 950635 - RNA, 22 nt, Human
cuugcuucauuagugucuuagu

SEQ ID NO: 950636 - RNA, 22 nt, Human
cuggccuggcagggagggcaug

SEQ ID NO: 950637 - RNA, 22 nt, Human
cggcagcugauugcagagcacc

SEQ ID NO: 950638 - RNA, 22 nt, Human
gcucugagcacugugcggcugg

SEQ ID NO: 950639 - RNA, 22 nt, Human
agucauaauuauaaacaucagu

SEQ ID NO: 950640 - RNA, 22 nt, Human
uuguccuuggaugaagcuggga

SEQ ID NO: 950641 - RNA, 22 nt, Human
ggagagaauuccauggacaugu

SEQ ID NO: 950642 - RNA, 23 nt, Human
aggcugcagaagaauagggucau

SEQ ID NO: 950643 - RNA, 22 nt, Human
uuuaacagaugcuaugucuacc

SEQ ID NO: 950644 - RNA, 22 nt, Human
gaggccuggucuaugagauguu

SEQ ID NO: 950645 - RNA, 18 nt, Human
gggcccuggcguccgccc

SEQ ID NO: 950646 - RNA, 22 nt, Human
ucacuuuugaucccuaugcagu

SEQ ID NO: 950647 - RNA, 22 nt, Human
ucucccacgguacaggauaaac

SEQ ID NO: 950648 - RNA, 19 nt, Human
cucagcuguagcucaugug

SEQ ID NO: 950649 - RNA, 22 nt, Human
ggccucucauguccugggcuuc

SEQ ID NO: 950650 - RNA, 22 nt, Human
ugcaauaacuacuuuaauguug

SEQ ID NO: 950651 - RNA, 22 nt, Human
aggucauuacaauuaucauuuu

SEQ ID NO: 950652 - RNA, 22 nt, Human
gauacauuuuaucuccuaacag

SEQ ID NO: 950653 - RNA, 22 nt, Human
uagauuucaggcuggcuugcgg

SEQ ID NO: 950654 - RNA, 22 nt, Human
aguguuguaugggaugacugcu

SEQ ID NO: 950655 - RNA, 22 nt, Human
agcaauauuucagcuagcaggu

SEQ ID NO: 950656 - RNA, 22 nt, Human
ugccugucuuuccucccucgua

SEQ ID NO: 950657 - RNA, 22 nt, Human
gugcagcugcaggagucagguc

SEQ ID NO: 950658 - RNA, 22 nt, Human
gucaggauuugaacucaggucu

SEQ ID NO: 950659 - RNA, 22 nt, Human
ggggcggggcucugagaagcau

SEQ ID NO: 950660 - RNA, 22 nt, Human
aagauuucucuccuggaaagca

SEQ ID NO: 950661 - RNA, 22 nt, Human
cagcugcaguucaaugcuugcu

SEQ ID NO: 950662 - RNA, 23 nt, Human
ugacacauuuccuuuccacugca

SEQ ID NO: 950663 - RNA, 22 nt, Human
uucuuuuacauuaagauuucag

SEQ ID NO: 950664 - RNA, 22 nt, Human
gugugccaggaacuggcugcug

SEQ ID NO: 950665 - RNA, 22 nt, Human
auggccaagaauauuucucaac

SEQ ID NO: 950666 - RNA, 22 nt, Human
ggcuggccucaggguccucgcu

SEQ ID NO: 950667 - RNA, 22 nt, Human
ugggaggagcccucugggaagg

SEQ ID NO: 950668 - RNA, 22 nt, Human
cugagagcagggacuugagcca

SEQ ID NO: 950669 - RNA, 22 nt, Human
cuguaauucacuagggucagcg

SEQ ID NO: 950670 - RNA, 22 nt, Human
uuccagugaugggcaauuuggu

SEQ ID NO: 950671 - RNA, 22 nt, Human
ggcagugacuguucagacgucc

SEQ ID NO: 950672 - RNA, 22 nt, Human
aggcagauuacuugaggccagg

SEQ ID NO: 950673 - RNA, 22 nt, Human
gcauugucaaaagugguaugac

SEQ ID NO: 950674 - RNA, 22 nt, Human
acugugugacuguuauuacugu

SEQ ID NO: 950675 - RNA, 22 nt, Human
agggcagcuagcuguagaaaga

SEQ ID NO: 950676 - RNA, 22 nt, Human
ucagggaacuacuucucccuau

SEQ ID NO: 950677 - RNA, 22 nt, Human
augagacuaccuguaauguggc

SEQ ID NO: 950678 - RNA, 22 nt, Human
agcugagcugcagaugacugua
